United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 5

SEQ ID NO: 174000 - RNA, 22 nt, Human
aucugaagaggucauggcugac

SEQ ID NO: 174001 - RNA, 22 nt, Human
ccuggaggcagaaauaggacuu

SEQ ID NO: 174002 - RNA, 22 nt, Human
aggauuuacuagcaaggauucu

SEQ ID NO: 174003 - RNA, 22 nt, Human
ucagagaguuggaaagaauuaa

SEQ ID NO: 174004 - RNA, 22 nt, Human
uguuugaacugaauaacauagu

SEQ ID NO: 174005 - RNA, 22 nt, Human
gcagcuuuuuggaugucaguua

SEQ ID NO: 174006 - RNA, 22 nt, Human
ggcaggcauggccacucccuag

SEQ ID NO: 174007 - RNA, 20 nt, Human
auuugcaucugaauaacuua

SEQ ID NO: 174008 - RNA, 22 nt, Human
uucuuuucaagaggggcaagga

SEQ ID NO: 174009 - RNA, 22 nt, Human
ugcauacacaugugcacauacg

SEQ ID NO: 174010 - RNA, 20 nt, Human
guaaugaauguaaacaguaa

SEQ ID NO: 174011 - RNA, 22 nt, Human
ccauggcaauggucagucuauu

SEQ ID NO: 174012 - RNA, 22 nt, Human
uauaaauuauuaggcugcuaaa

SEQ ID NO: 174013 - RNA, 21 nt, Human
auuauuauaaagaccacaggg

SEQ ID NO: 174014 - RNA, 20 nt, Human
acuggaucuggcuggagcug

SEQ ID NO: 174015 - RNA, 22 nt, Human
ccuauacaggcuucuuuacaug

SEQ ID NO: 174016 - RNA, 22 nt, Human
uccaugagcuagggauucauca

SEQ ID NO: 174017 - RNA, 22 nt, Human
cccugcagcuuuugcauaguca

SEQ ID NO: 174018 - RNA, 22 nt, Human
uuucugaauaacucuaugauau

SEQ ID NO: 174019 - RNA, 22 nt, Human
aaucuuucccuauuaaaugugg

SEQ ID NO: 174020 - RNA, 18 nt, Human
gacccagcagaugggcuu

SEQ ID NO: 174021 - RNA, 22 nt, Human
gggcaaguccggugcccagagc

SEQ ID NO: 174022 - RNA, 17 nt, Human
cagacaggcugucaccc

SEQ ID NO: 174023 - RNA, 22 nt, Human
acauguguguauacguauuuau

SEQ ID NO: 174024 - RNA, 20 nt, Human
ucagauuuuucuaacuuuga

SEQ ID NO: 174025 - RNA, 22 nt, Human
gccaaaucuggauuuagcaaga

SEQ ID NO: 174026 - RNA, 22 nt, Human
ucccaggcugggggccugaagu

SEQ ID NO: 174027 - RNA, 22 nt, Human
ccuugguuuccaggaugaggcu

SEQ ID NO: 174028 - RNA, 22 nt, Human
gauggcuuugugcaccaugauu

SEQ ID NO: 174029 - RNA, 22 nt, Human
aaggcuuuuguuccuauuuagu

SEQ ID NO: 174030 - RNA, 21 nt, Human
aggauuuacuauuaacugugu

SEQ ID NO: 174031 - RNA, 22 nt, Human
uccuucuuucccccuagucauu

SEQ ID NO: 174032 - RNA, 18 nt, Human
uguaaacacuuucauucu

SEQ ID NO: 174033 - RNA, 22 nt, Human
ugggaccugcccuggccccauc

SEQ ID NO: 174034 - RNA, 22 nt, Human
uaagaaacaugauacuuuuccu

SEQ ID NO: 174035 - RNA, 22 nt, Human
caguccuuagucuggauggcuu

SEQ ID NO: 174036 - RNA, 19 nt, Human
aacuguaauuaauacccua

SEQ ID NO: 174037 - RNA, 22 nt, Human
ccaugcacaccagcaggcagac

SEQ ID NO: 174038 - RNA, 16 nt, Human
ucuuaguuguguggua

SEQ ID NO: 174039 - RNA, 17 nt, Human
ggcuggaggggacccgg

SEQ ID NO: 174040 - RNA, 22 nt, Human
gaauuguauugauuuuucagag

SEQ ID NO: 174041 - RNA, 22 nt, Human
uacacaugaucauuuaguagca

SEQ ID NO: 174042 - RNA, 22 nt, Human
uucauacaguggcugcacucca

SEQ ID NO: 174043 - RNA, 22 nt, Human
uuuacauugcauuagguauuau

SEQ ID NO: 174044 - RNA, 22 nt, Human
uuagaaaucaccucugaagauc

SEQ ID NO: 174045 - RNA, 22 nt, Human
acaacaaaaucacuagucuucc

SEQ ID NO: 174046 - RNA, 22 nt, Human
auuuugaugcuaucuaaugaau

SEQ ID NO: 174047 - RNA, 22 nt, Human
gcacaauuauuuaugcaguaug

SEQ ID NO: 174048 - RNA, 22 nt, Human
cucuucuugaaagaggaauuca

SEQ ID NO: 174049 - RNA, 22 nt, Human
ucugcagguaagcguucuugga

SEQ ID NO: 174050 - RNA, 22 nt, Human
gacaguccuugcccaguaucua

SEQ ID NO: 174051 - RNA, 22 nt, Human
guuuuauaugucucugcugaca

SEQ ID NO: 174052 - RNA, 22 nt, Human
cuccagugagugagcaggcgac

SEQ ID NO: 174053 - RNA, 22 nt, Human
guuuucuggcaguuauuccuua

SEQ ID NO: 174054 - RNA, 22 nt, Human
gcagggcagagggagaaucucu

SEQ ID NO: 174055 - RNA, 21 nt, Human
agguggggcugcaccucugcu

SEQ ID NO: 174056 - RNA, 22 nt, Human
gcuuggaaguaggauugggaga

SEQ ID NO: 174057 - RNA, 22 nt, Human
uauugcugacugucuucugagu

SEQ ID NO: 174058 - RNA, 22 nt, Human
cuacagaaguuucccuugcuua

SEQ ID NO: 174059 - RNA, 22 nt, Human
acaugugugacaacagagguga

SEQ ID NO: 174060 - RNA, 22 nt, Human
agcugcaaaccaggccggcgcg

SEQ ID NO: 174061 - RNA, 22 nt, Human
gaacaucaugaagaaaacauau

SEQ ID NO: 174062 - RNA, 22 nt, Human
uguccucacaugguggggagag

SEQ ID NO: 174063 - RNA, 22 nt, Human
uacauaauuaaucuuuaaguuc

SEQ ID NO: 174064 - RNA, 22 nt, Human
aguccagucucacucuuggcag

SEQ ID NO: 174065 - RNA, 17 nt, Human
ucuguucaagugagagg

SEQ ID NO: 174066 - RNA, 22 nt, Human
caaguccucgcuucuagcugug

SEQ ID NO: 174067 - RNA, 22 nt, Human
uugcuaauuuaacuaccuuguu

SEQ ID NO: 174068 - RNA, 22 nt, Human
uguuuauugagugccuacuaua

SEQ ID NO: 174069 - RNA, 22 nt, Human
augacaaaagaagacaugaggu

SEQ ID NO: 174070 - RNA, 21 nt, Human
uuccagagauuguuucaccug

SEQ ID NO: 174071 - RNA, 22 nt, Human
acuaucaacaucauugcucuag

SEQ ID NO: 174072 - RNA, 22 nt, Human
gaaggcugcgaggggagugccg

SEQ ID NO: 174073 - RNA, 22 nt, Human
auucugggaacuuugucucuca

SEQ ID NO: 174074 - RNA, 22 nt, Human
auucagagcacuggguagaauu

SEQ ID NO: 174075 - RNA, 22 nt, Human
uaaaauugcggugaauauuucc

SEQ ID NO: 174076 - RNA, 22 nt, Human
cuuaaauucuuaaugcccucau

SEQ ID NO: 174077 - RNA, 22 nt, Human
uaugugucuuuaucuggcucuu

SEQ ID NO: 174078 - RNA, 22 nt, Human
ggagcugaggacacuacauuuu

SEQ ID NO: 174079 - RNA, 22 nt, Human
ugggcagggaucucuuuugcaa

SEQ ID NO: 174080 - RNA, 22 nt, Human
uuugucaucccuuuugaaacug

SEQ ID NO: 174081 - RNA, 22 nt, Human
uaugacaagguggaguaugagu

SEQ ID NO: 174082 - RNA, 22 nt, Human
ugcuuuauaggggauugcaggc

SEQ ID NO: 174083 - RNA, 22 nt, Human
cugugucccacacgagguguau

SEQ ID NO: 174084 - RNA, 22 nt, Human
aaauuucuguuguuuugagcca

SEQ ID NO: 174085 - RNA, 22 nt, Human
auugcuuuagaaagaaaaauau

SEQ ID NO: 174086 - RNA, 22 nt, Human
gggcuggaggagauccagaggc

SEQ ID NO: 174087 - RNA, 22 nt, Human
auaugcaagcacauagaauacu

SEQ ID NO: 174088 - RNA, 22 nt, Human
uaagaaguacaaaaauuuucug

SEQ ID NO: 174089 - RNA, 23 nt, Human
uuauugaggguguagauuggugu

SEQ ID NO: 174090 - RNA, 23 nt, Human
aaggugucauugaugggauucua

SEQ ID NO: 174091 - RNA, 22 nt, Human
acacaaacugcuagaaaauugg

SEQ ID NO: 174092 - RNA, 22 nt, Human
auucuucauuguugauucaugu

SEQ ID NO: 174093 - RNA, 18 nt, Human
uuggaggauguccaugaa

SEQ ID NO: 174094 - RNA, 22 nt, Human
ucuucacagaugcauauacuuc

SEQ ID NO: 174095 - RNA, 21 nt, Human
auuucagagcacacaaguaaa

SEQ ID NO: 174096 - RNA, 22 nt, Human
ucagggcauccauugccuguug

SEQ ID NO: 174097 - RNA, 22 nt, Human
agguauuauuagcaucucuauu

SEQ ID NO: 174098 - RNA, 19 nt, Human
gcugggugaggucguugga

SEQ ID NO: 174099 - RNA, 20 nt, Human
ggcaggugcucgcuuggucu

SEQ ID NO: 174100 - RNA, 21 nt, Human
gcaggugugguaucagcuucc

SEQ ID NO: 174101 - RNA, 17 nt, Human
gugaagagucauugaau

SEQ ID NO: 174102 - RNA, 21 nt, Human
ccuucuccauuacaguaagcu

SEQ ID NO: 174103 - RNA, 22 nt, Human
ccuggaucccgauggcugugag

SEQ ID NO: 174104 - RNA, 22 nt, Human
gcaaagaaaugucagugagagg

SEQ ID NO: 174105 - RNA, 22 nt, Human
cugucucagcaggaagucauca

SEQ ID NO: 174106 - RNA, 22 nt, Human
gguguccugucagcuagaguga

SEQ ID NO: 174107 - RNA, 22 nt, Human
ugcagggcagcuagggagcuuu

SEQ ID NO: 174108 - RNA, 20 nt, Human
uauggcuuggcaaagcuuca

SEQ ID NO: 174109 - RNA, 22 nt, Human
uugcuuuaggauuuaaguggca

SEQ ID NO: 174110 - RNA, 22 nt, Human
uuucuucuugaguaaccagauu

SEQ ID NO: 174111 - RNA, 22 nt, Human
cuacagaagccguggucaggaa

SEQ ID NO: 174112 - RNA, 22 nt, Human
aagguggucuuacugaugguau

SEQ ID NO: 174113 - RNA, 22 nt, Human
cuuuuucuucuaggugugccug

SEQ ID NO: 174114 - RNA, 22 nt, Human
auuagauauuugcuguuggauu

SEQ ID NO: 174115 - RNA, 22 nt, Human
agacagguagcaggacagauau

SEQ ID NO: 174116 - RNA, 22 nt, Human
auauuccauugguuucccuucu

SEQ ID NO: 174117 - RNA, 22 nt, Human
gcagaauuggauaguugugaua

SEQ ID NO: 174118 - RNA, 22 nt, Human
uucuaaaauaaguuuaucuggu

SEQ ID NO: 174119 - RNA, 22 nt, Human
agcagguggccacgaggaggag

SEQ ID NO: 174120 - RNA, 19 nt, Human
uggaggaaguauauuucau

SEQ ID NO: 174121 - RNA, 22 nt, Human
agcauguucaucuucuguuggu

SEQ ID NO: 174122 - RNA, 22 nt, Human
ucaggugggaccugcuaggaca

SEQ ID NO: 174123 - RNA, 22 nt, Human
gacaauacagaaagggacaugc

SEQ ID NO: 174124 - RNA, 22 nt, Human
uggcagggucuugcuguguugc

SEQ ID NO: 174125 - RNA, 22 nt, Human
cagaauuuagcacaauguaugg

SEQ ID NO: 174126 - RNA, 22 nt, Human
ccagcuuuuccucucauugcuu

SEQ ID NO: 174127 - RNA, 22 nt, Human
gauugcuggggcaggcuguagc

SEQ ID NO: 174128 - RNA, 22 nt, Human
caggauggcagagaaaagggug

SEQ ID NO: 174129 - RNA, 22 nt, Human
uuuauccauaucauuaaaaucu

SEQ ID NO: 174130 - RNA, 22 nt, Human
ccaggugggcgugucuucaccu

SEQ ID NO: 174131 - RNA, 22 nt, Human
ucagugauuucuggggugaggg

SEQ ID NO: 174132 - RNA, 22 nt, Human
cacuuuauuauaaauuugagag

SEQ ID NO: 174133 - RNA, 22 nt, Human
uucucuuuucaccaguugcuaa

SEQ ID NO: 174134 - RNA, 22 nt, Human
agggcuccgggcaggcgaugga

SEQ ID NO: 174135 - RNA, 22 nt, Human
ccagggcaugggaagaacugaa

SEQ ID NO: 174136 - RNA, 22 nt, Human
uguccuuagaagaagugaaaga

SEQ ID NO: 174137 - RNA, 22 nt, Human
uucuucaaugugcccuguuuuc

SEQ ID NO: 174138 - RNA, 22 nt, Human
uauuuccaaaagccuauuauga

SEQ ID NO: 174139 - RNA, 22 nt, Human
agguggggccaaaugcuacagu

SEQ ID NO: 174140 - RNA, 22 nt, Human
caagaucagggugccagaaugg

SEQ ID NO: 174141 - RNA, 22 nt, Human
uuggcuuuuaugcagcuuaggu

SEQ ID NO: 174142 - RNA, 22 nt, Human
ucagcuuucucuucuaucgaua

SEQ ID NO: 174143 - RNA, 15 nt, Human
ggcagguggaucacu

SEQ ID NO: 174144 - RNA, 22 nt, Human
uacagguaaaauuaucagaaac

SEQ ID NO: 174145 - RNA, 22 nt, Human
ccaggugugucuggccccgaag

SEQ ID NO: 174146 - RNA, 22 nt, Human
uaagaaacuaaugcaauaagag

SEQ ID NO: 174147 - RNA, 22 nt, Human
ugggugggagcacccugucugg

SEQ ID NO: 174148 - RNA, 22 nt, Human
ccagcauggcaccugagaugag

SEQ ID NO: 174149 - RNA, 22 nt, Human
auuucaacacuuuuggaauuag

SEQ ID NO: 174150 - RNA, 22 nt, Human
agaaagaggaugcagaucucau

SEQ ID NO: 174151 - RNA, 22 nt, Human
uuggaucacucugaagccuuac

SEQ ID NO: 174152 - RNA, 22 nt, Human
acagggcaccugagguaggaag

SEQ ID NO: 174153 - RNA, 22 nt, Human
agucaccaacaugguucccagg

SEQ ID NO: 174154 - RNA, 17 nt, Human
ugaaaucagcacccagg

SEQ ID NO: 174155 - RNA, 22 nt, Human
ugcuucaaguugaaauauucuu

SEQ ID NO: 174156 - RNA, 22 nt, Human
gaggcugggaaguccaagacca

SEQ ID NO: 174157 - RNA, 23 nt, Human
aaauucaguccuucaacucugag

SEQ ID NO: 174158 - RNA, 22 nt, Human
gugaauaacuuucuauguuaau

SEQ ID NO: 174159 - RNA, 22 nt, Human
uacuuuaucagcgucaaaggua

SEQ ID NO: 174160 - RNA, 21 nt, Human
uuacaaagcaagugcuguguc

SEQ ID NO: 174161 - RNA, 22 nt, Human
cucuuccuacagucugcuaugc

SEQ ID NO: 174162 - RNA, 22 nt, Human
guucuucaucuuaaccaucugu

SEQ ID NO: 174163 - RNA, 22 nt, Human
ucaguucuuuauuucacaguga

SEQ ID NO: 174164 - RNA, 22 nt, Human
aaauccuaaggagaauaugauu

SEQ ID NO: 174165 - RNA, 22 nt, Human
uuuauacauggagaauuuuugc

SEQ ID NO: 174166 - RNA, 22 nt, Human
ggucuggcaggugaggacucag

SEQ ID NO: 174167 - RNA, 22 nt, Human
agaaauguggaucguuuuaaaa

SEQ ID NO: 174168 - RNA, 22 nt, Human
guacuacaguuucucauuaaau

SEQ ID NO: 174169 - RNA, 22 nt, Human
aagagcaucgguggagccccca

SEQ ID NO: 174170 - RNA, 22 nt, Human
acagguguccaacauuuaccuu

SEQ ID NO: 174171 - RNA, 22 nt, Human
ggucaaaguugaagaagggcau

SEQ ID NO: 174172 - RNA, 22 nt, Human
aaguccuuuccaguccugugau

SEQ ID NO: 174173 - RNA, 22 nt, Human
guuaggcaaauaacuguggagc

SEQ ID NO: 174174 - RNA, 22 nt, Human
acauuguaguuguucugcagca

SEQ ID NO: 174175 - RNA, 23 nt, Human
auuucuaggggauuuucuggugc

SEQ ID NO: 174176 - RNA, 19 nt, Human
agauuuaccucauauaguu

SEQ ID NO: 174177 - RNA, 22 nt, Human
uuuccagagcaugucugcucag

SEQ ID NO: 174178 - RNA, 22 nt, Human
uucacagauuucccugcacaug

SEQ ID NO: 174179 - RNA, 22 nt, Human
auuuccaucaucauuaggccua

SEQ ID NO: 174180 - RNA, 22 nt, Human
uagggcaggugaagaaaagcua

SEQ ID NO: 174181 - RNA, 22 nt, Human
ugcuuuauggagcccaucucau

SEQ ID NO: 174182 - RNA, 22 nt, Human
agcuugauuucucugcagugug

SEQ ID NO: 174183 - RNA, 22 nt, Human
gagggcuccauuccccgugccc

SEQ ID NO: 174184 - RNA, 22 nt, Human
cuuuauguacuguguauuugaa

SEQ ID NO: 174185 - RNA, 22 nt, Human
uuauauuguguaauaagugaag

SEQ ID NO: 174186 - RNA, 22 nt, Human
cugaggcucccucgggucugcu

SEQ ID NO: 174187 - RNA, 22 nt, Human
aacaaacaaacauuuugucauc

SEQ ID NO: 174188 - RNA, 22 nt, Human
gacuuuggcaucuagacauugu

SEQ ID NO: 174189 - RNA, 22 nt, Human
gcucuggccagacccucagugg

SEQ ID NO: 174190 - RNA, 22 nt, Human
ccugggugaaauaguccucaag

SEQ ID NO: 174191 - RNA, 22 nt, Human
auucuucaccugagucagucua

SEQ ID NO: 174192 - RNA, 22 nt, Human
ggguugaggcggaugucggcgg

SEQ ID NO: 174193 - RNA, 19 nt, Human
gagggcucauuugaacaau

SEQ ID NO: 174194 - RNA, 22 nt, Human
auuuguaauuucuuaucugugu

SEQ ID NO: 174195 - RNA, 22 nt, Human
uugaaaacuuucuagaccaaga

SEQ ID NO: 174196 - RNA, 22 nt, Human
uuaacugugacaguuucucaga

SEQ ID NO: 174197 - RNA, 23 nt, Human
cgcccagccucagugaccugggc

SEQ ID NO: 174198 - RNA, 22 nt, Human
ccuugcucucccaagcccgcag

SEQ ID NO: 174199 - RNA, 22 nt, Human
uucaaaauuguucuaagcucug

SEQ ID NO: 174200 - RNA, 22 nt, Human
agggacuauuuacccaucucac

SEQ ID NO: 174201 - RNA, 22 nt, Human
cccaguguuccuugaggggcug

SEQ ID NO: 174202 - RNA, 22 nt, Human
ugcuagugugugagauguucaa

SEQ ID NO: 174203 - RNA, 22 nt, Human
uuugaacaugcugcaugauaau

SEQ ID NO: 174204 - RNA, 22 nt, Human
uagauauaucugucauacuggu

SEQ ID NO: 174205 - RNA, 22 nt, Human
ucagcugcucaaauuuauguca

SEQ ID NO: 174206 - RNA, 22 nt, Human
cagagauuauuauaacuaauua

SEQ ID NO: 174207 - RNA, 19 nt, Human
uagcugauagcuacuuuau

SEQ ID NO: 174208 - RNA, 22 nt, Human
gcaggcuccaaggccugggaga

SEQ ID NO: 174209 - RNA, 22 nt, Human
ggauucagugucuguuaauagu

SEQ ID NO: 174210 - RNA, 20 nt, Human
uuucaagucagcaauucuca

SEQ ID NO: 174211 - RNA, 22 nt, Human
ccuguucacugcacaguuuccg

SEQ ID NO: 174212 - RNA, 22 nt, Human
ucuggccccuggcaguccugga

SEQ ID NO: 174213 - RNA, 22 nt, Human
cuuaggcaguuuaggaaagaga

SEQ ID NO: 174214 - RNA, 22 nt, Human
ggcuuuauaggguagaggauca

SEQ ID NO: 174215 - RNA, 22 nt, Human
ucagggcaaugucccucagaag

SEQ ID NO: 174216 - RNA, 22 nt, Human
auuuaaugucgagcuauuguag

SEQ ID NO: 174217 - RNA, 21 nt, Human
uacuacagucucuuuaucagu

SEQ ID NO: 174218 - RNA, 22 nt, Human
aaauucaguuuuaauaaucacu

SEQ ID NO: 174219 - RNA, 22 nt, Human
acaggcaggcgggacagcccga

SEQ ID NO: 174220 - RNA, 22 nt, Human
gcuggaggcuggagugcagugg

SEQ ID NO: 174221 - RNA, 22 nt, Human
uuuucauuguaaaucaggaaac

SEQ ID NO: 174222 - RNA, 22 nt, Human
uggcuggagcauuccuugucuu

SEQ ID NO: 174223 - RNA, 22 nt, Human
ugucaccaugcgaggcuaauuu

SEQ ID NO: 174224 - RNA, 22 nt, Human
gacagacaggaggccaccugcu

SEQ ID NO: 174225 - RNA, 22 nt, Human
ccuggagggacccuggcccugu

SEQ ID NO: 174226 - RNA, 23 nt, Human
ugguggggucuuggagacagcac

SEQ ID NO: 174227 - RNA, 22 nt, Human
uucuaaauuuuggaagaugcag

SEQ ID NO: 174228 - RNA, 15 nt, Human
gcaggcagaucaccg

SEQ ID NO: 174229 - RNA, 22 nt, Human
ggucuggauaauuccaguaccu

SEQ ID NO: 174230 - RNA, 22 nt, Human
gcuauacaaguguagaauagag

SEQ ID NO: 174231 - RNA, 22 nt, Human
cauauuuauagaucuggcauuu

SEQ ID NO: 174232 - RNA, 22 nt, Human
cuuccuucuguaagaccaguug

SEQ ID NO: 174233 - RNA, 22 nt, Human
agggaagaaaauccaucgcugc

SEQ ID NO: 174234 - RNA, 22 nt, Human
ucagccaguuugauucuauuug

SEQ ID NO: 174235 - RNA, 22 nt, Human
aaugugucuaugugguucacag

SEQ ID NO: 174236 - RNA, 19 nt, Human
ccagagagcuagguacaga

SEQ ID NO: 174237 - RNA, 22 nt, Human
aagggcucacccaacucacuuc

SEQ ID NO: 174238 - RNA, 22 nt, Human
gagccaccuucaacucaggaau

SEQ ID NO: 174239 - RNA, 22 nt, Human
cauuaggguaauugaacacuua

SEQ ID NO: 174240 - RNA, 22 nt, Human
cccaggcagggacgugcucugg

SEQ ID NO: 174241 - RNA, 22 nt, Human
acaucugaccauuacaagacau

SEQ ID NO: 174242 - RNA, 22 nt, Human
uccuaguucucugccagucgcu

SEQ ID NO: 174243 - RNA, 22 nt, Human
aagcgccaugguuccugcgcag

SEQ ID NO: 174244 - RNA, 22 nt, Human
ucucucuugucaccccaucugc

SEQ ID NO: 174245 - RNA, 22 nt, Human
ucagcacugaaauucuucacau

SEQ ID NO: 174246 - RNA, 22 nt, Human
cccugcagugugaccucaccua

SEQ ID NO: 174247 - RNA, 22 nt, Human
gugagcauauauguaaucguuu

SEQ ID NO: 174248 - RNA, 22 nt, Human
ucagguguggucaccacagggu

SEQ ID NO: 174249 - RNA, 22 nt, Human
cauagaaaagaguagguaaugu

SEQ ID NO: 174250 - RNA, 22 nt, Human
uucauucuugucuuuguauagu

SEQ ID NO: 174251 - RNA, 22 nt, Human
aguaaacacugucuuuauauau

SEQ ID NO: 174252 - RNA, 22 nt, Human
aaauucuaugucaauguuuauu

SEQ ID NO: 174253 - RNA, 22 nt, Human
ggacagacagugugagugaggc

SEQ ID NO: 174254 - RNA, 22 nt, Human
uguacauacauagauauacaca

SEQ ID NO: 174255 - RNA, 22 nt, Human
uacacauguauuuauguguaca

SEQ ID NO: 174256 - RNA, 18 nt, Human
uuucacagauucaugacu

SEQ ID NO: 174257 - RNA, 22 nt, Human
caucagaaucugagucucugcc

SEQ ID NO: 174258 - RNA, 22 nt, Human
ggcuccacugcugaccacucca

SEQ ID NO: 174259 - RNA, 22 nt, Human
ugcuuauuuauagucaauagag

SEQ ID NO: 174260 - RNA, 22 nt, Human
ucagcuuuuuacaugugaaaua

SEQ ID NO: 174261 - RNA, 22 nt, Human
ucccaggcaaaggcagcucauu

SEQ ID NO: 174262 - RNA, 22 nt, Human
aauggaauaccuagguggccca

SEQ ID NO: 174263 - RNA, 22 nt, Human
auggcuuucagauuucuauguu

SEQ ID NO: 174264 - RNA, 22 nt, Human
aguguuugucccguuagaaaug

SEQ ID NO: 174265 - RNA, 22 nt, Human
ugcagggaaaguguuggcagca

SEQ ID NO: 174266 - RNA, 22 nt, Human
cuuugaauuccaguacaauaac

SEQ ID NO: 174267 - RNA, 22 nt, Human
acauuaaacuugcuuggcugua

SEQ ID NO: 174268 - RNA, 22 nt, Human
uuuagaaugugacuguauuuga

SEQ ID NO: 174269 - RNA, 22 nt, Human
guaggcagugguuggaagagaa

SEQ ID NO: 174270 - RNA, 18 nt, Human
uggcagggaggaaauaua

SEQ ID NO: 174271 - RNA, 22 nt, Human
aagcugcacuacuugagggacc

SEQ ID NO: 174272 - RNA, 22 nt, Human
uacccagcuucaagucaggacu

SEQ ID NO: 174273 - RNA, 22 nt, Human
uuugacucugggugcuuuuucg

SEQ ID NO: 174274 - RNA, 22 nt, Human
aguauaauuagauaucaaaagu

SEQ ID NO: 174275 - RNA, 22 nt, Human
cauuuguacagaacagcuuuau

SEQ ID NO: 174276 - RNA, 22 nt, Human
agagacaaugccaaugcacacg

SEQ ID NO: 174277 - RNA, 22 nt, Human
ucugggauuuuauagacaugcu

SEQ ID NO: 174278 - RNA, 22 nt, Human
cuucuucaaccugaaaguuuca

SEQ ID NO: 174279 - RNA, 22 nt, Human
agugugagaacggacuaauaaa

SEQ ID NO: 174280 - RNA, 22 nt, Human
uuucaguuacugcuauaucauu

SEQ ID NO: 174281 - RNA, 22 nt, Human
ccagagacgucggucagggcgc

SEQ ID NO: 174282 - RNA, 22 nt, Human
uauucauaguaaacaaaagugg

SEQ ID NO: 174283 - RNA, 22 nt, Human
uuuccuuccuugcuagccugag

SEQ ID NO: 174284 - RNA, 22 nt, Human
aagggcucugugugccucccca

SEQ ID NO: 174285 - RNA, 22 nt, Human
ucuagggaacaugggucaagcu

SEQ ID NO: 174286 - RNA, 22 nt, Human
gacaauaaaaugaucuuacagu

SEQ ID NO: 174287 - RNA, 22 nt, Human
uuggaggaggcauuggaggauu

SEQ ID NO: 174288 - RNA, 22 nt, Human
aggauuuacaaugauucuaggu

SEQ ID NO: 174289 - RNA, 22 nt, Human
auugauaucaguuugcugauug

SEQ ID NO: 174290 - RNA, 22 nt, Human
aguccggggucuggacaccugg

SEQ ID NO: 174291 - RNA, 22 nt, Human
gccaggcagagccccgugcagc

SEQ ID NO: 174292 - RNA, 22 nt, Human
uuugacuccugccuucuccugu

SEQ ID NO: 174293 - RNA, 20 nt, Human
agcugcaacagacuguaugg

SEQ ID NO: 174294 - RNA, 22 nt, Human
ucuucagagugaaagucuguga

SEQ ID NO: 174295 - RNA, 22 nt, Human
uauuccagaugaaaucauucag

SEQ ID NO: 174296 - RNA, 22 nt, Human
ugagcagaacacgggauccaug

SEQ ID NO: 174297 - RNA, 22 nt, Human
aauuuacaguugcugaugguac

SEQ ID NO: 174298 - RNA, 22 nt, Human
ugcagggccgcuggaggucaug

SEQ ID NO: 174299 - RNA, 22 nt, Human
uucuuguauguaugcaaaauca

SEQ ID NO: 174300 - RNA, 22 nt, Human
uaggcuaggcugaagguuuugg

SEQ ID NO: 174301 - RNA, 22 nt, Human
aaacaccagucccaguauacac

SEQ ID NO: 174302 - RNA, 22 nt, Human
ccagugugguagguccacaggu

SEQ ID NO: 174303 - RNA, 22 nt, Human
uccuggauuuaacccuggcucu

SEQ ID NO: 174304 - RNA, 22 nt, Human
caggccucuauggucagcugag

SEQ ID NO: 174305 - RNA, 22 nt, Human
ccagccuuacugcccuucagug

SEQ ID NO: 174306 - RNA, 22 nt, Human
gcugcaaaccugccaccuggug

SEQ ID NO: 174307 - RNA, 19 nt, Human
uguguccuagcagccaguc

SEQ ID NO: 174308 - RNA, 22 nt, Human
ucagguguagguuguucaguuu

SEQ ID NO: 174309 - RNA, 22 nt, Human
cagggcucacucggcuggcguc

SEQ ID NO: 174310 - RNA, 22 nt, Human
uguguccuucugggagucccag

SEQ ID NO: 174311 - RNA, 22 nt, Human
cuugaagaaaguauguugggau

SEQ ID NO: 174312 - RNA, 22 nt, Human
ugguuuaccccuguccuauauc

SEQ ID NO: 174313 - RNA, 22 nt, Human
agagcugaauuuggguggugga

SEQ ID NO: 174314 - RNA, 22 nt, Human
uccaggagaggccugaccaggu

SEQ ID NO: 174315 - RNA, 22 nt, Human
uucacauaaugauacaaagcuu

SEQ ID NO: 174316 - RNA, 22 nt, Human
cauuuguaucauauguaucuua

SEQ ID NO: 174317 - RNA, 22 nt, Human
auucaagagcccauguuuccug

SEQ ID NO: 174318 - RNA, 22 nt, Human
uuuccucacacagaagaucuug

SEQ ID NO: 174319 - RNA, 22 nt, Human
cagagcagugaggaguugugua

SEQ ID NO: 174320 - RNA, 22 nt, Human
uccaggaggugaggggaccaaa

SEQ ID NO: 174321 - RNA, 20 nt, Human
acagaugaggaaaaugaagu

SEQ ID NO: 174322 - RNA, 22 nt, Human
gcagguguggauuugcauccag

SEQ ID NO: 174323 - RNA, 22 nt, Human
ucuuccugaaacccuguuccag

SEQ ID NO: 174324 - RNA, 22 nt, Human
gaugagguguguggccacuaga

SEQ ID NO: 174325 - RNA, 22 nt, Human
gcuguucauuagaaauagaaug

SEQ ID NO: 174326 - RNA, 22 nt, Human
auauuagguuggugcaaaagua

SEQ ID NO: 174327 - RNA, 22 nt, Human
uauacagaacugcacgugcacg

SEQ ID NO: 174328 - RNA, 22 nt, Human
aaucagaaauugagggucuggu

SEQ ID NO: 174329 - RNA, 22 nt, Human
uuccugggugguccugguagag

SEQ ID NO: 174330 - RNA, 22 nt, Human
aaauuaguacauugcaaagucc

SEQ ID NO: 174331 - RNA, 22 nt, Human
acccagccuacaaagcucaccu

SEQ ID NO: 174332 - RNA, 22 nt, Human
ugaucugaaggacaugggaccc

SEQ ID NO: 174333 - RNA, 22 nt, Human
uuguugcucuuguugccacaug

SEQ ID NO: 174334 - RNA, 22 nt, Human
cagucaccaccagguggcagua

SEQ ID NO: 174335 - RNA, 22 nt, Human
gggacagaaggaagugagcaca

SEQ ID NO: 174336 - RNA, 22 nt, Human
gagggcaguagccucguacccu

SEQ ID NO: 174337 - RNA, 19 nt, Human
aguuuauuauaggugauuc

SEQ ID NO: 174338 - RNA, 22 nt, Human
uggagcaggaagucuauggcug

SEQ ID NO: 174339 - RNA, 22 nt, Human
uuguccaaaguaacacaucuag

SEQ ID NO: 174340 - RNA, 22 nt, Human
uaauuccaccuuuuuccaacuu

SEQ ID NO: 174341 - RNA, 23 nt, Human
ugcuggguaaauagcugaguaac

SEQ ID NO: 174342 - RNA, 22 nt, Human
aaagauucgagcgauguauaaa

SEQ ID NO: 174343 - RNA, 22 nt, Human
gaugaggucuacauuguuaaaa

SEQ ID NO: 174344 - RNA, 21 nt, Human
ccagagagagggaaguggguu

SEQ ID NO: 174345 - RNA, 22 nt, Human
gcagguggauauugcuacuuga

SEQ ID NO: 174346 - RNA, 22 nt, Human
uuuccagguauuaauacuguau

SEQ ID NO: 174347 - RNA, 18 nt, Human
cuucucccaucuuggcca

SEQ ID NO: 174348 - RNA, 22 nt, Human
gcagguguccugggcuggcagu

SEQ ID NO: 174349 - RNA, 22 nt, Human
aagcagacaucccauacuuuug

SEQ ID NO: 174350 - RNA, 22 nt, Human
ucuguggauuuuaguguucaug

SEQ ID NO: 174351 - RNA, 22 nt, Human
aauuccaggaugcaggaggugc

SEQ ID NO: 174352 - RNA, 22 nt, Human
cagggcagggauguugcggcag

SEQ ID NO: 174353 - RNA, 22 nt, Human
uaugcacauucacacaaaaaug

SEQ ID NO: 174354 - RNA, 22 nt, Human
acagauuuaggacuguagcgau

SEQ ID NO: 174355 - RNA, 22 nt, Human
gguacaauccacuguggguuag

SEQ ID NO: 174356 - RNA, 22 nt, Human
ccagucacucugugagagcuac

SEQ ID NO: 174357 - RNA, 22 nt, Human
cagggcagagccaggauuucaa

SEQ ID NO: 174358 - RNA, 22 nt, Human
aucuucaaagggauguccaugg

SEQ ID NO: 174359 - RNA, 19 nt, Human
ugcugggucauauggaaac

SEQ ID NO: 174360 - RNA, 22 nt, Human
ggaguugauuuuggauauauua

SEQ ID NO: 174361 - RNA, 23 nt, Human
ucuaauacaugaaaccuagaugu

SEQ ID NO: 174362 - RNA, 22 nt, Human
uuuacagaugaggauacugagg

SEQ ID NO: 174363 - RNA, 22 nt, Human
uuuaaaaucagaugggaguugg

SEQ ID NO: 174364 - RNA, 22 nt, Human
ucuuuccauggccacacagucu

SEQ ID NO: 174365 - RNA, 22 nt, Human
ccagagagguagcuuacccucu

SEQ ID NO: 174366 - RNA, 22 nt, Human
uaauucagggccagaaucccca

SEQ ID NO: 174367 - RNA, 22 nt, Human
aacauucuauuuugcuaaaaca

SEQ ID NO: 174368 - RNA, 22 nt, Human
ugucauaaucaguuuugcaugu

SEQ ID NO: 174369 - RNA, 22 nt, Human
cuggaggagcaauaugguuagg

SEQ ID NO: 174370 - RNA, 22 nt, Human
ucccaguggugggugcacauuu

SEQ ID NO: 174371 - RNA, 22 nt, Human
uuauugagcacauaguaugugg

SEQ ID NO: 174372 - RNA, 22 nt, Human
cuuauugaaagccccugugccu

SEQ ID NO: 174373 - RNA, 22 nt, Human
aaaacuaaauacgcuuugccuc

SEQ ID NO: 174374 - RNA, 22 nt, Human
cuuacaaaggagaggagauagg

SEQ ID NO: 174375 - RNA, 22 nt, Human
uuacauguuuacggauacacuu

SEQ ID NO: 174376 - RNA, 16 nt, Human
cuacccagugagaagg

SEQ ID NO: 174377 - RNA, 22 nt, Human
ucaaucacguguuccauguucu

SEQ ID NO: 174378 - RNA, 22 nt, Human
acagcuuuaguguggguggugc

SEQ ID NO: 174379 - RNA, 22 nt, Human
uaacuuuaguguaugagguaag

SEQ ID NO: 174380 - RNA, 22 nt, Human
uguuaggguccugugcaggggc

SEQ ID NO: 174381 - RNA, 22 nt, Human
gucugcccucacgccagcuggg

SEQ ID NO: 174382 - RNA, 22 nt, Human
acagcagguuauuguuauggca

SEQ ID NO: 174383 - RNA, 22 nt, Human
caaagucagcugccagucccaa

SEQ ID NO: 174384 - RNA, 23 nt, Human
ugggaccuguuugcccacagaug

SEQ ID NO: 174385 - RNA, 22 nt, Human
ucaggugucuugugggauuuua

SEQ ID NO: 174386 - RNA, 22 nt, Human
auuaggcauuauggggauaagg

SEQ ID NO: 174387 - RNA, 22 nt, Human
gaauuucaaagagguuaagagg

SEQ ID NO: 174388 - RNA, 22 nt, Human
ucguccugugcaccugccugca

SEQ ID NO: 174389 - RNA, 22 nt, Human
cuguccuguacuuugaggcccu

SEQ ID NO: 174390 - RNA, 22 nt, Human
gcugggucuggcugugagccgg

SEQ ID NO: 174391 - RNA, 22 nt, Human
acaugaaguggucagaucaaac

SEQ ID NO: 174392 - RNA, 22 nt, Human
ggcaggugccaguuggcuuggg

SEQ ID NO: 174393 - RNA, 22 nt, Human
ucagugugaguaccaugcucag

SEQ ID NO: 174394 - RNA, 22 nt, Human
cuuccagaggaacucugcagug

SEQ ID NO: 174395 - RNA, 22 nt, Human
acagcauugcuccaucucaaga

SEQ ID NO: 174396 - RNA, 22 nt, Human
caguagacacauuaauauggaa

SEQ ID NO: 174397 - RNA, 22 nt, Human
augugcaaauccaaugugaaug

SEQ ID NO: 174398 - RNA, 23 nt, Human
ugcaggugauuaauccaguuuca

SEQ ID NO: 174399 - RNA, 22 nt, Human
uuccagugaugggcaauuuggu

SEQ ID NO: 174400 - RNA, 22 nt, Human
cuacagaagaaacuaucacuau

SEQ ID NO: 174401 - RNA, 21 nt, Human
uccugcagggcagcagagugg

SEQ ID NO: 174402 - RNA, 22 nt, Human
cacagguguguccuggucuugu

SEQ ID NO: 174403 - RNA, 22 nt, Human
auuauccucagaaaacauguga

SEQ ID NO: 174404 - RNA, 21 nt, Human
uggcagggguaguaguacagc

SEQ ID NO: 174405 - RNA, 22 nt, Human
uccugcagaccucagucagguc

SEQ ID NO: 174406 - RNA, 22 nt, Human
ucacaaauauuuuaacaguagg

SEQ ID NO: 174407 - RNA, 22 nt, Human
uucuacaauaugaauaaugaag

SEQ ID NO: 174408 - RNA, 22 nt, Human
uccauucuaugcuuacauuuau

SEQ ID NO: 174409 - RNA, 22 nt, Human
gggcagguauuuaucuucuauu

SEQ ID NO: 174410 - RNA, 22 nt, Human
auccaugauuaguaggauaaag

SEQ ID NO: 174411 - RNA, 22 nt, Human
cuucaguucuaaaguagaaugu

SEQ ID NO: 174412 - RNA, 22 nt, Human
gcagggcagaccuccagccuau

SEQ ID NO: 174413 - RNA, 22 nt, Human
aagaaaucagaaaagcauucgu

SEQ ID NO: 174414 - RNA, 22 nt, Human
gacuuuauccugccugaccacg

SEQ ID NO: 174415 - RNA, 22 nt, Human
gguacaauucugggguaugcuc

SEQ ID NO: 174416 - RNA, 21 nt, Human
uggaccuguccuucucgcugu

SEQ ID NO: 174417 - RNA, 20 nt, Human
uuccagagaucugcauuuua

SEQ ID NO: 174418 - RNA, 22 nt, Human
uuuaucuguuccucuuggaggc

SEQ ID NO: 174419 - RNA, 22 nt, Human
cagauucucacuguauucaggu

SEQ ID NO: 174420 - RNA, 22 nt, Human
acaaauuuauugaagggcauau

SEQ ID NO: 174421 - RNA, 22 nt, Human
caagaaucagaccugucagggu

SEQ ID NO: 174422 - RNA, 22 nt, Human
ucuggccugaaaguccaugcuu

SEQ ID NO: 174423 - RNA, 22 nt, Human
auacuaaaguauagaacuuagu

SEQ ID NO: 174424 - RNA, 22 nt, Human
acccagcuguuucccgugucau

SEQ ID NO: 174425 - RNA, 23 nt, Human
gccaggcacaugguggacacgca

SEQ ID NO: 174426 - RNA, 22 nt, Human
uuucacaaaugucuuuaacuug

SEQ ID NO: 174427 - RNA, 22 nt, Human
gcaguguuaggaauaaaaauga

SEQ ID NO: 174428 - RNA, 22 nt, Human
ugaauaaucauguccauagugu

SEQ ID NO: 174429 - RNA, 22 nt, Human
agcagguguagggcucuuugua

SEQ ID NO: 174430 - RNA, 22 nt, Human
uuaaauuccagccucauaauag

SEQ ID NO: 174431 - RNA, 20 nt, Human
auuccucagccccagccuca

SEQ ID NO: 174432 - RNA, 22 nt, Human
auuaggcagggcaugguggcuc

SEQ ID NO: 174433 - RNA, 22 nt, Human
gaaguucaaaagacagauuuga

SEQ ID NO: 174434 - RNA, 18 nt, Human
uuccuucugauguauaug

SEQ ID NO: 174435 - RNA, 22 nt, Human
cauuuguaguuaaaaaugucuc

SEQ ID NO: 174436 - RNA, 22 nt, Human
augugucuuugagacucugcua

SEQ ID NO: 174437 - RNA, 22 nt, Human
guccugguccugccuccccaug

SEQ ID NO: 174438 - RNA, 22 nt, Human
uaucagaaaucaacacacagug

SEQ ID NO: 174439 - RNA, 22 nt, Human
acaagccaauuacugugccagg

SEQ ID NO: 174440 - RNA, 22 nt, Human
gaaucauuuagcucugcaugga

SEQ ID NO: 174441 - RNA, 22 nt, Human
gcagggcaaauguggaaaggag

SEQ ID NO: 174442 - RNA, 22 nt, Human
ccagccacugggccacugccag

SEQ ID NO: 174443 - RNA, 22 nt, Human
cagggcucccaaauaucucuuc

SEQ ID NO: 174444 - RNA, 22 nt, Human
aaggugucaggcuugggaaagu

SEQ ID NO: 174445 - RNA, 22 nt, Human
agcagggccucuggcacugguc

SEQ ID NO: 174446 - RNA, 22 nt, Human
auuguauaauuguauugccaaa

SEQ ID NO: 174447 - RNA, 22 nt, Human
augaaaauguacauguguauaa

SEQ ID NO: 174448 - RNA, 22 nt, Human
uguggggcuuacaaaggcagau

SEQ ID NO: 174449 - RNA, 22 nt, Human
acagaaauugggcaaauggaag

SEQ ID NO: 174450 - RNA, 22 nt, Human
cauuuucagcacccaucugaaa

SEQ ID NO: 174451 - RNA, 22 nt, Human
uccuucuggaggcucuaagggg

SEQ ID NO: 174452 - RNA, 22 nt, Human
uuauuguuuacuaguuugcaga

SEQ ID NO: 174453 - RNA, 22 nt, Human
ucagaauaugcuaaugacauuu

SEQ ID NO: 174454 - RNA, 22 nt, Human
aaauuauaggugccaccuugga

SEQ ID NO: 174455 - RNA, 22 nt, Human
agucaaagaagaugguuccaaa

SEQ ID NO: 174456 - RNA, 22 nt, Human
acaguaaaaagccuuagaauuu

SEQ ID NO: 174457 - RNA, 22 nt, Human
uuuauuaugauggacaccuucg

SEQ ID NO: 174458 - RNA, 22 nt, Human
caguccuugcuaugacccugag

SEQ ID NO: 174459 - RNA, 22 nt, Human
gguacaaugguucauuuuaugu

SEQ ID NO: 174460 - RNA, 22 nt, Human
uccuggguaaacacugaccuuu

SEQ ID NO: 174461 - RNA, 22 nt, Human
agcaggugacagggcuguggug

SEQ ID NO: 174462 - RNA, 22 nt, Human
ccagcuauugcuguguaacagu

SEQ ID NO: 174463 - RNA, 22 nt, Human
caauuucaugccauguauugcu

SEQ ID NO: 174464 - RNA, 22 nt, Human
uccugcagagacagaggccuca

SEQ ID NO: 174465 - RNA, 22 nt, Human
uguuucaggaccuaucuuuuag

SEQ ID NO: 174466 - RNA, 22 nt, Human
cuaugaaaggauuuggaguugu

SEQ ID NO: 174467 - RNA, 22 nt, Human
uuagggacaaauuugcagaacc

SEQ ID NO: 174468 - RNA, 22 nt, Human
ucauuguauuaaaauauugguu

SEQ ID NO: 174469 - RNA, 22 nt, Human
uggguuuaaacucaacucuaaa

SEQ ID NO: 174470 - RNA, 22 nt, Human
ucaugugucugccaguguuuau

SEQ ID NO: 174471 - RNA, 22 nt, Human
cuaauacacccuauugcuuguu

SEQ ID NO: 174472 - RNA, 22 nt, Human
aauuucaaacuaauaggaacca

SEQ ID NO: 174473 - RNA, 22 nt, Human
uaggcaacaugucgaauacugu

SEQ ID NO: 174474 - RNA, 22 nt, Human
uuucuucuugauuuaaacaggg

SEQ ID NO: 174475 - RNA, 22 nt, Human
caugugucacagccuuuuauug

SEQ ID NO: 174476 - RNA, 22 nt, Human
agucaaaggguauuuggauuga

SEQ ID NO: 174477 - RNA, 22 nt, Human
aacauucugguucuaaaaaccu

SEQ ID NO: 174478 - RNA, 22 nt, Human
cauucuuacacaauauuuuaau

SEQ ID NO: 174479 - RNA, 22 nt, Human
ugaaagcacaaguucuaacagg

SEQ ID NO: 174480 - RNA, 22 nt, Human
ugacauguaguuagaaaauagg

SEQ ID NO: 174481 - RNA, 22 nt, Human
ucuggagggcccacauccacaa

SEQ ID NO: 174482 - RNA, 22 nt, Human
cucugaauggacacuccagugu

SEQ ID NO: 174483 - RNA, 23 nt, Human
cuuuucauugccuuagcgcagag

SEQ ID NO: 174484 - RNA, 22 nt, Human
uguggcagaggaggcagcgucc

SEQ ID NO: 174485 - RNA, 22 nt, Human
auuuaagacugacuucaccagu

SEQ ID NO: 174486 - RNA, 22 nt, Human
gugggggacccaggugcugucc

SEQ ID NO: 174487 - RNA, 22 nt, Human
uuucaacauauaccauaaugcc

SEQ ID NO: 174488 - RNA, 22 nt, Human
ucaacuuuaguguagcuauuua

SEQ ID NO: 174489 - RNA, 22 nt, Human
uuuauuuauccuucuggauugc

SEQ ID NO: 174490 - RNA, 22 nt, Human
gucugcccugagcucccagugc

SEQ ID NO: 174491 - RNA, 22 nt, Human
ucacagaagagauauugacaga

SEQ ID NO: 174492 - RNA, 22 nt, Human
aagucaccccacacucuuggga

SEQ ID NO: 174493 - RNA, 22 nt, Human
aagcuuuaagugucagucagcc

SEQ ID NO: 174494 - RNA, 22 nt, Human
aaggugucggguuagcucagcc

SEQ ID NO: 174495 - RNA, 22 nt, Human
uuuaggcacaacuacucagcua

SEQ ID NO: 174496 - RNA, 22 nt, Human
ugacaugugucuccuuccgucu

SEQ ID NO: 174497 - RNA, 22 nt, Human
cagaggcagacccuccagggcg

SEQ ID NO: 174498 - RNA, 22 nt, Human
acaggugucuaaggcagacagc

SEQ ID NO: 174499 - RNA, 22 nt, Human
uccagcauauauagagaaugag

SEQ ID NO: 174500 - RNA, 22 nt, Human
acaggacauguaccaggugguc

SEQ ID NO: 174501 - RNA, 21 nt, Human
uuucuucacuuugccccaugu

SEQ ID NO: 174502 - RNA, 22 nt, Human
augagacuaccuguaauguggc

SEQ ID NO: 174503 - RNA, 22 nt, Human
ucuucagauaaagggagaguau

SEQ ID NO: 174504 - RNA, 22 nt, Human
ugucaccaccggaagaaacugc

SEQ ID NO: 174505 - RNA, 22 nt, Human
uguguccuaugaaagaggguua

SEQ ID NO: 174506 - RNA, 22 nt, Human
cuuucuucaucaagugccacgu

SEQ ID NO: 174507 - RNA, 22 nt, Human
aguugaauaauuagacauaucu

SEQ ID NO: 174508 - RNA, 22 nt, Human
uguccugggucccugcuagaag

SEQ ID NO: 174509 - RNA, 22 nt, Human
auggaggaugugcagcaugggc

SEQ ID NO: 174510 - RNA, 22 nt, Human
ugcaaaauaaugaacgauuuuu

SEQ ID NO: 174511 - RNA, 22 nt, Human
agacagacugguuugaauuggu

SEQ ID NO: 174512 - RNA, 22 nt, Human
guccaugacugugacucacaug

SEQ ID NO: 174513 - RNA, 19 nt, Human
uuagggacaugaauucuag

SEQ ID NO: 174514 - RNA, 22 nt, Human
ccagggcauguccaagacuuag

SEQ ID NO: 174515 - RNA, 22 nt, Human
ugcaggugguuuggacacugcu

SEQ ID NO: 174516 - RNA, 22 nt, Human
acuuuauuuccuauugcaucca

SEQ ID NO: 174517 - RNA, 22 nt, Human
cagacaggcaggugcugcuuug

SEQ ID NO: 174518 - RNA, 23 nt, Human
ugcaggugugcagagggcucuug

SEQ ID NO: 174519 - RNA, 22 nt, Human
aguguguccagaaaucuguauu

SEQ ID NO: 174520 - RNA, 22 nt, Human
acagacaguaaauaguguggcu

SEQ ID NO: 174521 - RNA, 22 nt, Human
uuacuuuugcaccaaacuaaua

SEQ ID NO: 174522 - RNA, 22 nt, Human
aaaugcuaacaaggaaugcugc

SEQ ID NO: 174523 - RNA, 22 nt, Human
accaggcagcaccaaagccggu

SEQ ID NO: 174524 - RNA, 22 nt, Human
agauaaaaugguucaaaggcua

SEQ ID NO: 174525 - RNA, 22 nt, Human
ucucuuucuauaugugagucuu

SEQ ID NO: 174526 - RNA, 22 nt, Human
agggaccugucaaugacaguua

SEQ ID NO: 174527 - RNA, 22 nt, Human
uggacaugucuucuccaagaaa

SEQ ID NO: 174528 - RNA, 22 nt, Human
gcagagugaagggagaggugug

SEQ ID NO: 174529 - RNA, 22 nt, Human
ggcagggaagcuggcaucacgg

SEQ ID NO: 174530 - RNA, 22 nt, Human
cagcuuuaccuuuaggaguaac

SEQ ID NO: 174531 - RNA, 22 nt, Human
aagggacccuggaucaaaugga

SEQ ID NO: 174532 - RNA, 22 nt, Human
ugcaaaaacagccuugaggccu

SEQ ID NO: 174533 - RNA, 22 nt, Human
auuuacugagguaaauaaacug

SEQ ID NO: 174534 - RNA, 22 nt, Human
uguguccugguguuaauuuuau

SEQ ID NO: 174535 - RNA, 22 nt, Human
cuuaauuacccaaugugguagg

SEQ ID NO: 174536 - RNA, 22 nt, Human
gacccagaaggagugcccuaga

SEQ ID NO: 174537 - RNA, 22 nt, Human
uacauguuauuucacuauuggu

SEQ ID NO: 174538 - RNA, 22 nt, Human
aauuaguaaccuaauuccaucu

SEQ ID NO: 174539 - RNA, 22 nt, Human
ucauuguuucugcuuuucauga

SEQ ID NO: 174540 - RNA, 21 nt, Human
ugacagguuuaggauuaaaau

SEQ ID NO: 174541 - RNA, 22 nt, Human
acagcuuuuuacuaauagauug

SEQ ID NO: 174542 - RNA, 22 nt, Human
auuuucauuuugcagggugaga

SEQ ID NO: 174543 - RNA, 22 nt, Human
cuuaggcauccaggguucuucc

SEQ ID NO: 174544 - RNA, 22 nt, Human
aauaauuagugggacagagaac

SEQ ID NO: 174545 - RNA, 22 nt, Human
gggcaaagugguggaggcaguu

SEQ ID NO: 174546 - RNA, 22 nt, Human
gaagugaagagauuagaaauca

SEQ ID NO: 174547 - RNA, 22 nt, Human
uuuguaaauagcaguacucaug

SEQ ID NO: 174548 - RNA, 22 nt, Human
ugggaccagauaaagggagguc

SEQ ID NO: 174549 - RNA, 22 nt, Human
uaugauguguaccuaagucacc

SEQ ID NO: 174550 - RNA, 22 nt, Human
uuugugcagauguauauuugug

SEQ ID NO: 174551 - RNA, 22 nt, Human
uggccucaaucuguccuccagc

SEQ ID NO: 174552 - RNA, 22 nt, Human
agggacccauagagagaccagu

SEQ ID NO: 174553 - RNA, 22 nt, Human
auuuacuggaaaaacuaugagc

SEQ ID NO: 174554 - RNA, 22 nt, Human
ccagcuuuccaggguugacugg

SEQ ID NO: 174555 - RNA, 22 nt, Human
agacagacacaugguaacagau

SEQ ID NO: 174556 - RNA, 22 nt, Human
cuaaaauuaccuaccaguuuag

SEQ ID NO: 174557 - RNA, 22 nt, Human
cagcaugaugcucacacaaaac

SEQ ID NO: 174558 - RNA, 22 nt, Human
ucacaaauagcuauauuaagga

SEQ ID NO: 174559 - RNA, 22 nt, Human
cagguggugccuccaggcuggu

SEQ ID NO: 174560 - RNA, 23 nt, Human
aaugggugcaacuauccaugaca

SEQ ID NO: 174561 - RNA, 22 nt, Human
uauuccagguauucuucaagag

SEQ ID NO: 174562 - RNA, 22 nt, Human
acaacuuuguagcaauuccacg

SEQ ID NO: 174563 - RNA, 22 nt, Human
augaaauggugguuuuccauuu

SEQ ID NO: 174564 - RNA, 22 nt, Human
uucuucaguuugguaaauguaa

SEQ ID NO: 174565 - RNA, 22 nt, Human
cuggaggaauaaucuccuaccc

SEQ ID NO: 174566 - RNA, 22 nt, Human
acagaauuuacacaucucuaaa

SEQ ID NO: 174567 - RNA, 22 nt, Human
auguguccaaggccacaauagc

SEQ ID NO: 174568 - RNA, 22 nt, Human
ccuggguggcugccugccuuuc

SEQ ID NO: 174569 - RNA, 22 nt, Human
ucaggcaggcucagaggaaaac

SEQ ID NO: 174570 - RNA, 22 nt, Human
ugggaccugaagcagguuggca

SEQ ID NO: 174571 - RNA, 20 nt, Human
acccagcucugugcccuggg

SEQ ID NO: 174572 - RNA, 22 nt, Human
uccaugaggcagggaggcuggc

SEQ ID NO: 174573 - RNA, 20 nt, Human
uauuccaaggguagagaaaa

SEQ ID NO: 174574 - RNA, 22 nt, Human
caacuuucuguuaaauguuagu

SEQ ID NO: 174575 - RNA, 22 nt, Human
uuagcuuucaugaaccuggucg

SEQ ID NO: 174576 - RNA, 22 nt, Human
ucaugaauauugaaugcuucau

SEQ ID NO: 174577 - RNA, 23 nt, Human
ggauuuaguggaugagcugagug

SEQ ID NO: 174578 - RNA, 22 nt, Human
ugacaggugcugggggcagugu

SEQ ID NO: 174579 - RNA, 22 nt, Human
aagccggcugggccgaggcugc

SEQ ID NO: 174580 - RNA, 22 nt, Human
aaagcugcaagcuccugaggaa

SEQ ID NO: 174581 - RNA, 22 nt, Human
aguucaguaguccuucauugua

SEQ ID NO: 174582 - RNA, 22 nt, Human
cccaggaguaagugacauuguu

SEQ ID NO: 174583 - RNA, 22 nt, Human
uagucaccugugagcugcguag

SEQ ID NO: 174584 - RNA, 22 nt, Human
aagguggugaucaucuugaagg

SEQ ID NO: 174585 - RNA, 22 nt, Human
ccagagagcuacaaggcauaaa

SEQ ID NO: 174586 - RNA, 22 nt, Human
uggaauguuuccccagccugca

SEQ ID NO: 174587 - RNA, 22 nt, Human
uugcugggcaugucuuaauucu

SEQ ID NO: 174588 - RNA, 22 nt, Human
guuuauuauacaacaaaagcua

SEQ ID NO: 174589 - RNA, 22 nt, Human
ggcucugccucugacccucugg

SEQ ID NO: 174590 - RNA, 22 nt, Human
ggaaggaaguaaaugaugcuau

SEQ ID NO: 174591 - RNA, 18 nt, Human
caauuucaauggucugaa

SEQ ID NO: 174592 - RNA, 22 nt, Human
ucuucagauggccaguuguccc

SEQ ID NO: 174593 - RNA, 23 nt, Human
ucuguucaaggcuuucuccuuga

SEQ ID NO: 174594 - RNA, 22 nt, Human
cagacagguugcaaaacuucaa

SEQ ID NO: 174595 - RNA, 22 nt, Human
cuguuaauugugaauuuuacau

SEQ ID NO: 174596 - RNA, 22 nt, Human
cugugucccuugucccagagcc

SEQ ID NO: 174597 - RNA, 22 nt, Human
acaggauuagcaaguaaucagg

SEQ ID NO: 174598 - RNA, 22 nt, Human
gguguccuucguccgcuggcau

SEQ ID NO: 174599 - RNA, 22 nt, Human
ugcuggagucucuugacccugg

SEQ ID NO: 174600 - RNA, 22 nt, Human
uuugguauugcacacugucuuc

SEQ ID NO: 174601 - RNA, 22 nt, Human
aucuaaaaggagcucuuuaucu

SEQ ID NO: 174602 - RNA, 22 nt, Human
uggaugucauaguuggauauac

SEQ ID NO: 174603 - RNA, 22 nt, Human
cugucccuucauuauucacuac

SEQ ID NO: 174604 - RNA, 16 nt, Human
gcagguggggcgcgca

SEQ ID NO: 174605 - RNA, 20 nt, Human
uccaggcagcucagaguguc

SEQ ID NO: 174606 - RNA, 22 nt, Human
gaggauggaggcaguuagggcc

SEQ ID NO: 174607 - RNA, 22 nt, Human
ucagacagcuugggauaacuga

SEQ ID NO: 174608 - RNA, 22 nt, Human
uugguuuguucaccaucaagca

SEQ ID NO: 174609 - RNA, 22 nt, Human
uaguuuuacuugcgaugauaau

SEQ ID NO: 174610 - RNA, 22 nt, Human
gcucucuuuuuccagugguggu

SEQ ID NO: 174611 - RNA, 22 nt, Human
gagcaggucuuucauggugcau

SEQ ID NO: 174612 - RNA, 22 nt, Human
acucuuauuuugaaguaauaau

SEQ ID NO: 174613 - RNA, 22 nt, Human
gauuucaaggauguuagaggug

SEQ ID NO: 174614 - RNA, 22 nt, Human
uuccaugaaauguguuaugcuu

SEQ ID NO: 174615 - RNA, 22 nt, Human
cauauuugguauaacuuaagca

SEQ ID NO: 174616 - RNA, 22 nt, Human
uguguccuccagggagauguaa

SEQ ID NO: 174617 - RNA, 22 nt, Human
gcaguguuuacauauuagaaac

SEQ ID NO: 174618 - RNA, 22 nt, Human
uugagggucuggaucugcugcu

SEQ ID NO: 174619 - RNA, 22 nt, Human
cuuuauguccaccagacugcaa

SEQ ID NO: 174620 - RNA, 22 nt, Human
uucaacuuuaugcauauguauu

SEQ ID NO: 174621 - RNA, 22 nt, Human
uuuccaaauaaggucacauucu

SEQ ID NO: 174622 - RNA, 22 nt, Human
uuugcagugauucuugcaguga

SEQ ID NO: 174623 - RNA, 22 nt, Human
uuuccuaguucuaagaaaugua

SEQ ID NO: 174624 - RNA, 22 nt, Human
gcagggaccucacuacccccag

SEQ ID NO: 174625 - RNA, 22 nt, Human
gggaacuucagaaagucgcugc

SEQ ID NO: 174626 - RNA, 22 nt, Human
acuggaggccccucccagugaa

SEQ ID NO: 174627 - RNA, 22 nt, Human
uauuucagcaagaagaaugugg

SEQ ID NO: 174628 - RNA, 22 nt, Human
gacuuuauuacuaacccuguga

SEQ ID NO: 174629 - RNA, 22 nt, Human
uugguacaaaaguaacuguggu

SEQ ID NO: 174630 - RNA, 22 nt, Human
ugaauaauuccuuuuugucaag

SEQ ID NO: 174631 - RNA, 22 nt, Human
auuaauuuuaccuuuguaaaca

SEQ ID NO: 174632 - RNA, 22 nt, Human
gcuggagguagggagguccugu

SEQ ID NO: 174633 - RNA, 22 nt, Human
aaaguggugggcgaacucauca

SEQ ID NO: 174634 - RNA, 16 nt, Human
cagcuuuaugucagug

SEQ ID NO: 174635 - RNA, 22 nt, Human
gcagaagucagaccaucugaau

SEQ ID NO: 174636 - RNA, 22 nt, Human
caugugucuaaucuacuaauau

SEQ ID NO: 174637 - RNA, 22 nt, Human
auagaauucuuugaaauuuaug

SEQ ID NO: 174638 - RNA, 22 nt, Human
acagguguuuuggaggaugauu

SEQ ID NO: 174639 - RNA, 22 nt, Human
aaauuucaguuggaaugagcuc

SEQ ID NO: 174640 - RNA, 22 nt, Human
cagcuuugccaaguaaggucuu

SEQ ID NO: 174641 - RNA, 19 nt, Human
ggaacuuggccuuuaccca

SEQ ID NO: 174642 - RNA, 21 nt, Human
ugacagcauagagcagggagg

SEQ ID NO: 174643 - RNA, 22 nt, Human
gcaguccaaaguggcucucacc

SEQ ID NO: 174644 - RNA, 20 nt, Human
uuugacucaggccuuuagcc

SEQ ID NO: 174645 - RNA, 22 nt, Human
aaguccaugaucaagauguggc

SEQ ID NO: 174646 - RNA, 22 nt, Human
uauuccaaaauaguuaagcacu

SEQ ID NO: 174647 - RNA, 22 nt, Human
agauggucaaggauacuguuca

SEQ ID NO: 174648 - RNA, 22 nt, Human
auaaagauuuuuaggcauuucu

SEQ ID NO: 174649 - RNA, 22 nt, Human
cuguccucaccuuggcaggggg

SEQ ID NO: 174650 - RNA, 22 nt, Human
aaugcaaagcaagcagagauuu

SEQ ID NO: 174651 - RNA, 22 nt, Human
aagacaggaacauagcaaaucc

SEQ ID NO: 174652 - RNA, 22 nt, Human
ggcagaccucuccagccccaca

SEQ ID NO: 174653 - RNA, 22 nt, Human
auuguauuagcacaauacaauu

SEQ ID NO: 174654 - RNA, 22 nt, Human
aguagaauagauggauacuauu

SEQ ID NO: 174655 - RNA, 22 nt, Human
cuguccugaggcagguggccug

SEQ ID NO: 174656 - RNA, 22 nt, Human
uuaugcaaaggggccucuuccu

SEQ ID NO: 174657 - RNA, 22 nt, Human
aacuuuaucggaacagguacuc

SEQ ID NO: 174658 - RNA, 22 nt, Human
ucagagagccucaggcacugcc

SEQ ID NO: 174659 - RNA, 22 nt, Human
uggcaaaggaaaugauuuaaga

SEQ ID NO: 174660 - RNA, 22 nt, Human
uagggcucacugagaugaauau

SEQ ID NO: 174661 - RNA, 22 nt, Human
ugggugugcccagauggugucc

SEQ ID NO: 174662 - RNA, 18 nt, Human
agcaggugcuguuucuuu

SEQ ID NO: 174663 - RNA, 21 nt, Human
acaggcucacgauccauuucu

SEQ ID NO: 174664 - RNA, 22 nt, Human
gacccugccaugagugacaggg

SEQ ID NO: 174665 - RNA, 20 nt, Human
aacacagauaccaaagguug

SEQ ID NO: 174666 - RNA, 22 nt, Human
aaaggcuaugagauagaagaua

SEQ ID NO: 174667 - RNA, 22 nt, Human
gggaggaaugcaacuuauuuag

SEQ ID NO: 174668 - RNA, 22 nt, Human
acauucacgcucucaaagcuga

SEQ ID NO: 174669 - RNA, 22 nt, Human
acauaauaaaaauaacagcuca

SEQ ID NO: 174670 - RNA, 21 nt, Human
uccuucucuaugauugucuga

SEQ ID NO: 174671 - RNA, 22 nt, Human
caacuuuagcaauguuaguaua

SEQ ID NO: 174672 - RNA, 22 nt, Human
ucagaauuugauuccugggaua

SEQ ID NO: 174673 - RNA, 22 nt, Human
auucuuauuauaguaaaacagu

SEQ ID NO: 174674 - RNA, 22 nt, Human
cuuauuagaaagaaaagacaug

SEQ ID NO: 174675 - RNA, 22 nt, Human
augcuuaaccuugguguacaau

SEQ ID NO: 174676 - RNA, 22 nt, Human
ccaggcaggcgauggugcagug

SEQ ID NO: 174677 - RNA, 22 nt, Human
aggcuucuucuuccuauuuagu

SEQ ID NO: 174678 - RNA, 22 nt, Human
uggcaggucaugaguggccacc

SEQ ID NO: 174679 - RNA, 19 nt, Human
aauuagggagucgguuaag

SEQ ID NO: 174680 - RNA, 22 nt, Human
auuuccaauuucauccaugucc

SEQ ID NO: 174681 - RNA, 22 nt, Human
auuucauagauuguaaaucccu

SEQ ID NO: 174682 - RNA, 22 nt, Human
uugcagcuuagugauguuaucu

SEQ ID NO: 174683 - RNA, 22 nt, Human
cuuuacugaagugaagaccugg

SEQ ID NO: 174684 - RNA, 22 nt, Human
uuucuaguaaucaauauaaagu

SEQ ID NO: 174685 - RNA, 22 nt, Human
cucuuccucucaugcggucaua

SEQ ID NO: 174686 - RNA, 22 nt, Human
caauuucacugacacccuggaa

SEQ ID NO: 174687 - RNA, 22 nt, Human
gaguccuuuguuccuugccaca

SEQ ID NO: 174688 - RNA, 22 nt, Human
cucuggaaaauugugugggggu

SEQ ID NO: 174689 - RNA, 22 nt, Human
agggcuccaaggaaguguagcu

SEQ ID NO: 174690 - RNA, 22 nt, Human
ugucuucaguaaaauacacuau

SEQ ID NO: 174691 - RNA, 22 nt, Human
auucucaguucacuaguuucuu

SEQ ID NO: 174692 - RNA, 22 nt, Human
cguauacaugaagacauugcug

SEQ ID NO: 174693 - RNA, 22 nt, Human
uuccaggaggagguacuagagg

SEQ ID NO: 174694 - RNA, 22 nt, Human
aagauauacuauuaaguaccau

SEQ ID NO: 174695 - RNA, 22 nt, Human
auguuucaaauauauagaguug

SEQ ID NO: 174696 - RNA, 22 nt, Human
aagggcaggaaaagauggaugu

SEQ ID NO: 174697 - RNA, 22 nt, Human
uuccggaagguucucuagaauu

SEQ ID NO: 174698 - RNA, 22 nt, Human
aguccuuacucgggggcccaga

SEQ ID NO: 174699 - RNA, 22 nt, Human
aaauggaauguguuuauaauuc

SEQ ID NO: 174700 - RNA, 22 nt, Human
uuugaaaauuagacacaggcua

SEQ ID NO: 174701 - RNA, 22 nt, Human
gggaccugccaaggccacccag

SEQ ID NO: 174702 - RNA, 20 nt, Human
aggcucagcugagcucuugg

SEQ ID NO: 174703 - RNA, 18 nt, Human
caauuucauccuuaagcc

SEQ ID NO: 174704 - RNA, 22 nt, Human
uucuucaacaaggacacuguua

SEQ ID NO: 174705 - RNA, 22 nt, Human
guaaacaugcuguguacucagc

SEQ ID NO: 174706 - RNA, 22 nt, Human
cagggcagggccacacccccug

SEQ ID NO: 174707 - RNA, 22 nt, Human
uagaaucuaguucauucauuug

SEQ ID NO: 174708 - RNA, 22 nt, Human
aacaguaaaaaucauuuaguug

SEQ ID NO: 174709 - RNA, 22 nt, Human
ucaggugucugccucuuugagu

SEQ ID NO: 174710 - RNA, 22 nt, Human
uccucagauauaaaugagggug

SEQ ID NO: 174711 - RNA, 22 nt, Human
cuuguccccagcagguugguuu

SEQ ID NO: 174712 - RNA, 22 nt, Human
uuacaaaguguuaugauaaaca

SEQ ID NO: 174713 - RNA, 22 nt, Human
uuucauaaggguuucuagacuu

SEQ ID NO: 174714 - RNA, 22 nt, Human
cuaaaugucauggaguuguaga

SEQ ID NO: 174715 - RNA, 22 nt, Human
uggaccugggguggccuccucu

SEQ ID NO: 174716 - RNA, 22 nt, Human
ugcuagggauauaguggcgagu

SEQ ID NO: 174717 - RNA, 22 nt, Human
aaagcagaggugauaugacuua

SEQ ID NO: 174718 - RNA, 19 nt, Human
ccagguggaacugagguag

SEQ ID NO: 174719 - RNA, 22 nt, Human
cauguaaagcauccuucuaggg

SEQ ID NO: 174720 - RNA, 22 nt, Human
uugcagggcaucuaugucuggu

SEQ ID NO: 174721 - RNA, 22 nt, Human
uguccuggccaaggccuugcuu

SEQ ID NO: 174722 - RNA, 22 nt, Human
uauccaaaggaacaaucacagc

SEQ ID NO: 174723 - RNA, 22 nt, Human
aaguccuuuauccuaaaagguc

SEQ ID NO: 174724 - RNA, 22 nt, Human
auacagaaaaugaugcagaguu

SEQ ID NO: 174725 - RNA, 22 nt, Human
caauuucauggauaaaagaugu

SEQ ID NO: 174726 - RNA, 22 nt, Human
auucacaaaaugauauagauac

SEQ ID NO: 174727 - RNA, 22 nt, Human
gaaguccugguccucucauuca

SEQ ID NO: 174728 - RNA, 22 nt, Human
aaagacagacggaaaccugagg

SEQ ID NO: 174729 - RNA, 22 nt, Human
uugcaggggaaggagcagagcu

SEQ ID NO: 174730 - RNA, 22 nt, Human
ggggaccuggccacccauccuu

SEQ ID NO: 174731 - RNA, 21 nt, Human
gguguccugagggauagguag

SEQ ID NO: 174732 - RNA, 22 nt, Human
gggcaggucugggucagccuga

SEQ ID NO: 174733 - RNA, 22 nt, Human
agauucuacucuagauccaugg

SEQ ID NO: 174734 - RNA, 17 nt, Human
acagggcagaaacagcu

SEQ ID NO: 174735 - RNA, 22 nt, Human
caguuucuuuccauuguuaccu

SEQ ID NO: 174736 - RNA, 17 nt, Human
accaggcaacacgccca

SEQ ID NO: 174737 - RNA, 22 nt, Human
aagcugcaaaaaauuucugucu

SEQ ID NO: 174738 - RNA, 22 nt, Human
caacauuugaguaaagaaaugg

SEQ ID NO: 174739 - RNA, 22 nt, Human
uuccucuagcuucucacuaaca

SEQ ID NO: 174740 - RNA, 22 nt, Human
ugcagggccagacuggguugga

SEQ ID NO: 174741 - RNA, 22 nt, Human
gaaggcaucacagaggcuguga

SEQ ID NO: 174742 - RNA, 22 nt, Human
ugauuucuuccuugucauuaga

SEQ ID NO: 174743 - RNA, 22 nt, Human
cugcagggaacugaggcccaga

SEQ ID NO: 174744 - RNA, 22 nt, Human
uugaauucauuucucauugagu

SEQ ID NO: 174745 - RNA, 22 nt, Human
gcaggcaguugcaguuuucuag

SEQ ID NO: 174746 - RNA, 22 nt, Human
auuaggcauucaugcagcuccu

SEQ ID NO: 174747 - RNA, 22 nt, Human
uuccauaauaaccugagagaaa

SEQ ID NO: 174748 - RNA, 22 nt, Human
uuugcugucagccgcuauuuuc

SEQ ID NO: 174749 - RNA, 22 nt, Human
aagggcucccaacucaucuuuu

SEQ ID NO: 174750 - RNA, 22 nt, Human
aucagaaauagucauguuacuu

SEQ ID NO: 174751 - RNA, 22 nt, Human
uaauuucagugcaagcucacgg

SEQ ID NO: 174752 - RNA, 22 nt, Human
agggcuccugaggcccuucugg

SEQ ID NO: 174753 - RNA, 21 nt, Human
acagggcaugcagcuggcugu

SEQ ID NO: 174754 - RNA, 22 nt, Human
agaggcacaacagucccauugu

SEQ ID NO: 174755 - RNA, 22 nt, Human
gacagguggguaccuuuaugga

SEQ ID NO: 174756 - RNA, 22 nt, Human
uuccaaagugcuggaauuacau

SEQ ID NO: 174757 - RNA, 22 nt, Human
ugcuccagugagcuggccaucc

SEQ ID NO: 174758 - RNA, 18 nt, Human
aaugugaauauuuacuuc

SEQ ID NO: 174759 - RNA, 20 nt, Human
guauuaggagguaaauguaa

SEQ ID NO: 174760 - RNA, 22 nt, Human
uacccaggaggaaacugaggcu

SEQ ID NO: 174761 - RNA, 20 nt, Human
ugugccuggcuuuguccuga

SEQ ID NO: 174762 - RNA, 22 nt, Human
uguguccuacugaggagcuccu

SEQ ID NO: 174763 - RNA, 22 nt, Human
aaugugucccuuauuucacagg

SEQ ID NO: 174764 - RNA, 22 nt, Human
auacagaaaaguggauagccag

SEQ ID NO: 174765 - RNA, 22 nt, Human
ugcuauacauguacauauuagu

SEQ ID NO: 174766 - RNA, 18 nt, Human
uuauuggugcugcuguuc

SEQ ID NO: 174767 - RNA, 22 nt, Human
acacacagguaaaggagccugg

SEQ ID NO: 174768 - RNA, 22 nt, Human
ucauguuauugacucauaauau

SEQ ID NO: 174769 - RNA, 22 nt, Human
cuggaggacagaggccaugucu

SEQ ID NO: 174770 - RNA, 22 nt, Human
ggcauccaguucugaucaacaa

SEQ ID NO: 174771 - RNA, 20 nt, Human
auguucuucauuuaauguuc

SEQ ID NO: 174772 - RNA, 22 nt, Human
ucuggaucggguuccucagguc

SEQ ID NO: 174773 - RNA, 22 nt, Human
gggcugacucugcacugagcca

SEQ ID NO: 174774 - RNA, 22 nt, Human
caagaaucuugcagcuuagacu

SEQ ID NO: 174775 - RNA, 22 nt, Human
acacauaagccuaaucaucucc

SEQ ID NO: 174776 - RNA, 22 nt, Human
uccgccaggacugagggcccau

SEQ ID NO: 174777 - RNA, 22 nt, Human
cuucucccgaagccgguucugc

SEQ ID NO: 174778 - RNA, 22 nt, Human
cacuuuauaugcauuaccucau

SEQ ID NO: 174779 - RNA, 22 nt, Human
ugggacacaaaccagaccagga

SEQ ID NO: 174780 - RNA, 22 nt, Human
uaaagaucuuaggaagauuuuc

SEQ ID NO: 174781 - RNA, 22 nt, Human
uuaguuagucccugguaccuuu

SEQ ID NO: 174782 - RNA, 22 nt, Human
ugggugcucugcuucccugcac

SEQ ID NO: 174783 - RNA, 22 nt, Human
auuuccaggagaaaggauuuua

SEQ ID NO: 174784 - RNA, 21 nt, Human
uggccaaacuggagcauuuga

SEQ ID NO: 174785 - RNA, 22 nt, Human
auuucuguauccugcugucaga

SEQ ID NO: 174786 - RNA, 22 nt, Human
acuucuucuucagcugggggau

SEQ ID NO: 174787 - RNA, 22 nt, Human
cagagcauuuggaagccacgug

SEQ ID NO: 174788 - RNA, 22 nt, Human
cagguugaaaguggaggagcua

SEQ ID NO: 174789 - RNA, 20 nt, Human
gaggccucagccucagcucc

SEQ ID NO: 174790 - RNA, 23 nt, Human
acagacuguauucaaaguaggac

SEQ ID NO: 174791 - RNA, 22 nt, Human
aauuccagcuaggaaaagcuuc

SEQ ID NO: 174792 - RNA, 22 nt, Human
ucagggcaccaaaaaagaugcc

SEQ ID NO: 174793 - RNA, 20 nt, Human
gcauguguauggaaggggga

SEQ ID NO: 174794 - RNA, 22 nt, Human
auuuucauggcuucugcucagu

SEQ ID NO: 174795 - RNA, 18 nt, Human
uaugugucuguuacaacu

SEQ ID NO: 174796 - RNA, 22 nt, Human
acaaaauuaccuaguuauuuuc

SEQ ID NO: 174797 - RNA, 22 nt, Human
cuuuccaaugucacuaugaauc

SEQ ID NO: 174798 - RNA, 22 nt, Human
cuguguccugcgucaagccaau

SEQ ID NO: 174799 - RNA, 22 nt, Human
aagguuaaauagguauuuucca

SEQ ID NO: 174800 - RNA, 22 nt, Human
caucuucagguucauggucaua

SEQ ID NO: 174801 - RNA, 22 nt, Human
auacagaagaacuauagccacu

SEQ ID NO: 174802 - RNA, 22 nt, Human
aaaauccugcugacucgagaug

SEQ ID NO: 174803 - RNA, 22 nt, Human
uggguccuuuuuggacuucuuc

SEQ ID NO: 174804 - RNA, 22 nt, Human
gaggcagcgggucaggaccgug

SEQ ID NO: 174805 - RNA, 22 nt, Human
uuucaugagauuccuccacauc

SEQ ID NO: 174806 - RNA, 22 nt, Human
cagguggcuucucccuaggcca

SEQ ID NO: 174807 - RNA, 22 nt, Human
ucuucacauggaacaugaagcu

SEQ ID NO: 174808 - RNA, 22 nt, Human
cugaggcucaagggcagguggg

SEQ ID NO: 174809 - RNA, 22 nt, Human
uacagacauucaauuuugaccc

SEQ ID NO: 174810 - RNA, 22 nt, Human
agaagggccagcuggacaccug

SEQ ID NO: 174811 - RNA, 22 nt, Human
gacagacaugggacuucauacu

SEQ ID NO: 174812 - RNA, 22 nt, Human
cucuggaauugaccugggaggg

SEQ ID NO: 174813 - RNA, 22 nt, Human
uuugaagacagaucaauauaag

SEQ ID NO: 174814 - RNA, 22 nt, Human
cagcacaguacaaggcacggau

SEQ ID NO: 174815 - RNA, 22 nt, Human
uaugugucccugcuacucaaca

SEQ ID NO: 174816 - RNA, 22 nt, Human
ugacuuccagcaacuuccucca

SEQ ID NO: 174817 - RNA, 19 nt, Human
gggcaaagugaucguccug

SEQ ID NO: 174818 - RNA, 22 nt, Human
uuucaaagcaacugaaaaggaa

SEQ ID NO: 174819 - RNA, 22 nt, Human
aggauuuaccgucauuuagucu

SEQ ID NO: 174820 - RNA, 22 nt, Human
uugacaauguccuuugaauuuc

SEQ ID NO: 174821 - RNA, 22 nt, Human
uucuggaucugagggggaagau

SEQ ID NO: 174822 - RNA, 22 nt, Human
acagaauuaaugaaaauuacaa

SEQ ID NO: 174823 - RNA, 22 nt, Human
uggcagguuaugcgggccacau

SEQ ID NO: 174824 - RNA, 22 nt, Human
ccagagaguaggaggcauuauu

SEQ ID NO: 174825 - RNA, 22 nt, Human
auauaacauacauacagaaaag

SEQ ID NO: 174826 - RNA, 22 nt, Human
uacaguauguucuugaauuugg

SEQ ID NO: 174827 - RNA, 21 nt, Human
aaucauacaaaacaugucagg

SEQ ID NO: 174828 - RNA, 20 nt, Human
guauuagguguuccucuuuc

SEQ ID NO: 174829 - RNA, 22 nt, Human
gcaguggcaugaugugggcuca

SEQ ID NO: 174830 - RNA, 22 nt, Human
auuuccugggucucacuccaga

SEQ ID NO: 174831 - RNA, 23 nt, Human
uuugaaguugacugccuuccaga

SEQ ID NO: 174832 - RNA, 22 nt, Human
accugcagccacuucucuccuu

SEQ ID NO: 174833 - RNA, 22 nt, Human
cuagaaauauuuuacagucaag

SEQ ID NO: 174834 - RNA, 22 nt, Human
uguguccugugaucucuagggu

SEQ ID NO: 174835 - RNA, 22 nt, Human
aaauauagugacacuuauaguc

SEQ ID NO: 174836 - RNA, 22 nt, Human
uacuuuauauuguggcuggcca

SEQ ID NO: 174837 - RNA, 22 nt, Human
cagggcuccccagagagccucu

SEQ ID NO: 174838 - RNA, 22 nt, Human
agguuuaugccuuggagcuggg

SEQ ID NO: 174839 - RNA, 20 nt, Human
ugcaggugggcccuucuggg

SEQ ID NO: 174840 - RNA, 20 nt, Human
uugauucaagggcugaugga

SEQ ID NO: 174841 - RNA, 22 nt, Human
acacuuuagaaaaaagaauggu

SEQ ID NO: 174842 - RNA, 22 nt, Human
ucaggugggucuacaauuaguu

SEQ ID NO: 174843 - RNA, 22 nt, Human
aguggggcggacaggaccagga

SEQ ID NO: 174844 - RNA, 22 nt, Human
uccagaauacucugaaaucauu

SEQ ID NO: 174845 - RNA, 22 nt, Human
ccauuguaguaucuguuuuagu

SEQ ID NO: 174846 - RNA, 22 nt, Human
cacuguauuauuaggaaugaca

SEQ ID NO: 174847 - RNA, 22 nt, Human
cuguaaauaugaagaauauaug

SEQ ID NO: 174848 - RNA, 22 nt, Human
ugaaacaaugugaaguugcuga

SEQ ID NO: 174849 - RNA, 21 nt, Human
ucuucccucaggauguccugc

SEQ ID NO: 174850 - RNA, 22 nt, Human
ucaguaaaugaaugaauauaug

SEQ ID NO: 174851 - RNA, 22 nt, Human
gcugggcuugguuucccugcuu

SEQ ID NO: 174852 - RNA, 22 nt, Human
uuacagaauguucuuccaacag

SEQ ID NO: 174853 - RNA, 22 nt, Human
aauaaaauggucaguuuucuca

SEQ ID NO: 174854 - RNA, 22 nt, Human
uuguguccaaggcuauggugau

SEQ ID NO: 174855 - RNA, 22 nt, Human
ucuaaccuuugaaacugcuuuc

SEQ ID NO: 174856 - RNA, 22 nt, Human
uccaggcauguggccaguacuc

SEQ ID NO: 174857 - RNA, 23 nt, Human
uuccacaaugaaaauaaagcagg

SEQ ID NO: 174858 - RNA, 22 nt, Human
auggccuuagugaugauuaaua

SEQ ID NO: 174859 - RNA, 22 nt, Human
uugcugauucaugauuugagaa

SEQ ID NO: 174860 - RNA, 22 nt, Human
auugcuuucuuuggggaacugu

SEQ ID NO: 174861 - RNA, 22 nt, Human
uggucuggggaccgaggguuac

SEQ ID NO: 174862 - RNA, 22 nt, Human
gucuggaagaacuagggauguu

SEQ ID NO: 174863 - RNA, 22 nt, Human
uccaaauucuagggccuugguu

SEQ ID NO: 174864 - RNA, 22 nt, Human
aaagaaggggucuacauccaau

SEQ ID NO: 174865 - RNA, 18 nt, Human
ucuggagggaagcuuuga

SEQ ID NO: 174866 - RNA, 22 nt, Human
auuuccauuaucaugacaaauu

SEQ ID NO: 174867 - RNA, 22 nt, Human
uuucuggguuuaugucacagcu

SEQ ID NO: 174868 - RNA, 22 nt, Human
ccuggaucuuuguuguaaauau

SEQ ID NO: 174869 - RNA, 22 nt, Human
aucuguucuucaaaauauuaca

SEQ ID NO: 174870 - RNA, 22 nt, Human
aaauucagcagugaaaugcccc

SEQ ID NO: 174871 - RNA, 22 nt, Human
caucagaaaccuugaggaaacu

SEQ ID NO: 174872 - RNA, 22 nt, Human
uuugcacuagcauuuguccaug

SEQ ID NO: 174873 - RNA, 22 nt, Human
auacauaauuacuuccgauguu

SEQ ID NO: 174874 - RNA, 22 nt, Human
ucaggugguccuaagugccauc

SEQ ID NO: 174875 - RNA, 22 nt, Human
acagguggggcacuuggagccu

SEQ ID NO: 174876 - RNA, 22 nt, Human
caaauucaaauuucaucagugu

SEQ ID NO: 174877 - RNA, 21 nt, Human
uugcugcccucccuuuccuca

SEQ ID NO: 174878 - RNA, 22 nt, Human
ucaaauaaugccauucaucauc

SEQ ID NO: 174879 - RNA, 22 nt, Human
ucaaguuucucucagauuaugg

SEQ ID NO: 174880 - RNA, 22 nt, Human
cuugcaugcauuugaagaucau

SEQ ID NO: 174881 - RNA, 22 nt, Human
aauuagggaaguauuuaguagu

SEQ ID NO: 174882 - RNA, 22 nt, Human
ucauuugugugagugauuugac

SEQ ID NO: 174883 - RNA, 22 nt, Human
gcagggaccuugcccacccucc

SEQ ID NO: 174884 - RNA, 22 nt, Human
auaaauaucacuguugucccuc

SEQ ID NO: 174885 - RNA, 22 nt, Human
acuguucacagauuagucgaug

SEQ ID NO: 174886 - RNA, 22 nt, Human
uuagcuucuuacauuucauccu

SEQ ID NO: 174887 - RNA, 22 nt, Human
caguucacacugugcuaucugc

SEQ ID NO: 174888 - RNA, 23 nt, Human
ucuguacacaucagcaucuccca

SEQ ID NO: 174889 - RNA, 22 nt, Human
ucaccagggcuccagccagccu

SEQ ID NO: 174890 - RNA, 22 nt, Human
auacuuucugaccaauuaauug

SEQ ID NO: 174891 - RNA, 22 nt, Human
auuucagaugaccaaauggaaa

SEQ ID NO: 174892 - RNA, 22 nt, Human
gacaugugagagcucgguuuuc

SEQ ID NO: 174893 - RNA, 22 nt, Human
gcagguggaagcagcagacuca

SEQ ID NO: 174894 - RNA, 22 nt, Human
ccuggaucuuucugacugacaa

SEQ ID NO: 174895 - RNA, 22 nt, Human
aucaagaauugggagcuauuga

SEQ ID NO: 174896 - RNA, 22 nt, Human
ucuucagaggaagucagucuuu

SEQ ID NO: 174897 - RNA, 22 nt, Human
uugcuuuauuggguuuacugcc

SEQ ID NO: 174898 - RNA, 22 nt, Human
auuuaguguauucuaauaugug

SEQ ID NO: 174899 - RNA, 20 nt, Human
uucuauacauaucacugaaa

SEQ ID NO: 174900 - RNA, 22 nt, Human
agcagcauuaugauauaucuua

SEQ ID NO: 174901 - RNA, 22 nt, Human
aauguugagcuugaaaguaggu

SEQ ID NO: 174902 - RNA, 22 nt, Human
caugaguuuuuuaguucaugca

SEQ ID NO: 174903 - RNA, 22 nt, Human
cuuaaagaguauuuaauauaau

SEQ ID NO: 174904 - RNA, 22 nt, Human
uccagauggauuuaagaccuaa

SEQ ID NO: 174905 - RNA, 22 nt, Human
gagcagugacuggagcaugaga

SEQ ID NO: 174906 - RNA, 22 nt, Human
gcugggugauucauuuccauaa

SEQ ID NO: 174907 - RNA, 22 nt, Human
agacagcuagggcugcagggac

SEQ ID NO: 174908 - RNA, 21 nt, Human
uuuagggaggauauuuaacuu

SEQ ID NO: 174909 - RNA, 20 nt, Human
uacaauacacaugcauauga

SEQ ID NO: 174910 - RNA, 19 nt, Human
gcagguggauguggucagc

SEQ ID NO: 174911 - RNA, 22 nt, Human
gcaugcagggagggucuggcug

SEQ ID NO: 174912 - RNA, 22 nt, Human
uaaauucagugaguaauuucug

SEQ ID NO: 174913 - RNA, 22 nt, Human
ucagacaguuugcagugugccu

SEQ ID NO: 174914 - RNA, 22 nt, Human
uuaagcaacacacauuaauuau

SEQ ID NO: 174915 - RNA, 22 nt, Human
acagaauugauggaaaucucag

SEQ ID NO: 174916 - RNA, 22 nt, Human
aaaccaucagauaauucauacu

SEQ ID NO: 174917 - RNA, 22 nt, Human
ugaaacauuugaugaucuuugg

SEQ ID NO: 174918 - RNA, 22 nt, Human
cuucuuucccaggcauguuuua

SEQ ID NO: 174919 - RNA, 19 nt, Human
agacaaguuuccagaagcc

SEQ ID NO: 174920 - RNA, 22 nt, Human
gggugggguucaggaaucuuca

SEQ ID NO: 174921 - RNA, 22 nt, Human
uuaagcauggaagugaaauaau

SEQ ID NO: 174922 - RNA, 22 nt, Human
cagagaaaaaauccugcucuca

SEQ ID NO: 174923 - RNA, 22 nt, Human
gacccagcuaaccaggugggga

SEQ ID NO: 174924 - RNA, 22 nt, Human
acagguggaaacaugguguugg

SEQ ID NO: 174925 - RNA, 22 nt, Human
gaaagaggaaggagauguauua

SEQ ID NO: 174926 - RNA, 22 nt, Human
aauauaugagggagcuauuuga

SEQ ID NO: 174927 - RNA, 22 nt, Human
cuuccuuccuuccccgaaaugc

SEQ ID NO: 174928 - RNA, 22 nt, Human
aaaaucuggcaacacuaaguuu

SEQ ID NO: 174929 - RNA, 22 nt, Human
ugcagguggccaucuucguucu

SEQ ID NO: 174930 - RNA, 22 nt, Human
uuccuuagugccucuuccgcug

SEQ ID NO: 174931 - RNA, 22 nt, Human
gacagguggggaaacuaaggua

SEQ ID NO: 174932 - RNA, 22 nt, Human
aagacuuucaaguaugcaugca

SEQ ID NO: 174933 - RNA, 22 nt, Human
cuggcucugagcccaccuccag

SEQ ID NO: 174934 - RNA, 22 nt, Human
ggucuggaauaagguccaggaa

SEQ ID NO: 174935 - RNA, 22 nt, Human
aacagaauaguugauguacagu

SEQ ID NO: 174936 - RNA, 22 nt, Human
gauaaaauaacuauggaauacu

SEQ ID NO: 174937 - RNA, 22 nt, Human
agaggugacauaggagaggcuc

SEQ ID NO: 174938 - RNA, 22 nt, Human
ucugggugucacuccugccugc

SEQ ID NO: 174939 - RNA, 22 nt, Human
aauuauccuuaaugcaguaagc

SEQ ID NO: 174940 - RNA, 22 nt, Human
uuuaggcaagggcaagauuauc

SEQ ID NO: 174941 - RNA, 22 nt, Human
uguuuugcuucucuguuuccca

SEQ ID NO: 174942 - RNA, 21 nt, Human
uuucacaaaaguaugugacaa

SEQ ID NO: 174943 - RNA, 22 nt, Human
uuucuacauucaaaaacuacca

SEQ ID NO: 174944 - RNA, 22 nt, Human
uccugcagccaagggucaucga

SEQ ID NO: 174945 - RNA, 22 nt, Human
uacagagacuuuauggcacaaa

SEQ ID NO: 174946 - RNA, 19 nt, Human
cucagagaggggcagugcc

SEQ ID NO: 174947 - RNA, 22 nt, Human
uuucaguucaguuuauuauauc

SEQ ID NO: 174948 - RNA, 22 nt, Human
uuaauaaaguaugaauuggaaa

SEQ ID NO: 174949 - RNA, 22 nt, Human
ccaugugucuccccuggaagua

SEQ ID NO: 174950 - RNA, 22 nt, Human
ggcauuuacauaaucuuauuua

SEQ ID NO: 174951 - RNA, 22 nt, Human
cuagaaaugcucaagagaaagu

SEQ ID NO: 174952 - RNA, 22 nt, Human
cuauugcuuuugugugcuccca

SEQ ID NO: 174953 - RNA, 22 nt, Human
uauuucccagggagcaacaagc

SEQ ID NO: 174954 - RNA, 22 nt, Human
gguaaaaugcagauucuuagcc

SEQ ID NO: 174955 - RNA, 22 nt, Human
aauaauuacccaucuuuuugua

SEQ ID NO: 174956 - RNA, 22 nt, Human
uuccuucuaauauucugccugu

SEQ ID NO: 174957 - RNA, 17 nt, Human
ugauaguucauuuuaag

SEQ ID NO: 174958 - RNA, 22 nt, Human
gaaaaaggauaaauacaguguu

SEQ ID NO: 174959 - RNA, 22 nt, Human
acacauaagaaacuacaaagag

SEQ ID NO: 174960 - RNA, 22 nt, Human
ugcaggugugugcaagggaggg

SEQ ID NO: 174961 - RNA, 22 nt, Human
agggaccugcucacugccuggc

SEQ ID NO: 174962 - RNA, 22 nt, Human
uccugucuaaagaccugcaggc

SEQ ID NO: 174963 - RNA, 22 nt, Human
cuggaggaggaagucuacaaug

SEQ ID NO: 174964 - RNA, 22 nt, Human
gaggaggaaguucucuguaggc

SEQ ID NO: 174965 - RNA, 22 nt, Human
cuguccuccagacgacaguccc

SEQ ID NO: 174966 - RNA, 22 nt, Human
ggauguugauugaauggccauu

SEQ ID NO: 174967 - RNA, 22 nt, Human
agagggugcuggagagacauug

SEQ ID NO: 174968 - RNA, 22 nt, Human
uuuaaauguuuaaaacucguga

SEQ ID NO: 174969 - RNA, 22 nt, Human
ggcagggcccugauuccugggg

SEQ ID NO: 174970 - RNA, 22 nt, Human
auuauaaagaacaugugugugg

SEQ ID NO: 174971 - RNA, 21 nt, Human
auacauucuauuaagcauuua

SEQ ID NO: 174972 - RNA, 22 nt, Human
uucaacuauuaugaauaaaauu

SEQ ID NO: 174973 - RNA, 22 nt, Human
cagcuuuauugagguauaauug

SEQ ID NO: 174974 - RNA, 22 nt, Human
aacaaugugaagugcuguucag

SEQ ID NO: 174975 - RNA, 22 nt, Human
auugcuggcagcuggaucugca

SEQ ID NO: 174976 - RNA, 22 nt, Human
uaguuuaccaaauugaucuucc

SEQ ID NO: 174977 - RNA, 22 nt, Human
uugcuuuaccugugguauauuu

SEQ ID NO: 174978 - RNA, 22 nt, Human
ccugggucuucagucugcuggu

SEQ ID NO: 174979 - RNA, 22 nt, Human
ucauuuguucucauucucuacu

SEQ ID NO: 174980 - RNA, 22 nt, Human
uucuuaacucaaauauauaucc

SEQ ID NO: 174981 - RNA, 22 nt, Human
ccuggaucuccucuauucauau

SEQ ID NO: 174982 - RNA, 22 nt, Human
ugaauagacuggggcugugaag

SEQ ID NO: 174983 - RNA, 21 nt, Human
gagauuuagaaggaucaauuu

SEQ ID NO: 174984 - RNA, 22 nt, Human
guacccaggcacgccuugcuga

SEQ ID NO: 174985 - RNA, 22 nt, Human
acagggcaugugcaagagacau

SEQ ID NO: 174986 - RNA, 22 nt, Human
auacaacuuuacaugcaauucc

SEQ ID NO: 174987 - RNA, 22 nt, Human
cauuuacaauguacagguugug

SEQ ID NO: 174988 - RNA, 22 nt, Human
cucuggccuggggccugcuccc

SEQ ID NO: 174989 - RNA, 23 nt, Human
guuccuucauguggucauugguu

SEQ ID NO: 174990 - RNA, 22 nt, Human
ugucaaaaauaagagagauugu

SEQ ID NO: 174991 - RNA, 22 nt, Human
agcuuuauuugucauucacggc

SEQ ID NO: 174992 - RNA, 22 nt, Human
gggaccugccauugcucacagg

SEQ ID NO: 174993 - RNA, 20 nt, Human
cuggaguguagcaguggcug

SEQ ID NO: 174994 - RNA, 22 nt, Human
ugcagggagggcccagcaaucu

SEQ ID NO: 174995 - RNA, 19 nt, Human
uauugguaugugugaggca

SEQ ID NO: 174996 - RNA, 22 nt, Human
aggaucugugagugcugcagac

SEQ ID NO: 174997 - RNA, 22 nt, Human
uugcuaauaaaguuuuuaugug

SEQ ID NO: 174998 - RNA, 22 nt, Human
aauuguaacuacauugagaaca

SEQ ID NO: 174999 - RNA, 22 nt, Human
ugagcaucuuuuuacagguuua

SEQ ID NO: 175000 - RNA, 22 nt, Human
acauguaagacuagcuuaaagu

SEQ ID NO: 175001 - RNA, 20 nt, Human
acaaaauagguacuggguag

SEQ ID NO: 175002 - RNA, 22 nt, Human
aauuuccagaucagaugacuca

SEQ ID NO: 175003 - RNA, 22 nt, Human
uauuuagaaugcguguacgugu

SEQ ID NO: 175004 - RNA, 19 nt, Human
cacacccaugcuugccaag

SEQ ID NO: 175005 - RNA, 22 nt, Human
uuucucauagucaugccucuua

SEQ ID NO: 175006 - RNA, 22 nt, Human
uggcaaaguaucugucccagcu

SEQ ID NO: 175007 - RNA, 22 nt, Human
aucauucuagcuguuguguuga

SEQ ID NO: 175008 - RNA, 22 nt, Human
uaaagucaucuuuacaucuuug

SEQ ID NO: 175009 - RNA, 22 nt, Human
cuuucauuugauaagaaugcca

SEQ ID NO: 175010 - RNA, 22 nt, Human
ugacauguauaucuuacgcuau

SEQ ID NO: 175011 - RNA, 22 nt, Human
uaaaaugaucucucauguucuu

SEQ ID NO: 175012 - RNA, 19 nt, Human
gauuuaaacguggcucuau

SEQ ID NO: 175013 - RNA, 22 nt, Human
acaaauaugguacucggagaaa

SEQ ID NO: 175014 - RNA, 22 nt, Human
acuucacagaaauuuuaugagg

SEQ ID NO: 175015 - RNA, 22 nt, Human
uggcagguggcucuggcauucu

SEQ ID NO: 175016 - RNA, 22 nt, Human
ucaggugucuaucuaaccuggu

SEQ ID NO: 175017 - RNA, 22 nt, Human
cuugaaguugcaaaacauuaau

SEQ ID NO: 175018 - RNA, 19 nt, Human
uccugcugugugaagggga

SEQ ID NO: 175019 - RNA, 22 nt, Human
gggacaugccccucagugggug

SEQ ID NO: 175020 - RNA, 22 nt, Human
uacuuuauucaggaaggcuggu

SEQ ID NO: 175021 - RNA, 22 nt, Human
aacauuguuuugcacaacucuu

SEQ ID NO: 175022 - RNA, 22 nt, Human
ggacagacaaaaauaguaagca

SEQ ID NO: 175023 - RNA, 22 nt, Human
uagucaccagcuacaggacagc

SEQ ID NO: 175024 - RNA, 22 nt, Human
ucauuucaaugauacuacuaag

SEQ ID NO: 175025 - RNA, 22 nt, Human
aaauccuaagcagaggaauuua

SEQ ID NO: 175026 - RNA, 22 nt, Human
cugucuuuaguacaaaaaaugu

SEQ ID NO: 175027 - RNA, 22 nt, Human
gaucugaagauaugaaauauuu

SEQ ID NO: 175028 - RNA, 22 nt, Human
aauuauauuguggugugaaugu

SEQ ID NO: 175029 - RNA, 22 nt, Human
uacccagcaaucccuagagguu

SEQ ID NO: 175030 - RNA, 21 nt, Human
uucuucuuggacuguuuuggc

SEQ ID NO: 175031 - RNA, 22 nt, Human
cagguaguccacagugagggag

SEQ ID NO: 175032 - RNA, 22 nt, Human
uuuaaagaaauuccucaucuuu

SEQ ID NO: 175033 - RNA, 22 nt, Human
cuccauugaacauccucucaga

SEQ ID NO: 175034 - RNA, 22 nt, Human
aguucgagaucugcugaugaga

SEQ ID NO: 175035 - RNA, 22 nt, Human
uauguguccuaagcaaucaucc

SEQ ID NO: 175036 - RNA, 22 nt, Human
aagauuauggcagauaacaauu

SEQ ID NO: 175037 - RNA, 19 nt, Human
uuucuuuuccccucagcac

SEQ ID NO: 175038 - RNA, 22 nt, Human
cucuggaaauggccauagucau

SEQ ID NO: 175039 - RNA, 22 nt, Human
ggggaccugggcuucaaggguu

SEQ ID NO: 175040 - RNA, 22 nt, Human
acagagagaauuggguuuacag

SEQ ID NO: 175041 - RNA, 22 nt, Human
agguguccaggaagaugcuggc

SEQ ID NO: 175042 - RNA, 22 nt, Human
agaaacucauccuggagaugac

SEQ ID NO: 175043 - RNA, 22 nt, Human
uugcuuuaucuaagcauggcca

SEQ ID NO: 175044 - RNA, 22 nt, Human
aagugguuuuaagagguuccuu

SEQ ID NO: 175045 - RNA, 22 nt, Human
guguccugccacccugggcuuu

SEQ ID NO: 175046 - RNA, 22 nt, Human
uuuagccaacuauaugacuagu

SEQ ID NO: 175047 - RNA, 22 nt, Human
cacaccagagguuaccugcaaa

SEQ ID NO: 175048 - RNA, 19 nt, Human
ccaggccugcgggcguugg

SEQ ID NO: 175049 - RNA, 19 nt, Human
uucauucuuucuacuuacc

SEQ ID NO: 175050 - RNA, 22 nt, Human
acucuacuguaguaugggcacu

SEQ ID NO: 175051 - RNA, 22 nt, Human
gggugggacucuuuggccugag

SEQ ID NO: 175052 - RNA, 22 nt, Human
aauugcuuuacaagccguuuaa

SEQ ID NO: 175053 - RNA, 22 nt, Human
auuaaauguuccuuaaauuaua

SEQ ID NO: 175054 - RNA, 22 nt, Human
gaucugaagagcaaugaaauau

SEQ ID NO: 175055 - RNA, 22 nt, Human
agcaugaaaacaugaaacagca

SEQ ID NO: 175056 - RNA, 22 nt, Human
ggcgcacaaugugcagguuugu

SEQ ID NO: 175057 - RNA, 22 nt, Human
ugggaagauggagugacaggca

SEQ ID NO: 175058 - RNA, 22 nt, Human
caggcagcccugcaccaagugu

SEQ ID NO: 175059 - RNA, 22 nt, Human
ugucaccaugccagcuucugcc

SEQ ID NO: 175060 - RNA, 22 nt, Human
auauuaggcaaggagauuauuu

SEQ ID NO: 175061 - RNA, 22 nt, Human
ggcuuucuaugaacucaaaggc

SEQ ID NO: 175062 - RNA, 22 nt, Human
acagacaguaugguggggcuga

SEQ ID NO: 175063 - RNA, 22 nt, Human
cuggguguucaggagcugggcu

SEQ ID NO: 175064 - RNA, 22 nt, Human
auaauaaaccaggaugggucug

SEQ ID NO: 175065 - RNA, 22 nt, Human
cuggguaaguuccuaaggcuca

SEQ ID NO: 175066 - RNA, 22 nt, Human
cagcacagggacaauagcagau

SEQ ID NO: 175067 - RNA, 20 nt, Human
cucuggaagaguuuaaaugg

SEQ ID NO: 175068 - RNA, 22 nt, Human
uuccuccuacgcuuaucacuuu

SEQ ID NO: 175069 - RNA, 22 nt, Human
agucacauggacucaggaugac

SEQ ID NO: 175070 - RNA, 20 nt, Human
auacuuguuuucaggcuuuu

SEQ ID NO: 175071 - RNA, 22 nt, Human
guuucacagaugguguucauau

SEQ ID NO: 175072 - RNA, 22 nt, Human
cagcuugaaauauuaggagaug

SEQ ID NO: 175073 - RNA, 22 nt, Human
acagagagaaacaaucagcagc

SEQ ID NO: 175074 - RNA, 22 nt, Human
uugcaggguugacacugccugc

SEQ ID NO: 175075 - RNA, 22 nt, Human
auggcuuucucuaaugugguau

SEQ ID NO: 175076 - RNA, 22 nt, Human
aauaaugucuuuggcuugacca

SEQ ID NO: 175077 - RNA, 19 nt, Human
guuccaaaggccagaccuu

SEQ ID NO: 175078 - RNA, 22 nt, Human
uggaugcugcugucagggaugg

SEQ ID NO: 175079 - RNA, 22 nt, Human
cagguacauucguagacccauu

SEQ ID NO: 175080 - RNA, 22 nt, Human
gccugcagccucaagggcugag

SEQ ID NO: 175081 - RNA, 22 nt, Human
ccagacagcaguuaaaggacau

SEQ ID NO: 175082 - RNA, 22 nt, Human
uauuuccaggccccacucuaga

SEQ ID NO: 175083 - RNA, 22 nt, Human
agcuggagaauaggaauuagug

SEQ ID NO: 175084 - RNA, 22 nt, Human
gcauacagagaggauguggcau

SEQ ID NO: 175085 - RNA, 22 nt, Human
acuuauuagcugugugaccuug

SEQ ID NO: 175086 - RNA, 22 nt, Human
ggcauuuaauccaucugauuga

SEQ ID NO: 175087 - RNA, 22 nt, Human
caguucuuaauaccaugugguu

SEQ ID NO: 175088 - RNA, 16 nt, Human
uaugugucucaucuac

SEQ ID NO: 175089 - RNA, 22 nt, Human
uuauacuuuauacuacaucauu

SEQ ID NO: 175090 - RNA, 23 nt, Human
agggcuccuuguugauuagcauu

SEQ ID NO: 175091 - RNA, 22 nt, Human
aaucaugugggauagucugcuc

SEQ ID NO: 175092 - RNA, 23 nt, Human
accaugaugggagugcaaauaag

SEQ ID NO: 175093 - RNA, 22 nt, Human
caaguccucaaagggcucugcu

SEQ ID NO: 175094 - RNA, 22 nt, Human
uuaguuuucucaucuaucucac

SEQ ID NO: 175095 - RNA, 22 nt, Human
caaucaguuucuguuguauaau

SEQ ID NO: 175096 - RNA, 22 nt, Human
uaauuauaacaguuacaucuua

SEQ ID NO: 175097 - RNA, 22 nt, Human
acuguccaagcaugccuggcuu

SEQ ID NO: 175098 - RNA, 22 nt, Human
aaauauaauuucugccucaaua

SEQ ID NO: 175099 - RNA, 22 nt, Human
uuauuuacaacucuucucuucc

SEQ ID NO: 175100 - RNA, 22 nt, Human
ccagagaguaaacauuuuccgg

SEQ ID NO: 175101 - RNA, 22 nt, Human
auacaugugugugcauacaugu

SEQ ID NO: 175102 - RNA, 22 nt, Human
uuggcaaaauuuaaagaaguga

SEQ ID NO: 175103 - RNA, 22 nt, Human
cagcuuguuuuauuuggggacc

SEQ ID NO: 175104 - RNA, 16 nt, Human
ccuggaggucacuuca

SEQ ID NO: 175105 - RNA, 22 nt, Human
uaacauguuaagaaauuagaua

SEQ ID NO: 175106 - RNA, 22 nt, Human
ucuggaugcucugagcccaagg

SEQ ID NO: 175107 - RNA, 22 nt, Human
uuuaaagagaaugugaaggagu

SEQ ID NO: 175108 - RNA, 22 nt, Human
uggcagggaguucguucacaac

SEQ ID NO: 175109 - RNA, 22 nt, Human
uaccugcacagccagccaugug

SEQ ID NO: 175110 - RNA, 22 nt, Human
ccaggugucugucucuuuuuca

SEQ ID NO: 175111 - RNA, 22 nt, Human
cagaauaaaagucccaaggcau

SEQ ID NO: 175112 - RNA, 22 nt, Human
uuccagaagccuccauauuacu

SEQ ID NO: 175113 - RNA, 22 nt, Human
uagaaaucagcaggcauaugua

SEQ ID NO: 175114 - RNA, 22 nt, Human
acagguggcuuauuggcugauu

SEQ ID NO: 175115 - RNA, 22 nt, Human
auuuggaaaugcaucucuugag

SEQ ID NO: 175116 - RNA, 22 nt, Human
guacacauuaugcuucucuaaa

SEQ ID NO: 175117 - RNA, 22 nt, Human
gaauuugaaaagugaugggaau

SEQ ID NO: 175118 - RNA, 22 nt, Human
ggcaggcauggggucugccauu

SEQ ID NO: 175119 - RNA, 22 nt, Human
uuugacucuugcuuugguggcu

SEQ ID NO: 175120 - RNA, 22 nt, Human
cagggacccgcacagguagcau

SEQ ID NO: 175121 - RNA, 22 nt, Human
uacacauguuuggcaaguaugu

SEQ ID NO: 175122 - RNA, 22 nt, Human
ccacuucaucagugcuccauuu

SEQ ID NO: 175123 - RNA, 22 nt, Human
ugcaggugucucugucuagcgu

SEQ ID NO: 175124 - RNA, 22 nt, Human
cauaauauacuacauugaugaa

SEQ ID NO: 175125 - RNA, 22 nt, Human
ucagagagugcaaaauauagcu

SEQ ID NO: 175126 - RNA, 22 nt, Human
uuccuucuaauuuuacaccuga

SEQ ID NO: 175127 - RNA, 22 nt, Human
uuuucauuguuccucgagcauu

SEQ ID NO: 175128 - RNA, 22 nt, Human
uagaaaugaauguuuaaaaguc

SEQ ID NO: 175129 - RNA, 22 nt, Human
auuuccuucggacaguuugggu

SEQ ID NO: 175130 - RNA, 19 nt, Human
caggaaugagguaauggcu

SEQ ID NO: 175131 - RNA, 22 nt, Human
aaguuuuccuguguccaagaug

SEQ ID NO: 175132 - RNA, 21 nt, Human
ggcaggugggucucuguugcu

SEQ ID NO: 175133 - RNA, 22 nt, Human
agacaggugcucgcccaagucc

SEQ ID NO: 175134 - RNA, 22 nt, Human
cacaggccugucucuuucuaac

SEQ ID NO: 175135 - RNA, 22 nt, Human
uuaacacuaucugucauaauua

SEQ ID NO: 175136 - RNA, 22 nt, Human
acaugcuuugauguauuuugca

SEQ ID NO: 175137 - RNA, 22 nt, Human
gcuguucacagacucugcucug

SEQ ID NO: 175138 - RNA, 22 nt, Human
gugaccauccugguaaugaauc

SEQ ID NO: 175139 - RNA, 22 nt, Human
ucagcuuucucaaagaagcugg

SEQ ID NO: 175140 - RNA, 22 nt, Human
aagcaauagcaacaacuuuaca

SEQ ID NO: 175141 - RNA, 22 nt, Human
ugggguggauagaaagugaugu

SEQ ID NO: 175142 - RNA, 22 nt, Human
uacaacauguaaagugguuuaa

SEQ ID NO: 175143 - RNA, 22 nt, Human
cugagaucuuuauacgaggcac

SEQ ID NO: 175144 - RNA, 19 nt, Human
gcuaggguugguggcgugc

SEQ ID NO: 175145 - RNA, 22 nt, Human
gacugccagaaugugaggccug

SEQ ID NO: 175146 - RNA, 22 nt, Human
cagggcucaggcucugggauuc

SEQ ID NO: 175147 - RNA, 22 nt, Human
cccagcuugcccaggacugagg

SEQ ID NO: 175148 - RNA, 22 nt, Human
ggaugucuaggguuuaugugcc

SEQ ID NO: 175149 - RNA, 22 nt, Human
uauuuauuggacaguguugcug

SEQ ID NO: 175150 - RNA, 22 nt, Human
ucacaauuuggauacagcuaug

SEQ ID NO: 175151 - RNA, 23 nt, Human
guaaaauacgcagugcaguguga

SEQ ID NO: 175152 - RNA, 22 nt, Human
aagcugcagcacagagaggugg

SEQ ID NO: 175153 - RNA, 22 nt, Human
agauaucaccaguuuuacauac

SEQ ID NO: 175154 - RNA, 22 nt, Human
uauugcuguucuuuaaaugaag

SEQ ID NO: 175155 - RNA, 22 nt, Human
ugggugugccauauuccauuuc

SEQ ID NO: 175156 - RNA, 22 nt, Human
cauuuguaggaugcuucuuguu

SEQ ID NO: 175157 - RNA, 22 nt, Human
ugagauguaagguaugcuuacu

SEQ ID NO: 175158 - RNA, 22 nt, Human
auuuacagugugccuacuauau

SEQ ID NO: 175159 - RNA, 22 nt, Human
uggcauuucuggccauuugugu

SEQ ID NO: 175160 - RNA, 22 nt, Human
uuuuaauugcaauuaugguccc

SEQ ID NO: 175161 - RNA, 22 nt, Human
uaaauucugaucaaguuccuuc

SEQ ID NO: 175162 - RNA, 23 nt, Human
ucuggaggggacacugcagaugc

SEQ ID NO: 175163 - RNA, 22 nt, Human
gaaaauagcagauagaccaaug

SEQ ID NO: 175164 - RNA, 22 nt, Human
augaaaauugacagcggaagua

SEQ ID NO: 175165 - RNA, 22 nt, Human
guuagggagucagguggcucuu

SEQ ID NO: 175166 - RNA, 19 nt, Human
ugcuuaauuccuaguaggu

SEQ ID NO: 175167 - RNA, 22 nt, Human
ugcuuuaucugacuuggcgcug

SEQ ID NO: 175168 - RNA, 22 nt, Human
ugcaggugugguuccucagcca

SEQ ID NO: 175169 - RNA, 22 nt, Human
ugacauguauguauuuguuuau

SEQ ID NO: 175170 - RNA, 22 nt, Human
acuuugaaggggaacauuuuaa

SEQ ID NO: 175171 - RNA, 22 nt, Human
ggugcaggagcggggugcucgg

SEQ ID NO: 175172 - RNA, 22 nt, Human
gccaggcauuuguuaggugcug

SEQ ID NO: 175173 - RNA, 23 nt, Human
uacuuaggguuuagaucugacug

SEQ ID NO: 175174 - RNA, 22 nt, Human
auguccagaguguccuggaaag

SEQ ID NO: 175175 - RNA, 22 nt, Human
uuucaacuagccccuaaguccu

SEQ ID NO: 175176 - RNA, 22 nt, Human
augaaaaguucgaucuagaagg

SEQ ID NO: 175177 - RNA, 20 nt, Human
auguaaaauuauaaggcuga

SEQ ID NO: 175178 - RNA, 22 nt, Human
auggcuuuucacagaggguucu

SEQ ID NO: 175179 - RNA, 22 nt, Human
uuuauuagauuaucaaagaggu

SEQ ID NO: 175180 - RNA, 22 nt, Human
caucauaaaauugagauaacug

SEQ ID NO: 175181 - RNA, 20 nt, Human
caucagaaauccugacccac

SEQ ID NO: 175182 - RNA, 22 nt, Human
aauuugauucccugcaccuguu

SEQ ID NO: 175183 - RNA, 19 nt, Human
uuccuuagaggaggcggug

SEQ ID NO: 175184 - RNA, 22 nt, Human
agguggggcugggaaagauucc

SEQ ID NO: 175185 - RNA, 22 nt, Human
cacagaaaaaggcuugaaaauc

SEQ ID NO: 175186 - RNA, 22 nt, Human
aagaaaagauguuugguuuuca

SEQ ID NO: 175187 - RNA, 22 nt, Human
ucauuguauucagaacugaaga

SEQ ID NO: 175188 - RNA, 23 nt, Human
uuuugacaggaggaagguguuga

SEQ ID NO: 175189 - RNA, 22 nt, Human
agcaggugaauuccuggaugug

SEQ ID NO: 175190 - RNA, 22 nt, Human
ucuucaaauccuacagugucug

SEQ ID NO: 175191 - RNA, 22 nt, Human
uggcucugagucugcccuuggc

SEQ ID NO: 175192 - RNA, 22 nt, Human
aacaugucuggguauucacaag

SEQ ID NO: 175193 - RNA, 22 nt, Human
cagggcagccaggccccguggg

SEQ ID NO: 175194 - RNA, 22 nt, Human
cucuggaaaaccacuagcagga

SEQ ID NO: 175195 - RNA, 22 nt, Human
guuuaagaggguuucauuccca

SEQ ID NO: 175196 - RNA, 22 nt, Human
caaauucaaugaacauguuuaa

SEQ ID NO: 175197 - RNA, 22 nt, Human
gaggugucaugagggccugcuc

SEQ ID NO: 175198 - RNA, 22 nt, Human
acauguguaaaaguggauaaaa

SEQ ID NO: 175199 - RNA, 22 nt, Human
aaagauuauggcauugaaauac

SEQ ID NO: 175200 - RNA, 22 nt, Human
acagguguaauuugcccgaggu

SEQ ID NO: 175201 - RNA, 22 nt, Human
aauggcuucugaagcacacuuu

SEQ ID NO: 175202 - RNA, 22 nt, Human
ggauuaagaccugucaguacac

SEQ ID NO: 175203 - RNA, 22 nt, Human
aacaugugucuggcuagauugu

SEQ ID NO: 175204 - RNA, 22 nt, Human
uuucagaugugugucucugaag

SEQ ID NO: 175205 - RNA, 22 nt, Human
uucuuccucacacucucaccca

SEQ ID NO: 175206 - RNA, 22 nt, Human
aguucuucauaaccuuacugug

SEQ ID NO: 175207 - RNA, 22 nt, Human
agcagguguuggcugggccauc

SEQ ID NO: 175208 - RNA, 22 nt, Human
cccaugagauucugaauuuggc

SEQ ID NO: 175209 - RNA, 22 nt, Human
gucuggaaggaggagauggagc

SEQ ID NO: 175210 - RNA, 22 nt, Human
auuuaauuuacauuugacagag

SEQ ID NO: 175211 - RNA, 22 nt, Human
uuugacauuggcuuauucuguu

SEQ ID NO: 175212 - RNA, 22 nt, Human
uacagauaacugaaugcagacu

SEQ ID NO: 175213 - RNA, 22 nt, Human
ucuuauugucuagauugagaug

SEQ ID NO: 175214 - RNA, 22 nt, Human
gagcuuuacuucugacuggugc

SEQ ID NO: 175215 - RNA, 19 nt, Human
ccuggaggugaagguucuc

SEQ ID NO: 175216 - RNA, 22 nt, Human
gccccagcguggcuguguuagg

SEQ ID NO: 175217 - RNA, 22 nt, Human
gauuuccauuuucaacuccugc

SEQ ID NO: 175218 - RNA, 22 nt, Human
aaggugucacuguuucuggccu

SEQ ID NO: 175219 - RNA, 22 nt, Human
gucugccccacaggcucaguug

SEQ ID NO: 175220 - RNA, 22 nt, Human
ucauguguuaaacuccaagaua

SEQ ID NO: 175221 - RNA, 22 nt, Human
uauuugagcgaagcaguguuuu

SEQ ID NO: 175222 - RNA, 22 nt, Human
uuuauuauccaguguugucaug

SEQ ID NO: 175223 - RNA, 22 nt, Human
uuucuuuugaauaguguguggu

SEQ ID NO: 175224 - RNA, 22 nt, Human
uccaugagacagauacuguaag

SEQ ID NO: 175225 - RNA, 22 nt, Human
gagauuuagcugcuuaacuccu

SEQ ID NO: 175226 - RNA, 22 nt, Human
uuccucaguuagugccugaggc

SEQ ID NO: 175227 - RNA, 20 nt, Human
cuucuucagccuaugcuuca

SEQ ID NO: 175228 - RNA, 22 nt, Human
acagauguacacucauauauaa

SEQ ID NO: 175229 - RNA, 22 nt, Human
auauuugucaauucacuguuca

SEQ ID NO: 175230 - RNA, 22 nt, Human
uacaucuaucuagaugcucaga

SEQ ID NO: 175231 - RNA, 22 nt, Human
uuuccaagagcuuauuucugaa

SEQ ID NO: 175232 - RNA, 20 nt, Human
aagauucauuguaauuaggg

SEQ ID NO: 175233 - RNA, 22 nt, Human
agcuuuaucuucaccugggaau

SEQ ID NO: 175234 - RNA, 22 nt, Human
gcaucuaaacuugcaucauugu

SEQ ID NO: 175235 - RNA, 22 nt, Human
uguguccuuucuaaugcccaga

SEQ ID NO: 175236 - RNA, 22 nt, Human
auccuucuucaaagagggaaaa

SEQ ID NO: 175237 - RNA, 22 nt, Human
ugcuuuauucaggguuuacccc

SEQ ID NO: 175238 - RNA, 22 nt, Human
cguuuauuuugaagauuccacu

SEQ ID NO: 175239 - RNA, 22 nt, Human
uggcauuuuguucaguauaugg

SEQ ID NO: 175240 - RNA, 22 nt, Human
ggcaggcaacggaccacuaguc

SEQ ID NO: 175241 - RNA, 22 nt, Human
cuuuauuccuacaagauuuucu

SEQ ID NO: 175242 - RNA, 22 nt, Human
uuuauugaguaucuacuaugug

SEQ ID NO: 175243 - RNA, 22 nt, Human
cuguccugugucagccugaaau

SEQ ID NO: 175244 - RNA, 22 nt, Human
uuacagaagagaaagaauucag

SEQ ID NO: 175245 - RNA, 22 nt, Human
acugguuuuccagguuacuucu

SEQ ID NO: 175246 - RNA, 22 nt, Human
auggguuucccucugaaauuau

SEQ ID NO: 175247 - RNA, 22 nt, Human
uagaauucaagauucaacaggc

SEQ ID NO: 175248 - RNA, 22 nt, Human
ccagaucuucuuuucagugucu

SEQ ID NO: 175249 - RNA, 23 nt, Human
gacagagugagaccuugucuuac

SEQ ID NO: 175250 - RNA, 22 nt, Human
aaaugcuacauacacaucaggg

SEQ ID NO: 175251 - RNA, 22 nt, Human
gugaccaucagagaauaacaaa

SEQ ID NO: 175252 - RNA, 22 nt, Human
auguacaaaauguuuugaaaug

SEQ ID NO: 175253 - RNA, 22 nt, Human
auugcugacaccaaguaguagc

SEQ ID NO: 175254 - RNA, 22 nt, Human
auuaggcacuagaaugucaauu

SEQ ID NO: 175255 - RNA, 22 nt, Human
aaaauuauagaucuagugccug

SEQ ID NO: 175256 - RNA, 22 nt, Human
ggcuuggaccagucacaguggu

SEQ ID NO: 175257 - RNA, 22 nt, Human
uccagcaugaaggggcuuuuau

SEQ ID NO: 175258 - RNA, 22 nt, Human
agcagguguauauaaggcugag

SEQ ID NO: 175259 - RNA, 22 nt, Human
gaugggauuuuuuauguguuca

SEQ ID NO: 175260 - RNA, 22 nt, Human
ucugaaagaagggcagucuuuu

SEQ ID NO: 175261 - RNA, 20 nt, Human
uuacagaaaugauguuauuu

SEQ ID NO: 175262 - RNA, 22 nt, Human
cuagggacagaaagaggguaga

SEQ ID NO: 175263 - RNA, 22 nt, Human
gaugaugaggccaugaggcagg

SEQ ID NO: 175264 - RNA, 22 nt, Human
cacuggaauauggcguugaacc

SEQ ID NO: 175265 - RNA, 22 nt, Human
gggacauggaggcgcgcaggca

SEQ ID NO: 175266 - RNA, 22 nt, Human
agguggggaaaccagcgauccc

SEQ ID NO: 175267 - RNA, 22 nt, Human
aaaagucugcucucauuucaga

SEQ ID NO: 175268 - RNA, 22 nt, Human
uuuauuuauaagccacuugcug

SEQ ID NO: 175269 - RNA, 22 nt, Human
aucauucugauggucaaugcua

SEQ ID NO: 175270 - RNA, 22 nt, Human
acagguggaggcuuuaggaggu

SEQ ID NO: 175271 - RNA, 22 nt, Human
uucagaaguagcuaagcaguca

SEQ ID NO: 175272 - RNA, 22 nt, Human
uaaaauguuugcaagagaccag

SEQ ID NO: 175273 - RNA, 22 nt, Human
agcagguggauuuagacgggag

SEQ ID NO: 175274 - RNA, 22 nt, Human
aguccaugguucugacucaucu

SEQ ID NO: 175275 - RNA, 22 nt, Human
cggcagggcuccaugcauuucu

SEQ ID NO: 175276 - RNA, 22 nt, Human
agcaguccaacugagguggcau

SEQ ID NO: 175277 - RNA, 16 nt, Human
gcuggagggagggguu

SEQ ID NO: 175278 - RNA, 22 nt, Human
ugcaggugcguuuucaagccuc

SEQ ID NO: 175279 - RNA, 22 nt, Human
uauguuaagugggauaaucaaa

SEQ ID NO: 175280 - RNA, 22 nt, Human
ucagguggaauuaauuaagaga

SEQ ID NO: 175281 - RNA, 22 nt, Human
aagcuuuagagaugaguuccuu

SEQ ID NO: 175282 - RNA, 22 nt, Human
uuagaaauacaagugagguuga

SEQ ID NO: 175283 - RNA, 22 nt, Human
uggaggaaguggcuggccagaa

SEQ ID NO: 175284 - RNA, 22 nt, Human
ccuugguccaacccugcacagc

SEQ ID NO: 175285 - RNA, 22 nt, Human
aauguauuccucaugcaagagu

SEQ ID NO: 175286 - RNA, 22 nt, Human
aguuauccgaaggcacugagau

SEQ ID NO: 175287 - RNA, 22 nt, Human
guuauaaaaugcacaguuguuu

SEQ ID NO: 175288 - RNA, 21 nt, Human
cacuccacuuagaacaggguu

SEQ ID NO: 175289 - RNA, 22 nt, Human
auggcuggauaguugaagcucu

SEQ ID NO: 175290 - RNA, 22 nt, Human
uaauuguagcuuuguaaucagc

SEQ ID NO: 175291 - RNA, 22 nt, Human
uuacagaaguuucagcguuuua

SEQ ID NO: 175292 - RNA, 22 nt, Human
acagagagcugugauugaguua

SEQ ID NO: 175293 - RNA, 22 nt, Human
gcaguggccacauggaggagga

SEQ ID NO: 175294 - RNA, 22 nt, Human
uucagaaacccauugggucucu

SEQ ID NO: 175295 - RNA, 19 nt, Human
ccucaucuuggugugugca

SEQ ID NO: 175296 - RNA, 22 nt, Human
uuucaguuguccuguuaauagc

SEQ ID NO: 175297 - RNA, 22 nt, Human
caguaaauacauaucagagaag

SEQ ID NO: 175298 - RNA, 22 nt, Human
guucuucagcauuagaagucau

SEQ ID NO: 175299 - RNA, 22 nt, Human
cacgcauguggaucagaugaag

SEQ ID NO: 175300 - RNA, 22 nt, Human
ccagcuuuucuuaucauuauaa

SEQ ID NO: 175301 - RNA, 22 nt, Human
gucauuccuauccauuugauac

SEQ ID NO: 175302 - RNA, 22 nt, Human
uaugugucccuugguguagcaa

SEQ ID NO: 175303 - RNA, 22 nt, Human
agggaagaagcugguaguaggu

SEQ ID NO: 175304 - RNA, 22 nt, Human
uuuccaaaggcuaaacucaguu

SEQ ID NO: 175305 - RNA, 22 nt, Human
auuuauugguuugcauggugaa

SEQ ID NO: 175306 - RNA, 22 nt, Human
gucuucaacaauaacuaccacu

SEQ ID NO: 175307 - RNA, 20 nt, Human
uacagacaugacaauaaugg

SEQ ID NO: 175308 - RNA, 22 nt, Human
uuaguuaguggggcugucaguc

SEQ ID NO: 175309 - RNA, 22 nt, Human
auuacacuuguucaucaucacc

SEQ ID NO: 175310 - RNA, 22 nt, Human
gggcucucaaggcagggcccca

SEQ ID NO: 175311 - RNA, 22 nt, Human
ugggcaggaugcguugauucuu

SEQ ID NO: 175312 - RNA, 22 nt, Human
auggcuuugaaguaauguaauu

SEQ ID NO: 175313 - RNA, 19 nt, Human
uggcagggagugauauuag

SEQ ID NO: 175314 - RNA, 22 nt, Human
cuuccaaagcacuuuauggacc

SEQ ID NO: 175315 - RNA, 22 nt, Human
auuucuacaguacacaugcauu

SEQ ID NO: 175316 - RNA, 22 nt, Human
cuguccucuguccucagcagga

SEQ ID NO: 175317 - RNA, 22 nt, Human
caguuuauuuccaagaugacaa

SEQ ID NO: 175318 - RNA, 22 nt, Human
ucauucuuuaccaaguugucac

SEQ ID NO: 175319 - RNA, 20 nt, Human
agauuauuccuaagauuucu

SEQ ID NO: 175320 - RNA, 22 nt, Human
gcagcuuuaaacauuggaaaua

SEQ ID NO: 175321 - RNA, 22 nt, Human
gguggcagagaggagguaguuu

SEQ ID NO: 175322 - RNA, 22 nt, Human
uuugaaauaugaggcauuauga

SEQ ID NO: 175323 - RNA, 22 nt, Human
accuuuauagcugauuaugaca

SEQ ID NO: 175324 - RNA, 22 nt, Human
agaaaucauugaauuauuugcu

SEQ ID NO: 175325 - RNA, 22 nt, Human
ugucagagagcaggcaguagaa

SEQ ID NO: 175326 - RNA, 22 nt, Human
cccaggcagcccuucugacgca

SEQ ID NO: 175327 - RNA, 22 nt, Human
uucugugcccauuuuaaaaugg

SEQ ID NO: 175328 - RNA, 22 nt, Human
guuauugacauguauuaagcac

SEQ ID NO: 175329 - RNA, 22 nt, Human
aguggcagagcugugucuugaa

SEQ ID NO: 175330 - RNA, 22 nt, Human
cuagggaccucagcuccuggag

SEQ ID NO: 175331 - RNA, 22 nt, Human
agaugaagaugccacuaagacc

SEQ ID NO: 175332 - RNA, 22 nt, Human
auuucucaucuuugugaauggu

SEQ ID NO: 175333 - RNA, 22 nt, Human
uuuaggcaaacucauugucaga

SEQ ID NO: 175334 - RNA, 22 nt, Human
gcagggacgcagcacucuccgu

SEQ ID NO: 175335 - RNA, 22 nt, Human
ccauaaucuggcuuugagagag

SEQ ID NO: 175336 - RNA, 22 nt, Human
gagcacccuuugcacaucaguc

SEQ ID NO: 175337 - RNA, 22 nt, Human
acuauacaccaaaauauuaagg

SEQ ID NO: 175338 - RNA, 22 nt, Human
agcaggugcauggcgagcgcgg

SEQ ID NO: 175339 - RNA, 22 nt, Human
uuuuaagaugcuaguauuucag

SEQ ID NO: 175340 - RNA, 22 nt, Human
uuccuucuagagcuuguuuagg

SEQ ID NO: 175341 - RNA, 22 nt, Human
aauguuuuguaugccucugagc

SEQ ID NO: 175342 - RNA, 22 nt, Human
ugaaaauggccugaagaagcaa

SEQ ID NO: 175343 - RNA, 22 nt, Human
ugcagggauuagaggccgggga

SEQ ID NO: 175344 - RNA, 22 nt, Human
aagcugcagaugugccugugga

SEQ ID NO: 175345 - RNA, 22 nt, Human
uaguaguaauuguuaucuuauu

SEQ ID NO: 175346 - RNA, 22 nt, Human
uacuucaaccuucucuauuaga

SEQ ID NO: 175347 - RNA, 22 nt, Human
uucauucugggcucuaaggaac

SEQ ID NO: 175348 - RNA, 22 nt, Human
cuucucccaaguaugcaguuug

SEQ ID NO: 175349 - RNA, 22 nt, Human
cauuucaauacuaucugagaau

SEQ ID NO: 175350 - RNA, 22 nt, Human
cuguuauuuagaacauggaauc

SEQ ID NO: 175351 - RNA, 22 nt, Human
uccaugcagaggagcugguggc

SEQ ID NO: 175352 - RNA, 22 nt, Human
gcaggugugaaugugaauuaag

SEQ ID NO: 175353 - RNA, 22 nt, Human
uaucuaaauggaauauuccaga

SEQ ID NO: 175354 - RNA, 21 nt, Human
ugaaacaaucagacagagucu

SEQ ID NO: 175355 - RNA, 22 nt, Human
cccaggcagaauuaguguuuca

SEQ ID NO: 175356 - RNA, 22 nt, Human
uaggugguagagccuggcuugc

SEQ ID NO: 175357 - RNA, 22 nt, Human
uucaaacaguguagaauauaug

SEQ ID NO: 175358 - RNA, 22 nt, Human
uuuacagaaugucaauuucuau

SEQ ID NO: 175359 - RNA, 22 nt, Human
acagccagguaaaggcauggca

SEQ ID NO: 175360 - RNA, 22 nt, Human
gaggugucguagauuauucuca

SEQ ID NO: 175361 - RNA, 22 nt, Human
uugaauaauauguucaggagga

SEQ ID NO: 175362 - RNA, 22 nt, Human
cugggugucaggagacaugaug

SEQ ID NO: 175363 - RNA, 22 nt, Human
uaacauuagguagacauaagcc

SEQ ID NO: 175364 - RNA, 22 nt, Human
uccugcagacauuuacaccuuu

SEQ ID NO: 175365 - RNA, 22 nt, Human
gagcuuuaagggcacuggucuu

SEQ ID NO: 175366 - RNA, 22 nt, Human
aaaagcagguacucagcuuggg

SEQ ID NO: 175367 - RNA, 18 nt, Human
uguggcugguccacacug

SEQ ID NO: 175368 - RNA, 22 nt, Human
guggaggaaaagaaguugggug

SEQ ID NO: 175369 - RNA, 22 nt, Human
uggcaaagcuagacauucccuc

SEQ ID NO: 175370 - RNA, 22 nt, Human
aguccuuuuguuuugagaugag

SEQ ID NO: 175371 - RNA, 22 nt, Human
uuuuauguaauccuuacugucg

SEQ ID NO: 175372 - RNA, 22 nt, Human
ugcuuaauaggaguugaacauu

SEQ ID NO: 175373 - RNA, 20 nt, Human
cagagaccaggccagguguc

SEQ ID NO: 175374 - RNA, 17 nt, Human
ggcaguggaggaagaga

SEQ ID NO: 175375 - RNA, 20 nt, Human
agaaccuaaguuaaaacaca

SEQ ID NO: 175376 - RNA, 22 nt, Human
acaaaauuuuuagacaaggcuu

SEQ ID NO: 175377 - RNA, 22 nt, Human
aggacaugaagaaagggcaagg

SEQ ID NO: 175378 - RNA, 22 nt, Human
aggguggccaccaaguauguca

SEQ ID NO: 175379 - RNA, 22 nt, Human
ucugaacauccagcaaugcaca

SEQ ID NO: 175380 - RNA, 22 nt, Human
gucauucuuaacaacucaguag

SEQ ID NO: 175381 - RNA, 22 nt, Human
uccucagcauggaaucuggacu

SEQ ID NO: 175382 - RNA, 22 nt, Human
ucagacaggccucuccagccuc

SEQ ID NO: 175383 - RNA, 22 nt, Human
gcaguucuacuuauccauagac

SEQ ID NO: 175384 - RNA, 22 nt, Human
uuaaauuagucaagcuucucug

SEQ ID NO: 175385 - RNA, 22 nt, Human
uccuucaagaugccacagcuuu

SEQ ID NO: 175386 - RNA, 22 nt, Human
acauaaguuauggauaaaaugu

SEQ ID NO: 175387 - RNA, 22 nt, Human
agagcggggauaguuaauauuc

SEQ ID NO: 175388 - RNA, 22 nt, Human
uaacagaagaugaaacuucuuu

SEQ ID NO: 175389 - RNA, 22 nt, Human
cuagaugccaauuuuuauggau

SEQ ID NO: 175390 - RNA, 22 nt, Human
aauugcuuacuguuuuucaccu

SEQ ID NO: 175391 - RNA, 22 nt, Human
cacaauuuguuuuaucaguauu

SEQ ID NO: 175392 - RNA, 18 nt, Human
uaaauauauuucccccuu

SEQ ID NO: 175393 - RNA, 23 nt, Human
uacagaaggaguagucacuaaga

SEQ ID NO: 175394 - RNA, 22 nt, Human
cucuucuuuaguccagaccauc

SEQ ID NO: 175395 - RNA, 22 nt, Human
uauuagguaaaggacuugcagg

SEQ ID NO: 175396 - RNA, 22 nt, Human
acacacucaauugcauaagcac

SEQ ID NO: 175397 - RNA, 22 nt, Human
auucuucaguauguguggauug

SEQ ID NO: 175398 - RNA, 22 nt, Human
uuauuccaauuucuccuacaaa

SEQ ID NO: 175399 - RNA, 23 nt, Human
cuguccugccauccacagcggcc

SEQ ID NO: 175400 - RNA, 22 nt, Human
augugcuuguaauguuaaaugu

SEQ ID NO: 175401 - RNA, 22 nt, Human
ggcaggugugagcuguaaagga

SEQ ID NO: 175402 - RNA, 22 nt, Human
uaacuugguuggugggcaggag

SEQ ID NO: 175403 - RNA, 22 nt, Human
ccuagaugggauggcggccggg

SEQ ID NO: 175404 - RNA, 22 nt, Human
uagacaggguggcuuagaaaca

SEQ ID NO: 175405 - RNA, 22 nt, Human
uuacagaaugugccauuugguc

SEQ ID NO: 175406 - RNA, 22 nt, Human
cauggcuuuuuagcauauucaa

SEQ ID NO: 175407 - RNA, 22 nt, Human
aguacauauaguaauuuagcca

SEQ ID NO: 175408 - RNA, 22 nt, Human
auucuucauuuacuguuacuug

SEQ ID NO: 175409 - RNA, 22 nt, Human
uuaaagaugcagcuuuagagaa

SEQ ID NO: 175410 - RNA, 22 nt, Human
aucagaaaauacccaguguuua

SEQ ID NO: 175411 - RNA, 22 nt, Human
auguucaaacuuuuuacacacc

SEQ ID NO: 175412 - RNA, 22 nt, Human
augcaugcagggaagacaguag

SEQ ID NO: 175413 - RNA, 22 nt, Human
ucagggcaggacaguguaggcc

SEQ ID NO: 175414 - RNA, 22 nt, Human
ccuuuauucaauuaguccuaau

SEQ ID NO: 175415 - RNA, 22 nt, Human
uaauuuacuugcaaauaacaau

SEQ ID NO: 175416 - RNA, 22 nt, Human
ucacaaaagcuuuugaauuugg

SEQ ID NO: 175417 - RNA, 22 nt, Human
uugcagggaaaucagugaggau

SEQ ID NO: 175418 - RNA, 22 nt, Human
uguggggccaaagcccagccac

SEQ ID NO: 175419 - RNA, 22 nt, Human
ccagagaggccaaggucguggu

SEQ ID NO: 175420 - RNA, 22 nt, Human
uuucaacuugaagaauugauac

SEQ ID NO: 175421 - RNA, 22 nt, Human
uaaucuaccacuauugcaauau

SEQ ID NO: 175422 - RNA, 22 nt, Human
aaagaguucuaugaucuuucca

SEQ ID NO: 175423 - RNA, 22 nt, Human
uagggcucagcucuagcuccug

SEQ ID NO: 175424 - RNA, 22 nt, Human
gaggugucacuauuuugcuuau

SEQ ID NO: 175425 - RNA, 22 nt, Human
aauugcuuagagaauccaggua

SEQ ID NO: 175426 - RNA, 22 nt, Human
cuuugaauugccguuucaucug

SEQ ID NO: 175427 - RNA, 22 nt, Human
ugcaggugcagcgauacuguga

SEQ ID NO: 175428 - RNA, 22 nt, Human
guccaggucuggacccugagcc

SEQ ID NO: 175429 - RNA, 22 nt, Human
ucuucaaacugaaaauuuagaa

SEQ ID NO: 175430 - RNA, 22 nt, Human
ccaaacaaauccccauucuuag

SEQ ID NO: 175431 - RNA, 22 nt, Human
agacaaagacagcaucucaggu

SEQ ID NO: 175432 - RNA, 22 nt, Human
aguggaggcacuaauuggauuu

SEQ ID NO: 175433 - RNA, 22 nt, Human
cuguccagcuuggcuccugggg

SEQ ID NO: 175434 - RNA, 22 nt, Human
gacagacacuauugguaugccu

SEQ ID NO: 175435 - RNA, 22 nt, Human
uuccuucuggagcccggggagc

SEQ ID NO: 175436 - RNA, 22 nt, Human
gaugaggucauguuuuacauau

SEQ ID NO: 175437 - RNA, 22 nt, Human
guccuucucaaauccuguguuu

SEQ ID NO: 175438 - RNA, 22 nt, Human
aauagaaaggaggggcucuugu

SEQ ID NO: 175439 - RNA, 22 nt, Human
ucagaaauguaagcugaugacu

SEQ ID NO: 175440 - RNA, 22 nt, Human
aauugcuuaugccaggugagag

SEQ ID NO: 175441 - RNA, 22 nt, Human
gggucugggcaggcgcuuccuc

SEQ ID NO: 175442 - RNA, 22 nt, Human
accauuugacucucuaaggaua

SEQ ID NO: 175443 - RNA, 22 nt, Human
uauuggauagcuugugcagaau

SEQ ID NO: 175444 - RNA, 22 nt, Human
acuguauuuggauauaagaucu

SEQ ID NO: 175445 - RNA, 22 nt, Human
uuuccuucaucaucugagagcu

SEQ ID NO: 175446 - RNA, 22 nt, Human
ucuguucaguugauguaguuuu

SEQ ID NO: 175447 - RNA, 22 nt, Human
agacagacauucuagagccacc

SEQ ID NO: 175448 - RNA, 22 nt, Human
auaguuuuauagauauugugua

SEQ ID NO: 175449 - RNA, 22 nt, Human
uuucuuucaauucuccuaaugc

SEQ ID NO: 175450 - RNA, 22 nt, Human
cuuaagcaaaauauucuuucac

SEQ ID NO: 175451 - RNA, 22 nt, Human
aaauuucaguuaccuuuacguu

SEQ ID NO: 175452 - RNA, 22 nt, Human
ugcaggugccaucgcugcucau

SEQ ID NO: 175453 - RNA, 22 nt, Human
uauugcuggaaaauggugugau

SEQ ID NO: 175454 - RNA, 22 nt, Human
acaaagucacaauaauuaaccu

SEQ ID NO: 175455 - RNA, 22 nt, Human
uuguguccccuguucuaccugu

SEQ ID NO: 175456 - RNA, 22 nt, Human
gaugggcguggcgcguuuggug

SEQ ID NO: 175457 - RNA, 20 nt, Human
uuucacaucugucccuuuaa

SEQ ID NO: 175458 - RNA, 22 nt, Human
uccuuguugcugcagucaccug

SEQ ID NO: 175459 - RNA, 22 nt, Human
uuaguuuauaauucauuucugu

SEQ ID NO: 175460 - RNA, 22 nt, Human
gcaaauucuuaacuggacugug

SEQ ID NO: 175461 - RNA, 22 nt, Human
acacacaauuaguuuuaugcuu

SEQ ID NO: 175462 - RNA, 22 nt, Human
auacaacuuuaucuguaaugag

SEQ ID NO: 175463 - RNA, 22 nt, Human
ccagaugagaccacacugcugg

SEQ ID NO: 175464 - RNA, 22 nt, Human
agaaauguauucuguauguuuu

SEQ ID NO: 175465 - RNA, 22 nt, Human
ggcucccugccuguccucaguc

SEQ ID NO: 175466 - RNA, 22 nt, Human
cuauuagacacaauuagugauu

SEQ ID NO: 175467 - RNA, 22 nt, Human
guguguccuugggccucugcag

SEQ ID NO: 175468 - RNA, 22 nt, Human
cacagcauaaugaaauauacuu

SEQ ID NO: 175469 - RNA, 22 nt, Human
gagugcaggccugagcaccauc

SEQ ID NO: 175470 - RNA, 21 nt, Human
ucauucacaggguauuguaua

SEQ ID NO: 175471 - RNA, 22 nt, Human
ucacugugaauguuaucaucuu

SEQ ID NO: 175472 - RNA, 22 nt, Human
uaauuuuaugacaguguauuuu

SEQ ID NO: 175473 - RNA, 22 nt, Human
aaaacugaaauacgauccaaug

SEQ ID NO: 175474 - RNA, 22 nt, Human
ucaguaaacagguuuaaguccu

SEQ ID NO: 175475 - RNA, 22 nt, Human
uuccuuagaguuuccagaaagc

SEQ ID NO: 175476 - RNA, 22 nt, Human
ucugggugccacugucuguaca

SEQ ID NO: 175477 - RNA, 18 nt, Human
cucagagaugcccuuauu

SEQ ID NO: 175478 - RNA, 22 nt, Human
agcagguggacagaggaagaaa

SEQ ID NO: 175479 - RNA, 22 nt, Human
aaacaucaccauuuuaccuaau

SEQ ID NO: 175480 - RNA, 22 nt, Human
gagggcucuacucaccacccug

SEQ ID NO: 175481 - RNA, 23 nt, Human
aagucaccaagaggaaggcggag

SEQ ID NO: 175482 - RNA, 22 nt, Human
augcuuuuccaggagaaauaua

SEQ ID NO: 175483 - RNA, 22 nt, Human
ucagguguuucuggagaaguaa

SEQ ID NO: 175484 - RNA, 22 nt, Human
augccaaagcccaaguucauca

SEQ ID NO: 175485 - RNA, 22 nt, Human
aagcuuucagagcagaauguga

SEQ ID NO: 175486 - RNA, 22 nt, Human
auuuauugaagcuuauuacguu

SEQ ID NO: 175487 - RNA, 22 nt, Human
uuucauugagacuauagacauc

SEQ ID NO: 175488 - RNA, 14 nt, Human
gcagguggaucacc

SEQ ID NO: 175489 - RNA, 23 nt, Human
acuauaaaguuguucugauuuac

SEQ ID NO: 175490 - RNA, 22 nt, Human
caucagaaccagcugggugagg

SEQ ID NO: 175491 - RNA, 22 nt, Human
guacaauaacuagucuuauagu

SEQ ID NO: 175492 - RNA, 22 nt, Human
auaagcauguuagaauauuuga

SEQ ID NO: 175493 - RNA, 22 nt, Human
gaaaacacuuugaucugaaagu

SEQ ID NO: 175494 - RNA, 22 nt, Human
auaacaugagccagauugaaag

SEQ ID NO: 175495 - RNA, 22 nt, Human
ucucccucuuugucugcuuugg

SEQ ID NO: 175496 - RNA, 22 nt, Human
acuguucaucucuuagaaagua

SEQ ID NO: 175497 - RNA, 22 nt, Human
guaggcagguggaggagugaag

SEQ ID NO: 175498 - RNA, 22 nt, Human
uacaggaaguaaguaaugaaau

SEQ ID NO: 175499 - RNA, 22 nt, Human
aggaggaacucagaaagaaggu

SEQ ID NO: 175500 - RNA, 22 nt, Human
gcaggugucugacugccuucuu

SEQ ID NO: 175501 - RNA, 22 nt, Human
caucuaaauuugacuccaagga

SEQ ID NO: 175502 - RNA, 22 nt, Human
guaaacaucagccacucuauuu

SEQ ID NO: 175503 - RNA, 22 nt, Human
ccaggugugauuucaucugagg

SEQ ID NO: 175504 - RNA, 19 nt, Human
aaaaacuuaguccagaaag

SEQ ID NO: 175505 - RNA, 22 nt, Human
guccaguguguuuaucuuggau

SEQ ID NO: 175506 - RNA, 22 nt, Human
ucaguaaaugguugcuguuauu

SEQ ID NO: 175507 - RNA, 22 nt, Human
aauuccaggcagaaaugugagu

SEQ ID NO: 175508 - RNA, 22 nt, Human
auuucuguaguccacauucuuu

SEQ ID NO: 175509 - RNA, 22 nt, Human
gucaacuugcaagaugcugggc

SEQ ID NO: 175510 - RNA, 22 nt, Human
ccagcuuuauagcuucaaagga

SEQ ID NO: 175511 - RNA, 22 nt, Human
auauuaggugcucaauacaugc

SEQ ID NO: 175512 - RNA, 22 nt, Human
aguccaguguguucuggcagca

SEQ ID NO: 175513 - RNA, 22 nt, Human
caugggggucuggacaacaggc

SEQ ID NO: 175514 - RNA, 20 nt, Human
uguuccaagcuaaugaauga

SEQ ID NO: 175515 - RNA, 22 nt, Human
auuauuguacuuucaauaaggu

SEQ ID NO: 175516 - RNA, 22 nt, Human
agcugcaagucuguguggggag

SEQ ID NO: 175517 - RNA, 22 nt, Human
uuuugcuugagugcacaaaaug

SEQ ID NO: 175518 - RNA, 20 nt, Human
ucuaaaguacaguuugugug

SEQ ID NO: 175519 - RNA, 22 nt, Human
cauaauuacugauaugcugauu

SEQ ID NO: 175520 - RNA, 22 nt, Human
cuuuauggaaucaaagacugga

SEQ ID NO: 175521 - RNA, 22 nt, Human
aagucacccuagggccuggacu

SEQ ID NO: 175522 - RNA, 22 nt, Human
auuuauuggaugcuuacuuggg

SEQ ID NO: 175523 - RNA, 22 nt, Human
gcagcuuuaaaggaggcucuga

SEQ ID NO: 175524 - RNA, 22 nt, Human
aauugcuuguuucuuuaacuga

SEQ ID NO: 175525 - RNA, 22 nt, Human
caugguuuugagccuauuaugc

SEQ ID NO: 175526 - RNA, 22 nt, Human
uccaggcaugucugaguccuuc

SEQ ID NO: 175527 - RNA, 22 nt, Human
ccagguguccccgucacugcag

SEQ ID NO: 175528 - RNA, 22 nt, Human
gacagacacagggccaugauug

SEQ ID NO: 175529 - RNA, 22 nt, Human
uggcauuuggcuuacuuauguu

SEQ ID NO: 175530 - RNA, 17 nt, Human
gggcagggacuccuggg

SEQ ID NO: 175531 - RNA, 23 nt, Human
ucagggacaugaugugucauauc

SEQ ID NO: 175532 - RNA, 22 nt, Human
ccagguggaggugugagguccu

SEQ ID NO: 175533 - RNA, 22 nt, Human
aggauuuaccuccagcuaggcu

SEQ ID NO: 175534 - RNA, 22 nt, Human
aaucucuugggaggaaugaauu

SEQ ID NO: 175535 - RNA, 22 nt, Human
aguugacauccauaacaggaag

SEQ ID NO: 175536 - RNA, 21 nt, Human
cuguccaguaauuccuggcac

SEQ ID NO: 175537 - RNA, 22 nt, Human
agcugaaucucaggcauccuuu

SEQ ID NO: 175538 - RNA, 22 nt, Human
cuggagugacuuuguuccuuuu

SEQ ID NO: 175539 - RNA, 22 nt, Human
uuuuauagcugaauaguauucc

SEQ ID NO: 175540 - RNA, 22 nt, Human
acagaaugggauuugaauauuu

SEQ ID NO: 175541 - RNA, 22 nt, Human
uuuuuugucuugaagaaauggu

SEQ ID NO: 175542 - RNA, 22 nt, Human
ugcauaaacagauacuucaugu

SEQ ID NO: 175543 - RNA, 22 nt, Human
gcugccagucuaaugggaaaca

SEQ ID NO: 175544 - RNA, 22 nt, Human
uugaucaaaucagcuacugagg

SEQ ID NO: 175545 - RNA, 22 nt, Human
uuuaucuggacugugauauaaa

SEQ ID NO: 175546 - RNA, 22 nt, Human
cuuaggcagggcuggaagaucu

SEQ ID NO: 175547 - RNA, 22 nt, Human
aaaacaggugucagcaaacuau

SEQ ID NO: 175548 - RNA, 22 nt, Human
gaguucuaaaggcagaacauaa

SEQ ID NO: 175549 - RNA, 22 nt, Human
auggaucagaaucccgggaggg

SEQ ID NO: 175550 - RNA, 22 nt, Human
agccauuuuccugaaauauaac

SEQ ID NO: 175551 - RNA, 22 nt, Human
ggaaguuguaugaucggggaau

SEQ ID NO: 175552 - RNA, 22 nt, Human
gcagguggauuaucagaagugc

SEQ ID NO: 175553 - RNA, 22 nt, Human
ugcagggcaucuuugaagugug

SEQ ID NO: 175554 - RNA, 22 nt, Human
uguccuuaaggagcuuaauguc

SEQ ID NO: 175555 - RNA, 22 nt, Human
uuuaaugaauaauucaaaucug

SEQ ID NO: 175556 - RNA, 22 nt, Human
cauuuauuggcauguaguaggu

SEQ ID NO: 175557 - RNA, 22 nt, Human
gugggugucaguaucuuuaacg

SEQ ID NO: 175558 - RNA, 22 nt, Human
ggcucugggccuccaaggucug

SEQ ID NO: 175559 - RNA, 22 nt, Human
ucaagagaaggggaaauagacu

SEQ ID NO: 175560 - RNA, 22 nt, Human
uacauauacugagugauuugcu

SEQ ID NO: 175561 - RNA, 22 nt, Human
auguaaauuguacugacacacg

SEQ ID NO: 175562 - RNA, 22 nt, Human
gcaggcagagguggaggagaca

SEQ ID NO: 175563 - RNA, 22 nt, Human
agcagggccaacaguaaacacc

SEQ ID NO: 175564 - RNA, 22 nt, Human
aggacaugugccuccagggcag

SEQ ID NO: 175565 - RNA, 22 nt, Human
uacauguggguuaaaaacacuc

SEQ ID NO: 175566 - RNA, 22 nt, Human
ggaggcaggaaagacagguuca

SEQ ID NO: 175567 - RNA, 22 nt, Human
gauugcugggucccacucccag

SEQ ID NO: 175568 - RNA, 22 nt, Human
ugucuuuaaaauuaaacacauc

SEQ ID NO: 175569 - RNA, 22 nt, Human
uccaggcagggcagccaucaag

SEQ ID NO: 175570 - RNA, 22 nt, Human
uuucaaagucaagaaggauacu

SEQ ID NO: 175571 - RNA, 22 nt, Human
gcaguggcuaagcucgcaugca

SEQ ID NO: 175572 - RNA, 22 nt, Human
acacuuuacucuuacaccauug

SEQ ID NO: 175573 - RNA, 22 nt, Human
uaugcugugcuagauacaauau

SEQ ID NO: 175574 - RNA, 22 nt, Human
acagcaggauuuggcgauguug

SEQ ID NO: 175575 - RNA, 22 nt, Human
gggugggagaaaugaguaucua

SEQ ID NO: 175576 - RNA, 22 nt, Human
cuuucuuugcagugagccagag

SEQ ID NO: 175577 - RNA, 22 nt, Human
ugucaccaaguugaugaaugca

SEQ ID NO: 175578 - RNA, 22 nt, Human
aucuguaaagauaaucauaugu

SEQ ID NO: 175579 - RNA, 22 nt, Human
auucaacggguagaagggucuu

SEQ ID NO: 175580 - RNA, 20 nt, Human
ucccaaggaugccugggugu

SEQ ID NO: 175581 - RNA, 22 nt, Human
ccuucuccugccuuggguucau

SEQ ID NO: 175582 - RNA, 21 nt, Human
acauguaagagaguuucaaga

SEQ ID NO: 175583 - RNA, 22 nt, Human
ucaagagauugaauaauaacug

SEQ ID NO: 175584 - RNA, 22 nt, Human
cccaaggccuucaagccagcuc

SEQ ID NO: 175585 - RNA, 19 nt, Human
ccagagacauuggcaucuu

SEQ ID NO: 175586 - RNA, 22 nt, Human
uugaauaauuaauuacacucag

SEQ ID NO: 175587 - RNA, 21 nt, Human
aauuacagauggaauuacaga

SEQ ID NO: 175588 - RNA, 22 nt, Human
cagauuuaccuaacuccaaguu

SEQ ID NO: 175589 - RNA, 22 nt, Human
acaaaguccugguguauggcca

SEQ ID NO: 175590 - RNA, 22 nt, Human
uccugcagcugcagaccugggg

SEQ ID NO: 175591 - RNA, 22 nt, Human
aauauucaaguuauucuuucuu

SEQ ID NO: 175592 - RNA, 22 nt, Human
ggggaccuucccagagcaguug

SEQ ID NO: 175593 - RNA, 22 nt, Human
cuugggugcuggaggcugccgc

SEQ ID NO: 175594 - RNA, 21 nt, Human
cagaggcaggcucugugugug

SEQ ID NO: 175595 - RNA, 22 nt, Human
cgggcuccgggucuuugcaguc

SEQ ID NO: 175596 - RNA, 20 nt, Human
ugcagggcugccucccagcu

SEQ ID NO: 175597 - RNA, 22 nt, Human
cauuuacagugagaguuuuuac

SEQ ID NO: 175598 - RNA, 22 nt, Human
ccuggaggagcgcugaccagcu

SEQ ID NO: 175599 - RNA, 22 nt, Human
uguccuuuucuuuagugcagcu

SEQ ID NO: 175600 - RNA, 22 nt, Human
ucccaaggugcucggcaacagg

SEQ ID NO: 175601 - RNA, 22 nt, Human
uggcuuuacacauccacugccu

SEQ ID NO: 175602 - RNA, 22 nt, Human
cuauacaguaaccacagugauu

SEQ ID NO: 175603 - RNA, 22 nt, Human
acagguggccccgagggagugg

SEQ ID NO: 175604 - RNA, 22 nt, Human
gggcagguggagggcccagcca

SEQ ID NO: 175605 - RNA, 22 nt, Human
uccugcagccuugggcuggagc

SEQ ID NO: 175606 - RNA, 22 nt, Human
ucaaauaccagcaauuucaugu

SEQ ID NO: 175607 - RNA, 22 nt, Human
aggacaguguggaagagggugc

SEQ ID NO: 175608 - RNA, 19 nt, Human
cauguuaugcuguaguauc

SEQ ID NO: 175609 - RNA, 22 nt, Human
uuuuucaucugauugauaacuc

SEQ ID NO: 175610 - RNA, 22 nt, Human
gcaaaauuuacacuccuucuuc

SEQ ID NO: 175611 - RNA, 22 nt, Human
ccagccacagcuuccagcuccu

SEQ ID NO: 175612 - RNA, 22 nt, Human
caggugguacuuaaagucagaa

SEQ ID NO: 175613 - RNA, 22 nt, Human
cuucauuaaugucuauaaguuu

SEQ ID NO: 175614 - RNA, 22 nt, Human
guuggcaaguguuccuuccucu

SEQ ID NO: 175615 - RNA, 22 nt, Human
gcauguguugguuuaugcaugu

SEQ ID NO: 175616 - RNA, 22 nt, Human
guacagaaaugugaugacgcaa

SEQ ID NO: 175617 - RNA, 22 nt, Human
caugauaauuguuaacaaagua

SEQ ID NO: 175618 - RNA, 22 nt, Human
ccaugagcuuccuauauagggu

SEQ ID NO: 175619 - RNA, 22 nt, Human
uagcugaugaauaauuauucuu

SEQ ID NO: 175620 - RNA, 22 nt, Human
acauuuuuauucaucaaagcag

SEQ ID NO: 175621 - RNA, 22 nt, Human
aagccagauuucacucuuaauu

SEQ ID NO: 175622 - RNA, 22 nt, Human
acaggacaggcugggcuagacu

SEQ ID NO: 175623 - RNA, 22 nt, Human
ugaagaauaagauagauggagc

SEQ ID NO: 175624 - RNA, 22 nt, Human
ucucuuaauuuuggaauagugu

SEQ ID NO: 175625 - RNA, 22 nt, Human
guauuacaaauaaauguuacug

SEQ ID NO: 175626 - RNA, 22 nt, Human
gggugguggccagcagugggca

SEQ ID NO: 175627 - RNA, 22 nt, Human
agaaaauuagauuuuacugugu

SEQ ID NO: 175628 - RNA, 22 nt, Human
ugcagggauuguuggcauccau

SEQ ID NO: 175629 - RNA, 22 nt, Human
uguaaaaccaaaucaaucuagu

SEQ ID NO: 175630 - RNA, 22 nt, Human
cauguguccacccuugaacaca

SEQ ID NO: 175631 - RNA, 22 nt, Human
uugcucauauuugcauguguuu

SEQ ID NO: 175632 - RNA, 22 nt, Human
uuucuuuugcccuguggguuag

SEQ ID NO: 175633 - RNA, 22 nt, Human
acauuguaaauaccuuuaucac

SEQ ID NO: 175634 - RNA, 22 nt, Human
gaacuuggaacuggggcuacug

SEQ ID NO: 175635 - RNA, 22 nt, Human
ugugugcuaauguaugcucuaa

SEQ ID NO: 175636 - RNA, 22 nt, Human
caucagaaggaaggacgauuau

SEQ ID NO: 175637 - RNA, 22 nt, Human
ccugcagguugcagaggcggaa

SEQ ID NO: 175638 - RNA, 21 nt, Human
uguuuuccaccuugaggcaag

SEQ ID NO: 175639 - RNA, 21 nt, Human
uuuaaagaauaggaagggagg

SEQ ID NO: 175640 - RNA, 22 nt, Human
acuggguguauuagugguguuu

SEQ ID NO: 175641 - RNA, 22 nt, Human
augugguugaagaauuacaucu

SEQ ID NO: 175642 - RNA, 22 nt, Human
uuugcaaauaccaugaaacuug

SEQ ID NO: 175643 - RNA, 22 nt, Human
ugggccagcacugggugcucau

SEQ ID NO: 175644 - RNA, 21 nt, Human
aagaugauauuuuaucuguag

SEQ ID NO: 175645 - RNA, 22 nt, Human
gacccaggguauccagagcugc

SEQ ID NO: 175646 - RNA, 22 nt, Human
aauacugagaucccacaaagca

SEQ ID NO: 175647 - RNA, 22 nt, Human
uuuuagcacuaagugauaugcu

SEQ ID NO: 175648 - RNA, 22 nt, Human
uucaaauacauucuuugccacu

SEQ ID NO: 175649 - RNA, 22 nt, Human
cuacugaguccuucagcugcca

SEQ ID NO: 175650 - RNA, 22 nt, Human
uccaugguuucagucuggcugg

SEQ ID NO: 175651 - RNA, 22 nt, Human
auuccaaagcacaucagaacua

SEQ ID NO: 175652 - RNA, 23 nt, Human
uggaauguuucuuguacugaaug

SEQ ID NO: 175653 - RNA, 22 nt, Human
gcccaggcuggagugcaguagc

SEQ ID NO: 175654 - RNA, 22 nt, Human
auuaagggccaauccuccagcc

SEQ ID NO: 175655 - RNA, 22 nt, Human
auuucaguguuuuaagaguuca

SEQ ID NO: 175656 - RNA, 22 nt, Human
agcagggcagugaucagaaagg

SEQ ID NO: 175657 - RNA, 22 nt, Human
ugagauuuguuuuauaaaauag

SEQ ID NO: 175658 - RNA, 22 nt, Human
uuuaauuugaaaugaguaaccc

SEQ ID NO: 175659 - RNA, 22 nt, Human
auagaauucguguuuguaauuc

SEQ ID NO: 175660 - RNA, 21 nt, Human
ugaucauuuguguaaaggaga

SEQ ID NO: 175661 - RNA, 21 nt, Human
uguaaguuucaucugaauugg

SEQ ID NO: 175662 - RNA, 22 nt, Human
uuugaacugauaaucuucuguu

SEQ ID NO: 175663 - RNA, 22 nt, Human
acauacauauguuuaaaugcau

SEQ ID NO: 175664 - RNA, 22 nt, Human
cuucguuuuuaguagcaauguu

SEQ ID NO: 175665 - RNA, 22 nt, Human
ucagggcauucaagaggccugg

SEQ ID NO: 175666 - RNA, 22 nt, Human
aaggcauaccugaauguuugug

SEQ ID NO: 175667 - RNA, 22 nt, Human
uuauuuaaaagugguaagauuc

SEQ ID NO: 175668 - RNA, 22 nt, Human
ggcaccagccaccuauuucuag

SEQ ID NO: 175669 - RNA, 22 nt, Human
cauaaguuggguaauauaauga

SEQ ID NO: 175670 - RNA, 22 nt, Human
guacauaaaggaggcucuuugc

SEQ ID NO: 175671 - RNA, 22 nt, Human
uuuaauauuucuuuccugaagc

SEQ ID NO: 175672 - RNA, 23 nt, Human
aaugauuucaugaugauagcagc

SEQ ID NO: 175673 - RNA, 22 nt, Human
ggaacaggaaaggagggaugcu

SEQ ID NO: 175674 - RNA, 22 nt, Human
auguuauaguuauaaaaugagg

SEQ ID NO: 175675 - RNA, 22 nt, Human
aagaguggagcuggaaaguggg

SEQ ID NO: 175676 - RNA, 22 nt, Human
aauugcuucauuaacauuuagg

SEQ ID NO: 175677 - RNA, 22 nt, Human
cccagugucucuugugccuuuc

SEQ ID NO: 175678 - RNA, 22 nt, Human
agcuucuuggcucagcacuugg

SEQ ID NO: 175679 - RNA, 22 nt, Human
auuuccauuuucagccauuacu

SEQ ID NO: 175680 - RNA, 22 nt, Human
uggaccugcguaggugcugggc

SEQ ID NO: 175681 - RNA, 22 nt, Human
uggcagguagaguucugagaug

SEQ ID NO: 175682 - RNA, 22 nt, Human
gcagguggagcaguagucuggu

SEQ ID NO: 175683 - RNA, 22 nt, Human
cuccagggaugagacagaguag

SEQ ID NO: 175684 - RNA, 22 nt, Human
uggcagugggaagcuggaaguc

SEQ ID NO: 175685 - RNA, 22 nt, Human
auucugauaucuuauucuagcu

SEQ ID NO: 175686 - RNA, 22 nt, Human
uucuaccuacccucugcauaca

SEQ ID NO: 175687 - RNA, 22 nt, Human
cugaauaauguucucuuguaug

SEQ ID NO: 175688 - RNA, 22 nt, Human
uuaguucucaugaauuuuaagu

SEQ ID NO: 175689 - RNA, 22 nt, Human
agcagggcuggggcacgagcca

SEQ ID NO: 175690 - RNA, 22 nt, Human
uagaugcuguagaaauacuuau

SEQ ID NO: 175691 - RNA, 22 nt, Human
uuauuuuuaaaaguucacacag

SEQ ID NO: 175692 - RNA, 22 nt, Human
aaaucaguuagugguaggauug

SEQ ID NO: 175693 - RNA, 22 nt, Human
aauaauuauuugagagcagacc

SEQ ID NO: 175694 - RNA, 22 nt, Human
cuucuucaagagaaugggagac

SEQ ID NO: 175695 - RNA, 22 nt, Human
ucagucuuugcuuaugacaaua

SEQ ID NO: 175696 - RNA, 22 nt, Human
aauuagggaaaauuuacuugua

SEQ ID NO: 175697 - RNA, 22 nt, Human
uuucagacagauucuucucagu

SEQ ID NO: 175698 - RNA, 22 nt, Human
uggaauuuaguuaauuccauuu

SEQ ID NO: 175699 - RNA, 19 nt, Human
aaagcagaggagcaucuga

SEQ ID NO: 175700 - RNA, 22 nt, Human
uaguccuuuccggcugcuauaa

SEQ ID NO: 175701 - RNA, 21 nt, Human
uacagaaugcgcuucagucug

SEQ ID NO: 175702 - RNA, 22 nt, Human
uaucagaaggaagugccuuuaa

SEQ ID NO: 175703 - RNA, 22 nt, Human
uuggaucaaauuucaugcuguc

SEQ ID NO: 175704 - RNA, 22 nt, Human
uaagagaacuggauagauagga

SEQ ID NO: 175705 - RNA, 22 nt, Human
aauauccacacugugucccugc

SEQ ID NO: 175706 - RNA, 22 nt, Human
ucagggacagggugcugcugcg

SEQ ID NO: 175707 - RNA, 22 nt, Human
gucucuaucauagcugaacccu

SEQ ID NO: 175708 - RNA, 18 nt, Human
ucuuccaacacugacacc

SEQ ID NO: 175709 - RNA, 22 nt, Human
ccaaguacucucaccaaagcuu

SEQ ID NO: 175710 - RNA, 22 nt, Human
cucugcccucacuuggggccug

SEQ ID NO: 175711 - RNA, 22 nt, Human
uuauucuucuucucuugccagg

SEQ ID NO: 175712 - RNA, 22 nt, Human
ugucaaagacagaaggaaaugg

SEQ ID NO: 175713 - RNA, 22 nt, Human
ugcuggagaugaaagggcccug

SEQ ID NO: 175714 - RNA, 22 nt, Human
uacauaaugagcuaguuaaguu

SEQ ID NO: 175715 - RNA, 22 nt, Human
agaucauaugaaaaauuucaag

SEQ ID NO: 175716 - RNA, 22 nt, Human
gggaacuugccccagaggaauu

SEQ ID NO: 175717 - RNA, 22 nt, Human
augcuuuuaugucacaugguca

SEQ ID NO: 175718 - RNA, 22 nt, Human
uguuuucuuccuaauugcucau

SEQ ID NO: 175719 - RNA, 22 nt, Human
aggcagguuucccggcugucaa

SEQ ID NO: 175720 - RNA, 22 nt, Human
uaagaauuaucucauggauaau

SEQ ID NO: 175721 - RNA, 22 nt, Human
ucuccgaucacagguuuucaau

SEQ ID NO: 175722 - RNA, 22 nt, Human
uacaaaaaauugauacugacga

SEQ ID NO: 175723 - RNA, 22 nt, Human
uauugcugcuauugucaguuca

SEQ ID NO: 175724 - RNA, 22 nt, Human
uuuguagauucauugaacuuuu

SEQ ID NO: 175725 - RNA, 21 nt, Human
ucagaacuggugcagaugaau

SEQ ID NO: 175726 - RNA, 22 nt, Human
cagaugaaguaggugacgagca

SEQ ID NO: 175727 - RNA, 22 nt, Human
ugacaggucauauaagcuugca

SEQ ID NO: 175728 - RNA, 22 nt, Human
cuggcacugaguggcuuaugac

SEQ ID NO: 175729 - RNA, 22 nt, Human
cugggugaguugaugaaggaga

SEQ ID NO: 175730 - RNA, 22 nt, Human
uuucauaauagugcaguuuguu

SEQ ID NO: 175731 - RNA, 22 nt, Human
gccugggugaauuugauccuaa

SEQ ID NO: 175732 - RNA, 22 nt, Human
uuugcagugucagcuucugugu

SEQ ID NO: 175733 - RNA, 22 nt, Human
gguggggcucagcaaucugugu

SEQ ID NO: 175734 - RNA, 22 nt, Human
gcagacaggggcuuaggaaagg

SEQ ID NO: 175735 - RNA, 22 nt, Human
gguguccucaugauuuucuaga

SEQ ID NO: 175736 - RNA, 22 nt, Human
ugacugaaggacuagauugauu

SEQ ID NO: 175737 - RNA, 22 nt, Human
guucuguacuccaagcucuucc

SEQ ID NO: 175738 - RNA, 20 nt, Human
uugagcuuuuaguacagaca

SEQ ID NO: 175739 - RNA, 22 nt, Human
aaacaugaauagauauuaaaca

SEQ ID NO: 175740 - RNA, 22 nt, Human
acaugauauuaaugucuuauuu

SEQ ID NO: 175741 - RNA, 22 nt, Human
uuaauaaacaggugcagcugaa

SEQ ID NO: 175742 - RNA, 22 nt, Human
uguuccaagcugcuggauaagc

SEQ ID NO: 175743 - RNA, 22 nt, Human
cucugcccccagcuggugcuug

SEQ ID NO: 175744 - RNA, 22 nt, Human
accaggcaaaaccacaggagca

SEQ ID NO: 175745 - RNA, 22 nt, Human
gugaauaaccuacuccaggccu

SEQ ID NO: 175746 - RNA, 22 nt, Human
gcaaguacaaacgcaucggcug

SEQ ID NO: 175747 - RNA, 22 nt, Human
aggaccugaaauucuugcuuuu

SEQ ID NO: 175748 - RNA, 22 nt, Human
ucuuuccaaggacucuguagca

SEQ ID NO: 175749 - RNA, 22 nt, Human
auucuaacacaugcucuaagaa

SEQ ID NO: 175750 - RNA, 22 nt, Human
gaucagaaugggacauauccug

SEQ ID NO: 175751 - RNA, 22 nt, Human
gaaagccaucuggcugcuggga

SEQ ID NO: 175752 - RNA, 22 nt, Human
caugaggugauaaagcugggau

SEQ ID NO: 175753 - RNA, 22 nt, Human
auugcugaaaugaaaggauaug

SEQ ID NO: 175754 - RNA, 22 nt, Human
uucuggguggccaguauuuaga

SEQ ID NO: 175755 - RNA, 22 nt, Human
uguccuauuucucugugcauga

SEQ ID NO: 175756 - RNA, 22 nt, Human
aauguugaggauaucagaaaau

SEQ ID NO: 175757 - RNA, 22 nt, Human
ucagaaaugaucguuauucauu

SEQ ID NO: 175758 - RNA, 21 nt, Human
aaauuucugcaagccucaacu

SEQ ID NO: 175759 - RNA, 22 nt, Human
uacaugugcuggguucuuggcc

SEQ ID NO: 175760 - RNA, 22 nt, Human
aauugcuuuucaaggguacagc

SEQ ID NO: 175761 - RNA, 22 nt, Human
aauuagggagccaucauaaggu

SEQ ID NO: 175762 - RNA, 22 nt, Human
acagggcagguggcuacugguc

SEQ ID NO: 175763 - RNA, 22 nt, Human
caauuuuuuccaugcucuuaca

SEQ ID NO: 175764 - RNA, 22 nt, Human
aagggcuccauccuuauaaaug

SEQ ID NO: 175765 - RNA, 22 nt, Human
gagggcucugaaaggaggucac

SEQ ID NO: 175766 - RNA, 22 nt, Human
cgaggcagggaagcugcaaaag

SEQ ID NO: 175767 - RNA, 22 nt, Human
agcagguguaucggucaccuac

SEQ ID NO: 175768 - RNA, 22 nt, Human
gcucucuugguggcuguccugg

SEQ ID NO: 175769 - RNA, 22 nt, Human
ccagcugucagugugaaaauaa

SEQ ID NO: 175770 - RNA, 23 nt, Human
cuguccuguaguucacguuggcc

SEQ ID NO: 175771 - RNA, 22 nt, Human
cugauagacaaucaccauggga

SEQ ID NO: 175772 - RNA, 22 nt, Human
gugaccauaauagauuaugagu

SEQ ID NO: 175773 - RNA, 22 nt, Human
uuugacucauuaaagucuccgu

SEQ ID NO: 175774 - RNA, 22 nt, Human
cuucuucacacuggucugaagc

SEQ ID NO: 175775 - RNA, 22 nt, Human
uugugcaauuuaaaaucuuccu

SEQ ID NO: 175776 - RNA, 22 nt, Human
aagggcaggagaagacggauau

SEQ ID NO: 175777 - RNA, 22 nt, Human
cuguguccuuuuaguugcugug

SEQ ID NO: 175778 - RNA, 22 nt, Human
gugguggaugucuguaaucuca

SEQ ID NO: 175779 - RNA, 22 nt, Human
uuuucaguaaugucuacauaau

SEQ ID NO: 175780 - RNA, 22 nt, Human
uuccagaaaucuuucagcucaa

SEQ ID NO: 175781 - RNA, 22 nt, Human
cuuaggcaagcagagcccaucc

SEQ ID NO: 175782 - RNA, 22 nt, Human
augacagaggagugcaggugau

SEQ ID NO: 175783 - RNA, 22 nt, Human
cugauacauaguagcaugucau

SEQ ID NO: 175784 - RNA, 22 nt, Human
aggaggaaagaaggcccccagc

SEQ ID NO: 175785 - RNA, 22 nt, Human
uuucuucauucaccuucacccc

SEQ ID NO: 175786 - RNA, 22 nt, Human
ccagggcagaaaaagagggaau

SEQ ID NO: 175787 - RNA, 22 nt, Human
caccagacagguguaugcauau

SEQ ID NO: 175788 - RNA, 22 nt, Human
acaaaugugucuaauugugccu

SEQ ID NO: 175789 - RNA, 19 nt, Human
uuugugaagaaaaugaugc

SEQ ID NO: 175790 - RNA, 22 nt, Human
uguguccuuaugaaaauacugu

SEQ ID NO: 175791 - RNA, 22 nt, Human
ccaaguacagauuccuccacug

SEQ ID NO: 175792 - RNA, 22 nt, Human
auagcuuuacagaagaguuuag

SEQ ID NO: 175793 - RNA, 22 nt, Human
uuucaaaauuuugcagugguaa

SEQ ID NO: 175794 - RNA, 22 nt, Human
uagaaacagcauauauuagccc

SEQ ID NO: 175795 - RNA, 22 nt, Human
ugcuuuauuaagagagaaauuu

SEQ ID NO: 175796 - RNA, 20 nt, Human
agaaucugacccagagagac

SEQ ID NO: 175797 - RNA, 22 nt, Human
gcaugcagacagucugagacca

SEQ ID NO: 175798 - RNA, 22 nt, Human
uccaguuuacaggguugcuuuu

SEQ ID NO: 175799 - RNA, 22 nt, Human
gaauguaaaauugccuacaaga

SEQ ID NO: 175800 - RNA, 22 nt, Human
ucuguucaucucaugggagaau

SEQ ID NO: 175801 - RNA, 22 nt, Human
gcaggcagaucaccugucagga

SEQ ID NO: 175802 - RNA, 22 nt, Human
uauggcuuuuaacugucguaug

SEQ ID NO: 175803 - RNA, 22 nt, Human
cagggcaggaauuugacauugc

SEQ ID NO: 175804 - RNA, 22 nt, Human
uaauuucagugggcucugggcu

SEQ ID NO: 175805 - RNA, 22 nt, Human
cuccagugcacccagaggauuu

SEQ ID NO: 175806 - RNA, 22 nt, Human
gagcaguaggagaacccugagc

SEQ ID NO: 175807 - RNA, 22 nt, Human
cugaaggagaaggccacuguuc

SEQ ID NO: 175808 - RNA, 22 nt, Human
acagauuuuauuauucagguau

SEQ ID NO: 175809 - RNA, 22 nt, Human
cauuuguaucugggcugcugug

SEQ ID NO: 175810 - RNA, 22 nt, Human
agccaacuaggagauuaaggua

SEQ ID NO: 175811 - RNA, 22 nt, Human
cacacacaguuuuguauucugu

SEQ ID NO: 175812 - RNA, 22 nt, Human
cauuuugugcuagacacuaugg

SEQ ID NO: 175813 - RNA, 22 nt, Human
gcaugugugagaccuuuuagca

SEQ ID NO: 175814 - RNA, 22 nt, Human
cagggcuccccgcaccgcagcc

SEQ ID NO: 175815 - RNA, 22 nt, Human
gaauuucaagcagugcaauguu

SEQ ID NO: 175816 - RNA, 22 nt, Human
acaauaguaagguauauuguca

SEQ ID NO: 175817 - RNA, 22 nt, Human
gacaugugagcaagcgugcggc

SEQ ID NO: 175818 - RNA, 22 nt, Human
auagaauuauggaaagcaucuu

SEQ ID NO: 175819 - RNA, 21 nt, Human
auaagcaugcugauuacauuu

SEQ ID NO: 175820 - RNA, 23 nt, Human
ccagugauugccuggaaggaggu

SEQ ID NO: 175821 - RNA, 22 nt, Human
ccucuuccagcuguugcuucca

SEQ ID NO: 175822 - RNA, 22 nt, Human
ggcuuuugaauuccaaggcauu

SEQ ID NO: 175823 - RNA, 18 nt, Human
gcucuggcucaccuccag

SEQ ID NO: 175824 - RNA, 22 nt, Human
uccaggcacagaguuggucagu

SEQ ID NO: 175825 - RNA, 22 nt, Human
gcuggagggguaauaggauggg

SEQ ID NO: 175826 - RNA, 22 nt, Human
cacagguggcuucuuucaucuu

SEQ ID NO: 175827 - RNA, 22 nt, Human
aagucacauucugagguauugg

SEQ ID NO: 175828 - RNA, 22 nt, Human
aggcucagaggugagcaucugc

SEQ ID NO: 175829 - RNA, 22 nt, Human
cagcuuuuuagaaucuagggca

SEQ ID NO: 175830 - RNA, 22 nt, Human
agacaggcuuugcuguauauca

SEQ ID NO: 175831 - RNA, 22 nt, Human
uccucuggcucuuucccuagga

SEQ ID NO: 175832 - RNA, 22 nt, Human
uucuucagagaguagaagcaag

SEQ ID NO: 175833 - RNA, 16 nt, Human
uuauugaggccaagga

SEQ ID NO: 175834 - RNA, 22 nt, Human
acuauacauugaauguuaaggu

SEQ ID NO: 175835 - RNA, 22 nt, Human
ccagagagagaggucaauggca

SEQ ID NO: 175836 - RNA, 22 nt, Human
cugccugcaugcugccauagcu

SEQ ID NO: 175837 - RNA, 22 nt, Human
aaacacaccuuuggaacuguga

SEQ ID NO: 175838 - RNA, 22 nt, Human
aauuguaagugcugaguuaagg

SEQ ID NO: 175839 - RNA, 22 nt, Human
ugcuuuaacauaagauaucuuu

SEQ ID NO: 175840 - RNA, 22 nt, Human
cccaggcacaccccgaacggaa

SEQ ID NO: 175841 - RNA, 22 nt, Human
gugauuuaguguuaaguauguu

SEQ ID NO: 175842 - RNA, 22 nt, Human
cagcuucuccggccuggugcgg

SEQ ID NO: 175843 - RNA, 22 nt, Human
ugugaaaagggcuuuguacaaa

SEQ ID NO: 175844 - RNA, 22 nt, Human
uaucuauuauguucuauguguc

SEQ ID NO: 175845 - RNA, 22 nt, Human
aagucacaagcauauaugcauu

SEQ ID NO: 175846 - RNA, 22 nt, Human
gucugcccagaagacauccccu

SEQ ID NO: 175847 - RNA, 22 nt, Human
ucuggaucucccucauccuggg

SEQ ID NO: 175848 - RNA, 22 nt, Human
uagggacccucccugcucuaac

SEQ ID NO: 175849 - RNA, 22 nt, Human
uuucugauauacuguagaaucc

SEQ ID NO: 175850 - RNA, 22 nt, Human
caguccuuauuccuauauuccu

SEQ ID NO: 175851 - RNA, 22 nt, Human
cugugcagcuggcuuccuggaa

SEQ ID NO: 175852 - RNA, 19 nt, Human
ucuguucacauuguuucgc

SEQ ID NO: 175853 - RNA, 18 nt, Human
cuguucuagaacuccugu

SEQ ID NO: 175854 - RNA, 22 nt, Human
uaagaaucugcauuuuaacaag

SEQ ID NO: 175855 - RNA, 22 nt, Human
uaggcagaauuguugaaugaag

SEQ ID NO: 175856 - RNA, 22 nt, Human
uguguccuguccccuugcugcu

SEQ ID NO: 175857 - RNA, 22 nt, Human
uaaugucagcauaguuuauuuu

SEQ ID NO: 175858 - RNA, 22 nt, Human
gauaccagacagggagggagaa

SEQ ID NO: 175859 - RNA, 17 nt, Human
cucuggaauuggugaag

SEQ ID NO: 175860 - RNA, 22 nt, Human
auugcuugaauuaccauguaau

SEQ ID NO: 175861 - RNA, 22 nt, Human
ccugcaguuuguugugaccccg

SEQ ID NO: 175862 - RNA, 22 nt, Human
gucaggccaauacucuccagca

SEQ ID NO: 175863 - RNA, 18 nt, Human
acuguuaucugauaaggc

SEQ ID NO: 175864 - RNA, 22 nt, Human
ucucuucuuguguuuuccugcc

SEQ ID NO: 175865 - RNA, 21 nt, Human
aguaguuuagcacaggguuug

SEQ ID NO: 175866 - RNA, 21 nt, Human
agaaaaacacgauauaagccc

SEQ ID NO: 175867 - RNA, 22 nt, Human
caguguggugagauuccaggug

SEQ ID NO: 175868 - RNA, 22 nt, Human
uuuccuucuuagcgguguucuu

SEQ ID NO: 175869 - RNA, 22 nt, Human
aagcagggcuuuaagcgguuuu

SEQ ID NO: 175870 - RNA, 18 nt, Human
cagagcagagguggagcg

SEQ ID NO: 175871 - RNA, 22 nt, Human
guuucuuagguaaauucuuuga

SEQ ID NO: 175872 - RNA, 22 nt, Human
uauuccaagcacagcaacccag

SEQ ID NO: 175873 - RNA, 22 nt, Human
caggcagcugcuggguucagcc

SEQ ID NO: 175874 - RNA, 22 nt, Human
agcagggcuccugaaagccgcg

SEQ ID NO: 175875 - RNA, 22 nt, Human
uucuauugggcagcauugcuuc

SEQ ID NO: 175876 - RNA, 22 nt, Human
guuccaaaguuagaguguauug

SEQ ID NO: 175877 - RNA, 21 nt, Human
ugcauaaagaaauacaaauac

SEQ ID NO: 175878 - RNA, 22 nt, Human
uuauugagagcuguuuuauggc

SEQ ID NO: 175879 - RNA, 22 nt, Human
caaauacuaaacauaagauuuu

SEQ ID NO: 175880 - RNA, 22 nt, Human
ucaaaaauguuuuauauuggua

SEQ ID NO: 175881 - RNA, 22 nt, Human
uaauaaacugcuacgcuuaguu

SEQ ID NO: 175882 - RNA, 22 nt, Human
ggcaggcacauuugggggccgu

SEQ ID NO: 175883 - RNA, 22 nt, Human
uuccuuaggcuguuugcagugc

SEQ ID NO: 175884 - RNA, 22 nt, Human
gucacuguauccagguuccagc

SEQ ID NO: 175885 - RNA, 22 nt, Human
aauauuucugcagaaugguuuu

SEQ ID NO: 175886 - RNA, 22 nt, Human
acagguguguucccggaaagcc

SEQ ID NO: 175887 - RNA, 22 nt, Human
cucagagagggcaccagggcca

SEQ ID NO: 175888 - RNA, 22 nt, Human
aguaaacauagaauguucuucc

SEQ ID NO: 175889 - RNA, 18 nt, Human
cuguccaguagacucugc

SEQ ID NO: 175890 - RNA, 22 nt, Human
cuggcucuaucuccaaggcugg

SEQ ID NO: 175891 - RNA, 22 nt, Human
cauuagggacugaggaauaagg

SEQ ID NO: 175892 - RNA, 22 nt, Human
gggaaugugaaacaguaaggga

SEQ ID NO: 175893 - RNA, 22 nt, Human
gcuggguggaucggaggcucug

SEQ ID NO: 175894 - RNA, 22 nt, Human
ugagggagucaugauuaaggaa

SEQ ID NO: 175895 - RNA, 22 nt, Human
cuguccugagauaaagaugagg

SEQ ID NO: 175896 - RNA, 22 nt, Human
ucuggaggccauagggaaggau

SEQ ID NO: 175897 - RNA, 17 nt, Human
uccaggcauaucuccua

SEQ ID NO: 175898 - RNA, 22 nt, Human
ucgagcucuggagccaaggaug

SEQ ID NO: 175899 - RNA, 22 nt, Human
cuuuaguuuaagaacaugauga

SEQ ID NO: 175900 - RNA, 22 nt, Human
gggucuggagggcagcccuucu

SEQ ID NO: 175901 - RNA, 22 nt, Human
uuucugcauauguauguaugga

SEQ ID NO: 175902 - RNA, 22 nt, Human
cagagagcaugggaggcccgag

SEQ ID NO: 175903 - RNA, 22 nt, Human
gcagguguggagaguggucggg

SEQ ID NO: 175904 - RNA, 22 nt, Human
uuaaacauuuauggaggcagca

SEQ ID NO: 175905 - RNA, 22 nt, Human
cagggccagagagggcuggcug

SEQ ID NO: 175906 - RNA, 22 nt, Human
cuucugugcuucacaguugcca

SEQ ID NO: 175907 - RNA, 22 nt, Human
acaagaauuuacauguagugga

SEQ ID NO: 175908 - RNA, 22 nt, Human
gcaaaauuaaacuuagcaucau

SEQ ID NO: 175909 - RNA, 22 nt, Human
gcaggcagagaaggaacauuua

SEQ ID NO: 175910 - RNA, 22 nt, Human
uuauuacacugaaagaauugcg

SEQ ID NO: 175911 - RNA, 22 nt, Human
uagaauaaguugaugauauaug

SEQ ID NO: 175912 - RNA, 21 nt, Human
uuucuggguggcugcauagug

SEQ ID NO: 175913 - RNA, 22 nt, Human
agacaucaaugaucagagguag

SEQ ID NO: 175914 - RNA, 22 nt, Human
auuuaaauuuucugauggagag

SEQ ID NO: 175915 - RNA, 22 nt, Human
cagggcagugaagaacacacgu

SEQ ID NO: 175916 - RNA, 22 nt, Human
uccugcugccauuucaagugcu

SEQ ID NO: 175917 - RNA, 22 nt, Human
aagauaaacucuugauuucuga

SEQ ID NO: 175918 - RNA, 22 nt, Human
guuauugacucucuuguggcuu

SEQ ID NO: 175919 - RNA, 20 nt, Human
aggagcugaauuagaggguu

SEQ ID NO: 175920 - RNA, 22 nt, Human
ccagcuuuggaguguuguugcu

SEQ ID NO: 175921 - RNA, 22 nt, Human
auuccaaagccugaauaaugga

SEQ ID NO: 175922 - RNA, 22 nt, Human
aagggcagagggaaucccacau

SEQ ID NO: 175923 - RNA, 22 nt, Human
acagguguacaaugcaugacag

SEQ ID NO: 175924 - RNA, 22 nt, Human
ucuuagauguuagcucugugug

SEQ ID NO: 175925 - RNA, 22 nt, Human
uuugauuuacuggauauucuca

SEQ ID NO: 175926 - RNA, 22 nt, Human
uauuccuauggccacugcuacu

SEQ ID NO: 175927 - RNA, 22 nt, Human
guuuacauguacucauuauacu

SEQ ID NO: 175928 - RNA, 18 nt, Human
uggcagguagacucaggu

SEQ ID NO: 175929 - RNA, 22 nt, Human
agagauggagagcacuggggcu

SEQ ID NO: 175930 - RNA, 19 nt, Human
uguccucacagagcauaac

SEQ ID NO: 175931 - RNA, 22 nt, Human
caggacagagcccagacugugu

SEQ ID NO: 175932 - RNA, 22 nt, Human
gccuggagggauagaaugcaag

SEQ ID NO: 175933 - RNA, 22 nt, Human
gaaguccuccuaucuugcucuu

SEQ ID NO: 175934 - RNA, 22 nt, Human
uaugccuggaaccuuucucuuu

SEQ ID NO: 175935 - RNA, 22 nt, Human
uggcauuucuguuagacucuca

SEQ ID NO: 175936 - RNA, 22 nt, Human
ggguggaagccagagaggucau

SEQ ID NO: 175937 - RNA, 22 nt, Human
ggagaggggcaaguuuaucuag

SEQ ID NO: 175938 - RNA, 22 nt, Human
ccuguucacuuugacuucucca

SEQ ID NO: 175939 - RNA, 22 nt, Human
uucagaaacagagugagugagu

SEQ ID NO: 175940 - RNA, 22 nt, Human
gugagacacgugugugaccugg

SEQ ID NO: 175941 - RNA, 22 nt, Human
uagcaucuggagaaacaagucc

SEQ ID NO: 175942 - RNA, 22 nt, Human
agcaggugaugugagucuggaa

SEQ ID NO: 175943 - RNA, 15 nt, Human
uugcuuuaagacaug

SEQ ID NO: 175944 - RNA, 22 nt, Human
uuuaucuguuguaccugcauug

SEQ ID NO: 175945 - RNA, 22 nt, Human
uauugguaucugagacagaguu

SEQ ID NO: 175946 - RNA, 22 nt, Human
gaaguccucaaugcauugucuu

SEQ ID NO: 175947 - RNA, 22 nt, Human
aaggugucggcagagccgcuuc

SEQ ID NO: 175948 - RNA, 22 nt, Human
uaagaaucggucgcaacagagg

SEQ ID NO: 175949 - RNA, 21 nt, Human
auuuucauuaauucagugugg

SEQ ID NO: 175950 - RNA, 22 nt, Human
acaguguagaauccuguacuua

SEQ ID NO: 175951 - RNA, 22 nt, Human
ccaggugugagcauucugucuu

SEQ ID NO: 175952 - RNA, 22 nt, Human
agccauccucccaccucagccu

SEQ ID NO: 175953 - RNA, 19 nt, Human
caguccuuuccgcuuucuc

SEQ ID NO: 175954 - RNA, 22 nt, Human
uuggagguuugaaaauaugugu

SEQ ID NO: 175955 - RNA, 22 nt, Human
acuaaagaagccaaaguuuucu

SEQ ID NO: 175956 - RNA, 22 nt, Human
gcagguggcagaggugggaucu

SEQ ID NO: 175957 - RNA, 22 nt, Human
gacuuuauuuccuuauuuguga

SEQ ID NO: 175958 - RNA, 22 nt, Human
aauuaggggaggacguaucaua

SEQ ID NO: 175959 - RNA, 22 nt, Human
uaguacuacguuuucuacuauc

SEQ ID NO: 175960 - RNA, 22 nt, Human
gaggcuggaggucaaagaugaa

SEQ ID NO: 175961 - RNA, 22 nt, Human
acaugauucuugauaggcauug

SEQ ID NO: 175962 - RNA, 22 nt, Human
gaugagguuuuugaaaugugga

SEQ ID NO: 175963 - RNA, 22 nt, Human
auagcuuuuugucauagagucu

SEQ ID NO: 175964 - RNA, 19 nt, Human
cagaaauagcgaaguguaa

SEQ ID NO: 175965 - RNA, 22 nt, Human
uucauuccuucuguaccuugcc

SEQ ID NO: 175966 - RNA, 22 nt, Human
aguguccugugucccagacugu

SEQ ID NO: 175967 - RNA, 22 nt, Human
ccugggucuauagacuucaaga

SEQ ID NO: 175968 - RNA, 22 nt, Human
uuugaaguaccugguucugacu

SEQ ID NO: 175969 - RNA, 22 nt, Human
guacaauagucccuguuuggau

SEQ ID NO: 175970 - RNA, 22 nt, Human
cuauuauuauguuaacuggacu

SEQ ID NO: 175971 - RNA, 22 nt, Human
uacuacaagggcccuaaaaggu

SEQ ID NO: 175972 - RNA, 22 nt, Human
cugggcugcaguuccugguccu

SEQ ID NO: 175973 - RNA, 22 nt, Human
agggcgacaauggagagcguuu

SEQ ID NO: 175974 - RNA, 22 nt, Human
uccaguaugacugauguccuuc

SEQ ID NO: 175975 - RNA, 22 nt, Human
guaguucugcagugucaccuga

SEQ ID NO: 175976 - RNA, 22 nt, Human
ugucccucugaggcuucccugg

SEQ ID NO: 175977 - RNA, 19 nt, Human
ugguggcaaugucagcuaa

SEQ ID NO: 175978 - RNA, 22 nt, Human
agccggccauguggucuugugc

SEQ ID NO: 175979 - RNA, 22 nt, Human
uuaacacuccuaacuacagucu

SEQ ID NO: 175980 - RNA, 22 nt, Human
ccaugugucgggccugcagugg

SEQ ID NO: 175981 - RNA, 19 nt, Human
guuucauuaagauaggaaa

SEQ ID NO: 175982 - RNA, 22 nt, Human
uaggugucuggacaacuuugua

SEQ ID NO: 175983 - RNA, 22 nt, Human
caaguccuccaugugacuaggu

SEQ ID NO: 175984 - RNA, 22 nt, Human
ggcagguggcacugcugcuccc

SEQ ID NO: 175985 - RNA, 22 nt, Human
uuaguuuucccaucuuuauggu

SEQ ID NO: 175986 - RNA, 22 nt, Human
uucuucaaacaaaaguggcaug

SEQ ID NO: 175987 - RNA, 23 nt, Human
auucuucauuaucuucuagaaaa

SEQ ID NO: 175988 - RNA, 22 nt, Human
ugagacaaccuaauuaaacacc

SEQ ID NO: 175989 - RNA, 22 nt, Human
acuuguucauugaguacauaug

SEQ ID NO: 175990 - RNA, 22 nt, Human
ugcaaaaacugcaauugcuuuu

SEQ ID NO: 175991 - RNA, 22 nt, Human
ggcugaguugagaggauuacuu

SEQ ID NO: 175992 - RNA, 22 nt, Human
caaguccaucagauaagcaaga

SEQ ID NO: 175993 - RNA, 22 nt, Human
caucagaagaaagacaaaugau

SEQ ID NO: 175994 - RNA, 22 nt, Human
uuuaauugauucacagucugua

SEQ ID NO: 175995 - RNA, 17 nt, Human
acaggccugcuugcacu

SEQ ID NO: 175996 - RNA, 22 nt, Human
acagacagggcaccugccuccu

SEQ ID NO: 175997 - RNA, 22 nt, Human
uucuaacaaguggcuuguuagu

SEQ ID NO: 175998 - RNA, 22 nt, Human
agggcucccgcgguguccggga

SEQ ID NO: 175999 - RNA, 22 nt, Human
cauguugaauggccuugauuuu

SEQ ID NO: 176000 - RNA, 22 nt, Human
ucacugugcucucuagauaggc

SEQ ID NO: 176001 - RNA, 20 nt, Human
ccagacagcaccugccuggu

SEQ ID NO: 176002 - RNA, 22 nt, Human
ucaggaaagccuagaagagaac

SEQ ID NO: 176003 - RNA, 22 nt, Human
uuauuccaguaaucucuguaau

SEQ ID NO: 176004 - RNA, 22 nt, Human
ucuggcucauacaagccugcaa

SEQ ID NO: 176005 - RNA, 22 nt, Human
agaaaagaggcuuucuaagcau

SEQ ID NO: 176006 - RNA, 22 nt, Human
agagauucauguuuacuguagg

SEQ ID NO: 176007 - RNA, 22 nt, Human
gauuucaaaaguagauccauca

SEQ ID NO: 176008 - RNA, 22 nt, Human
ucagguggcuucggggaguggc

SEQ ID NO: 176009 - RNA, 22 nt, Human
uugauacuauuaagcacugggc

SEQ ID NO: 176010 - RNA, 22 nt, Human
uauuuauucuuuguacugccuu

SEQ ID NO: 176011 - RNA, 23 nt, Human
ccacuagcaccuguucaacuucu

SEQ ID NO: 176012 - RNA, 22 nt, Human
caggcauggugagaacucagcc

SEQ ID NO: 176013 - RNA, 18 nt, Human
uuuuacucauagcaggcc

SEQ ID NO: 176014 - RNA, 22 nt, Human
caaugaaagcaacugccuauaa

SEQ ID NO: 176015 - RNA, 21 nt, Human
auggugagauacugggugugg

SEQ ID NO: 176016 - RNA, 22 nt, Human
augugcuucauucuacaugaca

SEQ ID NO: 176017 - RNA, 22 nt, Human
auaaacucaugccaagaaauga

SEQ ID NO: 176018 - RNA, 22 nt, Human
gaauccaggguuguuugagcua

SEQ ID NO: 176019 - RNA, 22 nt, Human
acauccagaucucagcauggcu

SEQ ID NO: 176020 - RNA, 22 nt, Human
uaaauuauggcuggcagagcag

SEQ ID NO: 176021 - RNA, 22 nt, Human
guuuuuaucuaauagcaguuau

SEQ ID NO: 176022 - RNA, 23 nt, Human
uggcaggugguuagauguuuugu

SEQ ID NO: 176023 - RNA, 22 nt, Human
cuuguugcuaacauaugcuucu

SEQ ID NO: 176024 - RNA, 22 nt, Human
aauaucaacaguguccuucuaa

SEQ ID NO: 176025 - RNA, 22 nt, Human
gugucccaggccucuggaauua

SEQ ID NO: 176026 - RNA, 22 nt, Human
ccaggugguucaggucaccaua

SEQ ID NO: 176027 - RNA, 22 nt, Human
gcaacuuucaagcaccaugggg

SEQ ID NO: 176028 - RNA, 22 nt, Human
agcaggugggaucaagcuggca

SEQ ID NO: 176029 - RNA, 17 nt, Human
uucugggucccagggcc

SEQ ID NO: 176030 - RNA, 22 nt, Human
ugggccaguccagccccaggga

SEQ ID NO: 176031 - RNA, 22 nt, Human
guauauaugugugaacauguau

SEQ ID NO: 176032 - RNA, 22 nt, Human
aauuagggagagguagcuaggu

SEQ ID NO: 176033 - RNA, 22 nt, Human
ucaacaaauacuuaaagcagag

SEQ ID NO: 176034 - RNA, 22 nt, Human
ggcugccacgucgaggguccaa

SEQ ID NO: 176035 - RNA, 22 nt, Human
cuagaaauguagauucuuagug

SEQ ID NO: 176036 - RNA, 22 nt, Human
aaugaucuacucucauuaucuc

SEQ ID NO: 176037 - RNA, 22 nt, Human
ccaggcaggcuagaauguaaau

SEQ ID NO: 176038 - RNA, 22 nt, Human
uguuccuguuuaaugugcucau

SEQ ID NO: 176039 - RNA, 22 nt, Human
uguuccugaaugccuggcuggc

SEQ ID NO: 176040 - RNA, 22 nt, Human
cuucucaaaguugugaaucagg

SEQ ID NO: 176041 - RNA, 22 nt, Human
auggauuugcuuauacacaugu

SEQ ID NO: 176042 - RNA, 22 nt, Human
guucuaauaggagaaaagacag

SEQ ID NO: 176043 - RNA, 22 nt, Human
cuguggaauugaugcuuagugu

SEQ ID NO: 176044 - RNA, 22 nt, Human
auuucaacagaguuugaaggca

SEQ ID NO: 176045 - RNA, 22 nt, Human
gauuucaauccagcuuucuucu

SEQ ID NO: 176046 - RNA, 22 nt, Human
uauggcuuuuuauucaucuuac

SEQ ID NO: 176047 - RNA, 22 nt, Human
auugaaaaauucacaauucugg

SEQ ID NO: 176048 - RNA, 22 nt, Human
caucagaaggccagaggguagc

SEQ ID NO: 176049 - RNA, 22 nt, Human
gugugucccuacaacagcuuca

SEQ ID NO: 176050 - RNA, 22 nt, Human
uuacaagauaaccugaugcugu

SEQ ID NO: 176051 - RNA, 22 nt, Human
ugcuuuaucaaagcuauaguga

SEQ ID NO: 176052 - RNA, 22 nt, Human
cauggcuuuguucauauaauuu

SEQ ID NO: 176053 - RNA, 22 nt, Human
aauaacuggcacauaucacaua

SEQ ID NO: 176054 - RNA, 22 nt, Human
uuuuucagccaugaauuacacu

SEQ ID NO: 176055 - RNA, 22 nt, Human
auguuucaugacugagcaaaau

SEQ ID NO: 176056 - RNA, 22 nt, Human
auuucugugcaguaaaugguga

SEQ ID NO: 176057 - RNA, 22 nt, Human
caucagucuagauucuaguacc

SEQ ID NO: 176058 - RNA, 22 nt, Human
ccaaagucagugcucagucguc

SEQ ID NO: 176059 - RNA, 22 nt, Human
gaggugucccgcaguccccaag

SEQ ID NO: 176060 - RNA, 23 nt, Human
ucuuuccuaaugaaacagugaaa

SEQ ID NO: 176061 - RNA, 22 nt, Human
uugucuggucaaaucacuugua

SEQ ID NO: 176062 - RNA, 22 nt, Human
uagcuuuuaguacuuaauggcu

SEQ ID NO: 176063 - RNA, 21 nt, Human
ucuggguguaaaucuuauuug

SEQ ID NO: 176064 - RNA, 22 nt, Human
cuuagauacaguagaaagacuc

SEQ ID NO: 176065 - RNA, 22 nt, Human
cuggauuugccuauggugcuuu

SEQ ID NO: 176066 - RNA, 22 nt, Human
cucccaguguuguuuucugaug

SEQ ID NO: 176067 - RNA, 22 nt, Human
uuugcugaccccauucugaguc

SEQ ID NO: 176068 - RNA, 18 nt, Human
ucagcuuuugaaaaccaa

SEQ ID NO: 176069 - RNA, 15 nt, Human
gcaggcaggucaccu

SEQ ID NO: 176070 - RNA, 19 nt, Human
agaaauagccuuccuuguc

SEQ ID NO: 176071 - RNA, 22 nt, Human
uaaugucuccaggguugaccua

SEQ ID NO: 176072 - RNA, 22 nt, Human
uuccaggauggcaauaaugaau

SEQ ID NO: 176073 - RNA, 22 nt, Human
ucuguucauguugggcuuuucc

SEQ ID NO: 176074 - RNA, 22 nt, Human
ucugcccuggggucagccucca

SEQ ID NO: 176075 - RNA, 22 nt, Human
cuguuuucuagggcugagguga

SEQ ID NO: 176076 - RNA, 22 nt, Human
guggauggagcuggaagccauu

SEQ ID NO: 176077 - RNA, 22 nt, Human
guggauuacaagacaguugaga

SEQ ID NO: 176078 - RNA, 22 nt, Human
agaauucugacaauagaauugg

SEQ ID NO: 176079 - RNA, 23 nt, Human
uuuuauugauauguagcuguugu

SEQ ID NO: 176080 - RNA, 22 nt, Human
cuccuccuaaaugauucuuccu

SEQ ID NO: 176081 - RNA, 22 nt, Human
gauagaaagaauauagauucca

SEQ ID NO: 176082 - RNA, 22 nt, Human
agaucugaccuaaccccaccac

SEQ ID NO: 176083 - RNA, 23 nt, Human
uagaauucaaucuguuccacauc

SEQ ID NO: 176084 - RNA, 22 nt, Human
cauuguaagaggcuuugcagca

SEQ ID NO: 176085 - RNA, 22 nt, Human
acuuuaucaggaaucacacagc

SEQ ID NO: 176086 - RNA, 22 nt, Human
auuucucagcacuuccuaucuc

SEQ ID NO: 176087 - RNA, 22 nt, Human
uuucaguuuuugcucgauguau

SEQ ID NO: 176088 - RNA, 22 nt, Human
uugguacaaugugcuagguagg

SEQ ID NO: 176089 - RNA, 22 nt, Human
ggcaggugcucugugggccugg

SEQ ID NO: 176090 - RNA, 22 nt, Human
agcagggcucugccaugggccc

SEQ ID NO: 176091 - RNA, 22 nt, Human
aguuguaagaggcacaaggaag

SEQ ID NO: 176092 - RNA, 22 nt, Human
uagcuuuaggaugguucucuug

SEQ ID NO: 176093 - RNA, 22 nt, Human
uuuuccaaaguaccaugucccu

SEQ ID NO: 176094 - RNA, 22 nt, Human
caaugaaauugagauccagaga

SEQ ID NO: 176095 - RNA, 22 nt, Human
aaaucaguaaauguucauuaac

SEQ ID NO: 176096 - RNA, 22 nt, Human
caauacuuccuuguuagaggca

SEQ ID NO: 176097 - RNA, 22 nt, Human
aagaaagggagaaggauggugu

SEQ ID NO: 176098 - RNA, 20 nt, Human
ucagggcaugggacagcccc

SEQ ID NO: 176099 - RNA, 23 nt, Human
uuuauuuauuuaggcugagggau

SEQ ID NO: 176100 - RNA, 22 nt, Human
gacuacucaaacuuucucuaua

SEQ ID NO: 176101 - RNA, 22 nt, Human
uauugcugccucguccaggcug

SEQ ID NO: 176102 - RNA, 20 nt, Human
ccugucuccucuuaccuggc

SEQ ID NO: 176103 - RNA, 22 nt, Human
agggaauucacuggaacgcccu

SEQ ID NO: 176104 - RNA, 22 nt, Human
uccuccuuguucuuuugccuac

SEQ ID NO: 176105 - RNA, 22 nt, Human
ucagaauucugaccuuggguca

SEQ ID NO: 176106 - RNA, 22 nt, Human
aauacauguuuucuacuauucu

SEQ ID NO: 176107 - RNA, 22 nt, Human
uuuguuuucaaugugucauuca

SEQ ID NO: 176108 - RNA, 22 nt, Human
aaggugucaccagauuggcagg

SEQ ID NO: 176109 - RNA, 22 nt, Human
gcuucacaggcaaguuaagccu

SEQ ID NO: 176110 - RNA, 22 nt, Human
uccauguguuuuccuguccaca

SEQ ID NO: 176111 - RNA, 22 nt, Human
uucuucaaauagcagggaguca

SEQ ID NO: 176112 - RNA, 22 nt, Human
ugauaauauuuugaaucauaag

SEQ ID NO: 176113 - RNA, 17 nt, Human
cccguucucuucgcugg

SEQ ID NO: 176114 - RNA, 22 nt, Human
guaaauuauuucaagaucaucu

SEQ ID NO: 176115 - RNA, 22 nt, Human
cacauaaucaccaaguccuuuc

SEQ ID NO: 176116 - RNA, 22 nt, Human
aauucuagcauugugaaaauau

SEQ ID NO: 176117 - RNA, 22 nt, Human
auuuguuccacacauauuuacu

SEQ ID NO: 176118 - RNA, 21 nt, Human
acagagcauaaugguguggca

SEQ ID NO: 176119 - RNA, 18 nt, Human
ugcuggguaacuguaugg

SEQ ID NO: 176120 - RNA, 22 nt, Human
uaucauaaguuaauuaaacagu

SEQ ID NO: 176121 - RNA, 22 nt, Human
uuugacucuucuagcaagugug

SEQ ID NO: 176122 - RNA, 22 nt, Human
uuaagcauaauuaaagugaaau

SEQ ID NO: 176123 - RNA, 19 nt, Human
caggugguaaucugagccu

SEQ ID NO: 176124 - RNA, 22 nt, Human
uuugaagauuaugccagaguga

SEQ ID NO: 176125 - RNA, 22 nt, Human
cauuucaaggaccacccuggga

SEQ ID NO: 176126 - RNA, 22 nt, Human
guguguccaaggcacggaugac

SEQ ID NO: 176127 - RNA, 22 nt, Human
ccuuccucauccauuucucuug

SEQ ID NO: 176128 - RNA, 22 nt, Human
guuuuuacuaagguugcuaagu

SEQ ID NO: 176129 - RNA, 22 nt, Human
gaggugucuggccuuuguagga

SEQ ID NO: 176130 - RNA, 22 nt, Human
cagcaugaaacaauugagccca

SEQ ID NO: 176131 - RNA, 22 nt, Human
aguggggccgcgguccugcccu

SEQ ID NO: 176132 - RNA, 22 nt, Human
guuaauauuuaccugucaagaa

SEQ ID NO: 176133 - RNA, 22 nt, Human
acaauguguuuuuauacauuug

SEQ ID NO: 176134 - RNA, 22 nt, Human
acagguguaaaacccaggaugg

SEQ ID NO: 176135 - RNA, 22 nt, Human
gcagcuuucuugcccuaaucuu

SEQ ID NO: 176136 - RNA, 22 nt, Human
agucagguacuccgagggcaug

SEQ ID NO: 176137 - RNA, 22 nt, Human
gcaggacaggcguugguccagu

SEQ ID NO: 176138 - RNA, 22 nt, Human
ugcagguggauucaauguggga

SEQ ID NO: 176139 - RNA, 22 nt, Human
uucuuuuacauuaagauuucag

SEQ ID NO: 176140 - RNA, 22 nt, Human
uucagcaaacacgaugcuuguu

SEQ ID NO: 176141 - RNA, 22 nt, Human
agaauaucguagcauauuaucu

SEQ ID NO: 176142 - RNA, 22 nt, Human
aguuuccaaagcauguucacac

SEQ ID NO: 176143 - RNA, 22 nt, Human
cuggcuuucuauuuggugcuau

SEQ ID NO: 176144 - RNA, 22 nt, Human
cugguccuaaagcccuacucca

SEQ ID NO: 176145 - RNA, 22 nt, Human
aucuauacucagaguuaauauc

SEQ ID NO: 176146 - RNA, 22 nt, Human
auuucacaaaccauccugauuu

SEQ ID NO: 176147 - RNA, 22 nt, Human
ggcaggugcugggagcaucuca

SEQ ID NO: 176148 - RNA, 22 nt, Human
agcagggcuggauuuggcaaga

SEQ ID NO: 176149 - RNA, 22 nt, Human
ugcagguguagaguugggcucc

SEQ ID NO: 176150 - RNA, 22 nt, Human
ucaggaaagaagaugcucagug

SEQ ID NO: 176151 - RNA, 22 nt, Human
gaaccauuguugaaaagaauag

SEQ ID NO: 176152 - RNA, 22 nt, Human
aggcagggucuugcuauguugc

SEQ ID NO: 176153 - RNA, 23 nt, Human
agguggucuuguggaugcugcaa

SEQ ID NO: 176154 - RNA, 22 nt, Human
ucagcauaucuugagcuucaug

SEQ ID NO: 176155 - RNA, 22 nt, Human
cucuuaaauaacaucauugcuu

SEQ ID NO: 176156 - RNA, 22 nt, Human
gguguccuugcuccuucagcuu

SEQ ID NO: 176157 - RNA, 21 nt, Human
uguguaauauguauaagaaua

SEQ ID NO: 176158 - RNA, 22 nt, Human
acuggacagaggaaauauggag

SEQ ID NO: 176159 - RNA, 22 nt, Human
uacuaaacaucuggcauuaaau

SEQ ID NO: 176160 - RNA, 22 nt, Human
agguggggaggagugucucuuu

SEQ ID NO: 176161 - RNA, 22 nt, Human
auucauaaguaaaugauuaccu

SEQ ID NO: 176162 - RNA, 22 nt, Human
ugcuuuauucccuucugaugug

SEQ ID NO: 176163 - RNA, 22 nt, Human
uugaauaauguguauguuguua

SEQ ID NO: 176164 - RNA, 22 nt, Human
gaugaaaaucuugagaugucga

SEQ ID NO: 176165 - RNA, 22 nt, Human
uggaggaauaacagcaaccuua

SEQ ID NO: 176166 - RNA, 22 nt, Human
cugggugacagagugagauggu

SEQ ID NO: 176167 - RNA, 23 nt, Human
aaacuugcuauggcugaaaucau

SEQ ID NO: 176168 - RNA, 22 nt, Human
gccugcagccccucugcaguag

SEQ ID NO: 176169 - RNA, 22 nt, Human
cucuucuuauggccguggcuga

SEQ ID NO: 176170 - RNA, 22 nt, Human
aucagaauaauuagauuucaga

SEQ ID NO: 176171 - RNA, 22 nt, Human
gacagacagagaaugggcuuga

SEQ ID NO: 176172 - RNA, 22 nt, Human
ugcagggccccucugcaugagu

SEQ ID NO: 176173 - RNA, 23 nt, Human
uuggcaaagccuaugaaguccuc

SEQ ID NO: 176174 - RNA, 22 nt, Human
aguaaaaucaccaucucuuugu

SEQ ID NO: 176175 - RNA, 22 nt, Human
aaugaaacuaguagaaucuuug

SEQ ID NO: 176176 - RNA, 22 nt, Human
cucagcaacagcgacuuaaggg

SEQ ID NO: 176177 - RNA, 22 nt, Human
uuaaaagaauccuguuauccuc

SEQ ID NO: 176178 - RNA, 22 nt, Human
aaugaaacuauauuuagagagg

SEQ ID NO: 176179 - RNA, 20 nt, Human
uuacagaaaugauguuauuu

SEQ ID NO: 176180 - RNA, 22 nt, Human
aauguuaaguuuagauuauaac

SEQ ID NO: 176181 - RNA, 22 nt, Human
ucugaaauuuuaguuauagaaa

SEQ ID NO: 176182 - RNA, 18 nt, Human
cagaaaguuauuuacucu

SEQ ID NO: 176183 - RNA, 20 nt, Human
uuucacuggcuugauaaggu

SEQ ID NO: 176184 - RNA, 22 nt, Human
uucuaagaaauggaaaacgauu

SEQ ID NO: 176185 - RNA, 22 nt, Human
uaagaaacauuuuuaugacagu

SEQ ID NO: 176186 - RNA, 22 nt, Human
auuuacugagguaaauaaacug

SEQ ID NO: 176187 - RNA, 20 nt, Human
uaugauaauuacaaaauagu

SEQ ID NO: 176188 - RNA, 22 nt, Human
ucaguaaaugagcaaaaauuuc

SEQ ID NO: 176189 - RNA, 22 nt, Human
cucaaaauccauaaaaucaggu

SEQ ID NO: 176190 - RNA, 22 nt, Human
uucagaaaggcugugccagcca

SEQ ID NO: 176191 - RNA, 22 nt, Human
uuuaggaagaguugaguaaauu

SEQ ID NO: 176192 - RNA, 22 nt, Human
ucagaacauccugguuuaaaau

SEQ ID NO: 176193 - RNA, 22 nt, Human
uuuacagagaauguacauaaag

SEQ ID NO: 176194 - RNA, 22 nt, Human
aggaauuugggguuacaugaug

SEQ ID NO: 176195 - RNA, 22 nt, Human
auuuccuggaggaauggaagca

SEQ ID NO: 176196 - RNA, 22 nt, Human
uagaagaacaugucaaacuaua

SEQ ID NO: 176197 - RNA, 22 nt, Human
auuuuagagaaacaaacguagg

SEQ ID NO: 176198 - RNA, 22 nt, Human
cucaggaaaauauugaagaagu

SEQ ID NO: 176199 - RNA, 22 nt, Human
auuacugaggcaaaguaguuuu

SEQ ID NO: 176200 - RNA, 18 nt, Human
ucagacaaguuagacagg

SEQ ID NO: 176201 - RNA, 22 nt, Human
uuuuuaagagucuggaaauagu

SEQ ID NO: 176202 - RNA, 18 nt, Human
uauaaacacacuuagguu

SEQ ID NO: 176203 - RNA, 22 nt, Human
uuagaaaucaccucugaagauc

SEQ ID NO: 176204 - RNA, 22 nt, Human
auccucagagaacgaacacaau

SEQ ID NO: 176205 - RNA, 22 nt, Human
ucucagaaaugacaggagguac

SEQ ID NO: 176206 - RNA, 22 nt, Hepatitis B virus
gguggcuuuggggcauggacau

SEQ ID NO: 176207 - RNA, 22 nt, Hepatitis B virus
gaugaugugguauugggggcca

SEQ ID NO: 176208 - RNA, 22 nt, Hepatitis B virus
cauguccuacuguucaagccuc

SEQ ID NO: 176209 - RNA, 22 nt, Hepatitis B virus
ugagucccuuuuuaccucuauu

SEQ ID NO: 176210 - RNA, 22 nt, Human
gcagagauccuugcuggaugac

SEQ ID NO: 176211 - RNA, 22 nt, Human
ucccaggaucugagggcagaga

SEQ ID NO: 176212 - RNA, 22 nt, Human
agcugaaauucacaaggaucca

SEQ ID NO: 176213 - RNA, 22 nt, Human
agaggccuccgaaaggugggcu

SEQ ID NO: 176214 - RNA, 22 nt, Human
uaggcaugcaaauaaaugugca

SEQ ID NO: 176215 - RNA, 22 nt, Human
uuucucaacuguauuaugcaga

SEQ ID NO: 176216 - RNA, 22 nt, Human
ggaagaaaaugggcaacaggug

SEQ ID NO: 176217 - RNA, 22 nt, Human
ugagcagucagacaagcaucac

SEQ ID NO: 176218 - RNA, 22 nt, Human
aucaauucuuaggaaaauagcu

SEQ ID NO: 176219 - RNA, 22 nt, Human
agcccaugcaacaggccuagcg

SEQ ID NO: 176220 - RNA, 22 nt, Human
ucacaucucccuggaggacaca

SEQ ID NO: 176221 - RNA, 18 nt, Human
aaacagugccuaaguguc

SEQ ID NO: 176222 - RNA, 22 nt, Human
gaggaaccaaucugugauauuc

SEQ ID NO: 176223 - RNA, 22 nt, Human
uuguuucuuugaaguuucuaga

SEQ ID NO: 176224 - RNA, 22 nt, Human
ucuauagaucaguaaauaucuc

SEQ ID NO: 176225 - RNA, 22 nt, Human
augguggaaucggcgugaaugg

SEQ ID NO: 176226 - RNA, 20 nt, Human
gcauggcuaaucuguacuga

SEQ ID NO: 176227 - RNA, 22 nt, Human
ucaaacagcaggucuuucauag

SEQ ID NO: 176228 - RNA, 21 nt, Human
cgguggcucccgggauggcuc

SEQ ID NO: 176229 - RNA, 22 nt, Human
cugggagcgcagcaggcacaac

SEQ ID NO: 176230 - RNA, 22 nt, Human
uccuuucuaucuuggguaucua

SEQ ID NO: 176231 - RNA, 22 nt, Human
uuacuuuguucucaagauaugu

SEQ ID NO: 176232 - RNA, 22 nt, Human
ggagugauggaaagugcuuggc

SEQ ID NO: 176233 - RNA, 22 nt, Human
aaacaagagcuuacauggcugc

SEQ ID NO: 176234 - RNA, 22 nt, Human
gagcacugaggaaagcugguua

SEQ ID NO: 176235 - RNA, 22 nt, Human
cuggaggcacccuuagagaggc

SEQ ID NO: 176236 - RNA, 22 nt, Human
uguauuaacauuaauaaaaugg

SEQ ID NO: 176237 - RNA, 22 nt, Human
ggccacugccuccgccauggcu

SEQ ID NO: 176238 - RNA, 22 nt, Human
cagaguggagauguguguggaa

SEQ ID NO: 176239 - RNA, 22 nt, Human
cagggggugguccaggcugcgc

SEQ ID NO: 176240 - RNA, 22 nt, Human
agcccagagccucuccuaaagg

SEQ ID NO: 176241 - RNA, 23 nt, Human
uuucagaagugguccuaggaagc

SEQ ID NO: 176242 - RNA, 22 nt, Human
ugucccuggaacuauggcucca

SEQ ID NO: 176243 - RNA, 22 nt, Human
ucaugcagauaagaauaaguaa

SEQ ID NO: 176244 - RNA, 22 nt, Human
agugacauuugcaccagcugcu

SEQ ID NO: 176245 - RNA, 21 nt, Human
auaaagacaaacacuauuugg

SEQ ID NO: 176246 - RNA, 22 nt, Human
ugggggcagccaggcugucaag

SEQ ID NO: 176247 - RNA, 22 nt, Human
cagaacugggcagggagcagag

SEQ ID NO: 176248 - RNA, 22 nt, Human
ugcagggaacuuggacagcuag

SEQ ID NO: 176249 - RNA, 22 nt, Human
guuuauuagaguuuucugucug

SEQ ID NO: 176250 - RNA, 22 nt, Human
uucuuugcccuuaaugaaauaa

SEQ ID NO: 176251 - RNA, 22 nt, Human
ucugccucuuucaggccuggca

SEQ ID NO: 176252 - RNA, 22 nt, Human
caggcagcuagauuuauaacaa

SEQ ID NO: 176253 - RNA, 22 nt, Human
aaaggcuauuucagggucagua

SEQ ID NO: 176254 - RNA, 22 nt, Human
uggaacuaagguagaaacuauu

SEQ ID NO: 176255 - RNA, 19 nt, Human
cgcaggagccgaggugacc

SEQ ID NO: 176256 - RNA, 22 nt, Human
auuucugugcaguaaaugguga

SEQ ID NO: 176257 - RNA, 22 nt, Human
gcaggccucuguugagggccuu

SEQ ID NO: 176258 - RNA, 22 nt, Human
uccugagccugacaaucaccau

SEQ ID NO: 176259 - RNA, 22 nt, Human
ccacuggcauccagcugccauc

SEQ ID NO: 176260 - RNA, 20 nt, Human
ccucucugaagaggucaucu

SEQ ID NO: 176261 - RNA, 22 nt, Human
uugauucauauagauaugcgug

SEQ ID NO: 176262 - RNA, 22 nt, Human
gcaccucauuuugcagguagaa

SEQ ID NO: 176263 - RNA, 21 nt, Human
uuucuuaucuguaaaguggga

SEQ ID NO: 176264 - RNA, 22 nt, Human
cauaauuucuguaucagcacca

SEQ ID NO: 176265 - RNA, 22 nt, Human
aggccucuguuccccauguuuu

SEQ ID NO: 176266 - RNA, 22 nt, Human
aaguguguuuucaguguacuua

SEQ ID NO: 176267 - RNA, 22 nt, Human
aaugcuaacauugguuuauauc

SEQ ID NO: 176268 - RNA, 22 nt, Human
cuguguagccucaugugggcuu

SEQ ID NO: 176269 - RNA, 19 nt, Human
gcugcucugggucucaucu

SEQ ID NO: 176270 - RNA, 22 nt, Human
agggcucaccacugugcacucc

SEQ ID NO: 176271 - RNA, 22 nt, Human
cagggagcuggcuggcgugagu

SEQ ID NO: 176272 - RNA, 19 nt, Human
ggagucugagcccagguau

SEQ ID NO: 176273 - RNA, 22 nt, Human
acaggcugauagaccauaaaua

SEQ ID NO: 176274 - RNA, 22 nt, Human
acacugugcaugcauauacaca

SEQ ID NO: 176275 - RNA, 22 nt, Human
ggcagugccacuaagcucugcu

SEQ ID NO: 176276 - RNA, 22 nt, Human
cagccagaucagggcagggguu

SEQ ID NO: 176277 - RNA, 22 nt, Human
uaaaaggcacuuggaugcugag

SEQ ID NO: 176278 - RNA, 22 nt, Human
cugaggagcugaaggcccucca

SEQ ID NO: 176279 - RNA, 22 nt, Human
aacuaguuuuagcucuagcaac

SEQ ID NO: 176280 - RNA, 22 nt, Human
augcuuuacaguuuuccaaaca

SEQ ID NO: 176281 - RNA, 22 nt, Human
caggaaacauucuugguaagga

SEQ ID NO: 176282 - RNA, 22 nt, Human
uuagccauuaauguccugugca

SEQ ID NO: 176283 - RNA, 21 nt, Human
ucauuuuuauugcuaccuugc

SEQ ID NO: 176284 - RNA, 20 nt, Human
cauggcugugagcccacagg

SEQ ID NO: 176285 - RNA, 22 nt, Human
ccagcucucagcgggagacuca

SEQ ID NO: 176286 - RNA, 22 nt, Human
cuuuacagauggauaauuguuu

SEQ ID NO: 176287 - RNA, 22 nt, Human
acaugacagggaaugaggugaa

SEQ ID NO: 176288 - RNA, 22 nt, Human
gcugucuguggugucagcugac

SEQ ID NO: 176289 - RNA, 22 nt, Human
uguggcugugguuuucauaaau

SEQ ID NO: 176290 - RNA, 22 nt, Human
caauacuuccuuguuagaggca

SEQ ID NO: 176291 - RNA, 22 nt, Human
aaucugagggaacuugaacucc

SEQ ID NO: 176292 - RNA, 22 nt, Human
caaauacuaaacauaagauuuu

SEQ ID NO: 176293 - RNA, 23 nt, Human
auugauucccucuuggaagggau

SEQ ID NO: 176294 - RNA, 22 nt, Human
aacacaguuuuccaaaauagag

SEQ ID NO: 176295 - RNA, 21 nt, Human
ugcuugggggcuucaggagcu

SEQ ID NO: 176296 - RNA, 22 nt, Human
acauguguguauacguauuuau

SEQ ID NO: 176297 - RNA, 22 nt, Human
acugugcugcucuccgcagccc

SEQ ID NO: 176298 - RNA, 22 nt, Human
uggagcugggguuugaaucugg

SEQ ID NO: 176299 - RNA, 20 nt, Human
aggaaggaaguuugcaugga

SEQ ID NO: 176300 - RNA, 22 nt, Human
ggguccagaaugagaaugggcu

SEQ ID NO: 176301 - RNA, 22 nt, Human
cauggcagaaaccugagcugcu

SEQ ID NO: 176302 - RNA, 22 nt, Human
ucagaguuucugauuuaguagg

SEQ ID NO: 176303 - RNA, 22 nt, Human
aggcccaguagucgacggcgcu

SEQ ID NO: 176304 - RNA, 22 nt, Human
auucaguggauaucuucacuuu

SEQ ID NO: 176305 - RNA, 22 nt, Human
cuggcccaguucugcguuuugc

SEQ ID NO: 176306 - RNA, 22 nt, Human
accaugugaucaaaacaaaucc

SEQ ID NO: 176307 - RNA, 22 nt, Human
uggucagcguuugucagagcag

SEQ ID NO: 176308 - RNA, 21 nt, Human
acaaauuguuuauauaggaag

SEQ ID NO: 176309 - RNA, 22 nt, Human
ucauaggaguagcagugagagg

SEQ ID NO: 176310 - RNA, 22 nt, Human
gcugccucacuccagcccaaua

SEQ ID NO: 176311 - RNA, 22 nt, Human
ggcuguggacacugagcucaga

SEQ ID NO: 176312 - RNA, 22 nt, Human
gcuuuaaugcaauuucaccuca

SEQ ID NO: 176313 - RNA, 22 nt, Human
cucaggauuuacuaauuucaag

SEQ ID NO: 176314 - RNA, 22 nt, Human
cugcggugggcugggcuguccc

SEQ ID NO: 176315 - RNA, 22 nt, Human
uagggagaggaagcaggccgcu

SEQ ID NO: 176316 - RNA, 22 nt, Human
uucagaacaaccaugguuagau

SEQ ID NO: 176317 - RNA, 22 nt, Human
uaacauuucggugacaguggga

SEQ ID NO: 176318 - RNA, 22 nt, Human
uacacagugaguccucucugcc

SEQ ID NO: 176319 - RNA, 22 nt, Human
agaaucagaugaagacuccugc

SEQ ID NO: 176320 - RNA, 20 nt, Human
aacacugaggccuacucuuc

SEQ ID NO: 176321 - RNA, 22 nt, Human
cgcuucucuacucccagccagu

SEQ ID NO: 176322 - RNA, 22 nt, Human
gagagcuggguucaaguagcug

SEQ ID NO: 176323 - RNA, 22 nt, Human
agaugguccaucuauuuucuau

SEQ ID NO: 176324 - RNA, 22 nt, Human
ccaagcagucugcuaggaguuu

SEQ ID NO: 176325 - RNA, 22 nt, Human
ugauucaagagaguugggguau

SEQ ID NO: 176326 - RNA, 22 nt, Human
ggagagaaucugaaccugcucc

SEQ ID NO: 176327 - RNA, 22 nt, Human
gagcacagauccuggagccaca

SEQ ID NO: 176328 - RNA, 22 nt, Human
gccaggcauucuagaaguagug

SEQ ID NO: 176329 - RNA, 22 nt, Human
augucagaagcuggaugacagc

SEQ ID NO: 176330 - RNA, 22 nt, Human
uuucaacaggaugauaauaggc

SEQ ID NO: 176331 - RNA, 16 nt, Human
aaggagggaagagaau

SEQ ID NO: 176332 - RNA, 22 nt, Human
auuugcucuagcugcagugaau

SEQ ID NO: 176333 - RNA, 22 nt, Human
cugaggccguuggugggccuua

SEQ ID NO: 176334 - RNA, 22 nt, Human
ucucuguaagagaggcuuucau

SEQ ID NO: 176335 - RNA, 22 nt, Human
cucuggagaugguucucaauug

SEQ ID NO: 176336 - RNA, 22 nt, Human
acaagaaccaaagaaggauauu

SEQ ID NO: 176337 - RNA, 22 nt, Human
uucuuuuaauuucugucugcag

SEQ ID NO: 176338 - RNA, 22 nt, Human
gagcuggaggaccaggacuggg

SEQ ID NO: 176339 - RNA, 22 nt, Human
uagaggcacccuggaggagacu

SEQ ID NO: 176340 - RNA, 22 nt, Human
ucugaaauuuuaguuauagaaa

SEQ ID NO: 176341 - RNA, 18 nt, Human
cccagcuggugggucagu

SEQ ID NO: 176342 - RNA, 21 nt, Human
acacaaaccuccucagccugg

SEQ ID NO: 176343 - RNA, 18 nt, Human
uaggaggauacugagaug

SEQ ID NO: 176344 - RNA, 22 nt, Human
cagggagaggcaucauagggaa

SEQ ID NO: 176345 - RNA, 22 nt, Human
cuggcaggcaaauuggugggag

SEQ ID NO: 176346 - RNA, 22 nt, Human
agggcuguuuuuggcaccuggg

SEQ ID NO: 176347 - RNA, 22 nt, Human
auucagaaaguugucauauuug

SEQ ID NO: 176348 - RNA, 22 nt, Human
uugcucauuugccuuuagguuu

SEQ ID NO: 176349 - RNA, 22 nt, Human
cuggcucuaucuccaaggcugg

SEQ ID NO: 176350 - RNA, 22 nt, Human
aaagugcuuuaggauauuugga

SEQ ID NO: 176351 - RNA, 22 nt, Human
uauucucugcagcugaauguuu

SEQ ID NO: 176352 - RNA, 22 nt, Human
uccagaggggcagcccugugcu

SEQ ID NO: 176353 - RNA, 22 nt, Human
uacacauaggucugaauaaaaa

SEQ ID NO: 176354 - RNA, 22 nt, Human
ggugggcaggcgaggcccaggu

SEQ ID NO: 176355 - RNA, 19 nt, Human
gaucagagugucagcuugu

SEQ ID NO: 176356 - RNA, 22 nt, Human
acuuuugaagaauuaugcaaaa

SEQ ID NO: 176357 - RNA, 22 nt, Human
gugggccuccccuuuacgagcc

SEQ ID NO: 176358 - RNA, 20 nt, Human
uggcuucucuucacuccugu

SEQ ID NO: 176359 - RNA, 22 nt, Human
uggaaugaaaaguacuucagaa

SEQ ID NO: 176360 - RNA, 22 nt, Human
uggcccaggucucucugagccc

SEQ ID NO: 176361 - RNA, 22 nt, Human
acuggcagaacgugaugcgggu

SEQ ID NO: 176362 - RNA, 21 nt, Human
ggcaagaaacacaaucaagua

SEQ ID NO: 176363 - RNA, 22 nt, Human
acagacacaggcguggagucgc

SEQ ID NO: 176364 - RNA, 22 nt, Human
ggagggaguuucauuccugccc

SEQ ID NO: 176365 - RNA, 22 nt, Human
gggaggaaagagaaguggucca

SEQ ID NO: 176366 - RNA, 22 nt, Human
uggcccuuugguuuaugacuga

SEQ ID NO: 176367 - RNA, 22 nt, Human
cauucacaauggauugcuucaa

SEQ ID NO: 176368 - RNA, 22 nt, Human
uagcccagaugauugaaccaug

SEQ ID NO: 176369 - RNA, 20 nt, Human
uuugcgaggccaaggcgggc

SEQ ID NO: 176370 - RNA, 22 nt, Human
uuuucaguaaugucuacauaau

SEQ ID NO: 176371 - RNA, 20 nt, Human
ucaagaugaggucauacugg

SEQ ID NO: 176372 - RNA, 22 nt, Human
uggguucuuaaagggcuagguu

SEQ ID NO: 176373 - RNA, 20 nt, Human
auagaaucacaaguccugaa

SEQ ID NO: 176374 - RNA, 22 nt, Human
auugauucucauaggaccaucu

SEQ ID NO: 176375 - RNA, 21 nt, Human
augucaaaugcuuuauuuuau

SEQ ID NO: 176376 - RNA, 22 nt, Human
gguggggcuaggaccucaggau

SEQ ID NO: 176377 - RNA, 22 nt, Human
uaucuuuaacuugcaguauuua

SEQ ID NO: 176378 - RNA, 22 nt, Human
cuggaaggggcagucuuugggc

SEQ ID NO: 176379 - RNA, 22 nt, Human
agcuccuacucuaugccagaca

SEQ ID NO: 176380 - RNA, 22 nt, Human
uuacauguggugugaagaagag

SEQ ID NO: 176381 - RNA, 22 nt, Human
agcaggcagcaugggacccucc

SEQ ID NO: 176382 - RNA, 22 nt, Human
agaaggcucacuaagagugacu

SEQ ID NO: 176383 - RNA, 22 nt, Human
ggcuuuauuugcagccauuguu

SEQ ID NO: 176384 - RNA, 22 nt, Human
ccuaggcuggcugucuucaggu

SEQ ID NO: 176385 - RNA, 22 nt, Human
cuguuaaaagcacugccauccu

SEQ ID NO: 176386 - RNA, 22 nt, Human
uucccucucuagcuuuccccaa

SEQ ID NO: 176387 - RNA, 18 nt, Human
caaauagcaugauguccu

SEQ ID NO: 176388 - RNA, 22 nt, Human
auauaaguuaguggucauguuu

SEQ ID NO: 176389 - RNA, 22 nt, Human
uccugggacucugccucaggcu

SEQ ID NO: 176390 - RNA, 22 nt, Human
ccagugcauaaucaauacagcc

SEQ ID NO: 176391 - RNA, 20 nt, Human
aacugagaguucaggaggag

SEQ ID NO: 176392 - RNA, 22 nt, Human
cagguccuuuaguguccagaac

SEQ ID NO: 176393 - RNA, 22 nt, Human
agccuucacugggaccuuggau

SEQ ID NO: 176394 - RNA, 22 nt, Human
gugcauuaacaacccagaacuc

SEQ ID NO: 176395 - RNA, 22 nt, Human
ucugaaaugcaggcaauuugcu

SEQ ID NO: 176396 - RNA, 22 nt, Human
caucuguugcuuccuaacaagu

SEQ ID NO: 176397 - RNA, 19 nt, Human
ugcagaggguaggaaggcc

SEQ ID NO: 176398 - RNA, 22 nt, Human
cuggggaauagagcuggagacc

SEQ ID NO: 176399 - RNA, 22 nt, Human
acagugaaugcccaagaaaagu

SEQ ID NO: 176400 - RNA, 22 nt, Human
ccagagcuugacgugcaacgga

SEQ ID NO: 176401 - RNA, 22 nt, Human
ggcaaaaaguucccaucagugu

SEQ ID NO: 176402 - RNA, 22 nt, Human
aggcugccucuuuugagagggu

SEQ ID NO: 176403 - RNA, 22 nt, Human
agaaagggucacugaaagagga

SEQ ID NO: 176404 - RNA, 22 nt, Human
agucuguguauauucacugccc

SEQ ID NO: 176405 - RNA, 22 nt, Human
ugcauggaggaagaugaaugca

SEQ ID NO: 176406 - RNA, 22 nt, Human
gggcucuggggugcccuggcau

SEQ ID NO: 176407 - RNA, 22 nt, Human
uuuaugaacuacagauauaacu

SEQ ID NO: 176408 - RNA, 22 nt, Human
guggauuacaagacaguugaga

SEQ ID NO: 176409 - RNA, 22 nt, Human
guauucaguuugauugucuaca

SEQ ID NO: 176410 - RNA, 22 nt, Human
agucagaaucugcauuuuaacc

SEQ ID NO: 176411 - RNA, 22 nt, Human
augggacagggcuggcuggucc

SEQ ID NO: 176412 - RNA, 22 nt, Human
aaaguggggucuagagggccug

SEQ ID NO: 176413 - RNA, 22 nt, Human
agucacaugaggaaggggaagg

SEQ ID NO: 176414 - RNA, 22 nt, Human
cauggcaggcuucuucagccuu

SEQ ID NO: 176415 - RNA, 17 nt, Human
gacaagacagaauucau

SEQ ID NO: 176416 - RNA, 22 nt, Human
cuggaggaggaagucuacaaug

SEQ ID NO: 176417 - RNA, 22 nt, Human
ucuuauugucuagauugagaug

SEQ ID NO: 176418 - RNA, 22 nt, Human
aaagaccauguuuacagcuagg

SEQ ID NO: 176419 - RNA, 22 nt, Human
agaagccaaaggggccagauau

SEQ ID NO: 176420 - RNA, 22 nt, Human
auauucuuccaaaacaucauuu

SEQ ID NO: 176421 - RNA, 22 nt, Human
ccucuguacaggucagcaucua

SEQ ID NO: 176422 - RNA, 22 nt, Human
auuuccaugucgguauuuuaua

SEQ ID NO: 176423 - RNA, 22 nt, Human
agcccagggaguugauuagcau

SEQ ID NO: 176424 - RNA, 22 nt, Human
ucaaaugccagugguguggauc

SEQ ID NO: 176425 - RNA, 22 nt, Human
ggcuucucagcacacuguccac

SEQ ID NO: 176426 - RNA, 22 nt, Human
ucaggccugugcuggaggagau

SEQ ID NO: 176427 - RNA, 22 nt, Human
uguuggaauaagugcuugaagg

SEQ ID NO: 176428 - RNA, 19 nt, Human
gucuagaacauuguaggug

SEQ ID NO: 176429 - RNA, 22 nt, Human
cggcugcugccugagucgcugu

SEQ ID NO: 176430 - RNA, 22 nt, Human
aacugcauucagaaagcucacu

SEQ ID NO: 176431 - RNA, 22 nt, Human
agaggggcaaguaaagagucuu

SEQ ID NO: 176432 - RNA, 22 nt, Human
gcccagccuccaagcuccaagg

SEQ ID NO: 176433 - RNA, 22 nt, Human
ugcauuuaguuuuaauaaagga

SEQ ID NO: 176434 - RNA, 22 nt, Human
uauacacauuacaguuucagga

SEQ ID NO: 176435 - RNA, 22 nt, Human
acagggcagcaacuuugugccu

SEQ ID NO: 176436 - RNA, 22 nt, Human
auccugagguacugcagggccg

SEQ ID NO: 176437 - RNA, 22 nt, Human
ugcaauuagcauuguauucuua

SEQ ID NO: 176438 - RNA, 22 nt, Human
cucucagggucccugcggagga

SEQ ID NO: 176439 - RNA, 22 nt, Human
uuccucaacaacuucccuacag

SEQ ID NO: 176440 - RNA, 22 nt, Human
uuuccucuuugugacacagcug

SEQ ID NO: 176441 - RNA, 22 nt, Human
ugcagggcacggugcgcguggg

SEQ ID NO: 176442 - RNA, 22 nt, Human
uguccuggaaaaauggagaguu

SEQ ID NO: 176443 - RNA, 22 nt, Human
uggugcagacaggagccccgcu

SEQ ID NO: 176444 - RNA, 22 nt, Human
aaggcagcuucaccacagcauu

SEQ ID NO: 176445 - RNA, 22 nt, Human
ccuggcaugaggagcaugaggu

SEQ ID NO: 176446 - RNA, 22 nt, Human
ugucucuggcccaugagcagag

SEQ ID NO: 176447 - RNA, 22 nt, Human
ccucacuggccagccaggggug

SEQ ID NO: 176448 - RNA, 22 nt, Human
agccuucucugaaauucuguuu

SEQ ID NO: 176449 - RNA, 23 nt, Human
uguuuguuucuaugagagauagc

SEQ ID NO: 176450 - RNA, 22 nt, Human
uuaauuagagcugauguucaua

SEQ ID NO: 176451 - RNA, 18 nt, Human
gagucuuuguuacugcug

SEQ ID NO: 176452 - RNA, 22 nt, Human
aaggucuguggccaccucuggg

SEQ ID NO: 176453 - RNA, 22 nt, Human
uuugucaaaucaaaccacauuc

SEQ ID NO: 176454 - RNA, 22 nt, Human
cccaggcuuuuaaguuagacag

SEQ ID NO: 176455 - RNA, 22 nt, Human
gcuguacaaauuccacaagaga

SEQ ID NO: 176456 - RNA, 22 nt, Human
caggcccuuuccugggcauagg

SEQ ID NO: 176457 - RNA, 22 nt, Human
aaacuguaagagaauaaacuac

SEQ ID NO: 176458 - RNA, 22 nt, Human
cugaaacuuuaguucugcaaca

SEQ ID NO: 176459 - RNA, 21 nt, Human
gcucuggccuacuguucccuc

SEQ ID NO: 176460 - RNA, 22 nt, Human
ggcagcagcaagguuggagcug

SEQ ID NO: 176461 - RNA, 22 nt, Human
uuuuuccuuagggguuacucac

SEQ ID NO: 176462 - RNA, 22 nt, Human
caggaccaggcguucugggcug

SEQ ID NO: 176463 - RNA, 22 nt, Human
cagcugguugaagaggagcugg

SEQ ID NO: 176464 - RNA, 21 nt, Human
acaugagacacacauauaugu

SEQ ID NO: 176465 - RNA, 22 nt, Human
agagccuugccuggggcccugu

SEQ ID NO: 176466 - RNA, 22 nt, Human
uggucugauucuugcuccccaa

SEQ ID NO: 176467 - RNA, 22 nt, Human
cugcacaggggaugagggcagu

SEQ ID NO: 176468 - RNA, 22 nt, Human
gcagaggugagaagggccuccc

SEQ ID NO: 176469 - RNA, 22 nt, Human
aaucacagaguccagcagauga

SEQ ID NO: 176470 - RNA, 22 nt, Human
ucagcugcaguuucacaagcac

SEQ ID NO: 176471 - RNA, 22 nt, Human
cuccuggcuucugaaaucgugg

SEQ ID NO: 176472 - RNA, 22 nt, Human
ccucagagucuaguaaauaaua

SEQ ID NO: 176473 - RNA, 22 nt, Human
uacauuccuucguuuagagauu

SEQ ID NO: 176474 - RNA, 22 nt, Human
ggcaaaaguauuaucucuuuaa

SEQ ID NO: 176475 - RNA, 22 nt, Human
ugcagguggauucaauguggga

SEQ ID NO: 176476 - RNA, 22 nt, Human
ucauucaugaggugcuagugcu

SEQ ID NO: 176477 - RNA, 22 nt, Human
uugggggaagaggauagacagu

SEQ ID NO: 176478 - RNA, 22 nt, Human
uacaggagcauggggaagggau

SEQ ID NO: 176479 - RNA, 22 nt, Human
uguggaugaauaaagugcagac

SEQ ID NO: 176480 - RNA, 17 nt, Human
uuuagaauacaauguuu

SEQ ID NO: 176481 - RNA, 22 nt, Human
cuguccugaguucuuggagguc

SEQ ID NO: 176482 - RNA, 22 nt, Human
ccagagccugcugagccccauu

SEQ ID NO: 176483 - RNA, 22 nt, Human
cuccauauguucaguuaugcag

SEQ ID NO: 176484 - RNA, 22 nt, Human
aaaacacugcaaagcugauugg

SEQ ID NO: 176485 - RNA, 22 nt, Human
gagaggggcgcgcagcucgcga

SEQ ID NO: 176486 - RNA, 22 nt, Human
ugcacuacugugauacacagcc

SEQ ID NO: 176487 - RNA, 22 nt, Human
auggggagagccucugucccca

SEQ ID NO: 176488 - RNA, 22 nt, Human
aauaagaugugcuugaguuugg

SEQ ID NO: 176489 - RNA, 22 nt, Human
gcugagaaaugcagacaugcug

SEQ ID NO: 176490 - RNA, 22 nt, Human
agagagaggggcgagcaaacac

SEQ ID NO: 176491 - RNA, 22 nt, Human
aguucgagaucugcugaugaga

SEQ ID NO: 176492 - RNA, 22 nt, Human
ucucucagaggaagaggcagug

SEQ ID NO: 176493 - RNA, 23 nt, Human
ugcccucccaaugcuucggucac

SEQ ID NO: 176494 - RNA, 22 nt, Human
ugccucagagugggcuugcuau

SEQ ID NO: 176495 - RNA, 22 nt, Human
aauugcuugucuucuucccuac

SEQ ID NO: 176496 - RNA, 21 nt, Human
agcugcagcccaaaggccugu

SEQ ID NO: 176497 - RNA, 22 nt, Human
ugcuggaggagaagguugcuca

SEQ ID NO: 176498 - RNA, 22 nt, Human
uguccucaucuuuuccagaaau

SEQ ID NO: 176499 - RNA, 22 nt, Human
gaaguugauagaguacaugauu

SEQ ID NO: 176500 - RNA, 22 nt, Human
augcuaaagggguaggccuccu

SEQ ID NO: 176501 - RNA, 22 nt, Human
uucccuggcccuggcacgcucu

SEQ ID NO: 176502 - RNA, 22 nt, Human
aacagauaauuucuaaguuacu

SEQ ID NO: 176503 - RNA, 22 nt, Human
auagaagcaagaacagaaugga

SEQ ID NO: 176504 - RNA, 22 nt, Human
agggcugagcccaggcauguag

SEQ ID NO: 176505 - RNA, 22 nt, Human
ggcugugguggcaucccugagc

SEQ ID NO: 176506 - RNA, 22 nt, Human
uggaggcaacugaagauguagu

SEQ ID NO: 176507 - RNA, 19 nt, Human
ccagagcccgccagauggg

SEQ ID NO: 176508 - RNA, 22 nt, Human
agacagacauagaaauuaguaa

SEQ ID NO: 176509 - RNA, 22 nt, Human
auuuguuaauuaugaggcauac

SEQ ID NO: 176510 - RNA, 22 nt, Human
uccugggguguguuuugcugcu

SEQ ID NO: 176511 - RNA, 22 nt, Human
ugacaggugcugggggcagugu

SEQ ID NO: 176512 - RNA, 22 nt, Human
aaucuucauaaaaaucuaguag

SEQ ID NO: 176513 - RNA, 22 nt, Human
cugcagggcagaagggcauaga

SEQ ID NO: 176514 - RNA, 22 nt, Human
gggcagagguucaacuucaaca

SEQ ID NO: 176515 - RNA, 22 nt, Human
ucuccagugaaucuccuccugg

SEQ ID NO: 176516 - RNA, 22 nt, Human
augcauguuuauagggugcuuc

SEQ ID NO: 176517 - RNA, 22 nt, Human
uggcugcugcagacagacagga

SEQ ID NO: 176518 - RNA, 22 nt, Human
uucuccagacaacagaggguga

SEQ ID NO: 176519 - RNA, 22 nt, Human
ugaagccaaucugccaggcaga

SEQ ID NO: 176520 - RNA, 22 nt, Human
agcuagaaguccuagauaaagg

SEQ ID NO: 176521 - RNA, 22 nt, Human
cagacaucuuuuaucuucagga

SEQ ID NO: 176522 - RNA, 22 nt, Human
aggaaacuaacuuaucuuuaua

SEQ ID NO: 176523 - RNA, 22 nt, Human
agagcggggauaguuaauauuc

SEQ ID NO: 176524 - RNA, 22 nt, Human
uuaaauuauugagggauuguca

SEQ ID NO: 176525 - RNA, 22 nt, Human
agagcugguuuacucaggaauu

SEQ ID NO: 176526 - RNA, 22 nt, Human
uacuuuaucagcgucaaaggua

SEQ ID NO: 176527 - RNA, 22 nt, Human
auuuccuaauuuagggauagac

SEQ ID NO: 176528 - RNA, 22 nt, Human
uguuuggaaacacuggcagaaa

SEQ ID NO: 176529 - RNA, 22 nt, Human
gcaaucaaugauuuauauuugu

SEQ ID NO: 176530 - RNA, 22 nt, Human
gucuccacagcccagcugccac

SEQ ID NO: 176531 - RNA, 22 nt, Human
gacaucauagggugggaggaaa

SEQ ID NO: 176532 - RNA, 22 nt, Human
cuuaacauccugcauuuuucuu

SEQ ID NO: 176533 - RNA, 22 nt, Human
gggcaaagugguggaggcaguu

SEQ ID NO: 176534 - RNA, 22 nt, Human
ucuugagaagcggcugucucag

SEQ ID NO: 176535 - RNA, 22 nt, Human
uaaagcugcaggcucagaaaac

SEQ ID NO: 176536 - RNA, 22 nt, Human
caaaguauauuucauagucuca

SEQ ID NO: 176537 - RNA, 22 nt, Human
cuggcuguaacauuuugccaua

SEQ ID NO: 176538 - RNA, 21 nt, Human
aauaaccacuaauauaguggc

SEQ ID NO: 176539 - RNA, 22 nt, Human
uguuucuaggucaauaauuuuu

SEQ ID NO: 176540 - RNA, 22 nt, Human
aaaggcagagugcucagcuggc

SEQ ID NO: 176541 - RNA, 22 nt, Human
uggcugugggauaugugacuga

SEQ ID NO: 176542 - RNA, 22 nt, Human
gagcucagggcauugagcaaga

SEQ ID NO: 176543 - RNA, 21 nt, Human
uuugagaauuggucagagugc

SEQ ID NO: 176544 - RNA, 22 nt, Human
gcccucuguuauugcauccuua

SEQ ID NO: 176545 - RNA, 22 nt, Human
uuucacauguggaaugccaggu

SEQ ID NO: 176546 - RNA, 22 nt, Human
aaguggaggccgaguucacgca

SEQ ID NO: 176547 - RNA, 22 nt, Human
cucugggcugaauggcugaacc

SEQ ID NO: 176548 - RNA, 22 nt, Human
uucuuuauuaguuuagugagcu

SEQ ID NO: 176549 - RNA, 22 nt, Human
ucuuauugugaugaugaagaac

SEQ ID NO: 176550 - RNA, 22 nt, Human
uucucuggggacugucucuauu

SEQ ID NO: 176551 - RNA, 22 nt, Human
cuucacaggcaagucuguuuuu

SEQ ID NO: 176552 - RNA, 18 nt, Human
ggagcccagaggugaguu

SEQ ID NO: 176553 - RNA, 22 nt, Human
ucagugcaaaaaaugggcuaga

SEQ ID NO: 176554 - RNA, 22 nt, Human
uucagagcccaaauggagauua

SEQ ID NO: 176555 - RNA, 22 nt, Human
acauaucuuuacucaucaucuc

SEQ ID NO: 176556 - RNA, 19 nt, Human
agcaggccacagggccagc

SEQ ID NO: 176557 - RNA, 22 nt, Human
ccaggucuaucaaguugggcuc

SEQ ID NO: 176558 - RNA, 22 nt, Human
uucagcacaagacuagacaggu

SEQ ID NO: 176559 - RNA, 22 nt, Human
acugucuccucaucaugccugg

SEQ ID NO: 176560 - RNA, 22 nt, Human
agggaugaucaggguagaggcu

SEQ ID NO: 176561 - RNA, 22 nt, Human
cugguguccgcaacgggcagcg

SEQ ID NO: 176562 - RNA, 20 nt, Human
cuguuugcuaucaugagcug

SEQ ID NO: 176563 - RNA, 22 nt, Human
aagucagaaauaucugccauca

SEQ ID NO: 176564 - RNA, 22 nt, Human
auuuaauuuauagauguggaua

SEQ ID NO: 176565 - RNA, 22 nt, Human
uguggcagauuuuauaaauugc

SEQ ID NO: 176566 - RNA, 22 nt, Human
ucaagucacuggcagggaugcu

SEQ ID NO: 176567 - RNA, 22 nt, Human
acauaauggacaauaaugcauc

SEQ ID NO: 176568 - RNA, 22 nt, Human
uucuagaagcucuaggggagaa

SEQ ID NO: 176569 - RNA, 22 nt, Human
uaaggcuacugucagcuucagg

SEQ ID NO: 176570 - RNA, 22 nt, Human
ggcuggcuaucugugguugccu

SEQ ID NO: 176571 - RNA, 23 nt, Human
aggccagcgcagacaccgagcac

SEQ ID NO: 176572 - RNA, 22 nt, Human
aaacaauguugucuccaagagg

SEQ ID NO: 176573 - RNA, 22 nt, Human
ccucaggcuucgucuuccaccc

SEQ ID NO: 176574 - RNA, 22 nt, Human
aaguuacagucagagguuaaca

SEQ ID NO: 176575 - RNA, 22 nt, Human
ucagggcaucucuuaaguggug

SEQ ID NO: 176576 - RNA, 22 nt, Human
agcugaaacccaggccucagcu

SEQ ID NO: 176577 - RNA, 22 nt, Human
ucucagguggcccccaugagug

SEQ ID NO: 176578 - RNA, 22 nt, Human
auaacagauacucucugugagg

SEQ ID NO: 176579 - RNA, 22 nt, Human
uacaaugcaaaauacugucugc

SEQ ID NO: 176580 - RNA, 22 nt, Human
cuccuucuccucgggaggccag

SEQ ID NO: 176581 - RNA, 21 nt, Human
uuggaaucuuaggaguguggg

SEQ ID NO: 176582 - RNA, 22 nt, Human
uggcaacaccuggaagacaugg

SEQ ID NO: 176583 - RNA, 22 nt, Human
ugaggccugcauugaacuagaa

SEQ ID NO: 176584 - RNA, 22 nt, Human
uggcaaaggaaccuauuuuaaa

SEQ ID NO: 176585 - RNA, 22 nt, Human
caucugaauuugccuuaguuuc

SEQ ID NO: 176586 - RNA, 22 nt, Human
gggcuucuggcuacuguaugag

SEQ ID NO: 176587 - RNA, 22 nt, Human
agcuaucaguaggaccauguuc

SEQ ID NO: 176588 - RNA, 22 nt, Human
uuagccauuaaauuacaaggug

SEQ ID NO: 176589 - RNA, 22 nt, Human
aagcaagcuguuggcaauaggg

SEQ ID NO: 176590 - RNA, 22 nt, Human
agguggcagaggacuccuccug

SEQ ID NO: 176591 - RNA, 22 nt, Human
uucuggguaacaaggcaagaau

SEQ ID NO: 176592 - RNA, 22 nt, Human
ucucuacauaaccucaauacuc

SEQ ID NO: 176593 - RNA, 22 nt, Human
cccaguggcuuuugcccagguu

SEQ ID NO: 176594 - RNA, 22 nt, Human
uucgcagggagacaggcucucu

SEQ ID NO: 176595 - RNA, 22 nt, Human
acacccagagcgccagugccga

SEQ ID NO: 176596 - RNA, 22 nt, Human
agaagcagcuuucaaggugauu

SEQ ID NO: 176597 - RNA, 22 nt, Human
agaguggggaagguguugagaa

SEQ ID NO: 176598 - RNA, 22 nt, Human
gacccagaaggagugcccuaga

SEQ ID NO: 176599 - RNA, 22 nt, Human
uaaaaggauuagcaggaugggc

SEQ ID NO: 176600 - RNA, 22 nt, Human
agcagcaggagccgugggguga

SEQ ID NO: 176601 - RNA, 19 nt, Human
guccaggcauuggguuggu

SEQ ID NO: 176602 - RNA, 23 nt, Human
cauaaaauauuaguaugguagca

SEQ ID NO: 176603 - RNA, 22 nt, Human
ggcuucucucuucacauggcuu

SEQ ID NO: 176604 - RNA, 23 nt, Human
ugguggcagaaguagcagaugac

SEQ ID NO: 176605 - RNA, 22 nt, Human
uccagcaugacuaguuccccau

SEQ ID NO: 176606 - RNA, 22 nt, Human
aacaaugcacuaucguaagugg

SEQ ID NO: 176607 - RNA, 22 nt, Human
guggcuggaguaugaggaaagg

SEQ ID NO: 176608 - RNA, 22 nt, Human
aucauuuuuaagagacucuucu

SEQ ID NO: 176609 - RNA, 22 nt, Human
ccuuccagaggcgugacacccu

SEQ ID NO: 176610 - RNA, 22 nt, Human
uuccaugcaagaaguauggcuc

SEQ ID NO: 176611 - RNA, 22 nt, Human
ugcccaggaucuggcgaugcuc

SEQ ID NO: 176612 - RNA, 22 nt, Human
ugauuacacagcaguaauuuca

SEQ ID NO: 176613 - RNA, 22 nt, Human
aaucacaauuacuuuugcacca

SEQ ID NO: 176614 - RNA, 22 nt, Human
ggcuuccugggcauguguucua

SEQ ID NO: 176615 - RNA, 22 nt, Human
uugagaaaccuggcaguagaga

SEQ ID NO: 176616 - RNA, 22 nt, Human
uuaucaguuguguguauacacg

SEQ ID NO: 176617 - RNA, 22 nt, Human
uguggcucuccuccugcugccc

SEQ ID NO: 176618 - RNA, 20 nt, Human
auguccagugacuggaccau

SEQ ID NO: 176619 - RNA, 22 nt, Human
aagaauguucuuguagucauga

SEQ ID NO: 176620 - RNA, 22 nt, Human
ugucucaguauacgaaacacuu

SEQ ID NO: 176621 - RNA, 22 nt, Human
auucuuaauugccaugcuguau

SEQ ID NO: 176622 - RNA, 22 nt, Human
uucaggaucaaguugccaguag

SEQ ID NO: 176623 - RNA, 22 nt, Human
augcacagaacaauuuuaagag

SEQ ID NO: 176624 - RNA, 22 nt, Human
ugguccaguaaggguggagaga

SEQ ID NO: 176625 - RNA, 22 nt, Human
aaagagcuuuccacacuaguca

SEQ ID NO: 176626 - RNA, 22 nt, Human
agccagcaucccuucagucucc

SEQ ID NO: 176627 - RNA, 22 nt, Human
aauccugaccugggcaugcuug

SEQ ID NO: 176628 - RNA, 22 nt, Human
ugcuuagaugaggcagcaggag

SEQ ID NO: 176629 - RNA, 22 nt, Human
gugagagaauuugaguuaaauu

SEQ ID NO: 176630 - RNA, 22 nt, Human
uggcccugcuaugauccugcaa

SEQ ID NO: 176631 - RNA, 22 nt, Human
cggagcuggcgucuguguggac

SEQ ID NO: 176632 - RNA, 22 nt, Human
uagaacaguauaggcuaaacau

SEQ ID NO: 176633 - RNA, 22 nt, Human
uuucuaagaugugguuucaagg

SEQ ID NO: 176634 - RNA, 22 nt, Human
gcugccuuaacuucuucgcugu

SEQ ID NO: 176635 - RNA, 22 nt, Human
uuucucaaguucagauauuuga

SEQ ID NO: 176636 - RNA, 22 nt, Human
uauguacauaacaugaaaugca

SEQ ID NO: 176637 - RNA, 22 nt, Human
guauaugagaaccauggaggug

SEQ ID NO: 176638 - RNA, 22 nt, Human
guguuuuaucagacaaaguaua

SEQ ID NO: 176639 - RNA, 22 nt, Human
agcccagauaaaguacaaccau

SEQ ID NO: 176640 - RNA, 22 nt, Human
cccuuccuugugacuggugggg

SEQ ID NO: 176641 - RNA, 22 nt, Human
gccaggacugagaaugggagca

SEQ ID NO: 176642 - RNA, 22 nt, Human
ucugaaauucacaguugaguca

SEQ ID NO: 176643 - RNA, 22 nt, Human
aaugggaagucacuacuguuac

SEQ ID NO: 176644 - RNA, 22 nt, Human
uccuguguguggccuuucccag

SEQ ID NO: 176645 - RNA, 22 nt, Human
agggaaggagguuagaacccac

SEQ ID NO: 176646 - RNA, 22 nt, Human
guacaaauuaggaagcuuugug

SEQ ID NO: 176647 - RNA, 23 nt, Human
uugauuuagcugggauugcaugc

SEQ ID NO: 176648 - RNA, 22 nt, Human
ggcuggguuauuuauggccaag

SEQ ID NO: 176649 - RNA, 22 nt, Human
cuggcagguggauggggacucc

SEQ ID NO: 176650 - RNA, 20 nt, Human
aggagcucugugcugggaag

SEQ ID NO: 176651 - RNA, 22 nt, Human
uggcaugaauuuagcuuuccau

SEQ ID NO: 176652 - RNA, 22 nt, Human
uccauacacauugaauuuuagu

SEQ ID NO: 176653 - RNA, 22 nt, Human
ugaaugauaugugaaaaggaac

SEQ ID NO: 176654 - RNA, 22 nt, Human
ggaaggcucgaggaugcuucug

SEQ ID NO: 176655 - RNA, 22 nt, Human
ugccucuguggaaauggugguc

SEQ ID NO: 176656 - RNA, 20 nt, Human
ugggcugaggaucaggugcc

SEQ ID NO: 176657 - RNA, 22 nt, Human
ggaagaaaucugguuaagagau

SEQ ID NO: 176658 - RNA, 23 nt, Human
ugugaaauuugaggucagugcuu

SEQ ID NO: 176659 - RNA, 22 nt, Human
uggcagguuaacuuacaacugu

SEQ ID NO: 176660 - RNA, 22 nt, Human
gcaggggaguggaugauggauu

SEQ ID NO: 176661 - RNA, 22 nt, Human
ucaguguccuucguucuuguug

SEQ ID NO: 176662 - RNA, 22 nt, Human
ucuguagcaagugagaggcauu

SEQ ID NO: 176663 - RNA, 22 nt, Human
uucagugugcuucaggacguua

SEQ ID NO: 176664 - RNA, 22 nt, Human
guuauugacucucuuguggcuu

SEQ ID NO: 176665 - RNA, 22 nt, Human
guccagagccggaagagugaca

SEQ ID NO: 176666 - RNA, 22 nt, Human
caguagcaugcuuaucuuuuga

SEQ ID NO: 176667 - RNA, 22 nt, Human
uguucauuaguggaaguaaguu

SEQ ID NO: 176668 - RNA, 22 nt, Human
agaucugguuggaguccugaca

SEQ ID NO: 176669 - RNA, 22 nt, Human
agcaggccugccaccucggggu

SEQ ID NO: 176670 - RNA, 22 nt, Human
gcagggcagcucacugugguuc

SEQ ID NO: 176671 - RNA, 22 nt, Human
cagagccuuaguucuccuagaa

SEQ ID NO: 176672 - RNA, 22 nt, Human
ugggcucuggagggccuaggau

SEQ ID NO: 176673 - RNA, 22 nt, Human
gugugcucaagggcaggaaccu

SEQ ID NO: 176674 - RNA, 22 nt, Human
gacaagacagcuugcagacaac

SEQ ID NO: 176675 - RNA, 22 nt, Human
cucugucacuucuccagcugag

SEQ ID NO: 176676 - RNA, 22 nt, Human
augauuacauguguuaauauac

SEQ ID NO: 176677 - RNA, 22 nt, Human
aaacacagggauauauauucca

SEQ ID NO: 176678 - RNA, 22 nt, Human
ggcugagaguuuccucuggggc

SEQ ID NO: 176679 - RNA, 22 nt, Human
aucugcuggcaucucuagccca

SEQ ID NO: 176680 - RNA, 22 nt, Human
acauguaaaaggaacaugcaug

SEQ ID NO: 176681 - RNA, 22 nt, Human
acuuggauauguucacuagacc

SEQ ID NO: 176682 - RNA, 22 nt, Human
uucugggcuuggcuguuuccau

SEQ ID NO: 176683 - RNA, 22 nt, Human
aaagauguuaugaaauaacuau

SEQ ID NO: 176684 - RNA, 22 nt, Human
augaggcucucaacaccuugag

SEQ ID NO: 176685 - RNA, 23 nt, Human
ucugagagaacaaugccuccuau

SEQ ID NO: 176686 - RNA, 22 nt, Human
ugaagcaaacgcuucuguuccu

SEQ ID NO: 176687 - RNA, 22 nt, Human
gcugggaggcagcaccuuuagc

SEQ ID NO: 176688 - RNA, 22 nt, Human
cacuaaauguuucaauguggga

SEQ ID NO: 176689 - RNA, 22 nt, Human
auuucagagugagagugcucaa

SEQ ID NO: 176690 - RNA, 22 nt, Human
caguguucccugaacauauguu

SEQ ID NO: 176691 - RNA, 22 nt, Human
uccucaguggggcauucauuau

SEQ ID NO: 176692 - RNA, 22 nt, Human
aaauuauuacaagcuaguuggc

SEQ ID NO: 176693 - RNA, 19 nt, Human
aagucacuugagggcagga

SEQ ID NO: 176694 - RNA, 22 nt, Human
uuuauugaguaucuacuaugug

SEQ ID NO: 176695 - RNA, 22 nt, Human
auggaaugugaacaugauggca

SEQ ID NO: 176696 - RNA, 22 nt, Human
gaagagcuccaaaaacagugag

SEQ ID NO: 176697 - RNA, 22 nt, Human
augcagcuauuugagcauguca

SEQ ID NO: 176698 - RNA, 22 nt, Human
gguguccuucguccgcuggcau

SEQ ID NO: 176699 - RNA, 22 nt, Human
cacagcugcacagaggaggugc

SEQ ID NO: 176700 - RNA, 22 nt, Human
uaagagcacugaagucuucuua

SEQ ID NO: 176701 - RNA, 22 nt, Human
cccaggagauaacguucccaag

SEQ ID NO: 176702 - RNA, 23 nt, Human
uccaggagaauuccagggcccgg

SEQ ID NO: 176703 - RNA, 22 nt, Human
aucuaucaccuuuagguuuguu

SEQ ID NO: 176704 - RNA, 20 nt, Human
acauuugaguaucaucuacu

SEQ ID NO: 176705 - RNA, 22 nt, Human
guccuuauuucacuuaaacgua

SEQ ID NO: 176706 - RNA, 22 nt, Human
ucagaggaaaggucagauggcu

SEQ ID NO: 176707 - RNA, 22 nt, Human
gguccugucugacaucacugcu

SEQ ID NO: 176708 - RNA, 22 nt, Human
cacugaaauauuaauaucuuau

SEQ ID NO: 176709 - RNA, 22 nt, Human
caaggcugucuccagcuuccaa

SEQ ID NO: 176710 - RNA, 22 nt, Human
caguuucuucaucaguuaagca

SEQ ID NO: 176711 - RNA, 22 nt, Human
agggaccucuucuugcagcuga

SEQ ID NO: 176712 - RNA, 22 nt, Human
uucuccagacacaaaaucuaag

SEQ ID NO: 176713 - RNA, 22 nt, Human
ugcaaacaucaauggccugagc

SEQ ID NO: 176714 - RNA, 22 nt, Human
uucagaaagguuaaucuggauu

SEQ ID NO: 176715 - RNA, 22 nt, Human
cucacugucuguacuagcugau

SEQ ID NO: 176716 - RNA, 20 nt, Human
cuucuucauuaacccuacug

SEQ ID NO: 176717 - RNA, 22 nt, Human
ggcugccugaggcagugagaga

SEQ ID NO: 176718 - RNA, 22 nt, Human
uucuuuuaaugucuggcuuuca

SEQ ID NO: 176719 - RNA, 22 nt, Human
cugagaucuuuauacgaggcac

SEQ ID NO: 176720 - RNA, 22 nt, Human
gugccaaaagcuauaauuuggu

SEQ ID NO: 176721 - RNA, 22 nt, Human
acuguacucuucuagccaucug

SEQ ID NO: 176722 - RNA, 22 nt, Human
ugcagggaaucuguggcuggac

SEQ ID NO: 176723 - RNA, 21 nt, Human
gccagcugcagggcuuccuug

SEQ ID NO: 176724 - RNA, 22 nt, Human
aauuugauucccugcaccuguu

SEQ ID NO: 176725 - RNA, 22 nt, Human
gcucagagagaggcucaccauu

SEQ ID NO: 176726 - RNA, 22 nt, Human
aggaaucagaauucuuagaauu

SEQ ID NO: 176727 - RNA, 22 nt, Human
gguuccugugccucuagcuggc

SEQ ID NO: 176728 - RNA, 22 nt, Human
caaauagacucuagaauuuauu

SEQ ID NO: 176729 - RNA, 22 nt, Human
aguccaggacuguuucagcuga

SEQ ID NO: 176730 - RNA, 22 nt, Human
ggacggggagcuggaaagggga

SEQ ID NO: 176731 - RNA, 22 nt, Human
cguuuauuuugaagauuccacu

SEQ ID NO: 176732 - RNA, 20 nt, Human
aacauugaaagucuagaaga

SEQ ID NO: 176733 - RNA, 22 nt, Human
uuugcaguuucauugcugaaau

SEQ ID NO: 176734 - RNA, 22 nt, Human
ugcuauuuggaaaagcauuugg

SEQ ID NO: 176735 - RNA, 22 nt, Human
ugagaaucauccagaggcuucu

SEQ ID NO: 176736 - RNA, 22 nt, Human
ugccugggugcuggcuggucac

SEQ ID NO: 176737 - RNA, 22 nt, Human
acuucugagaaauuuaaggaca

SEQ ID NO: 176738 - RNA, 23 nt, Human
ggaagcucacguaguccugcacu

SEQ ID NO: 176739 - RNA, 23 nt, Human
ucauuccacaaauacuuaucuag

SEQ ID NO: 176740 - RNA, 22 nt, Human
aguccaaggagagacagcauuu

SEQ ID NO: 176741 - RNA, 22 nt, Human
acugaauaauggucugugaucu

SEQ ID NO: 176742 - RNA, 22 nt, Human
uuucccacacaguccacugcag

SEQ ID NO: 176743 - RNA, 22 nt, Human
uggaaaaaacccagacucuaga

SEQ ID NO: 176744 - RNA, 22 nt, Human
aucuuucuauuucuaaaaacua

SEQ ID NO: 176745 - RNA, 22 nt, Human
guggcacaaggcuuacacagca

SEQ ID NO: 176746 - RNA, 22 nt, Human
ucacccagcgggcgcacacucg

SEQ ID NO: 176747 - RNA, 22 nt, Human
gccugcugggagacacccccag

SEQ ID NO: 176748 - RNA, 22 nt, Human
gguggggcccaggcaucugaug

SEQ ID NO: 176749 - RNA, 22 nt, Human
agguuauucucuaucucauccc

SEQ ID NO: 176750 - RNA, 22 nt, Human
ccagcagcucccucaggguccg

SEQ ID NO: 176751 - RNA, 22 nt, Human
aacugucuaaggagaauaugaa

SEQ ID NO: 176752 - RNA, 22 nt, Human
agaaggcuuuaaguacuggcau

SEQ ID NO: 176753 - RNA, 22 nt, Human
uauggcuucuuuugcaacuacu

SEQ ID NO: 176754 - RNA, 22 nt, Human
caguaucuugcuuauagacaca

SEQ ID NO: 176755 - RNA, 22 nt, Human
augauacaagcaaaacuaauca

SEQ ID NO: 176756 - RNA, 22 nt, Human
cuccagugagcgcggggcaugg

SEQ ID NO: 176757 - RNA, 22 nt, Human
gcaggaguguauuugcauguaa

SEQ ID NO: 176758 - RNA, 20 nt, Human
ggcugaaaguagaaaguauu

SEQ ID NO: 176759 - RNA, 22 nt, Human
gcugccuccgccggcuccacag

SEQ ID NO: 176760 - RNA, 22 nt, Human
uacccaggaggaaacugaggcu

SEQ ID NO: 176761 - RNA, 22 nt, Human
cacuauaucucuuucaucuuuu

SEQ ID NO: 176762 - RNA, 22 nt, Human
ugugacccccgucacggcugcu

SEQ ID NO: 176763 - RNA, 22 nt, Human
auacaucaugcuccauauauuu

SEQ ID NO: 176764 - RNA, 22 nt, Human
ggcucagagaccugcgaucuga

SEQ ID NO: 176765 - RNA, 22 nt, Human
auucucuguuuccaagaugaaa

SEQ ID NO: 176766 - RNA, 22 nt, Human
auucugggucugggugugauca

SEQ ID NO: 176767 - RNA, 19 nt, Human
aaaugugaugguacaauuc

SEQ ID NO: 176768 - RNA, 18 nt, Human
ucugagguggacgaggag

SEQ ID NO: 176769 - RNA, 22 nt, Human
cucuggaaauggccauagucau

SEQ ID NO: 176770 - RNA, 22 nt, Human
cuggaguguaaagagcauagaa

SEQ ID NO: 176771 - RNA, 22 nt, Human
cauuugaauggcauuucacuuu

SEQ ID NO: 176772 - RNA, 22 nt, Human
cuuagaguuauggaaauguuga

SEQ ID NO: 176773 - RNA, 22 nt, Human
ucagccuuguggcccugcucca

SEQ ID NO: 176774 - RNA, 22 nt, Human
ugguggcagcugggacagaggu

SEQ ID NO: 176775 - RNA, 22 nt, Human
gcucagagcaucccagugaaug

SEQ ID NO: 176776 - RNA, 22 nt, Human
guuuuucuagaaaucuccuccu

SEQ ID NO: 176777 - RNA, 22 nt, Human
ucuguucaguugauuagacaga

SEQ ID NO: 176778 - RNA, 22 nt, Human
cagcugaagcccaggcagaacc

SEQ ID NO: 176779 - RNA, 22 nt, Human
uccauaaaugaaauagaacgcu

SEQ ID NO: 176780 - RNA, 21 nt, Human
ugagagccuccaaccggcuac

SEQ ID NO: 176781 - RNA, 22 nt, Human
uuauucacucauuuaacauuau

SEQ ID NO: 176782 - RNA, 22 nt, Human
agccuuagauaaaugcuagcuc

SEQ ID NO: 176783 - RNA, 22 nt, Human
ugaauuaaaggaauucgaauuc

SEQ ID NO: 176784 - RNA, 22 nt, Human
agaugcuggggccccucggaug

SEQ ID NO: 176785 - RNA, 22 nt, Human
gccaggcuccccggaucccugg

SEQ ID NO: 176786 - RNA, 22 nt, Human
aaacucagaagguacagaaggg

SEQ ID NO: 176787 - RNA, 20 nt, Human
cugcugugugugccucagcc

SEQ ID NO: 176788 - RNA, 22 nt, Human
cagagagaggggcugccuggcc

SEQ ID NO: 176789 - RNA, 22 nt, Human
ccaggagguggcaggacuugcc

SEQ ID NO: 176790 - RNA, 23 nt, Human
ucuguggccccuucgccccacuc

SEQ ID NO: 176791 - RNA, 22 nt, Human
gaggcugagaguuuguucuacu

SEQ ID NO: 176792 - RNA, 22 nt, Human
uccaggccucuagccccuaucu

SEQ ID NO: 176793 - RNA, 22 nt, Human
ucagaaguuaauacgaggagaa

SEQ ID NO: 176794 - RNA, 18 nt, Human
auguggcuagugcuacug

SEQ ID NO: 176795 - RNA, 22 nt, Human
cacagaggcucaaagccaggug

SEQ ID NO: 176796 - RNA, 22 nt, Human
ccaggaggaaagaccagcccau

SEQ ID NO: 176797 - RNA, 22 nt, Human
ugaggccucauuuagggagagg

SEQ ID NO: 176798 - RNA, 22 nt, Human
ggcuggagaagggugguugaca

SEQ ID NO: 176799 - RNA, 22 nt, Human
agaggccuaaccaagauguccu

SEQ ID NO: 176800 - RNA, 22 nt, Human
uggugaggccaaagccaugaca

SEQ ID NO: 176801 - RNA, 18 nt, Human
aggcagcagcaucuucuc

SEQ ID NO: 176802 - RNA, 22 nt, Human
uuccacagccaucacuguugcu

SEQ ID NO: 176803 - RNA, 19 nt, Human
ucagggcaguccggucccc

SEQ ID NO: 176804 - RNA, 22 nt, Human
ggagucugaguccucauagaca

SEQ ID NO: 176805 - RNA, 22 nt, Human
gccagcaaggaggggaaaaaug

SEQ ID NO: 176806 - RNA, 22 nt, Human
agggcgacaauggagagcguuu

SEQ ID NO: 176807 - RNA, 22 nt, Human
aggucaaaaugcuuuucagguc

SEQ ID NO: 176808 - RNA, 22 nt, Human
aacaucuucagagaagcuaagu

SEQ ID NO: 176809 - RNA, 22 nt, Human
gaucuugagcaaguuguguaac

SEQ ID NO: 176810 - RNA, 22 nt, Human
aaagggcuuuauaucagugugu

SEQ ID NO: 176811 - RNA, 22 nt, Human
cucagaauuuagggcucugagg

SEQ ID NO: 176812 - RNA, 22 nt, Human
guggucaggcagugggagagaa

SEQ ID NO: 176813 - RNA, 22 nt, Human
auccaggcauucugacuucaag

SEQ ID NO: 176814 - RNA, 22 nt, Human
gugcacagagcccagggccgcg

SEQ ID NO: 176815 - RNA, 20 nt, Human
uaggcagagcugugcagccu

SEQ ID NO: 176816 - RNA, 22 nt, Human
ggagaugcuauguaguuugguu

SEQ ID NO: 176817 - RNA, 22 nt, Human
uuuccaggcagaggaguuguga

SEQ ID NO: 176818 - RNA, 22 nt, Human
uagucucuggagacucuagggg

SEQ ID NO: 176819 - RNA, 22 nt, Human
uucacaaaacacuauuuucugg

SEQ ID NO: 176820 - RNA, 22 nt, Human
uucucugugagggugcuggauu

SEQ ID NO: 176821 - RNA, 22 nt, Human
uccaguaugacugauguccuuc

SEQ ID NO: 176822 - RNA, 20 nt, Human
gucuacacgggcaguguaga

SEQ ID NO: 176823 - RNA, 22 nt, Human
gcuucugaggaaggcucagccu

SEQ ID NO: 176824 - RNA, 22 nt, Human
cucaggaaccgcggcagcagcc

SEQ ID NO: 176825 - RNA, 22 nt, Human
augcaagauguauagaagacuu

SEQ ID NO: 176826 - RNA, 22 nt, Human
auuucuagcagggcaggaaaga

SEQ ID NO: 176827 - RNA, 22 nt, Human
uucucuggacagugaagagagg

SEQ ID NO: 176828 - RNA, 22 nt, Human
aggcuucuggggcaccgagcga

SEQ ID NO: 176829 - RNA, 22 nt, Human
augucuuuuauggagaugucau

SEQ ID NO: 176830 - RNA, 22 nt, Human
cagcucuuagagggagacagac

SEQ ID NO: 176831 - RNA, 22 nt, Human
agcugucuuucugccuccugau

SEQ ID NO: 176832 - RNA, 22 nt, Human
auacagaaaaguggauagccag

SEQ ID NO: 176833 - RNA, 22 nt, Human
acacauuuagcaccagguuuau

SEQ ID NO: 176834 - RNA, 22 nt, Human
gaggugggagggcagucccuaa

SEQ ID NO: 176835 - RNA, 22 nt, Human
uauauuaucauaaaaccauuca

SEQ ID NO: 176836 - RNA, 22 nt, Human
acuuaaaaccagacagcgucau

SEQ ID NO: 176837 - RNA, 22 nt, Human
gacagccaugcacuucugcugu

SEQ ID NO: 176838 - RNA, 22 nt, Human
ccugggcucgcgcacuucaccc

SEQ ID NO: 176839 - RNA, 22 nt, Human
ucaggugucugccucuuugagu

SEQ ID NO: 176840 - RNA, 21 nt, Human
uuggccuuugucucagacacu

SEQ ID NO: 176841 - RNA, 22 nt, Human
uccucagcuuuuauuucacuug

SEQ ID NO: 176842 - RNA, 22 nt, Human
ccagagcuucggggcggcugua

SEQ ID NO: 176843 - RNA, 22 nt, Human
gaguucaguaguuauagucuag

SEQ ID NO: 176844 - RNA, 22 nt, Human
gguuacauggaagaaauauaau

SEQ ID NO: 176845 - RNA, 22 nt, Human
cagccugacaccagcuuugggc

SEQ ID NO: 176846 - RNA, 22 nt, Human
aaggccagggaugccagcucgg

SEQ ID NO: 176847 - RNA, 22 nt, Human
agagccagcaacucuagcccug

SEQ ID NO: 176848 - RNA, 22 nt, Human
auucucuggucauugaguauaa

SEQ ID NO: 176849 - RNA, 22 nt, Human
cuggcccauggugagcucuggg

SEQ ID NO: 176850 - RNA, 22 nt, Human
uucugagaugugaaucugucaa

SEQ ID NO: 176851 - RNA, 18 nt, Human
cagcugaggaccaaacug

SEQ ID NO: 176852 - RNA, 22 nt, Human
cccucccuauguagaugauguu

SEQ ID NO: 176853 - RNA, 22 nt, Human
ugcucuggguucuugcuguuac

SEQ ID NO: 176854 - RNA, 22 nt, Human
auucuuaauuccaaagacugag

SEQ ID NO: 176855 - RNA, 22 nt, Human
acacagaugauguuccaggaac

SEQ ID NO: 176856 - RNA, 22 nt, Human
cugacucuccugagauggggag

SEQ ID NO: 176857 - RNA, 22 nt, Human
ggcagcuccucucagcaaaaga

SEQ ID NO: 176858 - RNA, 22 nt, Human
uagaaaauguuccacugccauu

SEQ ID NO: 176859 - RNA, 22 nt, Human
aacaguuacccuuaagaucuuu

SEQ ID NO: 176860 - RNA, 22 nt, Human
aagaggaggauugaugugggag

SEQ ID NO: 176861 - RNA, 22 nt, Human
aagaaucauuguaaaguucugu

SEQ ID NO: 176862 - RNA, 18 nt, Human
uuauuggugcugcuguuc

SEQ ID NO: 176863 - RNA, 22 nt, Human
uuguugaauggauaaauaaauu

SEQ ID NO: 176864 - RNA, 22 nt, Human
ucucugggccucccuuuccaag

SEQ ID NO: 176865 - RNA, 22 nt, Human
ugcauagaggauccaguguggu

SEQ ID NO: 176866 - RNA, 20 nt, Human
cuugcccagggucuccugcc

SEQ ID NO: 176867 - RNA, 22 nt, Human
auugacaaucuacuauguucug

SEQ ID NO: 176868 - RNA, 18 nt, Human
ggccagagggaggguccc

SEQ ID NO: 176869 - RNA, 22 nt, Human
uaaaaaucuuaugaauggcaag

SEQ ID NO: 176870 - RNA, 22 nt, Human
uaguuaacucuugguaauaggu

SEQ ID NO: 176871 - RNA, 22 nt, Human
ucaggaaagaguuagaugauua

SEQ ID NO: 176872 - RNA, 22 nt, Human
agaaugcaguuugaaauaaggu

SEQ ID NO: 176873 - RNA, 22 nt, Human
ugagagugaaaugucacauguc

SEQ ID NO: 176874 - RNA, 22 nt, Human
uaaaaugccagaccaguucacg

SEQ ID NO: 176875 - RNA, 22 nt, Human
ugauggcuuaguggcagggcga

SEQ ID NO: 176876 - RNA, 22 nt, Human
caucuuuguucuguaaacuuuu

SEQ ID NO: 176877 - RNA, 22 nt, Human
aaggaagggaaauagugauguc

SEQ ID NO: 176878 - RNA, 22 nt, Human
aguacaaauuauagcgcuugga

SEQ ID NO: 176879 - RNA, 22 nt, Human
gcaggcugagaguccaagaagg

SEQ ID NO: 176880 - RNA, 22 nt, Human
ucuccugguauguaugcaccug

SEQ ID NO: 176881 - RNA, 22 nt, Human
ugaguucuuuccguuagguaug

SEQ ID NO: 176882 - RNA, 22 nt, Human
ggaauguuuuccagaccuagau

SEQ ID NO: 176883 - RNA, 22 nt, Human
uuggcuucauugaucucacuuu

SEQ ID NO: 176884 - RNA, 22 nt, Human
ugaggccugggcacauaaccuc

SEQ ID NO: 176885 - RNA, 22 nt, Human
gaggagccauagauagugcugc

SEQ ID NO: 176886 - RNA, 23 nt, Human
cucaccaagcgccgccgcugugu

SEQ ID NO: 176887 - RNA, 22 nt, Human
gcuggccugggcucaagaccag

SEQ ID NO: 176888 - RNA, 20 nt, Human
gccaacgcgcuggggcugcc

SEQ ID NO: 176889 - RNA, 22 nt, Human
uuauuauugauucgcucucaaa

SEQ ID NO: 176890 - RNA, 19 nt, Human
acagggcagcaauaggaua

SEQ ID NO: 176891 - RNA, 22 nt, Human
gcaugcugcagggaaugcuugu

SEQ ID NO: 176892 - RNA, 22 nt, Human
cuucucccgaagccgguucugc

SEQ ID NO: 176893 - RNA, 22 nt, Human
uauguacacuuaaguuugagaa

SEQ ID NO: 176894 - RNA, 22 nt, Human
agggagagaaguuauacaagau

SEQ ID NO: 176895 - RNA, 22 nt, Human
acaugacacaggccuggccaau

SEQ ID NO: 176896 - RNA, 22 nt, Human
aaguaguugucccugaggaacg

SEQ ID NO: 176897 - RNA, 22 nt, Human
ucuagaccuggcacugcccugu

SEQ ID NO: 176898 - RNA, 22 nt, Human
gaaauauuucucuugagccccu

SEQ ID NO: 176899 - RNA, 22 nt, Human
ucaaaugaggcugaugaaugug

SEQ ID NO: 176900 - RNA, 22 nt, Human
gaaaggcucagaaguuuguauu

SEQ ID NO: 176901 - RNA, 22 nt, Human
ucccccucauuaccucauucaa

SEQ ID NO: 176902 - RNA, 22 nt, Human
gacaacaauaauguggagcuga

SEQ ID NO: 176903 - RNA, 22 nt, Human
uccagaggcaaaaagguaugga

SEQ ID NO: 176904 - RNA, 22 nt, Human
augaaauuaaucaacacauaca

SEQ ID NO: 176905 - RNA, 22 nt, Human
uggaaacuaggauggaagaaau

SEQ ID NO: 176906 - RNA, 22 nt, Human
aagaaaccuagucuggagcagc

SEQ ID NO: 176907 - RNA, 22 nt, Human
uaacacauagauauuuuaacuu

SEQ ID NO: 176908 - RNA, 22 nt, Human
ugguccugcuacaggggauuag

SEQ ID NO: 176909 - RNA, 22 nt, Human
augggugugaaaauggucaucu

SEQ ID NO: 176910 - RNA, 20 nt, Human
guguggccaggagcugcgcu

SEQ ID NO: 176911 - RNA, 22 nt, Human
cggcagagacggcgcuuugaac

SEQ ID NO: 176912 - RNA, 22 nt, Human
auuugccuuucgaaucaacagg

SEQ ID NO: 176913 - RNA, 20 nt, Human
ugcacagacaaugagcccag

SEQ ID NO: 176914 - RNA, 22 nt, Human
agaagaguaguaacagaaauua

SEQ ID NO: 176915 - RNA, 22 nt, Human
ggaguguggagaggacaugggu

SEQ ID NO: 176916 - RNA, 20 nt, Human
agagguucagucuggagaag

SEQ ID NO: 176917 - RNA, 19 nt, Human
cccacaggaggacauaugg

SEQ ID NO: 176918 - RNA, 22 nt, Human
caacugggauaaagagcuaaag

SEQ ID NO: 176919 - RNA, 22 nt, Human
ucuccugcuucaacugauggac

SEQ ID NO: 176920 - RNA, 22 nt, Human
caggagguuguaagagcaggcc

SEQ ID NO: 176921 - RNA, 22 nt, Human
aaggccagcccuaaugaugcuc

SEQ ID NO: 176922 - RNA, 19 nt, Human
caguggagauuggaggagg

SEQ ID NO: 176923 - RNA, 22 nt, Human
gaaauacaauuuugucccagcu

SEQ ID NO: 176924 - RNA, 22 nt, Human
ggcccagagacgugcaauguac

SEQ ID NO: 176925 - RNA, 15 nt, Human
cuccaugauuuugca

SEQ ID NO: 176926 - RNA, 22 nt, Human
aguaaucaauuuuucgguggau

SEQ ID NO: 176927 - RNA, 22 nt, Human
uagaaacagauguuuuugaaga

SEQ ID NO: 176928 - RNA, 22 nt, Human
agacccagaaagcagcugcauu

SEQ ID NO: 176929 - RNA, 22 nt, Human
agugcuuugagcguuugaaaag

SEQ ID NO: 176930 - RNA, 22 nt, Human
cuggaguuagaguagacacuga

SEQ ID NO: 176931 - RNA, 22 nt, Human
uuggaauaucaugcagaauaaa

SEQ ID NO: 176932 - RNA, 20 nt, Human
cuguggaauuuuaccaugcg

SEQ ID NO: 176933 - RNA, 22 nt, Human
cagggacagcacuaaacucuug

SEQ ID NO: 176934 - RNA, 22 nt, Human
uuuacuguucaacuugcaagua

SEQ ID NO: 176935 - RNA, 22 nt, Human
gcuuccuguaggcagguccaag

SEQ ID NO: 176936 - RNA, 22 nt, Human
cuggccucagagggucauggug

SEQ ID NO: 176937 - RNA, 22 nt, Human
ugaaggcuguuggauggggaag

SEQ ID NO: 176938 - RNA, 22 nt, Human
uggaggcauugugacugcugaa

SEQ ID NO: 176939 - RNA, 22 nt, Human
gccugcagugagugcagaaggu

SEQ ID NO: 176940 - RNA, 22 nt, Human
ccagugcucauucaaguccuua

SEQ ID NO: 176941 - RNA, 23 nt, Human
uugauuucaaaugcagagaacac

SEQ ID NO: 176942 - RNA, 19 nt, Human
ggcucaagcauccagguag

SEQ ID NO: 176943 - RNA, 21 nt, Human
agggaaagaaaaugagcuaau

SEQ ID NO: 176944 - RNA, 22 nt, Human
gccuggaguuguggugaagcca

SEQ ID NO: 176945 - RNA, 22 nt, Human
accagccaagacugccuggaau

SEQ ID NO: 176946 - RNA, 22 nt, Human
cuguguccuuuaaaaaagacac

SEQ ID NO: 176947 - RNA, 22 nt, Human
cuuagauacaguagaaagacuc

SEQ ID NO: 176948 - RNA, 22 nt, Human
gacaggugagaugaggaacacc

SEQ ID NO: 176949 - RNA, 22 nt, Human
uuuacugucucagagagacaaa

SEQ ID NO: 176950 - RNA, 22 nt, Human
agguggggaggagugucucuuu

SEQ ID NO: 176951 - RNA, 22 nt, Human
guccucaggaaggcuuucugac

SEQ ID NO: 176952 - RNA, 21 nt, Human
agcaggcaaaggugaagucuu

SEQ ID NO: 176953 - RNA, 22 nt, Human
agggaaagguagugaggucaca

SEQ ID NO: 176954 - RNA, 22 nt, Human
uccucuccagcaaacuggcuau

SEQ ID NO: 176955 - RNA, 22 nt, Human
caggcugcggucggcucugguc

SEQ ID NO: 176956 - RNA, 22 nt, Human
ccugggucaccaggcccaggca

SEQ ID NO: 176957 - RNA, 22 nt, Human
acuugaauuaggccuugagaga

SEQ ID NO: 176958 - RNA, 22 nt, Human
agcuucucucaggguaucuuuc

SEQ ID NO: 176959 - RNA, 22 nt, Human
ugcaggccuaugguggggcccc

SEQ ID NO: 176960 - RNA, 22 nt, Human
cuucccuuucuggugacuucuc

SEQ ID NO: 176961 - RNA, 22 nt, Human
uuuuacaggucauagguauagu

SEQ ID NO: 176962 - RNA, 22 nt, Human
acaauuccacauggcaugcagg

SEQ ID NO: 176963 - RNA, 22 nt, Human
ucaggagguguaacgaauacag

SEQ ID NO: 176964 - RNA, 22 nt, Human
cuguuuacuuauugguaaagag

SEQ ID NO: 176965 - RNA, 22 nt, Human
aggcccugcuuuccagagcuca

SEQ ID NO: 176966 - RNA, 22 nt, Human
cuccugacacaguccacacuug

SEQ ID NO: 176967 - RNA, 20 nt, Human
uuacaaguuucuaauaacca

SEQ ID NO: 176968 - RNA, 22 nt, Human
uuccagaaaacucugccuggua

SEQ ID NO: 176969 - RNA, 22 nt, Human
caggauggcagagaaaagggug

SEQ ID NO: 176970 - RNA, 22 nt, Human
acccaggcugcuucucaguggc

SEQ ID NO: 176971 - RNA, 22 nt, Human
caucagugagccccuugaugag

SEQ ID NO: 176972 - RNA, 20 nt, Human
ugaggcucagagagguugag

SEQ ID NO: 176973 - RNA, 22 nt, Human
accuucaaguaugugggcugaa

SEQ ID NO: 176974 - RNA, 22 nt, Human
agcacccuucagcccagccugg

SEQ ID NO: 176975 - RNA, 22 nt, Human
ccagggcaauuauuuggagggu

SEQ ID NO: 176976 - RNA, 22 nt, Human
gggcucugugguugugcuuugu

SEQ ID NO: 176977 - RNA, 21 nt, Human
uaaaagaugacaagacagcuc

SEQ ID NO: 176978 - RNA, 22 nt, Human
gagcucagacucgggccugggg

SEQ ID NO: 176979 - RNA, 22 nt, Human
cccaggcuggaauuccaggccu

SEQ ID NO: 176980 - RNA, 22 nt, Human
ccuuucagguacaccagggaug

SEQ ID NO: 176981 - RNA, 19 nt, Human
aucuacaauuauucucagu

SEQ ID NO: 176982 - RNA, 22 nt, Human
ucuggaauuaaacucaggagac

SEQ ID NO: 176983 - RNA, 23 nt, Human
ucacacagcuggucagguacaga

SEQ ID NO: 176984 - RNA, 22 nt, Human
ucugggcaguaccccucuccua

SEQ ID NO: 176985 - RNA, 22 nt, Human
uaugauuuguagacauuugauu

SEQ ID NO: 176986 - RNA, 22 nt, Human
gccacagguacuaugggagaga

SEQ ID NO: 176987 - RNA, 22 nt, Human
uccaguuuccuguggcugccua

SEQ ID NO: 176988 - RNA, 22 nt, Human
cuuuacauccuguuucccguuu

SEQ ID NO: 176989 - RNA, 22 nt, Human
caagauuugggggcacggaauc

SEQ ID NO: 176990 - RNA, 22 nt, Human
cuggcuuugaaaugcauuucag

SEQ ID NO: 176991 - RNA, 22 nt, Human
guguggcugauugacaugguca

SEQ ID NO: 176992 - RNA, 22 nt, Human
agacuccaaaugaaagaggggg

SEQ ID NO: 176993 - RNA, 22 nt, Human
cuauuauuagauaaucuacuug

SEQ ID NO: 176994 - RNA, 22 nt, Human
gaaaaggcagaguuccggggaa

SEQ ID NO: 176995 - RNA, 22 nt, Human
gugcagcugccgaucagauagg

SEQ ID NO: 176996 - RNA, 22 nt, Human
aaagcuaccuuuguguucauag

SEQ ID NO: 176997 - RNA, 22 nt, Human
uuuauccauaucauuaaaaucu

SEQ ID NO: 176998 - RNA, 22 nt, Human
gcuucucuuucuccccuggcgg

SEQ ID NO: 176999 - RNA, 19 nt, Human
uuccaccaucacucuguuu

SEQ ID NO: 177000 - RNA, 22 nt, Human
caggaaugaguucuggugcucu

SEQ ID NO: 177001 - RNA, 22 nt, Human
gauccacuguguuuguguugag

SEQ ID NO: 177002 - RNA, 22 nt, Human
gccaaagugcugcucuuuacca

SEQ ID NO: 177003 - RNA, 19 nt, Human
cacagggagaccacauguc

SEQ ID NO: 177004 - RNA, 20 nt, Human
uugaagaggauauaucgcuc

SEQ ID NO: 177005 - RNA, 22 nt, Human
gacauuuauuggauuuuacgag

SEQ ID NO: 177006 - RNA, 22 nt, Human
uuugaacuaccucuccuuagca

SEQ ID NO: 177007 - RNA, 22 nt, Human
acaugccaugguuguuugcugc

SEQ ID NO: 177008 - RNA, 19 nt, Human
ugggcagguucaguaaugg

SEQ ID NO: 177009 - RNA, 22 nt, Human
aauucacaguucugcaccuuac

SEQ ID NO: 177010 - RNA, 22 nt, Human
gaauguaaaauugccuacaaga

SEQ ID NO: 177011 - RNA, 22 nt, Human
ucucuguucauggcacuauguc

SEQ ID NO: 177012 - RNA, 22 nt, Human
auguccagggggcuugacuggu

SEQ ID NO: 177013 - RNA, 22 nt, Human
cagcauggccauuucucgcugc

SEQ ID NO: 177014 - RNA, 22 nt, Human
uucuacacaccucugaggacau

SEQ ID NO: 177015 - RNA, 21 nt, Human
ucuccuggguccaacccaugc

SEQ ID NO: 177016 - RNA, 22 nt, Human
ugaugaggcuucuuggugaaca

SEQ ID NO: 177017 - RNA, 22 nt, Human
cauacauuuauacacaucuaug

SEQ ID NO: 177018 - RNA, 22 nt, Human
ucagagucauugcaaguagaag

SEQ ID NO: 177019 - RNA, 23 nt, Human
uguugaaguaacuguuacauaga

SEQ ID NO: 177020 - RNA, 22 nt, Human
agaucagaaauguaauggcagu

SEQ ID NO: 177021 - RNA, 22 nt, Human
gaagucugccugccuucucugu

SEQ ID NO: 177022 - RNA, 22 nt, Human
agucuagaaacaagguagagcu

SEQ ID NO: 177023 - RNA, 22 nt, Human
caggagagcccggguccgggcu

SEQ ID NO: 177024 - RNA, 22 nt, Human
uacuuucuagcucuccccaguu

SEQ ID NO: 177025 - RNA, 22 nt, Human
ucacaguaaaagcauggaagag

SEQ ID NO: 177026 - RNA, 22 nt, Human
caaugaaaauuuaaguugcagc

SEQ ID NO: 177027 - RNA, 17 nt, Human
ggagacagggucuuuaa

SEQ ID NO: 177028 - RNA, 22 nt, Human
gaaugauauauuagcagauuuu

SEQ ID NO: 177029 - RNA, 22 nt, Human
aaauaugugaucagugaauaaa

SEQ ID NO: 177030 - RNA, 22 nt, Human
aagugcuugaucauaguucuca

SEQ ID NO: 177031 - RNA, 22 nt, Human
ggaggcaaagcacuuugcuugg

SEQ ID NO: 177032 - RNA, 22 nt, Human
cucaggcuaagaaggccaagug

SEQ ID NO: 177033 - RNA, 22 nt, Human
uuguguuucuggccaagaugga

SEQ ID NO: 177034 - RNA, 22 nt, Human
ggcuuugcuuaacgugcuucua

SEQ ID NO: 177035 - RNA, 22 nt, Human
ggacccugcguguauccacacu

SEQ ID NO: 177036 - RNA, 22 nt, Human
gucccagcuucccacuagcagc

SEQ ID NO: 177037 - RNA, 22 nt, Human
uucuucaaacaaaaguggcaug

SEQ ID NO: 177038 - RNA, 19 nt, Human
agacacacuugauaugugu

SEQ ID NO: 177039 - RNA, 22 nt, Human
agcucugccuugacaccuucuc

SEQ ID NO: 177040 - RNA, 22 nt, Human
ucugugcaagaccaacuuucaa

SEQ ID NO: 177041 - RNA, 22 nt, Human
ccuggcuccagcugccuguccu

SEQ ID NO: 177042 - RNA, 22 nt, Human
uucuucugccucccaccugaua

SEQ ID NO: 177043 - RNA, 22 nt, Human
uaaugucaaggucauucuagag

SEQ ID NO: 177044 - RNA, 22 nt, Human
ugcugagaucugccaguagaug

SEQ ID NO: 177045 - RNA, 22 nt, Human
uguauuuucugaggagcauuag

SEQ ID NO: 177046 - RNA, 22 nt, Human
ucucugaauucugaugcaagug

SEQ ID NO: 177047 - RNA, 22 nt, Human
aaggugguaggcuauaucagua

SEQ ID NO: 177048 - RNA, 22 nt, Human
gggaucugaguaggcagaagcu

SEQ ID NO: 177049 - RNA, 21 nt, Human
uagcuuuaauauucccacauu

SEQ ID NO: 177050 - RNA, 22 nt, Human
aauaucagcucugucacuuacu

SEQ ID NO: 177051 - RNA, 22 nt, Human
aacugugggaugcauuaauuca

SEQ ID NO: 177052 - RNA, 22 nt, Human
ccuagggagccugagagcagug

SEQ ID NO: 177053 - RNA, 22 nt, Human
uuuuacaaaugaggagcuggag

SEQ ID NO: 177054 - RNA, 22 nt, Human
auuaguaaaacauuguauaugu

SEQ ID NO: 177055 - RNA, 22 nt, Human
uugagcacaggugaacagcauc

SEQ ID NO: 177056 - RNA, 22 nt, Human
ggcucuggucagugaggggccu

SEQ ID NO: 177057 - RNA, 22 nt, Human
agucuuagaacuacagugccua

SEQ ID NO: 177058 - RNA, 22 nt, Human
uuucaaagaguuguaaauuacu

SEQ ID NO: 177059 - RNA, 22 nt, Human
agaguuucuugugagcacugac

SEQ ID NO: 177060 - RNA, 22 nt, Human
ugcacacacucugcauauacuu

SEQ ID NO: 177061 - RNA, 22 nt, Human
acuucagaguuaguuauagacc

SEQ ID NO: 177062 - RNA, 22 nt, Human
uuggcccagggucagcggcgcu

SEQ ID NO: 177063 - RNA, 19 nt, Human
ccaggagagcuuggagaag

SEQ ID NO: 177064 - RNA, 22 nt, Human
ccuuccuuugcaucauuucuag

SEQ ID NO: 177065 - RNA, 22 nt, Human
cagaggcuaagaugagugggug

SEQ ID NO: 177066 - RNA, 22 nt, Human
guauuagucaauuacagugggg

SEQ ID NO: 177067 - RNA, 22 nt, Human
auuacaaguuucaguguuuugc

SEQ ID NO: 177068 - RNA, 22 nt, Human
uccaaauauagaugaguuguaa

SEQ ID NO: 177069 - RNA, 22 nt, Human
agcccaggucuggcccagccug

SEQ ID NO: 177070 - RNA, 22 nt, Human
guccugagggcccaggcauucu

SEQ ID NO: 177071 - RNA, 21 nt, Human
cuacuuaaguaggggauuagg

SEQ ID NO: 177072 - RNA, 22 nt, Human
gcuggccauauauuuugcuguu

SEQ ID NO: 177073 - RNA, 22 nt, Human
gaggccuggguuggaggugcau

SEQ ID NO: 177074 - RNA, 22 nt, Human
cccuuagagauucugucagagu

SEQ ID NO: 177075 - RNA, 21 nt, Human
agacuucuagaagugagauag

SEQ ID NO: 177076 - RNA, 22 nt, Human
aaacauguaauucugcuuaaga

SEQ ID NO: 177077 - RNA, 22 nt, Human
gaggcugcagcuaucagacauu

SEQ ID NO: 177078 - RNA, 22 nt, Human
gguggagagcuggaugagaggu

SEQ ID NO: 177079 - RNA, 22 nt, Human
acauucuuaacaguuaaaaacu

SEQ ID NO: 177080 - RNA, 21 nt, Human
uggcucugaaagagugcugca

SEQ ID NO: 177081 - RNA, 22 nt, Human
agucuagaaugugcaccaagcu

SEQ ID NO: 177082 - RNA, 22 nt, Human
gaacacugagaaagucagcuuu

SEQ ID NO: 177083 - RNA, 22 nt, Human
caacauuugaguaaagaaaugg

SEQ ID NO: 177084 - RNA, 22 nt, Human
uagaaaacuaauacaugcuuga

SEQ ID NO: 177085 - RNA, 22 nt, Human
gggcagguggcagggucucugg

SEQ ID NO: 177086 - RNA, 22 nt, Human
uggcagcuguguccagguagaa

SEQ ID NO: 177087 - RNA, 22 nt, Human
gcucaggccuggcccaugggac

SEQ ID NO: 177088 - RNA, 22 nt, Human
auccugaaaacuuacgaagugg

SEQ ID NO: 177089 - RNA, 20 nt, Human
uucuaguuuggaguuauuaa

SEQ ID NO: 177090 - RNA, 22 nt, Human
acauuugucuuccuccucagug

SEQ ID NO: 177091 - RNA, 22 nt, Human
agaaacucuggaagaacuuuua

SEQ ID NO: 177092 - RNA, 22 nt, Human
auaaaugugaauuagagcuuug

SEQ ID NO: 177093 - RNA, 22 nt, Human
ucagagaaucucuccuuaguuu

SEQ ID NO: 177094 - RNA, 22 nt, Human
acucuguacuuucuuguugugu

SEQ ID NO: 177095 - RNA, 22 nt, Human
uguccaugggcgucaggcagga

SEQ ID NO: 177096 - RNA, 21 nt, Human
accucaagcaacaaccaaggu

SEQ ID NO: 177097 - RNA, 22 nt, Human
aguggcagagcaggugcuggaa

SEQ ID NO: 177098 - RNA, 22 nt, Human
aaggcuuguugaguaucuacug

SEQ ID NO: 177099 - RNA, 22 nt, Human
uaaacagccuccccuuucacuc

SEQ ID NO: 177100 - RNA, 22 nt, Human
ucucaguguggugcuuaggaua

SEQ ID NO: 177101 - RNA, 22 nt, Human
uccuagaacuccaggacagucc

SEQ ID NO: 177102 - RNA, 22 nt, Human
uagcaucuguucuuucauuaaa

SEQ ID NO: 177103 - RNA, 22 nt, Human
ucucugugcccaguaguucucu

SEQ ID NO: 177104 - RNA, 22 nt, Human
uaauauacuucccauaguuuga

SEQ ID NO: 177105 - RNA, 22 nt, Human
agauacaaaggccuacagagca

SEQ ID NO: 177106 - RNA, 22 nt, Human
cagcugagucugagguucuuug

SEQ ID NO: 177107 - RNA, 22 nt, Human
ggggaggaccuuuccaaggcuu

SEQ ID NO: 177108 - RNA, 22 nt, Human
uguguccugugaucucuagggu

SEQ ID NO: 177109 - RNA, 22 nt, Human
uaacuguaccuagauaacgaac

SEQ ID NO: 177110 - RNA, 22 nt, Human
uccuggagauaauugcagugaa

SEQ ID NO: 177111 - RNA, 20 nt, Human
uuacaaagaggcaucgcuuu

SEQ ID NO: 177112 - RNA, 22 nt, Human
agaagugccgaaaggaagacag

SEQ ID NO: 177113 - RNA, 22 nt, Human
aacacagguugcugggccucac

SEQ ID NO: 177114 - RNA, 22 nt, Human
acagauggaauguguuauggga

SEQ ID NO: 177115 - RNA, 22 nt, Human
uauuacaaauuauaaugggaga

SEQ ID NO: 177116 - RNA, 22 nt, Human
ugcaauuagcguauuaguuuau

SEQ ID NO: 177117 - RNA, 22 nt, Human
uuagauaacaguagaauaucaa

SEQ ID NO: 177118 - RNA, 22 nt, Human
agcacagauucugaagaguccu

SEQ ID NO: 177119 - RNA, 22 nt, Human
ugaggcagucacccccuccugc

SEQ ID NO: 177120 - RNA, 22 nt, Human
agguggggccaaaugcuacagu

SEQ ID NO: 177121 - RNA, 22 nt, Human
cugagcuguuuaaucccagaua

SEQ ID NO: 177122 - RNA, 22 nt, Human
gcucaggauuucauccaugugu

SEQ ID NO: 177123 - RNA, 22 nt, Human
gaagugaagagauuagaaauca

SEQ ID NO: 177124 - RNA, 22 nt, Human
acccggagucggagguugcagu

SEQ ID NO: 177125 - RNA, 22 nt, Human
uccccaggaaggcccuuccugg

SEQ ID NO: 177126 - RNA, 21 nt, Human
uugggaucugagaagugaaaa

SEQ ID NO: 177127 - RNA, 22 nt, Human
ggcccagucuggggcccuguga

SEQ ID NO: 177128 - RNA, 22 nt, Human
gagccuggccuccugccucagc

SEQ ID NO: 177129 - RNA, 20 nt, Human
uacaggcucugagagaugau

SEQ ID NO: 177130 - RNA, 23 nt, Human
ucugucuuguuuaggccacuguu

SEQ ID NO: 177131 - RNA, 22 nt, Human
uuagaaagaacuuuagauauca

SEQ ID NO: 177132 - RNA, 22 nt, Human
gccuguuugagaauagucaggg

SEQ ID NO: 177133 - RNA, 19 nt, Human
ucaaaacacaaaugguuga

SEQ ID NO: 177134 - RNA, 22 nt, Human
aaagucugagcagaauuucuca

SEQ ID NO: 177135 - RNA, 22 nt, Human
gggaagggagggaccucagucu

SEQ ID NO: 177136 - RNA, 22 nt, Human
aaauuucuugaggcucucuagc

SEQ ID NO: 177137 - RNA, 18 nt, Human
ggcugcuuaaggagaucc

SEQ ID NO: 177138 - RNA, 20 nt, Human
uggggaaagccaucgaugag

SEQ ID NO: 177139 - RNA, 20 nt, Human
cccagcccgggccgcgcucg

SEQ ID NO: 177140 - RNA, 22 nt, Human
uucaguguacagugaagggauu

SEQ ID NO: 177141 - RNA, 22 nt, Human
gcccaggagguggaggugcagu

SEQ ID NO: 177142 - RNA, 22 nt, Human
gcugggaguuacugucuccuuu

SEQ ID NO: 177143 - RNA, 22 nt, Human
gacagauggucaguguugaagu

SEQ ID NO: 177144 - RNA, 22 nt, Human
ccugucaggguuugccucagaa

SEQ ID NO: 177145 - RNA, 22 nt, Human
agagccaguuacaacuguggag

SEQ ID NO: 177146 - RNA, 22 nt, Human
uauugguauaggcauugaaacu

SEQ ID NO: 177147 - RNA, 22 nt, Human
gccuguuucuaaucucauuucu

SEQ ID NO: 177148 - RNA, 22 nt, Human
cccaggucucccugcagcccug

SEQ ID NO: 177149 - RNA, 21 nt, Human
uguucagaccaacuuggacug

SEQ ID NO: 177150 - RNA, 22 nt, Human
cucuuucucgccgcccgcaguc

SEQ ID NO: 177151 - RNA, 22 nt, Human
ccucagagcgcguggcauuauu

SEQ ID NO: 177152 - RNA, 22 nt, Human
cucagcaagauuaagcagcuug

SEQ ID NO: 177153 - RNA, 22 nt, Human
gcuccuggugcuguagagauuu

SEQ ID NO: 177154 - RNA, 22 nt, Human
ugaguccugcugagcagagagg

SEQ ID NO: 177155 - RNA, 22 nt, Human
aacaaauguaaaaugcagaugc

SEQ ID NO: 177156 - RNA, 22 nt, Human
ggcucagcuuaucugggcaggc

SEQ ID NO: 177157 - RNA, 18 nt, Human
ugccauccccagucaagu

SEQ ID NO: 177158 - RNA, 18 nt, Human
gccugccuagagcuugcc

SEQ ID NO: 177159 - RNA, 22 nt, Human
cagcacagcuggcucuggaagc

SEQ ID NO: 177160 - RNA, 22 nt, Human
uucugcugcgacccaggaguua

SEQ ID NO: 177161 - RNA, 22 nt, Human
uaggccagcccuuaguccuguc

SEQ ID NO: 177162 - RNA, 18 nt, Human
aaggcuucaaagaguaga

SEQ ID NO: 177163 - RNA, 21 nt, Human
ccuggcuucagggugcacugg

SEQ ID NO: 177164 - RNA, 22 nt, Human
aggguagcuacccaacuccaga

SEQ ID NO: 177165 - RNA, 22 nt, Human
uaacacugcuucauuuuggaga

SEQ ID NO: 177166 - RNA, 22 nt, Human
cccucucucaggcugacagccu

SEQ ID NO: 177167 - RNA, 22 nt, Human
cuccccacauuucucccugucu

SEQ ID NO: 177168 - RNA, 22 nt, Human
cccagcuugucugauucagccu

SEQ ID NO: 177169 - RNA, 22 nt, Human
aaauuauuuucagaauggagaa

SEQ ID NO: 177170 - RNA, 22 nt, Human
auguucuaaucccugcuaugua

SEQ ID NO: 177171 - RNA, 22 nt, Human
cuuuaguucuagaaagugaaac

SEQ ID NO: 177172 - RNA, 22 nt, Human
ucuguggaccaggguauaagga

SEQ ID NO: 177173 - RNA, 23 nt, Human
agcagggccagaauacuugcugu

SEQ ID NO: 177174 - RNA, 22 nt, Human
ucuagagcuggaguagaaugug

SEQ ID NO: 177175 - RNA, 22 nt, Human
ucauauaaguuuaaaacuaucu

SEQ ID NO: 177176 - RNA, 22 nt, Human
ugaacuuacaaauuaaaagacu

SEQ ID NO: 177177 - RNA, 22 nt, Human
ugccugaacaugaauaguuuau

SEQ ID NO: 177178 - RNA, 21 nt, Human
aguucuguuaugcuggacuca

SEQ ID NO: 177179 - RNA, 22 nt, Human
cuuccuggaugaagcccagcau

SEQ ID NO: 177180 - RNA, 22 nt, Human
uccugcagccaagggucaucga

SEQ ID NO: 177181 - RNA, 22 nt, Human
ccuucagaaugaaauucuaaug

SEQ ID NO: 177182 - RNA, 22 nt, Human
cuccuccuggacacaggcugug

SEQ ID NO: 177183 - RNA, 22 nt, Human
ucugagcuagaaaguaugcccu

SEQ ID NO: 177184 - RNA, 22 nt, Human
cuccugucaauaggcuccuggc

SEQ ID NO: 177185 - RNA, 22 nt, Human
acaagauuuuaugacucuuuuu

SEQ ID NO: 177186 - RNA, 22 nt, Human
agcugggguugcacacauuuug

SEQ ID NO: 177187 - RNA, 22 nt, Human
aagcaugguggaugauacagug

SEQ ID NO: 177188 - RNA, 22 nt, Human
uucuuucccaguagaugugaaa

SEQ ID NO: 177189 - RNA, 22 nt, Human
aggcugggaagguaaaguugua

SEQ ID NO: 177190 - RNA, 22 nt, Human
uuuuagaaguucaugugggauu

SEQ ID NO: 177191 - RNA, 23 nt, Human
ucucaugucuuuccuacaagcau

SEQ ID NO: 177192 - RNA, 22 nt, Human
ugaugaaacugagguuccaaga

SEQ ID NO: 177193 - RNA, 22 nt, Human
caguuaaacagauugaguguua

SEQ ID NO: 177194 - RNA, 22 nt, Human
cacugucugggacauguggucu

SEQ ID NO: 177195 - RNA, 22 nt, Human
uuucauaaugucacagucaaaa

SEQ ID NO: 177196 - RNA, 22 nt, Human
uauuuauucuuuguacugccuu

SEQ ID NO: 177197 - RNA, 22 nt, Human
ugggagaaacugucucucccac

SEQ ID NO: 177198 - RNA, 22 nt, Human
uucuucaguguagcaacuguau

SEQ ID NO: 177199 - RNA, 22 nt, Human
uugaaauagaugcgucagagau

SEQ ID NO: 177200 - RNA, 22 nt, Human
aagggcuccaagagguagcugg

SEQ ID NO: 177201 - RNA, 22 nt, Human
gcauacagagaggauguggcau

SEQ ID NO: 177202 - RNA, 22 nt, Human
agggcagugggaaagccugcuc

SEQ ID NO: 177203 - RNA, 22 nt, Human
uccacagaauguaagauccaca

SEQ ID NO: 177204 - RNA, 22 nt, Human
ucagccacuucccucuggucag

SEQ ID NO: 177205 - RNA, 22 nt, Human
aggcucagcccaagguggagag

SEQ ID NO: 177206 - RNA, 22 nt, Human
gucaggcugccagucuuuauug

SEQ ID NO: 177207 - RNA, 23 nt, Human
ugugcacaucugacgggugaagg

SEQ ID NO: 177208 - RNA, 22 nt, Human
uccagagguauguagagaguau

SEQ ID NO: 177209 - RNA, 22 nt, Human
cuuggugcccagcagguggcug

SEQ ID NO: 177210 - RNA, 22 nt, Human
acugucugcuggccccugguua

SEQ ID NO: 177211 - RNA, 22 nt, Human
cagucuggcucagcacaaaggg

SEQ ID NO: 177212 - RNA, 22 nt, Human
aaugauaccgccaauauuacca

SEQ ID NO: 177213 - RNA, 22 nt, Human
caggcuacauuugcucugagaa

SEQ ID NO: 177214 - RNA, 22 nt, Human
ucaggcuguaaauggugugggu

SEQ ID NO: 177215 - RNA, 22 nt, Human
augaaaauugacagcggaagua

SEQ ID NO: 177216 - RNA, 22 nt, Human
cagcaggcuggacuucaguccc

SEQ ID NO: 177217 - RNA, 22 nt, Human
aaugguuuguaccuguccuugg

SEQ ID NO: 177218 - RNA, 22 nt, Human
ucacaggcuggucuccgaggac

SEQ ID NO: 177219 - RNA, 22 nt, Human
ucagaaguauuaugcuaaagga

SEQ ID NO: 177220 - RNA, 22 nt, Human
gauggaaugaauggcagauaca

SEQ ID NO: 177221 - RNA, 22 nt, Human
auuacacauagacauucguuca

SEQ ID NO: 177222 - RNA, 22 nt, Human
aagcccugaccugagaguccgu

SEQ ID NO: 177223 - RNA, 22 nt, Human
acauacuuaugcuaaaaauaua

SEQ ID NO: 177224 - RNA, 22 nt, Human
uuuagaaauucaucuauggccu

SEQ ID NO: 177225 - RNA, 22 nt, Human
auauuaaaacuaugguuuucag

SEQ ID NO: 177226 - RNA, 19 nt, Human
cucuccaccuaacagguau

SEQ ID NO: 177227 - RNA, 21 nt, Human
ugaauuucgguauggcuauaa

SEQ ID NO: 177228 - RNA, 22 nt, Human
ccucuggccaucccccauuaag

SEQ ID NO: 177229 - RNA, 22 nt, Human
cuuagcaguggguaccagggcu

SEQ ID NO: 177230 - RNA, 22 nt, Human
cauguguccuagcuauucuccu

SEQ ID NO: 177231 - RNA, 22 nt, Human
aacauuguuuucccuauaucca

SEQ ID NO: 177232 - RNA, 22 nt, Human
uccuggccauaggcuauuucag

SEQ ID NO: 177233 - RNA, 17 nt, Human
aggcuccuccuaagguc

SEQ ID NO: 177234 - RNA, 22 nt, Human
uugacagcuacggagcagcugu

SEQ ID NO: 177235 - RNA, 22 nt, Human
acagguggacacagcagcaguc

SEQ ID NO: 177236 - RNA, 22 nt, Human
guuaguguauauugccuucaaa

SEQ ID NO: 177237 - RNA, 22 nt, Human
ccaccucucaggguuuccuaau

SEQ ID NO: 177238 - RNA, 22 nt, Human
cccugugccagagaggcaggag

SEQ ID NO: 177239 - RNA, 22 nt, Human
uagugucaaacagggauuagaa

SEQ ID NO: 177240 - RNA, 22 nt, Human
uacaccagguguuauggucaau

SEQ ID NO: 177241 - RNA, 22 nt, Human
uuuaccacaauuuuaaacaaug

SEQ ID NO: 177242 - RNA, 22 nt, Human
uagcacaguucacuaugauaca

SEQ ID NO: 177243 - RNA, 22 nt, Human
gugcaugaagacucagaaaguc

SEQ ID NO: 177244 - RNA, 22 nt, Human
aucacacuguuauuuuaguuaa

SEQ ID NO: 177245 - RNA, 22 nt, Human
ugcaauaacccaugagauagaa

SEQ ID NO: 177246 - RNA, 22 nt, Human
gaggagcacaugaggcugaggg

SEQ ID NO: 177247 - RNA, 22 nt, Human
ccauuagaagauguaauagaga

SEQ ID NO: 177248 - RNA, 22 nt, Human
ugggggcugaguaagaugagau

SEQ ID NO: 177249 - RNA, 22 nt, Human
ggggaccuuuccauuucugaga

SEQ ID NO: 177250 - RNA, 22 nt, Human
auccaagucagggauaguuuga

SEQ ID NO: 177251 - RNA, 22 nt, Human
uggcuucucccuccccaucuag

SEQ ID NO: 177252 - RNA, 22 nt, Human
ugccgcagugcggggagggccc

SEQ ID NO: 177253 - RNA, 22 nt, Human
augaggcaguacacacaaagcc

SEQ ID NO: 177254 - RNA, 21 nt, Human
aucuggaagaacugguaagug

SEQ ID NO: 177255 - RNA, 22 nt, Human
guuuuacacaccuaugaaagac

SEQ ID NO: 177256 - RNA, 22 nt, Human
aguggcuggcauaggaacagac

SEQ ID NO: 177257 - RNA, 22 nt, Human
cgcaggcugcagccaagaagag

SEQ ID NO: 177258 - RNA, 22 nt, Human
uaaaguagcaaguuuagacuga

SEQ ID NO: 177259 - RNA, 22 nt, Human
uuggaggaaauugcuuuugugg

SEQ ID NO: 177260 - RNA, 22 nt, Human
ggcugugggccagcuagacccu

SEQ ID NO: 177261 - RNA, 22 nt, Human
cuguuaaucugcuugcaugaug

SEQ ID NO: 177262 - RNA, 22 nt, Human
uggaggagaccauuccacucag

SEQ ID NO: 177263 - RNA, 22 nt, Human
caggauccuggcugcauggacg

SEQ ID NO: 177264 - RNA, 22 nt, Human
cuacagcuguguguuuaugugc

SEQ ID NO: 177265 - RNA, 22 nt, Human
gcuggcagucccaucagcuggg

SEQ ID NO: 177266 - RNA, 22 nt, Human
agcagcuguuuguugaauuggu

SEQ ID NO: 177267 - RNA, 22 nt, Human
uuguagauggcuuauuucugug

SEQ ID NO: 177268 - RNA, 17 nt, Human
ugugcauagaauaauga

SEQ ID NO: 177269 - RNA, 22 nt, Human
uuggcagagaguaugcugaaga

SEQ ID NO: 177270 - RNA, 22 nt, Human
accugcaggggugcucucuggg

SEQ ID NO: 177271 - RNA, 22 nt, Human
aacuguggacuugagacugaug

SEQ ID NO: 177272 - RNA, 22 nt, Human
aauuggaaaaugcuacauauca

SEQ ID NO: 177273 - RNA, 22 nt, Human
uggaggcaggagacagggcaaa

SEQ ID NO: 177274 - RNA, 21 nt, Human
augggcagaggcagagaggcu

SEQ ID NO: 177275 - RNA, 20 nt, Human
acucuggggcucauuagggg

SEQ ID NO: 177276 - RNA, 22 nt, Human
uguaggucaaguccauugugcu

SEQ ID NO: 177277 - RNA, 22 nt, Human
augacauaaagcuaugcuaggu

SEQ ID NO: 177278 - RNA, 22 nt, Human
uuuaaaaggcagcuucuuuugu

SEQ ID NO: 177279 - RNA, 18 nt, Human
uccugcagcuucuaugua

SEQ ID NO: 177280 - RNA, 22 nt, Human
cuauuuucauucuuacauuguc

SEQ ID NO: 177281 - RNA, 18 nt, Human
gaaagccaugcagcagug

SEQ ID NO: 177282 - RNA, 22 nt, Human
agacaagacuaggcaguuguug

SEQ ID NO: 177283 - RNA, 22 nt, Human
gaucuagaaggcaaauauagug

SEQ ID NO: 177284 - RNA, 22 nt, Human
uccuguuuccaauuuguugggu

SEQ ID NO: 177285 - RNA, 22 nt, Human
ugaaccaucuggcuccagaaga

SEQ ID NO: 177286 - RNA, 21 nt, Human
gcucagagaggguaauuaacc

SEQ ID NO: 177287 - RNA, 22 nt, Human
acuggugguuucuccccagaga

SEQ ID NO: 177288 - RNA, 22 nt, Human
cuggaggccacuguacagauug

SEQ ID NO: 177289 - RNA, 22 nt, Human
ggcagaggugacagugucuuuu

SEQ ID NO: 177290 - RNA, 17 nt, Human
ggccuguguggcugcag

SEQ ID NO: 177291 - RNA, 22 nt, Human
uccuaaaggcugcuuuuauauu

SEQ ID NO: 177292 - RNA, 22 nt, Human
aacuccauuucccugccuccug

SEQ ID NO: 177293 - RNA, 22 nt, Human
cugaggagagguggccuguguu

SEQ ID NO: 177294 - RNA, 22 nt, Human
agccaugggagacugugggaga

SEQ ID NO: 177295 - RNA, 22 nt, Human
cugacuuuuccaaauaauacuu

SEQ ID NO: 177296 - RNA, 22 nt, Human
ugucacauuauaugugaggaua

SEQ ID NO: 177297 - RNA, 22 nt, Human
uugauuuauagaauguucaagc

SEQ ID NO: 177298 - RNA, 22 nt, Human
uuacaguggucauuugggaaaa

SEQ ID NO: 177299 - RNA, 22 nt, Human
ccucuggggguccucagagucu

SEQ ID NO: 177300 - RNA, 22 nt, Human
uagcccagcuuggccuauuucu

SEQ ID NO: 177301 - RNA, 20 nt, Human
acauguacagacagguuucu

SEQ ID NO: 177302 - RNA, 22 nt, Human
aggcugcuauaaacauucccgu

SEQ ID NO: 177303 - RNA, 21 nt, Human
gaggaaugguuugcaaagcac

SEQ ID NO: 177304 - RNA, 22 nt, Human
agugccuugugugugggcagcc

SEQ ID NO: 177305 - RNA, 19 nt, Human
agagaggcugugugaggga

SEQ ID NO: 177306 - RNA, 22 nt, Human
agugauucuuuaaagugguauu

SEQ ID NO: 177307 - RNA, 22 nt, Human
cucaguguuaaauauaagguau

SEQ ID NO: 177308 - RNA, 22 nt, Human
cugggcacuugcucacagcucu

SEQ ID NO: 177309 - RNA, 22 nt, Human
aggcugugaugagccucaugga

SEQ ID NO: 177310 - RNA, 19 nt, Human
gcugggugggguccacagc

SEQ ID NO: 177311 - RNA, 22 nt, Human
uucagagccacuucaagucuaa

SEQ ID NO: 177312 - RNA, 22 nt, Human
ugcccucccuguacugucagga

SEQ ID NO: 177313 - RNA, 22 nt, Human
uuuuauauggcacauugguugg

SEQ ID NO: 177314 - RNA, 22 nt, Human
cuggguguagcccaguaugagg

SEQ ID NO: 177315 - RNA, 22 nt, Human
agcaggcuuuccacagaaggag

SEQ ID NO: 177316 - RNA, 20 nt, Human
gucaaacuacuggcagugcc

SEQ ID NO: 177317 - RNA, 22 nt, Human
agccaccaccacugaaagguua

SEQ ID NO: 177318 - RNA, 22 nt, Human
uagaggagaacacaaauuauag

SEQ ID NO: 177319 - RNA, 17 nt, Human
uggcucugaggcugaau

SEQ ID NO: 177320 - RNA, 20 nt, Human
uggaggcagagccagaggga

SEQ ID NO: 177321 - RNA, 22 nt, Human
gagaggcccuguggucccagcu

SEQ ID NO: 177322 - RNA, 22 nt, Human
auggcagggcccuuggcuccca

SEQ ID NO: 177323 - RNA, 22 nt, Human
uuuaugcacaauuagucuuaua

SEQ ID NO: 177324 - RNA, 22 nt, Human
cacaguggcaaaggggcuuggg

SEQ ID NO: 177325 - RNA, 17 nt, Human
ccaggucuccuugcuuu

SEQ ID NO: 177326 - RNA, 22 nt, Human
uccugcagcugauaaauacagu

SEQ ID NO: 177327 - RNA, 22 nt, Human
gcuggcagagcucugggcuggg

SEQ ID NO: 177328 - RNA, 23 nt, Human
uuauaaauauuuucagguguguu

SEQ ID NO: 177329 - RNA, 22 nt, Human
auguggaucacagggguguguc

SEQ ID NO: 177330 - RNA, 22 nt, Human
cauuuccacucugggagucaga

SEQ ID NO: 177331 - RNA, 23 nt, Human
aggguggcuugcuuugcuuccuu

SEQ ID NO: 177332 - RNA, 22 nt, Human
agcugcaauacccuucuuccuu

SEQ ID NO: 177333 - RNA, 22 nt, Human
gagaagucauuugaccaccuag

SEQ ID NO: 177334 - RNA, 18 nt, Human
uauauuucacacauauuc

SEQ ID NO: 177335 - RNA, 23 nt, Human
gccaggcuccggucuguggccac

SEQ ID NO: 177336 - RNA, 22 nt, Human
caggcuccaagcccucugaugu

SEQ ID NO: 177337 - RNA, 22 nt, Human
aucuuagacccuugguagaaaa

SEQ ID NO: 177338 - RNA, 21 nt, Human
agaugcaguuugcaggugggu

SEQ ID NO: 177339 - RNA, 22 nt, Human
aguccuggacuuggagucaggg

SEQ ID NO: 177340 - RNA, 22 nt, Human
ggcuugcuucuuguccaggaau

SEQ ID NO: 177341 - RNA, 18 nt, Human
cccaggcuuugugggucu

SEQ ID NO: 177342 - RNA, 22 nt, Human
ccaggagcgggaaaaggaagaa

SEQ ID NO: 177343 - RNA, 22 nt, Human
caggagcaugcugaugccagaa

SEQ ID NO: 177344 - RNA, 20 nt, Human
gauuacaaaaugaaaugcau

SEQ ID NO: 177345 - RNA, 22 nt, Human
acuugguucuaacuaguguaua

SEQ ID NO: 177346 - RNA, 22 nt, Human
caagauguggugggcugaguuu

SEQ ID NO: 177347 - RNA, 22 nt, Human
gcuguggccuccagcacucccc

SEQ ID NO: 177348 - RNA, 22 nt, Human
uuauaggaaaaguucuagaaaa

SEQ ID NO: 177349 - RNA, 22 nt, Human
ugcauucaucauuugaaagccc

SEQ ID NO: 177350 - RNA, 22 nt, Human
aaagugcagcuugugaucccua

SEQ ID NO: 177351 - RNA, 22 nt, Human
gccugcagccucagagaauuuu

SEQ ID NO: 177352 - RNA, 20 nt, Human
aggcaugggaugcccagauu

SEQ ID NO: 177353 - RNA, 22 nt, Human
uaaggcuucagcauucaaaaca

SEQ ID NO: 177354 - RNA, 22 nt, Human
agggcugacaguaaaaguauga

SEQ ID NO: 177355 - RNA, 19 nt, Human
ugguggaggccccauguuc

SEQ ID NO: 177356 - RNA, 22 nt, Human
cacauucagggaacauuggagg

SEQ ID NO: 177357 - RNA, 22 nt, Human
aaugaugaacucagagggaacc

SEQ ID NO: 177358 - RNA, 22 nt, Human
gaggcuccauggaggaguaugg

SEQ ID NO: 177359 - RNA, 22 nt, Human
caugcucacaaaagauggcaaa

SEQ ID NO: 177360 - RNA, 22 nt, Human
agcaggcaccagggcucguccu

SEQ ID NO: 177361 - RNA, 22 nt, Human
agaggcugggcaggacccacag

SEQ ID NO: 177362 - RNA, 22 nt, Human
gagggcugaaguguuuuaugag

SEQ ID NO: 177363 - RNA, 22 nt, Human
cuguugcugggaacgcauguca

SEQ ID NO: 177364 - RNA, 22 nt, Human
cugcugaggccuucccuguccu

SEQ ID NO: 177365 - RNA, 22 nt, Human
caagugucuauaucagugcuug

SEQ ID NO: 177366 - RNA, 22 nt, Human
acaguauacauugauuaggacc

SEQ ID NO: 177367 - RNA, 22 nt, Human
aagaaaagauguuugguuuuca

SEQ ID NO: 177368 - RNA, 22 nt, Human
acacaugcgauagagagguagg

SEQ ID NO: 177369 - RNA, 20 nt, Human
uagauacccaaugcucauca

SEQ ID NO: 177370 - RNA, 22 nt, Human
ucucuggguaaaguucucucau

SEQ ID NO: 177371 - RNA, 22 nt, Human
aaaugugaguuauagcaauaga

SEQ ID NO: 177372 - RNA, 22 nt, Human
gacagcagccacagggagaggg

SEQ ID NO: 177373 - RNA, 22 nt, Human
gcagggcuguaauuugagccug

SEQ ID NO: 177374 - RNA, 22 nt, Human
gagggaguaacguacuacagug

SEQ ID NO: 177375 - RNA, 22 nt, Human
uucuagacuucaggcauucucc

SEQ ID NO: 177376 - RNA, 17 nt, Human
uuuaaacuacuacaagg

SEQ ID NO: 177377 - RNA, 19 nt, Human
uaucacugggcacugagga

SEQ ID NO: 177378 - RNA, 18 nt, Human
cagagcaguaugaauguu

SEQ ID NO: 177379 - RNA, 22 nt, Human
ucuguucauacagaguauagua

SEQ ID NO: 177380 - RNA, 22 nt, Human
ugcucaggccagccggacagag

SEQ ID NO: 177381 - RNA, 22 nt, Human
uccugcagcucugagaagcauc

SEQ ID NO: 177382 - RNA, 22 nt, Human
uggcuucuugggaugggucauu

SEQ ID NO: 177383 - RNA, 22 nt, Human
ugcagacaagugcaucuaaccc

SEQ ID NO: 177384 - RNA, 22 nt, Human
ugcuggaagaauuccaugcugg

SEQ ID NO: 177385 - RNA, 19 nt, Human
aggcacagguugucuggac

SEQ ID NO: 177386 - RNA, 21 nt, Human
uaucuacuggugucuuucaga

SEQ ID NO: 177387 - RNA, 22 nt, Human
ccucagcagacacgcuucucac

SEQ ID NO: 177388 - RNA, 22 nt, Human
agauguuuuggagacacuaacc

SEQ ID NO: 177389 - RNA, 22 nt, Human
uuuauauaacagagacugcuau

SEQ ID NO: 177390 - RNA, 22 nt, Human
uuauggcauauuccucauugua

SEQ ID NO: 177391 - RNA, 22 nt, Human
gucccuggggguuuaggacuca

SEQ ID NO: 177392 - RNA, 22 nt, Human
uggaaacuauagucacaauaga

SEQ ID NO: 177393 - RNA, 22 nt, Human
aagcaucuuaaaaaguaucaga

SEQ ID NO: 177394 - RNA, 22 nt, Human
ggugggcagcucuuggcaggca

SEQ ID NO: 177395 - RNA, 22 nt, Human
ucccagggacaccaagcuguuu

SEQ ID NO: 177396 - RNA, 22 nt, Human
cuggcucaggguggucuggguc

SEQ ID NO: 177397 - RNA, 22 nt, Human
acauacagaccugcagggcagc

SEQ ID NO: 177398 - RNA, 22 nt, Human
uguaaaugaaguaugcuuuacu

SEQ ID NO: 177399 - RNA, 22 nt, Human
gcaggugucuucauggaacucu

SEQ ID NO: 177400 - RNA, 23 nt, Human
auugagaaggauacauuguucuc

SEQ ID NO: 177401 - RNA, 18 nt, Human
ucuuccaacacugacacc

SEQ ID NO: 177402 - RNA, 19 nt, Human
uagacucuaauguuaagcu

SEQ ID NO: 177403 - RNA, 22 nt, Human
ugucacaugacacaaauaucua

SEQ ID NO: 177404 - RNA, 22 nt, Human
uccaggcucuaggcugcucucc

SEQ ID NO: 177405 - RNA, 22 nt, Human
cugggaggacaacuuggagcuc

SEQ ID NO: 177406 - RNA, 22 nt, Human
ugacauacuuuuagauagaugg

SEQ ID NO: 177407 - RNA, 22 nt, Human
uuuuugaaggcugaugugauua

SEQ ID NO: 177408 - RNA, 22 nt, Human
guugaaagagcauggacuugaa

SEQ ID NO: 177409 - RNA, 21 nt, Human
ugggggagaauugguugcuuu

SEQ ID NO: 177410 - RNA, 22 nt, Human
auauggcauucuuuuuaagggu

SEQ ID NO: 177411 - RNA, 22 nt, Human
ucuggggugugaccugagcaug

SEQ ID NO: 177412 - RNA, 22 nt, Human
cuccuucacgcaggcugccaug

SEQ ID NO: 177413 - RNA, 23 nt, Human
ugaguucucaucuuggcuucuau

SEQ ID NO: 177414 - RNA, 22 nt, Human
uagaacuagaacaaggauuuga

SEQ ID NO: 177415 - RNA, 22 nt, Human
gcaaagcaagauucagauguag

SEQ ID NO: 177416 - RNA, 22 nt, Human
gucauucuuaacaacucaguag

SEQ ID NO: 177417 - RNA, 22 nt, Human
gaggcauaaguagaagagauug

SEQ ID NO: 177418 - RNA, 22 nt, Human
augccuuucccaacaggguggg

SEQ ID NO: 177419 - RNA, 22 nt, Human
gcagauaggguauuaggaguaa

SEQ ID NO: 177420 - RNA, 22 nt, Human
uccaaggaggagcuggagauug

SEQ ID NO: 177421 - RNA, 22 nt, Human
uuggaauugaggauuuacauag

SEQ ID NO: 177422 - RNA, 22 nt, Human
uuuuggaaucauuuacagagca

SEQ ID NO: 177423 - RNA, 22 nt, Human
cagcagaagcaacauucaggcu

SEQ ID NO: 177424 - RNA, 22 nt, Human
cugagcaggauauucacagcag

SEQ ID NO: 177425 - RNA, 22 nt, Human
ucugaagggcugaguggaggag

SEQ ID NO: 177426 - RNA, 23 nt, Human
ccagggagguugauugguuaccc

SEQ ID NO: 177427 - RNA, 22 nt, Human
ugacagacauggaagccagagu

SEQ ID NO: 177428 - RNA, 22 nt, Human
gcucaggcaggagugcaguggc

SEQ ID NO: 177429 - RNA, 22 nt, Human
aggcucugaaggagaaccuguu

SEQ ID NO: 177430 - RNA, 22 nt, Human
ucagcagccgcagcugacucag

SEQ ID NO: 177431 - RNA, 22 nt, Human
ucugcgcccugucgccugcucc

SEQ ID NO: 177432 - RNA, 22 nt, Human
ugaucaaagccaaaguugagau

SEQ ID NO: 177433 - RNA, 21 nt, Human
ugcuggguuugcccaucaggc

SEQ ID NO: 177434 - RNA, 22 nt, Human
ccagcugggucccugcuggggc

SEQ ID NO: 177435 - RNA, 22 nt, Human
caggugucuaauucucaccccc

SEQ ID NO: 177436 - RNA, 22 nt, Human
agcccagcugcuauguaccugg

SEQ ID NO: 177437 - RNA, 22 nt, Human
uacaaagaguuuggucucuaga

SEQ ID NO: 177438 - RNA, 22 nt, Human
gcucacagccggcuggcagggg

SEQ ID NO: 177439 - RNA, 22 nt, Human
cagaccaucuugaagcaaacug

SEQ ID NO: 177440 - RNA, 22 nt, Human
ccuuaauuucuguccuucagau

SEQ ID NO: 177441 - RNA, 20 nt, Human
uccaguggccugaaucugga

SEQ ID NO: 177442 - RNA, 22 nt, Human
gcugcccugcaucugugccuuc

SEQ ID NO: 177443 - RNA, 22 nt, Human
agaguuacugcagagaugaaua

SEQ ID NO: 177444 - RNA, 22 nt, Human
ugcaggaaacagaggcucaaau

SEQ ID NO: 177445 - RNA, 21 nt, Human
gugaauuaauuauaugccuua

SEQ ID NO: 177446 - RNA, 22 nt, Human
aacaaacaaacauuuugucauc

SEQ ID NO: 177447 - RNA, 22 nt, Human
aacauugcagcuuaauugcagg

SEQ ID NO: 177448 - RNA, 22 nt, Human
agguguguauaaacauacauau

SEQ ID NO: 177449 - RNA, 22 nt, Human
uuguguccugauuugacacaau

SEQ ID NO: 177450 - RNA, 22 nt, Human
uaauacaaggcaggaagcagua

SEQ ID NO: 177451 - RNA, 19 nt, Human
ugcauacauguuaacaugu

SEQ ID NO: 177452 - RNA, 22 nt, Human
aguauggggcugugugugcaca

SEQ ID NO: 177453 - RNA, 22 nt, Human
uugguacauguuaaggaagagu

SEQ ID NO: 177454 - RNA, 22 nt, Human
auccagugagugcagcuguugu

SEQ ID NO: 177455 - RNA, 22 nt, Human
acacugagcaucucuagaggca

SEQ ID NO: 177456 - RNA, 22 nt, Human
guuuugugaggcacccacaggu

SEQ ID NO: 177457 - RNA, 22 nt, Human
ugucucugaggugagggucagc

SEQ ID NO: 177458 - RNA, 22 nt, Human
gcaggcaccacggcucaggucu

SEQ ID NO: 177459 - RNA, 22 nt, Human
caugaaggaauaauuguuuaga

SEQ ID NO: 177460 - RNA, 22 nt, Human
gcugccuggcuuuaguccacuu

SEQ ID NO: 177461 - RNA, 19 nt, Human
ugccugucaguagaucuca

SEQ ID NO: 177462 - RNA, 22 nt, Human
cacaggagaacccacagauucu

SEQ ID NO: 177463 - RNA, 22 nt, Human
ucccugagacucuggaguguaa

SEQ ID NO: 177464 - RNA, 22 nt, Human
gucugggcaagggagauggcgc

SEQ ID NO: 177465 - RNA, 22 nt, Human
uuucuacauucaaaaacuacca

SEQ ID NO: 177466 - RNA, 22 nt, Human
uagaacauaagucauucauuug

SEQ ID NO: 177467 - RNA, 22 nt, Human
cccugggaguccacugauguca

SEQ ID NO: 177468 - RNA, 22 nt, Human
ucuuuauuucugaaucccccau

SEQ ID NO: 177469 - RNA, 22 nt, Human
ucuggcagaggaaggaggccug

SEQ ID NO: 177470 - RNA, 22 nt, Human
ccugggaagucagccaaggacg

SEQ ID NO: 177471 - RNA, 22 nt, Human
accauucuuuacacuuauuucu

SEQ ID NO: 177472 - RNA, 22 nt, Human
uacauggugguggcacuugacu

SEQ ID NO: 177473 - RNA, 22 nt, Human
uuccauauguauauagcuguua

SEQ ID NO: 177474 - RNA, 22 nt, Human
gggccucagcucugcucugcaa

SEQ ID NO: 177475 - RNA, 22 nt, Human
gcugucugggaugucacugcug

SEQ ID NO: 177476 - RNA, 22 nt, Human
cugcagguuaggagcacuccuu

SEQ ID NO: 177477 - RNA, 22 nt, Human
uggccaguggacuaaguucuga

SEQ ID NO: 177478 - RNA, 22 nt, Human
acucagaggaaacccuccuagg

SEQ ID NO: 177479 - RNA, 19 nt, Human
ucccagagucuagagguug

SEQ ID NO: 177480 - RNA, 22 nt, Human
gagacacaagacgcaacucugu

SEQ ID NO: 177481 - RNA, 22 nt, Human
gcucagggucccuuggugcugg

SEQ ID NO: 177482 - RNA, 22 nt, Human
ucuucucuccugcuuggcagaa

SEQ ID NO: 177483 - RNA, 22 nt, Human
agucaauucuuuucaacucaag

SEQ ID NO: 177484 - RNA, 22 nt, Human
aaaugaguagcgaugcacauua

SEQ ID NO: 177485 - RNA, 19 nt, Human
agagaaggauccuaugguu

SEQ ID NO: 177486 - RNA, 22 nt, Human
acaauuucugaucagugaauuu

SEQ ID NO: 177487 - RNA, 22 nt, Human
uuugcuuucuguugaacagagu

SEQ ID NO: 177488 - RNA, 23 nt, Human
agggugagcaagcuauggagacc

SEQ ID NO: 177489 - RNA, 22 nt, Human
cuucacagcaugagcuuuggag

SEQ ID NO: 177490 - RNA, 22 nt, Human
cuucauguucugccuguggaag

SEQ ID NO: 177491 - RNA, 22 nt, Human
agucucuccacauuguuauaaa

SEQ ID NO: 177492 - RNA, 22 nt, Human
acagcugcauucuuaacaggaa

SEQ ID NO: 177493 - RNA, 22 nt, Human
agguuuguuaaaccagauugcu

SEQ ID NO: 177494 - RNA, 20 nt, Human
acaugaaaggaaacaggaaa

SEQ ID NO: 177495 - RNA, 22 nt, Human
cuguaacagcugucagagcagg

SEQ ID NO: 177496 - RNA, 22 nt, Human
agaagcagaaggaagcagggcc

SEQ ID NO: 177497 - RNA, 22 nt, Human
augcagggcagaguacguuagc

SEQ ID NO: 177498 - RNA, 22 nt, Human
ugggggcacuucgaggucgccu

SEQ ID NO: 177499 - RNA, 20 nt, Human
gccagaguuaugaugagagg

SEQ ID NO: 177500 - RNA, 22 nt, Human
cuggguucuuggcacagcagga

SEQ ID NO: 177501 - RNA, 22 nt, Human
uuuuaucauuacccagcugaaa

SEQ ID NO: 177502 - RNA, 23 nt, Human
gcaguuaguccacuuugcagaga

SEQ ID NO: 177503 - RNA, 22 nt, Human
uccaggagaaggccauccagcg

SEQ ID NO: 177504 - RNA, 22 nt, Human
uucuacagaauaaauguuuaca

SEQ ID NO: 177505 - RNA, 22 nt, Human
uagcagaguaauacuuuggagc

SEQ ID NO: 177506 - RNA, 20 nt, Human
agagcagcaguuggugaggu

SEQ ID NO: 177507 - RNA, 22 nt, Human
uuguuuaucgcuugcucacaua

SEQ ID NO: 177508 - RNA, 22 nt, Human
uuucauguuggggaguugagug

SEQ ID NO: 177509 - RNA, 22 nt, Human
agucacuguucugucaugucaa

SEQ ID NO: 177510 - RNA, 22 nt, Human
ucuguguuuaaaagauaugucc

SEQ ID NO: 177511 - RNA, 20 nt, Human
uggggucuaguuggccuggg

SEQ ID NO: 177512 - RNA, 22 nt, Human
aguacaaguagaaugcuacaag

SEQ ID NO: 177513 - RNA, 22 nt, Human
agugcuguccaguuucacaggu

SEQ ID NO: 177514 - RNA, 22 nt, Human
uccugcagagacagaggccuca

SEQ ID NO: 177515 - RNA, 23 nt, Human
agugacaaugggccagagguggc

SEQ ID NO: 177516 - RNA, 22 nt, Human
uuccaugagcucugaguucaca

SEQ ID NO: 177517 - RNA, 22 nt, Human
cugagggaagggguacauggcu

SEQ ID NO: 177518 - RNA, 22 nt, Human
uucaguauuucaugacuuucuu

SEQ ID NO: 177519 - RNA, 20 nt, Human
acuggcagccugccugcugu

SEQ ID NO: 177520 - RNA, 22 nt, Human
caauauauaaugaguacuuucc

SEQ ID NO: 177521 - RNA, 22 nt, Human
uugccaugcagccaggaaggag

SEQ ID NO: 177522 - RNA, 22 nt, Human
acaucucuuauaaacucucuga

SEQ ID NO: 177523 - RNA, 22 nt, Human
uguuuagaggaacuggaaucag

SEQ ID NO: 177524 - RNA, 22 nt, Human
gagaaagauuguccuucagggg

SEQ ID NO: 177525 - RNA, 22 nt, Human
ccagggcugguggcugcagagg

SEQ ID NO: 177526 - RNA, 22 nt, Human
uauuugaaggcauacauuuuga

SEQ ID NO: 177527 - RNA, 22 nt, Human
aagcagccacuggccaguuaua

SEQ ID NO: 177528 - RNA, 22 nt, Human
aagcugcagacccccugucuca

SEQ ID NO: 177529 - RNA, 22 nt, Human
ucacagaacaagccugguggag

SEQ ID NO: 177530 - RNA, 22 nt, Human
uuugaacaugcugcaugauaau

SEQ ID NO: 177531 - RNA, 22 nt, Human
gagugguaaugagcagauuagg

SEQ ID NO: 177532 - RNA, 22 nt, Human
aagucagaaaacagagcaauua

SEQ ID NO: 177533 - RNA, 22 nt, Human
agaaucugcauuucuaauaagc

SEQ ID NO: 177534 - RNA, 18 nt, Human
aucaaggaggggaagguc

SEQ ID NO: 177535 - RNA, 22 nt, Human
gugcaggggaucagguugcagc

SEQ ID NO: 177536 - RNA, 22 nt, Human
uucuaccuacccucugcauaca

SEQ ID NO: 177537 - RNA, 22 nt, Human
ucuguggcuuccuauuucuugg

SEQ ID NO: 177538 - RNA, 22 nt, Human
gcaguucuacuuauccauagac

SEQ ID NO: 177539 - RNA, 22 nt, Human
aaggcuuccacuuuguuggguc

SEQ ID NO: 177540 - RNA, 22 nt, Human
ucuguggcugguaauugcaugu

SEQ ID NO: 177541 - RNA, 22 nt, Human
agaggcaaggcaggauucuucu

SEQ ID NO: 177542 - RNA, 22 nt, Human
gaggugucuggccuuuguagga

SEQ ID NO: 177543 - RNA, 22 nt, Human
uuuaccuggauucuuacuuccu

SEQ ID NO: 177544 - RNA, 22 nt, Human
aaaacauucugugaacucucaa

SEQ ID NO: 177545 - RNA, 22 nt, Human
caaauguauucucacuucaggg

SEQ ID NO: 177546 - RNA, 22 nt, Human
gcagggucuugagaggcagcca

SEQ ID NO: 177547 - RNA, 22 nt, Human
agcaguguuuugauucugggag

SEQ ID NO: 177548 - RNA, 18 nt, Human
uggcagagugucuguucu

SEQ ID NO: 177549 - RNA, 22 nt, Human
augguauuccuuuauguagaag

SEQ ID NO: 177550 - RNA, 22 nt, Human
uuauuguuaggcuuuuggaauu

SEQ ID NO: 177551 - RNA, 22 nt, Human
ucugugcagacauggggaagcc

SEQ ID NO: 177552 - RNA, 22 nt, Human
gaucuucuagcagaaguaauuu

SEQ ID NO: 177553 - RNA, 22 nt, Human
ccuggcugcccauggacccucu

SEQ ID NO: 177554 - RNA, 22 nt, Human
ugguccaggcacccuucuagag

SEQ ID NO: 177555 - RNA, 22 nt, Human
ugcuuugcaaauaauagaaugu

SEQ ID NO: 177556 - RNA, 22 nt, Human
uacaacgugggacuuuguuucu

SEQ ID NO: 177557 - RNA, 22 nt, Human
ucagagcaaauuccugugagcc

SEQ ID NO: 177558 - RNA, 22 nt, Human
caggcuuggguucucugaguua

SEQ ID NO: 177559 - RNA, 22 nt, Human
uuaaauuagucaagcuucucug

SEQ ID NO: 177560 - RNA, 22 nt, Human
ugaauaaauugagagcgaaugu

SEQ ID NO: 177561 - RNA, 22 nt, Human
gaaugacauugaaaagacauug

SEQ ID NO: 177562 - RNA, 22 nt, Human
ucaggagguaggacauacuggu

SEQ ID NO: 177563 - RNA, 22 nt, Human
gcaaagcugggugugaaugcac

SEQ ID NO: 177564 - RNA, 22 nt, Human
gagaccccagcucagccuccag

SEQ ID NO: 177565 - RNA, 22 nt, Human
caaagaguuuuuucauauaaug

SEQ ID NO: 177566 - RNA, 22 nt, Human
uaauguauaacaaauacucauc

SEQ ID NO: 177567 - RNA, 22 nt, Human
aggcuuuccugucacucaugcu

SEQ ID NO: 177568 - RNA, 22 nt, Human
cagucucuaaaucaaucugaau

SEQ ID NO: 177569 - RNA, 22 nt, Human
gggcaauucacaggguuguuau

SEQ ID NO: 177570 - RNA, 22 nt, Human
uagcagagaggggacaguggca

SEQ ID NO: 177571 - RNA, 22 nt, Human
cccuccuggaggcggaugccca

SEQ ID NO: 177572 - RNA, 21 nt, Human
acucaggagacuaacuauguc

SEQ ID NO: 177573 - RNA, 20 nt, Human
aggcccugccagggacggag

SEQ ID NO: 177574 - RNA, 22 nt, Human
gcccaggggaguagucaauuua

SEQ ID NO: 177575 - RNA, 22 nt, Human
ucagaaguacugugcuacaaua

SEQ ID NO: 177576 - RNA, 22 nt, Human
aaugacaagacauagucucuga

SEQ ID NO: 177577 - RNA, 21 nt, Human
uucucagagucuauuacaguu

SEQ ID NO: 177578 - RNA, 22 nt, Human
ggcuggcugcaugcccccuccu

SEQ ID NO: 177579 - RNA, 23 nt, Human
cugugucuaugcagccauaucca

SEQ ID NO: 177580 - RNA, 22 nt, Human
ggaagagccuggggugucaggc

SEQ ID NO: 177581 - RNA, 22 nt, Human
uaaggacaauuugucgcuugca

SEQ ID NO: 177582 - RNA, 22 nt, Human
gugcaggggccuccccuugcug

SEQ ID NO: 177583 - RNA, 22 nt, Human
uaauaauuggcaauguugagca

SEQ ID NO: 177584 - RNA, 22 nt, Human
agaugaaaagauaagcagcaau

SEQ ID NO: 177585 - RNA, 22 nt, Human
acauacauguaaaggaaauuau

SEQ ID NO: 177586 - RNA, 22 nt, Human
ucugagcugcuagguaugcauu

SEQ ID NO: 177587 - RNA, 22 nt, Human
agagaauuaauuaggagcacug

SEQ ID NO: 177588 - RNA, 22 nt, Human
aauccauuuaccuuugcuugaa

SEQ ID NO: 177589 - RNA, 22 nt, Human
agccuuguuggucugaguuugg

SEQ ID NO: 177590 - RNA, 22 nt, Human
acuucauguaguccaucagguu

SEQ ID NO: 177591 - RNA, 22 nt, Human
auacagguguacacacaugcaa

SEQ ID NO: 177592 - RNA, 22 nt, Human
acacaugaaagacauuaaggug

SEQ ID NO: 177593 - RNA, 22 nt, Human
gagaaggauguggcucauagcu

SEQ ID NO: 177594 - RNA, 22 nt, Human
uuaguuuauaauucauuucugu

SEQ ID NO: 177595 - RNA, 22 nt, Human
uuucagugcuucuguuuaccgg

SEQ ID NO: 177596 - RNA, 23 nt, Human
agagcuuuccaguuucuugguga

SEQ ID NO: 177597 - RNA, 22 nt, Human
uacuuaaaaauuaucaaagugg

SEQ ID NO: 177598 - RNA, 22 nt, Human
agagucuuggcugagaacaaga

SEQ ID NO: 177599 - RNA, 22 nt, Human
cugccagcagaggccagcgcug

SEQ ID NO: 177600 - RNA, 22 nt, Human
caggaaaaaugccaggagucag

SEQ ID NO: 177601 - RNA, 22 nt, Human
cagggccucugugggcucucuc

SEQ ID NO: 177602 - RNA, 22 nt, Human
aaguuuuauuggaacauagcca

SEQ ID NO: 177603 - RNA, 22 nt, Human
gaggccucaggcgugggaaggg

SEQ ID NO: 177604 - RNA, 19 nt, Human
ucucuugaauaggucaaac

SEQ ID NO: 177605 - RNA, 22 nt, Human
ugaagcuuuaggauggguucau

SEQ ID NO: 177606 - RNA, 22 nt, Human
uuuagggaauagaagaucugaa

SEQ ID NO: 177607 - RNA, 22 nt, Human
auucaacuuauaagauauuaau

SEQ ID NO: 177608 - RNA, 22 nt, Human
uuuuauugggaguccucuacug

SEQ ID NO: 177609 - RNA, 22 nt, Human
ucugcaggcuguacaggaagca

SEQ ID NO: 177610 - RNA, 22 nt, Human
gcugcccaggguggagccggcu

SEQ ID NO: 177611 - RNA, 22 nt, Human
ucagacagagaaguacaaugag

SEQ ID NO: 177612 - RNA, 22 nt, Human
acagcuccuggggcuuuaaugg

SEQ ID NO: 177613 - RNA, 22 nt, Human
ggccugagucacaucaggagag

SEQ ID NO: 177614 - RNA, 22 nt, Human
uucuguuaccuuugugaguuuc

SEQ ID NO: 177615 - RNA, 22 nt, Human
aagggcuggagaggaaagguug

SEQ ID NO: 177616 - RNA, 23 nt, Human
uugcaaaaugcaauugaguuaga

SEQ ID NO: 177617 - RNA, 22 nt, Human
agggaagugaaugacagauauc

SEQ ID NO: 177618 - RNA, 22 nt, Human
aauauccagguagaugucuucu

SEQ ID NO: 177619 - RNA, 22 nt, Human
caguuacauuaauaaugcacau

SEQ ID NO: 177620 - RNA, 22 nt, Human
ucuacccugcggucuuggggca

SEQ ID NO: 177621 - RNA, 22 nt, Human
gcagagcugggucuguauccaa

SEQ ID NO: 177622 - RNA, 22 nt, Human
ucuccauacuugccuuuggccu

SEQ ID NO: 177623 - RNA, 22 nt, Human
cccaagggagugccuggucaac

SEQ ID NO: 177624 - RNA, 22 nt, Human
uccuggggaggucgaggcugag

SEQ ID NO: 177625 - RNA, 22 nt, Human
aagugaagaaauacaugagaau

SEQ ID NO: 177626 - RNA, 22 nt, Human
caggcccagaggccucuuccca

SEQ ID NO: 177627 - RNA, 22 nt, Human
cuugccaguguugcagaagcuc

SEQ ID NO: 177628 - RNA, 22 nt, Human
ugcaggcugcuggcaguagcuu

SEQ ID NO: 177629 - RNA, 22 nt, Human
uccaggccugacuauaaaugua

SEQ ID NO: 177630 - RNA, 22 nt, Human
aaacugcaauuauguuugcaga

SEQ ID NO: 177631 - RNA, 22 nt, Human
ugcucagcagucaaggucauag

SEQ ID NO: 177632 - RNA, 22 nt, Human
guguguucagcaagagguaagg

SEQ ID NO: 177633 - RNA, 22 nt, Human
guggcagugaaggucauagcau

SEQ ID NO: 177634 - RNA, 22 nt, Human
ugcccugcagacccugcagugu

SEQ ID NO: 177635 - RNA, 22 nt, Human
ugcuuuauaggggauugcaggc

SEQ ID NO: 177636 - RNA, 22 nt, Human
uacauguaagacaugagacucu

SEQ ID NO: 177637 - RNA, 22 nt, Human
ugcuccugaauuacacuacuac

SEQ ID NO: 177638 - RNA, 22 nt, Human
aaauauccauaagcacaucuau

SEQ ID NO: 177639 - RNA, 22 nt, Human
agcuggcagagcauuuguggcc

SEQ ID NO: 177640 - RNA, 22 nt, Human
ucccuucuggcagcagugugag

SEQ ID NO: 177641 - RNA, 22 nt, Human
acugggccuguacagagaaaac

SEQ ID NO: 177642 - RNA, 22 nt, Human
aaaguccuguuaacuguuaaca

SEQ ID NO: 177643 - RNA, 22 nt, Human
aagucauuaucucuucuaaucu

SEQ ID NO: 177644 - RNA, 22 nt, Human
uggcuguagaacaguggauauu

SEQ ID NO: 177645 - RNA, 22 nt, Human
caaagcuggacugcucaguuca

SEQ ID NO: 177646 - RNA, 22 nt, Human
aaugagaucagagauaacucaa

SEQ ID NO: 177647 - RNA, 22 nt, Human
ccuuccuggcuguccgccugau

SEQ ID NO: 177648 - RNA, 22 nt, Human
ucagaaucucuggaggcuuggc

SEQ ID NO: 177649 - RNA, 22 nt, Human
acaugacaaaaugcacaggauu

SEQ ID NO: 177650 - RNA, 22 nt, Human
cugggcagcuguaucagggagu

SEQ ID NO: 177651 - RNA, 22 nt, Human
gggcuucucugaucaauauuuc

SEQ ID NO: 177652 - RNA, 22 nt, Human
cugcucuucccacucacuccca

SEQ ID NO: 177653 - RNA, 22 nt, Human
uucuucuuuaucucaguauccu

SEQ ID NO: 177654 - RNA, 21 nt, Human
ggcuguggagccaugacucac

SEQ ID NO: 177655 - RNA, 20 nt, Human
agcuacaaugcgaagcuggc

SEQ ID NO: 177656 - RNA, 22 nt, Human
uagagcuggaauuugcagcaag

SEQ ID NO: 177657 - RNA, 22 nt, Human
aaagcaagacaggaguuucaga

SEQ ID NO: 177658 - RNA, 22 nt, Human
aggaccuguagggccugcaucc

SEQ ID NO: 177659 - RNA, 22 nt, Human
uuccuggccuaagguaggugac

SEQ ID NO: 177660 - RNA, 22 nt, Human
ggcacagcacuguaggccuggg

SEQ ID NO: 177661 - RNA, 17 nt, Human
agcaggcugcagaggcc

SEQ ID NO: 177662 - RNA, 22 nt, Human
gucaacagagacagagacacug

SEQ ID NO: 177663 - RNA, 22 nt, Human
aacauuuccggccuuuuguucu

SEQ ID NO: 177664 - RNA, 22 nt, Human
uuuuaguuuggauuucuaaagc

SEQ ID NO: 177665 - RNA, 22 nt, Human
uccugggacucuuuaucagaga

SEQ ID NO: 177666 - RNA, 22 nt, Human
ggggcagcucccgagggcagga

SEQ ID NO: 177667 - RNA, 22 nt, Human
cagggcugguuugucgaagaaa

SEQ ID NO: 177668 - RNA, 22 nt, Human
guccuggcugucuuauguugaa

SEQ ID NO: 177669 - RNA, 22 nt, Human
gcuccagguauuugcccuuuua

SEQ ID NO: 177670 - RNA, 22 nt, Human
aaacagacugaagaguugaagc

SEQ ID NO: 177671 - RNA, 22 nt, Human
uugacagggccaagaauggacc

SEQ ID NO: 177672 - RNA, 22 nt, Human
ugagcuuauacaugugaaguca

SEQ ID NO: 177673 - RNA, 22 nt, Human
uauaggaaauuuaucuccuggg

SEQ ID NO: 177674 - RNA, 19 nt, Human
auuguacauugaguuuggc

SEQ ID NO: 177675 - RNA, 22 nt, Human
acugcagccuugaacucugggc

SEQ ID NO: 177676 - RNA, 22 nt, Human
aggucucugcccacacaggcuu

SEQ ID NO: 177677 - RNA, 22 nt, Human
uggcagcauuuuuuccagaaca

SEQ ID NO: 177678 - RNA, 22 nt, Human
gaugaauugaaaucauugggca

SEQ ID NO: 177679 - RNA, 23 nt, Human
uggcagagacccagaaucuacau

SEQ ID NO: 177680 - RNA, 22 nt, Human
cucagcacuuuggaaggcugau

SEQ ID NO: 177681 - RNA, 22 nt, Human
aggucugccucacucacuucug

SEQ ID NO: 177682 - RNA, 22 nt, Human
cuccuggcucucuguuuagugu

SEQ ID NO: 177683 - RNA, 22 nt, Human
ucagcaggcgguuccuuguggg

SEQ ID NO: 177684 - RNA, 22 nt, Human
aacagugcuguuauaaauguac

SEQ ID NO: 177685 - RNA, 22 nt, Human
gguggggagucaggcauucuug

SEQ ID NO: 177686 - RNA, 22 nt, Human
cugggagcaagucaggaaaggu

SEQ ID NO: 177687 - RNA, 22 nt, Human
aaugagaaccuugaaaggaacu

SEQ ID NO: 177688 - RNA, 22 nt, Human
ugacucacuuaauuuacaaguc

SEQ ID NO: 177689 - RNA, 19 nt, Human
uucacaauuaugaaauuag

SEQ ID NO: 177690 - RNA, 22 nt, Human
uugugucccccuuugagagcca

SEQ ID NO: 177691 - RNA, 22 nt, Human
aucuuuggucuugagugcaucu

SEQ ID NO: 177692 - RNA, 20 nt, Human
ccacccugcuaagaauacac

SEQ ID NO: 177693 - RNA, 22 nt, Human
gccucaugagggaucugcccuc

SEQ ID NO: 177694 - RNA, 22 nt, Human
ucuagaauuugcguagguuaga

SEQ ID NO: 177695 - RNA, 19 nt, Human
uuaaagugcgagaagucuu

SEQ ID NO: 177696 - RNA, 22 nt, Human
cuuccauacagacaaugcaaug

SEQ ID NO: 177697 - RNA, 22 nt, Human
augggcagagcuggugggaggc

SEQ ID NO: 177698 - RNA, 22 nt, Human
uaccagccucuguugggggugg

SEQ ID NO: 177699 - RNA, 22 nt, Human
agccuugaguucaagugcuggc

SEQ ID NO: 177700 - RNA, 22 nt, Human
uauuuuacuuuaaagcgagaga

SEQ ID NO: 177701 - RNA, 22 nt, Human
gcauuaauguaagacccacucc

SEQ ID NO: 177702 - RNA, 17 nt, Human
caggaaaauaugaguga

SEQ ID NO: 177703 - RNA, 22 nt, Human
cccagcaucuccaggcauggcc

SEQ ID NO: 177704 - RNA, 22 nt, Human
agaaaacugggaggagagcuuc

SEQ ID NO: 177705 - RNA, 22 nt, Human
cugggcucaagaagucuucccu

SEQ ID NO: 177706 - RNA, 22 nt, Human
uccuggcaggucagcaggagca

SEQ ID NO: 177707 - RNA, 22 nt, Human
ggccccagguagaagauauaga

SEQ ID NO: 177708 - RNA, 22 nt, Human
ugaaagggguugaguuacagcu

SEQ ID NO: 177709 - RNA, 22 nt, Human
uaacuuuaggaauagguaaucu

SEQ ID NO: 177710 - RNA, 22 nt, Human
ucugcugcuacagacucucuag

SEQ ID NO: 177711 - RNA, 22 nt, Human
uagggcaggggaggaaucugaa

SEQ ID NO: 177712 - RNA, 22 nt, Human
cucugguucagggcucccuggc

SEQ ID NO: 177713 - RNA, 22 nt, Human
auggcccaggcaggcugguacu

SEQ ID NO: 177714 - RNA, 22 nt, Human
aggcacaggaggugguaagaag

SEQ ID NO: 177715 - RNA, 22 nt, Human
guaaucucagcuacuugggagg

SEQ ID NO: 177716 - RNA, 22 nt, Human
aaguaccuagaaauauuuuuga

SEQ ID NO: 177717 - RNA, 22 nt, Human
aagcuguuagggagugguaggu

SEQ ID NO: 177718 - RNA, 22 nt, Human
ggagccuggcccggcccuuggc

SEQ ID NO: 177719 - RNA, 22 nt, Human
uuguuuauuagcaauuauccug

SEQ ID NO: 177720 - RNA, 22 nt, Human
ugauacagucagcucacaauug

SEQ ID NO: 177721 - RNA, 22 nt, Human
caggccagcagggccuccgugg

SEQ ID NO: 177722 - RNA, 22 nt, Human
agacacaguauaagcacaacaa

SEQ ID NO: 177723 - RNA, 22 nt, Human
auuagagauuaugaauuccuag

SEQ ID NO: 177724 - RNA, 22 nt, Human
augaggcaugggaucaaaauga

SEQ ID NO: 177725 - RNA, 21 nt, Human
gccaaggggguagcuauuccu

SEQ ID NO: 177726 - RNA, 21 nt, Human
ugaaguucgcgggcaagauua

SEQ ID NO: 177727 - RNA, 22 nt, Human
ucaucccucugccaggcccagg

SEQ ID NO: 177728 - RNA, 22 nt, Human
acagguuugcagcuuguuaccu

SEQ ID NO: 177729 - RNA, 22 nt, Human
gcacagaaccagacaugaggca

SEQ ID NO: 177730 - RNA, 22 nt, Human
cacaugaugguggaagccauag

SEQ ID NO: 177731 - RNA, 22 nt, Human
ggugggucuuguggggcagcuu

SEQ ID NO: 177732 - RNA, 22 nt, Human
agagccucugucauggagagaa

SEQ ID NO: 177733 - RNA, 22 nt, Human
gaggggcacaguaaaggguccc

SEQ ID NO: 177734 - RNA, 22 nt, Human
uuauuccagcuaagaguccugg

SEQ ID NO: 177735 - RNA, 21 nt, Human
cugcccauuugugaugucccc

SEQ ID NO: 177736 - RNA, 22 nt, Human
cuuauucuacuccacaagcucu

SEQ ID NO: 177737 - RNA, 22 nt, Human
uuucuuuaucauagcaucuuug

SEQ ID NO: 177738 - RNA, 22 nt, Human
uuuguagcagcaugauuuauaa

SEQ ID NO: 177739 - RNA, 22 nt, Human
cucauuuacacuaugggaacua

SEQ ID NO: 177740 - RNA, 22 nt, Human
uaaauuauguuccauguccuuu

SEQ ID NO: 177741 - RNA, 22 nt, Human
ucuggagaggaggauguggaca

SEQ ID NO: 177742 - RNA, 22 nt, Human
ggagcugggguuggcaucuucc

SEQ ID NO: 177743 - RNA, 21 nt, Human
ccccugggagcccugucagua

SEQ ID NO: 177744 - RNA, 22 nt, Human
ggaaagccaggugcucuggugu

SEQ ID NO: 177745 - RNA, 22 nt, Human
gcccaggaagugacucagaugu

SEQ ID NO: 177746 - RNA, 19 nt, Human
ugcccugcacgcuguccug

SEQ ID NO: 177747 - RNA, 22 nt, Human
uuaaaaucuaaagcaguugucu

SEQ ID NO: 177748 - RNA, 22 nt, Human
ucuggguaugaccuauuuuucc

SEQ ID NO: 177749 - RNA, 22 nt, Human
cugcacagcccucaagagccug

SEQ ID NO: 177750 - RNA, 22 nt, Human
caguccuggggaccaggcugag

SEQ ID NO: 177751 - RNA, 22 nt, Human
aggcuuguggggaaucugugug

SEQ ID NO: 177752 - RNA, 22 nt, Human
ucagaaccagcccagcagauga

SEQ ID NO: 177753 - RNA, 22 nt, Human
accaguaggaguuggagaggaa

SEQ ID NO: 177754 - RNA, 20 nt, Human
ucugggagggacaagucucc

SEQ ID NO: 177755 - RNA, 22 nt, Human
acauucccuuggcuugaagcag

SEQ ID NO: 177756 - RNA, 22 nt, Human
cuggggcugcagcgaucuucau

SEQ ID NO: 177757 - RNA, 22 nt, Human
cauggugaggggugaagggcag

SEQ ID NO: 177758 - RNA, 18 nt, Human
gccaguggguccaggugc

SEQ ID NO: 177759 - RNA, 22 nt, Human
gcagggugccgacuucagggau

SEQ ID NO: 177760 - RNA, 21 nt, Human
cugcaaauaccuaguuaucug

SEQ ID NO: 177761 - RNA, 22 nt, Human
uggcaggaaggagacucagccc

SEQ ID NO: 177762 - RNA, 22 nt, Human
agggagguaggagcuucuagcu

SEQ ID NO: 177763 - RNA, 22 nt, Human
uucuugauguaccaacuuggga

SEQ ID NO: 177764 - RNA, 22 nt, Human
aguucaguaguccuucauugua

SEQ ID NO: 177765 - RNA, 17 nt, Human
acugucuuuuacacccu

SEQ ID NO: 177766 - RNA, 22 nt, Human
caggagcaaggagcagugggau

SEQ ID NO: 177767 - RNA, 22 nt, Human
ccauaaucauguaaguaaauuc

SEQ ID NO: 177768 - RNA, 19 nt, Human
uccuagaaugaggguguug

SEQ ID NO: 177769 - RNA, 22 nt, Human
gcuggcuggaguaaggagggag

SEQ ID NO: 177770 - RNA, 22 nt, Human
accagugucuuauugaccaucu

SEQ ID NO: 177771 - RNA, 22 nt, Human
gccugggagugcacagugaggu

SEQ ID NO: 177772 - RNA, 22 nt, Human
ccagccaggcuggcuguggagg

SEQ ID NO: 177773 - RNA, 22 nt, Human
auucucugaagucaauggaaau

SEQ ID NO: 177774 - RNA, 22 nt, Human
uucaucaggcaucaugcucaag

SEQ ID NO: 177775 - RNA, 22 nt, Human
cagggccuggagcugggccugc

SEQ ID NO: 177776 - RNA, 22 nt, Human
ccaggucuuugacuaauaugcu

SEQ ID NO: 177777 - RNA, 22 nt, Human
gcaggucuaucaggcugcaggu

SEQ ID NO: 177778 - RNA, 22 nt, Human
agguggcuguauucagcuguaa

SEQ ID NO: 177779 - RNA, 22 nt, Human
cugcaggagugaaagcaggccu

SEQ ID NO: 177780 - RNA, 22 nt, Human
auaaugaggauuugcauauuag

SEQ ID NO: 177781 - RNA, 22 nt, Human
agccugggcaacaacacagcga

SEQ ID NO: 177782 - RNA, 22 nt, Human
ucugggcccuaaaccagcucua

SEQ ID NO: 177783 - RNA, 23 nt, Human
agggccucaggagggcugcaugg

SEQ ID NO: 177784 - RNA, 20 nt, Human
aacacugagggcuacucuuc

SEQ ID NO: 177785 - RNA, 21 nt, Human
ggcaucucuuaguaucaccau

SEQ ID NO: 177786 - RNA, 22 nt, Human
gccucucucuacccaguaugau

SEQ ID NO: 177787 - RNA, 22 nt, Human
aggggagcuaacaccagagccc

SEQ ID NO: 177788 - RNA, 22 nt, Human
aaggugucaccagauuggcagg

SEQ ID NO: 177789 - RNA, 22 nt, Human
gcugccuguugaagggucugug

SEQ ID NO: 177790 - RNA, 22 nt, Human
uggaaacacccacgcaugcaua

SEQ ID NO: 177791 - RNA, 22 nt, Human
cuucaguucuaaaguagaaugu

SEQ ID NO: 177792 - RNA, 22 nt, Human
uggcaugaguauaggcuucuca

SEQ ID NO: 177793 - RNA, 21 nt, Human
ccaaaggcuauguaucuucug

SEQ ID NO: 177794 - RNA, 22 nt, Human
caggguggaagcuguagagugg

SEQ ID NO: 177795 - RNA, 22 nt, Human
ucaaauaaggagucaugaccau

SEQ ID NO: 177796 - RNA, 22 nt, Human
ucacagcauugucacaaggcug

SEQ ID NO: 177797 - RNA, 22 nt, Human
ucacaguuauagucuguagaau

SEQ ID NO: 177798 - RNA, 22 nt, Human
agcaggauuuugaagugcaagu

SEQ ID NO: 177799 - RNA, 22 nt, Human
cuguacucaagguaaaccagga

SEQ ID NO: 177800 - RNA, 22 nt, Human
ugcacagaugggcuuguucaua

SEQ ID NO: 177801 - RNA, 22 nt, Human
aaaaauagcuucucuugucccu

SEQ ID NO: 177802 - RNA, 22 nt, Human
aagcucaggaaagagucugguu

SEQ ID NO: 177803 - RNA, 22 nt, Human
agugaaaacacuaguucuugcc

SEQ ID NO: 177804 - RNA, 22 nt, Human
ccagaggaggggggucuuucug

SEQ ID NO: 177805 - RNA, 22 nt, Human
aucacaaaggucucagagcaca

SEQ ID NO: 177806 - RNA, 22 nt, Human
aagauguucuauuuucacuuuu

SEQ ID NO: 177807 - RNA, 22 nt, Human
ccacugaggcaggcaguaucua

SEQ ID NO: 177808 - RNA, 22 nt, Human
acuggccaggcagcaguagcuu

SEQ ID NO: 177809 - RNA, 22 nt, Human
gcagggcuggggcugcuccuga

SEQ ID NO: 177810 - RNA, 22 nt, Human
auuucuguaacuuaugaaaguu

SEQ ID NO: 177811 - RNA, 22 nt, Human
auguuacugugaucaugauacu

SEQ ID NO: 177812 - RNA, 22 nt, Human
caagaugugccuaaucagaccu

SEQ ID NO: 177813 - RNA, 22 nt, Human
uggcccugacacgugguacugg

SEQ ID NO: 177814 - RNA, 22 nt, Human
ccucagaagaaguggaauugau

SEQ ID NO: 177815 - RNA, 22 nt, Human
cuccauggaaaaggcuguuguu

SEQ ID NO: 177816 - RNA, 22 nt, Human
aggcaguuucugggacagcaua

SEQ ID NO: 177817 - RNA, 22 nt, Human
guggggcaugcacgcugcuccu

SEQ ID NO: 177818 - RNA, 22 nt, Human
aguagcacaauuuugucccuaa

SEQ ID NO: 177819 - RNA, 22 nt, Human
uugaggaguacaaagcaugcuu

SEQ ID NO: 177820 - RNA, 22 nt, Human
aggccagaaauuuggaguaugu

SEQ ID NO: 177821 - RNA, 22 nt, Human
auuuauuauugugguuacuucu

SEQ ID NO: 177822 - RNA, 22 nt, Human
cuuguuuuggcuaguaugaugu

SEQ ID NO: 177823 - RNA, 22 nt, Human
uggcaguggcgggacucagggc

SEQ ID NO: 177824 - RNA, 20 nt, Human
gccugagcuauugccaggau

SEQ ID NO: 177825 - RNA, 22 nt, Human
caaguuuacaauguguaugugu

SEQ ID NO: 177826 - RNA, 22 nt, Human
ucccauugccauagauaggaca

SEQ ID NO: 177827 - RNA, 21 nt, Human
uuuucuggaguaugucuccuc

SEQ ID NO: 177828 - RNA, 22 nt, Human
gagcugguucuguccagggaau

SEQ ID NO: 177829 - RNA, 22 nt, Human
auguuucuacagcguccacuga

SEQ ID NO: 177830 - RNA, 22 nt, Human
agggaaauaaucuauucugagg

SEQ ID NO: 177831 - RNA, 22 nt, Human
gaggaggcuguuucucugcauu

SEQ ID NO: 177832 - RNA, 22 nt, Human
acuaagugauucuaagcaucuu

SEQ ID NO: 177833 - RNA, 22 nt, Human
ucuuuacacaagacaagaauaa

SEQ ID NO: 177834 - RNA, 22 nt, Human
ggcuguccuuggccaaggcacu

SEQ ID NO: 177835 - RNA, 22 nt, Human
ucagagaguuggaaagaauuaa

SEQ ID NO: 177836 - RNA, 22 nt, Human
acacuguaaacaucucaagcac

SEQ ID NO: 177837 - RNA, 19 nt, Human
gggcucuggccucaguggg

SEQ ID NO: 177838 - RNA, 22 nt, Human
cugugggagaagcuagcacagg

SEQ ID NO: 177839 - RNA, 22 nt, Human
ucagauggaggcaauguuaccu

SEQ ID NO: 177840 - RNA, 22 nt, Human
ugcucccaaaccugacaggcuc

SEQ ID NO: 177841 - RNA, 22 nt, Human
aaguccagcucuaaauaucuga

SEQ ID NO: 177842 - RNA, 18 nt, Human
ugcccaccagaagaggga

SEQ ID NO: 177843 - RNA, 22 nt, Human
agggagcaugggugaagcaggc

SEQ ID NO: 177844 - RNA, 22 nt, Human
caggucucuuuugucacaccac

SEQ ID NO: 177845 - RNA, 22 nt, Human
acaaaguguuuucugaaggccu

SEQ ID NO: 177846 - RNA, 22 nt, Human
uucucaugaaacucgcuuccuc

SEQ ID NO: 177847 - RNA, 22 nt, Human
ucccuccuggugagcaggggcu

SEQ ID NO: 177848 - RNA, 22 nt, Human
uguggggcugugguguucuucu

SEQ ID NO: 177849 - RNA, 22 nt, Human
caccaccaggcaggacaccgaa

SEQ ID NO: 177850 - RNA, 22 nt, Human
gagcuggugugugcccgagcac

SEQ ID NO: 177851 - RNA, 22 nt, Human
uccugaggacuaacaggaagga

SEQ ID NO: 177852 - RNA, 22 nt, Human
cccagguggguuggccucuguc

SEQ ID NO: 177853 - RNA, 22 nt, Human
gaaggccacggaauggagcugg

SEQ ID NO: 177854 - RNA, 22 nt, Human
cauuugucaucacugagcugcc

SEQ ID NO: 177855 - RNA, 22 nt, Human
gggaagcccugugcuugccugg

SEQ ID NO: 177856 - RNA, 22 nt, Human
aguagugaacagccacaggauu

SEQ ID NO: 177857 - RNA, 22 nt, Human
gccaccuggacagcugugcccu

SEQ ID NO: 177858 - RNA, 22 nt, Human
gaagaggaugacaggagccggu

SEQ ID NO: 177859 - RNA, 21 nt, Human
ccuuuagauuucuaugcaguu

SEQ ID NO: 177860 - RNA, 22 nt, Human
cuauucaguugugggcaacaau

SEQ ID NO: 177861 - RNA, 22 nt, Human
cagcaugccugggcugccugcc

SEQ ID NO: 177862 - RNA, 22 nt, Human
gaucagaguggcuagagccuug

SEQ ID NO: 177863 - RNA, 22 nt, Human
uuuugagauggagucuugcucu

SEQ ID NO: 177864 - RNA, 22 nt, Human
agaaaguuaaacagugauaaga

SEQ ID NO: 177865 - RNA, 22 nt, Human
aggaauguuuagaaugucagaa

SEQ ID NO: 177866 - RNA, 22 nt, Human
ggcacugauuccauucaugaag

SEQ ID NO: 177867 - RNA, 22 nt, Human
ucugaaauggcgauggccguug

SEQ ID NO: 177868 - RNA, 22 nt, Human
uucugcagugugcagggccugu

SEQ ID NO: 177869 - RNA, 22 nt, Human
auuugucucugcacuuuacuca

SEQ ID NO: 177870 - RNA, 20 nt, Human
agcacagcgcgguguuccuu

SEQ ID NO: 177871 - RNA, 22 nt, Human
uacauuuauaaggcuucucugu

SEQ ID NO: 177872 - RNA, 22 nt, Human
gggcagguacaagaugcuucuu

SEQ ID NO: 177873 - RNA, 22 nt, Human
guuuccucugcugguuuucauu

SEQ ID NO: 177874 - RNA, 21 nt, Human
ucagaacaauuccaugccucc

SEQ ID NO: 177875 - RNA, 22 nt, Human
agaugagugagagcaucaacuu

SEQ ID NO: 177876 - RNA, 22 nt, Human
aaauggcacuuugacagccugc

SEQ ID NO: 177877 - RNA, 22 nt, Human
cuacugaugcuauacuucucag

SEQ ID NO: 177878 - RNA, 22 nt, Human
gugaggcuacucagcuguccga

SEQ ID NO: 177879 - RNA, 22 nt, Human
ugcaggugcagcgauacuguga

SEQ ID NO: 177880 - RNA, 22 nt, Human
gggcgccgugggaaacagccgg

SEQ ID NO: 177881 - RNA, 17 nt, Human
agcagcuggcacaggag

SEQ ID NO: 177882 - RNA, 22 nt, Human
aaaacauaaacugacagcccau

SEQ ID NO: 177883 - RNA, 22 nt, Human
uggcaaagacgcuagcuaagau

SEQ ID NO: 177884 - RNA, 22 nt, Human
agaagccacugcucccagugag

SEQ ID NO: 177885 - RNA, 22 nt, Human
ucacagaaauaagauaguuauu

SEQ ID NO: 177886 - RNA, 22 nt, Human
uaaucacagaaacagacuguuu

SEQ ID NO: 177887 - RNA, 22 nt, Human
uucuggaaaugcacaacuaauu

SEQ ID NO: 177888 - RNA, 22 nt, Human
agccagcugccuuucacaucug

SEQ ID NO: 177889 - RNA, 22 nt, Human
aagucucugauguguguuaggu

SEQ ID NO: 177890 - RNA, 22 nt, Human
aucuaauuuucacucauuugcu

SEQ ID NO: 177891 - RNA, 22 nt, Human
gccaccugcgggccguggugga

SEQ ID NO: 177892 - RNA, 22 nt, Human
gggcacaccuugucugagcaca

SEQ ID NO: 177893 - RNA, 23 nt, Human
agcuuccuagugaccuggagucu

SEQ ID NO: 177894 - RNA, 22 nt, Human
cuccuccagcucucccuggggg

SEQ ID NO: 177895 - RNA, 22 nt, Human
agucucugcugguugugccuau

SEQ ID NO: 177896 - RNA, 22 nt, Human
uuagggacagcucuguagguga

SEQ ID NO: 177897 - RNA, 22 nt, Human
aagagggcagcacagguggguc

SEQ ID NO: 177898 - RNA, 22 nt, Human
ugguccugaucaccgcugggca

SEQ ID NO: 177899 - RNA, 22 nt, Human
ccagagggaagaggaagcgcug

SEQ ID NO: 177900 - RNA, 22 nt, Human
ccucugagugcuuugagggaga

SEQ ID NO: 177901 - RNA, 20 nt, Human
auugaaauuuuucugagauu

SEQ ID NO: 177902 - RNA, 22 nt, Human
cuagagaaacgccgugggagga

SEQ ID NO: 177903 - RNA, 22 nt, Human
ggcaggcaucauguggucauua

SEQ ID NO: 177904 - RNA, 22 nt, Human
gauccacagcccgcuugggccc

SEQ ID NO: 177905 - RNA, 22 nt, Human
ugacaugugucuccuuccgucu

SEQ ID NO: 177906 - RNA, 22 nt, Human
gagccuggauagccuuguucca

SEQ ID NO: 177907 - RNA, 22 nt, Human
agugugaccuuauuuggaaaca

SEQ ID NO: 177908 - RNA, 17 nt, Human
cccguucucuucgcugg

SEQ ID NO: 177909 - RNA, 22 nt, Human
cggggcuguagcacagcugagc

SEQ ID NO: 177910 - RNA, 22 nt, Human
acacuuuaucaauauucaaaaa

SEQ ID NO: 177911 - RNA, 22 nt, Human
gugcaaaagcaauugcaguuuu

SEQ ID NO: 177912 - RNA, 22 nt, Human
agcuuguuagaaauguagacuc

SEQ ID NO: 177913 - RNA, 22 nt, Human
acuuggaaaauucaaaauggca

SEQ ID NO: 177914 - RNA, 22 nt, Human
ugaaagcuguacaugugguaca

SEQ ID NO: 177915 - RNA, 22 nt, Human
aagcacuggggccacagacacg

SEQ ID NO: 177916 - RNA, 22 nt, Human
ccugagggucaaggagcccuag

SEQ ID NO: 177917 - RNA, 22 nt, Human
gcuggcuggaggagggagguug

SEQ ID NO: 177918 - RNA, 20 nt, Human
gggcuagguagccauuuggc

SEQ ID NO: 177919 - RNA, 22 nt, Human
ccucugagugacagccuccucu

SEQ ID NO: 177920 - RNA, 22 nt, Human
aggaggaauacaauccagcagc

SEQ ID NO: 177921 - RNA, 22 nt, Human
aggcuccaaauuaccaagcucu

SEQ ID NO: 177922 - RNA, 22 nt, Human
aggaaccagagguugagcaacu

SEQ ID NO: 177923 - RNA, 21 nt, Human
cagcccagagcaguggggcca

SEQ ID NO: 177924 - RNA, 22 nt, Human
cugcaaggcugaauucagcuga

SEQ ID NO: 177925 - RNA, 22 nt, Human
ggcacagcugaugcagacacac

SEQ ID NO: 177926 - RNA, 22 nt, Human
cuucuucuggacaggcagcucc

SEQ ID NO: 177927 - RNA, 22 nt, Human
ggauguugauugaauggccauu

SEQ ID NO: 177928 - RNA, 22 nt, Human
augaugucaugaauauauuagu

SEQ ID NO: 177929 - RNA, 22 nt, Human
aaauacauacacuguacguggc

SEQ ID NO: 177930 - RNA, 22 nt, Human
cccaggcugaguuagagguguc

SEQ ID NO: 177931 - RNA, 22 nt, Human
uacaaguccguaaagggcagau

SEQ ID NO: 177932 - RNA, 19 nt, Human
ggaccagguccugggcagc

SEQ ID NO: 177933 - RNA, 22 nt, Human
cuuuuagcugcaaguguucaca

SEQ ID NO: 177934 - RNA, 22 nt, Human
cucagcaguauacucugaagau

SEQ ID NO: 177935 - RNA, 22 nt, Human
ugggaggcagaaguugacugga

SEQ ID NO: 177936 - RNA, 22 nt, Human
ugucucaguucccuucucugga

SEQ ID NO: 177937 - RNA, 22 nt, Human
agaauuuuugauuaucuacucg

SEQ ID NO: 177938 - RNA, 22 nt, Human
ccuguggcucucuuuggagguc

SEQ ID NO: 177939 - RNA, 22 nt, Human
uucacauugugcagauuauggu

SEQ ID NO: 177940 - RNA, 22 nt, Human
agcaggucuugcucucaacagg

SEQ ID NO: 177941 - RNA, 22 nt, Human
gaaaaucugcuuauauuauuuu

SEQ ID NO: 177942 - RNA, 23 nt, Human
auuuacagguuaaaugaaaucag

SEQ ID NO: 177943 - RNA, 22 nt, Human
guagccuagaggucacgucuuc

SEQ ID NO: 177944 - RNA, 22 nt, Human
ugacacaguagaaagaugauga

SEQ ID NO: 177945 - RNA, 22 nt, Human
caucuuuugguaggagccgggc

SEQ ID NO: 177946 - RNA, 22 nt, Human
cagcaagaacagccugaugugc

SEQ ID NO: 177947 - RNA, 22 nt, Human
uggggacaggagacuuacagcu

SEQ ID NO: 177948 - RNA, 22 nt, Human
uuucaguuuccagcuuugucau

SEQ ID NO: 177949 - RNA, 22 nt, Human
ggccuuggugcucuguguugca

SEQ ID NO: 177950 - RNA, 22 nt, Human
uuuccucagaagugucuacuau

SEQ ID NO: 177951 - RNA, 22 nt, Human
uucagaaugcuauuucugaaau

SEQ ID NO: 177952 - RNA, 22 nt, Human
ucaugcagagccagucaggaua

SEQ ID NO: 177953 - RNA, 22 nt, Human
aggcuguggugcugaaggaggg

SEQ ID NO: 177954 - RNA, 22 nt, Human
gccaggguucgaauccguaugg

SEQ ID NO: 177955 - RNA, 22 nt, Human
gagaggccauggcugugcagug

SEQ ID NO: 177956 - RNA, 22 nt, Human
uugaaugaauaguugcuagaag

SEQ ID NO: 177957 - RNA, 22 nt, Human
gagggccaaagagcaagagccu

SEQ ID NO: 177958 - RNA, 22 nt, Human
cagcuggccugaucccuguggc

SEQ ID NO: 177959 - RNA, 22 nt, Human
cugcugugcacccaggaaggcu

SEQ ID NO: 177960 - RNA, 22 nt, Human
ucuagauguacugcugaagagu

SEQ ID NO: 177961 - RNA, 22 nt, Human
agcagggggaguuagacuagau

SEQ ID NO: 177962 - RNA, 22 nt, Human
cagcccaguaccaagcaguugg

SEQ ID NO: 177963 - RNA, 22 nt, Human
acaggcuuacaggcugcaagua

SEQ ID NO: 177964 - RNA, 22 nt, Human
ucagugcagggugggagagaga

SEQ ID NO: 177965 - RNA, 22 nt, Human
auuccacagaggacuccgauug

SEQ ID NO: 177966 - RNA, 22 nt, Human
agugucacagacccaaucagga

SEQ ID NO: 177967 - RNA, 22 nt, Human
ugcacgugugagcauucacaug

SEQ ID NO: 177968 - RNA, 22 nt, Human
uucaucugcuucuugauuuugc

SEQ ID NO: 177969 - RNA, 22 nt, Human
cagcuuuaccaauauuuggaaa

SEQ ID NO: 177970 - RNA, 22 nt, Human
cuuucugauuuuaagcucuaau

SEQ ID NO: 177971 - RNA, 22 nt, Human
gccaaaucuggauuuagcaaga

SEQ ID NO: 177972 - RNA, 22 nt, Human
uggcaggagccugcggggaggu

SEQ ID NO: 177973 - RNA, 22 nt, Human
aaauagcauaaaauaggaagcu

SEQ ID NO: 177974 - RNA, 18 nt, Human
ccagugccaagaguggca

SEQ ID NO: 177975 - RNA, 21 nt, Human
uugaaggaucacuucuguacc

SEQ ID NO: 177976 - RNA, 22 nt, Human
gcuguucucuguaacaugcauu

SEQ ID NO: 177977 - RNA, 22 nt, Human
gcacaugucuuauucacuguua

SEQ ID NO: 177978 - RNA, 22 nt, Human
gccuguguuuuuaacucuagga

SEQ ID NO: 177979 - RNA, 22 nt, Human
agcauccacucacugggagagg

SEQ ID NO: 177980 - RNA, 22 nt, Human
gcuggccacacugcugauggag

SEQ ID NO: 177981 - RNA, 22 nt, Human
ugacauguaguuagaaaauagg

SEQ ID NO: 177982 - RNA, 22 nt, Human
gcaucuuuagccucuccguggc

SEQ ID NO: 177983 - RNA, 22 nt, Human
cugggccuccucugcccaagcu

SEQ ID NO: 177984 - RNA, 22 nt, Human
acaguguguuggaggagacugu

SEQ ID NO: 177985 - RNA, 22 nt, Human
agugaaauccuggucaacaggu

SEQ ID NO: 177986 - RNA, 21 nt, Human
acagcauguuuguguguuugc

SEQ ID NO: 177987 - RNA, 22 nt, Human
ucucccacagucucccauggcu

SEQ ID NO: 177988 - RNA, 23 nt, Human
ucugggcugagcucgaguguaga

SEQ ID NO: 177989 - RNA, 22 nt, Human
auguuuucuagaguuuaaaauc

SEQ ID NO: 177990 - RNA, 22 nt, Human
uccugugauggcuugcgaugug

SEQ ID NO: 177991 - RNA, 22 nt, Human
agggaggaaggauguuccaaag

SEQ ID NO: 177992 - RNA, 22 nt, Human
aggaaaaaccuguuaaugguag

SEQ ID NO: 177993 - RNA, 22 nt, Human
cuuggggcuuuguguguaggau

SEQ ID NO: 177994 - RNA, 22 nt, Human
aaggcuucuggagcuugcuggc

SEQ ID NO: 177995 - RNA, 22 nt, Human
cuuaaauuggaugaguuaaguu

SEQ ID NO: 177996 - RNA, 22 nt, Human
ugcugccauggucgcugguguc

SEQ ID NO: 177997 - RNA, 22 nt, Human
ucuccccucccuggaccagugc

SEQ ID NO: 177998 - RNA, 22 nt, Human
guggcuugagcaggggcagagg

SEQ ID NO: 177999 - RNA, 22 nt, Human
guuaacaagaauuacucuggaa

SEQ ID NO: 178000 - RNA, 22 nt, Human
ugucugaugauagugucucucc

SEQ ID NO: 178001 - RNA, 22 nt, Human
aagggcagaauagagaagaugg

SEQ ID NO: 178002 - RNA, 22 nt, Human
cuguggcagggaagaggccaug

SEQ ID NO: 178003 - RNA, 22 nt, Human
uagaaucugaauguagagcuga

SEQ ID NO: 178004 - RNA, 22 nt, Human
uggcagaaugaagacuggggcc

SEQ ID NO: 178005 - RNA, 22 nt, Human
ucuggcugaaauuagaagguuc

SEQ ID NO: 178006 - RNA, 20 nt, Human
acucuguacugucaauguug

SEQ ID NO: 178007 - RNA, 22 nt, Human
uacugaaaguggucaacagugg

SEQ ID NO: 178008 - RNA, 22 nt, Human
uuuagaaauugcagagugggug

SEQ ID NO: 178009 - RNA, 22 nt, Human
uuugaagauaaauauggagaaa

SEQ ID NO: 178010 - RNA, 22 nt, Human
ucugggcuuuaagaacucuguu

SEQ ID NO: 178011 - RNA, 22 nt, Human
gcucaggacccaggugugaccu

SEQ ID NO: 178012 - RNA, 22 nt, Human
cuagaaggaagcccagcacuuc

SEQ ID NO: 178013 - RNA, 22 nt, Human
ucucuguggguuucaccagcgc

SEQ ID NO: 178014 - RNA, 22 nt, Human
gguguagcucugugucccacug

SEQ ID NO: 178015 - RNA, 22 nt, Human
ugcaauuacugggagguuuuau

SEQ ID NO: 178016 - RNA, 22 nt, Human
cgugagggcauggcagugagga

SEQ ID NO: 178017 - RNA, 22 nt, Human
agacacagaugguaccugagcc

SEQ ID NO: 178018 - RNA, 20 nt, Human
cuccagccccugcccugguc

SEQ ID NO: 178019 - RNA, 22 nt, Human
acaguaacaaauggccugagga

SEQ ID NO: 178020 - RNA, 22 nt, Human
acagacaugggccgcucuugag

SEQ ID NO: 178021 - RNA, 22 nt, Human
acaggcugcccgcuccccaccu

SEQ ID NO: 178022 - RNA, 22 nt, Human
uauuccuaagucccaacuacau

SEQ ID NO: 178023 - RNA, 22 nt, Human
aaauauuguuuugguaagcuuc

SEQ ID NO: 178024 - RNA, 22 nt, Human
augagguuuuacugccauuuuc

SEQ ID NO: 178025 - RNA, 22 nt, Human
agcaccaggcuguuggaagccc

SEQ ID NO: 178026 - RNA, 22 nt, Human
auagacauggucuuuugucauu

SEQ ID NO: 178027 - RNA, 22 nt, Human
gagcugggcuggcuuccucccu

SEQ ID NO: 178028 - RNA, 22 nt, Human
ugauaggcuuaauuuuccuguc

SEQ ID NO: 178029 - RNA, 22 nt, Human
agcuguuccaggccucauugcu

SEQ ID NO: 178030 - RNA, 22 nt, Human
gcuccucucccagagcugcagg

SEQ ID NO: 178031 - RNA, 22 nt, Human
uugcuaauuuaacuaccuuguu

SEQ ID NO: 178032 - RNA, 22 nt, Human
cauuuuguagcaaugacuguug

SEQ ID NO: 178033 - RNA, 22 nt, Human
ggcuucugagugcucugcuguu

SEQ ID NO: 178034 - RNA, 22 nt, Human
gugacguuuaauagugacaugg

SEQ ID NO: 178035 - RNA, 22 nt, Human
cugccaccaugccccagcagag

SEQ ID NO: 178036 - RNA, 22 nt, Human
uggagaggagcaccauggccau

SEQ ID NO: 178037 - RNA, 22 nt, Human
caaaagauacuugcaucuaacu

SEQ ID NO: 178038 - RNA, 22 nt, Human
gcugagcugggacaguccuggg

SEQ ID NO: 178039 - RNA, 22 nt, Human
guaggucuucugaaaaccaaaa

SEQ ID NO: 178040 - RNA, 22 nt, Human
accuuggaaaugcccauugccu

SEQ ID NO: 178041 - RNA, 22 nt, Human
uccuccaagccuuugugaagug

SEQ ID NO: 178042 - RNA, 21 nt, Human
gaugauggcaggcagcacugg

SEQ ID NO: 178043 - RNA, 18 nt, Human
cuguucuagaacuccugu

SEQ ID NO: 178044 - RNA, 22 nt, Human
gcugugugcuaggauauguuuu

SEQ ID NO: 178045 - RNA, 19 nt, Human
gguccucagcagagcaugc

SEQ ID NO: 178046 - RNA, 22 nt, Human
cugagaauaaagccagcaggag

SEQ ID NO: 178047 - RNA, 22 nt, Human
cuuuuacugugaaaagaaacug

SEQ ID NO: 178048 - RNA, 22 nt, Human
gccugggagcacaucggggucc

SEQ ID NO: 178049 - RNA, 22 nt, Human
agucaguugcaaacaucaggca

SEQ ID NO: 178050 - RNA, 22 nt, Human
cuguggcuucuagguccccgau

SEQ ID NO: 178051 - RNA, 22 nt, Human
caguggcucaugccuauaaucc

SEQ ID NO: 178052 - RNA, 22 nt, Human
gacagacagggguucuccugga

SEQ ID NO: 178053 - RNA, 22 nt, Human
agacugggccauuuccccagcu

SEQ ID NO: 178054 - RNA, 22 nt, Human
agggcucugggguggcagagau

SEQ ID NO: 178055 - RNA, 22 nt, Human
aagcugaagaugccagugggag

SEQ ID NO: 178056 - RNA, 22 nt, Human
gaaugcuaagcaugugggaguu

SEQ ID NO: 178057 - RNA, 22 nt, Human
aucuggaacaaagcuuaggaau

SEQ ID NO: 178058 - RNA, 22 nt, Human
ucacagacaccuuggccacagu

SEQ ID NO: 178059 - RNA, 23 nt, Human
cucccuggcccuugggagaccug

SEQ ID NO: 178060 - RNA, 21 nt, Human
ugugugcauaugcauguacau

SEQ ID NO: 178061 - RNA, 22 nt, Human
aggcucugaguagagcugccag

SEQ ID NO: 178062 - RNA, 22 nt, Human
uuuuucuugugcuggaucuaau

SEQ ID NO: 178063 - RNA, 22 nt, Human
gagcuacaagggagacuuuuuu

SEQ ID NO: 178064 - RNA, 22 nt, Human
cacuuuuaaauggguccguguu

SEQ ID NO: 178065 - RNA, 22 nt, Human
cuacuguuauuauuaauaguaa

SEQ ID NO: 178066 - RNA, 17 nt, Human
uaugaggcaguuuguga

SEQ ID NO: 178067 - RNA, 22 nt, Human
cagugcagcugccccgcuggua

SEQ ID NO: 178068 - RNA, 22 nt, Human
uccacccccagacagcugguga

SEQ ID NO: 178069 - RNA, 22 nt, Human
cucccaggccaugcucuagcca

SEQ ID NO: 178070 - RNA, 20 nt, Human
ugcugggugggcagcuguaa

SEQ ID NO: 178071 - RNA, 22 nt, Human
gagcagcugagcuggaaugaga

SEQ ID NO: 178072 - RNA, 23 nt, Human
cggggccagggucaggaccgguc

SEQ ID NO: 178073 - RNA, 22 nt, Human
uuggcugcauuuuggguucguu

SEQ ID NO: 178074 - RNA, 22 nt, Human
gcaguggauccaaugguaucuu

SEQ ID NO: 178075 - RNA, 17 nt, Human
cugaaauauuaugauaa

SEQ ID NO: 178076 - RNA, 22 nt, Human
uaagugaugucuugguuaauga

SEQ ID NO: 178077 - RNA, 22 nt, Human
agcugcugcaaguggugcuaac

SEQ ID NO: 178078 - RNA, 22 nt, Human
ugcucaucaacaugaugaucau

SEQ ID NO: 178079 - RNA, 22 nt, Human
agucugcaggaccgcgucacau

SEQ ID NO: 178080 - RNA, 22 nt, Human
cugucaauuuauguugacaugc

SEQ ID NO: 178081 - RNA, 22 nt, Human
cugacuguugcuguugaugagg

SEQ ID NO: 178082 - RNA, 22 nt, Human
gccuggcccagggcucuuguug

SEQ ID NO: 178083 - RNA, 22 nt, Human
agaaccuucagauuaggaggug

SEQ ID NO: 178084 - RNA, 22 nt, Human
ucuuuggacuuuccaauuuguu

SEQ ID NO: 178085 - RNA, 22 nt, Human
agagcuauaacagcacuguaca

SEQ ID NO: 178086 - RNA, 22 nt, Human
ugaggcaaggcugaaugaaggc

SEQ ID NO: 178087 - RNA, 22 nt, Human
ucuccaaaucaaucaauaugaa

SEQ ID NO: 178088 - RNA, 22 nt, Human
gaggugucugcuguguucaaag

SEQ ID NO: 178089 - RNA, 18 nt, Human
gcuuugcagaaauacaga

SEQ ID NO: 178090 - RNA, 22 nt, Human
ucaguuuagaguuauuuaaucu

SEQ ID NO: 178091 - RNA, 22 nt, Human
cacaaugugguuugucaucuuu

SEQ ID NO: 178092 - RNA, 22 nt, Human
uuuggcuaauuaggugcugauu

SEQ ID NO: 178093 - RNA, 22 nt, Human
agacauaggauuccacauagca

SEQ ID NO: 178094 - RNA, 22 nt, Human
ugcaacaguggggcaugcugaa

SEQ ID NO: 178095 - RNA, 22 nt, Human
auacacaucuauuuaagagaca

SEQ ID NO: 178096 - RNA, 22 nt, Human
uacauuuucuaggggaccaaga

SEQ ID NO: 178097 - RNA, 22 nt, Human
acaguuaaggaaauggagguuc

SEQ ID NO: 178098 - RNA, 22 nt, Human
acacaggcaaugugagugggag

SEQ ID NO: 178099 - RNA, 22 nt, Human
auugucuucugucuuauaguuc

SEQ ID NO: 178100 - RNA, 23 nt, Human
auuuccuacuauaaaagagguaa

SEQ ID NO: 178101 - RNA, 22 nt, Human
aagauaauauucauuaacuaga

SEQ ID NO: 178102 - RNA, 22 nt, Human
caggagggcccgagacucuucc

SEQ ID NO: 178103 - RNA, 22 nt, Human
ucuagaaaaaaacugcugugga

SEQ ID NO: 178104 - RNA, 22 nt, Human
ucuuggcaguggaauaccagga

SEQ ID NO: 178105 - RNA, 22 nt, Human
ugaaacaaaccaguaauuuugu

SEQ ID NO: 178106 - RNA, 22 nt, Human
agggagaacaguugcagcagac

SEQ ID NO: 178107 - RNA, 22 nt, Human
gcccagcacaucuggccuugaa

SEQ ID NO: 178108 - RNA, 22 nt, Human
gcuuaggaaaaugguggaguug

SEQ ID NO: 178109 - RNA, 22 nt, Human
uacaggagagauuuaguaauca

SEQ ID NO: 178110 - RNA, 22 nt, Human
gcagggggucauucacgcuggc

SEQ ID NO: 178111 - RNA, 22 nt, Human
cuguacaggagacgucugugca

SEQ ID NO: 178112 - RNA, 22 nt, Human
cuggcucauagagcagcuccaa

SEQ ID NO: 178113 - RNA, 22 nt, Human
uuuaaacauaucuguugaggga

SEQ ID NO: 178114 - RNA, 22 nt, Human
aguggcuguaggcuaugagaga

SEQ ID NO: 178115 - RNA, 22 nt, Human
uggcaggagagcgucagaucag

SEQ ID NO: 178116 - RNA, 17 nt, Human
cuccuggccaccccucu

SEQ ID NO: 178117 - RNA, 22 nt, Human
gguccuugggucuccuguguuu

SEQ ID NO: 178118 - RNA, 22 nt, Human
cagacacaccaggcccauucug

SEQ ID NO: 178119 - RNA, 21 nt, Human
uugcuguuuucccaaugcagu

SEQ ID NO: 178120 - RNA, 22 nt, Human
uuccuggcacauaguuagugcu

SEQ ID NO: 178121 - RNA, 22 nt, Human
gggaaggguguugucuuaucuu

SEQ ID NO: 178122 - RNA, 22 nt, Human
aaagauuauggaacacacauga

SEQ ID NO: 178123 - RNA, 22 nt, Human
uaagauguggaaucacagcuuc

SEQ ID NO: 178124 - RNA, 22 nt, Human
gucuggcauaugcaaagugcau

SEQ ID NO: 178125 - RNA, 18 nt, Human
auuuugaacugggaauau

SEQ ID NO: 178126 - RNA, 22 nt, Human
cuccuggugcuggggcugccgc

SEQ ID NO: 178127 - RNA, 22 nt, Human
ggucaacagagguaaugguaac

SEQ ID NO: 178128 - RNA, 22 nt, Human
ccagggcagcgccccuccacgc

SEQ ID NO: 178129 - RNA, 22 nt, Human
cuggcugcuuguagacucgacu

SEQ ID NO: 178130 - RNA, 22 nt, Human
gccuuggacucggguggacuca

SEQ ID NO: 178131 - RNA, 22 nt, Human
acauuucucauaggagagccac

SEQ ID NO: 178132 - RNA, 22 nt, Human
aagucuaggacaggaagucuau

SEQ ID NO: 178133 - RNA, 22 nt, Human
ucaggcuguauaucuugcacuc

SEQ ID NO: 178134 - RNA, 22 nt, Human
uagugcaggguuuuaagcacug

SEQ ID NO: 178135 - RNA, 22 nt, Human
cagcugagaaaggcaggcucac

SEQ ID NO: 178136 - RNA, 19 nt, Human
agggcuaggcacauagggc

SEQ ID NO: 178137 - RNA, 22 nt, Human
aaaugccucuggguuauucuag

SEQ ID NO: 178138 - RNA, 22 nt, Human
agcaaucagcuucuuuguguuu

SEQ ID NO: 178139 - RNA, 22 nt, Human
caggucagaggcgcagccccca

SEQ ID NO: 178140 - RNA, 21 nt, Human
gccagccaugcuugccuaggc

SEQ ID NO: 178141 - RNA, 22 nt, Human
guuauauuggcagaagagaaga

SEQ ID NO: 178142 - RNA, 22 nt, Human
aauaacagaaacuugagcauca

SEQ ID NO: 178143 - RNA, 22 nt, Human
cagcuguugugcugggcaguua

SEQ ID NO: 178144 - RNA, 22 nt, Human
gguccaucucuugagcccacau

SEQ ID NO: 178145 - RNA, 22 nt, Human
gccaggaguucagaugcauguu

SEQ ID NO: 178146 - RNA, 22 nt, Human
ggggaaggauugaguugaccca

SEQ ID NO: 178147 - RNA, 23 nt, Human
aggugcagcccuggaccugcccc

SEQ ID NO: 178148 - RNA, 22 nt, Human
ggguccaggcacuaugcuaagu

SEQ ID NO: 178149 - RNA, 22 nt, Human
cagagacaccccagaaaauaag

SEQ ID NO: 178150 - RNA, 22 nt, Human
aggcaagcauugggaacagggc

SEQ ID NO: 178151 - RNA, 22 nt, Human
uuugaaaaaggccuuugguaug

SEQ ID NO: 178152 - RNA, 22 nt, Human
guuucucugucuguuacauugg

SEQ ID NO: 178153 - RNA, 22 nt, Human
ucccaggcgccugguggggagc

SEQ ID NO: 178154 - RNA, 22 nt, Human
aaaguguugggauuacaggcau

SEQ ID NO: 178155 - RNA, 22 nt, Human
cucucccuggccagcugugcag

SEQ ID NO: 178156 - RNA, 22 nt, Human
uugaggagguccuggguuuacu

SEQ ID NO: 178157 - RNA, 16 nt, Human
ccuggaggucacuuca

SEQ ID NO: 178158 - RNA, 22 nt, Human
uaguccacagacucuacagcau

SEQ ID NO: 178159 - RNA, 22 nt, Human
cugccuagcgccaucugccucu

SEQ ID NO: 178160 - RNA, 22 nt, Human
ucuguaaaauuaguauaauugu

SEQ ID NO: 178161 - RNA, 22 nt, Human
gggggaagaggcaugaaguccu

SEQ ID NO: 178162 - RNA, 19 nt, Human
accugcaguaauaauuccu

SEQ ID NO: 178163 - RNA, 22 nt, Human
auguacaggauggugcucaucu

SEQ ID NO: 178164 - RNA, 22 nt, Human
auauauuuuuugagacagaguc

SEQ ID NO: 178165 - RNA, 22 nt, Human
aauguaaaguugggcacaaaug

SEQ ID NO: 178166 - RNA, 22 nt, Human
uguggcugcuccugggugguca

SEQ ID NO: 178167 - RNA, 21 nt, Human
aagcuuccaaacugcuggacu

SEQ ID NO: 178168 - RNA, 22 nt, Human
ugccugcccacgacuacagcag

SEQ ID NO: 178169 - RNA, 22 nt, Human
ucaggugggaguagaaugcuag

SEQ ID NO: 178170 - RNA, 22 nt, Human
cucugugcuuaugcuccauggg

SEQ ID NO: 178171 - RNA, 22 nt, Human
gaaggaggcuccccaaagucug

SEQ ID NO: 178172 - RNA, 22 nt, Human
ugggcucucagucagacuggca

SEQ ID NO: 178173 - RNA, 22 nt, Human
gaggcugugugucccucuggac

SEQ ID NO: 178174 - RNA, 22 nt, Human
ccugugcagcccuugccaguuu

SEQ ID NO: 178175 - RNA, 23 nt, Human
gaaucaguggcuaacaaggaaac

SEQ ID NO: 178176 - RNA, 22 nt, Human
agucugguguaugaaagugaau

SEQ ID NO: 178177 - RNA, 22 nt, Human
ccuucucuacuccugaugcaug

SEQ ID NO: 178178 - RNA, 22 nt, Human
ugcuggagcccaggcggccuuu

SEQ ID NO: 178179 - RNA, 22 nt, Human
acagagcuguacuacuuacuga

SEQ ID NO: 178180 - RNA, 22 nt, Human
uuuugagauggugucucgcucc

SEQ ID NO: 178181 - RNA, 22 nt, Human
aaaucccacucacgaguuuugc

SEQ ID NO: 178182 - RNA, 22 nt, Human
agcaggagcauuuccaugauuc

SEQ ID NO: 178183 - RNA, 22 nt, Human
acaaggcaauggcaggauuuca

SEQ ID NO: 178184 - RNA, 22 nt, Human
cuggcugaucucaaucauggcu

SEQ ID NO: 178185 - RNA, 22 nt, Human
aagcccagaugugagaacugag

SEQ ID NO: 178186 - RNA, 22 nt, Human
gaggagcugggacccugucauc

SEQ ID NO: 178187 - RNA, 23 nt, Human
auuagaaaggcuuucuggugaaa

SEQ ID NO: 178188 - RNA, 22 nt, Human
gguucucuuccuccugacugag

SEQ ID NO: 178189 - RNA, 19 nt, Human
ugcuauuuagaacgccugg

SEQ ID NO: 178190 - RNA, 23 nt, Human
gugcacagucaagcccagcuuag

SEQ ID NO: 178191 - RNA, 22 nt, Human
cuguggaguuuguggcgcugac

SEQ ID NO: 178192 - RNA, 22 nt, Human
gaaccuguaaguauagaugugg

SEQ ID NO: 178193 - RNA, 22 nt, Human
augaggcauauccuccuauggu

SEQ ID NO: 178194 - RNA, 22 nt, Human
agauguuuguguuaucuccauu

SEQ ID NO: 178195 - RNA, 22 nt, Human
agucacaguuucccugagagag

SEQ ID NO: 178196 - RNA, 22 nt, Human
uggggagugaugccucggauaa

SEQ ID NO: 178197 - RNA, 22 nt, Human
ucucuuugacccuuuagcucca

SEQ ID NO: 178198 - RNA, 22 nt, Human
aaggcagagggcuggaucagag

SEQ ID NO: 178199 - RNA, 22 nt, Human
ugguggcacaagggagagaauc

SEQ ID NO: 178200 - RNA, 22 nt, Human
gauaauaucugguuuauucacc

SEQ ID NO: 178201 - RNA, 22 nt, Human
accccaggucuccaggcucugg

SEQ ID NO: 178202 - RNA, 22 nt, Human
guuuccugaaguuauuucaucc

SEQ ID NO: 178203 - RNA, 18 nt, Human
uccuggccacacuaccuu

SEQ ID NO: 178204 - RNA, 18 nt, Human
ucuugccugcacccucuc

SEQ ID NO: 178205 - RNA, 19 nt, Human
ucacagacagagcaaucac

SEQ ID NO: 178206 - RNA, 22 nt, Human
agcagcugggcucagagcuggg

SEQ ID NO: 178207 - RNA, 22 nt, Human
uucaagugaggcugucuuuaga

SEQ ID NO: 178208 - RNA, 22 nt, Human
gaguggguccacagaggugaca

SEQ ID NO: 178209 - RNA, 22 nt, Human
ucaggugguccuaagugccauc

SEQ ID NO: 178210 - RNA, 22 nt, Human
uggcugagggcacuaugaagcc

SEQ ID NO: 178211 - RNA, 23 nt, Human
ccauucccacugugccuucccug

SEQ ID NO: 178212 - RNA, 22 nt, Human
gaggcagagacuccaccuucag

SEQ ID NO: 178213 - RNA, 23 nt, Human
cuggaagugcuuuuauagcuuug

SEQ ID NO: 178214 - RNA, 22 nt, Human
cccaugccuucugacucacagg

SEQ ID NO: 178215 - RNA, 22 nt, Human
auauuacucugauuuaguaaau

SEQ ID NO: 178216 - RNA, 22 nt, Human
gagcaggaugggagcuggggcc

SEQ ID NO: 178217 - RNA, 22 nt, Human
aaugcuuauaacguuagaaugu

SEQ ID NO: 178218 - RNA, 22 nt, Human
aacacagaagugccaagagcca

SEQ ID NO: 178219 - RNA, 22 nt, Human
uugaggaggaaaaggggguacc

SEQ ID NO: 178220 - RNA, 22 nt, Human
gacauaaaccuugagauauuaa

SEQ ID NO: 178221 - RNA, 22 nt, Human
uccaccagcagccugucagccu

SEQ ID NO: 178222 - RNA, 22 nt, Human
auuugucauguauguaaaguug

SEQ ID NO: 178223 - RNA, 19 nt, Human
agaggcagucuccaacagg

SEQ ID NO: 178224 - RNA, 18 nt, Human
ucagggaagagaauauga

SEQ ID NO: 178225 - RNA, 22 nt, Human
uuauuuugccacaggugaccuu

SEQ ID NO: 178226 - RNA, 22 nt, Human
cugagguggcgccucucuuuaa

SEQ ID NO: 178227 - RNA, 22 nt, Human
gugcacaucgugcagguuuguu

SEQ ID NO: 178228 - RNA, 22 nt, Human
accaggacuuuguauucagcuu

SEQ ID NO: 178229 - RNA, 22 nt, Human
aacuuucaggcaaugaauauuu

SEQ ID NO: 178230 - RNA, 22 nt, Human
aaaggcugccagguaaaauauu

SEQ ID NO: 178231 - RNA, 22 nt, Human
uaaaugaaaggguuuaauuuau

SEQ ID NO: 178232 - RNA, 19 nt, Human
aaaaagaggcuauaauauu

SEQ ID NO: 178233 - RNA, 22 nt, Human
uucuuuugggaauuacguaugc

SEQ ID NO: 178234 - RNA, 20 nt, Human
agacuuaggcaauuuaggcu

SEQ ID NO: 178235 - RNA, 22 nt, Human
gggggaagacugggcuagugau

SEQ ID NO: 178236 - RNA, 22 nt, Human
aagcauggagcaauagaaugac

SEQ ID NO: 178237 - RNA, 22 nt, Human
auccuggcuuuaggucagaggc

SEQ ID NO: 178238 - RNA, 22 nt, Human
cuuauuagugucugucugaguu

SEQ ID NO: 178239 - RNA, 22 nt, Human
uacgaauccuguggaugaaugu

SEQ ID NO: 178240 - RNA, 22 nt, Human
gcagaauauuauggaaaaagua

SEQ ID NO: 178241 - RNA, 22 nt, Human
gaccauuuccaccaugggcaca

SEQ ID NO: 178242 - RNA, 22 nt, Human
aagacaucagugaugacauuug

SEQ ID NO: 178243 - RNA, 22 nt, Human
uggucaggcugcucugcggcgu

SEQ ID NO: 178244 - RNA, 22 nt, Human
uucuccauuuaacuuccuuaug

SEQ ID NO: 178245 - RNA, 22 nt, Human
accuguuuuagucuuuaaucau

SEQ ID NO: 178246 - RNA, 21 nt, Human
aguugcauaggccagccaucc

SEQ ID NO: 178247 - RNA, 22 nt, Human
guuaauuuaguagaguccagau

SEQ ID NO: 178248 - RNA, 22 nt, Human
aauguuuuagauuacugcuggg

SEQ ID NO: 178249 - RNA, 22 nt, Human
uuggcuucuucgcacagcagua

SEQ ID NO: 178250 - RNA, 22 nt, Human
agacaaguucugugggucaccu

SEQ ID NO: 178251 - RNA, 22 nt, Human
ucuggaggccauagggaaggau

SEQ ID NO: 178252 - RNA, 22 nt, Human
aguguuuggggugauuguaacc

SEQ ID NO: 178253 - RNA, 22 nt, Human
aaauauuugucugaggcgguug

SEQ ID NO: 178254 - RNA, 22 nt, Human
acagaaauugcuaauagcucau

SEQ ID NO: 178255 - RNA, 20 nt, Human
cauauauaccuagaagugga

SEQ ID NO: 178256 - RNA, 22 nt, Human
aucucccaaacucauuucuuca

SEQ ID NO: 178257 - RNA, 22 nt, Human
uauauccagaaaaucaguucau

SEQ ID NO: 178258 - RNA, 22 nt, Human
uacuguacugcaguucugcaaa

SEQ ID NO: 178259 - RNA, 22 nt, Human
gggagccagccauccagaaccu

SEQ ID NO: 178260 - RNA, 22 nt, Human
aucaaugcucuguacccagaau

SEQ ID NO: 178261 - RNA, 22 nt, Human
acaguggaguugggguagcccu

SEQ ID NO: 178262 - RNA, 22 nt, Human
acagguggggcacuuggagccu

SEQ ID NO: 178263 - RNA, 22 nt, Human
uagagcuuggacugcauuuucg

SEQ ID NO: 178264 - RNA, 22 nt, Human
agaaauuccuaagguacacaag

SEQ ID NO: 178265 - RNA, 22 nt, Human
ugaccacacgucuggaauugug

SEQ ID NO: 178266 - RNA, 22 nt, Human
cccaggaggucgaagcugcagu

SEQ ID NO: 178267 - RNA, 22 nt, Human
aaguccuuuaauaucacauagu

SEQ ID NO: 178268 - RNA, 16 nt, Human
uucucugggguugugc

SEQ ID NO: 178269 - RNA, 22 nt, Human
acaggugugagaacaugccuug

SEQ ID NO: 178270 - RNA, 22 nt, Human
cuguccugugcauugucagaug

SEQ ID NO: 178271 - RNA, 22 nt, Human
uaggaacaguccuagaaaucug

SEQ ID NO: 178272 - RNA, 22 nt, Human
gaagcaugcuaaggauucucag

SEQ ID NO: 178273 - RNA, 22 nt, Human
agacccucuccucauggacaug

SEQ ID NO: 178274 - RNA, 22 nt, Human
cacauucuuucacaguucugaa

SEQ ID NO: 178275 - RNA, 22 nt, Human
agcccaagaagagcuuucuugc

SEQ ID NO: 178276 - RNA, 22 nt, Human
ugaaguuugguggaaauuuccu

SEQ ID NO: 178277 - RNA, 22 nt, Human
gaacagggaguacggcacauuu

SEQ ID NO: 178278 - RNA, 22 nt, Human
uaggcuuccgagucuugguauc

SEQ ID NO: 178279 - RNA, 22 nt, Human
ucaggagcuuagaugcuuugac

SEQ ID NO: 178280 - RNA, 22 nt, Human
gaucccugcccucagccuggac

SEQ ID NO: 178281 - RNA, 21 nt, Human
ugucacauguggaugguauuu

SEQ ID NO: 178282 - RNA, 22 nt, Human
gauacaagacuaauaggaaaca

SEQ ID NO: 178283 - RNA, 22 nt, Human
cucuccagccuuuagcccacgc

SEQ ID NO: 178284 - RNA, 22 nt, Human
uguaaaguuacuuuugaaagga

SEQ ID NO: 178285 - RNA, 20 nt, Human
acagaugaggaaaaugaagu

SEQ ID NO: 178286 - RNA, 22 nt, Human
ucaugcaguuacuguuaugcaa

SEQ ID NO: 178287 - RNA, 22 nt, Human
acaguaauugugaacuuaacgu

SEQ ID NO: 178288 - RNA, 22 nt, Human
agugugcauuccucuccucagg

SEQ ID NO: 178289 - RNA, 22 nt, Human
ucacaggagucaaggaauagua

SEQ ID NO: 178290 - RNA, 22 nt, Human
agggugggcuagacucuucccc

SEQ ID NO: 178291 - RNA, 23 nt, Human
agaguuuguuucuaaugagugag

SEQ ID NO: 178292 - RNA, 22 nt, Human
ucucugggauaaacugggccag

SEQ ID NO: 178293 - RNA, 22 nt, Human
ccugcccacagagagggugcau

SEQ ID NO: 178294 - RNA, 22 nt, Human
uggcuucuuguuugguuuaaga

SEQ ID NO: 178295 - RNA, 22 nt, Human
uacaguuuguuacauuguuagu

SEQ ID NO: 178296 - RNA, 22 nt, Human
uccuuugguuguagacaggaau

SEQ ID NO: 178297 - RNA, 23 nt, Human
ucucaggguggcugggcccaucc

SEQ ID NO: 178298 - RNA, 22 nt, Human
ggcagguggccaagugucuaag

SEQ ID NO: 178299 - RNA, 22 nt, Human
uagacagauuuaaaggaaugga

SEQ ID NO: 178300 - RNA, 18 nt, Human
caaauucagugcuggaag

SEQ ID NO: 178301 - RNA, 22 nt, Human
uccugggaccaggcaccuacug

SEQ ID NO: 178302 - RNA, 22 nt, Human
uaaaagaccacaaggugguaau

SEQ ID NO: 178303 - RNA, 22 nt, Human
ugauuacaaaagauuguuugaa

SEQ ID NO: 178304 - RNA, 22 nt, Human
agagcuuuuacuuacauucuau

SEQ ID NO: 178305 - RNA, 22 nt, Human
ggcagggacuuugcaaaucuuu

SEQ ID NO: 178306 - RNA, 22 nt, Human
gccagccccagacauccuaucg

SEQ ID NO: 178307 - RNA, 22 nt, Human
guucuucaucauuaacacucug

SEQ ID NO: 178308 - RNA, 22 nt, Human
cuggcucccggggaucgagcac

SEQ ID NO: 178309 - RNA, 22 nt, Human
ggacauuuuucuuccuacaaug

SEQ ID NO: 178310 - RNA, 22 nt, Human
ucucaggcucuuggaaccuguu

SEQ ID NO: 178311 - RNA, 22 nt, Human
aaaagccaugcauaccuaagag

SEQ ID NO: 178312 - RNA, 22 nt, Human
ccuggcucugguucccucagcu

SEQ ID NO: 178313 - RNA, 22 nt, Human
uucuuugggcucagagagggag

SEQ ID NO: 178314 - RNA, 19 nt, Human
acugccugaggcucacagg

SEQ ID NO: 178315 - RNA, 22 nt, Human
gggagcugaauggcaauggaga

SEQ ID NO: 178316 - RNA, 22 nt, Human
uuucacauaucaacucuauccu

SEQ ID NO: 178317 - RNA, 22 nt, Human
aaaaaugcuuggacuuaauaaa

SEQ ID NO: 178318 - RNA, 22 nt, Human
aagaaugagcucaaagaucuua

SEQ ID NO: 178319 - RNA, 22 nt, Human
uaguuugucaaccacugucaca

SEQ ID NO: 178320 - RNA, 19 nt, Human
ggccagccaccucgccugg

SEQ ID NO: 178321 - RNA, 22 nt, Human
uuaguguuuaaagguuucagag

SEQ ID NO: 178322 - RNA, 22 nt, Human
aucauacagaaccugagcacuu

SEQ ID NO: 178323 - RNA, 22 nt, Human
aggcaaggugcuacagacagug

SEQ ID NO: 178324 - RNA, 22 nt, Human
cagaggcugcucuggguggcau

SEQ ID NO: 178325 - RNA, 22 nt, Human
agcuguauuugugaauauuuaa

SEQ ID NO: 178326 - RNA, 22 nt, Human
ucccaggaauugaagccagugu

SEQ ID NO: 178327 - RNA, 22 nt, Human
acugggcuguuccuuauuucua

SEQ ID NO: 178328 - RNA, 22 nt, Human
gagccuuucuagauaauccagg

SEQ ID NO: 178329 - RNA, 22 nt, Human
aacaaaggccguuaauaaccac

SEQ ID NO: 178330 - RNA, 22 nt, Human
ggcugugcagggcagagucuca

SEQ ID NO: 178331 - RNA, 22 nt, Human
aggcugcugccuuggagagugu

SEQ ID NO: 178332 - RNA, 22 nt, Human
gauggggaugagaagugagcag

SEQ ID NO: 178333 - RNA, 22 nt, Human
uuugaagugggcauuagaaccu

SEQ ID NO: 178334 - RNA, 22 nt, Human
cacagaggugauaguggucaag

SEQ ID NO: 178335 - RNA, 22 nt, Human
ucuguagcauucaccagcccug

SEQ ID NO: 178336 - RNA, 22 nt, Human
uuccugaacauuucuaaguuga

SEQ ID NO: 178337 - RNA, 18 nt, Human
ucugaaggaaugauucca

SEQ ID NO: 178338 - RNA, 20 nt, Human
uauaaauucagagcuuuggu

SEQ ID NO: 178339 - RNA, 22 nt, Human
cagaggcuagacugugcuuccu

SEQ ID NO: 178340 - RNA, 22 nt, Human
uccaggcauaaugcccaguggu

SEQ ID NO: 178341 - RNA, 22 nt, Human
ugaaagcagugauuucuccuuc

SEQ ID NO: 178342 - RNA, 22 nt, Human
uacaaaaaauugauacugacga

SEQ ID NO: 178343 - RNA, 22 nt, Human
gcccagggucuacaaaaauauu

SEQ ID NO: 178344 - RNA, 18 nt, Human
aggacacauucuucccuc

SEQ ID NO: 178345 - RNA, 22 nt, Human
uuuuucauugcagccucucucc

SEQ ID NO: 178346 - RNA, 22 nt, Human
uuagauaaagugauguaggcua

SEQ ID NO: 178347 - RNA, 22 nt, Human
ugaggccugaagccugaaguga

SEQ ID NO: 178348 - RNA, 22 nt, Human
gcacaugacuuugaggaaacca

SEQ ID NO: 178349 - RNA, 22 nt, Human
uacugucugcuucuuauagcuu

SEQ ID NO: 178350 - RNA, 22 nt, Human
ucuccuaggcuggagugcagug

SEQ ID NO: 178351 - RNA, 22 nt, Human
ugauuuuuggaucugagcugca

SEQ ID NO: 178352 - RNA, 22 nt, Human
ucaguggagcuaagcaugagau

SEQ ID NO: 178353 - RNA, 22 nt, Human
acaggaaguuuggaaagccuca

SEQ ID NO: 178354 - RNA, 22 nt, Human
ugguuccaaucgcacuggcuca

SEQ ID NO: 178355 - RNA, 22 nt, Human
agguccugggaguucuagugug

SEQ ID NO: 178356 - RNA, 22 nt, Human
agcauaauuccugacacacaag

SEQ ID NO: 178357 - RNA, 22 nt, Human
ugauguucuguauaucauauag

SEQ ID NO: 178358 - RNA, 22 nt, Human
gggcugaaaggccgccucagau

SEQ ID NO: 178359 - RNA, 22 nt, Human
ggcaugcucuggggguccuccg

SEQ ID NO: 178360 - RNA, 22 nt, Human
cucucugcuguauccuuaggcu

SEQ ID NO: 178361 - RNA, 22 nt, Human
aguauacaaauaaauguguaau

SEQ ID NO: 178362 - RNA, 22 nt, Human
cugggucuggccacaggaagua

SEQ ID NO: 178363 - RNA, 22 nt, Human
ggcagcugugaagugccucaca

SEQ ID NO: 178364 - RNA, 22 nt, Human
cagaaagcaagccauucacugu

SEQ ID NO: 178365 - RNA, 22 nt, Human
aaaauaugaaguugucaguaug

SEQ ID NO: 178366 - RNA, 22 nt, Human
aagagaaagcagacuuugucau

SEQ ID NO: 178367 - RNA, 19 nt, Human
ccauuguaaagaaaaaugu

SEQ ID NO: 178368 - RNA, 22 nt, Human
auccauaucuggacucuacccc

SEQ ID NO: 178369 - RNA, 18 nt, Human
uguggcaggggugggaga

SEQ ID NO: 178370 - RNA, 22 nt, Human
uucuuuuaauagagauccugug

SEQ ID NO: 178371 - RNA, 22 nt, Human
cuggucugcaaggccauauaga

SEQ ID NO: 178372 - RNA, 19 nt, Human
gcagguggauguggucagc

SEQ ID NO: 178373 - RNA, 22 nt, Human
ucagagguaguagcagaguuga

SEQ ID NO: 178374 - RNA, 22 nt, Human
agcccugcuucaccauuuacuu

SEQ ID NO: 178375 - RNA, 22 nt, Human
cagccagugugaccgaggagga

SEQ ID NO: 178376 - RNA, 22 nt, Human
aaagcuaagguagcauuggaga

SEQ ID NO: 178377 - RNA, 22 nt, Human
uuuggacauguugagucugaua

SEQ ID NO: 178378 - RNA, 22 nt, Human
guucacaagaguuacagacaga

SEQ ID NO: 178379 - RNA, 22 nt, Human
gccagccaggaagaaaguaaga

SEQ ID NO: 178380 - RNA, 22 nt, Human
uuauuggaaaagggcuguaauu

SEQ ID NO: 178381 - RNA, 22 nt, Human
caauaacugcuaaauucccugu

SEQ ID NO: 178382 - RNA, 22 nt, Human
agcuugggugugccugcgagcu

SEQ ID NO: 178383 - RNA, 18 nt, Human
agcuguuguugacucugu

SEQ ID NO: 178384 - RNA, 22 nt, Human
uggccugacugucaggcuguau

SEQ ID NO: 178385 - RNA, 22 nt, Human
gagcaguggucugaucuucuaa

SEQ ID NO: 178386 - RNA, 22 nt, Human
cuggcagcccaaccuagagucu

SEQ ID NO: 178387 - RNA, 22 nt, Human
auccacagucagaacgggccua

SEQ ID NO: 178388 - RNA, 21 nt, Human
acacguguguguaaacacaca

SEQ ID NO: 178389 - RNA, 22 nt, Human
aaagcaguaugaaaggcaauaa

SEQ ID NO: 178390 - RNA, 22 nt, Human
auagugggaauuacgauauacu

SEQ ID NO: 178391 - RNA, 22 nt, Human
uccuggccaugcaagaugagga

SEQ ID NO: 178392 - RNA, 22 nt, Human
uaggcuggaacuuaggcagagg

SEQ ID NO: 178393 - RNA, 22 nt, Human
gaggcacaauacaugucucaag

SEQ ID NO: 178394 - RNA, 22 nt, Human
auauuucuggggguguguuucu

SEQ ID NO: 178395 - RNA, 22 nt, Human
agagaugcaucucuuaaaauug

SEQ ID NO: 178396 - RNA, 22 nt, Human
uauuuguugaguuguuaugucu

SEQ ID NO: 178397 - RNA, 22 nt, Human
gcaguaggaguuuccagggugg

SEQ ID NO: 178398 - RNA, 22 nt, Human
uucaugaaaguguaucuugugg

SEQ ID NO: 178399 - RNA, 22 nt, Human
ggcaggcaaggcagccugguga

SEQ ID NO: 178400 - RNA, 22 nt, Human
aagggcucugugugccucccca

SEQ ID NO: 178401 - RNA, 22 nt, Human
agaggcuccgucaucccucuuu

SEQ ID NO: 178402 - RNA, 22 nt, Human
aauucacaggagguauuugucc

SEQ ID NO: 178403 - RNA, 21 nt, Human
agcuuacauuaccauuguugc

SEQ ID NO: 178404 - RNA, 22 nt, Human
aguuguacauugugaacauuca

SEQ ID NO: 178405 - RNA, 20 nt, Human
cugacagaaaauauuucauc

SEQ ID NO: 178406 - RNA, 22 nt, Human
aaucuuacaccgaauuuaaacu

SEQ ID NO: 178407 - RNA, 22 nt, Human
uaagaugaucaccaaaugcugg

SEQ ID NO: 178408 - RNA, 22 nt, Human
aaggacagguuggggcuucagg

SEQ ID NO: 178409 - RNA, 22 nt, Human
ccaggccucuggcugcuuaguc

SEQ ID NO: 178410 - RNA, 22 nt, Human
ggagcccuccaucccuugcggc

SEQ ID NO: 178411 - RNA, 22 nt, Human
caagaaguugacagccagguga

SEQ ID NO: 178412 - RNA, 22 nt, Human
aauccagaugagcaaucauacu

SEQ ID NO: 178413 - RNA, 22 nt, Human
gaagcagugugaacccauguaa

SEQ ID NO: 178414 - RNA, 22 nt, Human
agcaguuaccaaggaaccuggu

SEQ ID NO: 178415 - RNA, 20 nt, Human
uucaaguugggucucuggcu

SEQ ID NO: 178416 - RNA, 22 nt, Human
agcauccuccuucccagagaug

SEQ ID NO: 178417 - RNA, 22 nt, Human
uauuacaagaaagggcaugaau

SEQ ID NO: 178418 - RNA, 20 nt, Human
accccagccccucuaucuga

SEQ ID NO: 178419 - RNA, 20 nt, Human
gaagccagaggggaaaggag

SEQ ID NO: 178420 - RNA, 22 nt, Human
auguucauuugacaaguaguga

SEQ ID NO: 178421 - RNA, 22 nt, Human
uccccagauucaugucugcugu

SEQ ID NO: 178422 - RNA, 22 nt, Human
cugcaggggccucgagcacagg

SEQ ID NO: 178423 - RNA, 22 nt, Human
uguugagacugagggagucagc

SEQ ID NO: 178424 - RNA, 22 nt, Human
cagcacaguacaaggcacggau

SEQ ID NO: 178425 - RNA, 22 nt, Human
gaaauagacacuuucuaugaau

SEQ ID NO: 178426 - RNA, 22 nt, Human
uucugcauucaaauuaugugag

SEQ ID NO: 178427 - RNA, 22 nt, Human
aagaacuagucuuacagccuca

SEQ ID NO: 178428 - RNA, 22 nt, Human
ggcagcugguucuuuccauuaa

SEQ ID NO: 178429 - RNA, 22 nt, Human
augcaaaaguaguugcaguuuu

SEQ ID NO: 178430 - RNA, 19 nt, Human
uggcagaggcaguuuguac

SEQ ID NO: 178431 - RNA, 17 nt, Human
uccuggccuggugugug

SEQ ID NO: 178432 - RNA, 22 nt, Human
cuggcuccaucacugggugaug

SEQ ID NO: 178433 - RNA, 22 nt, Human
acagccagaagucaggguggga

SEQ ID NO: 178434 - RNA, 22 nt, Human
uuccaggcugaugggccacagg

SEQ ID NO: 178435 - RNA, 22 nt, Human
uuuaggauauuaauguucagag

SEQ ID NO: 178436 - RNA, 22 nt, Human
agggacaucucacaaacaacuu

SEQ ID NO: 178437 - RNA, 22 nt, Human
uccuuauaguugucuuugaacc

SEQ ID NO: 178438 - RNA, 22 nt, Human
gaggaaggaaugcaguguaugc

SEQ ID NO: 178439 - RNA, 22 nt, Human
aauuacugucuccugcuggugu

SEQ ID NO: 178440 - RNA, 22 nt, Human
gacccugguguccagguccugc

SEQ ID NO: 178441 - RNA, 22 nt, Human
gccaguggcuugccaggcagga

SEQ ID NO: 178442 - RNA, 18 nt, Human
aacaggauccuccacuuc

SEQ ID NO: 178443 - RNA, 22 nt, Human
uucuuguucuccucauuuagag

SEQ ID NO: 178444 - RNA, 22 nt, Human
gagagccagcaguaaagacauu

SEQ ID NO: 178445 - RNA, 23 nt, Human
augcccugugcagaaauguggaa

SEQ ID NO: 178446 - RNA, 19 nt, Human
cagcacaugcuucucugag

SEQ ID NO: 178447 - RNA, 22 nt, Human
uuggagauaucacaccuucaca

SEQ ID NO: 178448 - RNA, 22 nt, Human
uucagaaaggauaauuggaagg

SEQ ID NO: 178449 - RNA, 22 nt, Human
aaauggaucuguggaauacauu

SEQ ID NO: 178450 - RNA, 22 nt, Human
cagcaucuggauuuccuccacu

SEQ ID NO: 178451 - RNA, 22 nt, Human
cuccccagcauucugacuuccu

SEQ ID NO: 178452 - RNA, 22 nt, Human
ugcaggcugcagucucaggugg

SEQ ID NO: 178453 - RNA, 22 nt, Human
gcaguccauugacagaggucuu

SEQ ID NO: 178454 - RNA, 23 nt, Human
ucucugaguuguacuuucccuug

SEQ ID NO: 178455 - RNA, 22 nt, Human
auccaugauuaguaggauaaag

SEQ ID NO: 178456 - RNA, 20 nt, Human
agaggcuuccuugggaggag

SEQ ID NO: 178457 - RNA, 17 nt, Human
gagcagggaugcgguuc

SEQ ID NO: 178458 - RNA, 22 nt, Human
ugagacagucaccaggcaggcc

SEQ ID NO: 178459 - RNA, 22 nt, Human
aaacauucaaagcaggaugugu

SEQ ID NO: 178460 - RNA, 22 nt, Human
caccuacuuugugcagauuuua

SEQ ID NO: 178461 - RNA, 22 nt, Human
aucccugugacgagcaucccua

SEQ ID NO: 178462 - RNA, 22 nt, Human
guggcagagggugagcuggacu

SEQ ID NO: 178463 - RNA, 22 nt, Human
aaaggcuugcgauuccuuguaa

SEQ ID NO: 178464 - RNA, 22 nt, Human
ccaggccucccuuuuccagcca

SEQ ID NO: 178465 - RNA, 22 nt, Human
ugugucauauuaguauugagag

SEQ ID NO: 178466 - RNA, 22 nt, Human
ugccagugcuugugucugagca

SEQ ID NO: 178467 - RNA, 22 nt, Human
caaugacacucugcacagugcu

SEQ ID NO: 178468 - RNA, 22 nt, Human
agggacaguuacaucaucagac

SEQ ID NO: 178469 - RNA, 22 nt, Human
cccagagccucauucuguuggg

SEQ ID NO: 178470 - RNA, 17 nt, Human
uaagugauuaucucaua

SEQ ID NO: 178471 - RNA, 22 nt, Human
aaggcugaauucaaggguaggc

SEQ ID NO: 178472 - RNA, 22 nt, Human
aggaaaacacaguauugaugga

SEQ ID NO: 178473 - RNA, 22 nt, Human
ggcuuuugcuguguuuuccaga

SEQ ID NO: 178474 - RNA, 22 nt, Human
gcagggcuauuggaaggagaug

SEQ ID NO: 178475 - RNA, 22 nt, Human
uagggcugugucuccaggacca

SEQ ID NO: 178476 - RNA, 22 nt, Human
agccucugguccucccucagcu

SEQ ID NO: 178477 - RNA, 22 nt, Human
uucuacaauaugaauaaugaag

SEQ ID NO: 178478 - RNA, 23 nt, Human
uugaaagauugcuaaguaaaaau

SEQ ID NO: 178479 - RNA, 22 nt, Human
ugaagagugcuugagauuuuaa

SEQ ID NO: 178480 - RNA, 22 nt, Human
gaagugacaagaugcuaggauc

SEQ ID NO: 178481 - RNA, 22 nt, Human
caguagucuuuuuccuccuaga

SEQ ID NO: 178482 - RNA, 22 nt, Human
aucuccaggcauuucaagagac

SEQ ID NO: 178483 - RNA, 22 nt, Human
gacacagaauuuacucccgaua

SEQ ID NO: 178484 - RNA, 22 nt, Human
aggcacaggaaugucauccagu

SEQ ID NO: 178485 - RNA, 22 nt, Human
aggaaacuaaagcccagagagg

SEQ ID NO: 178486 - RNA, 22 nt, Human
gccacauccagguggaucaaau

SEQ ID NO: 178487 - RNA, 18 nt, Human
augcccuguugacuucag

SEQ ID NO: 178488 - RNA, 22 nt, Human
cuggcucauccagguguugcuc

SEQ ID NO: 178489 - RNA, 22 nt, Human
ccagaugagaccacacugcugg

SEQ ID NO: 178490 - RNA, 22 nt, Human
agcaccagcgugggggccguug

SEQ ID NO: 178491 - RNA, 22 nt, Human
acuugaauuauauuucuagaga

SEQ ID NO: 178492 - RNA, 22 nt, Human
aacaaugaggaucuguucugag

SEQ ID NO: 178493 - RNA, 22 nt, Human
gcucaaauuucagacucaugaa

SEQ ID NO: 178494 - RNA, 17 nt, Human
gcaaggaaguucuuugc

SEQ ID NO: 178495 - RNA, 23 nt, Human
aagcuugucaccauuucuuucag

SEQ ID NO: 178496 - RNA, 22 nt, Human
cucugaggagaaagagcuuggu

SEQ ID NO: 178497 - RNA, 22 nt, Human
agcccagcccgggcugcgcuuu

SEQ ID NO: 178498 - RNA, 22 nt, Human
gcuggccccgagugcuacgcuc

SEQ ID NO: 178499 - RNA, 22 nt, Human
ugugggcacuaaugacaugcag

SEQ ID NO: 178500 - RNA, 22 nt, Human
agcuccugauucucagagauag

SEQ ID NO: 178501 - RNA, 21 nt, Human
uugcaacaaccuauauauuuu

SEQ ID NO: 178502 - RNA, 22 nt, Human
augccccaggaggugccaucca

SEQ ID NO: 178503 - RNA, 22 nt, Human
aaagcaguauauugguaguugu

SEQ ID NO: 178504 - RNA, 22 nt, Human
ugggaccuguuacauugaguua

SEQ ID NO: 178505 - RNA, 22 nt, Human
cuggcagggcucuuugggugcu

SEQ ID NO: 178506 - RNA, 22 nt, Human
uucuucaauuuuccauauacug

SEQ ID NO: 178507 - RNA, 16 nt, Human
ugguggggaggacagc

SEQ ID NO: 178508 - RNA, 23 nt, Human
acaaugucuguucauaaaauacc

SEQ ID NO: 178509 - RNA, 22 nt, Human
auugaaagguuuugagcagaua

SEQ ID NO: 178510 - RNA, 22 nt, Human
aaacaaacauagguuugaaagu

SEQ ID NO: 178511 - RNA, 22 nt, Human
aauuugugaaucugucucuuga

SEQ ID NO: 178512 - RNA, 22 nt, Human
acuguuucugccacaauagccc

SEQ ID NO: 178513 - RNA, 22 nt, Human
ugagauuuguuuuauaaaauag

SEQ ID NO: 178514 - RNA, 22 nt, Human
uucuggguggccaguauuuaga

SEQ ID NO: 178515 - RNA, 22 nt, Human
cucucuggaauuaaagcccaau

SEQ ID NO: 178516 - RNA, 22 nt, Human
agggcugaggcgagggagaugc

SEQ ID NO: 178517 - RNA, 22 nt, Human
agucacugaauaccuuaauguu

SEQ ID NO: 178518 - RNA, 20 nt, Human
gcugccuuggauggcuacac

SEQ ID NO: 178519 - RNA, 22 nt, Human
ggccugcacagagguggcucua

SEQ ID NO: 178520 - RNA, 22 nt, Human
accaggaguaacagugaguggu

SEQ ID NO: 178521 - RNA, 22 nt, Human
acuuucuucuuaugcauuaagg

SEQ ID NO: 178522 - RNA, 21 nt, Human
uuguguccuucuaaagggcca

SEQ ID NO: 178523 - RNA, 22 nt, Human
gacacugaccccaagcuguccu

SEQ ID NO: 178524 - RNA, 22 nt, Human
uugggagcuggaagcaaggccu

SEQ ID NO: 178525 - RNA, 22 nt, Human
aaugugucagcuugucgaucuu

SEQ ID NO: 178526 - RNA, 22 nt, Human
ucaguguccauaaauaaaguuu

SEQ ID NO: 178527 - RNA, 22 nt, Human
acagccagugcuccgugaggac

SEQ ID NO: 178528 - RNA, 22 nt, Human
agagguuguuagaauaguggag

SEQ ID NO: 178529 - RNA, 22 nt, Human
gccugagagucugcauuucuaa

SEQ ID NO: 178530 - RNA, 21 nt, Human
uggcggggacuuguggcugcc

SEQ ID NO: 178531 - RNA, 22 nt, Human
uccugggaaguugcaucaccgu

SEQ ID NO: 178532 - RNA, 19 nt, Human
auuuacugccuaaaaucuc

SEQ ID NO: 178533 - RNA, 22 nt, Human
ucagagagugcaaaauauagcu

SEQ ID NO: 178534 - RNA, 22 nt, Human
acagaacuuccagggaacauac

SEQ ID NO: 178535 - RNA, 22 nt, Human
caggagaugacagggaagaacc

SEQ ID NO: 178536 - RNA, 22 nt, Human
auugaaagaguuuucugcugca

SEQ ID NO: 178537 - RNA, 22 nt, Human
gccugaaguuucaugccucuau

SEQ ID NO: 178538 - RNA, 22 nt, Human
gacacagauaucucugagauua

SEQ ID NO: 178539 - RNA, 22 nt, Human
cucugugguaaaauagcaguau

SEQ ID NO: 178540 - RNA, 22 nt, Human
agcauccugcuugcugucugug

SEQ ID NO: 178541 - RNA, 22 nt, Human
gaaggccauugcguccugggau

SEQ ID NO: 178542 - RNA, 22 nt, Human
ccaggccauucccagaguugcu

SEQ ID NO: 178543 - RNA, 22 nt, Human
agcagugccgcaucuugugacc

SEQ ID NO: 178544 - RNA, 20 nt, Human
cuuuagaagaacccaagcau

SEQ ID NO: 178545 - RNA, 22 nt, Human
ugucugggauguaauuccugcc

SEQ ID NO: 178546 - RNA, 22 nt, Human
ugaaaugauuauaugguguuug

SEQ ID NO: 178547 - RNA, 22 nt, Human
auaagcuuugcuggagagaccu

SEQ ID NO: 178548 - RNA, 22 nt, Human
cagaaaccugucuggaguggga

SEQ ID NO: 178549 - RNA, 22 nt, Human
auucuacaaucauguagauccu

SEQ ID NO: 178550 - RNA, 22 nt, Human
gacagucccccagcagcaaacc

SEQ ID NO: 178551 - RNA, 22 nt, Human
ccacaagaugcaaacucuaaca

SEQ ID NO: 178552 - RNA, 22 nt, Human
ccuggcucaguguugaaggggu

SEQ ID NO: 178553 - RNA, 22 nt, Human
aggaaugucgucauaaacauga

SEQ ID NO: 178554 - RNA, 19 nt, Human
agcagcuguagauagacac

SEQ ID NO: 178555 - RNA, 22 nt, Human
gcuuucuguggugauguaaagg

SEQ ID NO: 178556 - RNA, 22 nt, Human
gaauacaaauaauaccaaggug

SEQ ID NO: 178557 - RNA, 22 nt, Human
agggucugacugaauggaaaag

SEQ ID NO: 178558 - RNA, 22 nt, Human
uugugucccugcggcugaggag

SEQ ID NO: 178559 - RNA, 22 nt, Human
guuccacauaacacaucuacaa

SEQ ID NO: 178560 - RNA, 22 nt, Human
accuagaauuuaaaacauugcu

SEQ ID NO: 178561 - RNA, 22 nt, Human
uugcugaagugaagguauguuu

SEQ ID NO: 178562 - RNA, 22 nt, Human
acugagcucuagguuuugaacc

SEQ ID NO: 178563 - RNA, 22 nt, Human
ucaggcugugucuuuaaacaau

SEQ ID NO: 178564 - RNA, 22 nt, Human
cuuagacauggcagcuccaagu

SEQ ID NO: 178565 - RNA, 22 nt, Human
uuggcagacuggguccugggga

SEQ ID NO: 178566 - RNA, 21 nt, Human
ucagagggcccuggaggcuca

SEQ ID NO: 178567 - RNA, 23 nt, Human
ucauuucauccagccuugagagu

SEQ ID NO: 178568 - RNA, 22 nt, Human
ccaggaagcggugagggcugcc

SEQ ID NO: 178569 - RNA, 22 nt, Human
aaugauauagcagacauagccu

SEQ ID NO: 178570 - RNA, 22 nt, Human
gcaggagugacauggaugugga

SEQ ID NO: 178571 - RNA, 22 nt, Human
uaugaaacauucauacaaauaa

SEQ ID NO: 178572 - RNA, 20 nt, Human
cuuccaccagggccgcugau

SEQ ID NO: 178573 - RNA, 22 nt, Human
cacaugcccagaacuucucauu

SEQ ID NO: 178574 - RNA, 22 nt, Human
aucauucaaaugauuuggaggu

SEQ ID NO: 178575 - RNA, 22 nt, Human
gccuccugcccagaugagugau

SEQ ID NO: 178576 - RNA, 23 nt, Human
cugauuugagcagaauaaaauag

SEQ ID NO: 178577 - RNA, 22 nt, Human
acauucuuauaagagugaggca

SEQ ID NO: 178578 - RNA, 22 nt, Human
uuaaagcaguuuguauacaugg

SEQ ID NO: 178579 - RNA, 22 nt, Human
cuuuauucugcaaauugccuug

SEQ ID NO: 178580 - RNA, 22 nt, Human
ucuguuuaugugucuaaauaaa

SEQ ID NO: 178581 - RNA, 22 nt, Human
agcagguguuagggauccaaug

SEQ ID NO: 178582 - RNA, 23 nt, Human
aguuuuuaauggucauagcugag

SEQ ID NO: 178583 - RNA, 22 nt, Human
cuaggcccaugagguuugcugg

SEQ ID NO: 178584 - RNA, 22 nt, Human
ugaaugaugcauuuguuuccca

SEQ ID NO: 178585 - RNA, 22 nt, Human
gcccucucggcauagcaggggc

SEQ ID NO: 178586 - RNA, 22 nt, Human
ucuacagugagucauucaaaca

SEQ ID NO: 178587 - RNA, 22 nt, Human
cagaaaauaaacauuuguggaa

SEQ ID NO: 178588 - RNA, 22 nt, Human
agccauggcgccacuagaggga

SEQ ID NO: 178589 - RNA, 22 nt, Human
cagaggcugacccugcuguugu

SEQ ID NO: 178590 - RNA, 22 nt, Human
gcuuccaguaaguugcugccau

SEQ ID NO: 178591 - RNA, 22 nt, Human
cauuugcaaaccaacaagauga

SEQ ID NO: 178592 - RNA, 22 nt, Human
gcacaguagguauuuacccagu

SEQ ID NO: 178593 - RNA, 22 nt, Human
ugaggacauugagacuggagac

SEQ ID NO: 178594 - RNA, 22 nt, Human
uacaggaaggagcacaucggga

SEQ ID NO: 178595 - RNA, 22 nt, Human
uccuggccucacaguccugggu

SEQ ID NO: 178596 - RNA, 22 nt, Human
agagcucaguguguuaugguua

SEQ ID NO: 178597 - RNA, 22 nt, Human
cccagagaugggaggugaucgg

SEQ ID NO: 178598 - RNA, 22 nt, Human
aauuaugagguagauaucacau

SEQ ID NO: 178599 - RNA, 22 nt, Human
acuguguggaccacucugaggc

SEQ ID NO: 178600 - RNA, 22 nt, Human
guccugggaggggcugguccug

SEQ ID NO: 178601 - RNA, 22 nt, Human
cuaacauuuauugagcacuuag

SEQ ID NO: 178602 - RNA, 22 nt, Human
gaauaacauuuuuuccuuuaca

SEQ ID NO: 178603 - RNA, 22 nt, Human
cagcagcaaggugaggguggag

SEQ ID NO: 178604 - RNA, 22 nt, Human
uguuacugugguuaccagaagc

SEQ ID NO: 178605 - RNA, 19 nt, Human
guuucauuaagauaggaaa

SEQ ID NO: 178606 - RNA, 22 nt, Human
ucccagcauuaaugccugucag

SEQ ID NO: 178607 - RNA, 22 nt, Human
aggaagcaaaaggcagggucua

SEQ ID NO: 178608 - RNA, 22 nt, Human
cacaaucucaacugccuuuuag

SEQ ID NO: 178609 - RNA, 22 nt, Human
aucucugguuguuuugcuccca

SEQ ID NO: 178610 - RNA, 22 nt, Human
auggugguuugggagaaaaagc

SEQ ID NO: 178611 - RNA, 22 nt, Human
ucuguccucuuugaagcugcuc

SEQ ID NO: 178612 - RNA, 20 nt, Human
uacauauuauaucagcugca

SEQ ID NO: 178613 - RNA, 22 nt, Human
aaaauugaagugaucaggaacu

SEQ ID NO: 178614 - RNA, 22 nt, Human
uggcugcagacaccuauggcag

SEQ ID NO: 178615 - RNA, 22 nt, Human
ugaaucaaugaauugcacuuca

SEQ ID NO: 178616 - RNA, 22 nt, Human
guuuuauaugucucugcugaca

SEQ ID NO: 178617 - RNA, 22 nt, Human
cccaggcauuuucaacuuuagu

SEQ ID NO: 178618 - RNA, 22 nt, Human
acccauuuuuaaauauaacuug

SEQ ID NO: 178619 - RNA, 21 nt, Human
aaggcuccuccucuaggccuc

SEQ ID NO: 178620 - RNA, 20 nt, Human
uugauucccucuaaacucgc

SEQ ID NO: 178621 - RNA, 22 nt, Human
guguguggaaaguuuuccaugg

SEQ ID NO: 178622 - RNA, 22 nt, Human
ggccuuggguauagguggguau

SEQ ID NO: 178623 - RNA, 22 nt, Human
acugugcagguagaugccuggg

SEQ ID NO: 178624 - RNA, 22 nt, Human
ggcugagcaauuuugaugacau

SEQ ID NO: 178625 - RNA, 22 nt, Human
ugacaggaggcuugaggccagg

SEQ ID NO: 178626 - RNA, 22 nt, Human
ggcugggaggaugacuugcuac

SEQ ID NO: 178627 - RNA, 22 nt, Human
gagccuggggacccuccugagu

SEQ ID NO: 178628 - RNA, 22 nt, Human
gaggggaagacuucuggacagu

SEQ ID NO: 178629 - RNA, 22 nt, Human
gggcucugggaugcucuuagag

SEQ ID NO: 178630 - RNA, 22 nt, Human
ccauguguucaauaagggaguu

SEQ ID NO: 178631 - RNA, 22 nt, Human
gcugucaccaaagcaggcacug

SEQ ID NO: 178632 - RNA, 23 nt, Human
aaauuauugcucuucaauugccu

SEQ ID NO: 178633 - RNA, 22 nt, Human
gccaccaguagcuaacaacagu

SEQ ID NO: 178634 - RNA, 22 nt, Human
agauggucuucauaaguuuuaa

SEQ ID NO: 178635 - RNA, 22 nt, Human
uaguuacagcaggcaggauaua

SEQ ID NO: 178636 - RNA, 22 nt, Human
gugcuucuuucuccucaagccu

SEQ ID NO: 178637 - RNA, 22 nt, Human
aauucaaucuguagauugugau

SEQ ID NO: 178638 - RNA, 22 nt, Human
accacccaccucacagcauagu

SEQ ID NO: 178639 - RNA, 20 nt, Human
cugcuccacccggcucucag

SEQ ID NO: 178640 - RNA, 22 nt, Human
ugaugauugggagacauuuggg

SEQ ID NO: 178641 - RNA, 23 nt, Human
uaaauuaccuuuccagugcaggg

SEQ ID NO: 178642 - RNA, 22 nt, Human
cacaggcagccuuguagaagaa

SEQ ID NO: 178643 - RNA, 22 nt, Human
ugcugagggcuguuaaggaagc

SEQ ID NO: 178644 - RNA, 22 nt, Human
agcuguggcaaccuugucagac

SEQ ID NO: 178645 - RNA, 22 nt, Human
ggcaggugaccuggccucccag

SEQ ID NO: 178646 - RNA, 19 nt, Human
uccugcagaccagaccugu

SEQ ID NO: 178647 - RNA, 22 nt, Human
uuaauuaauuaguuaagcaugu

SEQ ID NO: 178648 - RNA, 22 nt, Human
cagcagcucacucagguggcuc

SEQ ID NO: 178649 - RNA, 21 nt, Human
gagcugcaccuugaccuguuu

SEQ ID NO: 178650 - RNA, 22 nt, Human
uccuggcccggccgggccugcu

SEQ ID NO: 178651 - RNA, 22 nt, Human
agaaagcuccccaugagaugau

SEQ ID NO: 178652 - RNA, 22 nt, Human
uggaaacugugguauuucuuua

SEQ ID NO: 178653 - RNA, 22 nt, Human
caggaaaugaacaggaaugaac

SEQ ID NO: 178654 - RNA, 22 nt, Human
aucccauuuccuaguacaucau

SEQ ID NO: 178655 - RNA, 22 nt, Human
ugucuuuagagucacaaaacca

SEQ ID NO: 178656 - RNA, 22 nt, Human
uuauaccugaagcaggugaugu

SEQ ID NO: 178657 - RNA, 22 nt, Human
cugcuucuccaaaguaggacuu

SEQ ID NO: 178658 - RNA, 22 nt, Human
augugcaaauccaaugugaaug

SEQ ID NO: 178659 - RNA, 22 nt, Human
gaguccagacaccauaccugau

SEQ ID NO: 178660 - RNA, 22 nt, Human
uaacagaaaggggacagaaaua

SEQ ID NO: 178661 - RNA, 22 nt, Human
agcuggcuaugcccugugaacc

SEQ ID NO: 178662 - RNA, 22 nt, Human
uuccuuccuccuccaguucugg

SEQ ID NO: 178663 - RNA, 20 nt, Human
aggaaagccugugugagucu

SEQ ID NO: 178664 - RNA, 22 nt, Human
auacaucuaugccuuucugaca

SEQ ID NO: 178665 - RNA, 22 nt, Human
cagcuguguaaacacaugugua

SEQ ID NO: 178666 - RNA, 22 nt, Human
auggccagcccuucccgcagcu

SEQ ID NO: 178667 - RNA, 22 nt, Human
agaaaucccaaggcaucaacca

SEQ ID NO: 178668 - RNA, 22 nt, Human
uagcaacaagugacuaucuaua

SEQ ID NO: 178669 - RNA, 18 nt, Human
auggcacagucuuucccu

SEQ ID NO: 178670 - RNA, 22 nt, Human
gcacacauucuagccuuuugug

SEQ ID NO: 178671 - RNA, 22 nt, Human
agcuguguggugucugacagcu

SEQ ID NO: 178672 - RNA, 22 nt, Human
guggccagaaucuugaggccuu

SEQ ID NO: 178673 - RNA, 22 nt, Human
cccagagagguaaaacagccuu

SEQ ID NO: 178674 - RNA, 22 nt, Human
uauugcugacuuguucaguguu

SEQ ID NO: 178675 - RNA, 22 nt, Human
gcagccucagggcacucagaug

SEQ ID NO: 178676 - RNA, 22 nt, Human
ccaggcuccucaugaucuuguu

SEQ ID NO: 178677 - RNA, 22 nt, Human
gggagguaaagaugagcucagu

SEQ ID NO: 178678 - RNA, 22 nt, Human
aagcccagguaaguggcucaug

SEQ ID NO: 178679 - RNA, 22 nt, Human
agcugaagaaaugggaagcauu

SEQ ID NO: 178680 - RNA, 22 nt, Human
ccuagggucaguguggcaggag

SEQ ID NO: 178681 - RNA, 22 nt, Human
gaggcucagagggacuuucaag

SEQ ID NO: 178682 - RNA, 22 nt, Human
guaaguuuuucccuagauguag

SEQ ID NO: 178683 - RNA, 22 nt, Human
ggcaggcaggagcgugcuuggg

SEQ ID NO: 178684 - RNA, 22 nt, Human
agguguccaggaagaugcuggc

SEQ ID NO: 178685 - RNA, 22 nt, Human
ccagggagcccacaggacaaug

SEQ ID NO: 178686 - RNA, 22 nt, Human
gccaggcugccuuaucucuagc

SEQ ID NO: 178687 - RNA, 22 nt, Human
uuuaucuguuguaccugcauug

SEQ ID NO: 178688 - RNA, 22 nt, Human
cucugugcucccaugcuaguaa

SEQ ID NO: 178689 - RNA, 23 nt, Human
augugugggaggucagagagcca

SEQ ID NO: 178690 - RNA, 22 nt, Human
ccugguuuaugccagauccugu

SEQ ID NO: 178691 - RNA, 22 nt, Human
ucacagaaugucagaguugggg

SEQ ID NO: 178692 - RNA, 22 nt, Human
gaacuuuaaaacaaaguacagu

SEQ ID NO: 178693 - RNA, 22 nt, Human
uuuuucagccaugaauuacacu

SEQ ID NO: 178694 - RNA, 22 nt, Human
cuugaaucuggcuuugccacuu

SEQ ID NO: 178695 - RNA, 17 nt, Human
agucagaggaguaucug

SEQ ID NO: 178696 - RNA, 22 nt, Human
gucaaauauuaugcagcuugga

SEQ ID NO: 178697 - RNA, 22 nt, Human
agccuggauccuaggcucagcu

SEQ ID NO: 178698 - RNA, 22 nt, Human
uuggcuuggagaguugaaaugu

SEQ ID NO: 178699 - RNA, 22 nt, Human
ggaggaaauccuuaguaaggca

SEQ ID NO: 178700 - RNA, 22 nt, Human
gggcugacaaccaucugacaag

SEQ ID NO: 178701 - RNA, 22 nt, Human
ccugugaccacucugguucugc

SEQ ID NO: 178702 - RNA, 22 nt, Human
uguucauuaaacuacugugugg

SEQ ID NO: 178703 - RNA, 22 nt, Human
uaaagcauguacugugugcuag

SEQ ID NO: 178704 - RNA, 21 nt, Human
uggacuggugaguuuaggcug

SEQ ID NO: 178705 - RNA, 22 nt, Human
gggacgagaucuuggcagugug

SEQ ID NO: 178706 - RNA, 22 nt, Human
cuggguguuggguacugaccgu

SEQ ID NO: 178707 - RNA, 22 nt, Human
gcuuagaacauguggauugcaa

SEQ ID NO: 178708 - RNA, 22 nt, Human
uucauucugggcucuaaggaac

SEQ ID NO: 178709 - RNA, 22 nt, Human
ucucaggaagugauauugagac

SEQ ID NO: 178710 - RNA, 22 nt, Human
ugaggcaguauuuuagugacuu

SEQ ID NO: 178711 - RNA, 22 nt, Human
gcuccaggugucccagguaaaa

SEQ ID NO: 178712 - RNA, 22 nt, Human
cuuggcuccaaucccagcucug

SEQ ID NO: 178713 - RNA, 22 nt, Human
cugccugcaucccacagugggg

SEQ ID NO: 178714 - RNA, 19 nt, Human
ucuuauugagcagcugagg

SEQ ID NO: 178715 - RNA, 22 nt, Human
uaucuuuagaggaagagaaucu

SEQ ID NO: 178716 - RNA, 22 nt, Human
ccugcuguaaugugucuuuauu

SEQ ID NO: 178717 - RNA, 22 nt, Human
gccugcagccagggaguucucu

SEQ ID NO: 178718 - RNA, 22 nt, Human
uaaggccaggcuguggucggca

SEQ ID NO: 178719 - RNA, 22 nt, Human
ggagggcaucaaucaggccugg

SEQ ID NO: 178720 - RNA, 22 nt, Human
cuggaggagcaauaugguuagg

SEQ ID NO: 178721 - RNA, 19 nt, Human
gggaccugacuaauuggca

SEQ ID NO: 178722 - RNA, 22 nt, Human
gggggcaguaaccucaaagugu

SEQ ID NO: 178723 - RNA, 22 nt, Human
uaguauagauugaagcagauca

SEQ ID NO: 178724 - RNA, 22 nt, Human
gaggguccuggcuaagucugac

SEQ ID NO: 178725 - RNA, 22 nt, Human
aaauguacugauacuuauuuua

SEQ ID NO: 178726 - RNA, 22 nt, Human
cacaggagcuguggggcagugu

SEQ ID NO: 178727 - RNA, 22 nt, Human
aagggcucuguugccauuucag

SEQ ID NO: 178728 - RNA, 22 nt, Human
caggagugucgggucacuaggu

SEQ ID NO: 178729 - RNA, 20 nt, Human
uuggaaucaccuggagaggu

SEQ ID NO: 178730 - RNA, 22 nt, Human
caggaggcaguuucagaaguca

SEQ ID NO: 178731 - RNA, 22 nt, Human
ggugaggguaaauauaggcaaa

SEQ ID NO: 178732 - RNA, 22 nt, Human
agcaggcagccuaggaagugaa

SEQ ID NO: 178733 - RNA, 22 nt, Human
ggcugcagaggcccccaguggg

SEQ ID NO: 178734 - RNA, 22 nt, Human
agugaaauacugucguuuuuag

SEQ ID NO: 178735 - RNA, 22 nt, Human
gaggcagugcauugucuagggg

SEQ ID NO: 178736 - RNA, 22 nt, Human
augaggcacaucacagccaaug

SEQ ID NO: 178737 - RNA, 22 nt, Human
uagucuuuugagaaguauaucu

SEQ ID NO: 178738 - RNA, 22 nt, Human
auauuacuuccugguauaaaau

SEQ ID NO: 178739 - RNA, 22 nt, Human
aucuagaaguggcaugaauuac

SEQ ID NO: 178740 - RNA, 23 nt, Human
gaggagggucgugcuguguuccu

SEQ ID NO: 178741 - RNA, 22 nt, Human
uuuugcccuugcuagaucacug

SEQ ID NO: 178742 - RNA, 22 nt, Human
agaguacugccucaguuaugaa

SEQ ID NO: 178743 - RNA, 20 nt, Human
uacauuguagaaauauucaa

SEQ ID NO: 178744 - RNA, 22 nt, Human
guuccuuccuaucccgagagcc

SEQ ID NO: 178745 - RNA, 22 nt, Human
aauaccuuuucagugcacaaaa

SEQ ID NO: 178746 - RNA, 22 nt, Human
uuacaggggacauuggggacau

SEQ ID NO: 178747 - RNA, 22 nt, Human
cuucugaaguguuugaugauug

SEQ ID NO: 178748 - RNA, 22 nt, Human
cauuuguuuagaagucuuuaua

SEQ ID NO: 178749 - RNA, 22 nt, Human
ucuucccacugcccaugggcag

SEQ ID NO: 178750 - RNA, 22 nt, Human
cagcuggcgccuggggaccaga

SEQ ID NO: 178751 - RNA, 22 nt, Human
uggggcucuccacagugucuca

SEQ ID NO: 178752 - RNA, 22 nt, Human
ugucucagaggcaggaagagcc

SEQ ID NO: 178753 - RNA, 22 nt, Human
acaaguuaccaaaaaagauuca

SEQ ID NO: 178754 - RNA, 22 nt, Human
uucaggauuauacucucuuccc

SEQ ID NO: 178755 - RNA, 22 nt, Human
aaaugacagaguaagcuguuua

SEQ ID NO: 178756 - RNA, 22 nt, Human
uucuggaaggguggaguagcuu

SEQ ID NO: 178757 - RNA, 22 nt, Human
gcaucuaaauaaacgugggagu

SEQ ID NO: 178758 - RNA, 22 nt, Human
ucauuacacaguucaguggaaa

SEQ ID NO: 178759 - RNA, 20 nt, Human
ugggcacagcuuuggagggc

SEQ ID NO: 178760 - RNA, 18 nt, Human
ucucugaauauuuuaugu

SEQ ID NO: 178761 - RNA, 22 nt, Human
aacaaggcugguaucuuaaaga

SEQ ID NO: 178762 - RNA, 22 nt, Human
uaaugcuuuuccuucaaauaag

SEQ ID NO: 178763 - RNA, 22 nt, Human
ugccuuagaggauagugaagcc

SEQ ID NO: 178764 - RNA, 22 nt, Human
uucuccagacccuccugcagac

SEQ ID NO: 178765 - RNA, 22 nt, Human
cagggagcuggcuggcugugcc

SEQ ID NO: 178766 - RNA, 22 nt, Human
cauuuaauagaugcuguuucag

SEQ ID NO: 178767 - RNA, 22 nt, Human
cugagcccuugaacccaagucc

SEQ ID NO: 178768 - RNA, 22 nt, Human
gccuggagugguccugcugccc

SEQ ID NO: 178769 - RNA, 22 nt, Human
ucugagguguagcugggcuuca

SEQ ID NO: 178770 - RNA, 22 nt, Human
ggaauguugucauuuacauuau

SEQ ID NO: 178771 - RNA, 22 nt, Human
gggcagugguccaggcuacagc

SEQ ID NO: 178772 - RNA, 18 nt, Human
gcaggccuagaacuuggu

SEQ ID NO: 178773 - RNA, 22 nt, Human
aaagcacagagcucccacagga

SEQ ID NO: 178774 - RNA, 17 nt, Human
acaggcagaucaccuga

SEQ ID NO: 178775 - RNA, 22 nt, Human
aagcacagacucccucugagug

SEQ ID NO: 178776 - RNA, 23 nt, Human
acuuuagauaaauuaugugcaca

SEQ ID NO: 178777 - RNA, 22 nt, Human
auguaaacaagguuauugucca

SEQ ID NO: 178778 - RNA, 20 nt, Human
agacagaaucagagauaaag

SEQ ID NO: 178779 - RNA, 22 nt, Human
ucuggccugaaaguccaugcuu

SEQ ID NO: 178780 - RNA, 22 nt, Human
guccugggcggagggcugcugu

SEQ ID NO: 178781 - RNA, 22 nt, Human
agcuuuauauaaaagaguacau

SEQ ID NO: 178782 - RNA, 22 nt, Human
ccagcucucaaggcucccuggg

SEQ ID NO: 178783 - RNA, 19 nt, Human
cacgaguucucuuagcaaa

SEQ ID NO: 178784 - RNA, 22 nt, Human
caauucaugggcugaggaaggg

SEQ ID NO: 178785 - RNA, 22 nt, Human
uccuucaaagcuccuagugagc

SEQ ID NO: 178786 - RNA, 22 nt, Human
aaacaguuuuuuaagucucuag

SEQ ID NO: 178787 - RNA, 22 nt, Human
ugaagaggccgugugcagguga

SEQ ID NO: 178788 - RNA, 22 nt, Human
gcucucugccauaugaggauac

SEQ ID NO: 178789 - RNA, 19 nt, Human
uuuacagggaauggagacc

SEQ ID NO: 178790 - RNA, 17 nt, Human
ggucuggggccauuggc

SEQ ID NO: 178791 - RNA, 22 nt, Human
gugaggugguacaauauuaacu

SEQ ID NO: 178792 - RNA, 22 nt, Human
agucaccaacaugguucccagg

SEQ ID NO: 178793 - RNA, 22 nt, Human
gccucagguaaaacuugaguuu

SEQ ID NO: 178794 - RNA, 22 nt, Human
cuuccagucuagagcuaucugu

SEQ ID NO: 178795 - RNA, 22 nt, Human
acuugguugcuucugaaaugac

SEQ ID NO: 178796 - RNA, 22 nt, Human
uggugcagaugcaggucacugg

SEQ ID NO: 178797 - RNA, 22 nt, Human
ugaggcaggaguucaggcugcg

SEQ ID NO: 178798 - RNA, 22 nt, Human
acuaaagaagccaaaguuuucu

SEQ ID NO: 178799 - RNA, 22 nt, Human
acaaagugcacaagaugagaac

SEQ ID NO: 178800 - RNA, 22 nt, Human
ugcacacauucuauggggcuga

SEQ ID NO: 178801 - RNA, 22 nt, Human
ucagauagugauaauagcaugu

SEQ ID NO: 178802 - RNA, 22 nt, Human
aagugcauaauaacucccaagu

SEQ ID NO: 178803 - RNA, 22 nt, Human
gcaaggaccuuugagcgugcca

SEQ ID NO: 178804 - RNA, 22 nt, Human
ugccugucuucaggagugucac

SEQ ID NO: 178805 - RNA, 22 nt, Human
auugcaaaugagucuuaauaua

SEQ ID NO: 178806 - RNA, 22 nt, Human
cgucuuccucuuacgaugcgcu

SEQ ID NO: 178807 - RNA, 20 nt, Human
aaacauucauguacaaguga

SEQ ID NO: 178808 - RNA, 22 nt, Human
aaacaucuuucuauugcaaguu

SEQ ID NO: 178809 - RNA, 22 nt, Human
guggcccagcccuacagaggac

SEQ ID NO: 178810 - RNA, 22 nt, Human
ucaccagggagcuuguccucug

SEQ ID NO: 178811 - RNA, 22 nt, Human
ggcucuggagauguccgaccug

SEQ ID NO: 178812 - RNA, 22 nt, Human
uagacucagacagaaaaugugu

SEQ ID NO: 178813 - RNA, 22 nt, Human
ucuuagaaauuccccaguggcu

SEQ ID NO: 178814 - RNA, 22 nt, Human
ugagcagaacacgggauccaug

SEQ ID NO: 178815 - RNA, 22 nt, Human
cagcacuuugagggcucuuaau

SEQ ID NO: 178816 - RNA, 22 nt, Human
ggagcugagcagcgauggcgga

SEQ ID NO: 178817 - RNA, 22 nt, Human
gcacuggaaauaccuagaugaa

SEQ ID NO: 178818 - RNA, 17 nt, Human
cccagcuggcagugccg

SEQ ID NO: 178819 - RNA, 22 nt, Human
ucagaguuggccuuucuguauu

SEQ ID NO: 178820 - RNA, 22 nt, Human
gaccagaaaucaacacagaaug

SEQ ID NO: 178821 - RNA, 22 nt, Human
agcagagcgccugcucagaggg

SEQ ID NO: 178822 - RNA, 22 nt, Human
ccuagaauuauaaacuuauuag

SEQ ID NO: 178823 - RNA, 22 nt, Human
cuggcaugguguauuuguucaa

SEQ ID NO: 178824 - RNA, 22 nt, Human
gccuggcaggccucaugagggg

SEQ ID NO: 178825 - RNA, 22 nt, Human
uacuucugcaccaaccuuaaua

SEQ ID NO: 178826 - RNA, 22 nt, Human
aacacagcuaauuucugucaau

SEQ ID NO: 178827 - RNA, 22 nt, Human
cuggguccugcucucccuaaga

SEQ ID NO: 178828 - RNA, 22 nt, Human
uggguaggccaggaagcagugu

SEQ ID NO: 178829 - RNA, 22 nt, Human
uccugggagcauggugccguga

SEQ ID NO: 178830 - RNA, 20 nt, Human
aggcuugugcuuugucacuc

SEQ ID NO: 178831 - RNA, 22 nt, Human
uuggcagaauuaaccacugaag

SEQ ID NO: 178832 - RNA, 22 nt, Human
acacauauucauauguacuuac

SEQ ID NO: 178833 - RNA, 22 nt, Human
acagagagguaaaauauauagu

SEQ ID NO: 178834 - RNA, 22 nt, Human
ucacaugaguauuauuuuccaa

SEQ ID NO: 178835 - RNA, 22 nt, Human
aaaaguuauugaugcaggacaa

SEQ ID NO: 178836 - RNA, 22 nt, Human
uuuggcucuaguaaauauaacc

SEQ ID NO: 178837 - RNA, 22 nt, Human
gcagacacauccacuccuacag

SEQ ID NO: 178838 - RNA, 22 nt, Human
ggccccaguucacuccuggccg

SEQ ID NO: 178839 - RNA, 23 nt, Human
cccagggacacgaugacaccucc

SEQ ID NO: 178840 - RNA, 22 nt, Human
cacagcugaccacccugcuccc

SEQ ID NO: 178841 - RNA, 22 nt, Human
gaacaggguugggugagagagg

SEQ ID NO: 178842 - RNA, 22 nt, Human
guuacaaauguaaauucugggg

SEQ ID NO: 178843 - RNA, 22 nt, Human
cacuggggugggccugguagag

SEQ ID NO: 178844 - RNA, 22 nt, Human
ucaaaucccagcucagccucuc

SEQ ID NO: 178845 - RNA, 22 nt, Human
aagcuuggaagucuuccuuuca

SEQ ID NO: 178846 - RNA, 22 nt, Human
aaaugaucauguaauuucagaa

SEQ ID NO: 178847 - RNA, 22 nt, Human
gaauguuauuggacagcagugg

SEQ ID NO: 178848 - RNA, 22 nt, Human
gugcagggcagccgaaugggcu

SEQ ID NO: 178849 - RNA, 22 nt, Human
ugugcacaaugugcagguuugu

SEQ ID NO: 178850 - RNA, 22 nt, Human
ggucaaagggugagauggcagg

SEQ ID NO: 178851 - RNA, 22 nt, Human
uauugaauuagacccuaaaaug

SEQ ID NO: 178852 - RNA, 22 nt, Human
cuucacugaugggacagcucaa

SEQ ID NO: 178853 - RNA, 23 nt, Human
cuuucauugugguuucacagagc

SEQ ID NO: 178854 - RNA, 22 nt, Human
guccagugucuucuacauaaca

SEQ ID NO: 178855 - RNA, 22 nt, Human
cuuuggaaagugguucagguga

SEQ ID NO: 178856 - RNA, 22 nt, Human
ucaggccaaagaaacagcauga

SEQ ID NO: 178857 - RNA, 22 nt, Human
aaguacagaaauagcaggugca

SEQ ID NO: 178858 - RNA, 22 nt, Human
uaggcucagggcugggugacgg

SEQ ID NO: 178859 - RNA, 22 nt, Human
gagugcuggggugcagagaggu

SEQ ID NO: 178860 - RNA, 17 nt, Human
acacaucuuggcuuugc

SEQ ID NO: 178861 - RNA, 22 nt, Human
caggcauggaaaagcccagagg

SEQ ID NO: 178862 - RNA, 22 nt, Human
ugcuauuuuuaucuugaucaaa

SEQ ID NO: 178863 - RNA, 22 nt, Human
agcagagcaaagcucagaaaug

SEQ ID NO: 178864 - RNA, 22 nt, Human
ucaauagcauagcaauuaaugu

SEQ ID NO: 178865 - RNA, 22 nt, Human
ccaaggagcaaggcucaacaag

SEQ ID NO: 178866 - RNA, 22 nt, Human
agcaguuugaaucaauggccag

SEQ ID NO: 178867 - RNA, 22 nt, Human
ccagaggugguggugucuagaa

SEQ ID NO: 178868 - RNA, 19 nt, Human
auggcagcagcagcucucc

SEQ ID NO: 178869 - RNA, 22 nt, Human
gaguccaggcucagaaacccgu

SEQ ID NO: 178870 - RNA, 22 nt, Human
ugaaauuccaggagaguuaaaa

SEQ ID NO: 178871 - RNA, 22 nt, Human
acuuuaaaacugaucaucagag

SEQ ID NO: 178872 - RNA, 22 nt, Human
aaauauugguaggaugcuuguu

SEQ ID NO: 178873 - RNA, 22 nt, Human
ucaggggcuugaggugcauguc

SEQ ID NO: 178874 - RNA, 22 nt, Human
ccacccugagccgcaagagcag

SEQ ID NO: 178875 - RNA, 22 nt, Human
auuuccaagaaagcuuuaggau

SEQ ID NO: 178876 - RNA, 22 nt, Human
gccacagcagggcccucucagg

SEQ ID NO: 178877 - RNA, 22 nt, Human
cucucuggcccauccuguugcc

SEQ ID NO: 178878 - RNA, 22 nt, Human
ugcaggaguuccccucugccug

SEQ ID NO: 178879 - RNA, 22 nt, Human
ggcuucucccauucuucagggg

SEQ ID NO: 178880 - RNA, 22 nt, Human
uacacaggcugccucuuugcau

SEQ ID NO: 178881 - RNA, 22 nt, Human
ccaggaccuggagcucuaugaa

SEQ ID NO: 178882 - RNA, 22 nt, Human
ccaggcuagagagcaguggcau

SEQ ID NO: 178883 - RNA, 22 nt, Human
ucucugagacaguagccucugc

SEQ ID NO: 178884 - RNA, 22 nt, Human
gcuggcagggacagcugcgugu

SEQ ID NO: 178885 - RNA, 22 nt, Human
cagcaucuguuuuucugaccca

SEQ ID NO: 178886 - RNA, 22 nt, Human
caccuggaguagcaagguaauu

SEQ ID NO: 178887 - RNA, 22 nt, Human
ucucagaguuuuuuuccaggac

SEQ ID NO: 178888 - RNA, 22 nt, Human
uuaucugucaucaggcagacag

SEQ ID NO: 178889 - RNA, 20 nt, Human
gaggaaccacugggaggaga

SEQ ID NO: 178890 - RNA, 19 nt, Human
gcuccuggaugaccugugg

SEQ ID NO: 178891 - RNA, 22 nt, Human
aacgucuucucuccaaguaaau

SEQ ID NO: 178892 - RNA, 22 nt, Human
gcauucuugguaugaaggacag

SEQ ID NO: 178893 - RNA, 17 nt, Human
aggcauggucuggggug

SEQ ID NO: 178894 - RNA, 22 nt, Human
agcuugguggcccuccuggcug

SEQ ID NO: 178895 - RNA, 22 nt, Human
aaauagauuuccuagcauugga

SEQ ID NO: 178896 - RNA, 22 nt, Human
ucuccccuguuggccagguuuu

SEQ ID NO: 178897 - RNA, 22 nt, Human
ucccagagcaguacuccaggag

SEQ ID NO: 178898 - RNA, 22 nt, Human
ucuagagacaaaggaaggaggg

SEQ ID NO: 178899 - RNA, 22 nt, Human
aucagagcccggcaauuuauuu

SEQ ID NO: 178900 - RNA, 22 nt, Human
aguggcugauuacaaacugagu

SEQ ID NO: 178901 - RNA, 20 nt, Human
ucuguaggcaaguuagcagg

SEQ ID NO: 178902 - RNA, 21 nt, Human
agaggaagugauuggucuggc

SEQ ID NO: 178903 - RNA, 22 nt, Human
gggguugaucacagaggggucu

SEQ ID NO: 178904 - RNA, 19 nt, Human
ucaggcaguuauucacaaa

SEQ ID NO: 178905 - RNA, 22 nt, Human
gucugcauacaggacaugcaca

SEQ ID NO: 178906 - RNA, 22 nt, Human
cuguuucuccacacucuuccca

SEQ ID NO: 178907 - RNA, 22 nt, Human
caugagaucugcagggaugggc

SEQ ID NO: 178908 - RNA, 22 nt, Human
gccuguguguuuagcucugggg

SEQ ID NO: 178909 - RNA, 19 nt, Human
cgugaacaugacugcaugg

SEQ ID NO: 178910 - RNA, 20 nt, Human
gcuugcccacaucugcacug

SEQ ID NO: 178911 - RNA, 22 nt, Human
ggccuuaggcucaacaggcaga

SEQ ID NO: 178912 - RNA, 22 nt, Human
uuauauuaguuagacuugcugu

SEQ ID NO: 178913 - RNA, 19 nt, Human
cugucccucccagguauga

SEQ ID NO: 178914 - RNA, 20 nt, Human
aucaggauucuugcuuuguu

SEQ ID NO: 178915 - RNA, 22 nt, Human
agggauggagcccagcuguucu

SEQ ID NO: 178916 - RNA, 22 nt, Human
uacacuuucguuuguggauuag

SEQ ID NO: 178917 - RNA, 22 nt, Human
ucagucucaucaacucuauucc

SEQ ID NO: 178918 - RNA, 22 nt, Human
agaagcugcguuuauuuaaauc

SEQ ID NO: 178919 - RNA, 22 nt, Human
cagaguggcacucugcuggaug

SEQ ID NO: 178920 - RNA, 22 nt, Human
ucuccacacuuucucucccagg

SEQ ID NO: 178921 - RNA, 22 nt, Human
gaaaguauuuacauuaacaucu

SEQ ID NO: 178922 - RNA, 19 nt, Human
aggaggccaugccacuaga

SEQ ID NO: 178923 - RNA, 22 nt, Human
cagauaaauagacuuggucaga

SEQ ID NO: 178924 - RNA, 22 nt, Human
ucaggagcagcuguaggaaggg

SEQ ID NO: 178925 - RNA, 22 nt, Human
guccugugcaccgugggauguu

SEQ ID NO: 178926 - RNA, 22 nt, Human
uguaauuuccugauguuagaac

SEQ ID NO: 178927 - RNA, 22 nt, Human
cuugguuauacuccaggaacca

SEQ ID NO: 178928 - RNA, 22 nt, Human
agcugcaaguguugccuccuac

SEQ ID NO: 178929 - RNA, 22 nt, Human
agggaccagggguagcugagau

SEQ ID NO: 178930 - RNA, 22 nt, Human
cuggauguaaagggugaagaaa

SEQ ID NO: 178931 - RNA, 22 nt, Human
cuggcuggaggugagucacuga

SEQ ID NO: 178932 - RNA, 22 nt, Human
gacaugcaguucucaaggguag

SEQ ID NO: 178933 - RNA, 22 nt, Human
uguccccagagccuguuccugc

SEQ ID NO: 178934 - RNA, 22 nt, Human
aaucaggaugacugucauuuca

SEQ ID NO: 178935 - RNA, 22 nt, Human
aaaaugucugcuguugguuuau

SEQ ID NO: 178936 - RNA, 23 nt, Human
ggccucuguguucugcccacaug

SEQ ID NO: 178937 - RNA, 22 nt, Human
aggccugccuggagccuggcug

SEQ ID NO: 178938 - RNA, 22 nt, Human
aagcucaggcuggaccuggcuu

SEQ ID NO: 178939 - RNA, 22 nt, Human
cuucuuucccaggcauguuuua

SEQ ID NO: 178940 - RNA, 22 nt, Human
uucauagaucucaauuuugagg

SEQ ID NO: 178941 - RNA, 22 nt, Human
auucagugccaaggagaacuug

SEQ ID NO: 178942 - RNA, 21 nt, Human
agacacugguuuagcauucau

SEQ ID NO: 178943 - RNA, 22 nt, Human
cucagagaaaaggagcaagggu

SEQ ID NO: 178944 - RNA, 22 nt, Human
ugaggcaggaaguuauauaaug

SEQ ID NO: 178945 - RNA, 22 nt, Human
uucaguuuucccuccugcaggu

SEQ ID NO: 178946 - RNA, 22 nt, Human
cccugcagccggccagcucauu

SEQ ID NO: 178947 - RNA, 22 nt, Human
ccaggugugauuuggcaguguc

SEQ ID NO: 178948 - RNA, 22 nt, Human
agucuuauguuugugaagaacu

SEQ ID NO: 178949 - RNA, 22 nt, Human
accugucugcaugaucuaaaac

SEQ ID NO: 178950 - RNA, 22 nt, Human
ugaauaugugacuuugauuuca

SEQ ID NO: 178951 - RNA, 22 nt, Human
uagucaaaccucagaauacccc

SEQ ID NO: 178952 - RNA, 22 nt, Human
aggucagaaaaggagagcauug

SEQ ID NO: 178953 - RNA, 22 nt, Human
caggagccagaggcggauggag

SEQ ID NO: 178954 - RNA, 22 nt, Human
gaggacuaacuuggcagacgca

SEQ ID NO: 178955 - RNA, 22 nt, Human
ggcacgugccuaaggagcaggc

SEQ ID NO: 178956 - RNA, 22 nt, Human
uugcauuugcucauuugauaug

SEQ ID NO: 178957 - RNA, 22 nt, Human
auccuggguaaguuccuuuuaa

SEQ ID NO: 178958 - RNA, 22 nt, Human
gcuuuagaaauaucacugugga

SEQ ID NO: 178959 - RNA, 22 nt, Human
aacugguagcugauuaaguaua

SEQ ID NO: 178960 - RNA, 22 nt, Human
uccugaggcucacuuugaaugu

SEQ ID NO: 178961 - RNA, 22 nt, Human
ugccuguguggggucugccgcc

SEQ ID NO: 178962 - RNA, 22 nt, Human
cagcugcaugucuguggugguc

SEQ ID NO: 178963 - RNA, 22 nt, Human
ccucuggggugagugggccacu

SEQ ID NO: 178964 - RNA, 22 nt, Human
cuaaacaugcaagagcuucugg

SEQ ID NO: 178965 - RNA, 22 nt, Human
gacaauuagaucauuccuuuga

SEQ ID NO: 178966 - RNA, 22 nt, Human
cuggaggaccacagaagcuggu

SEQ ID NO: 178967 - RNA, 22 nt, Human
auacauacauguaugcacauac

SEQ ID NO: 178968 - RNA, 22 nt, Human
auaauaacaaugccagaugccu

SEQ ID NO: 178969 - RNA, 22 nt, Human
gaaggagagggucaaggauaau

SEQ ID NO: 178970 - RNA, 22 nt, Human
cagucccaaggaggaagcaguc

SEQ ID NO: 178971 - RNA, 22 nt, Human
ggagcugugcagugacuacaga

SEQ ID NO: 178972 - RNA, 22 nt, Human
aagaguuuaccagugcugcuuc

SEQ ID NO: 178973 - RNA, 22 nt, Human
aaaguacuaaugaauauuuugc

SEQ ID NO: 178974 - RNA, 22 nt, Human
cuuggacuggacccgaggaaug

SEQ ID NO: 178975 - RNA, 22 nt, Human
aagggggccacaccugguguga

SEQ ID NO: 178976 - RNA, 22 nt, Human
uggagcuggaagacagugauau

SEQ ID NO: 178977 - RNA, 22 nt, Human
ucuuuuccuucccuacagaucu

SEQ ID NO: 178978 - RNA, 22 nt, Human
uguaaagcaucucugucauaua

SEQ ID NO: 178979 - RNA, 22 nt, Human
gcucagcugcaccuggagagcc

SEQ ID NO: 178980 - RNA, 22 nt, Human
agggccugggucuguacuccuc

SEQ ID NO: 178981 - RNA, 19 nt, Human
aauaauguucaugagauug

SEQ ID NO: 178982 - RNA, 22 nt, Human
gcagcaggauggccaauugcca

SEQ ID NO: 178983 - RNA, 22 nt, Human
agaaucaacugaaaauugguga

SEQ ID NO: 178984 - RNA, 22 nt, Human
cuucagagcuuguuaaaacugu

SEQ ID NO: 178985 - RNA, 22 nt, Human
ccaggagcaaagaucacuggga

SEQ ID NO: 178986 - RNA, 22 nt, Human
acagucuugagcaucagccaga

SEQ ID NO: 178987 - RNA, 22 nt, Human
gccuggcugucuggcaagguuc

SEQ ID NO: 178988 - RNA, 22 nt, Human
gaaaacuauuggccuagaacaa

SEQ ID NO: 178989 - RNA, 22 nt, Human
caaaguccuagaacagugcuug

SEQ ID NO: 178990 - RNA, 22 nt, Human
gauuuacagcuauacccaaugg

SEQ ID NO: 178991 - RNA, 22 nt, Human
ugugaagguaagguuugcuuga

SEQ ID NO: 178992 - RNA, 22 nt, Human
cugugagacugauagggaagag

SEQ ID NO: 178993 - RNA, 22 nt, Human
uuaugaacaauuucuaggaaug

SEQ ID NO: 178994 - RNA, 22 nt, Human
gccuccugaagugcugggauua

SEQ ID NO: 178995 - RNA, 22 nt, Human
uucccaguuagucauuuuuaca

SEQ ID NO: 178996 - RNA, 23 nt, Human
ucucucuggcaaauuucacauau

SEQ ID NO: 178997 - RNA, 22 nt, Human
aaagacuaagaagaguauuauu

SEQ ID NO: 178998 - RNA, 22 nt, Human
gggcagcagaauuggacagaaa

SEQ ID NO: 178999 - RNA, 22 nt, Human
cauucugagcuaauaugcuuau

SEQ ID NO: 179000 - RNA, 22 nt, Human
gagcuuggcagugucacuaggg

SEQ ID NO: 179001 - RNA, 22 nt, Human
cccgagugucuacucacuccca

SEQ ID NO: 179002 - RNA, 23 nt, Human
ugggagcucaagggaggcugccc

SEQ ID NO: 179003 - RNA, 22 nt, Human
cagugccacuuaaugaggcugc

SEQ ID NO: 179004 - RNA, 22 nt, Human
aaggcauaggacaaaucaguga

SEQ ID NO: 179005 - RNA, 22 nt, Human
augcccugcucucgggaaggga

SEQ ID NO: 179006 - RNA, 22 nt, Human
agccggccauguggucuugugc

SEQ ID NO: 179007 - RNA, 22 nt, Human
uagcaagagugggcuuuguggg

SEQ ID NO: 179008 - RNA, 22 nt, Human
ugcagucucuaguuucugaaug

SEQ ID NO: 179009 - RNA, 22 nt, Human
cuccuggcucugccacuuacua

SEQ ID NO: 179010 - RNA, 22 nt, Human
agaggcaccaucuggaacagcc

SEQ ID NO: 179011 - RNA, 22 nt, Human
auuccaaagccugaauaaugga

SEQ ID NO: 179012 - RNA, 23 nt, Human
aggcaggcaguucagcuguuguu

SEQ ID NO: 179013 - RNA, 22 nt, Human
uuuaacacuaguuucuuuaacu

SEQ ID NO: 179014 - RNA, 17 nt, Human
ugaaagaaucagggaga

SEQ ID NO: 179015 - RNA, 22 nt, Human
uugaccuuggcuuuuaaaauau

SEQ ID NO: 179016 - RNA, 22 nt, Human
ugagccaggcccagugggguca

SEQ ID NO: 179017 - RNA, 19 nt, Human
acagugucuguauauaaau

SEQ ID NO: 179018 - RNA, 22 nt, Human
cugguuuagugaaauaggccag

SEQ ID NO: 179019 - RNA, 22 nt, Human
gagucagauugcagacagggcu

SEQ ID NO: 179020 - RNA, 22 nt, Human
cuguggaaagagccuuuggagg

SEQ ID NO: 179021 - RNA, 22 nt, Human
uccuccugcuguuagucuugaa

SEQ ID NO: 179022 - RNA, 22 nt, Human
uauaauauuccuuguuguaggu

SEQ ID NO: 179023 - RNA, 22 nt, Human
ccuggcagacagcacugaagcu

SEQ ID NO: 179024 - RNA, 22 nt, Human
uuuaucuucugcaguucuggcu

SEQ ID NO: 179025 - RNA, 22 nt, Human
agcuuaaacucuuugaaguuau

SEQ ID NO: 179026 - RNA, 22 nt, Human
aacauuugcaugcuuuauuaga

SEQ ID NO: 179027 - RNA, 22 nt, Human
uuuucauuagaaugacugagaa

SEQ ID NO: 179028 - RNA, 22 nt, Human
aagccuuggggcuccucuguau

SEQ ID NO: 179029 - RNA, 22 nt, Human
aggccaggccuuucuccauucc

SEQ ID NO: 179030 - RNA, 20 nt, Human
gaagacacagaguucaucuc

SEQ ID NO: 179031 - RNA, 22 nt, Human
gagguguccuagaaguauucag

SEQ ID NO: 179032 - RNA, 22 nt, Human
gaaugaagcaggucacacaguu

SEQ ID NO: 179033 - RNA, 22 nt, Human
auggcagccugaacacuuccug

SEQ ID NO: 179034 - RNA, 22 nt, Human
ugguauuacuucuagacacaag

SEQ ID NO: 179035 - RNA, 22 nt, Human
uagcaaagaagauauuauugca

SEQ ID NO: 179036 - RNA, 22 nt, Human
aacagcagggaaauuccaaguc

SEQ ID NO: 179037 - RNA, 22 nt, Human
ggcaacucuucuugcaaugggg

SEQ ID NO: 179038 - RNA, 22 nt, Human
ugcaauaaggaguaauaguaaa

SEQ ID NO: 179039 - RNA, 22 nt, Human
aguuagaauggauguugagagc

SEQ ID NO: 179040 - RNA, 22 nt, Human
caggacagagcccagacugugu

SEQ ID NO: 179041 - RNA, 22 nt, Human
agugugagaugauugaggagca

SEQ ID NO: 179042 - RNA, 22 nt, Human
uccugaccucuugcucugaccu

SEQ ID NO: 179043 - RNA, 22 nt, Human
gucuacacugaauuuccacaga

SEQ ID NO: 179044 - RNA, 22 nt, Human
guucuauucauugcuccacgag

SEQ ID NO: 179045 - RNA, 22 nt, Human
aagacaggaacauagcaaaucc

SEQ ID NO: 179046 - RNA, 22 nt, Human
ucuccagguaaauggcauccug

SEQ ID NO: 179047 - RNA, 23 nt, Human
ggccacugaauuuucugcaucuu

SEQ ID NO: 179048 - RNA, 22 nt, Human
uguggcugcaggcgauggagga

SEQ ID NO: 179049 - RNA, 22 nt, Human
gaacauaauuaaauguccuggg

SEQ ID NO: 179050 - RNA, 22 nt, Human
uggcuccuuccgcagcaugccu

SEQ ID NO: 179051 - RNA, 22 nt, Human
auuguaaauagugccacaauaa

SEQ ID NO: 179052 - RNA, 22 nt, Human
aaugggcucacaagaccugaau

SEQ ID NO: 179053 - RNA, 22 nt, Human
accugcacagccccagaaugcc

SEQ ID NO: 179054 - RNA, 22 nt, Human
gcuggccaggaagagucucaga

SEQ ID NO: 179055 - RNA, 22 nt, Human
aaagcaggcagcaggcuggauu

SEQ ID NO: 179056 - RNA, 22 nt, Human
aagcaccugcaguugacaaaaa

SEQ ID NO: 179057 - RNA, 22 nt, Human
acaggacucucugaaaauguac

SEQ ID NO: 179058 - RNA, 22 nt, Human
cacacaugguagcagguacaag

SEQ ID NO: 179059 - RNA, 22 nt, Human
agggcucccgugaggugacugc

SEQ ID NO: 179060 - RNA, 22 nt, Human
uucuaauuaaaucuacgcuagg

SEQ ID NO: 179061 - RNA, 22 nt, Human
uaccuucaccagcgaauguuug

SEQ ID NO: 179062 - RNA, 22 nt, Human
aagaguuucuuacuggcaucua

SEQ ID NO: 179063 - RNA, 22 nt, Human
agagcagaggcauggccguggg

SEQ ID NO: 179064 - RNA, 18 nt, Human
uucuggcucacucaugcu

SEQ ID NO: 179065 - RNA, 22 nt, Human
ggaaaucaagaagcagaugagu

SEQ ID NO: 179066 - RNA, 21 nt, Human
uagaucaugguauucuuuggc

SEQ ID NO: 179067 - RNA, 19 nt, Human
ugaggccaaggucacagau

SEQ ID NO: 179068 - RNA, 22 nt, Human
uuccaaguccagccaggccaaa

SEQ ID NO: 179069 - RNA, 22 nt, Human
caaaucugagucuacaauuuua

SEQ ID NO: 179070 - RNA, 22 nt, Human
caugaaggaauuaagguaagga

SEQ ID NO: 179071 - RNA, 22 nt, Human
gcuguaggaaugacauguaccu

SEQ ID NO: 179072 - RNA, 22 nt, Human
ugagccaaggccucaagaauuu

SEQ ID NO: 179073 - RNA, 22 nt, Human
cagguggucaggcagaugggcu

SEQ ID NO: 179074 - RNA, 23 nt, Human
ccagugauugccuggaaggaggu

SEQ ID NO: 179075 - RNA, 19 nt, Human
caagugaagccugggaugg

SEQ ID NO: 179076 - RNA, 22 nt, Human
accugggaaaaggaguggccau

SEQ ID NO: 179077 - RNA, 22 nt, Human
aguggcugagugacugugacuc

SEQ ID NO: 179078 - RNA, 20 nt, Human
cagucccaauccagggccag

SEQ ID NO: 179079 - RNA, 22 nt, Human
uguuuauaccuugguauaacca

SEQ ID NO: 179080 - RNA, 22 nt, Human
ggacugggaaucagggagaugc

SEQ ID NO: 179081 - RNA, 22 nt, Human
cagcccugggucccugcccugg

SEQ ID NO: 179082 - RNA, 22 nt, Human
gcugggcacugucccauaggcu

SEQ ID NO: 179083 - RNA, 22 nt, Human
aaacugaauucccaagggcaug

SEQ ID NO: 179084 - RNA, 22 nt, Human
agugcagccgagaucaggugcu

SEQ ID NO: 179085 - RNA, 22 nt, Human
uuaaaaccuagagaucagacag

SEQ ID NO: 179086 - RNA, 22 nt, Human
aaaguauucaaaaauauuuggu

SEQ ID NO: 179087 - RNA, 22 nt, Human
ugaaaugaaugugauucgauag

SEQ ID NO: 179088 - RNA, 22 nt, Human
cugccaggcagcagagggagaa

SEQ ID NO: 179089 - RNA, 21 nt, Human
ucucugagaggucugcuuaga

SEQ ID NO: 179090 - RNA, 22 nt, Human
cacugguagcaguuaaguuagg

SEQ ID NO: 179091 - RNA, 22 nt, Human
uaggaagaugaguaucaacuug

SEQ ID NO: 179092 - RNA, 22 nt, Human
uuccugugauauuagccacugu

SEQ ID NO: 179093 - RNA, 21 nt, Human
agugucauuugaucauuguua

SEQ ID NO: 179094 - RNA, 22 nt, Human
ugagcuucaaaauaugugaauc

SEQ ID NO: 179095 - RNA, 22 nt, Human
cuccuucugaggcucuggguuc

SEQ ID NO: 179096 - RNA, 22 nt, Human
caggaacagcaccaggagcuag

SEQ ID NO: 179097 - RNA, 22 nt, Human
ugacaaagugaggucuucagua

SEQ ID NO: 179098 - RNA, 22 nt, Human
aggcccugggagcagagaugca

SEQ ID NO: 179099 - RNA, 22 nt, Human
gugggggacccaggugcugucc

SEQ ID NO: 179100 - RNA, 17 nt, Human
gcuucuggagcuucugu

SEQ ID NO: 179101 - RNA, 22 nt, Human
caggcugcagcagcaguggccc

SEQ ID NO: 179102 - RNA, 22 nt, Human
ucccagagacagagccuccucc

SEQ ID NO: 179103 - RNA, 23 nt, Human
uccagggcaguggcugggucugc

SEQ ID NO: 179104 - RNA, 22 nt, Human
ccucagggaaugggaggcuggg

SEQ ID NO: 179105 - RNA, 22 nt, Human
gccagaagacuggagucagcug

SEQ ID NO: 179106 - RNA, 22 nt, Human
aguugacucucaagauccuguu

SEQ ID NO: 179107 - RNA, 22 nt, Human
agcuggagaauguggaugaucc

SEQ ID NO: 179108 - RNA, 22 nt, Human
aaacaguuuucucauuuagugu

SEQ ID NO: 179109 - RNA, 22 nt, Human
cucugggcaaagaugccucauc

SEQ ID NO: 179110 - RNA, 22 nt, Human
ugccaucuucucuggggauguu

SEQ ID NO: 179111 - RNA, 22 nt, Human
cucaagacugaucgcaguggaa

SEQ ID NO: 179112 - RNA, 22 nt, Human
ugagcccuaauuuacaacaucu

SEQ ID NO: 179113 - RNA, 22 nt, Human
gugcugggauuacaggugugag

SEQ ID NO: 179114 - RNA, 22 nt, Human
acaugcucuccaaggacagagc

SEQ ID NO: 179115 - RNA, 22 nt, Human
ggcugccuacuuucccagaguu

SEQ ID NO: 179116 - RNA, 22 nt, Human
agagcagagggcucugggacaa

SEQ ID NO: 179117 - RNA, 22 nt, Human
ggagagagaccuccaugcccag

SEQ ID NO: 179118 - RNA, 22 nt, Human
uacccagcuucaagucaggacu

SEQ ID NO: 179119 - RNA, 22 nt, Human
caggaaacauaugugcuugagg

SEQ ID NO: 179120 - RNA, 22 nt, Human
uucccucuuucacugugauuuu

SEQ ID NO: 179121 - RNA, 23 nt, Human
ccuggcacacaaggggugcugca

SEQ ID NO: 179122 - RNA, 19 nt, Human
uccagccccucugugugug

SEQ ID NO: 179123 - RNA, 22 nt, Human
aagcuguuguucauccugaauu

SEQ ID NO: 179124 - RNA, 22 nt, Human
uuccuccuucccauuccugggg

SEQ ID NO: 179125 - RNA, 22 nt, Human
uuccagcagcgugggagaagua

SEQ ID NO: 179126 - RNA, 22 nt, Human
auaugaauuuggcuggaaaggu

SEQ ID NO: 179127 - RNA, 22 nt, Human
ccugccugcaaaaugggacaag

SEQ ID NO: 179128 - RNA, 22 nt, Human
uaggaaauugacaccugcuuga

SEQ ID NO: 179129 - RNA, 23 nt, Human
cucagagguguuuuucacuuacu

SEQ ID NO: 179130 - RNA, 18 nt, Human
gcagugaagaaagagcuu

SEQ ID NO: 179131 - RNA, 22 nt, Human
agcugcccuuuaugaugcugaa

SEQ ID NO: 179132 - RNA, 19 nt, Human
acacaccagugccugugac

SEQ ID NO: 179133 - RNA, 22 nt, Human
acugagagcguguacaaacuua

SEQ ID NO: 179134 - RNA, 22 nt, Human
gaaacuagauguauuagagauu

SEQ ID NO: 179135 - RNA, 22 nt, Human
uggcaggugcacuuuugguuuc

SEQ ID NO: 179136 - RNA, 19 nt, Human
gguuauuugaggguuaaga

SEQ ID NO: 179137 - RNA, 22 nt, Human
agcuaggagauuuugugaggcu

SEQ ID NO: 179138 - RNA, 22 nt, Human
auauugagaugaggauauuaac

SEQ ID NO: 179139 - RNA, 22 nt, Human
gcugggcucagaccuagugaac

SEQ ID NO: 179140 - RNA, 18 nt, Human
cggcagagugcuucuagc

SEQ ID NO: 179141 - RNA, 22 nt, Human
guggcaggagagacacagccau

SEQ ID NO: 179142 - RNA, 22 nt, Human
ucucaaauuuguuagauaaaau

SEQ ID NO: 179143 - RNA, 22 nt, Human
gagggccaacuagcaccacuuu

SEQ ID NO: 179144 - RNA, 22 nt, Human
gcucugaggcugggagcacucu

SEQ ID NO: 179145 - RNA, 22 nt, Human
acaauucugaugguuucccagu

SEQ ID NO: 179146 - RNA, 22 nt, Human
uggcuuccuaggagcccgugcu

SEQ ID NO: 179147 - RNA, 22 nt, Human
aucugccugagucuagguuuuc

SEQ ID NO: 179148 - RNA, 22 nt, Human
ugagggucuggaaucugggcuu

SEQ ID NO: 179149 - RNA, 22 nt, Human
agggucagagucaggugcagua

SEQ ID NO: 179150 - RNA, 22 nt, Human
uuucuaguaaaagcuaauuacc

SEQ ID NO: 179151 - RNA, 22 nt, Human
ugagcccuugacaucgcccacu

SEQ ID NO: 179152 - RNA, 21 nt, Human
gagaggccugggcccgugagc

SEQ ID NO: 179153 - RNA, 22 nt, Human
augaggcaaucaugguccaguu

SEQ ID NO: 179154 - RNA, 22 nt, Human
ggaacugaaugucucgguauaa

SEQ ID NO: 179155 - RNA, 22 nt, Human
aaccaaguuuauuccaaguuac

SEQ ID NO: 179156 - RNA, 22 nt, Human
agcaggccacugcagcuggagc

SEQ ID NO: 179157 - RNA, 22 nt, Human
ucagucuuucgaauucagccag

SEQ ID NO: 179158 - RNA, 19 nt, Human
ucucaauucuccccacugc

SEQ ID NO: 179159 - RNA, 22 nt, Human
ccuccucugggaagauucagag

SEQ ID NO: 179160 - RNA, 22 nt, Human
ugagcuuuguggguaaagagag

SEQ ID NO: 179161 - RNA, 22 nt, Human
aucagagugggucuggcaugag

SEQ ID NO: 179162 - RNA, 22 nt, Human
uacagugcgauuuuuaggccuc

SEQ ID NO: 179163 - RNA, 22 nt, Human
agcccagcagaaaguccagccu

SEQ ID NO: 179164 - RNA, 22 nt, Human
agcugcaauucuggacauaguc

SEQ ID NO: 179165 - RNA, 22 nt, Human
ucccugggacucagacauggaa

SEQ ID NO: 179166 - RNA, 22 nt, Human
auguauuugaaauuugagacau

SEQ ID NO: 179167 - RNA, 23 nt, Human
uaucuuuuucaauguuggaaaua

SEQ ID NO: 179168 - RNA, 22 nt, Human
aaaguucagugccuucuauaca

SEQ ID NO: 179169 - RNA, 22 nt, Human
agaaaucaugucuuauuucuau

SEQ ID NO: 179170 - RNA, 22 nt, Human
cagugcagacguggagggggca

SEQ ID NO: 179171 - RNA, 22 nt, Human
ucagucaggagaugccagagau

SEQ ID NO: 179172 - RNA, 22 nt, Human
uaugcaaaguccuaagaaagaa

SEQ ID NO: 179173 - RNA, 22 nt, Human
auuugcuggugaauguauagcu

SEQ ID NO: 179174 - RNA, 22 nt, Human
aggaggccuacgcacaugucua

SEQ ID NO: 179175 - RNA, 22 nt, Human
uuguuacacauaauaacauuuu

SEQ ID NO: 179176 - RNA, 22 nt, Human
uugugcaaggcucuuggaaugu

SEQ ID NO: 179177 - RNA, 22 nt, Human
cugagacacaguggcugaaaag

SEQ ID NO: 179178 - RNA, 22 nt, Human
gcugcccucccagggcaagcuu

SEQ ID NO: 179179 - RNA, 23 nt, Human
agacacauaggagcagcuauugg

SEQ ID NO: 179180 - RNA, 22 nt, Human
uaagaugacuacuuaccacuga

SEQ ID NO: 179181 - RNA, 22 nt, Human
uggcuucauucuccugugaaua

SEQ ID NO: 179182 - RNA, 19 nt, Human
uguggcugagcacuccuua

SEQ ID NO: 179183 - RNA, 22 nt, Human
uugagggagaaagccgaggugu

SEQ ID NO: 179184 - RNA, 22 nt, Human
guccaggccaugguggacacag

SEQ ID NO: 179185 - RNA, 22 nt, Human
uuucuacaauuuuuggcaugag

SEQ ID NO: 179186 - RNA, 22 nt, Human
auagggcugccaucacagaaga

SEQ ID NO: 179187 - RNA, 22 nt, Human
ucagagaaaugacaauauauag

SEQ ID NO: 179188 - RNA, 22 nt, Human
cauguacaaaaggcaaaugccu

SEQ ID NO: 179189 - RNA, 22 nt, Human
aagcauuucagguagagauauu

SEQ ID NO: 179190 - RNA, 22 nt, Human
cugagcagucugacucaagcua

SEQ ID NO: 179191 - RNA, 22 nt, Human
gggcuggaggagauccagaggc

SEQ ID NO: 179192 - RNA, 22 nt, Human
ccagaagauggcucaaaccaug

SEQ ID NO: 179193 - RNA, 22 nt, Human
guacaaauacauucugaaggua

SEQ ID NO: 179194 - RNA, 20 nt, Human
uggcaggacuggcuccaccc

SEQ ID NO: 179195 - RNA, 22 nt, Human
cuggcagcauuaacagagagca

SEQ ID NO: 179196 - RNA, 22 nt, Human
gcugacaguuguaccugccccu

SEQ ID NO: 179197 - RNA, 22 nt, Human
uugagacagugggguguugccg

SEQ ID NO: 179198 - RNA, 22 nt, Human
ccuuguuuuggaaccaaaggau

SEQ ID NO: 179199 - RNA, 22 nt, Human
gcaccagcugcuggguucuaga

SEQ ID NO: 179200 - RNA, 22 nt, Human
ggacaggccuggcacaguacug

SEQ ID NO: 179201 - RNA, 22 nt, Human
acagccugagaguggagcuggc

SEQ ID NO: 179202 - RNA, 20 nt, Human
ucuuugugucagauggacag

SEQ ID NO: 179203 - RNA, 19 nt, Human
ggcugugguggugccuugc

SEQ ID NO: 179204 - RNA, 22 nt, Human
uuuuccaaauuagaaguagaga

SEQ ID NO: 179205 - RNA, 22 nt, Human
ggcuccaggcuccuauuucacu

SEQ ID NO: 179206 - RNA, 22 nt, Human
cugugggauucaugacauuaau

SEQ ID NO: 179207 - RNA, 22 nt, Human
ggaggagagagguugcaaacac

SEQ ID NO: 179208 - RNA, 22 nt, Human
ugaggcaggaggauugcaggau

SEQ ID NO: 179209 - RNA, 22 nt, Human
ggacucagcagccaggaguggc

SEQ ID NO: 179210 - RNA, 20 nt, Human
gcccucagucuugucuuuau

SEQ ID NO: 179211 - RNA, 22 nt, Human
gaggagagagggacugucugca

SEQ ID NO: 179212 - RNA, 18 nt, Human
gccaggcaggguggggaa

SEQ ID NO: 179213 - RNA, 22 nt, Human
guacauuuuacuuuguuugaau

SEQ ID NO: 179214 - RNA, 22 nt, Human
ugccugccuaggaagcugugaa

SEQ ID NO: 179215 - RNA, 22 nt, Human
auguuuuacccuuugcacaaac

SEQ ID NO: 179216 - RNA, 19 nt, Human
gacagugcaguuguaguac

SEQ ID NO: 179217 - RNA, 22 nt, Human
uccugaggaaugugaagagaac

SEQ ID NO: 179218 - RNA, 22 nt, Human
aagcacaugagcuauucaugcu

SEQ ID NO: 179219 - RNA, 22 nt, Human
acagucuuugcaaaguccuggu

SEQ ID NO: 179220 - RNA, 22 nt, Human
gccucugucauagcucauguga

SEQ ID NO: 179221 - RNA, 22 nt, Human
cuuguauucuuccacuuaagau

SEQ ID NO: 179222 - RNA, 23 nt, Human
ggcugggagcuccgggugcacgu

SEQ ID NO: 179223 - RNA, 22 nt, Human
uccugaggacccugucaggggc

SEQ ID NO: 179224 - RNA, 22 nt, Human
augcccuggggcuaccucugag

SEQ ID NO: 179225 - RNA, 22 nt, Human
ccagcucuggcuucuugcuggg

SEQ ID NO: 179226 - RNA, 22 nt, Human
ucugcuguguugaaugauuggu

SEQ ID NO: 179227 - RNA, 22 nt, Human
acucagaguuccugugcauagu

SEQ ID NO: 179228 - RNA, 20 nt, Human
agcaccagugggggcagccc

SEQ ID NO: 179229 - RNA, 22 nt, Human
cucaccacagagccuguccagc

SEQ ID NO: 179230 - RNA, 22 nt, Human
ggccucugccccagccacaccu

SEQ ID NO: 179231 - RNA, 22 nt, Human
uuacagguuguguauucaguga

SEQ ID NO: 179232 - RNA, 22 nt, Human
agaagccagucgcucucccgca

SEQ ID NO: 179233 - RNA, 22 nt, Human
cauguuuuguguacagaauauu

SEQ ID NO: 179234 - RNA, 22 nt, Human
ccuggcucuguccucgcgcaaa

SEQ ID NO: 179235 - RNA, 22 nt, Human
uucuguguucugugcaaugagc

SEQ ID NO: 179236 - RNA, 22 nt, Human
ggugaggaaagauggugacagu

SEQ ID NO: 179237 - RNA, 22 nt, Human
cugucuguucagauucauuacu

SEQ ID NO: 179238 - RNA, 22 nt, Human
cccacagggcugcugauggcag

SEQ ID NO: 179239 - RNA, 22 nt, Human
aacagcauaaguauuuauuuca

SEQ ID NO: 179240 - RNA, 22 nt, Human
ccuuuguucacuggagagugga

SEQ ID NO: 179241 - RNA, 22 nt, Human
acagaugaggcccaucagucug

SEQ ID NO: 179242 - RNA, 22 nt, Human
caagacaugcaauugccacuuu

SEQ ID NO: 179243 - RNA, 23 nt, Human
cagcuuucagggcuuuagggaag

SEQ ID NO: 179244 - RNA, 22 nt, Human
uagagaaauaagcuuugccuug

SEQ ID NO: 179245 - RNA, 23 nt, Human
aaguuaguuucaauaaagcaauu

SEQ ID NO: 179246 - RNA, 22 nt, Human
auaaaugaacauucacagagcu

SEQ ID NO: 179247 - RNA, 22 nt, Human
agaguggcuucuuugacaugcu

SEQ ID NO: 179248 - RNA, 22 nt, Human
aagcuguugaaguaauucagcc

SEQ ID NO: 179249 - RNA, 22 nt, Human
ugaggcugagauaucagggagg

SEQ ID NO: 179250 - RNA, 22 nt, Human
ugucuacuugggcucuacagca

SEQ ID NO: 179251 - RNA, 22 nt, Human
gcugcgagcucuuguucugaga

SEQ ID NO: 179252 - RNA, 22 nt, Human
gggggcugaggcuguucugagg

SEQ ID NO: 179253 - RNA, 22 nt, Human
aauuuacaggugcacucgccau

SEQ ID NO: 179254 - RNA, 22 nt, Human
auguacaauucuccuugguagg

SEQ ID NO: 179255 - RNA, 22 nt, Human
cagcaacaugugguaguguagg

SEQ ID NO: 179256 - RNA, 22 nt, Human
uucuuuugcaagacuauugauu

SEQ ID NO: 179257 - RNA, 22 nt, Human
gaaguucaaugucagcaucuau

SEQ ID NO: 179258 - RNA, 22 nt, Human
guggcuucuucuugggagcugc

SEQ ID NO: 179259 - RNA, 15 nt, Human
uuggaggauguagua

SEQ ID NO: 179260 - RNA, 22 nt, Human
ucuggcuuuccuggagcaagaa

SEQ ID NO: 179261 - RNA, 22 nt, Human
gaugauuuugaugcaguaaaga

SEQ ID NO: 179262 - RNA, 20 nt, Human
aguaggggaaugcaagagca

SEQ ID NO: 179263 - RNA, 16 nt, Human
ccagguggggcuguga

SEQ ID NO: 179264 - RNA, 22 nt, Human
ucaucuguucauacacaugcgu

SEQ ID NO: 179265 - RNA, 22 nt, Human
agugaggcaaagugagaggcag

SEQ ID NO: 179266 - RNA, 22 nt, Human
uagaacuucuuacagcuaaguu

SEQ ID NO: 179267 - RNA, 21 nt, Human
ucaggaagagcuucucccacu

SEQ ID NO: 179268 - RNA, 22 nt, Human
acacaucucucuuugaggagug

SEQ ID NO: 179269 - RNA, 20 nt, Human
uucaugggagcaaagaggcc

SEQ ID NO: 179270 - RNA, 22 nt, Human
cagguccucgggggaggccggc

SEQ ID NO: 179271 - RNA, 22 nt, Human
guuuagaagccaagauuugggu

SEQ ID NO: 179272 - RNA, 22 nt, Human
gucccagggcaaggcuguuucu

SEQ ID NO: 179273 - RNA, 22 nt, Human
guguccauucacugcaacacuu

SEQ ID NO: 179274 - RNA, 22 nt, Human
gcccugugcgcugaguucaggg

SEQ ID NO: 179275 - RNA, 22 nt, Human
ccagugcugaaugaggaggucu

SEQ ID NO: 179276 - RNA, 22 nt, Human
agugaugugggagaguauagcu

SEQ ID NO: 179277 - RNA, 22 nt, Human
gcagccacagaggagggaugca

SEQ ID NO: 179278 - RNA, 22 nt, Human
ugggaaggugauuuuccaaaag

SEQ ID NO: 179279 - RNA, 22 nt, Human
uaaggacaaucagguuaguagc

SEQ ID NO: 179280 - RNA, 22 nt, Human
gacauguugaagaauauuugga

SEQ ID NO: 179281 - RNA, 22 nt, Human
gucacaugccagugcacacagg

SEQ ID NO: 179282 - RNA, 19 nt, Human
cucagagaggggcagugcc

SEQ ID NO: 179283 - RNA, 22 nt, Human
uucuuucaauagcuggcauaug

SEQ ID NO: 179284 - RNA, 22 nt, Human
gcaggccagcugugcagauggg

SEQ ID NO: 179285 - RNA, 22 nt, Human
agggugccugcugcagguucag

SEQ ID NO: 179286 - RNA, 22 nt, Human
ccagagaguaaacauuuuccgg

SEQ ID NO: 179287 - RNA, 22 nt, Human
uccaggaguccuggguggcccc

SEQ ID NO: 179288 - RNA, 20 nt, Human
agugucuggauuuuguaacc

SEQ ID NO: 179289 - RNA, 22 nt, Human
ggagugaaagguaaguugagcu

SEQ ID NO: 179290 - RNA, 22 nt, Human
cugaggagauccccccagaagu

SEQ ID NO: 179291 - RNA, 22 nt, Human
cagagcccugggcacaugguag

SEQ ID NO: 179292 - RNA, 22 nt, Human
ucucagagaucuuucugcaugu

SEQ ID NO: 179293 - RNA, 22 nt, Human
agagacaagaaauaccugggac

SEQ ID NO: 179294 - RNA, 23 nt, Human
gcugggcuuacucuuucagugag

SEQ ID NO: 179295 - RNA, 22 nt, Human
uucuuacagcccuauuacuaaa

SEQ ID NO: 179296 - RNA, 22 nt, Human
cagagagaaucuuggcagcuga

SEQ ID NO: 179297 - RNA, 22 nt, Human
uugcccugucaguagaagugca

SEQ ID NO: 179298 - RNA, 19 nt, Human
uacaaaggaggauguaaaa

SEQ ID NO: 179299 - RNA, 22 nt, Human
cagaaguuugcaauuguuuauu

SEQ ID NO: 179300 - RNA, 22 nt, Human
cuauuuucccauaugguugaca

SEQ ID NO: 179301 - RNA, 22 nt, Human
uaaagauaagacaucaacugag

SEQ ID NO: 179302 - RNA, 22 nt, Human
gucuggcuguuccugccuguga

SEQ ID NO: 179303 - RNA, 22 nt, Human
uaugcagugguaucauuuuaaa

SEQ ID NO: 179304 - RNA, 22 nt, Human
uguuuugguagauugauuaugg

SEQ ID NO: 179305 - RNA, 22 nt, Human
gagcugugacacgcagcccagg

SEQ ID NO: 179306 - RNA, 22 nt, Human
ggagcccuucuauuccauggag

SEQ ID NO: 179307 - RNA, 22 nt, Human
aggaauguaacaggaguaaaaa

SEQ ID NO: 179308 - RNA, 22 nt, Human
cugugauggucaggcccuaucu

SEQ ID NO: 179309 - RNA, 22 nt, Human
cugcccugcuggagaucacagu

SEQ ID NO: 179310 - RNA, 22 nt, Human
gugcuucuccguucugcagcac

SEQ ID NO: 179311 - RNA, 22 nt, Human
aucuuuaggcaaguuacuuaac

SEQ ID NO: 179312 - RNA, 22 nt, Human
gcuuuggaacuuaaauccuugg

SEQ ID NO: 179313 - RNA, 22 nt, Human
uggcagcugaauggcuggaugg

SEQ ID NO: 179314 - RNA, 22 nt, Human
ggucacaugagaugcugcccuc

SEQ ID NO: 179315 - RNA, 22 nt, Human
augugucuaauuccaggagcac

SEQ ID NO: 179316 - RNA, 22 nt, Human
gagcacagaaggagaaauaugg

SEQ ID NO: 179317 - RNA, 22 nt, Human
uucuggcuucaucugacaagcc

SEQ ID NO: 179318 - RNA, 22 nt, Human
ucuucccagaccuuacauguga

SEQ ID NO: 179319 - RNA, 22 nt, Human
gcuggaguccaguggcaugauc

SEQ ID NO: 179320 - RNA, 17 nt, Human
uucaaugauuaaugcau

SEQ ID NO: 179321 - RNA, 22 nt, Human
uccuucagaaccugugauggaa

SEQ ID NO: 179322 - RNA, 19 nt, Human
cucucacucgccacauccu

SEQ ID NO: 179323 - RNA, 22 nt, Human
uuauacacugcagaaccagcau

SEQ ID NO: 179324 - RNA, 22 nt, Human
caugagagauccuucaugagag

SEQ ID NO: 179325 - RNA, 22 nt, Human
gaggcagagguuguugcaguga

SEQ ID NO: 179326 - RNA, 22 nt, Human
cagguccuuguuuguaaagcag

SEQ ID NO: 179327 - RNA, 14 nt, Human
gcagguggaucacu

SEQ ID NO: 179328 - RNA, 22 nt, Human
uggaggaggaugcauuuguugu

SEQ ID NO: 179329 - RNA, 22 nt, Human
aggcuucacauuuucuaggccu

SEQ ID NO: 179330 - RNA, 23 nt, Human
cggcugcucggccgaguccucgg

SEQ ID NO: 179331 - RNA, 22 nt, Human
ccagagagauugcuucuaaaga

SEQ ID NO: 179332 - RNA, 22 nt, Human
gccauauacccacugucuccau

SEQ ID NO: 179333 - RNA, 22 nt, Human
ggcuucagaggggagguagugc

SEQ ID NO: 179334 - RNA, 22 nt, Human
cuccauggaaccggggcugcuu

SEQ ID NO: 179335 - RNA, 22 nt, Human
aaugcuuauggguuccauaaua

SEQ ID NO: 179336 - RNA, 23 nt, Human
gagcucugcacuaggcccuggga

SEQ ID NO: 179337 - RNA, 22 nt, Human
gccaccagcagaaaaggggcca

SEQ ID NO: 179338 - RNA, 22 nt, Human
uauuucacuauucucuguaacu

SEQ ID NO: 179339 - RNA, 22 nt, Human
ugggcuuccuggagccugugcu

SEQ ID NO: 179340 - RNA, 22 nt, Human
aacauuuauugagcaccuacug

SEQ ID NO: 179341 - RNA, 22 nt, Human
aagggcugggucugguuaaccc

SEQ ID NO: 179342 - RNA, 22 nt, Human
gauaaaagaggaaauuuguuca

SEQ ID NO: 179343 - RNA, 22 nt, Human
aagccaguccucuacugggcac

SEQ ID NO: 179344 - RNA, 22 nt, Human
gccuccucuugagggucaggga

SEQ ID NO: 179345 - RNA, 21 nt, Human
aaaauguuuccuuguugguua

SEQ ID NO: 179346 - RNA, 22 nt, Human
uaauuauuaugacaacaauugc

SEQ ID NO: 179347 - RNA, 22 nt, Human
uuuuauagcugaauaguauucc

SEQ ID NO: 179348 - RNA, 22 nt, Human
guuagacaugcagaaucucagg

SEQ ID NO: 179349 - RNA, 22 nt, Human
uuuuuaucuuguaugugucucu

SEQ ID NO: 179350 - RNA, 22 nt, Human
ucuccugggcuugguugaaguu

SEQ ID NO: 179351 - RNA, 22 nt, Human
ucugagcuucugccugcugcaa

SEQ ID NO: 179352 - RNA, 20 nt, Human
cacccuacggccucaccucc

SEQ ID NO: 179353 - RNA, 20 nt, Human
uggcuucauaaugguuucug

SEQ ID NO: 179354 - RNA, 22 nt, Human
ugaggcucacgaacagaagacu

SEQ ID NO: 179355 - RNA, 22 nt, Human
cacaugugcaaauacugaggcu

SEQ ID NO: 179356 - RNA, 22 nt, Human
ccagaggaugcuggucagccuc

SEQ ID NO: 179357 - RNA, 22 nt, Human
aaaaccucaguucugcucuuaa

SEQ ID NO: 179358 - RNA, 22 nt, Human
aucaugaaucuuguguucuaug

SEQ ID NO: 179359 - RNA, 22 nt, Human
guccaggucuggacccugagcc

SEQ ID NO: 179360 - RNA, 22 nt, Human
uguuacaguacuacaauucugc

SEQ ID NO: 179361 - RNA, 22 nt, Human
ucagggcaagauugguuaauaa

SEQ ID NO: 179362 - RNA, 20 nt, Human
augugagggguugaaguggg

SEQ ID NO: 179363 - RNA, 22 nt, Human
gagcuccagaguuagacacccg

SEQ ID NO: 179364 - RNA, 22 nt, Human
gucuccugagacugcagucacc

SEQ ID NO: 179365 - RNA, 22 nt, Human
auauucaaauuacauuuacuaa

SEQ ID NO: 179366 - RNA, 22 nt, Human
gaaccuguuuauguuaccugcg

SEQ ID NO: 179367 - RNA, 22 nt, Human
ggggcugagucagugggaagag

SEQ ID NO: 179368 - RNA, 22 nt, Human
uaggagcuuuuggaguccugug

SEQ ID NO: 179369 - RNA, 22 nt, Human
auuauuucucacucacauaaua

SEQ ID NO: 179370 - RNA, 21 nt, Human
cucaggaucuuauauauuagu

SEQ ID NO: 179371 - RNA, 22 nt, Human
aacauucuauuuugcuaaaaca

SEQ ID NO: 179372 - RNA, 22 nt, Human
uaaauucuacaacuucaaagau

SEQ ID NO: 179373 - RNA, 22 nt, Human
agauacacagcccugccaucac

SEQ ID NO: 179374 - RNA, 22 nt, Human
gagacguggccuuugccugagc

SEQ ID NO: 179375 - RNA, 22 nt, Human
ucagaaaagaccacauuauucu

SEQ ID NO: 179376 - RNA, 22 nt, Human
uaacauauuguguggcacuagg

SEQ ID NO: 179377 - RNA, 22 nt, Human
ugugcaacuccuuccacagaca

SEQ ID NO: 179378 - RNA, 22 nt, Human
aaggaaaugagguugauggaug

SEQ ID NO: 179379 - RNA, 22 nt, Human
gcaggccucuaauucaccgcag

SEQ ID NO: 179380 - RNA, 22 nt, Human
guccucagcaccagaacuaggg

SEQ ID NO: 179381 - RNA, 22 nt, Human
cccagggaggcccaggcucugc

SEQ ID NO: 179382 - RNA, 22 nt, Human
gccaggcaggugucggagcccu

SEQ ID NO: 179383 - RNA, 22 nt, Human
acaaauggaacaaugaagacug

SEQ ID NO: 179384 - RNA, 22 nt, Human
gauucacucauauuuuacguuu

SEQ ID NO: 179385 - RNA, 22 nt, Human
uaggccagauuacuagaguagg

SEQ ID NO: 179386 - RNA, 22 nt, Human
gagcucagaggcgucuuugucc

SEQ ID NO: 179387 - RNA, 22 nt, Human
gagacacaguuaucaggcauac

SEQ ID NO: 179388 - RNA, 22 nt, Human
cuugauuuauuacccacuauau

SEQ ID NO: 179389 - RNA, 22 nt, Human
uguuuacagggugauuuuaccu

SEQ ID NO: 179390 - RNA, 22 nt, Human
agucuauugccuaacagagagg

SEQ ID NO: 179391 - RNA, 22 nt, Human
uaauaucuggcauucaaacaug

SEQ ID NO: 179392 - RNA, 22 nt, Human
uccaggcauguggccaguacuc

SEQ ID NO: 179393 - RNA, 22 nt, Human
ucaaaucuuuaacaugugcaaa

SEQ ID NO: 179394 - RNA, 22 nt, Human
auucaguuuuuauuggaccagc

SEQ ID NO: 179395 - RNA, 22 nt, Human
ucauguguguuucauguaugga

SEQ ID NO: 179396 - RNA, 22 nt, Human
aggcuagaggcuucuggcuuca

SEQ ID NO: 179397 - RNA, 22 nt, Human
ccucaggccugccagagcccca

SEQ ID NO: 179398 - RNA, 22 nt, Human
uuggcugccuguggaucgcauu

SEQ ID NO: 179399 - RNA, 22 nt, Human
ccaggagcagaguagguguuca

SEQ ID NO: 179400 - RNA, 22 nt, Human
auugucagugggauuugucaac

SEQ ID NO: 179401 - RNA, 22 nt, Human
uucucaaagaaagcugucauua

SEQ ID NO: 179402 - RNA, 23 nt, Human
cuggcccaggugagagguuggug

SEQ ID NO: 179403 - RNA, 23 nt, Human
ucagagcaagaugauguaugagc

SEQ ID NO: 179404 - RNA, 22 nt, Human
guccagcugggccagggcacuc

SEQ ID NO: 179405 - RNA, 22 nt, Human
cagcuauuuucucauuaaggau

SEQ ID NO: 179406 - RNA, 22 nt, Human
uuaaaugagauguucagauauu

SEQ ID NO: 179407 - RNA, 22 nt, Human
uuccaggacaagauguuucagg

SEQ ID NO: 179408 - RNA, 22 nt, Human
auucagugucuacuccauugcc

SEQ ID NO: 179409 - RNA, 22 nt, Human
ucagagcugugcuucaggaaag

SEQ ID NO: 179410 - RNA, 22 nt, Human
ugcaggguguccggaggaucac

SEQ ID NO: 179411 - RNA, 22 nt, Human
cuggauguucuucugcaauuau

SEQ ID NO: 179412 - RNA, 22 nt, Human
aacaucucuguauuuuauagac

SEQ ID NO: 179413 - RNA, 22 nt, Human
caggacagcucaacaccuccuc

SEQ ID NO: 179414 - RNA, 22 nt, Human
ccuuuccccgcgggaggugcca

SEQ ID NO: 179415 - RNA, 22 nt, Human
accuucaauuauuuuuguucca

SEQ ID NO: 179416 - RNA, 22 nt, Human
acauguaagacuagcuuaaagu

SEQ ID NO: 179417 - RNA, 22 nt, Human
ugcaaaaauugcuggaaucuuu

SEQ ID NO: 179418 - RNA, 22 nt, Human
agugcagggggaaagggugucu

SEQ ID NO: 179419 - RNA, 20 nt, Human
uggguccugugggagaagaa

SEQ ID NO: 179420 - RNA, 22 nt, Human
ggacccugggcagcuggcugcu

SEQ ID NO: 179421 - RNA, 22 nt, Human
aggacccacgcacaggaacccc

SEQ ID NO: 179422 - RNA, 22 nt, Human
uggcaaauauuuuguuuuguaa

SEQ ID NO: 179423 - RNA, 22 nt, Human
ugucacuuuggggagaguuuug

SEQ ID NO: 179424 - RNA, 22 nt, Human
uucuucagucccacuagccaca

SEQ ID NO: 179425 - RNA, 22 nt, Human
agcuggguacugaugucuucag

SEQ ID NO: 179426 - RNA, 22 nt, Human
ggaagaggcugaggccaugcug

SEQ ID NO: 179427 - RNA, 22 nt, Human
ugcccugccaagaccaaguggu

SEQ ID NO: 179428 - RNA, 22 nt, Human
ucuccaggcacuaccuggguaa

SEQ ID NO: 179429 - RNA, 22 nt, Human
cacaaaguauaacuugauggaa

SEQ ID NO: 179430 - RNA, 22 nt, Human
ugaggaagccaaacagcuacac

SEQ ID NO: 179431 - RNA, 22 nt, Human
uaucacuugcguuuuggcagag

SEQ ID NO: 179432 - RNA, 22 nt, Human
ggagcagaugucuucauggccu

SEQ ID NO: 179433 - RNA, 22 nt, Human
gucuccaguguucaggugacug

SEQ ID NO: 179434 - RNA, 22 nt, Human
cagagccaacgccaccugccca

SEQ ID NO: 179435 - RNA, 22 nt, Human
ugcccugguuacacuggagucc

SEQ ID NO: 179436 - RNA, 20 nt, Human
gcagagugugagagggugaa

SEQ ID NO: 179437 - RNA, 22 nt, Human
uagggcagccacccaggcugcu

SEQ ID NO: 179438 - RNA, 22 nt, Human
agugcccuggacggcggcccca

SEQ ID NO: 179439 - RNA, 22 nt, Human
aggcugggaaauguauuccagc

SEQ ID NO: 179440 - RNA, 22 nt, Human
aguaaacauuuucauauuuucu

SEQ ID NO: 179441 - RNA, 22 nt, Human
aacgaagcuuaacuuuucugag

SEQ ID NO: 179442 - RNA, 22 nt, Human
ugcuggcuuauuuaguaaaugu

SEQ ID NO: 179443 - RNA, 22 nt, Human
cucuuuggcguuggcagagcca

SEQ ID NO: 179444 - RNA, 22 nt, Human
cagaauaaagguacaauugagu

SEQ ID NO: 179445 - RNA, 20 nt, Human
gaacauuuggccauacugag

SEQ ID NO: 179446 - RNA, 22 nt, Human
aaggcagauaagaauucagcaa

SEQ ID NO: 179447 - RNA, 22 nt, Human
aggugucuggauggguguccuu

SEQ ID NO: 179448 - RNA, 22 nt, Human
uccagggaucuuuagagucuuu

SEQ ID NO: 179449 - RNA, 22 nt, Human
uuccuggcaccaccacuucuag

SEQ ID NO: 179450 - RNA, 22 nt, Human
aacuagaaaucacuacagguau

SEQ ID NO: 179451 - RNA, 22 nt, Human
gaggaaugggugucucgugauu

SEQ ID NO: 179452 - RNA, 22 nt, Human
agugggcaggcagggugcgcag

SEQ ID NO: 179453 - RNA, 22 nt, Human
ccugggugucaugggcagcugg

SEQ ID NO: 179454 - RNA, 22 nt, Human
ccucaggaaaugaauaaauggc

SEQ ID NO: 179455 - RNA, 22 nt, Human
agggaccaaucaccgacaggcu

SEQ ID NO: 179456 - RNA, 19 nt, Human
caaaugggacaggaaggca

SEQ ID NO: 179457 - RNA, 22 nt, Human
aagaguuuaugauauaacaugu

SEQ ID NO: 179458 - RNA, 22 nt, Human
uaagugguugcuuguuuucauu

SEQ ID NO: 179459 - RNA, 22 nt, Human
ugaggugggcuuguggauuugc

SEQ ID NO: 179460 - RNA, 23 nt, Human
uucugggcuguggaagccucggg

SEQ ID NO: 179461 - RNA, 22 nt, Human
uucaggaugaaagugugcaaca

SEQ ID NO: 179462 - RNA, 22 nt, Human
uagaaacauguucuguucuguu

SEQ ID NO: 179463 - RNA, 22 nt, Human
uugauuucuuacucuuccaagg

SEQ ID NO: 179464 - RNA, 22 nt, Human
ccugaggcucgcgcgccccugg

SEQ ID NO: 179465 - RNA, 22 nt, Human
uagcagagcagggaucagagcc

SEQ ID NO: 179466 - RNA, 22 nt, Human
cugccugaguacaagucccaga

SEQ ID NO: 179467 - RNA, 22 nt, Human
acaggauaguuuuuaaucuucc

SEQ ID NO: 179468 - RNA, 22 nt, Human
aggcuucuuuuagaggggaugg

SEQ ID NO: 179469 - RNA, 22 nt, Human
aaugaauugcaguacugacuug

SEQ ID NO: 179470 - RNA, 22 nt, Human
uuuucccaucuacaaagcaggg

SEQ ID NO: 179471 - RNA, 22 nt, Human
cagagccuuccuagcagacucu

SEQ ID NO: 179472 - RNA, 21 nt, Human
gcuuuagauuuagugagccag

SEQ ID NO: 179473 - RNA, 22 nt, Human
ugcccugggaacacagaugcca

SEQ ID NO: 179474 - RNA, 22 nt, Human
uuugacucauuaaagucuccgu

SEQ ID NO: 179475 - RNA, 22 nt, Human
caaagcuguaccccaaccuaug

SEQ ID NO: 179476 - RNA, 22 nt, Human
gagggugucugcguaacuggca

SEQ ID NO: 179477 - RNA, 22 nt, Human
auguaauaggguaacauaacau

SEQ ID NO: 179478 - RNA, 22 nt, Human
accuugaacccagcuugcugca

SEQ ID NO: 179479 - RNA, 22 nt, Human
agaaggaaggcugagugcugau

SEQ ID NO: 179480 - RNA, 22 nt, Human
gcagggaccucacuacccccag

SEQ ID NO: 179481 - RNA, 20 nt, Human
ugaggcaggagaauggcaug

SEQ ID NO: 179482 - RNA, 22 nt, Human
uguguguccuugaccucagugg

SEQ ID NO: 179483 - RNA, 22 nt, Human
agcccugggcuguagauaagca

SEQ ID NO: 179484 - RNA, 22 nt, Human
gcucugaguaaaugaaagcauu

SEQ ID NO: 179485 - RNA, 22 nt, Human
ugggaccucucuugagagagca

SEQ ID NO: 179486 - RNA, 22 nt, Human
cuuguaauuauaauguacuguu

SEQ ID NO: 179487 - RNA, 22 nt, Human
ccaguggaauuaaaaauaagug

SEQ ID NO: 179488 - RNA, 22 nt, Human
aggagccuccauggucacauuc

SEQ ID NO: 179489 - RNA, 21 nt, Human
ucugauguucacacccuguau

SEQ ID NO: 179490 - RNA, 22 nt, Human
gguguccuacugcuugguugcu

SEQ ID NO: 179491 - RNA, 22 nt, Human
gaagucuuggcugaaaacccuc

SEQ ID NO: 179492 - RNA, 22 nt, Human
agaggccaggcugcagagggau

SEQ ID NO: 179493 - RNA, 22 nt, Human
agcuccugaaaagcgcuugcuu

SEQ ID NO: 179494 - RNA, 22 nt, Human
agcaguuacuaguuaaaugcau

SEQ ID NO: 179495 - RNA, 22 nt, Human
ucugcccacaguccaauaguug

SEQ ID NO: 179496 - RNA, 22 nt, Human
uaguauuuccuguaagcuauag

SEQ ID NO: 179497 - RNA, 20 nt, Human
acagccagaggaggcagaca

SEQ ID NO: 179498 - RNA, 22 nt, Human
ucugccugaggacugacaccag

SEQ ID NO: 179499 - RNA, 22 nt, Human
caggagccgccaggcacguugg

SEQ ID NO: 179500 - RNA, 22 nt, Human
uucuuauagaagcaaccauugu

SEQ ID NO: 179501 - RNA, 22 nt, Human
gcugucccgaaccccugguaau

SEQ ID NO: 179502 - RNA, 22 nt, Human
aucagcugcuacauuggccucu

SEQ ID NO: 179503 - RNA, 22 nt, Human
cccagcuccagagccagaaaca

SEQ ID NO: 179504 - RNA, 17 nt, Human
gcagccucuugguagug

SEQ ID NO: 179505 - RNA, 22 nt, Human
guucuucacauuucauugagga

SEQ ID NO: 179506 - RNA, 22 nt, Human
gcaggcuggaggcuguucuggg

SEQ ID NO: 179507 - RNA, 22 nt, Human
uucugacaauucaguaacagca

SEQ ID NO: 179508 - RNA, 22 nt, Human
uaauuauagccgcuauuuugcu

SEQ ID NO: 179509 - RNA, 22 nt, Human
aggcagauauuucaguucacau

SEQ ID NO: 179510 - RNA, 22 nt, Human
ucugugccaccucuccaguguc

SEQ ID NO: 179511 - RNA, 22 nt, Human
ucucucagaacugcagcugcag

SEQ ID NO: 179512 - RNA, 22 nt, Human
aaaagccaagguccucuucaga

SEQ ID NO: 179513 - RNA, 21 nt, Human
uccugcagaaugccuuccuac

SEQ ID NO: 179514 - RNA, 22 nt, Human
ugcagcagggcccaggcacaga

SEQ ID NO: 179515 - RNA, 22 nt, Human
aauuuuacuaaucugaguguga

SEQ ID NO: 179516 - RNA, 22 nt, Human
ugagagcugggaaauguuagcu

SEQ ID NO: 179517 - RNA, 22 nt, Human
gggcccuggauuuaagcaugga

SEQ ID NO: 179518 - RNA, 22 nt, Human
auagaaacagaggucaggcauu

SEQ ID NO: 179519 - RNA, 22 nt, Human
aggucauuacaauuaucauuuu

SEQ ID NO: 179520 - RNA, 22 nt, Human
ggaauucaguggccagacauga

SEQ ID NO: 179521 - RNA, 22 nt, Human
gugaagaugccucaggugaccc

SEQ ID NO: 179522 - RNA, 22 nt, Human
uucccuuccucacucuacuugu

SEQ ID NO: 179523 - RNA, 22 nt, Human
ugcaaauuccauuuaaacacua

SEQ ID NO: 179524 - RNA, 22 nt, Human
acaaagaucuugcuuuccuacu

SEQ ID NO: 179525 - RNA, 22 nt, Human
ugcuguguaaaaggugauugaa

SEQ ID NO: 179526 - RNA, 22 nt, Human
caguccagcucaucaguggcac

SEQ ID NO: 179527 - RNA, 22 nt, Human
ucccugaguuuucuuucugacu

SEQ ID NO: 179528 - RNA, 22 nt, Human
uuuauuuauccuucuggauugc

SEQ ID NO: 179529 - RNA, 22 nt, Human
ccuuccaaaggagccacaucug

SEQ ID NO: 179530 - RNA, 22 nt, Human
aucuguaaaugcaaauguagcu

SEQ ID NO: 179531 - RNA, 22 nt, Human
aacaaaacauuugucuuguuuc

SEQ ID NO: 179532 - RNA, 22 nt, Human
cagcugggugaucuugggcagg

SEQ ID NO: 179533 - RNA, 20 nt, Human
ucacacaugguaagcuauga

SEQ ID NO: 179534 - RNA, 22 nt, Human
aagccaugguagaaaacucagu

SEQ ID NO: 179535 - RNA, 22 nt, Human
auguacuaugcagucaacuguu

SEQ ID NO: 179536 - RNA, 22 nt, Human
gggcagguauuuaucuucuauu

SEQ ID NO: 179537 - RNA, 22 nt, Human
gaggcaggcagauugcuugagg

SEQ ID NO: 179538 - RNA, 22 nt, Human
uccagauggauuuaagaccuaa

SEQ ID NO: 179539 - RNA, 22 nt, Human
ggaaggcuuucuguucugugac

SEQ ID NO: 179540 - RNA, 22 nt, Human
acagcauugcuccaucucaaga

SEQ ID NO: 179541 - RNA, 22 nt, Human
gauagaaagaauauagauucca

SEQ ID NO: 179542 - RNA, 22 nt, Human
gucuggcauucuuccuggagaa

SEQ ID NO: 179543 - RNA, 22 nt, Human
aggccagcugccacccgguccg

SEQ ID NO: 179544 - RNA, 22 nt, Human
acuguccagaagauagaaauau

SEQ ID NO: 179545 - RNA, 22 nt, Human
uagcccaggagaauugucuuuc

SEQ ID NO: 179546 - RNA, 22 nt, Human
cuccagagagaaaggaggccgc

SEQ ID NO: 179547 - RNA, 22 nt, Human
uggcuucucauuugcauuaaac

SEQ ID NO: 179548 - RNA, 22 nt, Human
cccugagagguugagugucugc

SEQ ID NO: 179549 - RNA, 22 nt, Human
aaaaugaacagaacaaugggga

SEQ ID NO: 179550 - RNA, 22 nt, Human
cuuuucugucagugcccaaauu

SEQ ID NO: 179551 - RNA, 22 nt, Human
gccaggaggggagaguguguca

SEQ ID NO: 179552 - RNA, 22 nt, Human
aagagcuccaggcaaugcgguc

SEQ ID NO: 179553 - RNA, 22 nt, Human
agccaggcugcaguuggcuggc

SEQ ID NO: 179554 - RNA, 22 nt, Human
aaagugcagggugcucugguau

SEQ ID NO: 179555 - RNA, 22 nt, Human
uccaaggagcagauccagagga

SEQ ID NO: 179556 - RNA, 22 nt, Human
cugcuuuaaucccugccuggaa

SEQ ID NO: 179557 - RNA, 22 nt, Human
ccugcccccgucagaggugaug

SEQ ID NO: 179558 - RNA, 22 nt, Human
ggagacacccacauugcugggu

SEQ ID NO: 179559 - RNA, 22 nt, Human
ccacucaggccuccugcucucc

SEQ ID NO: 179560 - RNA, 22 nt, Human
auucuucacauggauaggaucu

SEQ ID NO: 179561 - RNA, 22 nt, Human
acuuccagcaccucaagcggaa

SEQ ID NO: 179562 - RNA, 22 nt, Human
aaaugacacuaggcuuuuugca

SEQ ID NO: 179563 - RNA, 22 nt, Human
gaaggcuaaaggggcagagguu

SEQ ID NO: 179564 - RNA, 22 nt, Human
ucacuucuucccuugcacauau

SEQ ID NO: 179565 - RNA, 22 nt, Human
ugggaucugcaguuuaacaaaa

SEQ ID NO: 179566 - RNA, 22 nt, Human
uuugacucagcaaauucacagg

SEQ ID NO: 179567 - RNA, 22 nt, Human
ugcugaggcauuuggacagagu

SEQ ID NO: 179568 - RNA, 22 nt, Human
uagaauaugauuaauuuucuua

SEQ ID NO: 179569 - RNA, 19 nt, Human
aaagcagugcauccucuuu

SEQ ID NO: 179570 - RNA, 22 nt, Human
uaccaaaaccaagccauuaucu

SEQ ID NO: 179571 - RNA, 22 nt, Human
cuguggcaggaagggacuagca

SEQ ID NO: 179572 - RNA, 22 nt, Human
caguccucucacucaggccuuu

SEQ ID NO: 179573 - RNA, 22 nt, Human
ugcccugcugugccuggagcca

SEQ ID NO: 179574 - RNA, 22 nt, Human
gcuuggcuggagaaaguuaccu

SEQ ID NO: 179575 - RNA, 22 nt, Human
agggaaaucuuucaacacuuca

SEQ ID NO: 179576 - RNA, 22 nt, Human
acacacacaagcagguugugga

SEQ ID NO: 179577 - RNA, 22 nt, Human
ccagagcaauucucacagaacu

SEQ ID NO: 179578 - RNA, 22 nt, Human
ucucugagguuguuuccagcac

SEQ ID NO: 179579 - RNA, 22 nt, Human
cuuauuagaguuguguucuguu

SEQ ID NO: 179580 - RNA, 22 nt, Human
ggagcccucaccggcgagugcc

SEQ ID NO: 179581 - RNA, 22 nt, Human
cugaggcuggcguuugaggaag

SEQ ID NO: 179582 - RNA, 22 nt, Human
uuuggaaugguaccuucaguug

SEQ ID NO: 179583 - RNA, 22 nt, Human
uggacaugagcugagugggugu

SEQ ID NO: 179584 - RNA, 22 nt, Human
uguccaggcggccuugccuguu

SEQ ID NO: 179585 - RNA, 22 nt, Human
cuucuguggauauguucucucu

SEQ ID NO: 179586 - RNA, 22 nt, Human
ggucacaucuaaauggagcauu

SEQ ID NO: 179587 - RNA, 22 nt, Human
ucuuuggucaucaugggaagca

SEQ ID NO: 179588 - RNA, 22 nt, Human
aagcagaggaccgacggaggga

SEQ ID NO: 179589 - RNA, 22 nt, Human
cugaguccuugggcuuagagug

SEQ ID NO: 179590 - RNA, 22 nt, Human
aaugaugguuaaacacuggagg

SEQ ID NO: 179591 - RNA, 22 nt, Human
aagaugacuauuuaucuguaag

SEQ ID NO: 179592 - RNA, 22 nt, Human
gucuuccacauuucaagaggcu

SEQ ID NO: 179593 - RNA, 22 nt, Human
cgaggccaugcaugcugaggac

SEQ ID NO: 179594 - RNA, 22 nt, Human
cucuggagugcagccugguggc

SEQ ID NO: 179595 - RNA, 22 nt, Human
gccagguggagguugcagugag

SEQ ID NO: 179596 - RNA, 22 nt, Human
aaggugucaggcuugggaaagu

SEQ ID NO: 179597 - RNA, 22 nt, Human
accaggaaacucucgucuaguu

SEQ ID NO: 179598 - RNA, 22 nt, Human
cacugcacaauguagcaaagaa

SEQ ID NO: 179599 - RNA, 22 nt, Human
gaggccaggacaugaaagcuga

SEQ ID NO: 179600 - RNA, 22 nt, Human
ugguccagaugccuuggcuuua

SEQ ID NO: 179601 - RNA, 22 nt, Human
ucacaucucucauugccucugc

SEQ ID NO: 179602 - RNA, 22 nt, Human
acuguucuucccauuuauauug

SEQ ID NO: 179603 - RNA, 22 nt, Human
agccuggggcacuucuccaaac

SEQ ID NO: 179604 - RNA, 22 nt, Human
cagaaguggccucagagggagu

SEQ ID NO: 179605 - RNA, 22 nt, Human
acaagcucagaucccugucucu

SEQ ID NO: 179606 - RNA, 22 nt, Human
cuauuuucugucucuauagagu

SEQ ID NO: 179607 - RNA, 22 nt, Human
ggccugagcuugggcagcguau

SEQ ID NO: 179608 - RNA, 22 nt, Human
ugcagauaauacuagaacuuac

SEQ ID NO: 179609 - RNA, 22 nt, Human
ucacucuguuuuacucacuguu

SEQ ID NO: 179610 - RNA, 22 nt, Human
ccucaggcuucuaguucaguga

SEQ ID NO: 179611 - RNA, 22 nt, Human
aggcuucuucucuauguacaag

SEQ ID NO: 179612 - RNA, 22 nt, Human
auucuaaaucagagagcucugu

SEQ ID NO: 179613 - RNA, 22 nt, Human
auucaguuagccacagcuauuc

SEQ ID NO: 179614 - RNA, 22 nt, Human
aaaggcuauuuuuagauguuug

SEQ ID NO: 179615 - RNA, 22 nt, Human
auuuauugagagggaggggaau

SEQ ID NO: 179616 - RNA, 22 nt, Human
cagggcuggcuuccaaguuguu

SEQ ID NO: 179617 - RNA, 22 nt, Human
caauuucagguggauagguuuu

SEQ ID NO: 179618 - RNA, 22 nt, Human
ccaugggcgcacaggccuggag

SEQ ID NO: 179619 - RNA, 22 nt, Human
guguaucuggcaugucgagugu

SEQ ID NO: 179620 - RNA, 22 nt, Human
agagcucucuucauaacggccu

SEQ ID NO: 179621 - RNA, 22 nt, Human
cauacauuaccuaacuuaaugc

SEQ ID NO: 179622 - RNA, 22 nt, Human
cccugucucauugaucacuugu

SEQ ID NO: 179623 - RNA, 22 nt, Human
ucuuucuucuuucauaguguga

SEQ ID NO: 179624 - RNA, 22 nt, Human
auauauauugcccaggcugguu

SEQ ID NO: 179625 - RNA, 22 nt, Human
aucagagcugugauucccacuc

SEQ ID NO: 179626 - RNA, 22 nt, Human
acagacauuuuaagacacuuua

SEQ ID NO: 179627 - RNA, 22 nt, Human
uaucauuuuacugugacauuuu

SEQ ID NO: 179628 - RNA, 22 nt, Human
acacagaaccucauagccucuc

SEQ ID NO: 179629 - RNA, 23 nt, Human
guuuucaacacaauaaauguaac

SEQ ID NO: 179630 - RNA, 22 nt, Human
gaggugggaugugugugcuacu

SEQ ID NO: 179631 - RNA, 22 nt, Human
agguuugggaguagaaaucaga

SEQ ID NO: 179632 - RNA, 22 nt, Human
gccuggguccacugaucaugcu

SEQ ID NO: 179633 - RNA, 22 nt, Human
ggucagugccuaucaugugggc

SEQ ID NO: 179634 - RNA, 22 nt, Human
guccugguccugccuccccaug

SEQ ID NO: 179635 - RNA, 22 nt, Human
cucaggucacaggauggccagg

SEQ ID NO: 179636 - RNA, 16 nt, Human
uagggcugggaaggag

SEQ ID NO: 179637 - RNA, 22 nt, Human
aggagggaccuaggaauauugc

SEQ ID NO: 179638 - RNA, 22 nt, Human
caguuuuagggcaaugugaaga

SEQ ID NO: 179639 - RNA, 22 nt, Human
aggggcugggacagagccaagc

SEQ ID NO: 179640 - RNA, 22 nt, Human
ccaugugucuccccuggaagua

SEQ ID NO: 179641 - RNA, 22 nt, Human
uggcucuggauuaaucuaggaa

SEQ ID NO: 179642 - RNA, 22 nt, Human
acagaauaguuggcccugcuau

SEQ ID NO: 179643 - RNA, 22 nt, Human
uugaaagaagaagcugcgaugu

SEQ ID NO: 179644 - RNA, 22 nt, Human
uugcaaauucauggaucugaau

SEQ ID NO: 179645 - RNA, 22 nt, Human
uacacuggacaggaguaggaag

SEQ ID NO: 179646 - RNA, 22 nt, Human
aaacuugauuuagaacuaaggc

SEQ ID NO: 179647 - RNA, 22 nt, Human
cagucuuuguucccauuacuga

SEQ ID NO: 179648 - RNA, 22 nt, Human
gucuucuguuuacuuugaaguu

SEQ ID NO: 179649 - RNA, 22 nt, Human
cuuccuggcaaagcaaucagag

SEQ ID NO: 179650 - RNA, 22 nt, Human
gggcuggagagucccacguggg

SEQ ID NO: 179651 - RNA, 23 nt, Human
ggacacaggccuugucugcgccu

SEQ ID NO: 179652 - RNA, 22 nt, Human
uggaauguuuccccagccugca

SEQ ID NO: 179653 - RNA, 22 nt, Human
uggcuucucuguuuuaguauuu

SEQ ID NO: 179654 - RNA, 22 nt, Human
auuucucaguuccuacuguuua

SEQ ID NO: 179655 - RNA, 22 nt, Human
uaguuuuacuugcgaugauaau

SEQ ID NO: 179656 - RNA, 17 nt, Human
ucagggaaugagguugu

SEQ ID NO: 179657 - RNA, 22 nt, Human
gcuuccuguccaggccccacau

SEQ ID NO: 179658 - RNA, 22 nt, Human
ugauucaagcuacuguuacugg

SEQ ID NO: 179659 - RNA, 22 nt, Human
uaugugucugucgugcauaaau

SEQ ID NO: 179660 - RNA, 18 nt, Human
uggaggaaucacaauggc

SEQ ID NO: 179661 - RNA, 20 nt, Human
uccaggagguuaguguggcu

SEQ ID NO: 179662 - RNA, 22 nt, Human
acacauaagaaacuacaaagag

SEQ ID NO: 179663 - RNA, 20 nt, Human
gugcccugugggcuauuuuc

SEQ ID NO: 179664 - RNA, 22 nt, Human
gaugcuucaagcuuccuuauaa

SEQ ID NO: 179665 - RNA, 22 nt, Human
agcuuaaagccgccaucuagua

SEQ ID NO: 179666 - RNA, 22 nt, Human
auggaaaugauggaacauuaaa

SEQ ID NO: 179667 - RNA, 22 nt, Human
agaugguuuugucuuuaugauu

SEQ ID NO: 179668 - RNA, 22 nt, Human
cccccugcgcccggcacgucau

SEQ ID NO: 179669 - RNA, 22 nt, Human
uuacaaagaguguucuuuucca

SEQ ID NO: 179670 - RNA, 22 nt, Human
gagagggcaagguagaugcuac

SEQ ID NO: 179671 - RNA, 22 nt, Human
uaacaguauugaagauaaacua

SEQ ID NO: 179672 - RNA, 21 nt, Human
caggaaacugaggccaugggg

SEQ ID NO: 179673 - RNA, 22 nt, Human
cugugcccaccuggcucugagg

SEQ ID NO: 179674 - RNA, 22 nt, Human
agaaugauaaugccaugaugga

SEQ ID NO: 179675 - RNA, 22 nt, Human
augguacaaaauguauaaaguc

SEQ ID NO: 179676 - RNA, 22 nt, Human
caggacagaaauaaggaauaua

SEQ ID NO: 179677 - RNA, 22 nt, Human
agggccagcccauaaugccaaa

SEQ ID NO: 179678 - RNA, 23 nt, Human
cagcacaguacauuuccugucuc

SEQ ID NO: 179679 - RNA, 22 nt, Human
gaaaguuacagaaaccauuagu

SEQ ID NO: 179680 - RNA, 22 nt, Human
gcagacccugaacugggcaugg

SEQ ID NO: 179681 - RNA, 22 nt, Human
gccaggagagcuccuucagguu

SEQ ID NO: 179682 - RNA, 21 nt, Human
cuggcccagggaucugcauuu

SEQ ID NO: 179683 - RNA, 22 nt, Human
uagugaaauaugugcugauagc

SEQ ID NO: 179684 - RNA, 22 nt, Human
aaaguuguucaguaagaaacuc

SEQ ID NO: 179685 - RNA, 22 nt, Human
ucuauuaugguacuuaucauga

SEQ ID NO: 179686 - RNA, 22 nt, Human
caugugggacuccugcuguuuu

SEQ ID NO: 179687 - RNA, 22 nt, Human
ccaccagcuuuggcggugacag

SEQ ID NO: 179688 - RNA, 22 nt, Human
acagacauuuaauaaaugcuga

SEQ ID NO: 179689 - RNA, 22 nt, Human
ccugaggagauuguggcugggg

SEQ ID NO: 179690 - RNA, 22 nt, Human
aagauuauuuaagacaggaacc

SEQ ID NO: 179691 - RNA, 22 nt, Human
acauucaaaauuagguuaguug

SEQ ID NO: 179692 - RNA, 22 nt, Human
uacaugcuccuuaugagaaucu

SEQ ID NO: 179693 - RNA, 19 nt, Human
aagcauuagccaaagcauu

SEQ ID NO: 179694 - RNA, 22 nt, Human
agcuggcuuuugugaagguuuu

SEQ ID NO: 179695 - RNA, 22 nt, Human
cuagaaacgccuuuagcacaac

SEQ ID NO: 179696 - RNA, 22 nt, Human
caggggcaagaaugcugucagc

SEQ ID NO: 179697 - RNA, 22 nt, Human
agggggugucucugauuggguu

SEQ ID NO: 179698 - RNA, 22 nt, Human
cuccgcagcgggccaauccgga

SEQ ID NO: 179699 - RNA, 22 nt, Human
ccugcugucccucugggcucca

SEQ ID NO: 179700 - RNA, 22 nt, Human
cgcaccacugaauuccagccug

SEQ ID NO: 179701 - RNA, 19 nt, Human
agcuccugggcucugggcc

SEQ ID NO: 179702 - RNA, 19 nt, Human
gcuggcagauguggccgug

SEQ ID NO: 179703 - RNA, 22 nt, Human
cuguccuccagacgacaguccc

SEQ ID NO: 179704 - RNA, 22 nt, Human
auuccacagcucagccucucuu

SEQ ID NO: 179705 - RNA, 22 nt, Human
uucauaugcagauuaacaaaua

SEQ ID NO: 179706 - RNA, 22 nt, Human
uuucuguuguauggcuucugca

SEQ ID NO: 179707 - RNA, 22 nt, Human
ucugcagaauugucucaagcua

SEQ ID NO: 179708 - RNA, 22 nt, Human
cacaggcugcccgcagcuggga

SEQ ID NO: 179709 - RNA, 22 nt, Human
uagaaggcccauucauuuguuc

SEQ ID NO: 179710 - RNA, 22 nt, Human
agcaucuguuaagugccuucaa

SEQ ID NO: 179711 - RNA, 21 nt, Human
ugucacauugucccugcugcu

SEQ ID NO: 179712 - RNA, 22 nt, Human
ugcuuuaaaauggacuguuuug

SEQ ID NO: 179713 - RNA, 22 nt, Human
guggggguggaaaggcaaguug

SEQ ID NO: 179714 - RNA, 22 nt, Human
uuucaaagcaacugaaaaggaa

SEQ ID NO: 179715 - RNA, 22 nt, Human
aauauggcuccauuccuuuagg

SEQ ID NO: 179716 - RNA, 22 nt, Human
cagcauggacccaucgcugagu

SEQ ID NO: 179717 - RNA, 22 nt, Human
cuagcaucagaugagaagcugu

SEQ ID NO: 179718 - RNA, 22 nt, Human
agaagccacaggccucgucugg

SEQ ID NO: 179719 - RNA, 22 nt, Human
uacagugauuucuacugguguu

SEQ ID NO: 179720 - RNA, 19 nt, Human
ugaagcaggcagagaagau

SEQ ID NO: 179721 - RNA, 22 nt, Human
uagaacuguccaagucugagcu

SEQ ID NO: 179722 - RNA, 19 nt, Human
gccaggcuccauagccggc

SEQ ID NO: 179723 - RNA, 22 nt, Human
uaacaguaccauuaacuuugau

SEQ ID NO: 179724 - RNA, 22 nt, Human
ccaaugauggugcccacgauga

SEQ ID NO: 179725 - RNA, 19 nt, Human
ucaggaguuaguugugcuc

SEQ ID NO: 179726 - RNA, 23 nt, Human
guaacuggggaauuugagcuaug

SEQ ID NO: 179727 - RNA, 22 nt, Human
agaacuuuuggagacuuuuagu

SEQ ID NO: 179728 - RNA, 22 nt, Human
cagcuacagucugauugguuca

SEQ ID NO: 179729 - RNA, 22 nt, Human
ucaggcaggaucccagggaagg

SEQ ID NO: 179730 - RNA, 22 nt, Human
caauuuuuguacuuauaguacu

SEQ ID NO: 179731 - RNA, 22 nt, Human
ggcaggcaggucuucauggccc

SEQ ID NO: 179732 - RNA, 22 nt, Human
gaaaaugugccuuuggguauug

SEQ ID NO: 179733 - RNA, 22 nt, Human
uuaucacuuaugagcuuuuugc

SEQ ID NO: 179734 - RNA, 22 nt, Human
uuuuagcuguugauuguucccc

SEQ ID NO: 179735 - RNA, 22 nt, Human
uuagcuuucaugaaccuggucg

SEQ ID NO: 179736 - RNA, 22 nt, Human
ucugcaccucugaaauugguca

SEQ ID NO: 179737 - RNA, 20 nt, Human
ugguggagagaagcuauuug

SEQ ID NO: 179738 - RNA, 23 nt, Human
uugagcucaguagcucugcuggu

SEQ ID NO: 179739 - RNA, 22 nt, Human
gaggccagcgcgcagcacuuuu

SEQ ID NO: 179740 - RNA, 20 nt, Human
uagacuuuucaucaaccuua

SEQ ID NO: 179741 - RNA, 22 nt, Human
aggccucuguagggcccugaag

SEQ ID NO: 179742 - RNA, 22 nt, Human
uauauggauagugaucauaaga

SEQ ID NO: 179743 - RNA, 22 nt, Human
agccacccauucccgagcccua

SEQ ID NO: 179744 - RNA, 22 nt, Human
auacagagacacuugagacugg

SEQ ID NO: 179745 - RNA, 22 nt, Human
uuuguuuucuguaggccuuucc

SEQ ID NO: 179746 - RNA, 22 nt, Human
uguuuucuuccuaauugcucau

SEQ ID NO: 179747 - RNA, 18 nt, Human
cauaauuuucuuucuuua

SEQ ID NO: 179748 - RNA, 22 nt, Human
uuaaaugaacgagauaugcaac

SEQ ID NO: 179749 - RNA, 22 nt, Human
uugccagggcuuugguggcauc

SEQ ID NO: 179750 - RNA, 22 nt, Human
aguguguccagaaaucuguauu

SEQ ID NO: 179751 - RNA, 22 nt, Human
ccagagagaguacugggcucug

SEQ ID NO: 179752 - RNA, 22 nt, Human
ccagugugauuguugcaagaau

SEQ ID NO: 179753 - RNA, 22 nt, Human
cucuuaguaaugccaugaagca

SEQ ID NO: 179754 - RNA, 22 nt, Human
uccagagcuaauucagcagcug

SEQ ID NO: 179755 - RNA, 22 nt, Human
uauugguaucugagacagaguu

SEQ ID NO: 179756 - RNA, 22 nt, Human
acagugauugggguaucugcag

SEQ ID NO: 179757 - RNA, 23 nt, Human
cagcuccagugcacucagguagc

SEQ ID NO: 179758 - RNA, 22 nt, Human
ggagaugguggaagcuggugca

SEQ ID NO: 179759 - RNA, 22 nt, Human
aaugaauucugaagucuuccaa

SEQ ID NO: 179760 - RNA, 22 nt, Human
uucauugaaauacagucuugac

SEQ ID NO: 179761 - RNA, 22 nt, Human
gagcaggcucugccuguguguc

SEQ ID NO: 179762 - RNA, 22 nt, Human
gaugagcugucuagcuguugga

SEQ ID NO: 179763 - RNA, 22 nt, Human
ucugcaggugggccccuagaau

SEQ ID NO: 179764 - RNA, 22 nt, Human
gcaggagcagucaggggcagcu

SEQ ID NO: 179765 - RNA, 22 nt, Human
aagaaaacguuuugaggaguuu

SEQ ID NO: 179766 - RNA, 22 nt, Human
aaugccaucccucugucaccaa

SEQ ID NO: 179767 - RNA, 22 nt, Human
gacacaaaguuugucagaaauu

SEQ ID NO: 179768 - RNA, 22 nt, Human
ugcaggcuggggaggcagacuu

SEQ ID NO: 179769 - RNA, 22 nt, Human
cuccuucaugucauguguccgg

SEQ ID NO: 179770 - RNA, 22 nt, Human
ucagguggccaaaugggagcgc

SEQ ID NO: 179771 - RNA, 22 nt, Human
gucaaauauacuaagagguaaa

SEQ ID NO: 179772 - RNA, 22 nt, Human
caggcucccacaagcucccagc

SEQ ID NO: 179773 - RNA, 22 nt, Human
caaauaauuacuauccucacuu

SEQ ID NO: 179774 - RNA, 22 nt, Human
ggcaggguaugauuaccucuga

SEQ ID NO: 179775 - RNA, 22 nt, Human
ucuucaaaaaauauccaucagu

SEQ ID NO: 179776 - RNA, 22 nt, Human
cuaagaaaauagaagcaugcua

SEQ ID NO: 179777 - RNA, 22 nt, Human
agggaaugcuccguauaaaucu

SEQ ID NO: 179778 - RNA, 22 nt, Human
gggcugagugaccucaggccaa

SEQ ID NO: 179779 - RNA, 22 nt, Human
acagcuuuaguguggguggugc

SEQ ID NO: 179780 - RNA, 22 nt, Human
gagaagguggaccugaaggagc

SEQ ID NO: 179781 - RNA, 20 nt, Human
gugccuggagaagaggcugu

SEQ ID NO: 179782 - RNA, 22 nt, Human
cauuuucagcacccaucugaaa

SEQ ID NO: 179783 - RNA, 22 nt, Human
ugcagaggaccauuguccugga

SEQ ID NO: 179784 - RNA, 22 nt, Human
uccuggcauaauggcuuugcuc

SEQ ID NO: 179785 - RNA, 22 nt, Human
agugccaguuaauaagaaaugg

SEQ ID NO: 179786 - RNA, 22 nt, Human
gaaauguuugggaggagucaac

SEQ ID NO: 179787 - RNA, 22 nt, Human
aaccaccaccguaauuuaccca

SEQ ID NO: 179788 - RNA, 22 nt, Human
ggcaggaaaacaaugagccagg

SEQ ID NO: 179789 - RNA, 22 nt, Human
ugcagaagacacaagguaacgu

SEQ ID NO: 179790 - RNA, 22 nt, Human
uccugggguuuagagggaagug

SEQ ID NO: 179791 - RNA, 22 nt, Human
gcucugcccaaugucccuacac

SEQ ID NO: 179792 - RNA, 22 nt, Human
ucagggaaccucuccuguuucu

SEQ ID NO: 179793 - RNA, 22 nt, Human
cagcagaggugguucacauugu

SEQ ID NO: 179794 - RNA, 22 nt, Human
cugggccucacccuagaccaau

SEQ ID NO: 179795 - RNA, 23 nt, Human
agaggcaggaguggcuugcccgg

SEQ ID NO: 179796 - RNA, 22 nt, Human
gcagagcaccaaagugaaagau

SEQ ID NO: 179797 - RNA, 22 nt, Human
gggcuucucucaggggcaugag

SEQ ID NO: 179798 - RNA, 22 nt, Human
agaguuugggugggacagcuug

SEQ ID NO: 179799 - RNA, 22 nt, Human
uuuucauuuacauuagggaaga

SEQ ID NO: 179800 - RNA, 22 nt, Human
uuucaggauuuuaugagauagu

SEQ ID NO: 179801 - RNA, 22 nt, Human
cugagguagccauggcccaagu

SEQ ID NO: 179802 - RNA, 22 nt, Human
gucuuauuagguuaacccugcu

SEQ ID NO: 179803 - RNA, 22 nt, Human
ugcccucccacauuauggcugu

SEQ ID NO: 179804 - RNA, 22 nt, Human
ggccaugccugugggugcaggc

SEQ ID NO: 179805 - RNA, 22 nt, Human
cagucccagacccagaaggugg

SEQ ID NO: 179806 - RNA, 22 nt, Human
ggagcagagcucuucaucugca

SEQ ID NO: 179807 - RNA, 22 nt, Human
cuccaggacagauucagggcca

SEQ ID NO: 179808 - RNA, 22 nt, Human
agacagagauacuauguuguca

SEQ ID NO: 179809 - RNA, 22 nt, Human
aucuaagagagagagcaugucu

SEQ ID NO: 179810 - RNA, 22 nt, Human
ugcucuccugcuccucagccca

SEQ ID NO: 179811 - RNA, 22 nt, Human
ugcuggagaaaguuuuucugaa

SEQ ID NO: 179812 - RNA, 22 nt, Human
agguagaggccuccaggcagca

SEQ ID NO: 179813 - RNA, 16 nt, Human
caggugucagucaccu

SEQ ID NO: 179814 - RNA, 22 nt, Human
gauuagaaugggaagauacaag

SEQ ID NO: 179815 - RNA, 22 nt, Human
cagccaucccagccugugguuc

SEQ ID NO: 179816 - RNA, 22 nt, Human
uguaaguuuugugaaacaaaca

SEQ ID NO: 179817 - RNA, 22 nt, Human
uuccaauaaaauguuauuugca

SEQ ID NO: 179818 - RNA, 22 nt, Human
gggagagaauuauugccagacc

SEQ ID NO: 179819 - RNA, 22 nt, Human
aaugccaaugggcagaacuaga

SEQ ID NO: 179820 - RNA, 22 nt, Human
gcagaugguggggcaggaaaau

SEQ ID NO: 179821 - RNA, 22 nt, Human
augcuggggccucagaccagaa

SEQ ID NO: 179822 - RNA, 22 nt, Human
cugggcagaguccggaagaugg

SEQ ID NO: 179823 - RNA, 22 nt, Human
uuacacagaugguuaguagagg

SEQ ID NO: 179824 - RNA, 22 nt, Human
cauucacagagggggaagcauc

SEQ ID NO: 179825 - RNA, 22 nt, Human
ugccugugaaaacccugggguu

SEQ ID NO: 179826 - RNA, 22 nt, Human
aauuccucuaucuuucuucaag

SEQ ID NO: 179827 - RNA, 22 nt, Human
caggagcuucugcccauggcca

SEQ ID NO: 179828 - RNA, 22 nt, Human
gucuccagauauccuacacaac

SEQ ID NO: 179829 - RNA, 22 nt, Human
ucuccuggagcaggaagguggg

SEQ ID NO: 179830 - RNA, 22 nt, Human
uccuagaauagugugucuggag

SEQ ID NO: 179831 - RNA, 22 nt, Human
aguccugucaccucuacuuucg

SEQ ID NO: 179832 - RNA, 23 nt, Human
agagcaucaugaugcuaagucug

SEQ ID NO: 179833 - RNA, 22 nt, Human
acaguuuacagggauuugagcu

SEQ ID NO: 179834 - RNA, 22 nt, Human
uuacugaggguguaucuuagug

SEQ ID NO: 179835 - RNA, 21 nt, Human
ggacagcugcgcgcagggcuc

SEQ ID NO: 179836 - RNA, 22 nt, Human
cuacuguuguguuuuaaaggua

SEQ ID NO: 179837 - RNA, 22 nt, Human
cagguagguauggugcagucuu

SEQ ID NO: 179838 - RNA, 22 nt, Human
uaaaugagauguacauaacuca

SEQ ID NO: 179839 - RNA, 22 nt, Human
ucagagagguuggugauaagaa

SEQ ID NO: 179840 - RNA, 22 nt, Human
agcacuuuccuggcaaaugugg

SEQ ID NO: 179841 - RNA, 18 nt, Human
guaggucaguaccaagca

SEQ ID NO: 179842 - RNA, 18 nt, Human
agcagguggcgucugcag

SEQ ID NO: 179843 - RNA, 22 nt, Human
uggggaaggcggagcuugcagc

SEQ ID NO: 179844 - RNA, 22 nt, Human
agagaacaaauuaaaggugguu

SEQ ID NO: 179845 - RNA, 22 nt, Human
uccccucccuuccaacagagcu

SEQ ID NO: 179846 - RNA, 22 nt, Human
ucccagcccagauuugugugac

SEQ ID NO: 179847 - RNA, 22 nt, Human
gaguuaaaagcccucucagcag

SEQ ID NO: 179848 - RNA, 22 nt, Human
ccugcucccgggacgcguucac

SEQ ID NO: 179849 - RNA, 22 nt, Human
auaugagagaggaaagauuuua

SEQ ID NO: 179850 - RNA, 22 nt, Human
acuggcaguggcagcagaaaga

SEQ ID NO: 179851 - RNA, 22 nt, Human
uguuccugaggcaugugucaau

SEQ ID NO: 179852 - RNA, 22 nt, Human
cagguaguccacagugagggag

SEQ ID NO: 179853 - RNA, 22 nt, Human
cacaggacucgacugcagacag

SEQ ID NO: 179854 - RNA, 22 nt, Human
uaugaguuguggcuuagucaca

SEQ ID NO: 179855 - RNA, 22 nt, Human
agaaggcucauuugacugcauu

SEQ ID NO: 179856 - RNA, 22 nt, Human
ugcacacacaggagucuccucc

SEQ ID NO: 179857 - RNA, 22 nt, Human
aauugcuuaguugcaacuaugc

SEQ ID NO: 179858 - RNA, 22 nt, Human
uuucucuggccucaguuuaaca

SEQ ID NO: 179859 - RNA, 22 nt, Human
uaaggcuuauauacuuagacau

SEQ ID NO: 179860 - RNA, 22 nt, Human
agguaaauucagcagugacauu

SEQ ID NO: 179861 - RNA, 22 nt, Human
guggcugggcuccgagcggcuu

SEQ ID NO: 179862 - RNA, 22 nt, Human
uacauucauaugugugcauaca

SEQ ID NO: 179863 - RNA, 22 nt, Human
aaaggacugaugcugaguaccu

SEQ ID NO: 179864 - RNA, 22 nt, Human
cuggcuuucugcacagaauugg

SEQ ID NO: 179865 - RNA, 22 nt, Human
ggucacaugguugagcuugauc

SEQ ID NO: 179866 - RNA, 22 nt, Human
gucagagcugugcaaggcugag

SEQ ID NO: 179867 - RNA, 22 nt, Human
uuucaauguaugucuuucugag

SEQ ID NO: 179868 - RNA, 22 nt, Human
aagggaugcaggaaagaagguu

SEQ ID NO: 179869 - RNA, 22 nt, Human
uaugcauagguaucuauacuca

SEQ ID NO: 179870 - RNA, 22 nt, Human
ugcugaggaauuugguuuaugu

SEQ ID NO: 179871 - RNA, 22 nt, Human
ccagggcaacgcugucucagag

SEQ ID NO: 179872 - RNA, 22 nt, Human
uuuauauugggagucguuuuga

SEQ ID NO: 179873 - RNA, 22 nt, Human
ucucaaaucaaacuuugagcuu

SEQ ID NO: 179874 - RNA, 22 nt, Human
aacaggcuccuugugaauggau

SEQ ID NO: 179875 - RNA, 22 nt, Human
ucuugggauugcccugcaguuc

SEQ ID NO: 179876 - RNA, 22 nt, Human
ugggacagugaccccagagguc

SEQ ID NO: 179877 - RNA, 20 nt, Human
aggcugccaggucucacauc

SEQ ID NO: 179878 - RNA, 22 nt, Human
ccaggucucgggucugcucgug

SEQ ID NO: 179879 - RNA, 22 nt, Human
cucaacaugccuacucagucug

SEQ ID NO: 179880 - RNA, 22 nt, Human
agugcuggcccauagcugcugg

SEQ ID NO: 179881 - RNA, 22 nt, Human
acuucucuuccccggaacucua

SEQ ID NO: 179882 - RNA, 20 nt, Human
cagcagagacccauggggag

SEQ ID NO: 179883 - RNA, 22 nt, Human
caggcaccacacuaggggcuga

SEQ ID NO: 179884 - RNA, 22 nt, Human
ccagugcaccauuucccucugu

SEQ ID NO: 179885 - RNA, 22 nt, Human
aagcugaagacacagcuccagu

SEQ ID NO: 179886 - RNA, 22 nt, Human
gacacagucaagaguggaggaa

SEQ ID NO: 179887 - RNA, 22 nt, Human
ggcccugggaugcucagcagug

SEQ ID NO: 179888 - RNA, 21 nt, Human
guggagagugauuuugaugca

SEQ ID NO: 179889 - RNA, 22 nt, Human
cacuguaauagcauuauaagug

SEQ ID NO: 179890 - RNA, 22 nt, Human
aauguguuuuaugagagaauau

SEQ ID NO: 179891 - RNA, 22 nt, Human
uagauucucccaucaugagaug

SEQ ID NO: 179892 - RNA, 22 nt, Human
gggcugagggguaucucauggg

SEQ ID NO: 179893 - RNA, 22 nt, Human
uuugacuucuaucuaguaagaa

SEQ ID NO: 179894 - RNA, 22 nt, Human
aagcaauucacaguucacuuaa

SEQ ID NO: 179895 - RNA, 22 nt, Human
gaaaagcuuacugccacuuggc

SEQ ID NO: 179896 - RNA, 23 nt, Human
gaggccuggcccugccacaucuc

SEQ ID NO: 179897 - RNA, 22 nt, Human
aguuuucuguucuacaauuuga

SEQ ID NO: 179898 - RNA, 22 nt, Human
aggucugggcaccacuggcugc

SEQ ID NO: 179899 - RNA, 20 nt, Human
ugcucaggauggagaggugu

SEQ ID NO: 179900 - RNA, 22 nt, Human
acacuagcuauuaacuucacau

SEQ ID NO: 179901 - RNA, 22 nt, Human
aaacacaucauucaugucguca

SEQ ID NO: 179902 - RNA, 22 nt, Human
ucaggaaagaguguauccauca

SEQ ID NO: 179903 - RNA, 20 nt, Human
caccaggcgcucugagaaca

SEQ ID NO: 179904 - RNA, 22 nt, Human
gcuauugugacagcuuuucgcc

SEQ ID NO: 179905 - RNA, 22 nt, Human
uuccugugccucaggucucagc

SEQ ID NO: 179906 - RNA, 22 nt, Human
caaggccacuccagagacuggu

SEQ ID NO: 179907 - RNA, 21 nt, Human
uuggaaucucuucaucucugc

SEQ ID NO: 179908 - RNA, 22 nt, Human
aacuagaaaaagacuuucugag

SEQ ID NO: 179909 - RNA, 22 nt, Human
aucuggcuuacgaagcacuggu

SEQ ID NO: 179910 - RNA, 22 nt, Human
cugcacaguguuggaagcugcc

SEQ ID NO: 179911 - RNA, 22 nt, Human
cacgcgcacacucaggucaagu

SEQ ID NO: 179912 - RNA, 20 nt, Human
gaaauacuuacccaacuguu

SEQ ID NO: 179913 - RNA, 22 nt, Human
cugcacagcuggccagggagag

SEQ ID NO: 179914 - RNA, 22 nt, Human
aaagaaggaugggagaaauccu

SEQ ID NO: 179915 - RNA, 22 nt, Human
uggcucaggagggaucuuugcu

SEQ ID NO: 179916 - RNA, 22 nt, Human
caacaauaugcugaguuuuuca

SEQ ID NO: 179917 - RNA, 22 nt, Human
cugcaucaguggauaugauggu

SEQ ID NO: 179918 - RNA, 22 nt, Human
uucccucugcgcauugaauuuc

SEQ ID NO: 179919 - RNA, 22 nt, Human
uuggcaccucccuaggaagaag

SEQ ID NO: 179920 - RNA, 21 nt, Human
ugaggcucuguugugccugca

SEQ ID NO: 179921 - RNA, 22 nt, Human
auacuucuuuagcauauugaac

SEQ ID NO: 179922 - RNA, 17 nt, Human
gucagcagcuugcuugu

SEQ ID NO: 179923 - RNA, 22 nt, Human
ugcagggauuguuggcauccau

SEQ ID NO: 179924 - RNA, 22 nt, Human
agcauauaggaaauguugaauc

SEQ ID NO: 179925 - RNA, 21 nt, Human
aagaugauauuuuaucuguag

SEQ ID NO: 179926 - RNA, 22 nt, Human
gacaagcucuuguuucaugguu

SEQ ID NO: 179927 - RNA, 17 nt, Human
ugcauguccuuuguucc

SEQ ID NO: 179928 - RNA, 22 nt, Human
ggcaccagccaccuauuucuag

SEQ ID NO: 179929 - RNA, 22 nt, Human
uuauuuaaaagugguaagauuc

SEQ ID NO: 179930 - RNA, 22 nt, Human
ggcacagccacuuuggagaacu

SEQ ID NO: 179931 - RNA, 22 nt, Human
gggagagaaauuauagcaauga

SEQ ID NO: 179932 - RNA, 21 nt, Human
uacagaaugcgcuucagucug

SEQ ID NO: 179933 - RNA, 22 nt, Human
gcuuuagagcccagcuuggugg

SEQ ID NO: 179934 - RNA, 22 nt, Human
uuguugcucuuguugccacaug

SEQ ID NO: 179935 - RNA, 22 nt, Human
gacccuggcagauaccgucaca

SEQ ID NO: 179936 - RNA, 22 nt, Human
aguuagcagcuuauuagaaaca

SEQ ID NO: 179937 - RNA, 22 nt, Human
ugcugcagcagugcgggcagcu

SEQ ID NO: 179938 - RNA, 20 nt, Human
ugaaggugacuccuuucuug

SEQ ID NO: 179939 - RNA, 22 nt, Human
gagcuccuauggucgguggcuc

SEQ ID NO: 179940 - RNA, 22 nt, Human
cuugccaaauuaacauacagaa

SEQ ID NO: 179941 - RNA, 22 nt, Human
gggcucauucaucugggcuugg

SEQ ID NO: 179942 - RNA, 22 nt, Human
guuuccugcgugugccacucau

SEQ ID NO: 179943 - RNA, 22 nt, Human
aacaaaucuuaaaguaauucaa

SEQ ID NO: 179944 - RNA, 22 nt, Human
gcucaggcauguaugugguugc

SEQ ID NO: 179945 - RNA, 17 nt, Human
cuucucuggcagaagau

SEQ ID NO: 179946 - RNA, 22 nt, Human
acagacuggagcccuuuugccc

SEQ ID NO: 179947 - RNA, 22 nt, Human
gaugcugagcuguauggcuggu

SEQ ID NO: 179948 - RNA, 22 nt, Human
cagccgucagaugugccgcagc

SEQ ID NO: 179949 - RNA, 22 nt, Human
caccauuuaagaaagccaaauu

SEQ ID NO: 179950 - RNA, 22 nt, Human
gaacaauacaggcuuuauuccu

SEQ ID NO: 179951 - RNA, 22 nt, Human
ggggcagaguagcuggggugug

SEQ ID NO: 179952 - RNA, 22 nt, Human
ggcucuuguucguaccauggcu

SEQ ID NO: 179953 - RNA, 22 nt, Human
acugguggcuuucagacagaaa

SEQ ID NO: 179954 - RNA, 22 nt, Human
cacauuuaagcagauguggacc

SEQ ID NO: 179955 - RNA, 22 nt, Human
gcucccucccaccagccugcag

SEQ ID NO: 179956 - RNA, 22 nt, Human
acccugggugagaggcaaacag

SEQ ID NO: 179957 - RNA, 23 nt, Human
uuugcaaauuggacacaaccaca

SEQ ID NO: 179958 - RNA, 19 nt, Human
ggcuccuggggcucagccc

SEQ ID NO: 179959 - RNA, 22 nt, Human
cagggccaugaggcacaggguc

SEQ ID NO: 179960 - RNA, 22 nt, Human
uccaggagauacacugcaccag

SEQ ID NO: 179961 - RNA, 22 nt, Human
uuccagccuuuauccauccaga

SEQ ID NO: 179962 - RNA, 22 nt, Human
aacaaguuacucuuaaaguaua

SEQ ID NO: 179963 - RNA, 22 nt, Human
uauuacagcuuugauuaucugg

SEQ ID NO: 179964 - RNA, 22 nt, Human
ugccaggcccucccacagauua

SEQ ID NO: 179965 - RNA, 22 nt, Human
gaggugaugguugcacaaugcu

SEQ ID NO: 179966 - RNA, 22 nt, Human
cagagcagugaggaguugugua

SEQ ID NO: 179967 - RNA, 22 nt, Human
aaagccaggcagccaagccagu

SEQ ID NO: 179968 - RNA, 22 nt, Human
gcuuuuggccagauggggaaac

SEQ ID NO: 179969 - RNA, 22 nt, Human
aagagcauggaauggagaucca

SEQ ID NO: 179970 - RNA, 19 nt, Human
cgcagguggaaggagccgc

SEQ ID NO: 179971 - RNA, 22 nt, Human
ucaggagcaacaucuuugaauc

SEQ ID NO: 179972 - RNA, 16 nt, Human
auaauuacugcuacuu

SEQ ID NO: 179973 - RNA, 23 nt, Human
uagggcagcugggagggacaugc

SEQ ID NO: 179974 - RNA, 22 nt, Human
ugagaaaauuacuauaauuguc

SEQ ID NO: 179975 - RNA, 20 nt, Human
cuacacuuggcaccuggcau

SEQ ID NO: 179976 - RNA, 22 nt, Human
auacaacuuuacaugcaauucc

SEQ ID NO: 179977 - RNA, 21 nt, Human
agcagaggggacauguuugau

SEQ ID NO: 179978 - RNA, 22 nt, Human
gaggcuucuggaaagccuggca

SEQ ID NO: 179979 - RNA, 22 nt, Human
guggcauugacauguaaacagu

SEQ ID NO: 179980 - RNA, 22 nt, Human
uccuggaggcacucgcuggggc

SEQ ID NO: 179981 - RNA, 20 nt, Human
guuaggagguuggacaugga

SEQ ID NO: 179982 - RNA, 22 nt, Human
gcucugggccgggcaccagccu

SEQ ID NO: 179983 - RNA, 22 nt, Human
augcagggucuccgugugacga

SEQ ID NO: 179984 - RNA, 21 nt, Human
uccucugcagugagguggccu

SEQ ID NO: 179985 - RNA, 22 nt, Human
auucagugugagguuuucaagu

SEQ ID NO: 179986 - RNA, 22 nt, Human
uucucagaauugacugggagca

SEQ ID NO: 179987 - RNA, 22 nt, Human
auuucucaucuuugugaauggu

SEQ ID NO: 179988 - RNA, 22 nt, Human
guggcugcuguccucucugguu

SEQ ID NO: 179989 - RNA, 20 nt, Human
uaaaggcugugagguggccc

SEQ ID NO: 179990 - RNA, 22 nt, Human
accccagggcugccagccuccu

SEQ ID NO: 179991 - RNA, 22 nt, Human
ggagaguggauuccagcuguau

SEQ ID NO: 179992 - RNA, 22 nt, Human
agaaauuaggaaaguaacacuu

SEQ ID NO: 179993 - RNA, 22 nt, Human
uuaagacaguguauuuguuuuc

SEQ ID NO: 179994 - RNA, 22 nt, Human
ucuguaccucacaugcaccauc

SEQ ID NO: 179995 - RNA, 22 nt, Human
aagucucuuuaccucuccaggc

SEQ ID NO: 179996 - RNA, 22 nt, Human
agcagcaucugguucugaugug

SEQ ID NO: 179997 - RNA, 22 nt, Human
aggacucacauagcuucagaug

SEQ ID NO: 179998 - RNA, 22 nt, Human
cugaugccccuggaccugugac

SEQ ID NO: 179999 - RNA, 22 nt, Human
uggcuugguccuggcccuuccc

SEQ ID NO: 180000 - RNA, 22 nt, Human
agccucagugucaccaucuacc

SEQ ID NO: 180001 - RNA, 22 nt, Human
agcuguguagggaaucagagaa

SEQ ID NO: 180002 - RNA, 22 nt, Human
ucauuuguugcuguuaccugag

SEQ ID NO: 180003 - RNA, 22 nt, Human
agacaauauauaauuuuaguug

SEQ ID NO: 180004 - RNA, 22 nt, Human
uuggggaaggcuucccuguacc

SEQ ID NO: 180005 - RNA, 22 nt, Human
aucaggaucugggagccugaaa

SEQ ID NO: 180006 - RNA, 22 nt, Human
ugcuccagccuaugcucuccgg

SEQ ID NO: 180007 - RNA, 22 nt, Human
uaaggcaguuuugccugagaua

SEQ ID NO: 180008 - RNA, 22 nt, Human
uuaucugaaaaccucaaaauau

SEQ ID NO: 180009 - RNA, 22 nt, Human
gcuuuacauuuuggaaagguga

SEQ ID NO: 180010 - RNA, 22 nt, Human
ugagguggcacacacuuccugc

SEQ ID NO: 180011 - RNA, 22 nt, Human
ugcaacaggagaguucagggca

SEQ ID NO: 180012 - RNA, 23 nt, Human
ggggacaguucccacuggggucu

SEQ ID NO: 180013 - RNA, 22 nt, Human
ggcuagaguggaacuggagcgg

SEQ ID NO: 180014 - RNA, 22 nt, Human
agcuucugcccguguuugcucu

SEQ ID NO: 180015 - RNA, 22 nt, Human
ccccaaggugcucacugucugg

SEQ ID NO: 180016 - RNA, 22 nt, Human
gacaaacugaaguauauuuaga

SEQ ID NO: 180017 - RNA, 22 nt, Human
cuaucuuuuguucauuuugagu

SEQ ID NO: 180018 - RNA, 22 nt, Human
gcuguggaaaugccuaacauga

SEQ ID NO: 180019 - RNA, 22 nt, Human
caagaauuguacaaacugggug

SEQ ID NO: 180020 - RNA, 22 nt, Human
agggccuugcugucugaagcug

SEQ ID NO: 180021 - RNA, 22 nt, Human
guggaggagaggcgccuugcgg

SEQ ID NO: 180022 - RNA, 22 nt, Human
uuuaguuauugcacagaauuag

SEQ ID NO: 180023 - RNA, 22 nt, Human
ccauggcauuuuaugugucuua

SEQ ID NO: 180024 - RNA, 22 nt, Human
uaggaaauacuguaaguuuggg

SEQ ID NO: 180025 - RNA, 22 nt, Human
auuuuagauuuaagaauaaggu

SEQ ID NO: 180026 - RNA, 22 nt, Human
uuugcauuaguuuagauuucaa

SEQ ID NO: 180027 - RNA, 22 nt, Human
agccacugugugaccagcuguc

SEQ ID NO: 180028 - RNA, 21 nt, Human
uucaguuucuuccucaucuau

SEQ ID NO: 180029 - RNA, 22 nt, Human
ugaggcaagcugggcccaugga

SEQ ID NO: 180030 - RNA, 22 nt, Human
ucugauuagagcauucuugagu

SEQ ID NO: 180031 - RNA, 22 nt, Human
cugcuccuggucauccuccacu

SEQ ID NO: 180032 - RNA, 22 nt, Human
cauugcaacuucaaacuccugg

SEQ ID NO: 180033 - RNA, 14 nt, Human
uccacaucagcagu

SEQ ID NO: 180034 - RNA, 22 nt, Human
gacagguugaaguaucaaaggu

SEQ ID NO: 180035 - RNA, 22 nt, Human
gggcuucuguuccuuucacuug

SEQ ID NO: 180036 - RNA, 22 nt, Human
agguggagacccagagaaggcg

SEQ ID NO: 180037 - RNA, 22 nt, Human
agcugccacagagccuggccag

SEQ ID NO: 180038 - RNA, 22 nt, Human
ggcugcaaaggaaaagugguga

SEQ ID NO: 180039 - RNA, 22 nt, Human
ccaggccccagggcuggcuuuc

SEQ ID NO: 180040 - RNA, 22 nt, Human
ccugguggaaggugagugaggc

SEQ ID NO: 180041 - RNA, 22 nt, Human
uuuucauuuuuguagaugcaag

SEQ ID NO: 180042 - RNA, 22 nt, Human
augaggagcuguuuuaacugcu

SEQ ID NO: 180043 - RNA, 23 nt, Human
acagugugguggacaaggagcag

SEQ ID NO: 180044 - RNA, 22 nt, Human
aaguggcagccuuagaaggaga

SEQ ID NO: 180045 - RNA, 22 nt, Human
cuggaggggccauccacagucu

SEQ ID NO: 180046 - RNA, 22 nt, Human
ccugguggagaggggcggagcg

SEQ ID NO: 180047 - RNA, 22 nt, Human
gggcucugggucgugucuccau

SEQ ID NO: 180048 - RNA, 22 nt, Human
ugcuuuauugcaucaguguggg

SEQ ID NO: 180049 - RNA, 22 nt, Human
aaagccaucaguaaaaugauuu

SEQ ID NO: 180050 - RNA, 22 nt, Human
aaagugggaacaauggagagug

SEQ ID NO: 180051 - RNA, 22 nt, Human
cccagugucuccaacaucagau

SEQ ID NO: 180052 - RNA, 22 nt, Human
aaacacguauaaugugacagag

SEQ ID NO: 180053 - RNA, 22 nt, Human
ggucuagaugaaauuaaauguu

SEQ ID NO: 180054 - RNA, 22 nt, Human
uucauugaaggagggacuugcu

SEQ ID NO: 180055 - RNA, 22 nt, Human
acaucucuggguccuccaugca

SEQ ID NO: 180056 - RNA, 18 nt, Human
ccagcaugccagaggcug

SEQ ID NO: 180057 - RNA, 22 nt, Human
cuuuuguuaggagaaaacauca

SEQ ID NO: 180058 - RNA, 22 nt, Human
agcaggugggaucaagcuggca

SEQ ID NO: 180059 - RNA, 22 nt, Human
augcuguggggagugaggguag

SEQ ID NO: 180060 - RNA, 22 nt, Human
ucuggagaagcccagggagcug

SEQ ID NO: 180061 - RNA, 22 nt, Human
cccaaggccuucaagccagcuc

SEQ ID NO: 180062 - RNA, 22 nt, Human
ugggcaggaugcguugauucuu

SEQ ID NO: 180063 - RNA, 22 nt, Human
ucuguuaucucaagucacaaga

SEQ ID NO: 180064 - RNA, 22 nt, Human
cagggcuggauccuccagacuc

SEQ ID NO: 180065 - RNA, 22 nt, Human
cagcaugaucccaguugauugc

SEQ ID NO: 180066 - RNA, 22 nt, Human
uauuuaacuggaaacacaauga

SEQ ID NO: 180067 - RNA, 22 nt, Human
gaggaggggcacuugucuccua

SEQ ID NO: 180068 - RNA, 20 nt, Human
uccugcagucgcuagcgccc

SEQ ID NO: 180069 - RNA, 22 nt, Human
aauaccuuccaacaucaagaca

SEQ ID NO: 180070 - RNA, 22 nt, Human
gggugcagcagagcuccucugu

SEQ ID NO: 180071 - RNA, 22 nt, Human
ccagcagaggggcggagugcag

SEQ ID NO: 180072 - RNA, 22 nt, Human
ggcuggcuugcggagucacaga

SEQ ID NO: 180073 - RNA, 22 nt, Human
ucccugggccuccugcuaugca

SEQ ID NO: 180074 - RNA, 22 nt, Human
aguaacaaaugcaucugggcau

SEQ ID NO: 180075 - RNA, 22 nt, Human
agcacagaauggcuuggaagcc

SEQ ID NO: 180076 - RNA, 22 nt, Human
ucuccagguggggucaccuuuu

SEQ ID NO: 180077 - RNA, 22 nt, Human
caggccacacggcggcucccug

SEQ ID NO: 180078 - RNA, 22 nt, Human
aaugcuguccaauaggaacaua

SEQ ID NO: 180079 - RNA, 22 nt, Human
cagauaauaauaugacuucacu

SEQ ID NO: 180080 - RNA, 19 nt, Human
augucacucauguucccug

SEQ ID NO: 180081 - RNA, 23 nt, Human
ucucaaaucuuugcguuguaucu

SEQ ID NO: 180082 - RNA, 22 nt, Human
uguccuuuguguaucuauagua

SEQ ID NO: 180083 - RNA, 22 nt, Human
agcuccuguggcagcucuucug

SEQ ID NO: 180084 - RNA, 22 nt, Human
uacacauguauuuauguguaca

SEQ ID NO: 180085 - RNA, 22 nt, Human
caguuucuguuuuaaauagcag

SEQ ID NO: 180086 - RNA, 18 nt, Human
ucagaggagauaccuaaa

SEQ ID NO: 180087 - RNA, 22 nt, Human
ggcaggcacuguguuuuguguu

SEQ ID NO: 180088 - RNA, 23 nt, Human
cagaggugucagugcccaguguc

SEQ ID NO: 180089 - RNA, 22 nt, Human
uucguuuaguccacaaaugcau

SEQ ID NO: 180090 - RNA, 22 nt, Human
auaccauuuccauguuacauua

SEQ ID NO: 180091 - RNA, 23 nt, Human
gguggcaggaguggaugcugagc

SEQ ID NO: 180092 - RNA, 17 nt, Human
cagugaggccuuuccuc

SEQ ID NO: 180093 - RNA, 22 nt, Human
ccugucucuuucaaucugagag

SEQ ID NO: 180094 - RNA, 22 nt, Human
uggauuuccagacagcuuaauu

SEQ ID NO: 180095 - RNA, 22 nt, Human
uagcuucuugagaaagggugcc

SEQ ID NO: 180096 - RNA, 22 nt, Human
agccacagucaaccuguccaua

SEQ ID NO: 180097 - RNA, 22 nt, Human
cuggacucauccauagagguga

SEQ ID NO: 180098 - RNA, 22 nt, Human
cacaggugcuccucggggagcu

SEQ ID NO: 180099 - RNA, 22 nt, Human
aggccugggcaagaaggggcgu

SEQ ID NO: 180100 - RNA, 22 nt, Human
gcagcucaguaaaagaggagca

SEQ ID NO: 180101 - RNA, 22 nt, Human
uuuugauaucaugaugaacaga

SEQ ID NO: 180102 - RNA, 22 nt, Human
guuuuccugagcccagagaugc

SEQ ID NO: 180103 - RNA, 22 nt, Human
aguggcagaucucuggucugga

SEQ ID NO: 180104 - RNA, 22 nt, Human
auuuguuccaugaguaaggcua

SEQ ID NO: 180105 - RNA, 22 nt, Human
ucagguguucuccacucaguuu

SEQ ID NO: 180106 - RNA, 22 nt, Human
gccaggugggagacagacagca

SEQ ID NO: 180107 - RNA, 22 nt, Human
ccuuuauacuaaggcauacaau

SEQ ID NO: 180108 - RNA, 22 nt, Human
cuguggaaucaucaggucuuac

SEQ ID NO: 180109 - RNA, 22 nt, Human
ccucugggggcuuccuuacccu

SEQ ID NO: 180110 - RNA, 22 nt, Human
ccugcugugugacgggauguua

SEQ ID NO: 180111 - RNA, 22 nt, Human
cuuugcugccagaacccagcag

SEQ ID NO: 180112 - RNA, 22 nt, Human
uagcuucuaauacuuaccaauu

SEQ ID NO: 180113 - RNA, 22 nt, Human
cagggcuuugaacaggcaucaa

SEQ ID NO: 180114 - RNA, 22 nt, Human
cugaggcagagaaugaguuugu

SEQ ID NO: 180115 - RNA, 22 nt, Human
cuccccacgccuggacuaagag

SEQ ID NO: 180116 - RNA, 22 nt, Human
acaucuuuuacucugguucggg

SEQ ID NO: 180117 - RNA, 22 nt, Human
agaaaaguuuaaaucuuggcac

SEQ ID NO: 180118 - RNA, 22 nt, Human
uaacuucuggaaaugcaucugc

SEQ ID NO: 180119 - RNA, 22 nt, Human
uccugagggcgauucagcaggu

SEQ ID NO: 180120 - RNA, 22 nt, Human
aauaauaagauacuaagggagu

SEQ ID NO: 180121 - RNA, 22 nt, Human
guggggaggccuaagcaaguug

SEQ ID NO: 180122 - RNA, 22 nt, Human
ccacccagcagaggaggcaaga

SEQ ID NO: 180123 - RNA, 22 nt, Human
ucauguuauugacucauaauau

SEQ ID NO: 180124 - RNA, 22 nt, Human
ggccauggaccccgagcugacc

SEQ ID NO: 180125 - RNA, 22 nt, Human
aucucagacauguuguccauga

SEQ ID NO: 180126 - RNA, 22 nt, Human
uagacacaaaucucagugacac

SEQ ID NO: 180127 - RNA, 22 nt, Human
gcaguggccacauggaggagga

SEQ ID NO: 180128 - RNA, 22 nt, Human
ucagugaaaugcauauucuucg

SEQ ID NO: 180129 - RNA, 22 nt, Human
agggauggcaaguuaaccugag

SEQ ID NO: 180130 - RNA, 22 nt, Human
ucugaaauggggcugaagcacu

SEQ ID NO: 180131 - RNA, 22 nt, Human
aauaguuaagcaacuuuuucca

SEQ ID NO: 180132 - RNA, 22 nt, Human
auguugaguggaugaacaaaca

SEQ ID NO: 180133 - RNA, 22 nt, Human
ccucacugaagaggugacauuu

SEQ ID NO: 180134 - RNA, 22 nt, Human
ucuuuugugauucuucaguuac

SEQ ID NO: 180135 - RNA, 22 nt, Human
guuguaaauacaguacugaaac

SEQ ID NO: 180136 - RNA, 22 nt, Human
uuccugugaaauauagguccau

SEQ ID NO: 180137 - RNA, 22 nt, Human
gggccugaggcccagacacugg

SEQ ID NO: 180138 - RNA, 22 nt, Human
aagcuacauuaagcagauuuac

SEQ ID NO: 180139 - RNA, 18 nt, Human
ugcuuggagcauuuacca

SEQ ID NO: 180140 - RNA, 19 nt, Human
aggcagaggcuuggcuagc

SEQ ID NO: 180141 - RNA, 22 nt, Human
uuuacagagaauguacauaaag

SEQ ID NO: 180142 - RNA, 21 nt, Human
cugccaccugcuccaucagca

SEQ ID NO: 180143 - RNA, 22 nt, Human
uggcuucucaguuucauaauga

SEQ ID NO: 180144 - RNA, 22 nt, Human
aguggcugacaacuggguuaac

SEQ ID NO: 180145 - RNA, 22 nt, Human
uacaucauggcuucaugcugca

SEQ ID NO: 180146 - RNA, 22 nt, Human
cucuguggaagaagaaagaagg

SEQ ID NO: 180147 - RNA, 23 nt, Human
cccuggccuuggggcacaggcug

SEQ ID NO: 180148 - RNA, 22 nt, Human
cagacacacaagcaaucuaagu

SEQ ID NO: 180149 - RNA, 22 nt, Human
aggcucucuagaaacugugccu

SEQ ID NO: 180150 - RNA, 22 nt, Human
gcuggcuuuauggggcuugugg

SEQ ID NO: 180151 - RNA, 22 nt, Human
uggcuucuaaaguuucuuuuag

SEQ ID NO: 180152 - RNA, 22 nt, Human
uaaggacauugguuuugaguaa

SEQ ID NO: 180153 - RNA, 22 nt, Human
ggaaaaaugacacauaucucaa

SEQ ID NO: 180154 - RNA, 22 nt, Human
uuucucuucacugugugccuca

SEQ ID NO: 180155 - RNA, 22 nt, Human
aucuuuagucaggcguggguau

SEQ ID NO: 180156 - RNA, 22 nt, Human
aggagccaugagugacaucaca

SEQ ID NO: 180157 - RNA, 22 nt, Human
acagugauuggcacugauucag

SEQ ID NO: 180158 - RNA, 22 nt, Human
aagacucuguaucaugagggag

SEQ ID NO: 180159 - RNA, 22 nt, Human
uuaggaaauuccaccuguauuc

SEQ ID NO: 180160 - RNA, 22 nt, Human
aaucuauaugcuuuucacauac

SEQ ID NO: 180161 - RNA, 22 nt, Human
cuugaaagcuuugcgucuucua

SEQ ID NO: 180162 - RNA, 19 nt, Human
ggauucugcaguuuucaca

SEQ ID NO: 180163 - RNA, 22 nt, Human
ugacggcugggggcagugguca

SEQ ID NO: 180164 - RNA, 22 nt, Human
aagccuccuuauuaaaggauau

SEQ ID NO: 180165 - RNA, 23 nt, Human
ugguccugguugaggugggcccc

SEQ ID NO: 180166 - RNA, 22 nt, Human
uuaucugucuaucaagacuagc

SEQ ID NO: 180167 - RNA, 22 nt, Human
uuucaugaggggcaaaaucuca

SEQ ID NO: 180168 - RNA, 22 nt, Human
ccuuucugacagugaugggggg

SEQ ID NO: 180169 - RNA, 22 nt, Human
aaggcuggaguacagugcagug

SEQ ID NO: 180170 - RNA, 22 nt, Human
ggaagcaggaggcugggguaaa

SEQ ID NO: 180171 - RNA, 22 nt, Human
auccagaacaccuguaucacca

SEQ ID NO: 180172 - RNA, 22 nt, Human
cauuuguuuauaaguuccccag

SEQ ID NO: 180173 - RNA, 22 nt, Human
ccuggcagcuccguggccuucc

SEQ ID NO: 180174 - RNA, 22 nt, Human
uaaguuuucuggaauaacuugg

SEQ ID NO: 180175 - RNA, 22 nt, Human
agacauuuggaagauacacaua

SEQ ID NO: 180176 - RNA, 22 nt, Human
ccagaaaguucagcugugaaug

SEQ ID NO: 180177 - RNA, 22 nt, Human
aguuacucaaggcugauauaag

SEQ ID NO: 180178 - RNA, 22 nt, Human
ucugggcuuuuccaugccugug

SEQ ID NO: 180179 - RNA, 22 nt, Human
caggcucacuuucucagucaca

SEQ ID NO: 180180 - RNA, 22 nt, Human
guucaaaauucaaaugguauac

SEQ ID NO: 180181 - RNA, 22 nt, Human
uuuaguauguauuuaauggacu

SEQ ID NO: 180182 - RNA, 22 nt, Human
gaagauuaccugagaccacuug

SEQ ID NO: 180183 - RNA, 22 nt, Human
augugggccgugcggguguccu

SEQ ID NO: 180184 - RNA, 22 nt, Human
ggagacaauggaggccaaaaga

SEQ ID NO: 180185 - RNA, 22 nt, Human
ugacaugugcucaucuuggcua

SEQ ID NO: 180186 - RNA, 21 nt, Human
agccagucuguuuucuagugc

SEQ ID NO: 180187 - RNA, 22 nt, Human
guuuuacaagguuaaucagcag

SEQ ID NO: 180188 - RNA, 22 nt, Human
ggcucugccacuucuuggcugu

SEQ ID NO: 180189 - RNA, 22 nt, Human
agaggccacuuugccugugaug

SEQ ID NO: 180190 - RNA, 22 nt, Human
aggccagcuuccagaggggcag

SEQ ID NO: 180191 - RNA, 22 nt, Human
cucacagcugcuucaggaucca

SEQ ID NO: 180192 - RNA, 18 nt, Human
uagcaaagauguggauug

SEQ ID NO: 180193 - RNA, 22 nt, Human
uauuugagcgaagcaguguuuu

SEQ ID NO: 180194 - RNA, 22 nt, Human
cagcaggaggcauggcuucccu

SEQ ID NO: 180195 - RNA, 22 nt, Human
agugugggggcuuuggugucac

SEQ ID NO: 180196 - RNA, 22 nt, Human
ucuuuauguuugaaaguacaau

SEQ ID NO: 180197 - RNA, 22 nt, Human
uuaucaugacuucaagcaucca

SEQ ID NO: 180198 - RNA, 22 nt, Human
gcagagaggaaugaagccaucc

SEQ ID NO: 180199 - RNA, 22 nt, Human
aaagcagcagcacguggaagag

SEQ ID NO: 180200 - RNA, 22 nt, Human
uuuagguucuuggaaucagucu

SEQ ID NO: 180201 - RNA, 22 nt, Human
acucaggaagaaagcagcuggu

SEQ ID NO: 180202 - RNA, 22 nt, Human
cccaggagcuucucucugccuc

SEQ ID NO: 180203 - RNA, 22 nt, Human
cuugccuuugucuucaaaggcu

SEQ ID NO: 180204 - RNA, 22 nt, Human
uagggaugauggagccuaugua

SEQ ID NO: 180205 - RNA, 22 nt, Human
ucacagcuuugagcagagacca

SEQ ID NO: 180206 - RNA, 22 nt, Human
ucccuaggaccccaccuuccgc

SEQ ID NO: 180207 - RNA, 22 nt, Human
ugggcugaguguggaacuaguu

SEQ ID NO: 180208 - RNA, 22 nt, Human
uaaggcuuagaagcuaucugcu

SEQ ID NO: 180209 - RNA, 22 nt, Human
cgcaggcucgguucacagagca

SEQ ID NO: 180210 - RNA, 22 nt, Human
auauuuagauaaaaaugggcuu

SEQ ID NO: 180211 - RNA, 22 nt, Human
ugcccaggguuucuaagagcag

SEQ ID NO: 180212 - RNA, 22 nt, Human
ccuggcugccuuguguugaucu

SEQ ID NO: 180213 - RNA, 22 nt, Human
gaucaacaacuuuugaauagcu

SEQ ID NO: 180214 - RNA, 22 nt, Human
cauaacuugcuuuggagcccgg

SEQ ID NO: 180215 - RNA, 22 nt, Human
uucagagcucagaaaagugucu

SEQ ID NO: 180216 - RNA, 19 nt, Human
ugaggagcagcugguugau

SEQ ID NO: 180217 - RNA, 22 nt, Human
aagucuuuugcuaagaguaaug

SEQ ID NO: 180218 - RNA, 22 nt, Human
ucuccagguagauaugucagga

SEQ ID NO: 180219 - RNA, 22 nt, Human
uuguacuugccauagaacaaca

SEQ ID NO: 180220 - RNA, 22 nt, Human
gucucuggcuuuaugcugguuu

SEQ ID NO: 180221 - RNA, 22 nt, Human
uucacugugauguuuaagagaa

SEQ ID NO: 180222 - RNA, 22 nt, Human
gugcaaucugguuaauacgacu

SEQ ID NO: 180223 - RNA, 23 nt, Human
augaaugaauaaggcaggaaagc

SEQ ID NO: 180224 - RNA, 23 nt, Human
accuuggacuucccagcuuccag

SEQ ID NO: 180225 - RNA, 22 nt, Human
gcucacagucuggcauagucuc

SEQ ID NO: 180226 - RNA, 22 nt, Human
uaaaacuagugguugggacuaa

SEQ ID NO: 180227 - RNA, 19 nt, Human
cuuugucagaacaugcuuc

SEQ ID NO: 180228 - RNA, 22 nt, Human
cuuuaagagaucaccaaucaca

SEQ ID NO: 180229 - RNA, 20 nt, Human
cuccucaguuccaugggagg

SEQ ID NO: 180230 - RNA, 20 nt, Human
cucuggaagaguuuaaaugg

SEQ ID NO: 180231 - RNA, 22 nt, Human
aggcacagugccuggaaucaaa

SEQ ID NO: 180232 - RNA, 22 nt, Human
acacaucagaaauaugaaugag

SEQ ID NO: 180233 - RNA, 22 nt, Human
gugcaagacuuccuaagcaaua

SEQ ID NO: 180234 - RNA, 22 nt, Human
gaccucaucugaacauaugcaa

SEQ ID NO: 180235 - RNA, 22 nt, Human
cugggcccugaagacagucagg

SEQ ID NO: 180236 - RNA, 22 nt, Human
cagugcuguuguaagcucauug

SEQ ID NO: 180237 - RNA, 22 nt, Human
uuauagugcauaauuaacaugg

SEQ ID NO: 180238 - RNA, 22 nt, Human
gcuccugggcccugggcuaacu

SEQ ID NO: 180239 - RNA, 19 nt, Human
cagggauggguagggacuc

SEQ ID NO: 180240 - RNA, 22 nt, Human
gcugagggucuguucauguugc

SEQ ID NO: 180241 - RNA, 22 nt, Human
uuaacugugacaguuucucaga

SEQ ID NO: 180242 - RNA, 22 nt, Human
ccauucugacaccuaauucugu

SEQ ID NO: 180243 - RNA, 22 nt, Human
ucugucauuucaauaugguuaa

SEQ ID NO: 180244 - RNA, 22 nt, Human
ucuguggcuguuaucuuuauau

SEQ ID NO: 180245 - RNA, 20 nt, Human
ugagccuugaggagugacug

SEQ ID NO: 180246 - RNA, 22 nt, Human
ucaggcucagguuaggggccaa

SEQ ID NO: 180247 - RNA, 22 nt, Human
ucagucaugaccauggggugga

SEQ ID NO: 180248 - RNA, 22 nt, Human
ucuguggccugccuccucauuu

SEQ ID NO: 180249 - RNA, 22 nt, Human
uagaugcuuauaaagagcauau

SEQ ID NO: 180250 - RNA, 22 nt, Human
aucucuggguccauagaagaga

SEQ ID NO: 180251 - RNA, 22 nt, Human
uauauuguuggugggaauauaa

SEQ ID NO: 180252 - RNA, 22 nt, Human
uaccaaaagcuuguuucauaca

SEQ ID NO: 180253 - RNA, 22 nt, Human
ucagugucucauaugagguuuc

SEQ ID NO: 180254 - RNA, 22 nt, Human
uugaaugagaaguuauugccau

SEQ ID NO: 180255 - RNA, 22 nt, Human
acaugccagccucagcagcagu

SEQ ID NO: 180256 - RNA, 22 nt, Human
ggaagcugaacuuagcaaggaa

SEQ ID NO: 180257 - RNA, 22 nt, Human
ucugcagaaggaaucagcugag

SEQ ID NO: 180258 - RNA, 22 nt, Human
gcuggcaggagaaacggggugc

SEQ ID NO: 180259 - RNA, 22 nt, Human
aaagcugcccuugugaaacaag

SEQ ID NO: 180260 - RNA, 22 nt, Human
agugauggcaucggguccagca

SEQ ID NO: 180261 - RNA, 22 nt, Human
cccaguggagauaggagugugg

SEQ ID NO: 180262 - RNA, 22 nt, Human
gugaggcagagaugccaaaacu

SEQ ID NO: 180263 - RNA, 22 nt, Human
acaggagaaaucuggucaaaag

SEQ ID NO: 180264 - RNA, 22 nt, Human
gcucccagucugauggaggaga

SEQ ID NO: 180265 - RNA, 22 nt, Human
auuaagagccuacuaugugccg

SEQ ID NO: 180266 - RNA, 19 nt, Human
guggccagggcaggggcug

SEQ ID NO: 180267 - RNA, 22 nt, Human
uccaggacuauaggaaagacac

SEQ ID NO: 180268 - RNA, 22 nt, Human
aauauucaaguuauucuuucuu

SEQ ID NO: 180269 - RNA, 22 nt, Human
aaagccaggggagggauuccca

SEQ ID NO: 180270 - RNA, 22 nt, Human
acauggcucagucucaugacag

SEQ ID NO: 180271 - RNA, 22 nt, Human
ggggaggaagcuggaacacggg

SEQ ID NO: 180272 - RNA, 22 nt, Human
ugcuuccugaggccgucuucuc

SEQ ID NO: 180273 - RNA, 22 nt, Human
uacaugagggcacucugcaucu

SEQ ID NO: 180274 - RNA, 22 nt, Human
agaaaguuugagaacuguagau

SEQ ID NO: 180275 - RNA, 23 nt, Human
aacugcaagguugcugggaagua

SEQ ID NO: 180276 - RNA, 21 nt, Human
agacaacugugacuauucccu

SEQ ID NO: 180277 - RNA, 17 nt, Human
gggugggcacugcuggc

SEQ ID NO: 180278 - RNA, 22 nt, Human
gggaucuggaauuuugguaugu

SEQ ID NO: 180279 - RNA, 22 nt, Human
aaaggcuuguccaguaagggga

SEQ ID NO: 180280 - RNA, 22 nt, Human
gggaaaauauuaagcaggacuu

SEQ ID NO: 180281 - RNA, 22 nt, Human
aauuuacaguugcugaugguac

SEQ ID NO: 180282 - RNA, 22 nt, Human
uccagcccgagggcgcugauga

SEQ ID NO: 180283 - RNA, 22 nt, Human
auagggcauccuuuauugagau

SEQ ID NO: 180284 - RNA, 22 nt, Human
uguuggggucaggagcuagccu

SEQ ID NO: 180285 - RNA, 22 nt, Human
uugcccugucuuaagcuggcaa

SEQ ID NO: 180286 - RNA, 22 nt, Human
ccugagugcuuccagagucaug

SEQ ID NO: 180287 - RNA, 22 nt, Human
uuuaagaaguuauguuauaaau

SEQ ID NO: 180288 - RNA, 22 nt, Human
aggccagcagcaugacggcauc

SEQ ID NO: 180289 - RNA, 22 nt, Human
auaaacaguaaaugugagcagu

SEQ ID NO: 180290 - RNA, 22 nt, Human
uguuugaauuuugcuaacgugu

SEQ ID NO: 180291 - RNA, 22 nt, Human
uuuggaauguaguuuaaucauc

SEQ ID NO: 180292 - RNA, 21 nt, Human
aaguaaaucagagaaauaacc

SEQ ID NO: 180293 - RNA, 22 nt, Human
agagacagacacaucgggcugc

SEQ ID NO: 180294 - RNA, 22 nt, Human
ggcuggagauaugucuggaaca

SEQ ID NO: 180295 - RNA, 22 nt, Human
ggggagaugcuuagguccgggg

SEQ ID NO: 180296 - RNA, 22 nt, Human
ucuguuaugcauaagcaucagu

SEQ ID NO: 180297 - RNA, 22 nt, Human
cagaagaaaguggggagacaag

SEQ ID NO: 180298 - RNA, 22 nt, Human
guuucaaauagguuucagcaaa

SEQ ID NO: 180299 - RNA, 22 nt, Human
gcucucugggugugucuagaua

SEQ ID NO: 180300 - RNA, 22 nt, Human
uuuuuguucccagagaauuugu

SEQ ID NO: 180301 - RNA, 22 nt, Human
cuugggaguagaggcaggagca

SEQ ID NO: 180302 - RNA, 22 nt, Human
gaagccagccuugucugccucu

SEQ ID NO: 180303 - RNA, 22 nt, Human
auuuucagaacauucauucacu

SEQ ID NO: 180304 - RNA, 22 nt, Human
agagccacugggagacagagca

SEQ ID NO: 180305 - RNA, 22 nt, Human
gugcaaaaguaauugcgguuuu

SEQ ID NO: 180306 - RNA, 22 nt, Human
uggagcugguucuggggaagcu

SEQ ID NO: 180307 - RNA, 22 nt, Human
caguuaaaugaugugcccuaga

SEQ ID NO: 180308 - RNA, 22 nt, Human
ugccuugcugcuuuggaguccu

SEQ ID NO: 180309 - RNA, 22 nt, Human
caagcagagguuuauguauuag

SEQ ID NO: 180310 - RNA, 22 nt, Human
uccuggcacuuugggggcucgc

SEQ ID NO: 180311 - RNA, 22 nt, Human
gcugugcagugggaguucggug

SEQ ID NO: 180312 - RNA, 20 nt, Human
ucugugcaguuuaggaaggc

SEQ ID NO: 180313 - RNA, 22 nt, Human
auugguggugaggacaugccag

SEQ ID NO: 180314 - RNA, 22 nt, Human
gccucaguaaccuuaggggaua

SEQ ID NO: 180315 - RNA, 22 nt, Human
ggcugcagcccucgccuagcca

SEQ ID NO: 180316 - RNA, 22 nt, Human
cuggccuggggccucagcugcu

SEQ ID NO: 180317 - RNA, 22 nt, Human
uaggcugagcuaagagagcuua

SEQ ID NO: 180318 - RNA, 22 nt, Human
auucaguuucauggcacagcua

SEQ ID NO: 180319 - RNA, 22 nt, Human
ugguccuggaagguccugaggg

SEQ ID NO: 180320 - RNA, 22 nt, Human
acagcagcgugaaguguguuau

SEQ ID NO: 180321 - RNA, 22 nt, Human
uauuuccacccucaguaaggaa

SEQ ID NO: 180322 - RNA, 22 nt, Human
agucauuuaucuuagccauuau

SEQ ID NO: 180323 - RNA, 22 nt, Human
ggcuguccaccuaccaugccgg

SEQ ID NO: 180324 - RNA, 22 nt, Human
cugugggacucugaggaaaagc

SEQ ID NO: 180325 - RNA, 22 nt, Human
aauaaaauggucaguuuucuca

SEQ ID NO: 180326 - RNA, 22 nt, Human
uucucagugaaguuuagaacau

SEQ ID NO: 180327 - RNA, 22 nt, Human
aagcgccaugguuccugcgcag

SEQ ID NO: 180328 - RNA, 22 nt, Human
gaggccugcagcguggucccug

SEQ ID NO: 180329 - RNA, 23 nt, Human
ccucagcauggcaggagcccagc

SEQ ID NO: 180330 - RNA, 22 nt, Human
ugugaagguuuuuaugggauau

SEQ ID NO: 180331 - RNA, 22 nt, Human
agauaaaaugauuuucuggauc

SEQ ID NO: 180332 - RNA, 22 nt, Human
uagugaaauuuaugcacagcua

SEQ ID NO: 180333 - RNA, 22 nt, Human
gaccugccugagcugccucugc

SEQ ID NO: 180334 - RNA, 22 nt, Human
ucuguggagugaccugggcuuu

SEQ ID NO: 180335 - RNA, 22 nt, Human
gcuguggcuccaauggugagcc

SEQ ID NO: 180336 - RNA, 22 nt, Human
gaugagucacugcaggugcugg

SEQ ID NO: 180337 - RNA, 22 nt, Human
aagcagcuuaaauuagagccug

SEQ ID NO: 180338 - RNA, 22 nt, Human
ugaaucuuuuuggaaauaaaga

SEQ ID NO: 180339 - RNA, 22 nt, Human
auucuauuuuuuaagaaguagu

SEQ ID NO: 180340 - RNA, 22 nt, Human
uguucauugcccccuguguaaa

SEQ ID NO: 180341 - RNA, 22 nt, Human
ugaaggccuaacuuccagugcu

SEQ ID NO: 180342 - RNA, 17 nt, Human
uccuggcaguccccugg

SEQ ID NO: 180343 - RNA, 22 nt, Human
cuggcagcuuagcacucugguu

SEQ ID NO: 180344 - RNA, 20 nt, Human
aacucagagaugaaaaagac

SEQ ID NO: 180345 - RNA, 22 nt, Human
accucaaggaaaaucuagacag

SEQ ID NO: 180346 - RNA, 22 nt, Human
auugaaugcuugcuaacacuuu

SEQ ID NO: 180347 - RNA, 20 nt, Human
auaauuauuuacuuuugugc

SEQ ID NO: 180348 - RNA, 22 nt, Human
ugguuauaaauugcuaugcaga

SEQ ID NO: 180349 - RNA, 22 nt, Human
agaccagggucccacagagucu

SEQ ID NO: 180350 - RNA, 22 nt, Human
ggcuggcuggcugguagacaag

SEQ ID NO: 180351 - RNA, 22 nt, Human
aaucuucuuucuuaacaguaca

SEQ ID NO: 180352 - RNA, 22 nt, Human
cucugcccucacuuggggccug

SEQ ID NO: 180353 - RNA, 22 nt, Human
cugauagguuauuuucagugag

SEQ ID NO: 180354 - RNA, 22 nt, Human
uaggcuccugaguccacagcac

SEQ ID NO: 180355 - RNA, 22 nt, Human
acccugggcacaccauuucccc

SEQ ID NO: 180356 - RNA, 22 nt, Human
cauuuggauuuugaagagagua

SEQ ID NO: 180357 - RNA, 22 nt, Human
cagucagggacaccagcuagga

SEQ ID NO: 180358 - RNA, 22 nt, Human
cuccucugucuggcccugagcc

SEQ ID NO: 180359 - RNA, 22 nt, Human
ucaggccugcaaaugaauggua

SEQ ID NO: 180360 - RNA, 22 nt, Human
accaggcaguauggugcugcaa

SEQ ID NO: 180361 - RNA, 22 nt, Human
gaguaaaaguuggauuacaaag

SEQ ID NO: 180362 - RNA, 22 nt, Human
ccugagggaacaugcacccaau

SEQ ID NO: 180363 - RNA, 22 nt, Human
gcuugaugauaccuaggagaug

SEQ ID NO: 180364 - RNA, 22 nt, Human
ccuggcaagugggcucccagau

SEQ ID NO: 180365 - RNA, 22 nt, Human
aacacauauuuauauaugcaca

SEQ ID NO: 180366 - RNA, 22 nt, Human
uucuguggcaguuugggaggug

SEQ ID NO: 180367 - RNA, 22 nt, Human
gggcaugagaggcaggcaagug

SEQ ID NO: 180368 - RNA, 22 nt, Human
cagcugucuuugcacaguuuag

SEQ ID NO: 180369 - RNA, 22 nt, Human
uuuaaaugcagacguugauuca

SEQ ID NO: 180370 - RNA, 22 nt, Human
caaugucaugauuuuccauuag

SEQ ID NO: 180371 - RNA, 22 nt, Human
ggucagaauuaggucuagagua

SEQ ID NO: 180372 - RNA, 22 nt, Human
cucagcaacccacacacggucu

SEQ ID NO: 180373 - RNA, 22 nt, Human
cuggcagcauggagccugugcu

SEQ ID NO: 180374 - RNA, 22 nt, Human
agcaggguccugaggugaguca

SEQ ID NO: 180375 - RNA, 22 nt, Human
ccuauuuguaggcugggccagu

SEQ ID NO: 180376 - RNA, 22 nt, Human
agaaucuugggcaaauucaucu

SEQ ID NO: 180377 - RNA, 22 nt, Human
gcagggaaggggcaugcuggag

SEQ ID NO: 180378 - RNA, 17 nt, Human
agcugaaauugcugaag

SEQ ID NO: 180379 - RNA, 22 nt, Human
acaggcagggaccuuggcuaag

SEQ ID NO: 180380 - RNA, 22 nt, Human
uucauagugauuguucagauag

SEQ ID NO: 180381 - RNA, 22 nt, Human
aguacaaagugcuccugguucu

SEQ ID NO: 180382 - RNA, 22 nt, Human
uuuugcuugagugcacaaaaug

SEQ ID NO: 180383 - RNA, 22 nt, Human
caugggcaguuggcagggcuca

SEQ ID NO: 180384 - RNA, 22 nt, Human
ggccagacauaucgcucccaaa

SEQ ID NO: 180385 - RNA, 22 nt, Human
cagugcuggaggcuggagggaa

SEQ ID NO: 180386 - RNA, 22 nt, Human
gcuuaguccccaagagagacca

SEQ ID NO: 180387 - RNA, 22 nt, Human
aaugugaggccuugguaguuau

SEQ ID NO: 180388 - RNA, 22 nt, Human
agcagccacacgccuccuucuc

SEQ ID NO: 180389 - RNA, 22 nt, Human
cagaguccuggacacagagaca

SEQ ID NO: 180390 - RNA, 18 nt, Human
cauuuguuauugugugug

SEQ ID NO: 180391 - RNA, 22 nt, Human
gcuuuaaugcuucguggggcca

SEQ ID NO: 180392 - RNA, 22 nt, Human
cuuuuacaguggaccugccauu

SEQ ID NO: 180393 - RNA, 22 nt, Human
cacacaugugggauccgcaggg

SEQ ID NO: 180394 - RNA, 22 nt, Human
aguggcuggaauugcaggugcg

SEQ ID NO: 180395 - RNA, 22 nt, Human
uggcucucugggagguccuggc

SEQ ID NO: 180396 - RNA, 22 nt, Human
aacagagaucuuaauuccugua

SEQ ID NO: 180397 - RNA, 19 nt, Human
ugaguucugugguucucaa

SEQ ID NO: 180398 - RNA, 22 nt, Human
guuagaaacgcaggcucuccgg

SEQ ID NO: 180399 - RNA, 22 nt, Human
uugcugggugcuauuaugaaca

SEQ ID NO: 180400 - RNA, 22 nt, Human
auggaaauacacaagagguuuc

SEQ ID NO: 180401 - RNA, 22 nt, Human
uggguagaguggagggauaaga

SEQ ID NO: 180402 - RNA, 22 nt, Human
cuccugggaugacucuuucuuu

SEQ ID NO: 180403 - RNA, 22 nt, Human
agaguccaaaugugcaguuaug

SEQ ID NO: 180404 - RNA, 23 nt, Human
cucugggcgggcaggucagccuc

SEQ ID NO: 180405 - RNA, 22 nt, Human
uucuuugggcaauugcuggccc

SEQ ID NO: 180406 - RNA, 19 nt, Human
agggcacagggacagaagg

SEQ ID NO: 180407 - RNA, 22 nt, Human
ugaaguuucuugaaucuuggag

SEQ ID NO: 180408 - RNA, 22 nt, Human
cugccuggacagcucuuaccuu

SEQ ID NO: 180409 - RNA, 21 nt, Human
gcaguuuauguaauaugcacu

SEQ ID NO: 180410 - RNA, 22 nt, Human
auccaggaaggauggcauugag

SEQ ID NO: 180411 - RNA, 21 nt, Human
cucuuugggaucuuuggaaag

SEQ ID NO: 180412 - RNA, 22 nt, Human
gaggaagcagggcuuggcugag

SEQ ID NO: 180413 - RNA, 22 nt, Human
uauuacuguuacuucacacugu

SEQ ID NO: 180414 - RNA, 22 nt, Human
cauuuauucucagauccuuguc

SEQ ID NO: 180415 - RNA, 22 nt, Human
aauaugcaaauagguguaauga

SEQ ID NO: 180416 - RNA, 22 nt, Human
cuggcucccuggacauggggcc

SEQ ID NO: 180417 - RNA, 22 nt, Human
cagagggcacucggagugacau

SEQ ID NO: 180418 - RNA, 22 nt, Human
gguggcucggccagugcaggcc

SEQ ID NO: 180419 - RNA, 22 nt, Human
ugugcugggaaauggcaggaua

SEQ ID NO: 180420 - RNA, 22 nt, Human
ccugagccugcagccgagcaga

SEQ ID NO: 180421 - RNA, 22 nt, Human
agccacagggggugagggacaa

SEQ ID NO: 180422 - RNA, 22 nt, Human
uggcugaggagggucuucuggu

SEQ ID NO: 180423 - RNA, 22 nt, Human
ccccuccugcagcaccuuucuu

SEQ ID NO: 180424 - RNA, 22 nt, Human
gggagcuccacugccucucauu

SEQ ID NO: 180425 - RNA, 22 nt, Human
acaggugguagaguggaaagag

SEQ ID NO: 180426 - RNA, 22 nt, Human
agcccaggucucaaaguacagg

SEQ ID NO: 180427 - RNA, 22 nt, Human
ucuaaacacgucucuuugaaua

SEQ ID NO: 180428 - RNA, 22 nt, Human
uuggcugaccagaaccugcccc

SEQ ID NO: 180429 - RNA, 19 nt, Human
aaaaggaauauucuuuggg

SEQ ID NO: 180430 - RNA, 22 nt, Human
cuccugagcugcagccuugugu

SEQ ID NO: 180431 - RNA, 22 nt, Human
aggucaggaggccucugccauu

SEQ ID NO: 180432 - RNA, 22 nt, Human
ccucugagaccagcucugcacc

SEQ ID NO: 180433 - RNA, 22 nt, Human
uucaggaaauuggaguccuucu

SEQ ID NO: 180434 - RNA, 22 nt, Human
ccaaagguguuggccuucagug

SEQ ID NO: 180435 - RNA, 22 nt, Human
agcagcuguggggacaagggua

SEQ ID NO: 180436 - RNA, 22 nt, Human
gccugcaguucugugcuaggca

SEQ ID NO: 180437 - RNA, 22 nt, Human
ugcuuuaagagauuguuaguac

SEQ ID NO: 180438 - RNA, 22 nt, Human
gauacaguguguuaacgagaaa

SEQ ID NO: 180439 - RNA, 22 nt, Human
ugauucaacuuucauaacaaaa

SEQ ID NO: 180440 - RNA, 22 nt, Human
gggcuagaaauucugcagugga

SEQ ID NO: 180441 - RNA, 22 nt, Human
cacaguuucuauaggucagaau

SEQ ID NO: 180442 - RNA, 22 nt, Human
acauuugacuguagauacuugc

SEQ ID NO: 180443 - RNA, 22 nt, Human
uggugagagcugaccgugcgag

SEQ ID NO: 180444 - RNA, 22 nt, Human
uuucucuuucaaucugcaguac

SEQ ID NO: 180445 - RNA, 19 nt, Human
augauacaggugaaaauug

SEQ ID NO: 180446 - RNA, 23 nt, Human
aaggcauuggcuucucucauuuc

SEQ ID NO: 180447 - RNA, 22 nt, Human
gaggcugaugcugccucacaga

SEQ ID NO: 180448 - RNA, 22 nt, Human
cuugaaagucacaugcagcccu

SEQ ID NO: 180449 - RNA, 22 nt, Human
gcucugagaggugcagcaguaa

SEQ ID NO: 180450 - RNA, 19 nt, Human
aucugaggccucaucuggg

SEQ ID NO: 180451 - RNA, 22 nt, Human
agagggugcuggagagacauug

SEQ ID NO: 180452 - RNA, 20 nt, Human
aggagucccugugcucucuc

SEQ ID NO: 180453 - RNA, 22 nt, Human
uuugccugauucuaagagcuca

SEQ ID NO: 180454 - RNA, 22 nt, Human
cuucucuggcagaugugugucc

SEQ ID NO: 180455 - RNA, 22 nt, Human
cugcucuggcguacucggcauc

SEQ ID NO: 180456 - RNA, 22 nt, Human
agggacacgagguccugcuggg

SEQ ID NO: 180457 - RNA, 22 nt, Human
caggaaauaucucaacacuuua

SEQ ID NO: 180458 - RNA, 22 nt, Human
agaugugguaguugaagggaag

SEQ ID NO: 180459 - RNA, 22 nt, Human
caguagcccacuaguaugcagu

SEQ ID NO: 180460 - RNA, 22 nt, Human
uggcaggguuggccaccuuacc

SEQ ID NO: 180461 - RNA, 22 nt, Human
auugucaucgauguuagccagu

SEQ ID NO: 180462 - RNA, 22 nt, Human
uggggguguccuggugcacaca

SEQ ID NO: 180463 - RNA, 22 nt, Human
gcaccauugcugggcuaguucc

SEQ ID NO: 180464 - RNA, 19 nt, Human
agggaaggauucugucauu

SEQ ID NO: 180465 - RNA, 22 nt, Human
cuuaaucucaccugcaaagucc

SEQ ID NO: 180466 - RNA, 19 nt, Human
uagagcuuguuuuaggaag

SEQ ID NO: 180467 - RNA, 22 nt, Human
uuuccugagucagagacaccag

SEQ ID NO: 180468 - RNA, 22 nt, Human
auaucaaaauaaacagcaugca

SEQ ID NO: 180469 - RNA, 22 nt, Human
gaaggcugcugggaaguguggu

SEQ ID NO: 180470 - RNA, 22 nt, Human
cauagaaacugagacaaggauu

SEQ ID NO: 180471 - RNA, 22 nt, Human
aaaaguauaggguuuggaguca

SEQ ID NO: 180472 - RNA, 17 nt, Human
uauguguguguuuauac

SEQ ID NO: 180473 - RNA, 22 nt, Human
cagguucucagaaggcagucac

SEQ ID NO: 180474 - RNA, 22 nt, Human
ugggugcuucgucagcucugag

SEQ ID NO: 180475 - RNA, 22 nt, Human
aggaagccuggcauuaaaaagc

SEQ ID NO: 180476 - RNA, 22 nt, Human
uggggagguucgggaaucuugu

SEQ ID NO: 180477 - RNA, 22 nt, Human
uggagccagcaggacucagagg

SEQ ID NO: 180478 - RNA, 22 nt, Human
guggcagaguugcugacuagaa

SEQ ID NO: 180479 - RNA, 22 nt, Human
uggucccuagcacagcuguccu

SEQ ID NO: 180480 - RNA, 22 nt, Human
gcuggcccagcgcccagggcag

SEQ ID NO: 180481 - RNA, 22 nt, Human
ucauuauuuuggacuggagugu

SEQ ID NO: 180482 - RNA, 20 nt, Human
agcaagaguaaggacagcga

SEQ ID NO: 180483 - RNA, 22 nt, Human
cugggugugggucaagcaacca

SEQ ID NO: 180484 - RNA, 22 nt, Human
uuuuaucuaccuaugcucauuu

SEQ ID NO: 180485 - RNA, 22 nt, Human
agaugggccuucgagcaugccc

SEQ ID NO: 180486 - RNA, 22 nt, Human
acuuugaaauguguaagagaga

SEQ ID NO: 180487 - RNA, 22 nt, Human
gugcaggguagcgacggcagga

SEQ ID NO: 180488 - RNA, 22 nt, Human
caaauagacuuaagcaucugua

SEQ ID NO: 180489 - RNA, 22 nt, Human
uugaauuauaagugugucuacu

SEQ ID NO: 180490 - RNA, 22 nt, Human
ucucucagauggggcacuagua

SEQ ID NO: 180491 - RNA, 19 nt, Human
cuggaaugagaacaugccc

SEQ ID NO: 180492 - RNA, 22 nt, Human
cucugggcuuccuuuguggguu

SEQ ID NO: 180493 - RNA, 22 nt, Human
uugcaaauaaacaaguauacau

SEQ ID NO: 180494 - RNA, 22 nt, Human
gauugcugaagaaagugaguga

SEQ ID NO: 180495 - RNA, 22 nt, Human
ccuggugcccccaagccagcug

SEQ ID NO: 180496 - RNA, 22 nt, Human
cauguaaaccauugugagcauc

SEQ ID NO: 180497 - RNA, 23 nt, Human
ugggccucuccacccuuuucugu

SEQ ID NO: 180498 - RNA, 22 nt, Human
ugggcagcagcaaagccagacu

SEQ ID NO: 180499 - RNA, 22 nt, Human
ugcagaagaaugagcuuggagu

SEQ ID NO: 180500 - RNA, 22 nt, Human
auggcagggaccaagcugucau

SEQ ID NO: 180501 - RNA, 22 nt, Human
cugggaaagugugcuccccucc

SEQ ID NO: 180502 - RNA, 22 nt, Human
acucucacuagcucugugaccu

SEQ ID NO: 180503 - RNA, 22 nt, Human
cacaggagaaaggggaagcucg

SEQ ID NO: 180504 - RNA, 22 nt, Human
cuacauaaauauuuaugugucu

SEQ ID NO: 180505 - RNA, 21 nt, Human
aaauacagaaacuuguuuuca

SEQ ID NO: 180506 - RNA, 22 nt, Human
aucaggaaauacuuauuuauaa

SEQ ID NO: 180507 - RNA, 22 nt, Human
agggccugucuguagaacugaa

SEQ ID NO: 180508 - RNA, 22 nt, Human
uauuugauagagauaaaugaua

SEQ ID NO: 180509 - RNA, 22 nt, Human
ucaggcaaucugacagcuggag

SEQ ID NO: 180510 - RNA, 22 nt, Human
gaaacagauuaacagcauauuu

SEQ ID NO: 180511 - RNA, 22 nt, Human
uugcagggcuuggggauuacag

SEQ ID NO: 180512 - RNA, 22 nt, Human
gcuuuagacauaaaguucuuca

SEQ ID NO: 180513 - RNA, 20 nt, Human
uuucacaaugaacaugucuc

SEQ ID NO: 180514 - RNA, 22 nt, Human
aacaucuacuaagugccaggca

SEQ ID NO: 180515 - RNA, 22 nt, Human
aguguucacucuguggagccca

SEQ ID NO: 180516 - RNA, 22 nt, Human
cugggccuggcguuccaggcug

SEQ ID NO: 180517 - RNA, 22 nt, Human
ugcccuggggucuggagcagca

SEQ ID NO: 180518 - RNA, 22 nt, Human
uguuacuuaucucacgugaugc

SEQ ID NO: 180519 - RNA, 17 nt, Human
gcaggcacugcugccug

SEQ ID NO: 180520 - RNA, 22 nt, Human
ucaagcaaacucugagaaauaa

SEQ ID NO: 180521 - RNA, 22 nt, Human
uccaggaguuugagacugcagu

SEQ ID NO: 180522 - RNA, 22 nt, Human
gcucugagagcuacacagggua

SEQ ID NO: 180523 - RNA, 22 nt, Human
uuaguaaauaaagucuacuuuc

SEQ ID NO: 180524 - RNA, 22 nt, Human
uuaagucaauaucaaucucagc

SEQ ID NO: 180525 - RNA, 22 nt, Human
agggucucuggagagcugagga

SEQ ID NO: 180526 - RNA, 22 nt, Human
gaagcuaaugagauaaaugcca

SEQ ID NO: 180527 - RNA, 22 nt, Human
ucuaggaguaaugagcuagcac

SEQ ID NO: 180528 - RNA, 22 nt, Human
ucuguaguagguuguaguucuu

SEQ ID NO: 180529 - RNA, 22 nt, Human
uagugcagaggaggagccucug

SEQ ID NO: 180530 - RNA, 22 nt, Human
gcgcacugggcgcacgcguagg

SEQ ID NO: 180531 - RNA, 20 nt, Human
ugggccucuggugccucugg

SEQ ID NO: 180532 - RNA, 22 nt, Human
ggcaggcaacggaccacuaguc

SEQ ID NO: 180533 - RNA, 22 nt, Human
caguggauuagccagagcugga

SEQ ID NO: 180534 - RNA, 22 nt, Human
agucugggugugaaugaacuug

SEQ ID NO: 180535 - RNA, 22 nt, Human
ggcccagagggucaggagcuga

SEQ ID NO: 180536 - RNA, 22 nt, Human
aaaacaggugucagcaaacuau

SEQ ID NO: 180537 - RNA, 22 nt, Human
auugcugggaggauguguguuc

SEQ ID NO: 180538 - RNA, 22 nt, Human
ccaaaaaguacauuuaggugug

SEQ ID NO: 180539 - RNA, 22 nt, Human
gcuugcucuuuagccauggcca

SEQ ID NO: 180540 - RNA, 22 nt, Human
gggucuccuaauggaggaugac

SEQ ID NO: 180541 - RNA, 22 nt, Human
guuuacaguacucacuugcauu

SEQ ID NO: 180542 - RNA, 22 nt, Human
gcuaacauugauucagugccug

SEQ ID NO: 180543 - RNA, 22 nt, Human
cagacaaccaggucuuucaguu

SEQ ID NO: 180544 - RNA, 22 nt, Human
guacaaaugaaaauagaccacu

SEQ ID NO: 180545 - RNA, 22 nt, Human
ugguacugagaauagcgucuac

SEQ ID NO: 180546 - RNA, 19 nt, Human
agcccccagacagcaggcc

SEQ ID NO: 180547 - RNA, 22 nt, Human
auacaugugugagcgaagaugu

SEQ ID NO: 180548 - RNA, 22 nt, Human
ucucuggguauucacugccuuc

SEQ ID NO: 180549 - RNA, 22 nt, Human
cuucagugauauaggcuucucc

SEQ ID NO: 180550 - RNA, 22 nt, Human
ucccuggguuaccuuucaaggu

SEQ ID NO: 180551 - RNA, 22 nt, Human
cucugccaucuuggagcucaag

SEQ ID NO: 180552 - RNA, 22 nt, Human
ccacugagguuuugugguuaug

SEQ ID NO: 180553 - RNA, 22 nt, Human
ggcccugggacacaacaccgaa

SEQ ID NO: 180554 - RNA, 22 nt, Human
guccuggcccaggaguacacau

SEQ ID NO: 180555 - RNA, 18 nt, Human
gcauucaguagugaacaa

SEQ ID NO: 180556 - RNA, 22 nt, Human
uauguacaugauuucauuugcu

SEQ ID NO: 180557 - RNA, 21 nt, Human
aaucaagaguacugguguggc

SEQ ID NO: 180558 - RNA, 22 nt, Human
uacauagaauauuucacuuaaa

SEQ ID NO: 180559 - RNA, 22 nt, Human
auugaaaaaugacuauugcuua

SEQ ID NO: 180560 - RNA, 22 nt, Human
agugauuugggugucagaaagu

SEQ ID NO: 180561 - RNA, 22 nt, Human
cacagaggaaaggcaguuggua

SEQ ID NO: 180562 - RNA, 22 nt, Human
ccugggcuuuggaacaguacuu

SEQ ID NO: 180563 - RNA, 22 nt, Human
cgcugcagcuggcugcagggaa

SEQ ID NO: 180564 - RNA, 21 nt, Human
aaagugguaaggauuauuuug

SEQ ID NO: 180565 - RNA, 22 nt, Human
cugaaaaauauguuuuggagaa

SEQ ID NO: 180566 - RNA, 20 nt, Human
ucagauuuuucuaacuuuga

SEQ ID NO: 180567 - RNA, 22 nt, Human
agaaauaugcugauuagaugaa

SEQ ID NO: 180568 - RNA, 22 nt, Human
ucugggugcccuuugcucuguu

SEQ ID NO: 180569 - RNA, 22 nt, Human
ugcaggaguuaagugcucuccu

SEQ ID NO: 180570 - RNA, 22 nt, Human
aagucccugguuccuagcaaaa

SEQ ID NO: 180571 - RNA, 22 nt, Human
uuuacagugagagcuuagugag

SEQ ID NO: 180572 - RNA, 22 nt, Human
cagcccugugcuaagcacccuc

SEQ ID NO: 180573 - RNA, 22 nt, Human
uugauaaaaugauaucuucuuu

SEQ ID NO: 180574 - RNA, 23 nt, Human
acugcugucuuugaagugcuuga

SEQ ID NO: 180575 - RNA, 22 nt, Human
uacagagacuuuauggcacaaa

SEQ ID NO: 180576 - RNA, 20 nt, Human
ccagacagcaccugccuggu

SEQ ID NO: 180577 - RNA, 22 nt, Human
cuccugggcuaugucugcuugg

SEQ ID NO: 180578 - RNA, 23 nt, Human
aggagccaggaaccagcuucccc

SEQ ID NO: 180579 - RNA, 22 nt, Human
uccugaaaugugcacaugacau

SEQ ID NO: 180580 - RNA, 22 nt, Human
uuagccaugugggaaaaacagc

SEQ ID NO: 180581 - RNA, 22 nt, Human
ugcacuguaugguaucuggaca

SEQ ID NO: 180582 - RNA, 22 nt, Human
ugcaaauuucuuuaguacauaa

SEQ ID NO: 180583 - RNA, 19 nt, Human
ccucacccugcagaggagg

SEQ ID NO: 180584 - RNA, 22 nt, Human
uauaauuuuaagugguaaauua

SEQ ID NO: 180585 - RNA, 22 nt, Human
uugauucaucuucuaauaccca

SEQ ID NO: 180586 - RNA, 22 nt, Human
aucaaagugguuuucugugcuu

SEQ ID NO: 180587 - RNA, 22 nt, Human
ugcagagaaaguguagacaggc

SEQ ID NO: 180588 - RNA, 22 nt, Human
uggugggcacagugcccaggcu

SEQ ID NO: 180589 - RNA, 22 nt, Human
ugccagguacacaaguagccag

SEQ ID NO: 180590 - RNA, 22 nt, Human
acucaggaaauugagauaaugg

SEQ ID NO: 180591 - RNA, 22 nt, Human
cucuccaguuaccuaggucuga

SEQ ID NO: 180592 - RNA, 20 nt, Human
ugaaggcagguaagaaagau

SEQ ID NO: 180593 - RNA, 23 nt, Human
uuguccucuggaucgguuugguu

SEQ ID NO: 180594 - RNA, 22 nt, Human
ugaggugguuuguaucacuggg

SEQ ID NO: 180595 - RNA, 22 nt, Human
guccuuggagucaggcaaggcu

SEQ ID NO: 180596 - RNA, 22 nt, Human
agcucuguuacugauuuuccug

SEQ ID NO: 180597 - RNA, 22 nt, Human
cugccuugguuucuagcagggc

SEQ ID NO: 180598 - RNA, 22 nt, Human
cagagcacacaugcauagagug

SEQ ID NO: 180599 - RNA, 22 nt, Human
cucagagaaccuaagcggagga

SEQ ID NO: 180600 - RNA, 22 nt, Human
uuuuucucuaugccaggggccu

SEQ ID NO: 180601 - RNA, 22 nt, Human
uuauuguuagugagacuguaga

SEQ ID NO: 180602 - RNA, 22 nt, Human
uacauguaauuuucauaguaag

SEQ ID NO: 180603 - RNA, 22 nt, Human
gcacccaguuugucucaggguu

SEQ ID NO: 180604 - RNA, 22 nt, Human
augaaaagcauaaacgcugaag

SEQ ID NO: 180605 - RNA, 22 nt, Human
cuccaggcccacgucgaggagg

SEQ ID NO: 180606 - RNA, 22 nt, Human
guccuguguguugccggcugaa

SEQ ID NO: 180607 - RNA, 22 nt, Human
cagguuggggacuuaggaugac

SEQ ID NO: 180608 - RNA, 22 nt, Human
uaggugguugucugcuuuccua

SEQ ID NO: 180609 - RNA, 23 nt, Human
acucaucuucugguauccacagu

SEQ ID NO: 180610 - RNA, 22 nt, Human
aagcugcagcacagagaggugg

SEQ ID NO: 180611 - RNA, 22 nt, Human
gaaaggcuugagacauugauga

SEQ ID NO: 180612 - RNA, 22 nt, Human
aauuagggagagguagcuaggu

SEQ ID NO: 180613 - RNA, 22 nt, Human
ucacuuuacagaugggaaaacu

SEQ ID NO: 180614 - RNA, 22 nt, Human
gcucugaggagccaagaaugug

SEQ ID NO: 180615 - RNA, 22 nt, Human
caccaggcacagcucuccugcu

SEQ ID NO: 180616 - RNA, 23 nt, Human
ucuguaggcagcaugccacucuc

SEQ ID NO: 180617 - RNA, 22 nt, Human
ugaguguuguaaccauaugauu

SEQ ID NO: 180618 - RNA, 22 nt, Human
auguucuauaucauuauuguga

SEQ ID NO: 180619 - RNA, 22 nt, Human
gccugggacuggauguguuugu

SEQ ID NO: 180620 - RNA, 22 nt, Human
caggccuuugcacgugcaguug

SEQ ID NO: 180621 - RNA, 22 nt, Human
aaaauuauagaucuagugccug

SEQ ID NO: 180622 - RNA, 22 nt, Human
aggcuguccucucuugcucagu

SEQ ID NO: 180623 - RNA, 22 nt, Human
ucugaggauagaggcaauagga

SEQ ID NO: 180624 - RNA, 22 nt, Human
uuugacucuagucauagaagug

SEQ ID NO: 180625 - RNA, 22 nt, Human
gauagaaagguguugaaaucca

SEQ ID NO: 180626 - RNA, 22 nt, Human
cucaggaggaugacugccuugg

SEQ ID NO: 180627 - RNA, 22 nt, Human
cugaagcagggagugaugaagu

SEQ ID NO: 180628 - RNA, 21 nt, Human
ugacccuucuagcagaacaca

SEQ ID NO: 180629 - RNA, 22 nt, Human
ucccccacucuaaaggagccuu

SEQ ID NO: 180630 - RNA, 22 nt, Human
ucucacaucugcccugugcugg

SEQ ID NO: 180631 - RNA, 22 nt, Human
aacaggcucuucauuuccagag

SEQ ID NO: 180632 - RNA, 22 nt, Human
ccaggcuucccugagaggcugc

SEQ ID NO: 180633 - RNA, 22 nt, Human
cugggccacaucagaugaagac

SEQ ID NO: 180634 - RNA, 22 nt, Human
ccuuagaagaaaguuacuuuuu

SEQ ID NO: 180635 - RNA, 22 nt, Human
ggccuuagguucccugccucca

SEQ ID NO: 180636 - RNA, 22 nt, Human
ggaggccuagaaaagugguucu

SEQ ID NO: 180637 - RNA, 22 nt, Human
cagcuugggucaggugccugcu

SEQ ID NO: 180638 - RNA, 22 nt, Human
uguucccacaccagccucagcc

SEQ ID NO: 180639 - RNA, 22 nt, Human
ugagagggcccagagcacacca

SEQ ID NO: 180640 - RNA, 22 nt, Human
cagcugaauucuucagacucca

SEQ ID NO: 180641 - RNA, 22 nt, Human
auggaguaauauuaacauguua

SEQ ID NO: 180642 - RNA, 22 nt, Human
gugugucccuacaacagcuuca

SEQ ID NO: 180643 - RNA, 22 nt, Human
caucaucaaaagugacagagaa

SEQ ID NO: 180644 - RNA, 22 nt, Human
guccagucucuuuccaagccca

SEQ ID NO: 180645 - RNA, 22 nt, Human
uauguuuuucagacguccuaca

SEQ ID NO: 180646 - RNA, 19 nt, Human
ugguggaggugcaccugac

SEQ ID NO: 180647 - RNA, 21 nt, Human
aaugcugcccaguaagauggc

SEQ ID NO: 180648 - RNA, 22 nt, Human
caacagcuuuagaaacacuuuc

SEQ ID NO: 180649 - RNA, 22 nt, Human
agcccuaaauuaucuuuauuuu

SEQ ID NO: 180650 - RNA, 22 nt, Human
ugcauuaauuuuugccagguuc

SEQ ID NO: 180651 - RNA, 23 nt, Human
ccugcagcugccacgcccugcuc

SEQ ID NO: 180652 - RNA, 22 nt, Human
gcuuugcauuguuuaaucagga

SEQ ID NO: 180653 - RNA, 22 nt, Human
aguuauuuuggaaaaugaguca

SEQ ID NO: 180654 - RNA, 22 nt, Human
gaagcuugagaacuacuguccu

SEQ ID NO: 180655 - RNA, 22 nt, Human
uagauacauacauuuuaaaaug

SEQ ID NO: 180656 - RNA, 22 nt, Human
uuuaaaguuuuugcacauucug

SEQ ID NO: 180657 - RNA, 22 nt, Human
cuggcucugagcccaccuccag

SEQ ID NO: 180658 - RNA, 18 nt, Human
ugaacuuuuccugcugcu

SEQ ID NO: 180659 - RNA, 23 nt, Human
uuucaguuccagaaaaggggagc

SEQ ID NO: 180660 - RNA, 22 nt, Human
gccaaaguccuccagccaugca

SEQ ID NO: 180661 - RNA, 22 nt, Human
auucuuguaaauuuugugugaa

SEQ ID NO: 180662 - RNA, 22 nt, Human
ugagcucuguuagggcuggaac

SEQ ID NO: 180663 - RNA, 22 nt, Human
accagcugccuggucuaucugc

SEQ ID NO: 180664 - RNA, 20 nt, Human
uggcccagcacgacgaggac

SEQ ID NO: 180665 - RNA, 22 nt, Human
ugaggggccagaccccaccuag

SEQ ID NO: 180666 - RNA, 22 nt, Human
ucagacaggcuucuuucucccu

SEQ ID NO: 180667 - RNA, 22 nt, Human
uaucaacauuaauauuuucugg

SEQ ID NO: 180668 - RNA, 22 nt, Human
aucuuugggauccugauuuacu

SEQ ID NO: 180669 - RNA, 22 nt, Human
uagcauuccuuguggcuucuga

SEQ ID NO: 180670 - RNA, 22 nt, Human
agcacaggaacauggagauggg

SEQ ID NO: 180671 - RNA, 22 nt, Human
agaacugugaaguaugugaaau

SEQ ID NO: 180672 - RNA, 18 nt, Human
uggcaggggcaguacgcc

SEQ ID NO: 180673 - RNA, 22 nt, Human
ugucuguaauagucacuaugug

SEQ ID NO: 180674 - RNA, 22 nt, Human
auuccacaggacuaccaaugug

SEQ ID NO: 180675 - RNA, 22 nt, Human
gucccaggaacauucuggcuag

SEQ ID NO: 180676 - RNA, 22 nt, Human
aauguuugccugacuagagugg

SEQ ID NO: 180677 - RNA, 22 nt, Human
aaauccuuuucuauacagcaua

SEQ ID NO: 180678 - RNA, 18 nt, Human
auauucaagaagacagag

SEQ ID NO: 180679 - RNA, 22 nt, Human
agagccagauggagccgugugu

SEQ ID NO: 180680 - RNA, 21 nt, Human
uaggacagccccccugcccuc

SEQ ID NO: 180681 - RNA, 22 nt, Human
ucaaagaacaucaucugaaaug

SEQ ID NO: 180682 - RNA, 22 nt, Human
cuggcugcaaaaucuauucacu

SEQ ID NO: 180683 - RNA, 22 nt, Human
aucagucuguuggaauaucgcu

SEQ ID NO: 180684 - RNA, 22 nt, Human
uuuacaguuaagaaauguuacc

SEQ ID NO: 180685 - RNA, 22 nt, Human
ggugggagccaacacccuucug

SEQ ID NO: 180686 - RNA, 22 nt, Human
uuugugaauagguuggcuucca

SEQ ID NO: 180687 - RNA, 22 nt, Human
ugguccuggagaguguuccaua

SEQ ID NO: 180688 - RNA, 23 nt, Human
ugauuacaggaaguucaaguguu

SEQ ID NO: 180689 - RNA, 22 nt, Human
ugcuuauuaaacaugcauauuc

SEQ ID NO: 180690 - RNA, 22 nt, Human
ugcccugcccaucuacccuguc

SEQ ID NO: 180691 - RNA, 22 nt, Human
aaccugcauguuucuaaaagca

SEQ ID NO: 180692 - RNA, 22 nt, Human
gucagagcccuucccugauuuu

SEQ ID NO: 180693 - RNA, 22 nt, Human
aauaaugagcuugucuaauugu

SEQ ID NO: 180694 - RNA, 22 nt, Human
aggcugcucaccucccugucug

SEQ ID NO: 180695 - RNA, 22 nt, Human
gggcaggagaagguggaugucc

SEQ ID NO: 180696 - RNA, 22 nt, Human
uugagggagccugggagccaug

SEQ ID NO: 180697 - RNA, 20 nt, Human
gcauccagacacccagcugc

SEQ ID NO: 180698 - RNA, 23 nt, Human
auugugagauuacuaucacacug

SEQ ID NO: 180699 - RNA, 22 nt, Human
cuggagauguccgggugcuguu

SEQ ID NO: 180700 - RNA, 22 nt, Human
cacuggucagcaugguagacca

SEQ ID NO: 180701 - RNA, 22 nt, Human
gcaggcagagguggaggagaca

SEQ ID NO: 180702 - RNA, 22 nt, Human
ucucauguuucugguacuccuu

SEQ ID NO: 180703 - RNA, 22 nt, Human
agucacaugaucccugggccug

SEQ ID NO: 180704 - RNA, 18 nt, Human
ccuggaccugucuccuuu

SEQ ID NO: 180705 - RNA, 22 nt, Human
ugaaagcaaccuguaacaguga

SEQ ID NO: 180706 - RNA, 22 nt, Human
uugcuuuaccauuugaucucua

SEQ ID NO: 180707 - RNA, 22 nt, Human
ucagugcaguagaacuuuaguu

SEQ ID NO: 180708 - RNA, 19 nt, Human
ugcugcaggaugcugcugg

SEQ ID NO: 180709 - RNA, 22 nt, Human
ggcucaggaugagccuucucau

SEQ ID NO: 180710 - RNA, 20 nt, Human
acuccugguaacuuuuguga

SEQ ID NO: 180711 - RNA, 22 nt, Human
aagucauguggaagaauaaccu

SEQ ID NO: 180712 - RNA, 23 nt, Human
ccugucugugcuggguggacaca

SEQ ID NO: 180713 - RNA, 22 nt, Human
aggcaguuguagagagggcucu

SEQ ID NO: 180714 - RNA, 22 nt, Human
acagccaggagccaugggcagg

SEQ ID NO: 180715 - RNA, 21 nt, Human
ugcaggcuacuucugacucua

SEQ ID NO: 180716 - RNA, 22 nt, Human
augaaacacacacgcgcauacu

SEQ ID NO: 180717 - RNA, 22 nt, Human
uccugggagacccagcugugga

SEQ ID NO: 180718 - RNA, 22 nt, Human
gacaccaggucuguuguccucc

SEQ ID NO: 180719 - RNA, 22 nt, Human
uccugagcugccgcaucagcag

SEQ ID NO: 180720 - RNA, 22 nt, Human
aggcugagucgggaggaucacu

SEQ ID NO: 180721 - RNA, 22 nt, Human
uagaaccaguccacagaauuug

SEQ ID NO: 180722 - RNA, 22 nt, Human
gacuuugguuugagcaagucag

SEQ ID NO: 180723 - RNA, 22 nt, Human
caggcaagauccagaggcugcu

SEQ ID NO: 180724 - RNA, 22 nt, Human
ucugucugagugguguuagagu

SEQ ID NO: 180725 - RNA, 21 nt, Human
cccaggaggcugagaagagca

SEQ ID NO: 180726 - RNA, 22 nt, Human
agcauuuagucuuuauugcagc

SEQ ID NO: 180727 - RNA, 22 nt, Human
aacaguuugccugaaauguauu

SEQ ID NO: 180728 - RNA, 22 nt, Human
agggcagcucucaccucuggcc

SEQ ID NO: 180729 - RNA, 22 nt, Human
ggaugcaggaacacagcgaccu

SEQ ID NO: 180730 - RNA, 21 nt, Human
cuucuuggggagcagcuagac

SEQ ID NO: 180731 - RNA, 22 nt, Human
auguuucaucaguaagguuuug

SEQ ID NO: 180732 - RNA, 22 nt, Human
acugggcugccugguucuucua

SEQ ID NO: 180733 - RNA, 22 nt, Human
agugcuuuagcauccaacuguc

SEQ ID NO: 180734 - RNA, 22 nt, Human
acaacagugugguggaaggagc

SEQ ID NO: 180735 - RNA, 21 nt, Human
agcagccauuucacagagacu

SEQ ID NO: 180736 - RNA, 22 nt, Human
ucuccuccagaggcugugggga

SEQ ID NO: 180737 - RNA, 23 nt, Human
ggcugcucuuuucaugcuguuuc

SEQ ID NO: 180738 - RNA, 20 nt, Human
cagggccuaugauugagcuu

SEQ ID NO: 180739 - RNA, 22 nt, Human
aucaggaugacuauaaggcugc

SEQ ID NO: 180740 - RNA, 22 nt, Human
uguccaggcacugggacucuag

SEQ ID NO: 180741 - RNA, 22 nt, Human
aaacuggauuaccaggcuggug

SEQ ID NO: 180742 - RNA, 22 nt, Human
gccugccucaaaaucccaguuc

SEQ ID NO: 180743 - RNA, 22 nt, Human
aggccagcuucuacccucuguu

SEQ ID NO: 180744 - RNA, 22 nt, Human
uacacaguauaugggaucacag

SEQ ID NO: 180745 - RNA, 22 nt, Human
caacuacuggugcucaggaaau

SEQ ID NO: 180746 - RNA, 22 nt, Human
augcaaaaguaacugugauuuu

SEQ ID NO: 180747 - RNA, 18 nt, Human
ccuagccuccaagcucau

SEQ ID NO: 180748 - RNA, 22 nt, Human
gcuggcacugggaaggacugag

SEQ ID NO: 180749 - RNA, 22 nt, Human
uggaaaacuuugguggugaggg

SEQ ID NO: 180750 - RNA, 19 nt, Human
gcuucccaccagccagccc

SEQ ID NO: 180751 - RNA, 22 nt, Human
acaguggcuuuugugucugcag

SEQ ID NO: 180752 - RNA, 22 nt, Human
gauucuuugacaggguguuggg

SEQ ID NO: 180753 - RNA, 22 nt, Human
aucaggauuacacggggaugcu

SEQ ID NO: 180754 - RNA, 22 nt, Human
gccucugcugcaagccugguug

SEQ ID NO: 180755 - RNA, 22 nt, Human
caacagucucuauagcuccuug

SEQ ID NO: 180756 - RNA, 22 nt, Human
cauaucuccuccagcacaggcc

SEQ ID NO: 180757 - RNA, 21 nt, Human
uaaaugugagcagggcugggc

SEQ ID NO: 180758 - RNA, 22 nt, Human
uaggcccaguuccgccucccgg

SEQ ID NO: 180759 - RNA, 22 nt, Human
gcuucucuucgccuagguccuu

SEQ ID NO: 180760 - RNA, 22 nt, Human
gagacacaaacacauuuagagg

SEQ ID NO: 180761 - RNA, 22 nt, Human
ucugggagaagcugaugugaag

SEQ ID NO: 180762 - RNA, 22 nt, Human
cugugugaugggaagaauguuu

SEQ ID NO: 180763 - RNA, 22 nt, Human
cagaggccucacuuccagccag

SEQ ID NO: 180764 - RNA, 22 nt, Human
gaggcugucuguuagccuggga

SEQ ID NO: 180765 - RNA, 21 nt, Human
gcucccugcucagcuccuggg

SEQ ID NO: 180766 - RNA, 22 nt, Human
ucuggcucugacacuacuguua

SEQ ID NO: 180767 - RNA, 22 nt, Human
ccuggggaccugccucagcccu

SEQ ID NO: 180768 - RNA, 22 nt, Human
ucucacuuuccagacuuuucaa

SEQ ID NO: 180769 - RNA, 22 nt, Human
gaauucuuuucuuucugaaagu

SEQ ID NO: 180770 - RNA, 22 nt, Human
ccaagcuggacagcagcaagga

SEQ ID NO: 180771 - RNA, 22 nt, Human
aagauauacuauuaaguaccau

SEQ ID NO: 180772 - RNA, 22 nt, Human
gugcccugagcuuaugcauucu

SEQ ID NO: 180773 - RNA, 22 nt, Human
gcuccaggauaauaaaguuguu

SEQ ID NO: 180774 - RNA, 22 nt, Human
ucuccugguuuguuaaauaauu

SEQ ID NO: 180775 - RNA, 22 nt, Human
auugugcaaaaccucaggccuc

SEQ ID NO: 180776 - RNA, 22 nt, Human
gcagcacaaaguccccagggac

SEQ ID NO: 180777 - RNA, 22 nt, Human
gugcuuucugcugcauuccucu

SEQ ID NO: 180778 - RNA, 22 nt, Human
acauuucuuuucaucucuauau

SEQ ID NO: 180779 - RNA, 22 nt, Human
agcugcagcuacaguguugguu

SEQ ID NO: 180780 - RNA, 22 nt, Human
uuccaaagucauguugcugaua

SEQ ID NO: 180781 - RNA, 22 nt, Human
augucuuggguuucaguuuacu

SEQ ID NO: 180782 - RNA, 22 nt, Human
agccuccaaaugucaggucccg

SEQ ID NO: 180783 - RNA, 22 nt, Human
ugaguucucaugaaaucuaguu

SEQ ID NO: 180784 - RNA, 22 nt, Human
uuucuuuccauacauauugcua

SEQ ID NO: 180785 - RNA, 22 nt, Human
cagcacaggaauaugguggaca

SEQ ID NO: 180786 - RNA, 22 nt, Human
ucuaccagggucacagaggccc

SEQ ID NO: 180787 - RNA, 22 nt, Human
acauuugauuccauccucuacu

SEQ ID NO: 180788 - RNA, 22 nt, Human
guacaauuauuuaaauggugaa

SEQ ID NO: 180789 - RNA, 19 nt, Human
uguacaaggauuaugcagg

SEQ ID NO: 180790 - RNA, 22 nt, Human
uuuuauugucaaugaagacaga

SEQ ID NO: 180791 - RNA, 17 nt, Human
uacaggagagcaggaac

SEQ ID NO: 180792 - RNA, 22 nt, Human
aaagacucaauuguucccuaau

SEQ ID NO: 180793 - RNA, 22 nt, Human
uguguguguuucugcucauaca

SEQ ID NO: 180794 - RNA, 22 nt, Human
cuccuggagggccaaagaaaua

SEQ ID NO: 180795 - RNA, 22 nt, Human
cacugcucgcugcagcauggcc

SEQ ID NO: 180796 - RNA, 22 nt, Human
cccugggacccgcugcagaggc

SEQ ID NO: 180797 - RNA, 22 nt, Human
cugggugacagagugagauggu

SEQ ID NO: 180798 - RNA, 22 nt, Human
gccugggauuguguaagugaau

SEQ ID NO: 180799 - RNA, 22 nt, Human
accugcuuuauuccuccugccu

SEQ ID NO: 180800 - RNA, 22 nt, Human
uugcauauccuccaacacaugg

SEQ ID NO: 180801 - RNA, 22 nt, Human
uauccaaaguuucucagaaacu

SEQ ID NO: 180802 - RNA, 22 nt, Human
uguccuagaguacauuccacug

SEQ ID NO: 180803 - RNA, 22 nt, Human
ucuuucaaagcuguaguagauu

SEQ ID NO: 180804 - RNA, 22 nt, Human
accugcugugauucuaauuggc

SEQ ID NO: 180805 - RNA, 22 nt, Human
ggagccaguauuuaguggucuu

SEQ ID NO: 180806 - RNA, 22 nt, Human
uacauguggaguuuucuaguca

SEQ ID NO: 180807 - RNA, 20 nt, Human
ccuggcaggcggguuacuua

SEQ ID NO: 180808 - RNA, 22 nt, Human
cuguccugugucagccugaaau

SEQ ID NO: 180809 - RNA, 22 nt, Human
agggcugcuccuccuucaggcc

SEQ ID NO: 180810 - RNA, 22 nt, Human
ugcuggaguaacaagacacuca

SEQ ID NO: 180811 - RNA, 22 nt, Human
accuuggaaaguuuaauugagg

SEQ ID NO: 180812 - RNA, 19 nt, Human
uggaccugugcccauggcu

SEQ ID NO: 180813 - RNA, 22 nt, Human
accagcucuucugcucuaguug

SEQ ID NO: 180814 - RNA, 22 nt, Human
ugucuccuacugccuguggauc

SEQ ID NO: 180815 - RNA, 19 nt, Human
gaggcaguagucaaagcuu

SEQ ID NO: 180816 - RNA, 22 nt, Human
gcugcucuggcucugcaguguc

SEQ ID NO: 180817 - RNA, 19 nt, Human
aaggcugguaccauagguu

SEQ ID NO: 180818 - RNA, 22 nt, Human
aagagcuucccuguuguagagg

SEQ ID NO: 180819 - RNA, 22 nt, Human
uacagggacauggaacaggcuc

SEQ ID NO: 180820 - RNA, 22 nt, Human
gaaguuuauuucaaucuauuca

SEQ ID NO: 180821 - RNA, 21 nt, Human
aggcuguccuuugccagcccu

SEQ ID NO: 180822 - RNA, 22 nt, Human
ggaacugauuaagucaugagaa

SEQ ID NO: 180823 - RNA, 23 nt, Human
uucucuuuagauuuacauuacuc

SEQ ID NO: 180824 - RNA, 22 nt, Human
cuccaggcuucaagggccggcc

SEQ ID NO: 180825 - RNA, 22 nt, Human
gcagugcaggacaaaucagugc

SEQ ID NO: 180826 - RNA, 22 nt, Human
uggcagagacaaggccgggccu

SEQ ID NO: 180827 - RNA, 18 nt, Human
ggccagccccaggccagc

SEQ ID NO: 180828 - RNA, 22 nt, Human
cugguguggacuccgcgcggag

SEQ ID NO: 180829 - RNA, 17 nt, Human
ggccauggugcaagguu

SEQ ID NO: 180830 - RNA, 22 nt, Human
uuuacuaagcccaguuauaugc

SEQ ID NO: 180831 - RNA, 22 nt, Human
uggagggcuaagcugagggaua

SEQ ID NO: 180832 - RNA, 22 nt, Human
acagguguggggcugugguacu

SEQ ID NO: 180833 - RNA, 22 nt, Human
ggcugaggguuaagaucagaca

SEQ ID NO: 180834 - RNA, 22 nt, Human
gcagagugccgagauggaagcg

SEQ ID NO: 180835 - RNA, 22 nt, Human
ugagcucuucuaacuaauugug

SEQ ID NO: 180836 - RNA, 22 nt, Human
uuggcucccacuaacuccagca

SEQ ID NO: 180837 - RNA, 22 nt, Human
cuugacuucuucuagaaauaag

SEQ ID NO: 180838 - RNA, 22 nt, Human
uguaccagaugucuaaagccau

SEQ ID NO: 180839 - RNA, 21 nt, Human
cagcaagacauguuuaucaag

SEQ ID NO: 180840 - RNA, 22 nt, Human
gccaggcagauaugugagcuua

SEQ ID NO: 180841 - RNA, 22 nt, Human
aguuaaauguguuagccagggu

SEQ ID NO: 180842 - RNA, 17 nt, Human
guggcugcacacacaug

SEQ ID NO: 180843 - RNA, 22 nt, Human
gcuucuuuccuugggcuggaac

SEQ ID NO: 180844 - RNA, 23 nt, Human
uucagaagaaaugaguacaggag

SEQ ID NO: 180845 - RNA, 22 nt, Human
uuccucucaacaugccugccgg

SEQ ID NO: 180846 - RNA, 22 nt, Human
agagccuguaacaucuuucuua

SEQ ID NO: 180847 - RNA, 22 nt, Human
cuaccugguacauagaaauguu

SEQ ID NO: 180848 - RNA, 18 nt, Human
ugaagacaugagguuagu

SEQ ID NO: 180849 - RNA, 22 nt, Human
uugcauuacauuugcucagucu

SEQ ID NO: 180850 - RNA, 22 nt, Human
uucacauuacaaggccauauuu

SEQ ID NO: 180851 - RNA, 22 nt, Human
uugguaaacuugacagagaauc

SEQ ID NO: 180852 - RNA, 22 nt, Human
ucuggguccccgaggaaggaga

SEQ ID NO: 180853 - RNA, 23 nt, Human
uccagcagccaagaaggguagaa

SEQ ID NO: 180854 - RNA, 22 nt, Human
agaaggcuaaagaaacagauug

SEQ ID NO: 180855 - RNA, 21 nt, Human
ucugggugcuaguguuugcuu

SEQ ID NO: 180856 - RNA, 22 nt, Human
ucugcugcugcagcuacacuau

SEQ ID NO: 180857 - RNA, 22 nt, Human
gacaaaacugagaucacacugu

SEQ ID NO: 180858 - RNA, 22 nt, Human
uugggaaagaaugagaagguga

SEQ ID NO: 180859 - RNA, 22 nt, Human
agccugggcaugggacgggagg

SEQ ID NO: 180860 - RNA, 22 nt, Human
gaggcagagaccuucaggaccu

SEQ ID NO: 180861 - RNA, 22 nt, Human
cuucagaggggacucaaaguca

SEQ ID NO: 180862 - RNA, 22 nt, Human
ucaggugggucuacaauuaguu

SEQ ID NO: 180863 - RNA, 17 nt, Human
uccagccuccucugcug

SEQ ID NO: 180864 - RNA, 21 nt, Human
ucauguguaacuuuugaccac

SEQ ID NO: 180865 - RNA, 22 nt, Human
ggcaggugcuaagagagguaaa

SEQ ID NO: 180866 - RNA, 22 nt, Human
cuggaugugguaaugacuuuga

SEQ ID NO: 180867 - RNA, 22 nt, Human
uuguauuaaaauguguuucugu

SEQ ID NO: 180868 - RNA, 22 nt, Human
uggcuggagucuggugcuagcc

SEQ ID NO: 180869 - RNA, 22 nt, Human
cuucuuuccuuccuccaguggc

SEQ ID NO: 180870 - RNA, 22 nt, Human
cugccugcacugccuggcucca

SEQ ID NO: 180871 - RNA, 22 nt, Human
ggcucaggacacagugguuuag

SEQ ID NO: 180872 - RNA, 22 nt, Human
gcaaauaaaugcucacugcugu

SEQ ID NO: 180873 - RNA, 22 nt, Human
cagggcagagccaggauuucaa

SEQ ID NO: 180874 - RNA, 21 nt, Human
agacaguaacucuucuacucc

SEQ ID NO: 180875 - RNA, 22 nt, Human
cggagcugccugccaagccugc

SEQ ID NO: 180876 - RNA, 22 nt, Human
ccugugcauccgguggucauug

SEQ ID NO: 180877 - RNA, 22 nt, Human
ggcagagccucagcccuccacc

SEQ ID NO: 180878 - RNA, 22 nt, Human
ggcacugagcugccuuggggca

SEQ ID NO: 180879 - RNA, 22 nt, Human
cagguucuggguccuggguccu

SEQ ID NO: 180880 - RNA, 22 nt, Human
ugcagguggccaucuucguucu

SEQ ID NO: 180881 - RNA, 22 nt, Human
gugcucugccuggggucauggc

SEQ ID NO: 180882 - RNA, 22 nt, Human
caaaugcuacuaauaggcaagu

SEQ ID NO: 180883 - RNA, 22 nt, Human
gugguccaucaugcagagcucc

SEQ ID NO: 180884 - RNA, 22 nt, Human
cuguccugaaagggagauuggg

SEQ ID NO: 180885 - RNA, 19 nt, Human
caucuuggaguacuccuuu

SEQ ID NO: 180886 - RNA, 22 nt, Human
aaucaucuccgaaaaaagagua

SEQ ID NO: 180887 - RNA, 20 nt, Human
agcauacaucauaagaaacc

SEQ ID NO: 180888 - RNA, 22 nt, Human
agaaucaggaagacagccuggc

SEQ ID NO: 180889 - RNA, 22 nt, Human
gauuugcauucugaaagcuacc

SEQ ID NO: 180890 - RNA, 22 nt, Human
ugucuaacccaguggcaggagg

SEQ ID NO: 180891 - RNA, 22 nt, Human
ugcagcaggcacaggacggaag

SEQ ID NO: 180892 - RNA, 22 nt, Human
uggcuccuaaugcugcccagac

SEQ ID NO: 180893 - RNA, 22 nt, Human
ggagccagaggcugcugcugug

SEQ ID NO: 180894 - RNA, 22 nt, Human
uggugguuaugcgcuuuguggg

SEQ ID NO: 180895 - RNA, 22 nt, Human
aacgugcauuaggaccucucca

SEQ ID NO: 180896 - RNA, 22 nt, Human
aacacaggggcguggcucuuac

SEQ ID NO: 180897 - RNA, 20 nt, Human
uggaaccuaggcagagcugg

SEQ ID NO: 180898 - RNA, 22 nt, Human
aaaaagucugcaaaggagguug

SEQ ID NO: 180899 - RNA, 22 nt, Human
accaggcagucaccguccagga

SEQ ID NO: 180900 - RNA, 22 nt, Human
uuugaucaugaagaggauaaac

SEQ ID NO: 180901 - RNA, 22 nt, Human
cuaaaauuaccuaccaguuuag

SEQ ID NO: 180902 - RNA, 22 nt, Human
accaucuuagcagacugcagug

SEQ ID NO: 180903 - RNA, 23 nt, Human
ugcauuauccucucugaagacca

SEQ ID NO: 180904 - RNA, 22 nt, Human
aaguucuugaagacuuuaaaua

SEQ ID NO: 180905 - RNA, 18 nt, Human
cacaggcaggugauaggu

SEQ ID NO: 180906 - RNA, 22 nt, Human
cuccauacuuccaacaaacuuu

SEQ ID NO: 180907 - RNA, 22 nt, Human
uauuggauagcuugugcagaau

SEQ ID NO: 180908 - RNA, 22 nt, Human
ccuggccacagggcucugcauu

SEQ ID NO: 180909 - RNA, 22 nt, Human
agcuuuaugggagcuuagauaa

SEQ ID NO: 180910 - RNA, 22 nt, Human
uguuuucauuugauguaacaaa

SEQ ID NO: 180911 - RNA, 22 nt, Human
ugaauucccugcaggcauccuc

SEQ ID NO: 180912 - RNA, 22 nt, Human
aauagaauuuguacuguguuuu

SEQ ID NO: 180913 - RNA, 22 nt, Human
cuccagugcuucuagaaaauac

SEQ ID NO: 180914 - RNA, 22 nt, Human
ucagacagaaggacuauuugaa

SEQ ID NO: 180915 - RNA, 20 nt, Human
aucaaaggcugauucagucc

SEQ ID NO: 180916 - RNA, 22 nt, Human
gcagcuuugaagacuuauuugc

SEQ ID NO: 180917 - RNA, 22 nt, Human
gcaggcguguuucacgugccag

SEQ ID NO: 180918 - RNA, 22 nt, Human
uaaggcuagcaagaugagaaua

SEQ ID NO: 180919 - RNA, 22 nt, Human
auuuugaaaccaaguuauuucc

SEQ ID NO: 180920 - RNA, 22 nt, Human
cuuagaauuuuaauccagaaag

SEQ ID NO: 180921 - RNA, 22 nt, Human
caggaggaagaacucugcaaca

SEQ ID NO: 180922 - RNA, 22 nt, Human
uaggguccugccuacagagaca

SEQ ID NO: 180923 - RNA, 22 nt, Human
uguccuuuguucccugucucug

SEQ ID NO: 180924 - RNA, 22 nt, Human
cgguccaggauggcuggcaagc

SEQ ID NO: 180925 - RNA, 22 nt, Human
gcacucuccuggcugccacagu

SEQ ID NO: 180926 - RNA, 22 nt, Human
ucagauggcauagguuggaauu

SEQ ID NO: 180927 - RNA, 23 nt, Human
ggacccuguggagggugagaguc

SEQ ID NO: 180928 - RNA, 22 nt, Human
guaaguuauauuaaaauuucag

SEQ ID NO: 180929 - RNA, 22 nt, Human
cuggauguaacgaagguuucac

SEQ ID NO: 180930 - RNA, 22 nt, Human
ucugcuguuuacugugugauau

SEQ ID NO: 180931 - RNA, 22 nt, Human
cacugucacguucugaaacugu

SEQ ID NO: 180932 - RNA, 22 nt, Human
ggcugccuauagaauuauuagu

SEQ ID NO: 180933 - RNA, 22 nt, Human
aagagcaaguggguagugaagc

SEQ ID NO: 180934 - RNA, 22 nt, Human
acagugugguuugagcacuggg

SEQ ID NO: 180935 - RNA, 22 nt, Human
gaauacaccaaggaaucagaau

SEQ ID NO: 180936 - RNA, 22 nt, Human
ugucuuuuaguuugugagaucu

SEQ ID NO: 180937 - RNA, 22 nt, Human
ggcccugcugaagccgggucua

SEQ ID NO: 180938 - RNA, 22 nt, Human
ugucacauaggcaaaauguuuu

SEQ ID NO: 180939 - RNA, 22 nt, Human
gaaauuauugcuagagacugca

SEQ ID NO: 180940 - RNA, 22 nt, Human
uccaugcagcagccucccagcc

SEQ ID NO: 180941 - RNA, 22 nt, Human
cucugcaguguaacagcgcuug

SEQ ID NO: 180942 - RNA, 22 nt, Human
auuucuguauccugcugucaga

SEQ ID NO: 180943 - RNA, 22 nt, Human
aaggcagccuuuguuugauuga

SEQ ID NO: 180944 - RNA, 22 nt, Human
cauuaggguaauugaacacuua

SEQ ID NO: 180945 - RNA, 20 nt, Human
uggucuggagccagugagga

SEQ ID NO: 180946 - RNA, 22 nt, Human
gagaaagauggaaucuuacagg

SEQ ID NO: 180947 - RNA, 22 nt, Human
cagcagccauguaccacacuca

SEQ ID NO: 180948 - RNA, 22 nt, Human
uuucugaaacauggucuuugua

SEQ ID NO: 180949 - RNA, 22 nt, Human
aaucugucccuuaacuagucau

SEQ ID NO: 180950 - RNA, 22 nt, Human
uugcuuuaacuaguaaaugggg

SEQ ID NO: 180951 - RNA, 22 nt, Human
ccaugcccuugucaucuccagg

SEQ ID NO: 180952 - RNA, 22 nt, Human
uagaaucugccugcagcaaaga

SEQ ID NO: 180953 - RNA, 22 nt, Human
gcuccaagguauccaccagggu

SEQ ID NO: 180954 - RNA, 22 nt, Human
cucugagaggugagaagcagca

SEQ ID NO: 180955 - RNA, 22 nt, Human
cagugcagccaaggacaggcac

SEQ ID NO: 180956 - RNA, 22 nt, Human
ggcucuggcuacuccacccugu

SEQ ID NO: 180957 - RNA, 22 nt, Human
acaguuuaugguguuuuauaua

SEQ ID NO: 180958 - RNA, 22 nt, Human
ugcacagguaugcaaagcaugu

SEQ ID NO: 180959 - RNA, 22 nt, Human
ccuuggcuguguugccugcccu

SEQ ID NO: 180960 - RNA, 22 nt, Human
caguucuuaauaccaugugguu

SEQ ID NO: 180961 - RNA, 22 nt, Human
uucuggaacauagcaagaaguu

SEQ ID NO: 180962 - RNA, 22 nt, Human
gcacaaaacacauuuugacaau

SEQ ID NO: 180963 - RNA, 22 nt, Human
ugcucaggaggaggcugugagg

SEQ ID NO: 180964 - RNA, 22 nt, Human
augaggcagcugcuggagaacg

SEQ ID NO: 180965 - RNA, 22 nt, Human
ccagcccuugagauggaaggga

SEQ ID NO: 180966 - RNA, 22 nt, Human
uuacaggaggugcuagguguuu

SEQ ID NO: 180967 - RNA, 19 nt, Human
acugugcucgggaaccacu

SEQ ID NO: 180968 - RNA, 22 nt, Human
agugcagguuaaggaacuggcc

SEQ ID NO: 180969 - RNA, 22 nt, Human
uucuguuuauaauuugcaguug

SEQ ID NO: 180970 - RNA, 22 nt, Human
gagaggaguaggcugauggugc

SEQ ID NO: 180971 - RNA, 19 nt, Human
aguuuauuauaggugauuc

SEQ ID NO: 180972 - RNA, 22 nt, Human
ucacacaugcuaagccagagau

SEQ ID NO: 180973 - RNA, 22 nt, Human
uaaauguuguaaguacaucuaa

SEQ ID NO: 180974 - RNA, 22 nt, Human
aggcagcaauugaaaucauugu

SEQ ID NO: 180975 - RNA, 22 nt, Human
acgucuucguuggcagagauuu

SEQ ID NO: 180976 - RNA, 23 nt, Human
cagaaagcccuuuccccacagua

SEQ ID NO: 180977 - RNA, 22 nt, Human
gggacuuaaugcagagagggac

SEQ ID NO: 180978 - RNA, 22 nt, Human
agggaggugguuccccagugga

SEQ ID NO: 180979 - RNA, 22 nt, Human
cugagucuguacguuagccaua

SEQ ID NO: 180980 - RNA, 22 nt, Human
guggcagagauagaacuggaau

SEQ ID NO: 180981 - RNA, 22 nt, Human
acagaauauugguuacuguugc

SEQ ID NO: 180982 - RNA, 20 nt, Human
caccacagaauuggggacag

SEQ ID NO: 180983 - RNA, 22 nt, Human
ugaaggagaaauggaaaguggg

SEQ ID NO: 180984 - RNA, 22 nt, Human
agugugacuacauuacaagagu

SEQ ID NO: 180985 - RNA, 22 nt, Human
cugaaauaaaguugcuaaaauu

SEQ ID NO: 180986 - RNA, 22 nt, Human
ucagcuuggacagcuugguuga

SEQ ID NO: 180987 - RNA, 22 nt, Human
uuggcucagcugggacuguuga

SEQ ID NO: 180988 - RNA, 22 nt, Human
cuggcuuucucugugguguuca

SEQ ID NO: 180989 - RNA, 22 nt, Human
acagguuuuuguggauauaugu

SEQ ID NO: 180990 - RNA, 18 nt, Human
cugugggcuggugcauga

SEQ ID NO: 180991 - RNA, 22 nt, Human
cccagacccagagggaggcagg

SEQ ID NO: 180992 - RNA, 21 nt, Human
aaagagacaaauggcauauac

SEQ ID NO: 180993 - RNA, 22 nt, Human
aggcaaagcgauaccagagcua

SEQ ID NO: 180994 - RNA, 22 nt, Human
uccagccaagggagguuacuag

SEQ ID NO: 180995 - RNA, 22 nt, Human
ucccagccuuaucuccccuggc

SEQ ID NO: 180996 - RNA, 22 nt, Human
ucacagaagaaguagauugcau

SEQ ID NO: 180997 - RNA, 22 nt, Human
aagcugcaaggaagugugccag

SEQ ID NO: 180998 - RNA, 22 nt, Human
cuucucaguugcaagugucaga

SEQ ID NO: 180999 - RNA, 22 nt, Human
acagucuugcuguauggucagg

SEQ ID NO: 181000 - RNA, 22 nt, Human
auuauauugaguauaaccagag

SEQ ID NO: 181001 - RNA, 22 nt, Human
ucaggacacccugugcuuccuu

SEQ ID NO: 181002 - RNA, 22 nt, Human
agucucagccacacagaccuau

SEQ ID NO: 181003 - RNA, 21 nt, Human
uguggcugccucuggcccugg

SEQ ID NO: 181004 - RNA, 22 nt, Human
cugagccacugcuuguucagug

SEQ ID NO: 181005 - RNA, 21 nt, Human
gccugggaaaucugggaagcc

SEQ ID NO: 181006 - RNA, 22 nt, Human
ucucagaaaaacuuugagggua

SEQ ID NO: 181007 - RNA, 22 nt, Human
gcugccagucuaaugggaaaca

SEQ ID NO: 181008 - RNA, 22 nt, Human
uccuggauuuaacccuggcucu

SEQ ID NO: 181009 - RNA, 22 nt, Human
uuucacagagaaauauaacagg

SEQ ID NO: 181010 - RNA, 22 nt, Human
ccaucacaguccccaucgugau

SEQ ID NO: 181011 - RNA, 22 nt, Human
uguuuagacucaaaauugaaag

SEQ ID NO: 181012 - RNA, 22 nt, Human
agagugaaguucaucgugcagc

SEQ ID NO: 181013 - RNA, 22 nt, Human
cuuagaaugggacccaaugggu

SEQ ID NO: 181014 - RNA, 22 nt, Human
ccagagacgucggucagggcgc

SEQ ID NO: 181015 - RNA, 22 nt, Human
gaggaaggcuaaggggcuuaga

SEQ ID NO: 181016 - RNA, 22 nt, Human
uccaguccauggccucagucuu

SEQ ID NO: 181017 - RNA, 22 nt, Human
agcugcuguggggcucggccug

SEQ ID NO: 181018 - RNA, 22 nt, Human
gcuccuggauguucaagucggc

SEQ ID NO: 181019 - RNA, 22 nt, Human
acucagaggaaaguugagauug

SEQ ID NO: 181020 - RNA, 22 nt, Human
uauuagaaaggcuauugcauag

SEQ ID NO: 181021 - RNA, 22 nt, Human
cugaaagaauaagauguuuaca

SEQ ID NO: 181022 - RNA, 22 nt, Human
aacaugauuggaaaaugcuguc

SEQ ID NO: 181023 - RNA, 22 nt, Human
uagcuuuaagaugagaugugga

SEQ ID NO: 181024 - RNA, 22 nt, Human
guuguucucccuaacaauuacu

SEQ ID NO: 181025 - RNA, 22 nt, Human
cagcugagaaggucugaucagg

SEQ ID NO: 181026 - RNA, 19 nt, Human
uggcagguagugagcaguc

SEQ ID NO: 181027 - RNA, 19 nt, Human
uuccugggguuccauugug

SEQ ID NO: 181028 - RNA, 22 nt, Human
augaggcagcacaugggauugu

SEQ ID NO: 181029 - RNA, 22 nt, Human
agcauggacaguggcagcagug

SEQ ID NO: 181030 - RNA, 22 nt, Human
uacuuagacucuaucuagagau

SEQ ID NO: 181031 - RNA, 22 nt, Human
aaauguaguauguugcauguau

SEQ ID NO: 181032 - RNA, 22 nt, Human
ugucaacauuggcugacaguug

SEQ ID NO: 181033 - RNA, 22 nt, Human
uaagcuggggcuaugcuaaaua

SEQ ID NO: 181034 - RNA, 23 nt, Human
ugagggacaugguggcuucugag

SEQ ID NO: 181035 - RNA, 22 nt, Human
acaugaaaacugguuccuucag

SEQ ID NO: 181036 - RNA, 22 nt, Human
acugcaccucagccugggcgac

SEQ ID NO: 181037 - RNA, 23 nt, Human
agggccuggcguggagugugugc

SEQ ID NO: 181038 - RNA, 22 nt, Human
ggcccaucucuugcucuggguu

SEQ ID NO: 181039 - RNA, 18 nt, Human
gcuuucugugcagcggag

SEQ ID NO: 181040 - RNA, 21 nt, Human
cucagagcaguucagagggau

SEQ ID NO: 181041 - RNA, 21 nt, Human
guguggauaugugacaggugg

SEQ ID NO: 181042 - RNA, 22 nt, Human
ccugggcaacauagggagaccc

SEQ ID NO: 181043 - RNA, 22 nt, Human
agggaugauggaaagaagcagg

SEQ ID NO: 181044 - RNA, 22 nt, Human
cuggcuccugaggcuuggcccc

SEQ ID NO: 181045 - RNA, 22 nt, Human
gcaggagcaauggccuaucaga

SEQ ID NO: 181046 - RNA, 22 nt, Human
cuuccuucuguaagaccaguug

SEQ ID NO: 181047 - RNA, 22 nt, Human
ucagcuggagauccuuguugug

SEQ ID NO: 181048 - RNA, 22 nt, Human
ccaggucaagcuccccuguggu

SEQ ID NO: 181049 - RNA, 22 nt, Human
caagcagagagguuagaacaca

SEQ ID NO: 181050 - RNA, 22 nt, Human
ucucagguaagcuucuuugaug

SEQ ID NO: 181051 - RNA, 23 nt, Human
agcuucugguucaggucaagcag

SEQ ID NO: 181052 - RNA, 22 nt, Human
aagcacagggugucugcauuca

SEQ ID NO: 181053 - RNA, 22 nt, Human
ucacauuuucuacuacuguacg

SEQ ID NO: 181054 - RNA, 22 nt, Human
gcaggcugggguagccccacuu

SEQ ID NO: 181055 - RNA, 22 nt, Human
acaaagcuuagaccuaagagau

SEQ ID NO: 181056 - RNA, 22 nt, Human
cuggagggagauucaaaggagg

SEQ ID NO: 181057 - RNA, 22 nt, Human
auaggaaagaaaauuauguagg

SEQ ID NO: 181058 - RNA, 22 nt, Human
ucacuggggccuuuggucagga

SEQ ID NO: 181059 - RNA, 20 nt, Human
ccugcugggaacccucugaa

SEQ ID NO: 181060 - RNA, 22 nt, Human
aggcaacauaacacgaaagucu

SEQ ID NO: 181061 - RNA, 22 nt, Human
gaacagaauuaccgaagaucug

SEQ ID NO: 181062 - RNA, 22 nt, Human
uuggcugcuaauggcugacagc

SEQ ID NO: 181063 - RNA, 20 nt, Human
guugaaaguaauaugaugcu

SEQ ID NO: 181064 - RNA, 22 nt, Human
caauuucugggccucacacaag

SEQ ID NO: 181065 - RNA, 22 nt, Human
uguccuuuuucuuaggaaauau

SEQ ID NO: 181066 - RNA, 22 nt, Human
gguacagggcuuccuggacaag

SEQ ID NO: 181067 - RNA, 22 nt, Human
gagagcugcaagguagggcggg

SEQ ID NO: 181068 - RNA, 22 nt, Human
aacaggaccuuccaauccauca

SEQ ID NO: 181069 - RNA, 22 nt, Human
ucagaugagugcuuucagcugc

SEQ ID NO: 181070 - RNA, 22 nt, Human
uccaggcaaagugcugggcugc

SEQ ID NO: 181071 - RNA, 22 nt, Human
uguuucaugauugcugucauuu

SEQ ID NO: 181072 - RNA, 22 nt, Human
uucugggcucacagagcagcag

SEQ ID NO: 181073 - RNA, 22 nt, Human
agcaauuaugauaaggccgcug

SEQ ID NO: 181074 - RNA, 22 nt, Human
ucagguggcugguugcuggcua

SEQ ID NO: 181075 - RNA, 23 nt, Human
cagaaaugacaguaagcacccug

SEQ ID NO: 181076 - RNA, 22 nt, Human
uccugugccaucucuagagacu

SEQ ID NO: 181077 - RNA, 22 nt, Human
ccugaaaugacuccagcugagu

SEQ ID NO: 181078 - RNA, 22 nt, Human
cuucuuucuuuugaucacaggu

SEQ ID NO: 181079 - RNA, 22 nt, Human
gaggccugcuuuggcacucugg

SEQ ID NO: 181080 - RNA, 23 nt, Human
uuucacaaugagcauuacagaau

SEQ ID NO: 181081 - RNA, 20 nt, Human
cagcuuggaugagaggcuga

SEQ ID NO: 181082 - RNA, 22 nt, Human
gaaggcuauaugacucagcccu

SEQ ID NO: 181083 - RNA, 22 nt, Human
cucugcagaauuugagcugcuc

SEQ ID NO: 181084 - RNA, 22 nt, Human
gcugaugcaggguugagaggag

SEQ ID NO: 181085 - RNA, 22 nt, Human
uguauuuucagaguggcauuuc

SEQ ID NO: 181086 - RNA, 22 nt, Human
gaccagcugauaaggcauauaa

SEQ ID NO: 181087 - RNA, 22 nt, Human
uucuguuucuggggucucugac

SEQ ID NO: 181088 - RNA, 22 nt, Human
cauaauuugugguaguggggga

SEQ ID NO: 181089 - RNA, 18 nt, Human
gguugauaacuugugauu

SEQ ID NO: 181090 - RNA, 22 nt, Human
ucccugcagacguccugcgggu

SEQ ID NO: 181091 - RNA, 22 nt, Human
uggcugaguuccuggcacacgg

SEQ ID NO: 181092 - RNA, 22 nt, Human
cugggccugugacucccauccu

SEQ ID NO: 181093 - RNA, 22 nt, Human
cuuucuuuguccaccaacaaug

SEQ ID NO: 181094 - RNA, 22 nt, Human
cauaggaagccaucucagucac

SEQ ID NO: 181095 - RNA, 22 nt, Human
uucuuucugggaagaguucaga

SEQ ID NO: 181096 - RNA, 22 nt, Human
ccaggggcuggugcugagcugg

SEQ ID NO: 181097 - RNA, 22 nt, Human
uccagcacagaauuuccuagcu

SEQ ID NO: 181098 - RNA, 22 nt, Human
gcccaagccgccuuccagagac

SEQ ID NO: 181099 - RNA, 22 nt, Human
gccagcagccacagaagucacu

SEQ ID NO: 181100 - RNA, 22 nt, Human
cuuugcuugacacugugauugu

SEQ ID NO: 181101 - RNA, 22 nt, Human
ucugugugaccauaagccagcu

SEQ ID NO: 181102 - RNA, 22 nt, Human
uaagacacaugcguacaagaua

SEQ ID NO: 181103 - RNA, 22 nt, Human
aggcaacugacaguuucugcuu

SEQ ID NO: 181104 - RNA, 22 nt, Human
ucugcaggcauuuuugguuguc

SEQ ID NO: 181105 - RNA, 22 nt, Human
cagggcucacucggcuggcguc

SEQ ID NO: 181106 - RNA, 22 nt, Human
uguguccuucugggagucccag

SEQ ID NO: 181107 - RNA, 22 nt, Human
ccuggaucuaaggaagcuggga

SEQ ID NO: 181108 - RNA, 22 nt, Human
ggaaguuucaggaaucugcauu

SEQ ID NO: 181109 - RNA, 22 nt, Human
cuggcuggcagaugcucuugcu

SEQ ID NO: 181110 - RNA, 22 nt, Human
cagcaagaaucagacaaccuca

SEQ ID NO: 181111 - RNA, 22 nt, Human
uugccagggucaggaugagauc

SEQ ID NO: 181112 - RNA, 22 nt, Human
agucaagauucuggcacuagca

SEQ ID NO: 181113 - RNA, 22 nt, Human
agagccugucugccuuucuacc

SEQ ID NO: 181114 - RNA, 22 nt, Human
ccgggagcaggcgccaccgcca

SEQ ID NO: 181115 - RNA, 22 nt, Human
acauuucagauucaugaaguga

SEQ ID NO: 181116 - RNA, 21 nt, Human
uuuggcaguuucccaggaaau

SEQ ID NO: 181117 - RNA, 22 nt, Human
cuggcagguggagguugcagug

SEQ ID NO: 181118 - RNA, 22 nt, Human
aagaagcuaagacuaucugggu

SEQ ID NO: 181119 - RNA, 22 nt, Human
gaguggcauaugugccugugaa

SEQ ID NO: 181120 - RNA, 22 nt, Human
agaagccauaguaucucagggu

SEQ ID NO: 181121 - RNA, 22 nt, Human
gagcucugaaaaagcuugccuu

SEQ ID NO: 181122 - RNA, 22 nt, Human
gauucuuaugagugaacuuuac

SEQ ID NO: 181123 - RNA, 22 nt, Human
acagggcaccugagguaggaag

SEQ ID NO: 181124 - RNA, 22 nt, Human
cuuuuccacugagccucacaaa

SEQ ID NO: 181125 - RNA, 22 nt, Human
ccagcaggguugguuucuucug

SEQ ID NO: 181126 - RNA, 22 nt, Human
gcucugggaaggaucguaguga

SEQ ID NO: 181127 - RNA, 22 nt, Human
gggacucugagagccugagggu

SEQ ID NO: 181128 - RNA, 22 nt, Human
uggccuguguggcuuccuggga

SEQ ID NO: 181129 - RNA, 22 nt, Human
ugaggcagugauguuuaagcac

SEQ ID NO: 181130 - RNA, 22 nt, Human
cuuuacaaacuauaaagugcgg

SEQ ID NO: 181131 - RNA, 22 nt, Human
aaagcaguaguuuucaaauagu

SEQ ID NO: 181132 - RNA, 22 nt, Human
uucugagcugcaacacuaacau

SEQ ID NO: 181133 - RNA, 22 nt, Human
ucaggaaagguuuguugaaugg

SEQ ID NO: 181134 - RNA, 22 nt, Human
uccugggcccaggcugccaggg

SEQ ID NO: 181135 - RNA, 22 nt, Human
auugaaagcauggauuuggauu

SEQ ID NO: 181136 - RNA, 22 nt, Human
ccaggugucugucucuuuuuca

SEQ ID NO: 181137 - RNA, 22 nt, Human
gauagucaccucccuuaacuuu

SEQ ID NO: 181138 - RNA, 22 nt, Human
uccaggcugccacagugcaacg

SEQ ID NO: 181139 - RNA, 22 nt, Human
gggaggugauuaggaccaugua

SEQ ID NO: 181140 - RNA, 22 nt, Human
ugaggcaggacuugcauaaagu

SEQ ID NO: 181141 - RNA, 22 nt, Human
uucuccagucacugacuucgag

SEQ ID NO: 181142 - RNA, 22 nt, Human
uaacugguacucugguagccug

SEQ ID NO: 181143 - RNA, 22 nt, Human
aaguccaguuucauuugagguc

SEQ ID NO: 181144 - RNA, 22 nt, Human
ucugcuggccuuagcaggucua

SEQ ID NO: 181145 - RNA, 22 nt, Human
uguacauugucacucaucaagu

SEQ ID NO: 181146 - RNA, 22 nt, Human
uucuguguugugacauucuaga

SEQ ID NO: 181147 - RNA, 22 nt, Human
agaaaacagaaagucauuggug

SEQ ID NO: 181148 - RNA, 20 nt, Human
uauugccuaaauaccagaau

SEQ ID NO: 181149 - RNA, 22 nt, Human
uuguauuuccuauaaccuuucu

SEQ ID NO: 181150 - RNA, 22 nt, Human
agccucugauggcucccaagga

SEQ ID NO: 181151 - RNA, 22 nt, Human
guccucagaagccugcuuagcu

SEQ ID NO: 181152 - RNA, 22 nt, Human
acuugauuuuuauaauaaaugg

SEQ ID NO: 181153 - RNA, 22 nt, Human
uucauuccugagcccauauuua

SEQ ID NO: 181154 - RNA, 22 nt, Human
agcccaggaaguugaggcuugc

SEQ ID NO: 181155 - RNA, 22 nt, Human
cagcugcugcccuuggcugcag

SEQ ID NO: 181156 - RNA, 21 nt, Human
agcagcagaucuggugagggc

SEQ ID NO: 181157 - RNA, 22 nt, Human
cacaggccaauacccucucucu

SEQ ID NO: 181158 - RNA, 22 nt, Human
gagccugaugaaacaggcagac

SEQ ID NO: 181159 - RNA, 22 nt, Human
ugagcaggcgcagcaggagguc

SEQ ID NO: 181160 - RNA, 22 nt, Human
uggaggucugcaaggcgcugga

SEQ ID NO: 181161 - RNA, 22 nt, Human
acagccaguccucccacagggu

SEQ ID NO: 181162 - RNA, 22 nt, Human
ugggcaggagagaagcuaaaga

SEQ ID NO: 181163 - RNA, 22 nt, Human
aaacuugacaguagacagauua

SEQ ID NO: 181164 - RNA, 22 nt, Human
gcagcuuccugaguguggacag

SEQ ID NO: 181165 - RNA, 23 nt, Human
uucaugagauuaucugcaugugu

SEQ ID NO: 181166 - RNA, 22 nt, Human
uggcucaguuucugcccagcug

SEQ ID NO: 181167 - RNA, 22 nt, Human
acagguggcuuccauuuucuaa

SEQ ID NO: 181168 - RNA, 22 nt, Human
aggcaggcccugggccaucccg

SEQ ID NO: 181169 - RNA, 22 nt, Human
uaggcucuagauguggucuuug

SEQ ID NO: 181170 - RNA, 21 nt, Human
uggcuaaacccuaguaaauua

SEQ ID NO: 181171 - RNA, 22 nt, Human
uucucaggguuugugcaggcuu

SEQ ID NO: 181172 - RNA, 22 nt, Human
ucauaaauuagcugucuuugaa

SEQ ID NO: 181173 - RNA, 22 nt, Human
agguccagaggcuccuuauuac

SEQ ID NO: 181174 - RNA, 22 nt, Human
ggcccagugcuguucacccagu

SEQ ID NO: 181175 - RNA, 21 nt, Human
agcuuguuauuaauucagaac

SEQ ID NO: 181176 - RNA, 19 nt, Human
ugcccagaguguaugcgca

SEQ ID NO: 181177 - RNA, 23 nt, Human
uuuuagugacuccuuuaucugcc

SEQ ID NO: 181178 - RNA, 22 nt, Human
cagugcaguggcugagcuggag

SEQ ID NO: 181179 - RNA, 22 nt, Human
aagacaaugcauuacuaagaag

SEQ ID NO: 181180 - RNA, 23 nt, Human
uagaaucuguauuucugcaguuc

SEQ ID NO: 181181 - RNA, 22 nt, Human
ugcauauacccgcauuuacaua

SEQ ID NO: 181182 - RNA, 22 nt, Human
uuaauacaacuguugucacugg

SEQ ID NO: 181183 - RNA, 22 nt, Human
cgccucagccguggucaucuuc

SEQ ID NO: 181184 - RNA, 22 nt, Human
agcagguggugggccagauuug

SEQ ID NO: 181185 - RNA, 16 nt, Human
ucagugucagcuccug

SEQ ID NO: 181186 - RNA, 22 nt, Human
ccucuuugugccugcaggcugc

SEQ ID NO: 181187 - RNA, 22 nt, Human
cuguggucacuguuggggaaug

SEQ ID NO: 181188 - RNA, 22 nt, Human
acuaacuugcugagugaccaug

SEQ ID NO: 181189 - RNA, 22 nt, Human
caugccauuugguggauugaga

SEQ ID NO: 181190 - RNA, 22 nt, Human
auauuguacuaggguuacaugu

SEQ ID NO: 181191 - RNA, 22 nt, Human
caugcuaaaauaucugaagauu

SEQ ID NO: 181192 - RNA, 19 nt, Human
ccugggagucagcugaagg

SEQ ID NO: 181193 - RNA, 22 nt, Human
aaauucuuuugugcggugaagu

SEQ ID NO: 181194 - RNA, 22 nt, Human
gcugggagcccuggucugcucc

SEQ ID NO: 181195 - RNA, 18 nt, Human
caguggcauaguugagua

SEQ ID NO: 181196 - RNA, 22 nt, Human
uuggcccuuuaugggaugggca

SEQ ID NO: 181197 - RNA, 22 nt, Human
ggccagaggccacagcuguguc

SEQ ID NO: 181198 - RNA, 22 nt, Human
agaaaauaaauugaugguggaa

SEQ ID NO: 181199 - RNA, 18 nt, Human
ggacaucaucaggugcuu

SEQ ID NO: 181200 - RNA, 22 nt, Human
cauucauaagacuuugcucuug

SEQ ID NO: 181201 - RNA, 22 nt, Human
ugucacaucagggguguugaca

SEQ ID NO: 181202 - RNA, 22 nt, Human
uguuacagcagaauugaaagag

SEQ ID NO: 181203 - RNA, 23 nt, Human
agggcuccuuguugauuagcauu

SEQ ID NO: 181204 - RNA, 22 nt, Human
aauggccagcugggagaguuga

SEQ ID NO: 181205 - RNA, 22 nt, Human
gaggaugguaugaggcaagcaa

SEQ ID NO: 181206 - RNA, 22 nt, Human
cuacccaggcuggagugcagua

SEQ ID NO: 181207 - RNA, 22 nt, Human
cagcaucucuuuuugcauuccu

SEQ ID NO: 181208 - RNA, 19 nt, Human
cuggucugucaugcucccc

SEQ ID NO: 181209 - RNA, 22 nt, Human
uucugugaggacuucucaagga

SEQ ID NO: 181210 - RNA, 22 nt, Human
ccgaggcuggccucagggcugu

SEQ ID NO: 181211 - RNA, 22 nt, Human
ucuguacaguaccagauaguaa

SEQ ID NO: 181212 - RNA, 22 nt, Human
uugacucauaccugccugaccc

SEQ ID NO: 181213 - RNA, 22 nt, Human
ggaaaacaagagaaugauguuu

SEQ ID NO: 181214 - RNA, 22 nt, Human
ugggaguggggcauagaaggua

SEQ ID NO: 181215 - RNA, 22 nt, Human
accagucuuguugccaugucug

SEQ ID NO: 181216 - RNA, 22 nt, Human
gcuuggcucuaagacaccuauu

SEQ ID NO: 181217 - RNA, 22 nt, Human
uagaaaugugauaauagcuuaa

SEQ ID NO: 181218 - RNA, 22 nt, Human
uaugcaaaucauuagauuuccu

SEQ ID NO: 181219 - RNA, 22 nt, Human
ccuucuucuguguggcccaaga

SEQ ID NO: 181220 - RNA, 22 nt, Human
uucagcaguuucugagaagcaa

SEQ ID NO: 181221 - RNA, 22 nt, Human
augcacagacccaaaggccauc

SEQ ID NO: 181222 - RNA, 21 nt, Human
uuugccuucacgaagcauccu

SEQ ID NO: 181223 - RNA, 22 nt, Human
cuguccuguagcuccaucaguc

SEQ ID NO: 181224 - RNA, 22 nt, Human
ugaggcagaaauuccuguuuuc

SEQ ID NO: 181225 - RNA, 22 nt, Human
uggucuaagagccuaacugcug

SEQ ID NO: 181226 - RNA, 22 nt, Human
agcacccuccaacuucccugua

SEQ ID NO: 181227 - RNA, 22 nt, Human
acauguuuugugccuugacuag

SEQ ID NO: 181228 - RNA, 22 nt, Human
uggcagcaaaaccagaaucaga

SEQ ID NO: 181229 - RNA, 19 nt, Human
uccaggcauccuucaggcu

SEQ ID NO: 181230 - RNA, 22 nt, Human
uuuuauuggagugauaccaagc

SEQ ID NO: 181231 - RNA, 19 nt, Human
cuucugugauacaucaguc

SEQ ID NO: 181232 - RNA, 22 nt, Human
cugccucuguugggcauggucu

SEQ ID NO: 181233 - RNA, 19 nt, Human
gcacugaagaguuggucac

SEQ ID NO: 181234 - RNA, 19 nt, Human
ucauuguugguuugucggg

SEQ ID NO: 181235 - RNA, 22 nt, Human
uguuaaucaacaacaaacagug

SEQ ID NO: 181236 - RNA, 22 nt, Human
gagcucaguguagucauggcuu

SEQ ID NO: 181237 - RNA, 22 nt, Human
caagggcucacggucugcuggg

SEQ ID NO: 181238 - RNA, 22 nt, Human
aaaacacaagaagcaggguaca

SEQ ID NO: 181239 - RNA, 22 nt, Human
gugcauauuuugcacacagaug

SEQ ID NO: 181240 - RNA, 22 nt, Human
ugcuaacaaagucuaaaucaua

SEQ ID NO: 181241 - RNA, 21 nt, Human
gaaaaccauuugcaucaugag

SEQ ID NO: 181242 - RNA, 22 nt, Human
gauggcuuaagaguaaaaggca

SEQ ID NO: 181243 - RNA, 20 nt, Human
uuacuugucucagcauggag

SEQ ID NO: 181244 - RNA, 22 nt, Human
uuugaaaggguuaugagacuga

SEQ ID NO: 181245 - RNA, 22 nt, Human
cauaauuaggcaguugaucauu

SEQ ID NO: 181246 - RNA, 22 nt, Human
ccugcaccuaacacaacgcucu

SEQ ID NO: 181247 - RNA, 22 nt, Human
uugcaagagagucugaaaaaug

SEQ ID NO: 181248 - RNA, 22 nt, Human
ugcaggcaccauucugccucuc

SEQ ID NO: 181249 - RNA, 22 nt, Human
uuuagagcaggguguggcacau

SEQ ID NO: 181250 - RNA, 22 nt, Human
aguccauaguuuacauuacagc

SEQ ID NO: 181251 - RNA, 23 nt, Human
ugagaagccaggggagcgugagg

SEQ ID NO: 181252 - RNA, 22 nt, Human
acacuguuccacacuaagaagg

SEQ ID NO: 181253 - RNA, 22 nt, Human
acaggcuuuuuugcucucgaau

SEQ ID NO: 181254 - RNA, 18 nt, Human
ucccuccugccugcuucc

SEQ ID NO: 181255 - RNA, 22 nt, Human
auaucuaggcugaauguaaaau

SEQ ID NO: 181256 - RNA, 22 nt, Human
acaggccauaaaggcaggcccu

SEQ ID NO: 181257 - RNA, 22 nt, Human
cuggcccuaugagccuccugau

SEQ ID NO: 181258 - RNA, 22 nt, Human
ggcuggucucagugcuggguuc

SEQ ID NO: 181259 - RNA, 22 nt, Human
cagcaacugugccugacacaca

SEQ ID NO: 181260 - RNA, 22 nt, Human
uggaaucaguuacaugugguug

SEQ ID NO: 181261 - RNA, 22 nt, Human
auccuggcccucaugaccccuu

SEQ ID NO: 181262 - RNA, 22 nt, Human
uuccugaggaggaccaggacca

SEQ ID NO: 181263 - RNA, 22 nt, Human
agaagggaacucagagaugauu

SEQ ID NO: 181264 - RNA, 22 nt, Human
agaacuauugcaauaacaagaa

SEQ ID NO: 181265 - RNA, 19 nt, Human
agccacagaacuugcagga

SEQ ID NO: 181266 - RNA, 22 nt, Human
ccagagguuccaggcuagggag

SEQ ID NO: 181267 - RNA, 22 nt, Human
cuuuggauggcuguguguuuau

SEQ ID NO: 181268 - RNA, 22 nt, Human
guugaaaguagaugcuauuugg

SEQ ID NO: 181269 - RNA, 22 nt, Human
acaucucagaacugaguaaccg

SEQ ID NO: 181270 - RNA, 22 nt, Human
agagcaggcauaaagcuuugaa

SEQ ID NO: 181271 - RNA, 22 nt, Human
auucuagauaagaaaagggcug

SEQ ID NO: 181272 - RNA, 22 nt, Human
aaggaggccuggcagaugaaga

SEQ ID NO: 181273 - RNA, 22 nt, Human
aaacaucucaaagagguauuug

SEQ ID NO: 181274 - RNA, 22 nt, Human
guccagugacaaguagcuggcc

SEQ ID NO: 181275 - RNA, 18 nt, Human
agagacagcagcaaaaga

SEQ ID NO: 181276 - RNA, 16 nt, Human
aaggaaugucauucug

SEQ ID NO: 181277 - RNA, 22 nt, Human
agacagggucuugaucagagcu

SEQ ID NO: 181278 - RNA, 22 nt, Human
agaaacucaccuuuccagccau

SEQ ID NO: 181279 - RNA, 19 nt, Human
cucuuggguggcagaggcc

SEQ ID NO: 181280 - RNA, 22 nt, Human
agggaggagaauggacuccuuc

SEQ ID NO: 181281 - RNA, 22 nt, Human
caguucucuugaucgucucuug

SEQ ID NO: 181282 - RNA, 22 nt, Human
acauuuuacaguugucuggcua

SEQ ID NO: 181283 - RNA, 20 nt, Human
ggcaccaggcuaggauugga

SEQ ID NO: 181284 - RNA, 22 nt, Human
acuguuuucuguaaagggccag

SEQ ID NO: 181285 - RNA, 23 nt, Human
guuccuucauguggucauugguu

SEQ ID NO: 181286 - RNA, 22 nt, Human
gugagggcagcuuggucagugu

SEQ ID NO: 181287 - RNA, 21 nt, Human
gccaccccuggcacaggugcu

SEQ ID NO: 181288 - RNA, 22 nt, Human
ugcccaggguggagugcagcgg

SEQ ID NO: 181289 - RNA, 22 nt, Human
gaagcugggucgcugggauccu

SEQ ID NO: 181290 - RNA, 22 nt, Human
auguauuaugguuuuccuuaag

SEQ ID NO: 181291 - RNA, 22 nt, Human
uucaggauaguggugaguggca

SEQ ID NO: 181292 - RNA, 21 nt, Human
gucuuuuaagugaagagaggc

SEQ ID NO: 181293 - RNA, 23 nt, Human
ccaauucagauauuggcuugugc

SEQ ID NO: 181294 - RNA, 22 nt, Human
gcugaggccaggccccaccgga

SEQ ID NO: 181295 - RNA, 22 nt, Human
cuggcugcuugggacagccaug

SEQ ID NO: 181296 - RNA, 22 nt, Human
caggauggucagaugcauuguc

SEQ ID NO: 181297 - RNA, 22 nt, Human
uccuggccgccgcguggggccg

SEQ ID NO: 181298 - RNA, 22 nt, Human
ucugcauauuguuaauggaaug

SEQ ID NO: 181299 - RNA, 21 nt, Human
uuauuucacauggacuuccag

SEQ ID NO: 181300 - RNA, 22 nt, Human
uaagcaaugcuguaguucaguc

SEQ ID NO: 181301 - RNA, 22 nt, Human
uugagguaguacuuauuauugg

SEQ ID NO: 181302 - RNA, 18 nt, Human
aaauuauucuuccuuuuc

SEQ ID NO: 181303 - RNA, 22 nt, Human
uggcugccuagugucugagcag

SEQ ID NO: 181304 - RNA, 22 nt, Human
aacuuguauauguuauucagag

SEQ ID NO: 181305 - RNA, 22 nt, Human
ucacagacacauuaaacaugug

SEQ ID NO: 181306 - RNA, 22 nt, Human
ucauaaaaguacucauguucau

SEQ ID NO: 181307 - RNA, 17 nt, Human
caguggcagaucuucuc

SEQ ID NO: 181308 - RNA, 22 nt, Human
cuggcuuugaaggucuuuccua

SEQ ID NO: 181309 - RNA, 22 nt, Human
cagagccagagaccugcugugc

SEQ ID NO: 181310 - RNA, 22 nt, Human
ucacaaagcuuugauaagcaga

SEQ ID NO: 181311 - RNA, 22 nt, Human
ccuccugguaauuagcgaaagg

SEQ ID NO: 181312 - RNA, 23 nt, Human
uccuucaaguuaggaagugaaca

SEQ ID NO: 181313 - RNA, 22 nt, Human
ccugcaagaccugagacacacc

SEQ ID NO: 181314 - RNA, 22 nt, Human
uuagaaccauaaugaaucaaug

SEQ ID NO: 181315 - RNA, 22 nt, Human
gggagggagaggacaguucuau

SEQ ID NO: 181316 - RNA, 22 nt, Human
cuucccaguucugcuugagggg

SEQ ID NO: 181317 - RNA, 22 nt, Human
uguguacacgagagguuauaua

SEQ ID NO: 181318 - RNA, 21 nt, Human
gcaggggauagaaauggucug

SEQ ID NO: 181319 - RNA, 22 nt, Human
gagguggucgaggagggguacc

SEQ ID NO: 181320 - RNA, 22 nt, Human
ccuccaggccuugcagguuaac

SEQ ID NO: 181321 - RNA, 22 nt, Human
auggaaauggagugugcuugcu

SEQ ID NO: 181322 - RNA, 22 nt, Human
acuuguucauugaguacauaug

SEQ ID NO: 181323 - RNA, 22 nt, Human
ugcugcagacgaagcccaugcc

SEQ ID NO: 181324 - RNA, 22 nt, Human
caggcauggagaggcagagacu

SEQ ID NO: 181325 - RNA, 22 nt, Human
agguccugaagauuuuacuaga

SEQ ID NO: 181326 - RNA, 22 nt, Human
caggguggugaauagcuauagu

SEQ ID NO: 181327 - RNA, 22 nt, Human
auugucagggguuguggaguuu

SEQ ID NO: 181328 - RNA, 22 nt, Human
cugggaggauucauugagguga

SEQ ID NO: 181329 - RNA, 22 nt, Human
ucgagcugcacgcccccgagcu

SEQ ID NO: 181330 - RNA, 22 nt, Human
gugggacaaggaugaagauauu

SEQ ID NO: 181331 - RNA, 22 nt, Human
accugcagguguuuccacacuu

SEQ ID NO: 181332 - RNA, 22 nt, Human
uugccugguccugugggugcug

SEQ ID NO: 181333 - RNA, 22 nt, Human
gucaacaagguuugcuuaucuu

SEQ ID NO: 181334 - RNA, 19 nt, Human
uaaaggaagaggaagggaa

SEQ ID NO: 181335 - RNA, 22 nt, Human
gcccaggaguuggaggcugcag

SEQ ID NO: 181336 - RNA, 22 nt, Human
ucuugcacuucaugaauauguu

SEQ ID NO: 181337 - RNA, 22 nt, Human
gaauuuaaggaccaagcauuuu

SEQ ID NO: 181338 - RNA, 22 nt, Human
ccugaguggugcuaagcagaua

SEQ ID NO: 181339 - RNA, 22 nt, Human
gggcugcugggcaagaaacauu

SEQ ID NO: 181340 - RNA, 22 nt, Human
gcuguccucgucucucacgcaa

SEQ ID NO: 181341 - RNA, 22 nt, Human
guccuucauuuccugaucucua

SEQ ID NO: 181342 - RNA, 22 nt, Human
gauucaaagacagacucauuuc

SEQ ID NO: 181343 - RNA, 22 nt, Human
uaccuggcagucagucuuuccg

SEQ ID NO: 181344 - RNA, 22 nt, Human
cuuucuucaucaagugccacgu

SEQ ID NO: 181345 - RNA, 22 nt, Human
ugcugggccaaagcaggguuuu

SEQ ID NO: 181346 - RNA, 22 nt, Human
gucugcccuggggcaucaguuu

SEQ ID NO: 181347 - RNA, 22 nt, Human
acagcaugucuaguuaaauacu

SEQ ID NO: 181348 - RNA, 22 nt, Human
caggcucaauggccacuugggc

SEQ ID NO: 181349 - RNA, 22 nt, Human
acauaugaguacuauacagugc

SEQ ID NO: 181350 - RNA, 22 nt, Human
uuuagggaugucagaacaggga

SEQ ID NO: 181351 - RNA, 22 nt, Human
cagggccugccugguuccugga

SEQ ID NO: 181352 - RNA, 20 nt, Human
uaacugaucauuuucaccag

SEQ ID NO: 181353 - RNA, 22 nt, Human
cuagaacaaauuaggaggcaua

SEQ ID NO: 181354 - RNA, 22 nt, Human
aaauguauugcauaggauauuu

SEQ ID NO: 181355 - RNA, 22 nt, Human
augguuauuacugcuguuccag

SEQ ID NO: 181356 - RNA, 20 nt, Human
aguaggcaaaggaaagaucu

SEQ ID NO: 181357 - RNA, 22 nt, Human
cagcugguuaucagagaggccu

SEQ ID NO: 181358 - RNA, 22 nt, Human
uaaugcuuuguuuugaucuaac

SEQ ID NO: 181359 - RNA, 22 nt, Human
agguggcagaugggggugcucg

SEQ ID NO: 181360 - RNA, 18 nt, Human
aguuagaaaugaaggcca

SEQ ID NO: 181361 - RNA, 22 nt, Human
agucaaaggguauuuggauuga

SEQ ID NO: 181362 - RNA, 22 nt, Human
cacagguguccaauaccugcuu

SEQ ID NO: 181363 - RNA, 22 nt, Human
cucuuuaagcuccuaacagcca

SEQ ID NO: 181364 - RNA, 22 nt, Human
aagaaucuguugauuccccacu

SEQ ID NO: 181365 - RNA, 22 nt, Human
ucccagggacccagccugauac

SEQ ID NO: 181366 - RNA, 23 nt, Human
ugaguucuaggcuuaaaacuagc

SEQ ID NO: 181367 - RNA, 22 nt, Human
aagcugaaacauuagccuaaac

SEQ ID NO: 181368 - RNA, 22 nt, Human
gcugcgccggaucccacguucc

SEQ ID NO: 181369 - RNA, 22 nt, Human
aacuuauugaacauucucgaau

SEQ ID NO: 181370 - RNA, 22 nt, Human
aagagagacaauagguagcauu

SEQ ID NO: 181371 - RNA, 22 nt, Human
uuaucauugucgcagucuaauu

SEQ ID NO: 181372 - RNA, 17 nt, Human
acagggcagaaacagcu

SEQ ID NO: 181373 - RNA, 23 nt, Human
auuccagagcuagagucaagugg

SEQ ID NO: 181374 - RNA, 22 nt, Human
cuggcugccuauagucucccuu

SEQ ID NO: 181375 - RNA, 22 nt, Human
uucugugugccagaguugugcu

SEQ ID NO: 181376 - RNA, 22 nt, Human
ugagcugcccccuggccugcuc

SEQ ID NO: 181377 - RNA, 20 nt, Human
ugaaggccagcagcauaggg

SEQ ID NO: 181378 - RNA, 22 nt, Human
ugucauuuaauagauaugaugg

SEQ ID NO: 181379 - RNA, 20 nt, Human
uacaauauucccacuuugcu

SEQ ID NO: 181380 - RNA, 22 nt, Human
gugggcaggccccaaagcaggg

SEQ ID NO: 181381 - RNA, 22 nt, Human
ucaucucaaaacccaaggggca

SEQ ID NO: 181382 - RNA, 22 nt, Human
cucuggccugcuuccucaggua

SEQ ID NO: 181383 - RNA, 22 nt, Human
guugacagcuggugagcugcua

SEQ ID NO: 181384 - RNA, 22 nt, Human
uugcaggguccuguggcucucc

SEQ ID NO: 181385 - RNA, 22 nt, Human
uggcaauguaggcaagaacauu

SEQ ID NO: 181386 - RNA, 19 nt, Human
cuccuucccugguuucugu

SEQ ID NO: 181387 - RNA, 22 nt, Human
cugccuggcauagucuggucga

SEQ ID NO: 181388 - RNA, 20 nt, Human
gcuucucagggcuucucuga

SEQ ID NO: 181389 - RNA, 22 nt, Human
gcuccuguuuucuuccagaaau

SEQ ID NO: 181390 - RNA, 22 nt, Human
uggugagaccuuguuccuuaug

SEQ ID NO: 181391 - RNA, 22 nt, Human
agcugccugugcugggagccca

SEQ ID NO: 181392 - RNA, 17 nt, Human
acaacagaaauguauuc

SEQ ID NO: 181393 - RNA, 22 nt, Human
cccaggacucugacacccccaa

SEQ ID NO: 181394 - RNA, 22 nt, Human
ggccaggaagggaagaucagca

SEQ ID NO: 181395 - RNA, 22 nt, Human
gacccggcuccaggcccagcag

SEQ ID NO: 181396 - RNA, 22 nt, Human
gaggcugggaaguccaagacca

SEQ ID NO: 181397 - RNA, 22 nt, Human
agccuugcuuuuucaguagcac

SEQ ID NO: 181398 - RNA, 22 nt, Human
uucuucaaaauccagcaugauu

SEQ ID NO: 181399 - RNA, 22 nt, Human
cagcugucacuucuaaguuuug

SEQ ID NO: 181400 - RNA, 22 nt, Human
ucaucaaagucaaagaaugacu

SEQ ID NO: 181401 - RNA, 22 nt, Human
ucuuggagauagggucuuaaug

SEQ ID NO: 181402 - RNA, 22 nt, Human
cugugacuagaccugcaggaga

SEQ ID NO: 181403 - RNA, 22 nt, Human
aucagucuguguuagaaaagag

SEQ ID NO: 181404 - RNA, 23 nt, Human
guguucaucccagucugugcaau

SEQ ID NO: 181405 - RNA, 22 nt, Human
uaacaauacccauucuaauuac

SEQ ID NO: 181406 - RNA, 22 nt, Human
ccuguaaauaguuucuucugac

SEQ ID NO: 181407 - RNA, 22 nt, Human
gcuguagguucagucuccaugc

SEQ ID NO: 181408 - RNA, 22 nt, Human
auuguugggucucacuccuaga

SEQ ID NO: 181409 - RNA, 21 nt, Human
cagagcagcguucugcugugg

SEQ ID NO: 181410 - RNA, 22 nt, Human
ucucagaagugaucaggauguu

SEQ ID NO: 181411 - RNA, 22 nt, Human
ccugaggucacaacuugcuuau

SEQ ID NO: 181412 - RNA, 18 nt, Human
ucuguccuuccauucuuc

SEQ ID NO: 181413 - RNA, 22 nt, Human
cauugaaagagauaaagccuuu

SEQ ID NO: 181414 - RNA, 22 nt, Human
caaaugcuaugauuuugaguuu

SEQ ID NO: 181415 - RNA, 22 nt, Human
aagcugcaaaaaauuucugucu

SEQ ID NO: 181416 - RNA, 22 nt, Human
ugagacagcccuucugcacagg

SEQ ID NO: 181417 - RNA, 22 nt, Human
cacagugcaugaugggcagaag

SEQ ID NO: 181418 - RNA, 21 nt, Human
gugcccuguucccacaugccc

SEQ ID NO: 181419 - RNA, 22 nt, Human
agggaggcaggaaaguugucug

SEQ ID NO: 181420 - RNA, 22 nt, Human
ucaagggaggagacacagcccu

SEQ ID NO: 181421 - RNA, 19 nt, Human
uggcuuccugacucucauc

SEQ ID NO: 181422 - RNA, 22 nt, Human
uagggacacugcucaugaguuc

SEQ ID NO: 181423 - RNA, 22 nt, Human
aacagcuguucgcagauguagg

SEQ ID NO: 181424 - RNA, 19 nt, Human
ucucucuguacauuagaua

SEQ ID NO: 181425 - RNA, 22 nt, Human
aauaaucuugacuacugaauca

SEQ ID NO: 181426 - RNA, 22 nt, Human
cagcucuuccuagccaugccac

SEQ ID NO: 181427 - RNA, 22 nt, Human
aagcaaagagauaaccuuuugg

SEQ ID NO: 181428 - RNA, 21 nt, Human
aggcagcucaggcccagagag

SEQ ID NO: 181429 - RNA, 22 nt, Human
uugcagagugguugugaggauu

SEQ ID NO: 181430 - RNA, 22 nt, Human
aaaugucagaaaacauggagug

SEQ ID NO: 181431 - RNA, 22 nt, Human
uggggcagcuccaucuauucca

SEQ ID NO: 181432 - RNA, 22 nt, Human
acugaugaucugggaguagagu

SEQ ID NO: 181433 - RNA, 22 nt, Human
acuuccagcuagguucugcuaa

SEQ ID NO: 181434 - RNA, 22 nt, Human
agagagacgggggcugcugcuu

SEQ ID NO: 181435 - RNA, 18 nt, Human
auccugggagcagacagc

SEQ ID NO: 181436 - RNA, 22 nt, Human
gagaacacaugcagacugggua

SEQ ID NO: 181437 - RNA, 22 nt, Human
caauacaauuaccaguuaauca

SEQ ID NO: 181438 - RNA, 22 nt, Human
cagcccuccuuucacucccagg

SEQ ID NO: 181439 - RNA, 22 nt, Human
uccaggagaggccugaccaggu

SEQ ID NO: 181440 - RNA, 20 nt, Human
guaacucuggcuaaguaaau

SEQ ID NO: 181441 - RNA, 23 nt, Human
uucaaagaucuucugaaaucugu

SEQ ID NO: 181442 - RNA, 21 nt, Human
gggaggaagcugcuucucucu

SEQ ID NO: 181443 - RNA, 22 nt, Human
ucucucccaaaucugcagauag

SEQ ID NO: 181444 - RNA, 18 nt, Human
cuagaugagcuuggcaag

SEQ ID NO: 181445 - RNA, 22 nt, Human
aaagugcaguccaugaaauuaa

SEQ ID NO: 181446 - RNA, 22 nt, Human
ccacugaggccugggcccaggg

SEQ ID NO: 181447 - RNA, 22 nt, Human
uugcuguaaguaucuuucuacc

SEQ ID NO: 181448 - RNA, 22 nt, Human
uuauucuucuucucuugccagg

SEQ ID NO: 181449 - RNA, 22 nt, Human
uccuaggguuggagacagugac

SEQ ID NO: 181450 - RNA, 22 nt, Human
aacugcaauaacuugugcacca

SEQ ID NO: 181451 - RNA, 22 nt, Human
auucaagauuaauucuauguca

SEQ ID NO: 181452 - RNA, 22 nt, Human
cccaccacgugcuuugcuggag

SEQ ID NO: 181453 - RNA, 22 nt, Human
acuuucaauuugcacuaaccua

SEQ ID NO: 181454 - RNA, 20 nt, Human
uuuauucacagagaagaguu

SEQ ID NO: 181455 - RNA, 22 nt, Human
cugagcacugggcacauagcug

SEQ ID NO: 181456 - RNA, 21 nt, Human
ugcucaugagcccacagcugc

SEQ ID NO: 181457 - RNA, 22 nt, Human
aacaagaacaccuacaguucua

SEQ ID NO: 181458 - RNA, 22 nt, Human
uuugaaaguucuucugacacua

SEQ ID NO: 181459 - RNA, 22 nt, Human
auugauucuguaagucaacaau

SEQ ID NO: 181460 - RNA, 22 nt, Human
cuggagccgcauggagcaggga

SEQ ID NO: 181461 - RNA, 22 nt, Human
aaaauaugacugugcuccuuaa

SEQ ID NO: 181462 - RNA, 22 nt, Human
cuuugaaaaaugguuuccuaga

SEQ ID NO: 181463 - RNA, 22 nt, Human
cuucuagauuuuuguaauuguu

SEQ ID NO: 181464 - RNA, 22 nt, Human
uugcagcuucuugcaucagaaa

SEQ ID NO: 181465 - RNA, 22 nt, Human
agcccagcuuugaaccauauca

SEQ ID NO: 181466 - RNA, 22 nt, Human
agagucuucuuuaggccauuua

SEQ ID NO: 181467 - RNA, 22 nt, Human
caggaugagguagaggcagaua

SEQ ID NO: 181468 - RNA, 22 nt, Human
agggcuccuccccggccuccac

SEQ ID NO: 181469 - RNA, 22 nt, Human
gacccagccugguuuuuauagg

SEQ ID NO: 181470 - RNA, 22 nt, Human
gugaggagggcuggucccaggc

SEQ ID NO: 181471 - RNA, 22 nt, Human
ccugggacucggccaggacaga

SEQ ID NO: 181472 - RNA, 22 nt, Human
gucugaggucauuagcucucuu

SEQ ID NO: 181473 - RNA, 22 nt, Human
ugcaggcuggaggagggacuaa

SEQ ID NO: 181474 - RNA, 22 nt, Human
aggaagcuagagccaccggacu

SEQ ID NO: 181475 - RNA, 22 nt, Human
ggcagcugaccuagcaccaucc

SEQ ID NO: 181476 - RNA, 22 nt, Human
agccuagaagaaguggcuacuu

SEQ ID NO: 181477 - RNA, 22 nt, Human
agauuacagaagaauaaguaga

SEQ ID NO: 181478 - RNA, 22 nt, Human
caggcaggucagugaagaagga

SEQ ID NO: 181479 - RNA, 22 nt, Human
uuguacagaaaaaauucuuggu

SEQ ID NO: 181480 - RNA, 20 nt, Human
uuuucugugccaagaaaacu

SEQ ID NO: 181481 - RNA, 22 nt, Human
cagcugugauuccugcugucca

SEQ ID NO: 181482 - RNA, 22 nt, Human
aggagcucauguggcugccugu

SEQ ID NO: 181483 - RNA, 22 nt, Human
cauggaauuuucuaggcauaaa

SEQ ID NO: 181484 - RNA, 22 nt, Human
cuuuaucuguguccucuugccu

SEQ ID NO: 181485 - RNA, 22 nt, Human
gcuuguuugugauuucuccaga

SEQ ID NO: 181486 - RNA, 22 nt, Human
uuggaugggcauuaggaaaguc

SEQ ID NO: 181487 - RNA, 22 nt, Human
gaugaggaauuugagguuagaa

SEQ ID NO: 181488 - RNA, 22 nt, Human
gcuguguaccuacuaacugcuu

SEQ ID NO: 181489 - RNA, 23 nt, Human
uccuggguuugaauucuagucuu

SEQ ID NO: 181490 - RNA, 22 nt, Human
ucuuccucuucugcugagaagu

SEQ ID NO: 181491 - RNA, 22 nt, Human
cagcucugggagucccaccccu

SEQ ID NO: 181492 - RNA, 22 nt, Human
aaacugcacacgaugugccuga

SEQ ID NO: 181493 - RNA, 22 nt, Human
auagcaaacuggagcuugcuuu

SEQ ID NO: 181494 - RNA, 22 nt, Human
uauuccagugugaucuuuguag

SEQ ID NO: 181495 - RNA, 22 nt, Human
ugucacauccauuuugcaagua

SEQ ID NO: 181496 - RNA, 22 nt, Human
cugggcugcaguuccugguccu

SEQ ID NO: 181497 - RNA, 22 nt, Human
ggaugcugacuuuggagcaugg

SEQ ID NO: 181498 - RNA, 22 nt, Human
cuggccuaggaaugguuuuccg

SEQ ID NO: 181499 - RNA, 20 nt, Human
uacauucaaaacaaacucug

SEQ ID NO: 181500 - RNA, 19 nt, Human
augucuguugaauuucaua

SEQ ID NO: 181501 - RNA, 22 nt, Human
aggggaagauuauacuuuugaa

SEQ ID NO: 181502 - RNA, 20 nt, Human
uugcuuuaucagacaugaua

SEQ ID NO: 181503 - RNA, 22 nt, Human
accagcugccuuuucuuaguag

SEQ ID NO: 181504 - RNA, 22 nt, Human
acugugauguucucuaucuugg

SEQ ID NO: 181505 - RNA, 22 nt, Human
aggacacagguaagccagugga

SEQ ID NO: 181506 - RNA, 18 nt, Human
gaggagccgucccuacua

SEQ ID NO: 181507 - RNA, 22 nt, Human
ugcugaggaaaaaugugacucu

SEQ ID NO: 181508 - RNA, 22 nt, Human
gugggcuuuugacagugccugg

SEQ ID NO: 181509 - RNA, 22 nt, Human
gaagacacuaaacuggggcuuc

SEQ ID NO: 181510 - RNA, 22 nt, Human
caggagcucuuaaggaugugau

SEQ ID NO: 181511 - RNA, 22 nt, Human
ucugcaggcuuauaggaugggu

SEQ ID NO: 181512 - RNA, 22 nt, Human
cuguugcuaaguagugcaggua

SEQ ID NO: 181513 - RNA, 22 nt, Human
caggguccaucuuucaucacug

SEQ ID NO: 181514 - RNA, 20 nt, Human
uuugucaacugcauccagca

SEQ ID NO: 181515 - RNA, 22 nt, Human
augcaguguuuggaagcuuaag

SEQ ID NO: 181516 - RNA, 22 nt, Human
uccagcuggccuaacuucaggg

SEQ ID NO: 181517 - RNA, 22 nt, Human
uggcaggaaauacccugccuag

SEQ ID NO: 181518 - RNA, 22 nt, Human
uagcagugcccuguggaauaag

SEQ ID NO: 181519 - RNA, 17 nt, Human
aaucucaguggcuuaag

SEQ ID NO: 181520 - RNA, 22 nt, Human
gacugucuuuugaauaaaaaug

SEQ ID NO: 181521 - RNA, 22 nt, Human
agguggcugagcugugccccug

SEQ ID NO: 181522 - RNA, 22 nt, Human
ccugugcccuggaaggagagag

SEQ ID NO: 181523 - RNA, 18 nt, Human
gucuggaggucaggagcu

SEQ ID NO: 181524 - RNA, 19 nt, Human
uuggccuuguuucauaucu

SEQ ID NO: 181525 - RNA, 22 nt, Human
ucucugagcugcuucuugcaua

SEQ ID NO: 181526 - RNA, 22 nt, Human
uucaacauguucuacauaaggg

SEQ ID NO: 181527 - RNA, 22 nt, Human
gccuuuaucuugggccaaguuu

SEQ ID NO: 181528 - RNA, 22 nt, Human
uagggcuauaagagaauaagac

SEQ ID NO: 181529 - RNA, 19 nt, Human
auccuggguccuccagcug

SEQ ID NO: 181530 - RNA, 22 nt, Human
uaaggcuuuguagugauugcuu

SEQ ID NO: 181531 - RNA, 22 nt, Human
auggcuugucuaugagugcucu

SEQ ID NO: 181532 - RNA, 22 nt, Human
ugcuccagugccugccccacag

SEQ ID NO: 181533 - RNA, 22 nt, Human
gaggaggggacaguacuugugc

SEQ ID NO: 181534 - RNA, 22 nt, Human
aucauuaguuguggaauucuug

SEQ ID NO: 181535 - RNA, 22 nt, Human
acagcagguuacaguggcacag

SEQ ID NO: 181536 - RNA, 22 nt, Human
ugaaggccagcucuuuaucagc

SEQ ID NO: 181537 - RNA, 22 nt, Human
uggcuuccugcauggauccucu

SEQ ID NO: 181538 - RNA, 20 nt, Human
aguuacgcuauuacucuccu

SEQ ID NO: 181539 - RNA, 22 nt, Human
uagcugagagcucacuugagga

SEQ ID NO: 181540 - RNA, 22 nt, Human
auggaauuugcaauaacaggau

SEQ ID NO: 181541 - RNA, 22 nt, Human
gaauuacaaagugagacaagcu

SEQ ID NO: 181542 - RNA, 21 nt, Human
gcaaguacuaucaucauuauc

SEQ ID NO: 181543 - RNA, 19 nt, Human
ucuuuagccagagcucugg

SEQ ID NO: 181544 - RNA, 22 nt, Human
uagggcagagcuuguacacgau

SEQ ID NO: 181545 - RNA, 22 nt, Human
auauuuugaaguuaauaaugug

SEQ ID NO: 181546 - RNA, 22 nt, Human
cagccaggacucccauuuagga

SEQ ID NO: 181547 - RNA, 22 nt, Human
agcuccuggacgaacagggagu

SEQ ID NO: 181548 - RNA, 20 nt, Human
aucuccugcuaccacccauu

SEQ ID NO: 181549 - RNA, 22 nt, Human
gcccucaggacaagguuacgcu

SEQ ID NO: 181550 - RNA, 22 nt, Human
uggcuggagcauuccuugucuu

SEQ ID NO: 181551 - RNA, 20 nt, Human
gcacacauagaaaugcauau

SEQ ID NO: 181552 - RNA, 22 nt, Human
gcccagggcagggcaagaguga

SEQ ID NO: 181553 - RNA, 22 nt, Human
caaguuuugauuuugcaguaaa

SEQ ID NO: 181554 - RNA, 22 nt, Human
agggucucuugccaugccucag

SEQ ID NO: 181555 - RNA, 22 nt, Human
ucagcaguggcucucaugcagu

SEQ ID NO: 181556 - RNA, 22 nt, Human
cagagcagagugauuguucugg

SEQ ID NO: 181557 - RNA, 22 nt, Human
acauucuucagcuuugucaggc

SEQ ID NO: 181558 - RNA, 22 nt, Human
ugaugacaguguuacagcucca

SEQ ID NO: 181559 - RNA, 22 nt, Human
agucccaacagcuuacaaggaa

SEQ ID NO: 181560 - RNA, 21 nt, Human
gcuggcucucugacgugcuuu

SEQ ID NO: 181561 - RNA, 22 nt, Human
uacuuguguucuacuagagaaa

SEQ ID NO: 181562 - RNA, 22 nt, Human
auggcagcuuugaauuucuuga

SEQ ID NO: 181563 - RNA, 22 nt, Human
accagggcacaggagucugaag

SEQ ID NO: 181564 - RNA, 22 nt, Human
ccugggcagggagaccaggcuc

SEQ ID NO: 181565 - RNA, 22 nt, Human
uuagaaagcuuuccauagucaa

SEQ ID NO: 181566 - RNA, 22 nt, Human
uucuucaaugugcccuguuuuc

SEQ ID NO: 181567 - RNA, 21 nt, Human
ggaacuuucaugaaucuagca

SEQ ID NO: 181568 - RNA, 20 nt, Human
gccaggagggugugaugagc

SEQ ID NO: 181569 - RNA, 22 nt, Human
guccagagauggacgagcagau

SEQ ID NO: 181570 - RNA, 18 nt, Human
gcucagguauagacaggg

SEQ ID NO: 181571 - RNA, 22 nt, Human
agaugcuggauggaaaaugauc

SEQ ID NO: 181572 - RNA, 22 nt, Human
gaggugguucagguagagccca

SEQ ID NO: 181573 - RNA, 22 nt, Human
cagagcggccacuagagggcgc

SEQ ID NO: 181574 - RNA, 22 nt, Human
gcagaggccaggccaccagcaa

SEQ ID NO: 181575 - RNA, 22 nt, Human
aaaguugaccgaaagauuuuga

SEQ ID NO: 181576 - RNA, 18 nt, Human
aagaggaggagcagguug

SEQ ID NO: 181577 - RNA, 22 nt, Human
aaaaugaagcaaaggcauucag

SEQ ID NO: 181578 - RNA, 22 nt, Human
gagugucagugcuuggggcuac

SEQ ID NO: 181579 - RNA, 22 nt, Human
ccucugugauuucugagccaau

SEQ ID NO: 181580 - RNA, 22 nt, Human
gauaauuauaggcuaagccacu

SEQ ID NO: 181581 - RNA, 21 nt, Human
uuccuggggacuuccguggga

SEQ ID NO: 181582 - RNA, 21 nt, Human
ucuccagagugggaggaaauc

SEQ ID NO: 181583 - RNA, 19 nt, Human
cuuuucaucaacagccaau

SEQ ID NO: 181584 - RNA, 22 nt, Human
uguuuucuggguggaagguacu

SEQ ID NO: 181585 - RNA, 22 nt, Human
uccuggaucuacucucaauugg

SEQ ID NO: 181586 - RNA, 23 nt, Human
ccucagggucuagcagagagaag

SEQ ID NO: 181587 - RNA, 22 nt, Human
ucuauacaugugcacacacauc

SEQ ID NO: 181588 - RNA, 22 nt, Human
ucagaaccugcaagucuaaccu

SEQ ID NO: 181589 - RNA, 22 nt, Human
agaggaggccaggcccacaccu

SEQ ID NO: 181590 - RNA, 22 nt, Human
cugccuggucucaggcaugggg

SEQ ID NO: 181591 - RNA, 18 nt, Human
cagaaguccuucaaggcc

SEQ ID NO: 181592 - RNA, 22 nt, Human
guaggcagucucucaggugauc

SEQ ID NO: 181593 - RNA, 22 nt, Human
cuggugcccuguguggcaggag

SEQ ID NO: 181594 - RNA, 22 nt, Human
uuugugcagauguauauuugug

SEQ ID NO: 181595 - RNA, 22 nt, Human
ugccaggcauauggccucuuug

SEQ ID NO: 181596 - RNA, 22 nt, Human
gccuggcaaggcccuguugacu

SEQ ID NO: 181597 - RNA, 22 nt, Human
auuguauaagucuauuuacaau

SEQ ID NO: 181598 - RNA, 22 nt, Human
aauggcuuugacauuuucaaau

SEQ ID NO: 181599 - RNA, 22 nt, Human
acaguggccucaaagaaagaga

SEQ ID NO: 181600 - RNA, 22 nt, Human
uccaggagggauugggcugugg

SEQ ID NO: 181601 - RNA, 22 nt, Human
guuaauaaagguauagaaucag

SEQ ID NO: 181602 - RNA, 22 nt, Human
aucuguagucacugcacagcuc

SEQ ID NO: 181603 - RNA, 22 nt, Human
ucuguucaucaucuggacacau

SEQ ID NO: 181604 - RNA, 22 nt, Human
augaguguacgugaaaguagau

SEQ ID NO: 181605 - RNA, 22 nt, Human
gaucacaugaauggaauagaag

SEQ ID NO: 181606 - RNA, 22 nt, Human
ggcaugcaugcaagguggugua

SEQ ID NO: 181607 - RNA, 22 nt, Human
acacagaguaucuuuugccuag

SEQ ID NO: 181608 - RNA, 22 nt, Human
cagaggacaauagaauggaaag

SEQ ID NO: 181609 - RNA, 22 nt, Human
acagauauuaugguuucuccuu

SEQ ID NO: 181610 - RNA, 23 nt, Human
ggcaugcaauggacagagcugga

SEQ ID NO: 181611 - RNA, 22 nt, Human
cagaguguuucuuugggugggu

SEQ ID NO: 181612 - RNA, 22 nt, Human
cccugcccuggagacacuuaaa

SEQ ID NO: 181613 - RNA, 21 nt, Human
acucugaaaauuaauaguuau

SEQ ID NO: 181614 - RNA, 23 nt, Human
gcugucugucaucucugcgggag

SEQ ID NO: 181615 - RNA, 22 nt, Human
uaggaaacucaaagggaagugg

SEQ ID NO: 181616 - RNA, 22 nt, Human
auucaguuucaaucauuguagu

SEQ ID NO: 181617 - RNA, 19 nt, Human
auggaaaaugccagacuga

SEQ ID NO: 181618 - RNA, 22 nt, Human
uuccccaggggcuccugccuuu

SEQ ID NO: 181619 - RNA, 22 nt, Human
agagccaggaugucuucugggg

SEQ ID NO: 181620 - RNA, 22 nt, Human
aauucugugcaggcagagcuau

SEQ ID NO: 181621 - RNA, 19 nt, Human
caucuuuggucaccuaguc

SEQ ID NO: 181622 - RNA, 22 nt, Human
ucagaggaauaaugcugcauuu

SEQ ID NO: 181623 - RNA, 22 nt, Human
accagaggaagggaaucucaag

SEQ ID NO: 181624 - RNA, 20 nt, Human
gcuuggcauaggccacuuga

SEQ ID NO: 181625 - RNA, 22 nt, Human
cuggcuuuuggaggagggucag

SEQ ID NO: 181626 - RNA, 21 nt, Human
uugaggagugagaguggguuu

SEQ ID NO: 181627 - RNA, 22 nt, Human
aaggaaauacaacauguauuca

SEQ ID NO: 181628 - RNA, 22 nt, Human
ugcuccagggccuccagugggg

SEQ ID NO: 181629 - RNA, 22 nt, Human
uggcaagaauauuggaccagaa

SEQ ID NO: 181630 - RNA, 22 nt, Human
cuugaaaugacaggagcacauc

SEQ ID NO: 181631 - RNA, 19 nt, Human
agugucagaauucauugaa

SEQ ID NO: 181632 - RNA, 22 nt, Human
aagucucuuccucugccaaaga

SEQ ID NO: 181633 - RNA, 22 nt, Human
gaggcgagaagcuggagauggu

SEQ ID NO: 181634 - RNA, 22 nt, Human
uucuuuuagaauuuccuaaggu

SEQ ID NO: 181635 - RNA, 22 nt, Human
aggcucagucuguucaugcacu

SEQ ID NO: 181636 - RNA, 22 nt, Human
agcuuguuaaacagccuccacu

SEQ ID NO: 181637 - RNA, 22 nt, Human
gaggccaggaggaucucucuaa

SEQ ID NO: 181638 - RNA, 22 nt, Human
auccugggggcagcuggaaaca

SEQ ID NO: 181639 - RNA, 22 nt, Human
caggcagagucagauuagacuu

SEQ ID NO: 181640 - RNA, 19 nt, Human
ucucaggcugggcggcugc

SEQ ID NO: 181641 - RNA, 22 nt, Human
gaggagaggccaucguuguuau

SEQ ID NO: 181642 - RNA, 22 nt, Human
agagccaggcggcugggcaccu

SEQ ID NO: 181643 - RNA, 22 nt, Human
aaauguaagucuuuguuucuua

SEQ ID NO: 181644 - RNA, 22 nt, Human
uaugaaaugauggggaaaauag

SEQ ID NO: 181645 - RNA, 22 nt, Human
cagaaguuugaccuuggugggu

SEQ ID NO: 181646 - RNA, 22 nt, Human
agcugcaacaucugcuuguccc

SEQ ID NO: 181647 - RNA, 22 nt, Human
aguuacagcacucaaaguuuuc

SEQ ID NO: 181648 - RNA, 21 nt, Human
agaugaggauacugaggccua

SEQ ID NO: 181649 - RNA, 22 nt, Human
agagccacggcaggccuaggaa

SEQ ID NO: 181650 - RNA, 20 nt, Human
cucuggcaaaggaugccuau

SEQ ID NO: 181651 - RNA, 22 nt, Human
uccuggcucgauugcuaccaau

SEQ ID NO: 181652 - RNA, 22 nt, Human
ccaggcccaccuuggccacuua

SEQ ID NO: 181653 - RNA, 22 nt, Human
agaaagugugucauacuaagug

SEQ ID NO: 181654 - RNA, 22 nt, Human
aguggggccgcgguccugcccu

SEQ ID NO: 181655 - RNA, 22 nt, Human
cagaggcauuacugaaaaggug

SEQ ID NO: 181656 - RNA, 22 nt, Human
aagaguuaugaaagcaaggcau

SEQ ID NO: 181657 - RNA, 22 nt, Human
agauaaauuccuaagauuucag

SEQ ID NO: 181658 - RNA, 22 nt, Human
cagugcagguggcagaggacag

SEQ ID NO: 181659 - RNA, 22 nt, Human
gccuggcacaguagggacccaa

SEQ ID NO: 181660 - RNA, 22 nt, Human
cagauaugauaggauuagcaca

SEQ ID NO: 181661 - RNA, 22 nt, Human
ucucuuaaaagauuuuaaugac

SEQ ID NO: 181662 - RNA, 22 nt, Human
uauacagauuaacagauuuaaa

SEQ ID NO: 181663 - RNA, 22 nt, Human
agggcagaaaucgauuacaccu

SEQ ID NO: 181664 - RNA, 22 nt, Human
ucugugcacaauaggcauuuuu

SEQ ID NO: 181665 - RNA, 22 nt, Human
aaguuaguggauaaacagcaaa

SEQ ID NO: 181666 - RNA, 22 nt, Human
cucaggccagguuucucccaca

SEQ ID NO: 181667 - RNA, 22 nt, Human
agaaucagugcuggcuauuagc

SEQ ID NO: 181668 - RNA, 21 nt, Human
auuucacacccuccuuuuucu

SEQ ID NO: 181669 - RNA, 22 nt, Human
ugcugaaaaugcguaucuucca

SEQ ID NO: 181670 - RNA, 22 nt, Human
ccagccugaaaugccucauccu

SEQ ID NO: 181671 - RNA, 22 nt, Human
cccuucucuuucacucacuauu

SEQ ID NO: 181672 - RNA, 22 nt, Human
gcagcuuuggagguggaacucu

SEQ ID NO: 181673 - RNA, 22 nt, Human
uggccagcacuuagcccuuacc

SEQ ID NO: 181674 - RNA, 22 nt, Human
uguuucuucucacacaaacuca

SEQ ID NO: 181675 - RNA, 22 nt, Human
agauggucugguuauuuuuagu

SEQ ID NO: 181676 - RNA, 22 nt, Human
ucucucaaccucggcacuauug

SEQ ID NO: 181677 - RNA, 22 nt, Human
gaauguuauugaacuacgagcu

SEQ ID NO: 181678 - RNA, 22 nt, Human
agccucagggcucugcgcagac

SEQ ID NO: 181679 - RNA, 20 nt, Human
cagaguaauuauuacccuuu

SEQ ID NO: 181680 - RNA, 22 nt, Human
aaagcacauaguagaaggauuu

SEQ ID NO: 181681 - RNA, 22 nt, Human
auugcuuuuaagcaccaccuaa

SEQ ID NO: 181682 - RNA, 22 nt, Human
auugagaaaauaaguauggaua

SEQ ID NO: 181683 - RNA, 20 nt, Human
agcaucuugcaucuucaagu

SEQ ID NO: 181684 - RNA, 22 nt, Human
cugcccaguuugggagccuuuc

SEQ ID NO: 181685 - RNA, 22 nt, Human
ugcuuuauaacuuaguuuaugg

SEQ ID NO: 181686 - RNA, 22 nt, Human
caggaggcaucauggagcggac

SEQ ID NO: 181687 - RNA, 22 nt, Human
cuaguggaaacuaacuggaauu

SEQ ID NO: 181688 - RNA, 22 nt, Human
uuucuguuguacuuaaacuagg

SEQ ID NO: 181689 - RNA, 17 nt, Human
ggcucucuuccagacuu

SEQ ID NO: 181690 - RNA, 22 nt, Human
gccagcucucauuguauaggcu

SEQ ID NO: 181691 - RNA, 22 nt, Human
gggagcuggcggauuccccagg

SEQ ID NO: 181692 - RNA, 22 nt, Human
uuucuugagcccaggaggugga

SEQ ID NO: 181693 - RNA, 22 nt, Human
gcucaugugugauuacaguuuu

SEQ ID NO: 181694 - RNA, 22 nt, Human
cuguugcucugaacaggucuug

SEQ ID NO: 181695 - RNA, 22 nt, Human
gggcuugguggagagaaugcug

SEQ ID NO: 181696 - RNA, 22 nt, Human
uuaguuaaaagauaauuuugga

SEQ ID NO: 181697 - RNA, 22 nt, Human
ggcuggcaggggaugucagaug

SEQ ID NO: 181698 - RNA, 22 nt, Human
aauguauuauacauaauuugug

SEQ ID NO: 181699 - RNA, 22 nt, Human
uagaaucuaguucauucauuug

SEQ ID NO: 181700 - RNA, 22 nt, Human
ucugugcagauguagaccaguu

SEQ ID NO: 181701 - RNA, 22 nt, Human
gccaggccugcaagugcuggug

SEQ ID NO: 181702 - RNA, 22 nt, Human
aaaguuuauuuucccugguuag

SEQ ID NO: 181703 - RNA, 22 nt, Human
gcagacaggggcuuaggaaagg

SEQ ID NO: 181704 - RNA, 22 nt, Human
ccugccugccugcuggccggga

SEQ ID NO: 181705 - RNA, 22 nt, Human
uggcgugcccuccagacuuggc

SEQ ID NO: 181706 - RNA, 22 nt, Human
ucugggucucagagugaccaug

SEQ ID NO: 181707 - RNA, 22 nt, Human
aggcucugcauccaggcuuuau

SEQ ID NO: 181708 - RNA, 22 nt, Human
gcugcagcccggcgcgccugag

SEQ ID NO: 181709 - RNA, 22 nt, Human
gggaaaggauuuacaguuugau

SEQ ID NO: 181710 - RNA, 20 nt, Human
auacaaagagauugauguau

SEQ ID NO: 181711 - RNA, 22 nt, Human
uucugaaugauagucuugaacu

SEQ ID NO: 181712 - RNA, 22 nt, Human
gcaggagcugcucuccugacga

SEQ ID NO: 181713 - RNA, 22 nt, Human
ggcacuaggagaccuggggguc

SEQ ID NO: 181714 - RNA, 22 nt, Human
aauaauguaggaugauaaauga

SEQ ID NO: 181715 - RNA, 22 nt, Human
gcacacaggggaguucucagaa

SEQ ID NO: 181716 - RNA, 22 nt, Human
ccacagagagugucagccuuug

SEQ ID NO: 181717 - RNA, 18 nt, Human
uguuaaaugaagauuugc

SEQ ID NO: 181718 - RNA, 22 nt, Human
agggauguucauuuuguggcug

SEQ ID NO: 181719 - RNA, 22 nt, Human
cagggcucuuccggagcaggga

SEQ ID NO: 181720 - RNA, 22 nt, Human
agcaugaaagcauaggacaguc

SEQ ID NO: 181721 - RNA, 22 nt, Human
ugcucccacacuacucggaggc

SEQ ID NO: 181722 - RNA, 22 nt, Human
ugccucaguuucaucugcagaa

SEQ ID NO: 181723 - RNA, 22 nt, Human
cagcucuuuacucugcaaugau

SEQ ID NO: 181724 - RNA, 22 nt, Human
cucuucuuauggccguggcuga

SEQ ID NO: 181725 - RNA, 22 nt, Human
ggccuugagagccagugcaggc

SEQ ID NO: 181726 - RNA, 22 nt, Human
aggcuaggggcagugccagcau

SEQ ID NO: 181727 - RNA, 22 nt, Human
auugaguaccuccagauucaua

SEQ ID NO: 181728 - RNA, 22 nt, Human
acucagcauauggggccgcuug

SEQ ID NO: 181729 - RNA, 22 nt, Human
cacccucccgucagccccuggg

SEQ ID NO: 181730 - RNA, 22 nt, Human
aaaauacuguggaguguugaaa

SEQ ID NO: 181731 - RNA, 22 nt, Human
aguuuucacacucaccaaaagg

SEQ ID NO: 181732 - RNA, 22 nt, Human
auucugaucauucaagauguca

SEQ ID NO: 181733 - RNA, 22 nt, Human
caagccuuggaaauccauucug

SEQ ID NO: 181734 - RNA, 23 nt, Human
ccagagcucuuucaugcuuccau

SEQ ID NO: 181735 - RNA, 22 nt, Human
cacagguuugacaaggauaaaa

SEQ ID NO: 181736 - RNA, 22 nt, Human
guauuucacauauggauaugcu

SEQ ID NO: 181737 - RNA, 22 nt, Human
ugcucauuggcgaucugaggga

SEQ ID NO: 181738 - RNA, 22 nt, Human
cugccagcaaugugaccaugcu

SEQ ID NO: 181739 - RNA, 22 nt, Human
aacuacagaaucauagaaaaua

SEQ ID NO: 181740 - RNA, 22 nt, Human
ugaaacauuaggaaaucauuau

SEQ ID NO: 181741 - RNA, 22 nt, Human
uuggcugcucagugauaugaga

SEQ ID NO: 181742 - RNA, 22 nt, Human
uggacagcuugcagagccaccc

SEQ ID NO: 181743 - RNA, 20 nt, Human
cacaggccccaagaccugua

SEQ ID NO: 181744 - RNA, 23 nt, Human
aucuaauuucuccaaaucucuac

SEQ ID NO: 181745 - RNA, 22 nt, Human
aauucugaugaauaaaucaucc

SEQ ID NO: 181746 - RNA, 22 nt, Human
ucagccugcgucauggugacac

SEQ ID NO: 181747 - RNA, 22 nt, Human
ccugccagcugugggccagccu

SEQ ID NO: 181748 - RNA, 22 nt, Human
ggaguggcagagaggguauacu

SEQ ID NO: 181749 - RNA, 22 nt, Human
cacaggaauuagcagccuaaaa

SEQ ID NO: 181750 - RNA, 22 nt, Human
cugcugagcaucagggcugccc

SEQ ID NO: 181751 - RNA, 22 nt, Human
ucaggaaauggcuucaugguuu

SEQ ID NO: 181752 - RNA, 21 nt, Human
auccauucuccgguuaaugag

SEQ ID NO: 181753 - RNA, 22 nt, Human
ggcucuggugcccuggcuccca

SEQ ID NO: 181754 - RNA, 22 nt, Human
ucaagcaaagauacaaauggaa

SEQ ID NO: 181755 - RNA, 22 nt, Human
uucaguaaggauaauaaacaga

SEQ ID NO: 181756 - RNA, 22 nt, Human
cagcuauuaauguuuuugcuga

SEQ ID NO: 181757 - RNA, 22 nt, Human
uggcagcagccauggaaggccc

SEQ ID NO: 181758 - RNA, 22 nt, Human
ugcuuuguguuugaauagauaa

SEQ ID NO: 181759 - RNA, 22 nt, Human
ucaggccuuucuucagagcuuc

SEQ ID NO: 181760 - RNA, 22 nt, Human
ucaugccaguuaaaggcuguga

SEQ ID NO: 181761 - RNA, 22 nt, Human
uugauuuuuuucuacuaugcgc

SEQ ID NO: 181762 - RNA, 22 nt, Human
acagcuguauccccagagcuca

SEQ ID NO: 181763 - RNA, 21 nt, Human
auugaaagucaacaaucaguu

SEQ ID NO: 181764 - RNA, 22 nt, Human
gaaauauuguacuggagauguu

SEQ ID NO: 181765 - RNA, 22 nt, Human
auuggcuuugauaucuaaaggg

SEQ ID NO: 181766 - RNA, 22 nt, Human
accugccuauggagccacaugg

SEQ ID NO: 181767 - RNA, 22 nt, Human
aagucacagaguuggaagucag

SEQ ID NO: 181768 - RNA, 22 nt, Human
auccuggcaagcagaggagaac

SEQ ID NO: 181769 - RNA, 22 nt, Human
cucuggaauggguguuucuaac

SEQ ID NO: 181770 - RNA, 22 nt, Human
aguggggaagauuuugcaguca

SEQ ID NO: 181771 - RNA, 22 nt, Human
cuggcuuuggaaacaauuuauc

SEQ ID NO: 181772 - RNA, 22 nt, Human
gccaccagggggcuccagugag

SEQ ID NO: 181773 - RNA, 22 nt, Human
cucagggugcagcacaguuccu

SEQ ID NO: 181774 - RNA, 22 nt, Human
gcauguguaugguaggaauauu

SEQ ID NO: 181775 - RNA, 23 nt, Human
guguguccauucgcacucuuagg

SEQ ID NO: 181776 - RNA, 22 nt, Human
gguggcagcauggucccagugu

SEQ ID NO: 181777 - RNA, 18 nt, Human
ugaucuuugaguauaaug

SEQ ID NO: 181778 - RNA, 22 nt, Human
uuccugcagcaaggagaagcug

SEQ ID NO: 181779 - RNA, 22 nt, Human
ggcugcuccuuuacccuggcag

SEQ ID NO: 181780 - RNA, 22 nt, Human
caguccugggagacuuacccag

SEQ ID NO: 181781 - RNA, 22 nt, Human
gcagggcucaacaggacacccc

SEQ ID NO: 181782 - RNA, 22 nt, Human
uuagaacuuaaacuucagaaag

SEQ ID NO: 181783 - RNA, 20 nt, Human
auccaugagagucuggauuc

SEQ ID NO: 181784 - RNA, 22 nt, Human
uuccagaauugggagccuugag

SEQ ID NO: 181785 - RNA, 22 nt, Human
agucccagcuucccccaugcag

SEQ ID NO: 181786 - RNA, 22 nt, Human
cugcagagagugccgggcagcc

SEQ ID NO: 181787 - RNA, 23 nt, Human
aguccuuuuuauaaaauugagga

SEQ ID NO: 181788 - RNA, 22 nt, Human
cucagagcucagcuuuguuagu

SEQ ID NO: 181789 - RNA, 22 nt, Human
aauagugcugcuguggacaugg

SEQ ID NO: 181790 - RNA, 22 nt, Human
gcccugggauuggguggaggcu

SEQ ID NO: 181791 - RNA, 22 nt, Human
aaucuucacucauucagaguug

SEQ ID NO: 181792 - RNA, 22 nt, Human
ugcuggcuguguaccaucucaa

SEQ ID NO: 181793 - RNA, 22 nt, Human
gcagcccagcagggcccggagc

SEQ ID NO: 181794 - RNA, 22 nt, Human
gcagugugucuggaguacaugg

SEQ ID NO: 181795 - RNA, 22 nt, Human
agagaugcaggguacauggaau

SEQ ID NO: 181796 - RNA, 22 nt, Human
guauuucaguuccucuugugac

SEQ ID NO: 181797 - RNA, 22 nt, Human
gaaaguuauucagccucucuga

SEQ ID NO: 181798 - RNA, 22 nt, Human
auaaauugugcuuuugacaucu

SEQ ID NO: 181799 - RNA, 23 nt, Human
uccaggcugaaggagcagauuuu

SEQ ID NO: 181800 - RNA, 20 nt, Human
gccaaggaggagaaacaggc

SEQ ID NO: 181801 - RNA, 20 nt, Human
aauuuacucacagaaugaau

SEQ ID NO: 181802 - RNA, 22 nt, Human
uagcaagaaguagcucuggauu

SEQ ID NO: 181803 - RNA, 23 nt, Human
acagacuguauucaaaguaggac

SEQ ID NO: 181804 - RNA, 22 nt, Human
ucucucuucaacccuuaacuag

SEQ ID NO: 181805 - RNA, 22 nt, Human
auggcaauuguaaauggaaaga

SEQ ID NO: 181806 - RNA, 21 nt, Human
aaagcaucacgaacauuuggg

SEQ ID NO: 181807 - RNA, 22 nt, Human
agggcugcuuaccuggaauggc

SEQ ID NO: 181808 - RNA, 21 nt, Human
uaaaggcuuuagaauggcaaa

SEQ ID NO: 181809 - RNA, 22 nt, Human
acuggcuuugagggaauagcua

SEQ ID NO: 181810 - RNA, 22 nt, Human
aauguacaaaagucagccaacu

SEQ ID NO: 181811 - RNA, 22 nt, Human
ugguccugguagcggugugcuu

SEQ ID NO: 181812 - RNA, 22 nt, Human
ugccuguguauuuccggccugc

SEQ ID NO: 181813 - RNA, 22 nt, Human
uuugauacugagaaaaacaaau

SEQ ID NO: 181814 - RNA, 22 nt, Human
agagcugaggauccagcugagc

SEQ ID NO: 181815 - RNA, 22 nt, Human
uccugagggcugcagucauagg

SEQ ID NO: 181816 - RNA, 22 nt, Human
uccugggguccugacugcuucc

SEQ ID NO: 181817 - RNA, 17 nt, Human
gggcugacaguggccuc

SEQ ID NO: 181818 - RNA, 22 nt, Human
ccagaaucccauugucacuuca

SEQ ID NO: 181819 - RNA, 22 nt, Human
gaaggcagggaauguggugcua

SEQ ID NO: 181820 - RNA, 22 nt, Human
acagucuuaugcauacacuauu

SEQ ID NO: 181821 - RNA, 22 nt, Human
ggagaaagggacugaucugcuc

SEQ ID NO: 181822 - RNA, 22 nt, Human
ggacugggauucuggaucugcu

SEQ ID NO: 181823 - RNA, 22 nt, Human
cuuuuacacucaucugggaggg

SEQ ID NO: 181824 - RNA, 22 nt, Human
agggggugaaugucugucuaca

SEQ ID NO: 181825 - RNA, 22 nt, Human
agauggccccaggugcccaggg

SEQ ID NO: 181826 - RNA, 22 nt, Human
ucuagaaaguacuagagcuggu

SEQ ID NO: 181827 - RNA, 22 nt, Human
augaaaugauugaaaucuuuac

SEQ ID NO: 181828 - RNA, 22 nt, Human
gaauacauuugccgugguucuc

SEQ ID NO: 181829 - RNA, 22 nt, Human
gcauuagacccaagguauuuug

SEQ ID NO: 181830 - RNA, 22 nt, Human
gggagggauuaguucugccugg

SEQ ID NO: 181831 - RNA, 22 nt, Human
ccccagugguugcaacagcaga

SEQ ID NO: 181832 - RNA, 22 nt, Human
gucugcuggcacgucacagaua

SEQ ID NO: 181833 - RNA, 22 nt, Human
agaggcagccguauuucaaagg

SEQ ID NO: 181834 - RNA, 22 nt, Human
uauggcagaggagaggcacuag

SEQ ID NO: 181835 - RNA, 22 nt, Human
gagcccagcuaaauuuauauaa

SEQ ID NO: 181836 - RNA, 22 nt, Human
agcccuggggcuggucuuggaa

SEQ ID NO: 181837 - RNA, 22 nt, Human
gaggcuguuggcugaucugagu

SEQ ID NO: 181838 - RNA, 22 nt, Human
uguuuuaagcucuagaagggga

SEQ ID NO: 181839 - RNA, 22 nt, Human
acucagagcagagcagccugag

SEQ ID NO: 181840 - RNA, 18 nt, Human
ggagcccacggcguccca

SEQ ID NO: 181841 - RNA, 21 nt, Human
uguguaaaguugaaauccugu

SEQ ID NO: 181842 - RNA, 22 nt, Human
uagcuucugggaguguuuacua

SEQ ID NO: 181843 - RNA, 17 nt, Human
uguuaauuccaaugaua

SEQ ID NO: 181844 - RNA, 22 nt, Human
uuauuuaggagaaggaacccug

SEQ ID NO: 181845 - RNA, 22 nt, Human
caaggccaagucucugugaaga

SEQ ID NO: 181846 - RNA, 22 nt, Human
ggcuggcugauaaaggguugag

SEQ ID NO: 181847 - RNA, 22 nt, Human
uccaggagugugugcuaauggg

SEQ ID NO: 181848 - RNA, 22 nt, Human
cucacugacgaggaagcugaga

SEQ ID NO: 181849 - RNA, 22 nt, Human
agcugcuccuuuccugcaggcg

SEQ ID NO: 181850 - RNA, 21 nt, Human
ugucacuuuaagcuagcucua

SEQ ID NO: 181851 - RNA, 22 nt, Human
guacaauuaagugcacaaauag

SEQ ID NO: 181852 - RNA, 22 nt, Human
gcgggccaccuuggagagcgcu

SEQ ID NO: 181853 - RNA, 22 nt, Human
uguccagguggccucugcugcu

SEQ ID NO: 181854 - RNA, 22 nt, Human
uggcugccuucccugcuggagg

SEQ ID NO: 181855 - RNA, 22 nt, Human
ucagggcucagugggauagguc

SEQ ID NO: 181856 - RNA, 22 nt, Human
cuaaauaaucccucuggucuua

SEQ ID NO: 181857 - RNA, 22 nt, Human
aagguccuguagccacagagcc

SEQ ID NO: 181858 - RNA, 22 nt, Human
uuagggcaggcaugagagaacu

SEQ ID NO: 181859 - RNA, 22 nt, Human
gugucccagccccacaggccug

SEQ ID NO: 181860 - RNA, 19 nt, Human
aggucauugauagugcagg

SEQ ID NO: 181861 - RNA, 22 nt, Human
aggcagguuggggaaaagcacu

SEQ ID NO: 181862 - RNA, 22 nt, Human
gcccugugccagucacgcugug

SEQ ID NO: 181863 - RNA, 20 nt, Human
uccugguggauacugcuuaa

SEQ ID NO: 181864 - RNA, 22 nt, Human
cagcuucugcuaucgaacaucu

SEQ ID NO: 181865 - RNA, 22 nt, Human
caucacuguccucagcauucca

SEQ ID NO: 181866 - RNA, 22 nt, Human
agaauagaauucucauagaauu

SEQ ID NO: 181867 - RNA, 22 nt, Human
acaugagaucacaaagauaaau

SEQ ID NO: 181868 - RNA, 22 nt, Human
uuacugaggagcauaucugagu

SEQ ID NO: 181869 - RNA, 20 nt, Human
ccaggcuggcaaaugggggc

SEQ ID NO: 181870 - RNA, 22 nt, Human
gcaguccucauccuuuagcagu

SEQ ID NO: 181871 - RNA, 22 nt, Human
uggcagagcccagaacugagca

SEQ ID NO: 181872 - RNA, 22 nt, Human
ucccugggaacaaaggaugaga

SEQ ID NO: 181873 - RNA, 22 nt, Human
ugugaaauguggauguuaauag

SEQ ID NO: 181874 - RNA, 22 nt, Human
agguccaguugccagaauggcc

SEQ ID NO: 181875 - RNA, 22 nt, Human
gugaggucuuugggaggugauu

SEQ ID NO: 181876 - RNA, 22 nt, Human
auaagguauaaggccuauuuuu

SEQ ID NO: 181877 - RNA, 22 nt, Human
gcaggagcaaacugcagugugg

SEQ ID NO: 181878 - RNA, 22 nt, Human
ggagugucagaaacaguguccu

SEQ ID NO: 181879 - RNA, 22 nt, Human
ucuggcucucaacaaauauuua

SEQ ID NO: 181880 - RNA, 22 nt, Human
aacuuucucuggauggcuuccu

SEQ ID NO: 181881 - RNA, 22 nt, Human
uuacaaagcgcuuuaccucuga

SEQ ID NO: 181882 - RNA, 22 nt, Human
uuuuucuuaaauguggguuggc

SEQ ID NO: 181883 - RNA, 22 nt, Human
cccaggacucggcacucuccuu

SEQ ID NO: 181884 - RNA, 22 nt, Human
ucuguauucuauggcaguuggu

SEQ ID NO: 181885 - RNA, 22 nt, Human
aagaggcagaaauaucgcugaa

SEQ ID NO: 181886 - RNA, 22 nt, Human
uggcaagggauuguggagaacu

SEQ ID NO: 181887 - RNA, 22 nt, Human
aagacaugcaauuagcaaggaa

SEQ ID NO: 181888 - RNA, 22 nt, Human
ucuggagcuggagggcaaggca

SEQ ID NO: 181889 - RNA, 22 nt, Human
cagcuggacuuuugauagaagu

SEQ ID NO: 181890 - RNA, 22 nt, Human
gugcaggguccuaauuguuaag

SEQ ID NO: 181891 - RNA, 22 nt, Human
cugagggaacuugggcaagucu

SEQ ID NO: 181892 - RNA, 22 nt, Human
uggcugugggaugagagccuca

SEQ ID NO: 181893 - RNA, 22 nt, Human
ggagaccuuaaggugcuuccua

SEQ ID NO: 181894 - RNA, 22 nt, Human
cugggcccaggcggcucucgga

SEQ ID NO: 181895 - RNA, 22 nt, Human
aaagaaauagauggcauuuaaa

SEQ ID NO: 181896 - RNA, 22 nt, Human
cccugcagcuuuugcauaguca

SEQ ID NO: 181897 - RNA, 21 nt, Human
uucugggaaaugagcuggggc

SEQ ID NO: 181898 - RNA, 22 nt, Human
acaaaagcacugcagaguaagc

SEQ ID NO: 181899 - RNA, 22 nt, Human
aaaucacagggucucuaaguau

SEQ ID NO: 181900 - RNA, 22 nt, Human
gcaggcaguugcaguuuucuag

SEQ ID NO: 181901 - RNA, 21 nt, Human
cucauuuauuuuuguguccaa

SEQ ID NO: 181902 - RNA, 22 nt, Human
aggcacagggaugcggagccag

SEQ ID NO: 181903 - RNA, 22 nt, Human
ucuuguuaaagugaagauacug

SEQ ID NO: 181904 - RNA, 19 nt, Human
ucucagaggaaaaauugcu

SEQ ID NO: 181905 - RNA, 22 nt, Human
cacagaggcaugacccugcccu

SEQ ID NO: 181906 - RNA, 22 nt, Human
acacucugcucugagcuucagg

SEQ ID NO: 181907 - RNA, 22 nt, Human
ugaggccuaccccccuguguuu

SEQ ID NO: 181908 - RNA, 22 nt, Human
aauggaggugucuggccuggua

SEQ ID NO: 181909 - RNA, 22 nt, Human
acacauucaugagugcaugcac

SEQ ID NO: 181910 - RNA, 22 nt, Human
ugaaggcuuuuuaaagcauuug

SEQ ID NO: 181911 - RNA, 22 nt, Human
cuacauaaauuuaucacagacu

SEQ ID NO: 181912 - RNA, 22 nt, Human
gagcacccuuugcacaucaguc

SEQ ID NO: 181913 - RNA, 23 nt, Human
ucucuuucaagagcuuaaugugc

SEQ ID NO: 181914 - RNA, 22 nt, Human
ucccaccccggucaagggcuga

SEQ ID NO: 181915 - RNA, 22 nt, Human
gcugagagugagcacuggauau

SEQ ID NO: 181916 - RNA, 22 nt, Human
cuucauuaaugucuauaaguuu

SEQ ID NO: 181917 - RNA, 22 nt, Human
uucauagagcagcucacugaau

SEQ ID NO: 181918 - RNA, 22 nt, Human
uuccagauauuuuuauguggaa

SEQ ID NO: 181919 - RNA, 19 nt, Human
ucagggaguuuacagcaug

SEQ ID NO: 181920 - RNA, 22 nt, Human
cugcugggaaggucugcucagu

SEQ ID NO: 181921 - RNA, 22 nt, Human
caguccugaggaagagcugcug

SEQ ID NO: 181922 - RNA, 22 nt, Human
gugccaggugcuaagcugugcu

SEQ ID NO: 181923 - RNA, 22 nt, Human
uuccagugacuaagcuucugcu

SEQ ID NO: 181924 - RNA, 22 nt, Human
uggagggucaccccuugcugag

SEQ ID NO: 181925 - RNA, 22 nt, Human
cuguccugauggugccacuggu

SEQ ID NO: 181926 - RNA, 22 nt, Human
gcagcuuucuaagcuuuauugc

SEQ ID NO: 181927 - RNA, 22 nt, Human
auucuucaucacuaccuuguga

SEQ ID NO: 181928 - RNA, 22 nt, Human
agacaaguguggugagagcagu

SEQ ID NO: 181929 - RNA, 21 nt, Human
cugucaccugcucagagaggg

SEQ ID NO: 181930 - RNA, 22 nt, Human
ccuggcuggauggagccccugg

SEQ ID NO: 181931 - RNA, 22 nt, Human
acagcaggcaugaaugacacug

SEQ ID NO: 181932 - RNA, 22 nt, Human
gcucuguaccugcggagaugag

SEQ ID NO: 181933 - RNA, 22 nt, Human
gagggcuccucacauucucuau

SEQ ID NO: 181934 - RNA, 22 nt, Human
acaugcuaugagagauuacuuc

SEQ ID NO: 181935 - RNA, 22 nt, Human
aacaucuccaaccuacauccac

SEQ ID NO: 181936 - RNA, 22 nt, Human
auguucauccaugucguagcag

SEQ ID NO: 181937 - RNA, 22 nt, Human
gagaaggacuacacaucuggcc

SEQ ID NO: 181938 - RNA, 22 nt, Human
agagaugacugauggcugauua

SEQ ID NO: 181939 - RNA, 21 nt, Human
ucaggcaggucccacugaaca

SEQ ID NO: 181940 - RNA, 22 nt, Human
cagagggcccccuggccacagu

SEQ ID NO: 181941 - RNA, 23 nt, Human
uaguuacauuauugucagagcug

SEQ ID NO: 181942 - RNA, 22 nt, Human
ccuuaaacucugauaugauauu

SEQ ID NO: 181943 - RNA, 23 nt, Human
ugaaagcaaugggucuauaguau

SEQ ID NO: 181944 - RNA, 22 nt, Human
ggccuccucacccugcucaggc

SEQ ID NO: 181945 - RNA, 22 nt, Human
ucuccucaccaccagcagcaga

SEQ ID NO: 181946 - RNA, 22 nt, Human
gagcccucuugucuauauggua

SEQ ID NO: 181947 - RNA, 22 nt, Human
gauucuuuggccuuuauugaca

SEQ ID NO: 181948 - RNA, 22 nt, Human
cccaaggaagacgcuugugaua

SEQ ID NO: 181949 - RNA, 22 nt, Human
cagaucuaucuguugauggugc

SEQ ID NO: 181950 - RNA, 22 nt, Human
cucaggaugucggugacuauug

SEQ ID NO: 181951 - RNA, 22 nt, Human
uuccauauucccaauuuugcca

SEQ ID NO: 181952 - RNA, 22 nt, Human
augauauagagaguagauuaaa

SEQ ID NO: 181953 - RNA, 22 nt, Human
cugagccuuauucaccagcccu

SEQ ID NO: 181954 - RNA, 22 nt, Human
ccaggccagcgcuggcuggagg

SEQ ID NO: 181955 - RNA, 22 nt, Human
agcagcaggcuuaaggaaaagu

SEQ ID NO: 181956 - RNA, 22 nt, Human
uagagauagcaguauugauucg

SEQ ID NO: 181957 - RNA, 22 nt, Human
agaggggagagcuaagcaauuc

SEQ ID NO: 181958 - RNA, 22 nt, Human
ggcugcaagacaagguugguuu

SEQ ID NO: 181959 - RNA, 22 nt, Human
gcuggccauggccugcgccauc

SEQ ID NO: 181960 - RNA, 22 nt, Human
ccauucugaacaauucuugucu

SEQ ID NO: 181961 - RNA, 21 nt, Human
aauacagugaagaauuucuuu

SEQ ID NO: 181962 - RNA, 17 nt, Human
agcaaggcuuaaguaaa

SEQ ID NO: 181963 - RNA, 22 nt, Human
agugagcaguacuuacuccugc

SEQ ID NO: 181964 - RNA, 22 nt, Human
cgugauuucuggcuuucuauau

SEQ ID NO: 181965 - RNA, 22 nt, Human
cagaaacuagauuuagacacaa

SEQ ID NO: 181966 - RNA, 22 nt, Human
cucugagggcucgagggacgcg

SEQ ID NO: 181967 - RNA, 22 nt, Human
cccaggaccauccuucugugcc

SEQ ID NO: 181968 - RNA, 22 nt, Human
cucuagaaagauuguugaccaa

SEQ ID NO: 181969 - RNA, 22 nt, Human
uuccuuccauagcaaaacaugc

SEQ ID NO: 181970 - RNA, 22 nt, Human
agaaucuaaauaugcaauuuga

SEQ ID NO: 181971 - RNA, 22 nt, Human
gagccuggauugucaccgacuu

SEQ ID NO: 181972 - RNA, 18 nt, Human
ugucucaggcugaaacag

SEQ ID NO: 181973 - RNA, 22 nt, Human
gcagcagcucucaaaguggucu

SEQ ID NO: 181974 - RNA, 15 nt, Human
uaccagcugauccgu

SEQ ID NO: 181975 - RNA, 22 nt, Human
cucugggugucuuaggagcuca

SEQ ID NO: 181976 - RNA, 22 nt, Human
uggcagagguaauucaaauccc

SEQ ID NO: 181977 - RNA, 22 nt, Human
uuugaaacucaugaucaucacu

SEQ ID NO: 181978 - RNA, 22 nt, Human
ucaucucucaggauaccagcag

SEQ ID NO: 181979 - RNA, 22 nt, Human
aaugugacugaauauuuacucu

SEQ ID NO: 181980 - RNA, 22 nt, Human
gggcagguggagggcccagcca

SEQ ID NO: 181981 - RNA, 22 nt, Human
ugcugccaccugguggcugaag

SEQ ID NO: 181982 - RNA, 22 nt, Human
aauaggcugagccauuucaagu

SEQ ID NO: 181983 - RNA, 22 nt, Human
auuccuucuuugagaauaagca

SEQ ID NO: 181984 - RNA, 22 nt, Human
uccuggccgcuggccccugaga

SEQ ID NO: 181985 - RNA, 22 nt, Human
ugccaggcaggacccuagaacc

SEQ ID NO: 181986 - RNA, 22 nt, Human
gaccacuggggugagggccauc

SEQ ID NO: 181987 - RNA, 22 nt, Human
ugcaggugagugcaggggcuca

SEQ ID NO: 181988 - RNA, 22 nt, Human
augaaucaaaguucauuugauc

SEQ ID NO: 181989 - RNA, 23 nt, Human
uggcuaaacaguggagaaagcuu

SEQ ID NO: 181990 - RNA, 22 nt, Human
aggagugagcuuuggggucaga

SEQ ID NO: 181991 - RNA, 22 nt, Human
ccacguguagguggacaggauc

SEQ ID NO: 181992 - RNA, 17 nt, Human
ggccagaggcggggcug

SEQ ID NO: 181993 - RNA, 22 nt, Human
auuauucauugguaggcaagcu

SEQ ID NO: 181994 - RNA, 22 nt, Human
gaggaaaauauucagggagguu

SEQ ID NO: 181995 - RNA, 22 nt, Human
gcacuggggucauagccuccag

SEQ ID NO: 181996 - RNA, 22 nt, Human
guuuauaaugucugugccaaaa

SEQ ID NO: 181997 - RNA, 22 nt, Human
cuauuagguaugcagccuauuu

SEQ ID NO: 181998 - RNA, 17 nt, Human
uccagcccugcccgacg

SEQ ID NO: 181999 - RNA, 23 nt, Human
aguuuccacccaggguagaaggg

SEQ ID NO: 182000 - RNA, 22 nt, Human
ugagacagccucugcacucaug

SEQ ID NO: 182001 - RNA, 23 nt, Human
ucugcaagauaaugaagaugaua

SEQ ID NO: 182002 - RNA, 22 nt, Human
ucugaaaucuguaagcacuagc

SEQ ID NO: 182003 - RNA, 21 nt, Human
uggcagaguugaguaguuaug

SEQ ID NO: 182004 - RNA, 22 nt, Human
cacuuuauauucuaagacggcc

SEQ ID NO: 182005 - RNA, 22 nt, Human
aggcuggccagugcugcagugg

SEQ ID NO: 182006 - RNA, 22 nt, Human
ggagaggcgaugagucacagcc

SEQ ID NO: 182007 - RNA, 17 nt, Human
ucacaucacacaagcaa

SEQ ID NO: 182008 - RNA, 22 nt, Human
agggagaagagaacaaagcccu

SEQ ID NO: 182009 - RNA, 22 nt, Human
cuuuugcagccauuauugcugc

SEQ ID NO: 182010 - RNA, 22 nt, Human
gggagccagcagggcauggagc

SEQ ID NO: 182011 - RNA, 22 nt, Human
caauuucaugccauguauugcu

SEQ ID NO: 182012 - RNA, 22 nt, Human
agcaggggucucugcuaaugaa

SEQ ID NO: 182013 - RNA, 22 nt, Human
gcagagccugugucugagcaaa

SEQ ID NO: 182014 - RNA, 22 nt, Human
acagaauaagguuuaucucucc

SEQ ID NO: 182015 - RNA, 22 nt, Human
uugucaaguaaggcugacauuu

SEQ ID NO: 182016 - RNA, 20 nt, Human
agcuggagaagggcccuucc

SEQ ID NO: 182017 - RNA, 22 nt, Human
ugcagaugagggaugaaaauga

SEQ ID NO: 182018 - RNA, 22 nt, Human
uuggaacacuagaaucuguacu

SEQ ID NO: 182019 - RNA, 22 nt, Human
cugggaagaaauugugggaggc

SEQ ID NO: 182020 - RNA, 22 nt, Human
ggccccagauucugggcugggu

SEQ ID NO: 182021 - RNA, 22 nt, Human
aaauguauccuacuuccugagu

SEQ ID NO: 182022 - RNA, 22 nt, Human
acacuuuuaagacuuuaaugaa

SEQ ID NO: 182023 - RNA, 19 nt, Human
gcucugccagugguaacau

SEQ ID NO: 182024 - RNA, 22 nt, Human
uggagaagcuguagguggacuc

SEQ ID NO: 182025 - RNA, 22 nt, Human
ugauuuacuucuggauaaaucc

SEQ ID NO: 182026 - RNA, 22 nt, Human
gcagcuuucuugcccuaaucuu

SEQ ID NO: 182027 - RNA, 22 nt, Human
aguggcuguuuauaggugggua

SEQ ID NO: 182028 - RNA, 22 nt, Human
uucugucucuguguuuacauua

SEQ ID NO: 182029 - RNA, 22 nt, Human
ugcugggucccuugagagcuca

SEQ ID NO: 182030 - RNA, 22 nt, Human
uacauucuacuuuuucacuccc

SEQ ID NO: 182031 - RNA, 22 nt, Human
uccaggcaaagggacuagcagg

SEQ ID NO: 182032 - RNA, 22 nt, Human
aagucaugaguccucuucugug

SEQ ID NO: 182033 - RNA, 22 nt, Human
uaaauguauaggcacuaaaccu

SEQ ID NO: 182034 - RNA, 19 nt, Human
ugugaaagcuaguguucuu

SEQ ID NO: 182035 - RNA, 22 nt, Human
aucagcagugaguggcuuucau

SEQ ID NO: 182036 - RNA, 22 nt, Human
gcuguggaugcuauggaucauc

SEQ ID NO: 182037 - RNA, 22 nt, Human
gacaagucaucuggggccugug

SEQ ID NO: 182038 - RNA, 22 nt, Human
ccacugagcaguagcugcgucg

SEQ ID NO: 182039 - RNA, 22 nt, Human
acucaggcuacaggggcagaag

SEQ ID NO: 182040 - RNA, 22 nt, Human
uccaggcugugcgcaccgugug

SEQ ID NO: 182041 - RNA, 22 nt, Human
uuccaauggaaucaugucuuga

SEQ ID NO: 182042 - RNA, 22 nt, Human
agccaggcagacucucuuucuu

SEQ ID NO: 182043 - RNA, 22 nt, Human
gcucccagacugaccagaggug

SEQ ID NO: 182044 - RNA, 22 nt, Human
cuggcucacaggugagaugcau

SEQ ID NO: 182045 - RNA, 22 nt, Human
acaaugcauaccuagcagcuca

SEQ ID NO: 182046 - RNA, 22 nt, Human
gcuggcacuugggacaaaaucu

SEQ ID NO: 182047 - RNA, 22 nt, Human
ucagcagggcugggagcuguga

SEQ ID NO: 182048 - RNA, 17 nt, Human
cagagucugucugcauc

SEQ ID NO: 182049 - RNA, 22 nt, Human
ucagaagcugggucucagaagc

SEQ ID NO: 182050 - RNA, 22 nt, Human
cuuuacaauucaagggaacucu

SEQ ID NO: 182051 - RNA, 20 nt, Human
ggucacuguggcugcaggau

SEQ ID NO: 182052 - RNA, 22 nt, Human
cuggcugcaggaugaggcugcc

SEQ ID NO: 182053 - RNA, 22 nt, Human
ucucuggggaaaaggcugauac

SEQ ID NO: 182054 - RNA, 22 nt, Human
ccaguucugacacaagcacagu

SEQ ID NO: 182055 - RNA, 21 nt, Human
aaauccaaacacuaguccaca

SEQ ID NO: 182056 - RNA, 20 nt, Human
uccagcacccucacagagaa

SEQ ID NO: 182057 - RNA, 22 nt, Human
cucucugggguuccagacgugg

SEQ ID NO: 182058 - RNA, 22 nt, Human
cugcagggaccacaagcagguu

SEQ ID NO: 182059 - RNA, 22 nt, Human
aggaaacugaagcccagagagg

SEQ ID NO: 182060 - RNA, 22 nt, Human
caguacaagaggccaccugccc

SEQ ID NO: 182061 - RNA, 22 nt, Human
acguguaaugaucaccacaauc

SEQ ID NO: 182062 - RNA, 22 nt, Human
gccugcagcugcuuccacacac

SEQ ID NO: 182063 - RNA, 22 nt, Human
ggcuucucuaaagaucaugcgu

SEQ ID NO: 182064 - RNA, 22 nt, Human
acagcacaggaguugaaugggc

SEQ ID NO: 182065 - RNA, 22 nt, Human
augcuaaauucagacaggguua

SEQ ID NO: 182066 - RNA, 22 nt, Human
cagaugcugccugggaaugucu

SEQ ID NO: 182067 - RNA, 22 nt, Human
aauggcugccagggcaggaggu

SEQ ID NO: 182068 - RNA, 22 nt, Human
uucuuacuaugauuugagccuc

SEQ ID NO: 182069 - RNA, 22 nt, Human
caaauuuagguaacagucugua

SEQ ID NO: 182070 - RNA, 22 nt, Human
ugcaagagcccaccacacacuu

SEQ ID NO: 182071 - RNA, 22 nt, Human
uucuggaagcugcagguggccg

SEQ ID NO: 182072 - RNA, 22 nt, Human
uugcauuucccauugaguaaug

SEQ ID NO: 182073 - RNA, 22 nt, Human
ggcagcucugcuccacaugagu

SEQ ID NO: 182074 - RNA, 22 nt, Human
agaugcuauacauuguaagaca

SEQ ID NO: 182075 - RNA, 22 nt, Human
ggcagaggagcuggaaacaugg

SEQ ID NO: 182076 - RNA, 22 nt, Human
agcagcugguaggaguggccac

SEQ ID NO: 182077 - RNA, 22 nt, Human
augaaacaugagaaauggagag

SEQ ID NO: 182078 - RNA, 22 nt, Human
auggcagcuggcuugggcaccu

SEQ ID NO: 182079 - RNA, 21 nt, Human
aggcagcgugagggccacuca

SEQ ID NO: 182080 - RNA, 22 nt, Human
uggaaacucagggccagaagga

SEQ ID NO: 182081 - RNA, 22 nt, Human
uaguuuuuucaacaaauggugc

SEQ ID NO: 182082 - RNA, 22 nt, Human
cuggagggcuucugcagguuac

SEQ ID NO: 182083 - RNA, 19 nt, Human
agugcagggagcacccuca

SEQ ID NO: 182084 - RNA, 22 nt, Human
aaccagaucgacuguuaacagc

SEQ ID NO: 182085 - RNA, 22 nt, Human
agggcuccaggggaccaucagu

SEQ ID NO: 182086 - RNA, 22 nt, Human
ugccagccuggccugagucuuu

SEQ ID NO: 182087 - RNA, 22 nt, Human
gaggcuccuccuuacauuuacc

SEQ ID NO: 182088 - RNA, 22 nt, Human
caucucuucauuagcauuauug

SEQ ID NO: 182089 - RNA, 22 nt, Human
gccuguggccgacugagagccu

SEQ ID NO: 182090 - RNA, 22 nt, Human
caggccuccacuccacgcagac

SEQ ID NO: 182091 - RNA, 22 nt, Human
aaugaguuauuuaauagaaagg

SEQ ID NO: 182092 - RNA, 22 nt, Human
ugguccagacauuucugaggua

SEQ ID NO: 182093 - RNA, 22 nt, Human
aguaaaauuucugcugaggaga

SEQ ID NO: 182094 - RNA, 22 nt, Human
uggugaucagucaacugucuuc

SEQ ID NO: 182095 - RNA, 22 nt, Human
cucacagcagcucugcgagaua

SEQ ID NO: 182096 - RNA, 22 nt, Human
auaugcuuaugaugucucaagu

SEQ ID NO: 182097 - RNA, 22 nt, Human
cacaggagcccugaggccuccc

SEQ ID NO: 182098 - RNA, 22 nt, Human
guguggcuagaagugucuuguu

SEQ ID NO: 182099 - RNA, 22 nt, Human
ccuccaagcugguccucugugu

SEQ ID NO: 182100 - RNA, 22 nt, Human
uucaggcccagcacagcgcgug

SEQ ID NO: 182101 - RNA, 22 nt, Human
uccuuggaagagcauucccagg

SEQ ID NO: 182102 - RNA, 22 nt, Human
cuggcugcaggaaggagugggc

SEQ ID NO: 182103 - RNA, 22 nt, Human
ucuuucuugguauaaagcaggg

SEQ ID NO: 182104 - RNA, 17 nt, Human
cugccuggagucccauc

SEQ ID NO: 182105 - RNA, 22 nt, Human
uuccugguggcuuugccaacug

SEQ ID NO: 182106 - RNA, 22 nt, Human
ccauggcuucuuucucugccag

SEQ ID NO: 182107 - RNA, 22 nt, Human
ggaagugaggaaauauuuuguu

SEQ ID NO: 182108 - RNA, 22 nt, Human
uacaaaguaauguauaauaucg

SEQ ID NO: 182109 - RNA, 22 nt, Human
uggcugaguucuccaggaguag

SEQ ID NO: 182110 - RNA, 22 nt, Human
cucaggucacggaucugagcug

SEQ ID NO: 182111 - RNA, 22 nt, Human
uuuuucuacugcccacauugua

SEQ ID NO: 182112 - RNA, 22 nt, Human
uuauugcaaaggaagagcuuga

SEQ ID NO: 182113 - RNA, 22 nt, Human
uugccuggacucugcugguauu

SEQ ID NO: 182114 - RNA, 22 nt, Human
uaggaagcuuccagaacuuaag

SEQ ID NO: 182115 - RNA, 22 nt, Human
acaguuaaucaaauggcauaug

SEQ ID NO: 182116 - RNA, 22 nt, Human
ugggggcugggaugucacuuuc

SEQ ID NO: 182117 - RNA, 22 nt, Human
agcuggcaauguaagucccugg

SEQ ID NO: 182118 - RNA, 21 nt, Human
ggaaaacuuuccuugucugaa

SEQ ID NO: 182119 - RNA, 22 nt, Human
acugguuuuccagguuacuucu

SEQ ID NO: 182120 - RNA, 22 nt, Human
ugauguuuaauacuaugcuuuu

SEQ ID NO: 182121 - RNA, 22 nt, Human
agcauucauugcuagaauguaa

SEQ ID NO: 182122 - RNA, 22 nt, Human
uuacagaacugucuugaaauuu

SEQ ID NO: 182123 - RNA, 22 nt, Human
ccugcccagcuucccgagugca

SEQ ID NO: 182124 - RNA, 18 nt, Human
ggcuucucuguuuauuuc

SEQ ID NO: 182125 - RNA, 22 nt, Human
uaagacauccguugcuuauaau

SEQ ID NO: 182126 - RNA, 23 nt, Human
uucugaaaauagauaguggcucc

SEQ ID NO: 182127 - RNA, 22 nt, Human
aauacagaggggucacaauuca

SEQ ID NO: 182128 - RNA, 21 nt, Human
agacagagugcagucuacaua

SEQ ID NO: 182129 - RNA, 23 nt, Human
aggcuggcuucaggagccucucc

SEQ ID NO: 182130 - RNA, 22 nt, Human
caacuauauagaaauugauugu

SEQ ID NO: 182131 - RNA, 22 nt, Human
uguauuuaauuguaucaucaca

SEQ ID NO: 182132 - RNA, 22 nt, Human
ucagagugaggcgucaacauga

SEQ ID NO: 182133 - RNA, 22 nt, Human
uuggggaagcuuugaaauacuu

SEQ ID NO: 182134 - RNA, 22 nt, Human
ccugggcaggccggacgcuggg

SEQ ID NO: 182135 - RNA, 22 nt, Human
uuagaacauuccaucacugggu

SEQ ID NO: 182136 - RNA, 22 nt, Human
gagcuggcagugguagacaugg

SEQ ID NO: 182137 - RNA, 22 nt, Human
cugcagggagaggggacagccu

SEQ ID NO: 182138 - RNA, 22 nt, Human
auacaguagggaccaugucuga

SEQ ID NO: 182139 - RNA, 22 nt, Human
auggcagacacaggcaggcaga

SEQ ID NO: 182140 - RNA, 23 nt, Human
accuagaaauacguuuuacaugg

SEQ ID NO: 182141 - RNA, 22 nt, Human
cauaugaaauaugaguugaaca

SEQ ID NO: 182142 - RNA, 17 nt, Human
ucugaagccagucugcu

SEQ ID NO: 182143 - RNA, 22 nt, Human
uccaguuuauuuuuggcagggu

SEQ ID NO: 182144 - RNA, 22 nt, Human
cugcugagccgcacccaggagc

SEQ ID NO: 182145 - RNA, 22 nt, Human
uugcugggucagaagccaggag

SEQ ID NO: 182146 - RNA, 22 nt, Human
ccaggaaggcaggccuccccgc

SEQ ID NO: 182147 - RNA, 22 nt, Human
aaugaacauggacaaguuaaua

SEQ ID NO: 182148 - RNA, 22 nt, Human
ugcaaaguugcaucaaaaccca

SEQ ID NO: 182149 - RNA, 21 nt, Human
ugaccagugccccauccuguc

SEQ ID NO: 182150 - RNA, 22 nt, Human
aaaaugaggucaauauccuuuu

SEQ ID NO: 182151 - RNA, 22 nt, Human
ccugagcagggcucugcagggc

SEQ ID NO: 182152 - RNA, 22 nt, Human
gcagucuuugaaugugaaauag

SEQ ID NO: 182153 - RNA, 21 nt, Human
ucagaguguguuacagcaagc

SEQ ID NO: 182154 - RNA, 22 nt, Human
ucaacaauugcauguugauguu

SEQ ID NO: 182155 - RNA, 22 nt, Human
ggcugguggggaaagaggacca

SEQ ID NO: 182156 - RNA, 22 nt, Human
ggcuccagguuuaaggguaugu

SEQ ID NO: 182157 - RNA, 21 nt, Human
cucaggauggcggccuggugg

SEQ ID NO: 182158 - RNA, 22 nt, Human
aggacauguaaauggagaggga

SEQ ID NO: 182159 - RNA, 22 nt, Human
gcaggccugcccagcaggaugg

SEQ ID NO: 182160 - RNA, 22 nt, Human
gcaggagccacuucagggaugc

SEQ ID NO: 182161 - RNA, 22 nt, Human
aaagcugccaaggagaauacua

SEQ ID NO: 182162 - RNA, 22 nt, Human
aauaacuuaagaaauuucccca

SEQ ID NO: 182163 - RNA, 22 nt, Human
caggccagguggcaggcaaaac

SEQ ID NO: 182164 - RNA, 20 nt, Human
gaguccaggggccuguagca

SEQ ID NO: 182165 - RNA, 23 nt, Human
cccaggcuacaaauuaugcucug

SEQ ID NO: 182166 - RNA, 22 nt, Human
cuggcagucugccucuucacug

SEQ ID NO: 182167 - RNA, 22 nt, Human
acaguggaggccauaugguccu

SEQ ID NO: 182168 - RNA, 22 nt, Human
gagagccugccagugaguguau

SEQ ID NO: 182169 - RNA, 22 nt, Human
cagcugcauuaauuuuagugaa

SEQ ID NO: 182170 - RNA, 22 nt, Human
ggaggggccggcugccugccac

SEQ ID NO: 182171 - RNA, 19 nt, Human
ggcuggagaaaggaaucag

SEQ ID NO: 182172 - RNA, 22 nt, Human
acuggcagcuguaggaugcaug

SEQ ID NO: 182173 - RNA, 22 nt, Human
uacaaaugguugaauggaugaa

SEQ ID NO: 182174 - RNA, 22 nt, Human
cuccucuuuggggauuuacaca

SEQ ID NO: 182175 - RNA, 22 nt, Human
uggaggagaacucccuggcuac

SEQ ID NO: 182176 - RNA, 22 nt, Human
aacagugaggugaauaugcucc

SEQ ID NO: 182177 - RNA, 22 nt, Human
uacaacaauuuccacauuagaa

SEQ ID NO: 182178 - RNA, 23 nt, Human
cuucucugagcuaggaaugcucu

SEQ ID NO: 182179 - RNA, 22 nt, Human
agacagacaaaauuccugccug

SEQ ID NO: 182180 - RNA, 22 nt, Human
ggcucugguggcaauugacugg

SEQ ID NO: 182181 - RNA, 22 nt, Human
ccuguauuauuuguaugugcug

SEQ ID NO: 182182 - RNA, 22 nt, Human
gcugucuuuuccuggcaguaaa

SEQ ID NO: 182183 - RNA, 22 nt, Human
agccaggcucaaggccugcucc

SEQ ID NO: 182184 - RNA, 22 nt, Human
auugcugaacuuauaaaugaau

SEQ ID NO: 182185 - RNA, 23 nt, Human
uuacaaguucugaaauuuccuuc

SEQ ID NO: 182186 - RNA, 22 nt, Human
cuuugaaaacacacgaauagac

SEQ ID NO: 182187 - RNA, 22 nt, Human
gugugcagggaugagugcaggu

SEQ ID NO: 182188 - RNA, 22 nt, Human
agggggcucagcaggcucugga

SEQ ID NO: 182189 - RNA, 18 nt, Human
gcuccugguuggaaagaa

SEQ ID NO: 182190 - RNA, 22 nt, Human
gcugccagcccagcaaggugug

SEQ ID NO: 182191 - RNA, 22 nt, Human
agcugaggaggaaugaugggua

SEQ ID NO: 182192 - RNA, 22 nt, Human
gaggcccagcauucagggcagg

SEQ ID NO: 182193 - RNA, 22 nt, Human
uccugguggauagaagccaagg

SEQ ID NO: 182194 - RNA, 22 nt, Human
cucugggcuccuucagcccuuu

SEQ ID NO: 182195 - RNA, 22 nt, Human
uuuaugucaaaacuacaguugg

SEQ ID NO: 182196 - RNA, 19 nt, Human
gcugggugaggucguugga

SEQ ID NO: 182197 - RNA, 22 nt, Human
uuccaugaaagugaaauggagc

SEQ ID NO: 182198 - RNA, 22 nt, Human
agcaccaggccauggggucccu

SEQ ID NO: 182199 - RNA, 22 nt, Human
gaacuggucuuuuagguuuucu

SEQ ID NO: 182200 - RNA, 22 nt, Human
aaaguguuuuccaugcaaugaa

SEQ ID NO: 182201 - RNA, 22 nt, Human
caggugaguaacaaugggugau

SEQ ID NO: 182202 - RNA, 22 nt, Human
uacaugugauaaauugauuaaa

SEQ ID NO: 182203 - RNA, 22 nt, Human
uuugucuucccccuuuaaucag

SEQ ID NO: 182204 - RNA, 22 nt, Human
uggcuucaggguugucuucagc

SEQ ID NO: 182205 - RNA, 22 nt, Human
aaggccagaguacuagaggcug

SEQ ID NO: 182206 - RNA, 22 nt, Human
uuagaacuuuucaacuccauuc

SEQ ID NO: 182207 - RNA, 22 nt, Human
cugaggagaugauaaugucauu

SEQ ID NO: 182208 - RNA, 23 nt, Human
agaggggagcaucugcuggcuga

SEQ ID NO: 182209 - RNA, 22 nt, Human
ucagcuuuccuugcuuuagauu

SEQ ID NO: 182210 - RNA, 22 nt, Human
aggcccagcccguccucgugcu

SEQ ID NO: 182211 - RNA, 19 nt, Human
ucucugccgaucagggccc

SEQ ID NO: 182212 - RNA, 22 nt, Human
agcuucucaaguguuugcgggg

SEQ ID NO: 182213 - RNA, 22 nt, Human
aagauaaacucuugauuucuga

SEQ ID NO: 182214 - RNA, 22 nt, Human
augcacaggcugugggcugguu

SEQ ID NO: 182215 - RNA, 22 nt, Human
uguuuaaauagaacauacugca

SEQ ID NO: 182216 - RNA, 22 nt, Human
gcugcccuguuuagccaggguu

SEQ ID NO: 182217 - RNA, 22 nt, Human
cagagcagugggguuggucaga

SEQ ID NO: 182218 - RNA, 22 nt, Human
uuccugugugaccgagacagug

SEQ ID NO: 182219 - RNA, 22 nt, Human
uccugggagcacaugguccugc

SEQ ID NO: 182220 - RNA, 22 nt, Human
cuccagauuccugcuggcagaa

SEQ ID NO: 182221 - RNA, 22 nt, Human
acugggcuccagaugugauacg

SEQ ID NO: 182222 - RNA, 22 nt, Human
aacagugucaggauuacagaua

SEQ ID NO: 182223 - RNA, 22 nt, Human
aagcaaggcccagagcaucagc

SEQ ID NO: 182224 - RNA, 22 nt, Human
uguguucuggcugugacagcug

SEQ ID NO: 182225 - RNA, 22 nt, Human
agacauuuccugugaaccuacu

SEQ ID NO: 182226 - RNA, 22 nt, Human
aucagcaaaaaugccuucagaa

SEQ ID NO: 182227 - RNA, 22 nt, Human
cagcucuuauuuucucuccuaa

SEQ ID NO: 182228 - RNA, 21 nt, Human
acugggcuagccugacuucug

SEQ ID NO: 182229 - RNA, 22 nt, Human
auguuuaaaggagucagagacu

SEQ ID NO: 182230 - RNA, 22 nt, Human
gaagagcuaaaggcacaggcuu

SEQ ID NO: 182231 - RNA, 22 nt, Human
agaaaugaauauguagugguua

SEQ ID NO: 182232 - RNA, 22 nt, Human
ucucaguggguuaaaagagaag

SEQ ID NO: 182233 - RNA, 22 nt, Human
acacagaggaaagugugaaggg

SEQ ID NO: 182234 - RNA, 22 nt, Human
cucugcagagccuccagcccag

SEQ ID NO: 182235 - RNA, 22 nt, Human
uucaaugcauauagauauagaa

SEQ ID NO: 182236 - RNA, 22 nt, Human
aaaucucaauuugaauuguagc

SEQ ID NO: 182237 - RNA, 22 nt, Human
ucaggcagaggauggggagcgu

SEQ ID NO: 182238 - RNA, 22 nt, Human
ccuggcuguuuauuucggggcu

SEQ ID NO: 182239 - RNA, 22 nt, Human
aagagccagugggaaagucuug

SEQ ID NO: 182240 - RNA, 20 nt, Human
acuaacauuugcaaggggcu

SEQ ID NO: 182241 - RNA, 22 nt, Human
cagagcccugcaugcuccaucu

SEQ ID NO: 182242 - RNA, 22 nt, Human
aucugcugcccagccacuugcu

SEQ ID NO: 182243 - RNA, 22 nt, Human
ugcagggaaagggcacugggcu

SEQ ID NO: 182244 - RNA, 20 nt, Human
guacucagaucaagucagcu

SEQ ID NO: 182245 - RNA, 22 nt, Human
uuagaacuuaagaauacugucu

SEQ ID NO: 182246 - RNA, 22 nt, Human
caaauacuguacugaacacugu

SEQ ID NO: 182247 - RNA, 22 nt, Human
uggagagguuuaaacaaaaguu

SEQ ID NO: 182248 - RNA, 22 nt, Human
gcagcugggacacugaggccag

SEQ ID NO: 182249 - RNA, 22 nt, Human
ggcucagcacagggcuggcauc

SEQ ID NO: 182250 - RNA, 22 nt, Human
acagggaauggagggaucagua

SEQ ID NO: 182251 - RNA, 22 nt, Human
ucagugucauaucaagaagaug

SEQ ID NO: 182252 - RNA, 21 nt, Human
aguggcugucaagggggccuu

SEQ ID NO: 182253 - RNA, 22 nt, Human
agaacagaagggaggaaggccu

SEQ ID NO: 182254 - RNA, 22 nt, Human
gugcagcugcaggagucagguc

SEQ ID NO: 182255 - RNA, 22 nt, Human
uguuaaaccuaguacagguccu

SEQ ID NO: 182256 - RNA, 21 nt, Human
gaggggcagcucuuagcauua

SEQ ID NO: 182257 - RNA, 22 nt, Human
gccagguguaguggccacaccu

SEQ ID NO: 182258 - RNA, 18 nt, Human
gcaggagauggguggggu

SEQ ID NO: 182259 - RNA, 22 nt, Human
cagguauucauagaauucagag

SEQ ID NO: 182260 - RNA, 22 nt, Human
ucacaucauuaagacuucuccu

SEQ ID NO: 182261 - RNA, 22 nt, Human
aguuaaaucauggccauuggaa

SEQ ID NO: 182262 - RNA, 22 nt, Human
acacauuuucaacacugucaag

SEQ ID NO: 182263 - RNA, 22 nt, Human
acauucucuuuuagaaagcugu

SEQ ID NO: 182264 - RNA, 22 nt, Human
ucuugggaggagcaccugccug

SEQ ID NO: 182265 - RNA, 22 nt, Human
cucugcaggggaggcaugcacu

SEQ ID NO: 182266 - RNA, 22 nt, Human
acacagugugugcagucggacg

SEQ ID NO: 182267 - RNA, 19 nt, Human
aauaagcuuggguaaaacu

SEQ ID NO: 182268 - RNA, 17 nt, Human
ucaggcugugccuggua

SEQ ID NO: 182269 - RNA, 22 nt, Human
aaaguuuuauaugcugcagcga

SEQ ID NO: 182270 - RNA, 22 nt, Human
cuucagaaacuaguaacagcua

SEQ ID NO: 182271 - RNA, 22 nt, Human
aaugauaagacaugaguagagg

SEQ ID NO: 182272 - RNA, 22 nt, Human
cagagacauucaguaaauuauc

SEQ ID NO: 182273 - RNA, 22 nt, Human
uuuuauguuccugaagcuaucu

SEQ ID NO: 182274 - RNA, 22 nt, Human
uguucacaagcagauguugcuu

SEQ ID NO: 182275 - RNA, 21 nt, Human
gaaagcacagaaaggacucuu

SEQ ID NO: 182276 - RNA, 22 nt, Human
ucuguaaguguugguuauucua

SEQ ID NO: 182277 - RNA, 22 nt, Human
gaauuccuuaggcucuugacug

SEQ ID NO: 182278 - RNA, 22 nt, Human
gcagauuacuggacugauucca

SEQ ID NO: 182279 - RNA, 23 nt, Human
ucauaaauauuagcacaguagga

SEQ ID NO: 182280 - RNA, 22 nt, Human
ccagcccuguuuaugugucacu

SEQ ID NO: 182281 - RNA, 20 nt, Human
uccagcccagcagccugaca

SEQ ID NO: 182282 - RNA, 22 nt, Human
aggagggauagaaaaauacuug

SEQ ID NO: 182283 - RNA, 22 nt, Human
uuaaggagcagaaugcuuggac

SEQ ID NO: 182284 - RNA, 22 nt, Human
gcugggcuucucaaugcugccu

SEQ ID NO: 182285 - RNA, 22 nt, Human
ugccuugggagccagcaugcca

SEQ ID NO: 182286 - RNA, 22 nt, Human
cugggccuugagaaucauguuu

SEQ ID NO: 182287 - RNA, 21 nt, Human
uacuacagucucuuuaucagu

SEQ ID NO: 182288 - RNA, 22 nt, Human
auaaccugguaguauuaaaugu

SEQ ID NO: 182289 - RNA, 23 nt, Human
aaagccaagucagucuacuggaa

SEQ ID NO: 182290 - RNA, 22 nt, Human
ucugggcugcuucagccuucgc

SEQ ID NO: 182291 - RNA, 22 nt, Human
uuuguucacauuuaggacucuc

SEQ ID NO: 182292 - RNA, 22 nt, Human
cuuggcaggguggaggaugcag

SEQ ID NO: 182293 - RNA, 22 nt, Human
gccucccuguuuccugcuccaa

SEQ ID NO: 182294 - RNA, 22 nt, Human
aagaguuauaccuauuucuaac

SEQ ID NO: 182295 - RNA, 22 nt, Human
ugguuccugguucacuuggcag

SEQ ID NO: 182296 - RNA, 19 nt, Human
cagcucaguuugauucucu

SEQ ID NO: 182297 - RNA, 22 nt, Human
gcucacugcaaccucugcuucc

SEQ ID NO: 182298 - RNA, 22 nt, Human
cuuuuccuauugauucuguuac

SEQ ID NO: 182299 - RNA, 22 nt, Human
ggcucuggggggaagucuguug

SEQ ID NO: 182300 - RNA, 22 nt, Human
cacagcaagagcuaaaugacca

SEQ ID NO: 182301 - RNA, 21 nt, Human
auuugcauuaaaauauuacgc

SEQ ID NO: 182302 - RNA, 22 nt, Human
cacacaaauauucuggaggcaa

SEQ ID NO: 182303 - RNA, 20 nt, Human
uacaggaaucaagacugcau

SEQ ID NO: 182304 - RNA, 22 nt, Human
uaagacacgggcugaucuaaag

SEQ ID NO: 182305 - RNA, 22 nt, Human
uaagaacauuuucggaaagaua

SEQ ID NO: 182306 - RNA, 22 nt, Human
agcugggcuggagcuccaagcg

SEQ ID NO: 182307 - RNA, 22 nt, Human
gggcaggugcccagggccagag

SEQ ID NO: 182308 - RNA, 22 nt, Human
ucccacaggagccugaguccca

SEQ ID NO: 182309 - RNA, 22 nt, Human
aaaugcuuagagguguucaaau

SEQ ID NO: 182310 - RNA, 22 nt, Human
uauuccaguucaccuuuucauc

SEQ ID NO: 182311 - RNA, 22 nt, Human
acaggcuggaggaggaccaaga

SEQ ID NO: 182312 - RNA, 22 nt, Human
ugccuggcucuaucaguggugg

SEQ ID NO: 182313 - RNA, 22 nt, Human
gucuggagggaagagaugucag

SEQ ID NO: 182314 - RNA, 22 nt, Human
aaugaucacugcaguugaugag

SEQ ID NO: 182315 - RNA, 22 nt, Human
uucacauuggugauauguuucu

SEQ ID NO: 182316 - RNA, 22 nt, Human
aaagacacaugucucuuagauu

SEQ ID NO: 182317 - RNA, 22 nt, Human
uuaaaagaccuguugagguuag

SEQ ID NO: 182318 - RNA, 22 nt, Human
cuacaucacuuaauucuuagaa

SEQ ID NO: 182319 - RNA, 22 nt, Human
ucagggcagaauccaaagaauu

SEQ ID NO: 182320 - RNA, 22 nt, Human
cugaagggaugugauuucuaca

SEQ ID NO: 182321 - RNA, 22 nt, Human
acaaagauucauuugcauuauu

SEQ ID NO: 182322 - RNA, 22 nt, Human
ccacaugcucuuguuacagugu

SEQ ID NO: 182323 - RNA, 21 nt, Human
cuguggccuggcuagcaccgu

SEQ ID NO: 182324 - RNA, 22 nt, Human
cagacaugauguaagcagaggc

SEQ ID NO: 182325 - RNA, 22 nt, Human
gucagcagugucagcucugggg

SEQ ID NO: 182326 - RNA, 22 nt, Human
gcucucugcaagucagcagccu

SEQ ID NO: 182327 - RNA, 22 nt, Human
gaagccacccuccuuccagccc

SEQ ID NO: 182328 - RNA, 22 nt, Human
cugcagagcagccaguccccca

SEQ ID NO: 182329 - RNA, 22 nt, Human
aguuaggaguauaggaaugccu

SEQ ID NO: 182330 - RNA, 22 nt, Human
gccauuuucugucuuguuuauu

SEQ ID NO: 182331 - RNA, 22 nt, Human
acaggccugaugccuuggcugg

SEQ ID NO: 182332 - RNA, 22 nt, Human
cucccagggccaucgagucacu

SEQ ID NO: 182333 - RNA, 22 nt, Human
gcuguucacaucuggaccauuu

SEQ ID NO: 182334 - RNA, 22 nt, Human
ugcugcagcuaaggugaggugc

SEQ ID NO: 182335 - RNA, 22 nt, Human
ccuggcacauaguaaguacuag

SEQ ID NO: 182336 - RNA, 22 nt, Human
uuucacaaaugucuuuaacuug

SEQ ID NO: 182337 - RNA, 22 nt, Human
ggcugaaacagauuucaagaca

SEQ ID NO: 182338 - RNA, 22 nt, Human
agacagcugggaguguccuucu

SEQ ID NO: 182339 - RNA, 17 nt, Human
aggcuggcucacaggga

SEQ ID NO: 182340 - RNA, 22 nt, Human
ugacagggucagagcugagcug

SEQ ID NO: 182341 - RNA, 22 nt, Human
gcucagagaguuucacaaguuu

SEQ ID NO: 182342 - RNA, 22 nt, Human
ugacuuuaagcuaucugauucu

SEQ ID NO: 182343 - RNA, 22 nt, Human
aaaagaaccuagcuccucaguc

SEQ ID NO: 182344 - RNA, 23 nt, Human
ucccagggaaggugagcgaggcu

SEQ ID NO: 182345 - RNA, 22 nt, Human
gcacagaacuucucuuaguagg

SEQ ID NO: 182346 - RNA, 22 nt, Human
uuccuggcacugcagugguuga

SEQ ID NO: 182347 - RNA, 22 nt, Human
ggagugggaacaaugacauggu

SEQ ID NO: 182348 - RNA, 22 nt, Human
uucucuuacauuuucucagccu

SEQ ID NO: 182349 - RNA, 22 nt, Human
aaaggccacugcaagggaaggu

SEQ ID NO: 182350 - RNA, 23 nt, Human
cucugcaggagagugggcagggc

SEQ ID NO: 182351 - RNA, 22 nt, Human
cugaggccggagcacugaagag

SEQ ID NO: 182352 - RNA, 22 nt, Human
caacagagagaccagaaacagg

SEQ ID NO: 182353 - RNA, 22 nt, Human
aggugucuucagggugagacag

SEQ ID NO: 182354 - RNA, 22 nt, Human
uuggaaaagcguucucuguagc

SEQ ID NO: 182355 - RNA, 22 nt, Human
gcuggaggaucacuugagccca

SEQ ID NO: 182356 - RNA, 22 nt, Human
caauuucuuguuaauucucagg

SEQ ID NO: 182357 - RNA, 21 nt, Human
aacugcaaaucuuagacugca

SEQ ID NO: 182358 - RNA, 20 nt, Human
uucuggaggcuacaagucug

SEQ ID NO: 182359 - RNA, 22 nt, Human
aaguuugcauagauuaagcauu

SEQ ID NO: 182360 - RNA, 22 nt, Human
aacauguuuccaguguaaggcc

SEQ ID NO: 182361 - RNA, 20 nt, Human
aguuugugugucuaugcgcu

SEQ ID NO: 182362 - RNA, 22 nt, Human
auagaauuacaguguguuugga

SEQ ID NO: 182363 - RNA, 22 nt, Human
gcauuuggaacuugguugagau

SEQ ID NO: 182364 - RNA, 22 nt, Human
uggcagcacuugaacuugagcc

SEQ ID NO: 182365 - RNA, 22 nt, Human
ggcagggaguggagacucccua

SEQ ID NO: 182366 - RNA, 22 nt, Human
ugucccagggaaggcccagcac

SEQ ID NO: 182367 - RNA, 22 nt, Human
cuucucugcaccccacuuuugc

SEQ ID NO: 182368 - RNA, 22 nt, Human
accagccugucugagucguggg

SEQ ID NO: 182369 - RNA, 22 nt, Human
uuuaucugagcugauagauagu

SEQ ID NO: 182370 - RNA, 22 nt, Human
gcugucuuggaaaaggcaaaga

SEQ ID NO: 182371 - RNA, 22 nt, Human
uaguuaggaaaguccagggagc

SEQ ID NO: 182372 - RNA, 22 nt, Human
cagauucuucauugccccauuc

SEQ ID NO: 182373 - RNA, 22 nt, Human
auguacaguuucuagacucaaa

SEQ ID NO: 182374 - RNA, 22 nt, Human
uguuuuagcugacacauggagc

SEQ ID NO: 182375 - RNA, 22 nt, Human
cuuuuucuucuaggugugccug

SEQ ID NO: 182376 - RNA, 22 nt, Human
cugcccugcuugaugacagcga

SEQ ID NO: 182377 - RNA, 22 nt, Human
ugaggaguguggauggagcuug

SEQ ID NO: 182378 - RNA, 22 nt, Human
uucugagagagccucucauguu

SEQ ID NO: 182379 - RNA, 22 nt, Human
auccuuagguggugcaucaggg

SEQ ID NO: 182380 - RNA, 22 nt, Human
cucaacagcucugccauacucc

SEQ ID NO: 182381 - RNA, 22 nt, Human
uuucaaggcuaguuuuaauuag

SEQ ID NO: 182382 - RNA, 22 nt, Human
aucaaaguaauuaacacugaga

SEQ ID NO: 182383 - RNA, 22 nt, Human
ugcuuugcuggcacuccuggcu

SEQ ID NO: 182384 - RNA, 22 nt, Human
agcuuugggcagaagaggauuc

SEQ ID NO: 182385 - RNA, 22 nt, Human
uuccucagcuguguccuggcga

SEQ ID NO: 182386 - RNA, 22 nt, Human
uucacaguuuaauggcaaggau

SEQ ID NO: 182387 - RNA, 22 nt, Human
uauuuucaccuucucuggauau

SEQ ID NO: 182388 - RNA, 22 nt, Human
uguauuuucuucuggaagcuua

SEQ ID NO: 182389 - RNA, 22 nt, Human
cuucccugguguuagcccaaug

SEQ ID NO: 182390 - RNA, 22 nt, Human
gcuguacaaggccucugccauc

SEQ ID NO: 182391 - RNA, 22 nt, Human
agauacaguguuacauuuuuau

SEQ ID NO: 182392 - RNA, 22 nt, Human
uguuucaaagaaagaaaauaua

SEQ ID NO: 182393 - RNA, 22 nt, Human
aucagcaagauguaauuucuau

SEQ ID NO: 182394 - RNA, 22 nt, Human
cagcuguguagaugcaggguca

SEQ ID NO: 182395 - RNA, 22 nt, Human
agcagagucuucaagggcaggc

SEQ ID NO: 182396 - RNA, 22 nt, Human
uagaacuuccaauucagggcug

SEQ ID NO: 182397 - RNA, 22 nt, Human
ucuguuucuucuucuguuauau

SEQ ID NO: 182398 - RNA, 22 nt, Human
cccuccagugucccagugggga

SEQ ID NO: 182399 - RNA, 22 nt, Human
ccucccaccauuuagagagagc

SEQ ID NO: 182400 - RNA, 22 nt, Human
acucuguaauucugaagcaccu

SEQ ID NO: 182401 - RNA, 22 nt, Human
uuccucaguuagugccugaggc

SEQ ID NO: 182402 - RNA, 22 nt, Human
uacauuacaggaaagauaaaga

SEQ ID NO: 182403 - RNA, 22 nt, Human
cagaaaggacagagugagggug

SEQ ID NO: 182404 - RNA, 22 nt, Human
uggagcugaggggaaugcugag

SEQ ID NO: 182405 - RNA, 22 nt, Human
aggcaggcucaaugcccagucu

SEQ ID NO: 182406 - RNA, 22 nt, Human
cuguacaggugaggagggggcu

SEQ ID NO: 182407 - RNA, 20 nt, Human
cugcucagaccaacucuucu

SEQ ID NO: 182408 - RNA, 22 nt, Human
uuucugcucgcucucaaucagg

SEQ ID NO: 182409 - RNA, 22 nt, Human
uuccuggguugugcauuguaca

SEQ ID NO: 182410 - RNA, 22 nt, Human
acccaggcuggagugcaguggu

SEQ ID NO: 182411 - RNA, 21 nt, Human
ggcagccucuguggaagggga

SEQ ID NO: 182412 - RNA, 22 nt, Human
uagguggugggauaugagcauc

SEQ ID NO: 182413 - RNA, 22 nt, Human
uuacagaguggucuggcuaugu

SEQ ID NO: 182414 - RNA, 22 nt, Human
uucaggaugacaccauguccag

SEQ ID NO: 182415 - RNA, 23 nt, Human
auguaaacuucagagucauugcc

SEQ ID NO: 182416 - RNA, 22 nt, Human
ccauaaucguguguuaaauaau

SEQ ID NO: 182417 - RNA, 22 nt, Human
cuuuuccucaggaggagacgcg

SEQ ID NO: 182418 - RNA, 22 nt, Human
uccuggcaguucagcccccuaa

SEQ ID NO: 182419 - RNA, 22 nt, Human
uccaucuacggcuauaccaccc

SEQ ID NO: 182420 - RNA, 22 nt, Human
cuucuuuaauguauacaaaaga

SEQ ID NO: 182421 - RNA, 22 nt, Human
uugauucaaaacaggagguagg

SEQ ID NO: 182422 - RNA, 22 nt, Human
ggguccagaguuuucccgcccu

SEQ ID NO: 182423 - RNA, 22 nt, Human
ucuccaguaucuuuccaaugaa

SEQ ID NO: 182424 - RNA, 22 nt, Human
agcucccagggcugggcaaguu

SEQ ID NO: 182425 - RNA, 22 nt, Human
cuguuuucaaagagagagaaug

SEQ ID NO: 182426 - RNA, 22 nt, Human
ugauuaaagguggaaggcaggu

SEQ ID NO: 182427 - RNA, 22 nt, Human
cagaggaaggcucugggaaugu

SEQ ID NO: 182428 - RNA, 23 nt, Human
ugcuggguaucagaaucacugag

SEQ ID NO: 182429 - RNA, 22 nt, Human
cauaggccacggucagcccaca

SEQ ID NO: 182430 - RNA, 22 nt, Human
cgguccagggaacgcccccgcc

SEQ ID NO: 182431 - RNA, 22 nt, Human
aguccugucucucccagggcca

SEQ ID NO: 182432 - RNA, 22 nt, Human
cuggcaguuggcauuggcaucu

SEQ ID NO: 182433 - RNA, 22 nt, Human
uacauagaggguaauagcauca

SEQ ID NO: 182434 - RNA, 22 nt, Human
accucagauuguggcuccgcug

SEQ ID NO: 182435 - RNA, 22 nt, Human
uccuuggcaugccgucuucucc

SEQ ID NO: 182436 - RNA, 22 nt, Human
uugaauucauuucucauugagu

SEQ ID NO: 182437 - RNA, 22 nt, Human
aauaaucucccuuuuuguaugu

SEQ ID NO: 182438 - RNA, 19 nt, Human
acaugacaacaggggaggc

SEQ ID NO: 182439 - RNA, 22 nt, Human
gcugggacugagacagugaccu

SEQ ID NO: 182440 - RNA, 20 nt, Human
ucagacccggggaagggagc

SEQ ID NO: 182441 - RNA, 22 nt, Human
cccucuacagggaagcgcuuuc

SEQ ID NO: 182442 - RNA, 22 nt, Human
uguucaaaugaucuucuuaaau

SEQ ID NO: 182443 - RNA, 22 nt, Human
agaggccaucugcucugugggg

SEQ ID NO: 182444 - RNA, 22 nt, Human
caguggcagagaacagagaccu

SEQ ID NO: 182445 - RNA, 22 nt, Human
uuugucuuaaaucuuguuacug

SEQ ID NO: 182446 - RNA, 20 nt, Human
ucagugcucaggcaccaggu

SEQ ID NO: 182447 - RNA, 22 nt, Human
caacugaacugauaucaacuau

SEQ ID NO: 182448 - RNA, 17 nt, Human
ugcugucugcuucccua

SEQ ID NO: 182449 - RNA, 22 nt, Human
ucaagcagcagaucaagagcua

SEQ ID NO: 182450 - RNA, 22 nt, Human
auuggagaagaacaugaauuag

SEQ ID NO: 182451 - RNA, 22 nt, Human
aacagcaguggcaggagaaggc

SEQ ID NO: 182452 - RNA, 22 nt, Human
aggacacaggcaggaggagauc

SEQ ID NO: 182453 - RNA, 22 nt, Human
aggggagccccugguccuggug

SEQ ID NO: 182454 - RNA, 21 nt, Human
ugcaggaguguaaugugaccc

SEQ ID NO: 182455 - RNA, 22 nt, Human
ugaggcaagucucaaucuuuga

SEQ ID NO: 182456 - RNA, 20 nt, Human
uuaaaaagagucacaggaga

SEQ ID NO: 182457 - RNA, 22 nt, Human
auggcaguugcccagccaaucc

SEQ ID NO: 182458 - RNA, 22 nt, Human
uuccaggacuggguguuugaag

SEQ ID NO: 182459 - RNA, 22 nt, Human
aguuuacacuuuugauucuuau

SEQ ID NO: 182460 - RNA, 14 nt, Human
gcaggcagaucauu

SEQ ID NO: 182461 - RNA, 22 nt, Human
uagaacugacguuagggaagaa

SEQ ID NO: 182462 - RNA, 22 nt, Human
ugcugagggagggguuuuccag

SEQ ID NO: 182463 - RNA, 22 nt, Human
cagagacagcaaguugauuucc

SEQ ID NO: 182464 - RNA, 22 nt, Human
augaugucuaucuuuguaguau

SEQ ID NO: 182465 - RNA, 22 nt, Human
cuggcuggucaucagcaguacg

SEQ ID NO: 182466 - RNA, 22 nt, Human
ggaggguggcagcguccugggc

SEQ ID NO: 182467 - RNA, 22 nt, Human
agcccaaggcuucccugcuggc

SEQ ID NO: 182468 - RNA, 22 nt, Human
uauuuccaagcugaauccaaug

SEQ ID NO: 182469 - RNA, 19 nt, Human
gauuuaaacguggcucuau

SEQ ID NO: 182470 - RNA, 22 nt, Human
cucugagguuccuuugcccucg

SEQ ID NO: 182471 - RNA, 22 nt, Human
ccucuggaucuuucuccacacu

SEQ ID NO: 182472 - RNA, 22 nt, Human
uucauugaaccacuuuauucuu

SEQ ID NO: 182473 - RNA, 22 nt, Human
ucucagaguuccucuggagucc

SEQ ID NO: 182474 - RNA, 23 nt, Human
uggaggcaggaugcuaaggaguc

SEQ ID NO: 182475 - RNA, 22 nt, Human
acaauguuucucuuuagucauu

SEQ ID NO: 182476 - RNA, 22 nt, Human
ucucaaacuacaguauggcugu

SEQ ID NO: 182477 - RNA, 20 nt, Human
ucuggcucuuugcuccuccc

SEQ ID NO: 182478 - RNA, 22 nt, Human
uagggcuguggucaguccucua

SEQ ID NO: 182479 - RNA, 22 nt, Human
ggucugcccacuacucuccauu

SEQ ID NO: 182480 - RNA, 22 nt, Human
uuaauuuucucaucugugaaau

SEQ ID NO: 182481 - RNA, 22 nt, Human
aaguauauacuaaauguuaauc

SEQ ID NO: 182482 - RNA, 22 nt, Human
agcaccaguuucgucgugacaa

SEQ ID NO: 182483 - RNA, 22 nt, Human
ucucugaguucuccuccagccc

SEQ ID NO: 182484 - RNA, 22 nt, Human
gacugugggaagacuguagguu

SEQ ID NO: 182485 - RNA, 22 nt, Human
uagcuucuggaguguuugaaaa

SEQ ID NO: 182486 - RNA, 22 nt, Human
ggcugccuuuagaacggaugcu

SEQ ID NO: 182487 - RNA, 22 nt, Human
agggaagccaagccuuagagaa

SEQ ID NO: 182488 - RNA, 22 nt, Human
cagcccugcagcuggaucucac

SEQ ID NO: 182489 - RNA, 22 nt, Human
acacacagguaaaggagccugg

SEQ ID NO: 182490 - RNA, 22 nt, Human
acaugauucuugauaggcauug

SEQ ID NO: 182491 - RNA, 22 nt, Human
ugggcaaaugcuuuuuagucaa

SEQ ID NO: 182492 - RNA, 22 nt, Human
ccucaguguguggauguuagag

SEQ ID NO: 182493 - RNA, 21 nt, Human
guagauaaagcauuuucauua

SEQ ID NO: 182494 - RNA, 22 nt, Human
auuacagauagacuuugaagcu

SEQ ID NO: 182495 - RNA, 22 nt, Human
gaguucuucuauauaguaugag

SEQ ID NO: 182496 - RNA, 22 nt, Human
ucucucuacuggggcacuagga

SEQ ID NO: 182497 - RNA, 22 nt, Human
aaggggauagagcagacacucc

SEQ ID NO: 182498 - RNA, 22 nt, Human
ugugugcacaggaguguuugaa

SEQ ID NO: 182499 - RNA, 23 nt, Human
ucucagacccgaagccagaggaa

SEQ ID NO: 182500 - RNA, 22 nt, Human
ucagguguuuaaggauagugau

SEQ ID NO: 182501 - RNA, 22 nt, Human
ggcuucccuuuccgagaggaga

SEQ ID NO: 182502 - RNA, 22 nt, Human
auggagccauuccugaagacuu

SEQ ID NO: 182503 - RNA, 22 nt, Human
gccagucuucauauucauggug

SEQ ID NO: 182504 - RNA, 22 nt, Human
guagaaucccaguggcuauauu

SEQ ID NO: 182505 - RNA, 22 nt, Human
agguggguucccgacucuggcu

SEQ ID NO: 182506 - RNA, 22 nt, Human
aguacaaacuguuucaaaguag

SEQ ID NO: 182507 - RNA, 22 nt, Human
uuguugucauuguagaggauuu

SEQ ID NO: 182508 - RNA, 22 nt, Human
ugggggagauugugcaucucua

SEQ ID NO: 182509 - RNA, 23 nt, Human
auagaagauuauugcaacagucc

SEQ ID NO: 182510 - RNA, 22 nt, Human
gcaaauucaacagcacauucuc

SEQ ID NO: 182511 - RNA, 22 nt, Human
agggacuggcucucugagcagg

SEQ ID NO: 182512 - RNA, 22 nt, Human
ucaagaacugugaagagucuga

SEQ ID NO: 182513 - RNA, 22 nt, Human
caggaugcggccugacucuaag

SEQ ID NO: 182514 - RNA, 22 nt, Human
aaaaagauagcauugugcuccu

SEQ ID NO: 182515 - RNA, 22 nt, Human
aagccagauuucacucuuaauu

SEQ ID NO: 182516 - RNA, 22 nt, Human
gaagccacaacuuuuucuuagc

SEQ ID NO: 182517 - RNA, 22 nt, Human
agagucagcuuaugacacaguc

SEQ ID NO: 182518 - RNA, 22 nt, Human
cccauggagugccugagggcca

SEQ ID NO: 182519 - RNA, 22 nt, Human
ugagcuuccucccugcauccau

SEQ ID NO: 182520 - RNA, 22 nt, Human
ucucuggguaugguaacguugg

SEQ ID NO: 182521 - RNA, 22 nt, Human
gccagguccccucauggcuccu

SEQ ID NO: 182522 - RNA, 22 nt, Human
aaacugugaagcaaguacaagg

SEQ ID NO: 182523 - RNA, 22 nt, Human
aggcugagagcaacgugucaga

SEQ ID NO: 182524 - RNA, 22 nt, Human
uuggaauucaaguuguagcuua

SEQ ID NO: 182525 - RNA, 22 nt, Human
gaggggcagagguagagaacaa

SEQ ID NO: 182526 - RNA, 22 nt, Human
aacugaggucuccagugcagaa

SEQ ID NO: 182527 - RNA, 22 nt, Human
cuccuucagcugaaucccugcu

SEQ ID NO: 182528 - RNA, 22 nt, Human
uuagcuuuccuacuaauaaaua

SEQ ID NO: 182529 - RNA, 21 nt, Human
ucgugcagcagcugaggcuug

SEQ ID NO: 182530 - RNA, 22 nt, Human
uuccugguaguaagacaucugg

SEQ ID NO: 182531 - RNA, 22 nt, Human
uauguacaauuuguuguauguc

SEQ ID NO: 182532 - RNA, 22 nt, Human
caauuucaagauucuguucuuu

SEQ ID NO: 182533 - RNA, 22 nt, Human
ggaucuggggcucugcugcuca

SEQ ID NO: 182534 - RNA, 22 nt, Human
cucuggguucacugaggcucug

SEQ ID NO: 182535 - RNA, 22 nt, Human
caggccccauuccucuugggac

SEQ ID NO: 182536 - RNA, 22 nt, Human
aggcacuucucaaauucaugcc

SEQ ID NO: 182537 - RNA, 22 nt, Human
cuccuggaugcaggcugucugc

SEQ ID NO: 182538 - RNA, 22 nt, Human
ugggaggaaugucacugagcca

SEQ ID NO: 182539 - RNA, 22 nt, Human
cugggccuaacccacagcguuu

SEQ ID NO: 182540 - RNA, 22 nt, Human
auggccagcucagagcacucag

SEQ ID NO: 182541 - RNA, 22 nt, Human
gacuucugccucaggggaaggu

SEQ ID NO: 182542 - RNA, 22 nt, Human
uuauuauugugaccugagaaug

SEQ ID NO: 182543 - RNA, 22 nt, Human
cgggcuggcugcagcugcugga

SEQ ID NO: 182544 - RNA, 22 nt, Human
ucacaggcccaaaccacgcuua

SEQ ID NO: 182545 - RNA, 22 nt, Human
uuacaguagcuuuauuuggagu

SEQ ID NO: 182546 - RNA, 22 nt, Human
agggcagcuaaggugcugacug

SEQ ID NO: 182547 - RNA, 22 nt, Human
cuggccagcugacagcagggcu

SEQ ID NO: 182548 - RNA, 22 nt, Human
uuuccuucccuggaugagaagu

SEQ ID NO: 182549 - RNA, 22 nt, Human
uacuguuaauguuaaauucagg

SEQ ID NO: 182550 - RNA, 22 nt, Human
agucucuugcuagaaucagcca

SEQ ID NO: 182551 - RNA, 22 nt, Human
uucagaacaauaugaacagaac

SEQ ID NO: 182552 - RNA, 22 nt, Human
agcucaaagcuguuacauugua

SEQ ID NO: 182553 - RNA, 22 nt, Human
ucuuuacauaguguggacuacu

SEQ ID NO: 182554 - RNA, 22 nt, Human
auucuacauuuggagugauguc

SEQ ID NO: 182555 - RNA, 18 nt, Human
gcugaaauucuaaacaaa

SEQ ID NO: 182556 - RNA, 22 nt, Human
gugaggagucugaagcacauaa

SEQ ID NO: 182557 - RNA, 22 nt, Human
ucucugggcuaaaaucaaggug

SEQ ID NO: 182558 - RNA, 18 nt, Human
gcaacagaucaacagaaa

SEQ ID NO: 182559 - RNA, 22 nt, Human
ggaggccaaggaggagcuugcc

SEQ ID NO: 182560 - RNA, 22 nt, Human
uagacacauacccuugcccaaa

SEQ ID NO: 182561 - RNA, 22 nt, Human
ugaggcagguaagcaaguuuug

SEQ ID NO: 182562 - RNA, 22 nt, Human
uucuucuucuggcugcaccugg

SEQ ID NO: 182563 - RNA, 22 nt, Human
gacuuuggcaucuagacauugu

SEQ ID NO: 182564 - RNA, 22 nt, Human
uuucacaaugcaauccuacuuc

SEQ ID NO: 182565 - RNA, 22 nt, Human
agucucaaguguuaguauuauu

SEQ ID NO: 182566 - RNA, 22 nt, Human
aggccagcaagaaagagagucu

SEQ ID NO: 182567 - RNA, 22 nt, Human
agugaaauaugcccauugcugu

SEQ ID NO: 182568 - RNA, 22 nt, Human
uaagaugagguagguaagacuu

SEQ ID NO: 182569 - RNA, 22 nt, Human
aaaagcaguuaucugggaggaa

SEQ ID NO: 182570 - RNA, 20 nt, Human
gccugcagguuggaugggau

SEQ ID NO: 182571 - RNA, 22 nt, Human
acauacuuaacauuaaagucau

SEQ ID NO: 182572 - RNA, 22 nt, Human
accugcagcuaaagauguaggg

SEQ ID NO: 182573 - RNA, 22 nt, Human
aguuaacacagucaggaguaac

SEQ ID NO: 182574 - RNA, 22 nt, Human
ucagauggguuuugaaggaugu

SEQ ID NO: 182575 - RNA, 22 nt, Human
gagggggcucccugaagccagu

SEQ ID NO: 182576 - RNA, 22 nt, Human
uaugccagggacuguuucacca

SEQ ID NO: 182577 - RNA, 22 nt, Human
gcagguggcagaggugggaucu

SEQ ID NO: 182578 - RNA, 22 nt, Human
cccaggaacagcacagaacagc

SEQ ID NO: 182579 - RNA, 22 nt, Human
acagugcauaaaaacaacuuuu

SEQ ID NO: 182580 - RNA, 22 nt, Human
cagaaccuuggugguagggaca

SEQ ID NO: 182581 - RNA, 22 nt, Human
gaaugaguauucuuuauaggau

SEQ ID NO: 182582 - RNA, 17 nt, Human
uagcacaaagcaggauu

SEQ ID NO: 182583 - RNA, 21 nt, Human
agaagggauugugguaaagau

SEQ ID NO: 182584 - RNA, 22 nt, Human
cucuuccuuucccuugagggug

SEQ ID NO: 182585 - RNA, 22 nt, Human
uggaaacuuaccguuuggggaa

SEQ ID NO: 182586 - RNA, 22 nt, Human
ggagugaggcauuuguagcuga

SEQ ID NO: 182587 - RNA, 22 nt, Human
agcagaugcgucugagugggag

SEQ ID NO: 182588 - RNA, 22 nt, Human
uacugugacagaguacuuaaac

SEQ ID NO: 182589 - RNA, 22 nt, Human
uucacagacuuuccauagauug

SEQ ID NO: 182590 - RNA, 22 nt, Human
gugacaggccacugcggcucug

SEQ ID NO: 182591 - RNA, 22 nt, Human
agaaagggcuauuuugagguag

SEQ ID NO: 182592 - RNA, 22 nt, Human
uugugacacaugccguccugag

SEQ ID NO: 182593 - RNA, 22 nt, Human
gcuuuaaugaagucacgcaaag

SEQ ID NO: 182594 - RNA, 22 nt, Human
acauucuuccagcuggcuguug

SEQ ID NO: 182595 - RNA, 22 nt, Human
ccuggcugcauuuugcuggaug

SEQ ID NO: 182596 - RNA, 22 nt, Human
aggggagccgaggggcaucugu

SEQ ID NO: 182597 - RNA, 22 nt, Human
cugcauaugagaauaggagaaa

SEQ ID NO: 182598 - RNA, 22 nt, Human
gccucuggggcagcugagucau

SEQ ID NO: 182599 - RNA, 20 nt, Human
gcugcucuccacggucugca

SEQ ID NO: 182600 - RNA, 22 nt, Human
aagaaagccaaaguucauaccu

SEQ ID NO: 182601 - RNA, 18 nt, Human
ucaggcugggccuccuuc

SEQ ID NO: 182602 - RNA, 19 nt, Human
ugcuuucuaaacacaugca

SEQ ID NO: 182603 - RNA, 22 nt, Human
agcuagaacuacaggcaugugc

SEQ ID NO: 182604 - RNA, 23 nt, Human
ccacaggcacagaggcuugcauc

SEQ ID NO: 182605 - RNA, 22 nt, Human
gaucugaagauaugaaauauuu

SEQ ID NO: 182606 - RNA, 22 nt, Human
aucuuugaucuuuauugcuaag

SEQ ID NO: 182607 - RNA, 22 nt, Human
auuuccaccggcucaggaaguu

SEQ ID NO: 182608 - RNA, 22 nt, Human
gaggcuggcagaaaagcacagg

SEQ ID NO: 182609 - RNA, 22 nt, Human
ggcaggcugggagucaucagag

SEQ ID NO: 182610 - RNA, 22 nt, Human
gaccauuuguugaaaagauuau

SEQ ID NO: 182611 - RNA, 22 nt, Human
agugaauguccccgcgggucag

SEQ ID NO: 182612 - RNA, 22 nt, Human
cuggccagccugucgaugcccu

SEQ ID NO: 182613 - RNA, 22 nt, Human
gguaacugcagaaugugccuca

SEQ ID NO: 182614 - RNA, 22 nt, Human
cagacaggguuuuggucuuugg

SEQ ID NO: 182615 - RNA, 22 nt, Human
aauuuguuuucaagucacugga

SEQ ID NO: 182616 - RNA, 22 nt, Human
uucuucaugcuguugcugcuug

SEQ ID NO: 182617 - RNA, 23 nt, Human
ccaggaagaggccauccacaguc

SEQ ID NO: 182618 - RNA, 17 nt, Human
caggcuccuuccagauu

SEQ ID NO: 182619 - RNA, 22 nt, Human
aauguuucguaaauugucuaug

SEQ ID NO: 182620 - RNA, 22 nt, Human
uuaauuaacuagccaaccacua

SEQ ID NO: 182621 - RNA, 22 nt, Human
ccaggaggcggaagguacagug

SEQ ID NO: 182622 - RNA, 22 nt, Human
uucucugaucuugcuagacuga

SEQ ID NO: 182623 - RNA, 21 nt, Human
cggagcugggcagggcauccc

SEQ ID NO: 182624 - RNA, 22 nt, Human
cagacagggaccucgcuccaga

SEQ ID NO: 182625 - RNA, 22 nt, Human
guccaugcagucaccuccagcu

SEQ ID NO: 182626 - RNA, 20 nt, Human
agacucaguuucuaugcucu

SEQ ID NO: 182627 - RNA, 22 nt, Human
ccagggcacguugggacaguac

SEQ ID NO: 182628 - RNA, 22 nt, Human
aggcuucucuccuuggcuugca

SEQ ID NO: 182629 - RNA, 22 nt, Human
aggccucucuccuuggcuugua

SEQ ID NO: 182630 - RNA, 22 nt, Human
ggaggggcauaguucaccauca

SEQ ID NO: 182631 - RNA, 22 nt, Human
cagcacagugcagaugcugacu

SEQ ID NO: 182632 - RNA, 22 nt, Human
caggcagcagccacucugguau

SEQ ID NO: 182633 - RNA, 22 nt, Human
aacaaacauuaccuggugcugg

SEQ ID NO: 182634 - RNA, 23 nt, Human
uggagcugggcucagacccuggg

SEQ ID NO: 182635 - RNA, 23 nt, Human
uaaugagaagcuuuguuuccuga

SEQ ID NO: 182636 - RNA, 22 nt, Human
ucaggaaguuuugaaucaacug

SEQ ID NO: 182637 - RNA, 22 nt, Human
ugcagguggcuccagggacugc

SEQ ID NO: 182638 - RNA, 21 nt, Human
acacaggcagugucccgaggu

SEQ ID NO: 182639 - RNA, 22 nt, Human
aacaccuugcagggauuaugac

SEQ ID NO: 182640 - RNA, 22 nt, Human
uucugggugacucacgcucccc

SEQ ID NO: 182641 - RNA, 22 nt, Human
uguuuaauugggccaacagcgg

SEQ ID NO: 182642 - RNA, 22 nt, Human
auccaaaaccagugcauuuucc

SEQ ID NO: 182643 - RNA, 22 nt, Human
auggaaagccaguguuccauca

SEQ ID NO: 182644 - RNA, 22 nt, Human
cucaggccaauaagcuccagcc

SEQ ID NO: 182645 - RNA, 22 nt, Human
aguacacaagacacauuuaaaa

SEQ ID NO: 182646 - RNA, 22 nt, Human
cugagcugggacucaguagcaa

SEQ ID NO: 182647 - RNA, 22 nt, Human
aggaggccgcugaugggcuccc

SEQ ID NO: 182648 - RNA, 22 nt, Human
aggcaaggugcucuugcucuau

SEQ ID NO: 182649 - RNA, 22 nt, Human
uuuuaucuucauuccuaucuac

SEQ ID NO: 182650 - RNA, 22 nt, Human
guuaaauaaccucauguccguu

SEQ ID NO: 182651 - RNA, 22 nt, Human
acaugucaauuuaguacucuua

SEQ ID NO: 182652 - RNA, 22 nt, Human
agugcccucgugcccagggccu

SEQ ID NO: 182653 - RNA, 22 nt, Human
acagucucuuggaauuuucaga

SEQ ID NO: 182654 - RNA, 22 nt, Human
ggcucugggugugaccuugggu

SEQ ID NO: 182655 - RNA, 22 nt, Human
acccagggcuuaaggcggugca

SEQ ID NO: 182656 - RNA, 22 nt, Human
agauaauuauuuacuucaaagu

SEQ ID NO: 182657 - RNA, 22 nt, Human
ggagacagugacuuagagacug

SEQ ID NO: 182658 - RNA, 20 nt, Human
aagagcuacuuagccuuucc

SEQ ID NO: 182659 - RNA, 22 nt, Human
uagucuuuuuaauaaauaaugc

SEQ ID NO: 182660 - RNA, 22 nt, Human
ccucugaguacagugauggauu

SEQ ID NO: 182661 - RNA, 22 nt, Human
gcccagcacauugcugaggacc

SEQ ID NO: 182662 - RNA, 19 nt, Human
aaaguugagaaacaaugga

SEQ ID NO: 182663 - RNA, 22 nt, Human
aggccacauagcuugcauguag

SEQ ID NO: 182664 - RNA, 22 nt, Human
aagaugcaugcugaagcuggcu

SEQ ID NO: 182665 - RNA, 22 nt, Human
cauuucauaguugucacaauaa

SEQ ID NO: 182666 - RNA, 22 nt, Human
ugggcagagucauacaggagac

SEQ ID NO: 182667 - RNA, 22 nt, Human
ucauuugugcaauguagaugaa

SEQ ID NO: 182668 - RNA, 21 nt, Human
gcuuucuguggacucugcacc

SEQ ID NO: 182669 - RNA, 22 nt, Human
gccugcagaggugcugcuagcu

SEQ ID NO: 182670 - RNA, 22 nt, Human
acagaaaaaugagggagcugga

SEQ ID NO: 182671 - RNA, 22 nt, Human
uuuuaagaggaggcuguuugaa

SEQ ID NO: 182672 - RNA, 22 nt, Human
uccaggcaugucccaagccgga

SEQ ID NO: 182673 - RNA, 22 nt, Human
aagcuccuuuggcucgagaucu

SEQ ID NO: 182674 - RNA, 22 nt, Human
uagaaauggguuacauuuagag

SEQ ID NO: 182675 - RNA, 22 nt, Human
ggcagccaugugggcagcgagu

SEQ ID NO: 182676 - RNA, 22 nt, Human
uucaaaauuguucuaagcucug

SEQ ID NO: 182677 - RNA, 22 nt, Human
ggcugcucggagccuccuguga

SEQ ID NO: 182678 - RNA, 22 nt, Human
gcccucagcaggaaagaucaac

SEQ ID NO: 182679 - RNA, 20 nt, Human
cucaaguaagguuauaaggu

SEQ ID NO: 182680 - RNA, 22 nt, Human
cagagcaguggagaguaggucu

SEQ ID NO: 182681 - RNA, 22 nt, Human
aucugggccaauccuaguacca

SEQ ID NO: 182682 - RNA, 22 nt, Human
ucagcuggcaucggcucaccca

SEQ ID NO: 182683 - RNA, 22 nt, Human
aaauggaauguguuuauaauuc

SEQ ID NO: 182684 - RNA, 22 nt, Human
acaaaggcaggauugacuuagu

SEQ ID NO: 182685 - RNA, 20 nt, Human
ucugucucugagcuagacuu

SEQ ID NO: 182686 - RNA, 22 nt, Human
aaauaguccugggaauaguacu

SEQ ID NO: 182687 - RNA, 22 nt, Human
gucugcugcagucguggcucua

SEQ ID NO: 182688 - RNA, 22 nt, Human
cagcuguucggggcuggcaugu

SEQ ID NO: 182689 - RNA, 22 nt, Human
ucuuccagucuguaggacuagg

SEQ ID NO: 182690 - RNA, 22 nt, Human
gcgucaauuccaucauucuucu

SEQ ID NO: 182691 - RNA, 22 nt, Human
aaggcauugcugauccucaggu

SEQ ID NO: 182692 - RNA, 22 nt, Human
uggcuggaugugagaucaagag

SEQ ID NO: 182693 - RNA, 22 nt, Human
guucuguagucauagagcaauu

SEQ ID NO: 182694 - RNA, 22 nt, Human
ggcaggugguaaggauuucaua

SEQ ID NO: 182695 - RNA, 22 nt, Human
aguggagaauaugcagaaagcc

SEQ ID NO: 182696 - RNA, 22 nt, Human
ccaguguauuauuugagaaauu

SEQ ID NO: 182697 - RNA, 22 nt, Human
ccccaaaacuuagugacuuaaa

SEQ ID NO: 182698 - RNA, 22 nt, Human
uuugcugaauagauuguaaacu

SEQ ID NO: 182699 - RNA, 22 nt, Human
aaacacuggcaauuucaugcac

SEQ ID NO: 182700 - RNA, 22 nt, Human
caugaauuuauauuauuaguga

SEQ ID NO: 182701 - RNA, 22 nt, Human
caugaauuuuucuguggguuaa

SEQ ID NO: 182702 - RNA, 22 nt, Human
cucacugcccugaaguuggguu

SEQ ID NO: 182703 - RNA, 22 nt, Human
ucagagauggaguuagcaguga

SEQ ID NO: 182704 - RNA, 22 nt, Human
gcuggggugugguggauaagcu

SEQ ID NO: 182705 - RNA, 22 nt, Human
aaaucuaggccgggugcggugg

SEQ ID NO: 182706 - RNA, 22 nt, Human
gcucugggugaaggguaccauu

SEQ ID NO: 182707 - RNA, 22 nt, Human
ucugugcugucucagagaaagc

SEQ ID NO: 182708 - RNA, 22 nt, Human
ugauaacuuuaauuugaucuga

SEQ ID NO: 182709 - RNA, 22 nt, Human
aaaaaccuuucccauacuaaga

SEQ ID NO: 182710 - RNA, 22 nt, Human
uccacaggcugaggcccuucug

SEQ ID NO: 182711 - RNA, 22 nt, Human
ucuuugcuccacacucuagaga

SEQ ID NO: 182712 - RNA, 22 nt, Human
cucugugguuagacuauggcug

SEQ ID NO: 182713 - RNA, 22 nt, Human
aaccccgcucaggcugggugag

SEQ ID NO: 182714 - RNA, 21 nt, Human
uugcuuauggcacugcuuugc

SEQ ID NO: 182715 - RNA, 22 nt, Human
gcugaaaugucuuuagcagugu

SEQ ID NO: 182716 - RNA, 22 nt, Human
cacaagcuccuuauguggagaa

SEQ ID NO: 182717 - RNA, 22 nt, Human
acuggcugaucaccugccucag

SEQ ID NO: 182718 - RNA, 22 nt, Human
caagaaucuugcagcuuagacu

SEQ ID NO: 182719 - RNA, 22 nt, Human
ucauuuguucaucugcucuucu

SEQ ID NO: 182720 - RNA, 21 nt, Human
ggaagggcucugaggacggcu

SEQ ID NO: 182721 - RNA, 22 nt, Human
uuguccuuggaugaagcuggga

SEQ ID NO: 182722 - RNA, 20 nt, Human
caggcacacucauuccugcu

SEQ ID NO: 182723 - RNA, 22 nt, Human
uuaaagaggcagguuaaauaau

SEQ ID NO: 182724 - RNA, 22 nt, Human
ugcaggugucugggggcaacag

SEQ ID NO: 182725 - RNA, 22 nt, Human
ugagacaguuggugaaaucuaa

SEQ ID NO: 182726 - RNA, 22 nt, Human
caggggcagucugugugcgugg

SEQ ID NO: 182727 - RNA, 22 nt, Human
gagcccagcuguccuuggcaaa

SEQ ID NO: 182728 - RNA, 22 nt, Human
aauaacaggguugauuugcaau

SEQ ID NO: 182729 - RNA, 22 nt, Human
aggaccuggaucacagagaucu

SEQ ID NO: 182730 - RNA, 22 nt, Human
gagacaguguccauccaggggc

SEQ ID NO: 182731 - RNA, 22 nt, Human
ggauguucugggguucucuugu

SEQ ID NO: 182732 - RNA, 22 nt, Human
gggcacagaagucuaagacauc

SEQ ID NO: 182733 - RNA, 21 nt, Human
cccagagccuagggagggcac

SEQ ID NO: 182734 - RNA, 16 nt, Human
aagccaguucagcauu

SEQ ID NO: 182735 - RNA, 22 nt, Human
gaauguuaaugcacuucuagcu

SEQ ID NO: 182736 - RNA, 22 nt, Human
caaggcagugggcuaggaaccu

SEQ ID NO: 182737 - RNA, 20 nt, Human
auacacuugcccagcuugug

SEQ ID NO: 182738 - RNA, 22 nt, Human
caggcccucguggugagcuggg

SEQ ID NO: 182739 - RNA, 22 nt, Human
auuaugcauuccaaccuuauuc

SEQ ID NO: 182740 - RNA, 22 nt, Human
ccccaugaaguagggucucuga

SEQ ID NO: 182741 - RNA, 17 nt, Human
aggcagcucagaacauc

SEQ ID NO: 182742 - RNA, 22 nt, Human
aaaggacacacaggaggugucu

SEQ ID NO: 182743 - RNA, 22 nt, Human
ugaaaucugucccacuuuagcu

SEQ ID NO: 182744 - RNA, 22 nt, Human
agcucagagauaaucaagagac

SEQ ID NO: 182745 - RNA, 23 nt, Human
agccccucauggugucuagacag

SEQ ID NO: 182746 - RNA, 22 nt, Human
augaggcucucaggggagcugu

SEQ ID NO: 182747 - RNA, 22 nt, Human
ugaauacacuaaaaaucacuuu

SEQ ID NO: 182748 - RNA, 22 nt, Human
ugcagggccuugggucuuucuu

SEQ ID NO: 182749 - RNA, 22 nt, Human
auacauacauguacacauaaau

SEQ ID NO: 182750 - RNA, 22 nt, Human
gcauggcagugaggauggugcu

SEQ ID NO: 182751 - RNA, 22 nt, Human
agccuucaaccuagcuagagca

SEQ ID NO: 182752 - RNA, 22 nt, Human
aggaauguaguuugaguagaaa

SEQ ID NO: 182753 - RNA, 22 nt, Human
ugaagccaucaggaagccagca

SEQ ID NO: 182754 - RNA, 22 nt, Human
uacaucucaucugugcucuccg

SEQ ID NO: 182755 - RNA, 22 nt, Human
cccaggcugucuguccuuugcu

SEQ ID NO: 182756 - RNA, 22 nt, Human
aaaacuaaauacgcuuugccuc

SEQ ID NO: 182757 - RNA, 22 nt, Human
ccuccugcggcguccgcgcucu

SEQ ID NO: 182758 - RNA, 22 nt, Human
gcccacaguguagcagguacuc

SEQ ID NO: 182759 - RNA, 22 nt, Human
gaucuagaccagaagcuguugu

SEQ ID NO: 182760 - RNA, 22 nt, Human
ugucauuuucagcuuaugcuuc

SEQ ID NO: 182761 - RNA, 22 nt, Human
uaagccugcaugaaccaugaga

SEQ ID NO: 182762 - RNA, 22 nt, Human
ggcacagagcuuugucccaguu

SEQ ID NO: 182763 - RNA, 22 nt, Human
ggcagguggcacugcugcuccc

SEQ ID NO: 182764 - RNA, 22 nt, Human
gcaaaugaagguggugcuacag

SEQ ID NO: 182765 - RNA, 21 nt, Human
uggcagguucaaaggccuauc

SEQ ID NO: 182766 - RNA, 22 nt, Human
cucagaagaacaaaggcucuac

SEQ ID NO: 182767 - RNA, 22 nt, Human
ugcagcagguauggcaagcucc

SEQ ID NO: 182768 - RNA, 22 nt, Human
uugcagcugaggaaauugaagc

SEQ ID NO: 182769 - RNA, 22 nt, Human
aggcagccugguuugaauggaa

SEQ ID NO: 182770 - RNA, 22 nt, Human
cuccugggcugggaacucagcc

SEQ ID NO: 182771 - RNA, 22 nt, Human
ggcagagcgcaugcgucgcaga

SEQ ID NO: 182772 - RNA, 22 nt, Human
gcugccuccugagauuugggca

SEQ ID NO: 182773 - RNA, 22 nt, Human
uucauugauaguuuuauguaug

SEQ ID NO: 182774 - RNA, 22 nt, Human
uaugugucaaaccauucaucug

SEQ ID NO: 182775 - RNA, 22 nt, Human
agcuucuccaucugcccagaga

SEQ ID NO: 182776 - RNA, 22 nt, Human
ugaggcucuccaagcagaugag

SEQ ID NO: 182777 - RNA, 18 nt, Human
uacuuuauucccccucca

SEQ ID NO: 182778 - RNA, 22 nt, Human
ccugggagugucagacuugcuu

SEQ ID NO: 182779 - RNA, 22 nt, Human
caccaggcacauaguaggcacu

SEQ ID NO: 182780 - RNA, 22 nt, Human
uaucaguagauaaacggauugc

SEQ ID NO: 182781 - RNA, 22 nt, Human
uuuacagauguggaaagugagc

SEQ ID NO: 182782 - RNA, 21 nt, Human
uucucagaucgaguagugaga

SEQ ID NO: 182783 - RNA, 22 nt, Human
ggagaagaggagcuggaagccu

SEQ ID NO: 182784 - RNA, 22 nt, Human
uucugggccuccuaggacaggc

SEQ ID NO: 182785 - RNA, 22 nt, Human
ugacauuuaucuucuacaauga

SEQ ID NO: 182786 - RNA, 22 nt, Human
uuuaccacagaaaaaaguaacu

SEQ ID NO: 182787 - RNA, 22 nt, Human
gaaaaugagccucagcuacauu

SEQ ID NO: 182788 - RNA, 22 nt, Human
gcagcucuucacuuacuccuuu

SEQ ID NO: 182789 - RNA, 22 nt, Human
augaagaaacuguucugggugg

SEQ ID NO: 182790 - RNA, 22 nt, Human
ucauuuguggaagugauugugg

SEQ ID NO: 182791 - RNA, 22 nt, Human
ugggggugguucuugccuccag

SEQ ID NO: 182792 - RNA, 22 nt, Human
aggaaacauugauauugggaaa

SEQ ID NO: 182793 - RNA, 22 nt, Human
ucagaacauggcauguuccauc

SEQ ID NO: 182794 - RNA, 22 nt, Human
cuucucagcuuagguaugguuu

SEQ ID NO: 182795 - RNA, 22 nt, Human
uaggcuccaagagcgaacucag

SEQ ID NO: 182796 - RNA, 22 nt, Human
acaguuauuuucccagcauuua

SEQ ID NO: 182797 - RNA, 20 nt, Human
cuuaaacacagagauagauu

SEQ ID NO: 182798 - RNA, 22 nt, Human
uuuaauauucugcauucuccuu

SEQ ID NO: 182799 - RNA, 22 nt, Human
agaggccaugcuagaggccugg

SEQ ID NO: 182800 - RNA, 22 nt, Human
uugguauuuccucaggcauguc

SEQ ID NO: 182801 - RNA, 22 nt, Human
ucucagaggcccgacguucucc

SEQ ID NO: 182802 - RNA, 22 nt, Human
uugccucauuuucuggugaaau

SEQ ID NO: 182803 - RNA, 22 nt, Human
uggggacauagccagucuggcu

SEQ ID NO: 182804 - RNA, 23 nt, Human
cugaggggaaaagggcuucaggc

SEQ ID NO: 182805 - RNA, 21 nt, Human
uaaaacuguaacuuuguccug

SEQ ID NO: 182806 - RNA, 22 nt, Human
auacagguucucuagggaacag

SEQ ID NO: 182807 - RNA, 22 nt, Human
ucugaaauauauuuugaguguu

SEQ ID NO: 182808 - RNA, 22 nt, Human
ggaaucuagaaagggagcaagg

SEQ ID NO: 182809 - RNA, 19 nt, Human
gcuguucugaccaucaccc

SEQ ID NO: 182810 - RNA, 22 nt, Human
cuccugggagucuuccuggaug

SEQ ID NO: 182811 - RNA, 22 nt, Human
cuuuguuuauauuucuccucga

SEQ ID NO: 182812 - RNA, 22 nt, Human
aaggcugaaagaccuugaaccu

SEQ ID NO: 182813 - RNA, 22 nt, Human
uguaaagaaagacgcagaguua

SEQ ID NO: 182814 - RNA, 17 nt, Human
gagugcugguggagcuc

SEQ ID NO: 182815 - RNA, 22 nt, Human
ccuccagcauuacuggcccaug

SEQ ID NO: 182816 - RNA, 22 nt, Human
ugcuuauuuagguagauauuaa

SEQ ID NO: 182817 - RNA, 22 nt, Human
gggcucugcgcucagcuccagc

SEQ ID NO: 182818 - RNA, 22 nt, Human
aguuuacaucuucaaucucauu

SEQ ID NO: 182819 - RNA, 22 nt, Human
ggccuuggauccaagcugcggc

SEQ ID NO: 182820 - RNA, 22 nt, Human
uccugaagucacaggcucugag

SEQ ID NO: 182821 - RNA, 22 nt, Human
ccauuuguuuucgcuaccaugg

SEQ ID NO: 182822 - RNA, 22 nt, Human
cagcugugaauugucuuaucua

SEQ ID NO: 182823 - RNA, 23 nt, Human
aggugccaacugagagcugagag

SEQ ID NO: 182824 - RNA, 22 nt, Human
uauuaauaaauauguaggggcc

SEQ ID NO: 182825 - RNA, 22 nt, Human
cucugggucuauaaugcagcug

SEQ ID NO: 182826 - RNA, 17 nt, Human
uuccaaggagcauuuga

SEQ ID NO: 182827 - RNA, 22 nt, Human
cacuaaaacuacauuggaaaca

SEQ ID NO: 182828 - RNA, 18 nt, Human
ugggcugccuggccucug

SEQ ID NO: 182829 - RNA, 22 nt, Human
guauuuuacuuacgcaugacuu

SEQ ID NO: 182830 - RNA, 19 nt, Human
cacagugcagccauuucuc

SEQ ID NO: 182831 - RNA, 22 nt, Human
auacaucuugucagauucaugu

SEQ ID NO: 182832 - RNA, 22 nt, Human
gaauugcuaaccaauucaaaau

SEQ ID NO: 182833 - RNA, 22 nt, Human
cuggagagaauguggaaugauu

SEQ ID NO: 182834 - RNA, 22 nt, Human
cugugugagcaucacuucagau

SEQ ID NO: 182835 - RNA, 21 nt, Human
ugaagggguggcagugugcuu

SEQ ID NO: 182836 - RNA, 22 nt, Human
ucuaggaaagccuuucacaacu

SEQ ID NO: 182837 - RNA, 22 nt, Human
agcugccauggccugaauuuac

SEQ ID NO: 182838 - RNA, 22 nt, Human
uccaggccauugacugcauccu

SEQ ID NO: 182839 - RNA, 22 nt, Human
gaaauuuauuaucuacaucauu

SEQ ID NO: 182840 - RNA, 22 nt, Human
gaagaaggugccagaggcuuac

SEQ ID NO: 182841 - RNA, 22 nt, Human
aaagccaagcugggaaggcagg

SEQ ID NO: 182842 - RNA, 22 nt, Human
ccagguggcccugcccuacucu

SEQ ID NO: 182843 - RNA, 22 nt, Human
ccccaggacacauggaccaagu

SEQ ID NO: 182844 - RNA, 19 nt, Human
gugcuccagggcaaggagu

SEQ ID NO: 182845 - RNA, 22 nt, Human
auaugaaaguaagcaugugugu

SEQ ID NO: 182846 - RNA, 22 nt, Human
ugggaccugcucuuggaaugag

SEQ ID NO: 182847 - RNA, 22 nt, Human
gccuuggacuaccacucccaca

SEQ ID NO: 182848 - RNA, 22 nt, Human
auucagacuaugaacacgucag

SEQ ID NO: 182849 - RNA, 22 nt, Human
aaguuuuaacaaguacuuacua

SEQ ID NO: 182850 - RNA, 23 nt, Human
ccugccuguucuaacuccauuuc

SEQ ID NO: 182851 - RNA, 22 nt, Human
ccugggcuuugcuggcaaggcc

SEQ ID NO: 182852 - RNA, 22 nt, Human
ugggguccagugccuggcaagg

SEQ ID NO: 182853 - RNA, 22 nt, Human
aaguccaguuuuuccagguggu

SEQ ID NO: 182854 - RNA, 22 nt, Human
cagaggcuaagaguguccaaag

SEQ ID NO: 182855 - RNA, 22 nt, Human
aguccagaccccggcagcuggu

SEQ ID NO: 182856 - RNA, 22 nt, Human
agcugcccccagggcugugcuu

SEQ ID NO: 182857 - RNA, 22 nt, Human
agagaaaacucauugagguguc

SEQ ID NO: 182858 - RNA, 22 nt, Human
uacauuccauguguguguauuc

SEQ ID NO: 182859 - RNA, 22 nt, Human
uuuuggcuccagugguuugugc

SEQ ID NO: 182860 - RNA, 22 nt, Human
aaucuaaggacuuagcauugcu

SEQ ID NO: 182861 - RNA, 22 nt, Human
agagauggauguuauuaugggu

SEQ ID NO: 182862 - RNA, 22 nt, Human
gucugcuguagguaggacagca

SEQ ID NO: 182863 - RNA, 22 nt, Human
gcauucuuguuuuuccuacccu

SEQ ID NO: 182864 - RNA, 22 nt, Human
cacagugugacugaccuucagc

SEQ ID NO: 182865 - RNA, 22 nt, Human
uuccaggauggagacacuagua

SEQ ID NO: 182866 - RNA, 22 nt, Human
uuucucauagucaugccucuua

SEQ ID NO: 182867 - RNA, 22 nt, Human
ggaggggcugagcaacuuucag

SEQ ID NO: 182868 - RNA, 22 nt, Human
ccuggcucuagaggccacuccu

SEQ ID NO: 182869 - RNA, 22 nt, Human
gugauacagguguucuggauau

SEQ ID NO: 182870 - RNA, 22 nt, Human
gggagggccagugcucucuaga

SEQ ID NO: 182871 - RNA, 22 nt, Human
caugccauuuuucuagauugag

SEQ ID NO: 182872 - RNA, 22 nt, Human
gucagaagcauuuguggcugaa

SEQ ID NO: 182873 - RNA, 22 nt, Human
ggcccuuccucuugugcuggca

SEQ ID NO: 182874 - RNA, 22 nt, Human
ccacaagugaaguacaccugcc

SEQ ID NO: 182875 - RNA, 22 nt, Human
uagaugaaaggucuagcacagu

SEQ ID NO: 182876 - RNA, 22 nt, Human
gccuggagggucccucucugga

SEQ ID NO: 182877 - RNA, 22 nt, Human
gagucucugcuauguuuucucu

SEQ ID NO: 182878 - RNA, 23 nt, Human
agucaagaugcaucugugaggaa

SEQ ID NO: 182879 - RNA, 22 nt, Human
cuccccaagccuuggcuucucc

SEQ ID NO: 182880 - RNA, 19 nt, Human
agcaggcagguggcccagg

SEQ ID NO: 182881 - RNA, 22 nt, Human
gagucaggcuagaggugagucu

SEQ ID NO: 182882 - RNA, 22 nt, Human
ugcugagcgcauccggcggccg

SEQ ID NO: 182883 - RNA, 22 nt, Human
uuuacuugauauggagcugagg

SEQ ID NO: 182884 - RNA, 22 nt, Human
uugagucuccucagcagggcua

SEQ ID NO: 182885 - RNA, 22 nt, Human
ugucgggcaugcauucugagaa

SEQ ID NO: 182886 - RNA, 22 nt, Human
uuuacaaguuuacagaaugaug

SEQ ID NO: 182887 - RNA, 22 nt, Human
ugaacagauggcccagcagagg

SEQ ID NO: 182888 - RNA, 22 nt, Human
acaacaguuuagguauuuguag

SEQ ID NO: 182889 - RNA, 22 nt, Human
agagucaguuagcgaauacuua

SEQ ID NO: 182890 - RNA, 22 nt, Human
cccaggcugggaacgauucuag

SEQ ID NO: 182891 - RNA, 22 nt, Human
gcucuggcuaguuaccucuuac

SEQ ID NO: 182892 - RNA, 20 nt, Human
gcagccucaacaggcacagc

SEQ ID NO: 182893 - RNA, 23 nt, Human
uuguauuuuuaguagagacaggg

SEQ ID NO: 182894 - RNA, 22 nt, Human
ugaaguuuaauuuuggacauga

SEQ ID NO: 182895 - RNA, 22 nt, Human
cuguaacuuaaugagaggcaga

SEQ ID NO: 182896 - RNA, 22 nt, Human
ugaucuuuacugcuguuuauaa

SEQ ID NO: 182897 - RNA, 22 nt, Human
ucagucuucccuccagugcaac

SEQ ID NO: 182898 - RNA, 22 nt, Human
uuucacagauguuuuggagucu

SEQ ID NO: 182899 - RNA, 22 nt, Human
agcccuugguauuuuccgaucc

SEQ ID NO: 182900 - RNA, 22 nt, Human
aucugauucauugaaaugggug

SEQ ID NO: 182901 - RNA, 22 nt, Human
gcaggcugaaacucggggucua

SEQ ID NO: 182902 - RNA, 22 nt, Human
gagcugaagcgcuacagcaucc

SEQ ID NO: 182903 - RNA, 22 nt, Human
uucugaaaacacacuuugcagc

SEQ ID NO: 182904 - RNA, 22 nt, Human
augcacaaacccacaauuaguc

SEQ ID NO: 182905 - RNA, 22 nt, Human
agcaggugcguuacuucacucu

SEQ ID NO: 182906 - RNA, 22 nt, Human
aucagcaagcaugguuaggugu

SEQ ID NO: 182907 - RNA, 22 nt, Human
acuuuguuccuuucacaaagaa

SEQ ID NO: 182908 - RNA, 22 nt, Human
acacuucucccaucuccuguug

SEQ ID NO: 182909 - RNA, 22 nt, Human
ugccaggguccugagggccuug

SEQ ID NO: 182910 - RNA, 22 nt, Human
acagccugauuuauggagcagu

SEQ ID NO: 182911 - RNA, 22 nt, Human
agcagggcuuuggcuggcuuuc

SEQ ID NO: 182912 - RNA, 22 nt, Human
agagauggagagcacuggggcu

SEQ ID NO: 182913 - RNA, 22 nt, Human
uucacuguccugcaacucuaga

SEQ ID NO: 182914 - RNA, 22 nt, Human
ugggagaggcugccaucuugca

SEQ ID NO: 182915 - RNA, 22 nt, Human
ccuggccagaggcgugccugug

SEQ ID NO: 182916 - RNA, 22 nt, Human
uccaggagguagugcuuaauuu

SEQ ID NO: 182917 - RNA, 22 nt, Human
gcugugcagccaagugccucug

SEQ ID NO: 182918 - RNA, 22 nt, Human
agacucuaacucaugccauugc

SEQ ID NO: 182919 - RNA, 22 nt, Human
ucuccuugugcuggguccuucc

SEQ ID NO: 182920 - RNA, 22 nt, Human
ggcgccagcacugcagcgccuc

SEQ ID NO: 182921 - RNA, 22 nt, Human
auguuuacaauucaguauuaca

SEQ ID NO: 182922 - RNA, 22 nt, Human
ccuggccaaucuagggcuguua

SEQ ID NO: 182923 - RNA, 22 nt, Human
ugggaccugcuccuggaaugag

SEQ ID NO: 182924 - RNA, 22 nt, Human
uaucuagauaccaagaagcaca

SEQ ID NO: 182925 - RNA, 22 nt, Human
gcaagcaauggacggugacuuu

SEQ ID NO: 182926 - RNA, 22 nt, Human
ccagagccucaacacagguccu

SEQ ID NO: 182927 - RNA, 22 nt, Human
ggcuggcagugugagagaggga

SEQ ID NO: 182928 - RNA, 23 nt, Human
ucucccugagguuguuagcauua

SEQ ID NO: 182929 - RNA, 22 nt, Human
aaacucuaagacacuguacaau

SEQ ID NO: 182930 - RNA, 22 nt, Human
caggcuugggagcagagccacu

SEQ ID NO: 182931 - RNA, 22 nt, Human
aaguaaaacacacaguccaccg

SEQ ID NO: 182932 - RNA, 22 nt, Human
aaagaugugccuguuucauagu

SEQ ID NO: 182933 - RNA, 18 nt, Human
ugcuggguaacuguaugg

SEQ ID NO: 182934 - RNA, 22 nt, Human
aagcauuuggcaugaaacucuu

SEQ ID NO: 182935 - RNA, 23 nt, Human
ucagaacaguucuuggugcauag

SEQ ID NO: 182936 - RNA, 22 nt, Human
uugucaagaaaaauggaugaag

SEQ ID NO: 182937 - RNA, 22 nt, Human
gcccucuggcacagagaugcag

SEQ ID NO: 182938 - RNA, 22 nt, Human
cuagaaucuaugucaggaacuc

SEQ ID NO: 182939 - RNA, 22 nt, Human
cuggcugcagcuccgaggaaga

SEQ ID NO: 182940 - RNA, 21 nt, Human
ugacauaauccauaguacaaa

SEQ ID NO: 182941 - RNA, 22 nt, Human
gccuggagggauagaaugcaag

SEQ ID NO: 182942 - RNA, 20 nt, Human
uuuauucagccuacccucuu

SEQ ID NO: 182943 - RNA, 22 nt, Human
ggugaggguaaacuaaaacauc

SEQ ID NO: 182944 - RNA, 22 nt, Human
aggcaagccgugccugucucaa

SEQ ID NO: 182945 - RNA, 18 nt, Human
cuggcauucuucccugga

SEQ ID NO: 182946 - RNA, 22 nt, Human
auuuccaggcuguuuugugaau

SEQ ID NO: 182947 - RNA, 22 nt, Human
aaacucuuuugcauauuagagg

SEQ ID NO: 182948 - RNA, 22 nt, Human
gcuguaggucauuuaaucaccu

SEQ ID NO: 182949 - RNA, 22 nt, Human
uccaggcaugguguaauuuugc

SEQ ID NO: 182950 - RNA, 22 nt, Human
aacaugagugauaaaauuaccu

SEQ ID NO: 182951 - RNA, 22 nt, Human
uacacaggguauggcuugagga

SEQ ID NO: 182952 - RNA, 22 nt, Human
ggcugccugugcccaggcacac

SEQ ID NO: 182953 - RNA, 22 nt, Human
gugcacagaagcagaagcuaga

SEQ ID NO: 182954 - RNA, 22 nt, Human
ugugcagcucuagagccaagcc

SEQ ID NO: 182955 - RNA, 22 nt, Human
ggacuggccggcgcugaggccc

SEQ ID NO: 182956 - RNA, 22 nt, Human
uuuagaacagauauuguaacuu

SEQ ID NO: 182957 - RNA, 22 nt, Human
ucucugggcucaggagcccggc

SEQ ID NO: 182958 - RNA, 22 nt, Human
guucuuuugguagagugugcau

SEQ ID NO: 182959 - RNA, 21 nt, Human
cuuuuacauucagucaugaug

SEQ ID NO: 182960 - RNA, 22 nt, Human
ugggccaggggccucuucugau

SEQ ID NO: 182961 - RNA, 22 nt, Human
uugaaaguuaucuagauucuga

SEQ ID NO: 182962 - RNA, 22 nt, Human
acaccauacucauguugguucc

SEQ ID NO: 182963 - RNA, 22 nt, Human
agcuguugucugcaggagaagc

SEQ ID NO: 182964 - RNA, 23 nt, Human
agaggccaacuucuugccccucc

SEQ ID NO: 182965 - RNA, 22 nt, Human
gggcagcucugcccaucagagg

SEQ ID NO: 182966 - RNA, 22 nt, Human
gacuggccuggggcugggcaca

SEQ ID NO: 182967 - RNA, 22 nt, Human
gggcuuggguauugugagaggu

SEQ ID NO: 182968 - RNA, 22 nt, Human
gugcaaaagcaguuggauuuuu

SEQ ID NO: 182969 - RNA, 22 nt, Human
cagcccuguugcgcuuccggcg

SEQ ID NO: 182970 - RNA, 22 nt, Human
gcugcaggcucugcaggaauug

SEQ ID NO: 182971 - RNA, 21 nt, Human
cacauuugaaccucacagcaa

SEQ ID NO: 182972 - RNA, 22 nt, Human
gcuccugcagagauguuccaug

SEQ ID NO: 182973 - RNA, 23 nt, Human
agaugaggcuucuccauguuggu

SEQ ID NO: 182974 - RNA, 22 nt, Human
ugggcaaacugucaaccauguc

SEQ ID NO: 182975 - RNA, 22 nt, Human
guuccucaguuguaaaaaaugu

SEQ ID NO: 182976 - RNA, 22 nt, Human
gaccucagugaauggucaugua

SEQ ID NO: 182977 - RNA, 22 nt, Human
cuggagcugguauagggacaaa

SEQ ID NO: 182978 - RNA, 23 nt, Human
agcaguuagggauacaaguuauc

SEQ ID NO: 182979 - RNA, 22 nt, Human
aggaagagguagcugucaaggg

SEQ ID NO: 182980 - RNA, 18 nt, Human
ggcagggaaaagauaggg

SEQ ID NO: 182981 - RNA, 22 nt, Human
uuggcccagacucggggacuga

SEQ ID NO: 182982 - RNA, 20 nt, Human
acugugugaucuggaaagcu

SEQ ID NO: 182983 - RNA, 22 nt, Human
agaaguuugguccuauaaacuc

SEQ ID NO: 182984 - RNA, 22 nt, Human
cguccuuugaauugaggucuuu

SEQ ID NO: 182985 - RNA, 22 nt, Human
uggcucagugcauucacaguaa

SEQ ID NO: 182986 - RNA, 22 nt, Human
cacagagaauucccauauguga

SEQ ID NO: 182987 - RNA, 22 nt, Human
cucucuccuuagcugcagacca

SEQ ID NO: 182988 - RNA, 22 nt, Human
acaaacuucccagacaagcucc

SEQ ID NO: 182989 - RNA, 22 nt, Human
aagggcugagcacagugagcca

SEQ ID NO: 182990 - RNA, 22 nt, Human
aacaguaacgagauguccuaac

SEQ ID NO: 182991 - RNA, 22 nt, Human
cucuuccuuaagacuauaaaga

SEQ ID NO: 182992 - RNA, 22 nt, Human
ugggcagcauccuccacaguca

SEQ ID NO: 182993 - RNA, 22 nt, Human
guagggacccacagucuauauu

SEQ ID NO: 182994 - RNA, 22 nt, Human
ucucuagagcaugugcugggca

SEQ ID NO: 182995 - RNA, 22 nt, Human
uguucuuuggcuuccuuuccgu

SEQ ID NO: 182996 - RNA, 22 nt, Human
caggacuggaagucucaagaga

SEQ ID NO: 182997 - RNA, 22 nt, Human
gcauuuuagaauauuggagcaa

SEQ ID NO: 182998 - RNA, 22 nt, Human
gacagcagaauccauucccagu

SEQ ID NO: 182999 - RNA, 22 nt, Human
uaaagcacauaucuuacaauaa

SEQ ID NO: 183000 - RNA, 22 nt, Human
uucuucaaauagcagggaguca

SEQ ID NO: 183001 - RNA, 22 nt, Human
accaugacgucacagaggcuuc

SEQ ID NO: 183002 - RNA, 22 nt, Human
auccuggcgccacacggcucua

SEQ ID NO: 183003 - RNA, 22 nt, Human
agccuccaucccaugcacaaag

SEQ ID NO: 183004 - RNA, 22 nt, Human
ucacaguaucacacaaggauua

SEQ ID NO: 183005 - RNA, 22 nt, Human
ggcuuccuggagaaggucugag

SEQ ID NO: 183006 - RNA, 21 nt, Human
uucuaaguguuaccuuuucuu

SEQ ID NO: 183007 - RNA, 22 nt, Human
aaggcuuuugacgguugccucu

SEQ ID NO: 183008 - RNA, 22 nt, Human
uaacuacaagggcggucucugu

SEQ ID NO: 183009 - RNA, 22 nt, Human
ucugaggguuacuuuauuaggc

SEQ ID NO: 183010 - RNA, 22 nt, Human
acagugucugacacauuguagc

SEQ ID NO: 183011 - RNA, 22 nt, Human
uugcuuuaucucuuaugccuca

SEQ ID NO: 183012 - RNA, 22 nt, Human
ugucugugaccucuuaggcaag

SEQ ID NO: 183013 - RNA, 22 nt, Human
ugggagagcagagaacccucuu

SEQ ID NO: 183014 - RNA, 22 nt, Human
gcuaggaguggugggucaagga

SEQ ID NO: 183015 - RNA, 22 nt, Human
cuccugcaagccuccccaagca

SEQ ID NO: 183016 - RNA, 23 nt, Human
uuucaacaaugcuuagagaaaac

SEQ ID NO: 183017 - RNA, 22 nt, Human
ccauagaugagacaaaguagag

SEQ ID NO: 183018 - RNA, 22 nt, Human
agacagacacaugguaacagau

SEQ ID NO: 183019 - RNA, 22 nt, Human
auuuuguuauaggagcugaaau

SEQ ID NO: 183020 - RNA, 22 nt, Human
uacacguguguguauguacaua

SEQ ID NO: 183021 - RNA, 20 nt, Human
cucagcagauucuucuagaa

SEQ ID NO: 183022 - RNA, 22 nt, Human
agcagagcugggauccuggguc

SEQ ID NO: 183023 - RNA, 22 nt, Human
aggcucagagaugaguaagcac

SEQ ID NO: 183024 - RNA, 22 nt, Human
uggaaacugcaguucccgggga

SEQ ID NO: 183025 - RNA, 22 nt, Human
ucauuuaauagcuuuugucuuu

SEQ ID NO: 183026 - RNA, 22 nt, Human
cugcugagagccacguggcaca

SEQ ID NO: 183027 - RNA, 22 nt, Human
aagcacagagaugggcacgccu

SEQ ID NO: 183028 - RNA, 22 nt, Human
uggcaaagauuaccacaucuac

SEQ ID NO: 183029 - RNA, 22 nt, Human
agucucagaaaagaagcaugga

SEQ ID NO: 183030 - RNA, 22 nt, Human
aagugugauuuguagaaugccu

SEQ ID NO: 183031 - RNA, 22 nt, Human
cagcauauuacuuuaaaaaauc

SEQ ID NO: 183032 - RNA, 22 nt, Human
ucucaggcauucccacauagaa

SEQ ID NO: 183033 - RNA, 20 nt, Human
uuucuugucggcuguugcug

SEQ ID NO: 183034 - RNA, 22 nt, Human
cugcucaguaauaguccuaucu

SEQ ID NO: 183035 - RNA, 22 nt, Human
ugacuucucuggccuggugcag

SEQ ID NO: 183036 - RNA, 22 nt, Human
ucccaggugaugcugaggccac

SEQ ID NO: 183037 - RNA, 22 nt, Human
caugcuucacacacugaaugac

SEQ ID NO: 183038 - RNA, 22 nt, Human
cuguccucaccuuggcaggggg

SEQ ID NO: 183039 - RNA, 22 nt, Human
agagucugaggcagcugcagcc

SEQ ID NO: 183040 - RNA, 22 nt, Human
augcaccugaacuccaucagcu

SEQ ID NO: 183041 - RNA, 22 nt, Human
uaccuguuuuaaagcuaaaagg

SEQ ID NO: 183042 - RNA, 22 nt, Human
gacaguuuuuaauccuuucaug

SEQ ID NO: 183043 - RNA, 22 nt, Human
gcccaggaguugaagggcugac

SEQ ID NO: 183044 - RNA, 22 nt, Human
aaaaugaggaacggaucauggc

SEQ ID NO: 183045 - RNA, 22 nt, Human
agagucaguaacauauauggua

SEQ ID NO: 183046 - RNA, 22 nt, Human
acaggccugggguacaaguucu

SEQ ID NO: 183047 - RNA, 22 nt, Human
ccagcuuuuccucucauugcuu

SEQ ID NO: 183048 - RNA, 22 nt, Human
auuagauuguaaauguuuucac

SEQ ID NO: 183049 - RNA, 22 nt, Human
caguuacacaccauugugaaca

SEQ ID NO: 183050 - RNA, 22 nt, Human
aagggcagagggaaucccacau

SEQ ID NO: 183051 - RNA, 22 nt, Human
agcuucuguucaucuuccaggc

SEQ ID NO: 183052 - RNA, 22 nt, Human
gggugcaggggacccuagggac

SEQ ID NO: 183053 - RNA, 22 nt, Human
gcagaaccugaauugaacauug

SEQ ID NO: 183054 - RNA, 22 nt, Human
uauuccaagugccuagaagagu

SEQ ID NO: 183055 - RNA, 23 nt, Human
ugugacagggucauugaaaaggg

SEQ ID NO: 183056 - RNA, 22 nt, Human
agcucagcacugucagcacucc

SEQ ID NO: 183057 - RNA, 22 nt, Human
uguugcaguaaaaauggagagg

SEQ ID NO: 183058 - RNA, 22 nt, Human
aucaucuugcuuucuguuuacu

SEQ ID NO: 183059 - RNA, 22 nt, Human
ugcauuggucauuuagaaaaua

SEQ ID NO: 183060 - RNA, 22 nt, Human
gaggagcuggcagcgucuccgc

SEQ ID NO: 183061 - RNA, 22 nt, Human
ugguuuuugguuuaacacuaug

SEQ ID NO: 183062 - RNA, 22 nt, Human
cucuggaguucucaugaggaac

SEQ ID NO: 183063 - RNA, 22 nt, Human
cagagugaaauaggggaucaag

SEQ ID NO: 183064 - RNA, 22 nt, Human
gcuguggcuugcagcuggggcu

SEQ ID NO: 183065 - RNA, 23 nt, Human
aaagacugcugagaauuuuagga

SEQ ID NO: 183066 - RNA, 22 nt, Human
gaaggaggcguuagcccuagga

SEQ ID NO: 183067 - RNA, 22 nt, Human
ggccuugacaguuaagagaccu

SEQ ID NO: 183068 - RNA, 19 nt, Human
uuagaagccauagguacag

SEQ ID NO: 183069 - RNA, 22 nt, Human
augaaaagggagugauauuugu

SEQ ID NO: 183070 - RNA, 22 nt, Human
uauccauuuauuuucuaggcaa

SEQ ID NO: 183071 - RNA, 19 nt, Human
acuggcagggcugcggugg

SEQ ID NO: 183072 - RNA, 22 nt, Human
cucccugggccucaguuucucu

SEQ ID NO: 183073 - RNA, 22 nt, Human
ggugcagggagaggcaggcccc

SEQ ID NO: 183074 - RNA, 22 nt, Human
gaggcucccuuuagguccagau

SEQ ID NO: 183075 - RNA, 22 nt, Human
uccauggguagcccugguugag

SEQ ID NO: 183076 - RNA, 22 nt, Human
uuuuuuaucuaugguaguacca

SEQ ID NO: 183077 - RNA, 22 nt, Human
aggucugaguauggccugagaa

SEQ ID NO: 183078 - RNA, 22 nt, Human
auuccaguuaguggcagcuuau

SEQ ID NO: 183079 - RNA, 22 nt, Human
uuccagaagauggcagcaaagg

SEQ ID NO: 183080 - RNA, 22 nt, Human
gccagcccauuaaccccugucc

SEQ ID NO: 183081 - RNA, 22 nt, Human
aggcaguuggucauugcucuuu

SEQ ID NO: 183082 - RNA, 22 nt, Human
cagagccucucagccccuuggg

SEQ ID NO: 183083 - RNA, 22 nt, Human
ccagcagagucuaggaaggagg

SEQ ID NO: 183084 - RNA, 22 nt, Human
aacauuguuuugcacaacucuu

SEQ ID NO: 183085 - RNA, 22 nt, Human
cugggcacagacccccugggcc

SEQ ID NO: 183086 - RNA, 22 nt, Human
gcaugcugcugaggcuggaaua

SEQ ID NO: 183087 - RNA, 22 nt, Human
uugcaaaaaccacaauuacuuu

SEQ ID NO: 183088 - RNA, 22 nt, Human
ccagcccuugcugaaggguggc

SEQ ID NO: 183089 - RNA, 22 nt, Human
cccugaggauagggcaggaccc

SEQ ID NO: 183090 - RNA, 22 nt, Human
uguccucaggaccuggcacagu

SEQ ID NO: 183091 - RNA, 22 nt, Human
ucaggugggaccugcuaggaca

SEQ ID NO: 183092 - RNA, 22 nt, Human
uugaggaggaacugugaggcaa

SEQ ID NO: 183093 - RNA, 22 nt, Human
ggacagacaaaaauaguaagca

SEQ ID NO: 183094 - RNA, 22 nt, Human
cguagguggcucagcaccuggg

SEQ ID NO: 183095 - RNA, 22 nt, Human
acagucuuucuacauucugugc

SEQ ID NO: 183096 - RNA, 22 nt, Human
ccagguggugccucuguucgca

SEQ ID NO: 183097 - RNA, 22 nt, Human
aaagaacuaccuguaugauauu

SEQ ID NO: 183098 - RNA, 22 nt, Human
ucugacaggucauuuucuauag

SEQ ID NO: 183099 - RNA, 22 nt, Human
acaacaaaaucacuagucuucc

SEQ ID NO: 183100 - RNA, 22 nt, Human
ggcacaauugcagcaauaaaca

SEQ ID NO: 183101 - RNA, 22 nt, Human
ccucugcugcuguugagcaccg

SEQ ID NO: 183102 - RNA, 22 nt, Human
guauucauuuauuuacucaucc

SEQ ID NO: 183103 - RNA, 22 nt, Human
guccugugaccugcauccugag

SEQ ID NO: 183104 - RNA, 22 nt, Human
agaugguucagaauuauaaaga

SEQ ID NO: 183105 - RNA, 22 nt, Human
cagcacauaaucagugauugug

SEQ ID NO: 183106 - RNA, 22 nt, Human
agcacagggacaaugccaggug

SEQ ID NO: 183107 - RNA, 22 nt, Human
gcuguccagagcaugggagcaa

SEQ ID NO: 183108 - RNA, 22 nt, Human
aucauucuaguccuuauggucu

SEQ ID NO: 183109 - RNA, 22 nt, Human
gaugaguucuuucuauucuauu

SEQ ID NO: 183110 - RNA, 22 nt, Human
gccauauauauuuugcacuagg

SEQ ID NO: 183111 - RNA, 22 nt, Human
auugcuaggaacagguugcacc

SEQ ID NO: 183112 - RNA, 22 nt, Human
acagugucaugucguguucccc

SEQ ID NO: 183113 - RNA, 22 nt, Human
cagagccagaacuagaccuugu

SEQ ID NO: 183114 - RNA, 22 nt, Human
auucucagaucuuagaggaaua

SEQ ID NO: 183115 - RNA, 22 nt, Human
uucauguuuguaggacugaggc

SEQ ID NO: 183116 - RNA, 22 nt, Human
agcaucagccucuguccuggag

SEQ ID NO: 183117 - RNA, 15 nt, Human
augaggcauuugggg

SEQ ID NO: 183118 - RNA, 22 nt, Human
acaguguggugauggcacuugc

SEQ ID NO: 183119 - RNA, 17 nt, Human
gggcagggacuccuggg

SEQ ID NO: 183120 - RNA, 22 nt, Human
uggaagaaaauucaaucgaguu

SEQ ID NO: 183121 - RNA, 22 nt, Human
guuauuuucauuggcucagacu

SEQ ID NO: 183122 - RNA, 22 nt, Human
uaacagagguagaauucaaggu

SEQ ID NO: 183123 - RNA, 22 nt, Human
gcugccugggcaggaggcgcug

SEQ ID NO: 183124 - RNA, 22 nt, Human
agagaucucugaagcugcugcu

SEQ ID NO: 183125 - RNA, 22 nt, Human
acuuaaaaagaaucuuuucacg

SEQ ID NO: 183126 - RNA, 22 nt, Human
ucuuggaggagaguaaguaccu

SEQ ID NO: 183127 - RNA, 22 nt, Human
caugagauaauuuuucuccagu

SEQ ID NO: 183128 - RNA, 22 nt, Human
gccaggagugucccacucauuu

SEQ ID NO: 183129 - RNA, 22 nt, Human
ugucuauuaauuccacauaaaa

SEQ ID NO: 183130 - RNA, 22 nt, Human
uccuggacucaggaccacagga

SEQ ID NO: 183131 - RNA, 22 nt, Human
uucagagcuuagaauggacuac

SEQ ID NO: 183132 - RNA, 22 nt, Human
acuacauuuccugaccccugug

SEQ ID NO: 183133 - RNA, 22 nt, Human
gcaugguggccuuaggguagcc

SEQ ID NO: 183134 - RNA, 22 nt, Human
uuaaguaacuuguccaaaugag

SEQ ID NO: 183135 - RNA, 22 nt, Human
uagggcucagaguccaguuucu

SEQ ID NO: 183136 - RNA, 22 nt, Human
auuuuccuagucaugugcuucu

SEQ ID NO: 183137 - RNA, 22 nt, Human
ccagaagucaggaaugagucuu

SEQ ID NO: 183138 - RNA, 22 nt, Human
gggaucuguguugcgauggauu

SEQ ID NO: 183139 - RNA, 22 nt, Human
cagauaugcugagacuccugug

SEQ ID NO: 183140 - RNA, 22 nt, Human
aagcagagguagggugugcagu

SEQ ID NO: 183141 - RNA, 22 nt, Human
uuacaugguuuauuuaccuaag

SEQ ID NO: 183142 - RNA, 22 nt, Human
gguguccugggcaggcagcuga

SEQ ID NO: 183143 - RNA, 22 nt, Human
ccagguggaggugugagguccu

SEQ ID NO: 183144 - RNA, 21 nt, Human
gagcugaauauguucuagggg

SEQ ID NO: 183145 - RNA, 21 nt, Human
aguccaggagucacccaagcc

SEQ ID NO: 183146 - RNA, 22 nt, Human
ugccugccuugcugcuggacag

SEQ ID NO: 183147 - RNA, 22 nt, Human
cuguuauuuagaacauggaauc

SEQ ID NO: 183148 - RNA, 22 nt, Human
auuacacagcgguuacuacuag

SEQ ID NO: 183149 - RNA, 22 nt, Human
aaaggcuauugcugauaauguu

SEQ ID NO: 183150 - RNA, 22 nt, Human
aggcagcaugcucugcuucuac

SEQ ID NO: 183151 - RNA, 22 nt, Human
uccucagucucucaaaugaggc

SEQ ID NO: 183152 - RNA, 22 nt, Human
gcuccagggucagcucagaacu

SEQ ID NO: 183153 - RNA, 22 nt, Human
gugcaaaaguaauugagguuuu

SEQ ID NO: 183154 - RNA, 22 nt, Human
uccaggagugauaaggccacug

SEQ ID NO: 183155 - RNA, 18 nt, Human
aggcccuggccucgaaca

SEQ ID NO: 183156 - RNA, 20 nt, Human
uuucugugagaaacacuguu

SEQ ID NO: 183157 - RNA, 22 nt, Human
ggaaagcuacugguguccucug

SEQ ID NO: 183158 - RNA, 22 nt, Human
auuuuccucaagccucuggaag

SEQ ID NO: 183159 - RNA, 22 nt, Human
uuacuacauuguaacacaguac

SEQ ID NO: 183160 - RNA, 19 nt, Human
agcuccuguucagcagcuc

SEQ ID NO: 183161 - RNA, 22 nt, Human
cagaagggcagcacugggaagg

SEQ ID NO: 183162 - RNA, 22 nt, Human
cuacuguugggagcccuggaag

SEQ ID NO: 183163 - RNA, 22 nt, Human
cccaggcucccaggugggacaa

SEQ ID NO: 183164 - RNA, 22 nt, Human
ucagucuucuagcaaauccagg

SEQ ID NO: 183165 - RNA, 22 nt, Human
gggauggaucuuggcugaggcu

SEQ ID NO: 183166 - RNA, 22 nt, Human
uucuuaacucaaauauauaucc

SEQ ID NO: 183167 - RNA, 22 nt, Human
augcaggggccgccuggccagg

SEQ ID NO: 183168 - RNA, 22 nt, Human
cacagcaauagcuaacugauac

SEQ ID NO: 183169 - RNA, 22 nt, Human
acagugacaacccaggauaaau

SEQ ID NO: 183170 - RNA, 22 nt, Human
aucuuguuaaagugcagauucu

SEQ ID NO: 183171 - RNA, 22 nt, Human
caagaugggcaccccagcaccu

SEQ ID NO: 183172 - RNA, 22 nt, Human
agggauggaagcucgucugcaa

SEQ ID NO: 183173 - RNA, 20 nt, Human
ccagaagagaugaucaucca

SEQ ID NO: 183174 - RNA, 22 nt, Human
guggccagcaagugcugccucu

SEQ ID NO: 183175 - RNA, 22 nt, Human
gccugagaucaggagaaagcca

SEQ ID NO: 183176 - RNA, 22 nt, Human
uguaggauuuucaccagaccuu

SEQ ID NO: 183177 - RNA, 22 nt, Human
agugucagccugggcaaggaac

SEQ ID NO: 183178 - RNA, 22 nt, Human
ugaggcagaguaagauacauga

SEQ ID NO: 183179 - RNA, 22 nt, Human
uuccuucuuccagaggcugccc

SEQ ID NO: 183180 - RNA, 22 nt, Human
cagcugaagaaagagugguuag

SEQ ID NO: 183181 - RNA, 22 nt, Human
cacagguggcuucuuucaucuu

SEQ ID NO: 183182 - RNA, 22 nt, Human
uguaucaaggguuuauguaagc

SEQ ID NO: 183183 - RNA, 21 nt, Human
uccaggccucaggaagggaug

SEQ ID NO: 183184 - RNA, 22 nt, Human
ggcugaaggaugaaagcugcag

SEQ ID NO: 183185 - RNA, 22 nt, Human
cagcuuauucaguaagcacaua

SEQ ID NO: 183186 - RNA, 22 nt, Human
uuagaaaaauguucaguaguuu

SEQ ID NO: 183187 - RNA, 22 nt, Human
acacaaugugcaggacaccugu

SEQ ID NO: 183188 - RNA, 22 nt, Human
ccagguggcuucugcccgaugu

SEQ ID NO: 183189 - RNA, 19 nt, Human
gcauaaaaugucaaugugu

SEQ ID NO: 183190 - RNA, 22 nt, Human
aggcacuguacuagguacaggg

SEQ ID NO: 183191 - RNA, 22 nt, Human
auucuuucauauaaaggcucag

SEQ ID NO: 183192 - RNA, 22 nt, Human
aguauuuguggauuuguauugg

SEQ ID NO: 183193 - RNA, 23 nt, Human
gaguggggagaaauugguuaaac

SEQ ID NO: 183194 - RNA, 21 nt, Human
augaggcaugagaggguuucu

SEQ ID NO: 183195 - RNA, 22 nt, Human
ugcaggugguccauuugggaac

SEQ ID NO: 183196 - RNA, 22 nt, Human
uuggcagggcaucagacacgug

SEQ ID NO: 183197 - RNA, 22 nt, Human
uaugaacugcucuuguguuuug

SEQ ID NO: 183198 - RNA, 22 nt, Human
cugaaggagcauagucaguuuu

SEQ ID NO: 183199 - RNA, 22 nt, Human
aguauucuggaauucuauguga

SEQ ID NO: 183200 - RNA, 22 nt, Human
agcccuggagcaaaggugucuu

SEQ ID NO: 183201 - RNA, 22 nt, Human
uugcuuuagguauagaauccau

SEQ ID NO: 183202 - RNA, 22 nt, Human
gucaacaagugguuauugggau

SEQ ID NO: 183203 - RNA, 22 nt, Human
uggaaacuauaaaagcaccuuc

SEQ ID NO: 183204 - RNA, 22 nt, Human
caggcagcgcucguggccuggc

SEQ ID NO: 183205 - RNA, 22 nt, Human
uagggucccagauaggagccag

SEQ ID NO: 183206 - RNA, 22 nt, Human
ccacaucuaagccuucaugaua

SEQ ID NO: 183207 - RNA, 22 nt, Human
agagcuggcugugggugacuuu

SEQ ID NO: 183208 - RNA, 22 nt, Human
uaacaaagguugccaaacuaag

SEQ ID NO: 183209 - RNA, 22 nt, Human
cugacuuuagaacccaaaaagu

SEQ ID NO: 183210 - RNA, 18 nt, Human
ugaacagaugaguugaag

SEQ ID NO: 183211 - RNA, 22 nt, Human
cugucccagccccguacucuaa

SEQ ID NO: 183212 - RNA, 21 nt, Human
uuccagaaaucucuuucuuca

SEQ ID NO: 183213 - RNA, 22 nt, Human
aacugucaucuuucaaggaaga

SEQ ID NO: 183214 - RNA, 22 nt, Human
agggcugugucccuaggggagc

SEQ ID NO: 183215 - RNA, 22 nt, Human
ugggaaggacgugucaguggca

SEQ ID NO: 183216 - RNA, 22 nt, Human
ccaggcucugcaaaaucaggcu

SEQ ID NO: 183217 - RNA, 22 nt, Human
ugggaagcacgcucagcagaaa

SEQ ID NO: 183218 - RNA, 22 nt, Human
uguccccaagguucagcccaca

SEQ ID NO: 183219 - RNA, 22 nt, Human
cagugcugguguaggcugacca

SEQ ID NO: 183220 - RNA, 22 nt, Human
ucuucaggaagggaaaucaucc

SEQ ID NO: 183221 - RNA, 22 nt, Human
caggaauccagagugagccucc

SEQ ID NO: 183222 - RNA, 22 nt, Human
aacauuugugaaguacuuagau

SEQ ID NO: 183223 - RNA, 21 nt, Human
uaggaacuguucugagugguc

SEQ ID NO: 183224 - RNA, 22 nt, Human
ucccagcuacucuagaggcuga

SEQ ID NO: 183225 - RNA, 17 nt, Human
uccaggcagcaacugag

SEQ ID NO: 183226 - RNA, 22 nt, Human
ugcuuuaaaccauggaugugag

SEQ ID NO: 183227 - RNA, 22 nt, Human
caguuucuguggucucuuuuca

SEQ ID NO: 183228 - RNA, 18 nt, Human
gagcuugaaauggcuuuu

SEQ ID NO: 183229 - RNA, 19 nt, Human
ugucagugauacaugcuuu

SEQ ID NO: 183230 - RNA, 22 nt, Human
acagggccucagccagggcaga

SEQ ID NO: 183231 - RNA, 22 nt, Human
ucucagagagcuguguuuuccu

SEQ ID NO: 183232 - RNA, 22 nt, Human
uugcuuuacaaaaauugauggu

SEQ ID NO: 183233 - RNA, 22 nt, Human
gacccuguuucuacaaauaauu

SEQ ID NO: 183234 - RNA, 21 nt, Human
ucuaaugacauccucugacaa

SEQ ID NO: 183235 - RNA, 22 nt, Human
ucagaacauucucauugacugc

SEQ ID NO: 183236 - RNA, 22 nt, Human
uacaugcauguguguaaauaua

SEQ ID NO: 183237 - RNA, 22 nt, Human
ugacacaaaggaaagcauaauc

SEQ ID NO: 183238 - RNA, 20 nt, Human
ucugugcaguggaggggcag

SEQ ID NO: 183239 - RNA, 22 nt, Human
gucagcugggcaucugcagaug

SEQ ID NO: 183240 - RNA, 22 nt, Human
auuucauugaaguuaauucuuc

SEQ ID NO: 183241 - RNA, 22 nt, Human
uauaggaaauaggucuucugug

SEQ ID NO: 183242 - RNA, 22 nt, Human
guuauugagguggagucucacu

SEQ ID NO: 183243 - RNA, 22 nt, Human
aaggagagguuguccguguugu

SEQ ID NO: 183244 - RNA, 22 nt, Human
aggugaggauagguggccaagg

SEQ ID NO: 183245 - RNA, 22 nt, Human
uccagcagguguuugccaacuu

SEQ ID NO: 183246 - RNA, 19 nt, Human
ucagcagcacugugauuuc

SEQ ID NO: 183247 - RNA, 22 nt, Human
cagcccuuuccuucucagcuuu

SEQ ID NO: 183248 - RNA, 19 nt, Human
gagaaucucuuugauguuu

SEQ ID NO: 183249 - RNA, 22 nt, Human
ggcaugggguguauguggcacg

SEQ ID NO: 183250 - RNA, 22 nt, Human
uauuccaguccuauccucuuuu

SEQ ID NO: 183251 - RNA, 17 nt, Human
uaggagacuggcugucc

SEQ ID NO: 183252 - RNA, 22 nt, Human
gacccauauaggacccuccaaa

SEQ ID NO: 183253 - RNA, 19 nt, Human
acaguccagcuguuuguac

SEQ ID NO: 183254 - RNA, 22 nt, Human
uuacuaaggacucuaaguucua

SEQ ID NO: 183255 - RNA, 22 nt, Human
aucuuguuaaagugcagauuuu

SEQ ID NO: 183256 - RNA, 21 nt, Human
ugcacuucaguggcuaaauuc

SEQ ID NO: 183257 - RNA, 22 nt, Human
ggcagauguuauaugaucugag

SEQ ID NO: 183258 - RNA, 22 nt, Human
auucuccuuauucugaaaaaag

SEQ ID NO: 183259 - RNA, 22 nt, Human
agauggggcugaaaguuccaau

SEQ ID NO: 183260 - RNA, 22 nt, Human
ggaaagagaaguugggaggaau

SEQ ID NO: 183261 - RNA, 22 nt, Human
ugcuggcuggccuggccuggac

SEQ ID NO: 183262 - RNA, 22 nt, Human
ucucaggcugacauugggacuc

SEQ ID NO: 183263 - RNA, 22 nt, Human
cagcagguguccuuuuggugga

SEQ ID NO: 183264 - RNA, 22 nt, Human
ucaguguccggagccugagugc

SEQ ID NO: 183265 - RNA, 23 nt, Human
ucagugucuaguuguggaauuga

SEQ ID NO: 183266 - RNA, 22 nt, Human
acuuccagaauuagaauuuaag

SEQ ID NO: 183267 - RNA, 16 nt, Human
uuuuauugugacagcc

SEQ ID NO: 183268 - RNA, 22 nt, Human
caguuuuauugguugaaaucug

SEQ ID NO: 183269 - RNA, 20 nt, Human
cucucuggaaggugggagcc

SEQ ID NO: 183270 - RNA, 22 nt, Human
caggcugggcuccggagauaaa

SEQ ID NO: 183271 - RNA, 22 nt, Human
caguaguuauuaguugccacug

SEQ ID NO: 183272 - RNA, 22 nt, Human
gccuucaguagugucagcugua

SEQ ID NO: 183273 - RNA, 22 nt, Human
caguucugacuuucauaauguc

SEQ ID NO: 183274 - RNA, 22 nt, Human
cuguggcuccagugaaccaaug

SEQ ID NO: 183275 - RNA, 22 nt, Human
ccaggcauugugagugggcagg

SEQ ID NO: 183276 - RNA, 22 nt, Human
ggcugggcauccauccaugaga

SEQ ID NO: 183277 - RNA, 20 nt, Human
cuccacaccuguucgcaggc

SEQ ID NO: 183278 - RNA, 22 nt, Human
cuucauuuggagaacugugcuu

SEQ ID NO: 183279 - RNA, 22 nt, Human
aagcccaguaccuucagugagg

SEQ ID NO: 183280 - RNA, 22 nt, Human
agaguacugcugcuggguacug

SEQ ID NO: 183281 - RNA, 20 nt, Human
uaaagacauaagcuacuauc

SEQ ID NO: 183282 - RNA, 22 nt, Human
ugaucuagguuggcuucaacug

SEQ ID NO: 183283 - RNA, 22 nt, Human
acaguacauaauccugagucug

SEQ ID NO: 183284 - RNA, 22 nt, Human
gaggagagaugguagauugggu

SEQ ID NO: 183285 - RNA, 22 nt, Human
ggcuucccugccucacuuauuc

SEQ ID NO: 183286 - RNA, 22 nt, Human
ucucuaaaucugguucacuugc

SEQ ID NO: 183287 - RNA, 22 nt, Human
aaacaaauagugcaugggaauu

SEQ ID NO: 183288 - RNA, 22 nt, Human
uguucuuugccagugauuuaau

SEQ ID NO: 183289 - RNA, 23 nt, Human
cuucuggcucuauaucagaauuc

SEQ ID NO: 183290 - RNA, 22 nt, Human
ugcauugauagaaaaacaugga

SEQ ID NO: 183291 - RNA, 22 nt, Human
ucuucauucucgccuuugucgu

SEQ ID NO: 183292 - RNA, 22 nt, Human
cagccacuucgagcuuccugau

SEQ ID NO: 183293 - RNA, 22 nt, Human
cuucucuugguaguucuuguug

SEQ ID NO: 183294 - RNA, 22 nt, Human
aauauacuauacuacuuucugg

SEQ ID NO: 183295 - RNA, 22 nt, Human
ccagagcccagcacacggugcu

SEQ ID NO: 183296 - RNA, 22 nt, Human
aaagagggacaggcgcagacac

SEQ ID NO: 183297 - RNA, 22 nt, Human
agacauauuggcuugcuuuaau

SEQ ID NO: 183298 - RNA, 22 nt, Human
aucuuugggcaaugaugaggga

SEQ ID NO: 183299 - RNA, 22 nt, Human
uuugaaauaugugaugagagag

SEQ ID NO: 183300 - RNA, 22 nt, Human
gugagggauaauaugcgggguu

SEQ ID NO: 183301 - RNA, 22 nt, Human
uacuuacaugaauucaagagca

SEQ ID NO: 183302 - RNA, 22 nt, Human
agguccugaggguucgucugca

SEQ ID NO: 183303 - RNA, 22 nt, Human
gugcaaacaucauagaguguac

SEQ ID NO: 183304 - RNA, 22 nt, Human
uuccccaggugauucucauggc

SEQ ID NO: 183305 - RNA, 22 nt, Human
aaaaguauggugguccuuuuua

SEQ ID NO: 183306 - RNA, 22 nt, Human
ucuuggcuacuuaggaggauuc

SEQ ID NO: 183307 - RNA, 23 nt, Human
ucuggaggggacacugcagaugc

SEQ ID NO: 183308 - RNA, 22 nt, Human
agcccuggcucccagcagcgcu

SEQ ID NO: 183309 - RNA, 22 nt, Human
agaucagauucugccuuuguga

SEQ ID NO: 183310 - RNA, 22 nt, Human
aagcccuggcccaaccuugauu

SEQ ID NO: 183311 - RNA, 22 nt, Human
uaugaacuuuugaugugacaug

SEQ ID NO: 183312 - RNA, 22 nt, Human
agaucuuuagaagauagaauca

SEQ ID NO: 183313 - RNA, 22 nt, Human
acauuccucagugccaguugag

SEQ ID NO: 183314 - RNA, 22 nt, Human
ugccucagucuaaagucucuca

SEQ ID NO: 183315 - RNA, 22 nt, Human
uuuguacauguaagauugcauc

SEQ ID NO: 183316 - RNA, 22 nt, Human
uuuacauguaauguuauacaaa

SEQ ID NO: 183317 - RNA, 22 nt, Human
aguuuuuccugauuuuacagaa

SEQ ID NO: 183318 - RNA, 22 nt, Human
ucugggcugugggaauucaaca

SEQ ID NO: 183319 - RNA, 19 nt, Human
acacauuugcacaauccac

SEQ ID NO: 183320 - RNA, 18 nt, Human
gccugggaggaggaaaug

SEQ ID NO: 183321 - RNA, 22 nt, Human
gauuacaauucagguugauaag

SEQ ID NO: 183322 - RNA, 22 nt, Human
auuagugucauguugaggacuu

SEQ ID NO: 183323 - RNA, 22 nt, Human
ucaugcaguuugaaguucaggg

SEQ ID NO: 183324 - RNA, 22 nt, Human
acucuguagggacgguucuccc

SEQ ID NO: 183325 - RNA, 22 nt, Human
cagggcugugcccaucuucccc

SEQ ID NO: 183326 - RNA, 22 nt, Human
uaggaaaccaaucuuuugggag

SEQ ID NO: 183327 - RNA, 23 nt, Human
aaacuacauuuauaguuuuucuc

SEQ ID NO: 183328 - RNA, 22 nt, Human
gccugccuuugugaggaagcgg

SEQ ID NO: 183329 - RNA, 18 nt, Human
gugacguuuuggaugauu

SEQ ID NO: 183330 - RNA, 22 nt, Human
gggaaugugaaacaguaaggga

SEQ ID NO: 183331 - RNA, 22 nt, Human
aaacaggcaucacucagcaaag

SEQ ID NO: 183332 - RNA, 22 nt, Human
uggggcuguccuuagucugaga

SEQ ID NO: 183333 - RNA, 22 nt, Human
auguuuguguuacacucugcag

SEQ ID NO: 183334 - RNA, 22 nt, Human
gcucagccgaacuucagagcag

SEQ ID NO: 183335 - RNA, 22 nt, Human
uguuuguauggaccuguucuau

SEQ ID NO: 183336 - RNA, 22 nt, Human
ucuccuggaagaauaccacacu

SEQ ID NO: 183337 - RNA, 22 nt, Human
ccuccaucaccaucugcccuca

SEQ ID NO: 183338 - RNA, 22 nt, Human
aauguaguucacaauugguacu

SEQ ID NO: 183339 - RNA, 22 nt, Human
gguagcugcagcaggcuggcaa

SEQ ID NO: 183340 - RNA, 22 nt, Human
ccagccucaucgccugccuguc

SEQ ID NO: 183341 - RNA, 22 nt, Human
guggcagugggaugcuaucagg

SEQ ID NO: 183342 - RNA, 17 nt, Human
uggcuuuccugacacag

SEQ ID NO: 183343 - RNA, 22 nt, Human
uuugcauugcauuaaguauucu

SEQ ID NO: 183344 - RNA, 22 nt, Human
uaugaaagaaucucagagcaca

SEQ ID NO: 183345 - RNA, 22 nt, Human
uucuuguucugguucuguuagc

SEQ ID NO: 183346 - RNA, 22 nt, Human
uuuaauugcauuuaaagaugga

SEQ ID NO: 183347 - RNA, 23 nt, Human
gugugcaggauuauuugcagaca

SEQ ID NO: 183348 - RNA, 22 nt, Human
aucuguagaagauacucugaga

SEQ ID NO: 183349 - RNA, 22 nt, Human
aaaugcuguucuuuuagguaga

SEQ ID NO: 183350 - RNA, 22 nt, Human
accuccccgggagcagccuccu

SEQ ID NO: 183351 - RNA, 22 nt, Human
acagaacuggaauuggaacuca

SEQ ID NO: 183352 - RNA, 22 nt, Human
uaguuuagcauacaucuucagg

SEQ ID NO: 183353 - RNA, 22 nt, Human
aaagaagauggagaccugacua

SEQ ID NO: 183354 - RNA, 21 nt, Human
guuauugaccuccaggcuggc

SEQ ID NO: 183355 - RNA, 22 nt, Human
guccaaugguaaauccaaauaa

SEQ ID NO: 183356 - RNA, 23 nt, Human
aacugagauaauguauguaaagc

SEQ ID NO: 183357 - RNA, 22 nt, Human
aagugcuguuucugaugaaugc

SEQ ID NO: 183358 - RNA, 22 nt, Human
uacauucacuuguugaaggugg

SEQ ID NO: 183359 - RNA, 21 nt, Human
agugacuaugacauuauuacc

SEQ ID NO: 183360 - RNA, 22 nt, Human
aggcccugcauuguacugaggg

SEQ ID NO: 183361 - RNA, 18 nt, Human
uuggaccugugucagggc

SEQ ID NO: 183362 - RNA, 22 nt, Human
gagcuccuggauugcuccuagg

SEQ ID NO: 183363 - RNA, 20 nt, Human
agccugcuguagaaguuugg

SEQ ID NO: 183364 - RNA, 22 nt, Human
gcacacagauuaggaaacagaa

SEQ ID NO: 183365 - RNA, 20 nt, Human
uggaggcaccuguggagauc

SEQ ID NO: 183366 - RNA, 22 nt, Human
auuugggaaugugcauuauacu

SEQ ID NO: 183367 - RNA, 22 nt, Human
cuguaagggccugacuacccug

SEQ ID NO: 183368 - RNA, 20 nt, Human
ggcccagugaaccaggacgg

SEQ ID NO: 183369 - RNA, 22 nt, Human
caaggaaacaugaaaugcauug

SEQ ID NO: 183370 - RNA, 20 nt, Human
caggaggcaaggucaagguc

SEQ ID NO: 183371 - RNA, 22 nt, Human
ucaccaggcuggaaugcagugg

SEQ ID NO: 183372 - RNA, 23 nt, Human
acagaaaucauuuguaagguacc

SEQ ID NO: 183373 - RNA, 22 nt, Human
acagaggcagugugagauacug

SEQ ID NO: 183374 - RNA, 22 nt, Human
uuugggaagugggagcaaggug

SEQ ID NO: 183375 - RNA, 22 nt, Human
ggucccaugacugacacagcag

SEQ ID NO: 183376 - RNA, 22 nt, Human
uccugccaggagugcuggcccu

SEQ ID NO: 183377 - RNA, 22 nt, Human
uuucuucauucaccuucacccc

SEQ ID NO: 183378 - RNA, 22 nt, Human
aggcucagacaggaaaaguaac

SEQ ID NO: 183379 - RNA, 22 nt, Human
augcaaauaagugcaggcgugg

SEQ ID NO: 183380 - RNA, 22 nt, Human
aagucagagaugccaaagauua

SEQ ID NO: 183381 - RNA, 22 nt, Human
ugcacacacaugaaguagcaug

SEQ ID NO: 183382 - RNA, 17 nt, Human
cccagggaccacugcuu

SEQ ID NO: 183383 - RNA, 22 nt, Human
uguaauuaacguucuuguuaga

SEQ ID NO: 183384 - RNA, 22 nt, Human
ccagggaugcagagguugcagu

SEQ ID NO: 183385 - RNA, 22 nt, Human
gccugggaacucugaucuccug

SEQ ID NO: 183386 - RNA, 22 nt, Human
aaagugcaucaaaugacuuccc

SEQ ID NO: 183387 - RNA, 22 nt, Human
aggcaggucacaugcuuggcga

SEQ ID NO: 183388 - RNA, 22 nt, Human
ugcuucuggaguaacaggguga

SEQ ID NO: 183389 - RNA, 22 nt, Human
ucaggucaggaaaauaagauug

SEQ ID NO: 183390 - RNA, 22 nt, Human
ucacacauacucaugugugagu

SEQ ID NO: 183391 - RNA, 22 nt, Human
ucucugugucucauguuccuau

SEQ ID NO: 183392 - RNA, 22 nt, Human
aggaacacccccuuccuaccag

SEQ ID NO: 183393 - RNA, 22 nt, Human
cuccugggagcuguggcagagc

SEQ ID NO: 183394 - RNA, 22 nt, Human
gggaaacucaggcauuuccacu

SEQ ID NO: 183395 - RNA, 22 nt, Human
ccagaccagacugacuugagcc

SEQ ID NO: 183396 - RNA, 22 nt, Human
uccuuucuuuucuaugggccca

SEQ ID NO: 183397 - RNA, 22 nt, Human
ucaauucugccucuaaauauuu

SEQ ID NO: 183398 - RNA, 18 nt, Human
agagaugguguagaguuu

SEQ ID NO: 183399 - RNA, 23 nt, Human
gguccacccgagccugcagcuuc

SEQ ID NO: 183400 - RNA, 22 nt, Human
ccagaggaguugaggcuuuggg

SEQ ID NO: 183401 - RNA, 22 nt, Human
aaugaagaaauggacaucuuua

SEQ ID NO: 183402 - RNA, 22 nt, Human
cugcugucuuuauuucacugcu

SEQ ID NO: 183403 - RNA, 22 nt, Human
agguccaggauuuguggggucu

SEQ ID NO: 183404 - RNA, 22 nt, Human
uggaaagugcucuagacuuucu

SEQ ID NO: 183405 - RNA, 22 nt, Human
gggcaugguggugcacaccugu

SEQ ID NO: 183406 - RNA, 22 nt, Human
caacuuuagcaauguuaguaua

SEQ ID NO: 183407 - RNA, 22 nt, Human
cagcaggcccagaguuucaugg

SEQ ID NO: 183408 - RNA, 22 nt, Human
augcaagcaaucugagcuuugg

SEQ ID NO: 183409 - RNA, 22 nt, Human
gccaaaucuugcacacucuugu

SEQ ID NO: 183410 - RNA, 17 nt, Human
gcccuggagccaggcua

SEQ ID NO: 183411 - RNA, 22 nt, Human
agggcccucugggcacuguggc

SEQ ID NO: 183412 - RNA, 22 nt, Human
aaaauacacauacuaggggaaa

SEQ ID NO: 183413 - RNA, 22 nt, Human
uaagaaauuuaguuauagaaug

SEQ ID NO: 183414 - RNA, 23 nt, Human
aggaggccugaaacugaggcuga

SEQ ID NO: 183415 - RNA, 22 nt, Human
acucaaauuugucaacugaagc

SEQ ID NO: 183416 - RNA, 22 nt, Human
cagcaucuaaucuucaugccgg

SEQ ID NO: 183417 - RNA, 22 nt, Human
cugggcgugucuuccagcuggc

SEQ ID NO: 183418 - RNA, 22 nt, Human
auuucacagcugucaguguuac

SEQ ID NO: 183419 - RNA, 22 nt, Human
gagucucugggagggaaagaag

SEQ ID NO: 183420 - RNA, 22 nt, Human
aaagccuugagauccuauaguu

SEQ ID NO: 183421 - RNA, 22 nt, Human
caggccugcuucuuacccuuca

SEQ ID NO: 183422 - RNA, 22 nt, Human
ucucugucugagccuggcagac

SEQ ID NO: 183423 - RNA, 17 nt, Human
uccaggcauaucuccua

SEQ ID NO: 183424 - RNA, 22 nt, Human
ugugaaaagggcuuuguacaaa

SEQ ID NO: 183425 - RNA, 22 nt, Human
agucaggauuuuggauuauucg

SEQ ID NO: 183426 - RNA, 22 nt, Human
ugugagaauuccugaucacagg

SEQ ID NO: 183427 - RNA, 22 nt, Human
guguacauagaauugugcuuug

SEQ ID NO: 183428 - RNA, 22 nt, Human
acuaacuucugagaaccaauug

SEQ ID NO: 183429 - RNA, 22 nt, Human
cuccaaguauguuaaaaucuaa

SEQ ID NO: 183430 - RNA, 22 nt, Human
aaagcucuuuuccaaguauuga

SEQ ID NO: 183431 - RNA, 22 nt, Human
cccaggagaugcacuccauugg

SEQ ID NO: 183432 - RNA, 22 nt, Human
uagagggaaggaagaauggauu

SEQ ID NO: 183433 - RNA, 22 nt, Human
uagggcuauucugaguaauaau

SEQ ID NO: 183434 - RNA, 22 nt, Human
gaggccagauacucucuucugc

SEQ ID NO: 183435 - RNA, 20 nt, Human
ccuucucuggaauugccucc

SEQ ID NO: 183436 - RNA, 22 nt, Human
gugaccauaauagauuaugagu

SEQ ID NO: 183437 - RNA, 22 nt, Human
cugugacugggugacaguccuc

SEQ ID NO: 183438 - RNA, 22 nt, Human
gucugucucccugugacugaga

SEQ ID NO: 183439 - RNA, 18 nt, Human
cuuuaugugcagagcuuu

SEQ ID NO: 183440 - RNA, 22 nt, Human
agggcucuguccccagaggccc

SEQ ID NO: 183441 - RNA, 19 nt, Human
gcucagagggcccugugcu

SEQ ID NO: 183442 - RNA, 22 nt, Human
uguuuacuucuuuccauggcuu

SEQ ID NO: 183443 - RNA, 22 nt, Human
ucuggcagcuauccucuggcca

SEQ ID NO: 183444 - RNA, 22 nt, Human
ugcuguggcaguuuauguauag

SEQ ID NO: 183445 - RNA, 22 nt, Human
cuguggaaaauuuguauguaau

SEQ ID NO: 183446 - RNA, 22 nt, Human
ucagugcaaucaagguauguuu

SEQ ID NO: 183447 - RNA, 22 nt, Human
uauauuaaacccucucuguagg

SEQ ID NO: 183448 - RNA, 22 nt, Human
ugggagaagcauggggugcaga

SEQ ID NO: 183449 - RNA, 22 nt, Human
uuuacagugucuuguugacugu

SEQ ID NO: 183450 - RNA, 22 nt, Human
cuuccuucugaagcauagaagc

SEQ ID NO: 183451 - RNA, 22 nt, Human
ccagcacucuauugaauauucu

SEQ ID NO: 183452 - RNA, 22 nt, Human
ggcagguggaaggucuccauuc

SEQ ID NO: 183453 - RNA, 22 nt, Human
gacaacagugguuucagguucc

SEQ ID NO: 183454 - RNA, 22 nt, Human
gugaccagugaugcugaggagu

SEQ ID NO: 183455 - RNA, 22 nt, Human
cugugagagugguggccuaggc

SEQ ID NO: 183456 - RNA, 17 nt, Human
ggcagcugccacuuuuu

SEQ ID NO: 183457 - RNA, 22 nt, Human
aauguuguuuuucugcaugucu

SEQ ID NO: 183458 - RNA, 22 nt, Human
aagagcuggcucuugcagcagc

SEQ ID NO: 183459 - RNA, 22 nt, Human
acuguccaagcaugccuggcuu

SEQ ID NO: 183460 - RNA, 22 nt, Human
uccuggugguuugaaaacugaa

SEQ ID NO: 183461 - RNA, 22 nt, Human
ggcagccccaucagagacgcug

SEQ ID NO: 183462 - RNA, 22 nt, Human
gauuacaaaacucaucuaugac

SEQ ID NO: 183463 - RNA, 22 nt, Human
ccagaaggcggagauugcagug

SEQ ID NO: 183464 - RNA, 17 nt, Human
uggcacagaggugcuau

SEQ ID NO: 183465 - RNA, 22 nt, Human
uucucuuuugugaugugagaug

SEQ ID NO: 183466 - RNA, 22 nt, Human
uggcuaggaauccaugacucuc

SEQ ID NO: 183467 - RNA, 20 nt, Human
gcucagggccugggucugga

SEQ ID NO: 183468 - RNA, 22 nt, Human
acucagagucaauguuaauggc

SEQ ID NO: 183469 - RNA, 23 nt, Human
gggaagcuccauggaggugcugg

SEQ ID NO: 183470 - RNA, 22 nt, Human
uccaggcuagagugcaguggcc

SEQ ID NO: 183471 - RNA, 22 nt, Human
aaaaggcuagcuaguaacagaa

SEQ ID NO: 183472 - RNA, 22 nt, Human
ccagggugagugucauggguua

SEQ ID NO: 183473 - RNA, 18 nt, Human
uuggggugaggccaggaa

SEQ ID NO: 183474 - RNA, 22 nt, Human
agggcccuaaggaaggcacaca

SEQ ID NO: 183475 - RNA, 22 nt, Human
ucuucaaagaauuuuaguaauu

SEQ ID NO: 183476 - RNA, 22 nt, Human
ugggaaggggagcuggaaagga

SEQ ID NO: 183477 - RNA, 22 nt, Human
accuccccucaccaaucugguu

SEQ ID NO: 183478 - RNA, 22 nt, Human
ugccugggaucugugcccuuug

SEQ ID NO: 183479 - RNA, 22 nt, Human
uaguuucuaaagcuuccuaggu

SEQ ID NO: 183480 - RNA, 22 nt, Human
ggaugucugucauuaugcuuuc

SEQ ID NO: 183481 - RNA, 20 nt, Human
uccuggccucccuggggcuc

SEQ ID NO: 183482 - RNA, 22 nt, Human
uuugacucuuaaguggcucaau

SEQ ID NO: 183483 - RNA, 22 nt, Human
auagugcauuuuauuaucagca

SEQ ID NO: 183484 - RNA, 22 nt, Human
gcucuguagugggcaugugauu

SEQ ID NO: 183485 - RNA, 22 nt, Human
guccauggcauuuccgucacau

SEQ ID NO: 183486 - RNA, 22 nt, Human
gaggaugcugcagugcaggaca

SEQ ID NO: 183487 - RNA, 22 nt, Human
cugggaagaagugggcuacauu

SEQ ID NO: 183488 - RNA, 22 nt, Human
uagggugguuagaaggaguaug

SEQ ID NO: 183489 - RNA, 22 nt, Human
gacaggugaaacagcaagguaa

SEQ ID NO: 183490 - RNA, 22 nt, Human
caagcuuuauccgccauguagg

SEQ ID NO: 183491 - RNA, 22 nt, Human
ugaggcaagggauggccccgug

SEQ ID NO: 183492 - RNA, 22 nt, Human
acuguauuuggauauaagaucu

SEQ ID NO: 183493 - RNA, 22 nt, Human
ugacuuuaaaauaacaaguuua

SEQ ID NO: 183494 - RNA, 20 nt, Human
aaaaacaguaaugcugaaga

SEQ ID NO: 183495 - RNA, 22 nt, Human
caugcccauugagaagggccuc

SEQ ID NO: 183496 - RNA, 22 nt, Human
uuaggaaaaugaaauuaccugu

SEQ ID NO: 183497 - RNA, 22 nt, Human
ggacagguucagcaguuuauaa

SEQ ID NO: 183498 - RNA, 22 nt, Human
ggcugugaaguagcaggggcag

SEQ ID NO: 183499 - RNA, 22 nt, Human
uuggccuucugguguucauuuu

SEQ ID NO: 183500 - RNA, 22 nt, Human
uacaguuacgcugagaaacgaa

SEQ ID NO: 183501 - RNA, 22 nt, Human
gcuucuguggugaggucaccuu

SEQ ID NO: 183502 - RNA, 20 nt, Human
ugcuucauuaugugagauag

SEQ ID NO: 183503 - RNA, 22 nt, Human
cuguuucauagaguugugaauu

SEQ ID NO: 183504 - RNA, 22 nt, Human
ugcaggcucaucucaagaguag

SEQ ID NO: 183505 - RNA, 19 nt, Human
agaguauugaauuugcccu

SEQ ID NO: 183506 - RNA, 22 nt, Human
gcugaggaaaggcuggaaggga

SEQ ID NO: 183507 - RNA, 22 nt, Human
caaguauuuuaaggacuagugg

SEQ ID NO: 183508 - RNA, 22 nt, Human
gucugcccagaagacauccccu

SEQ ID NO: 183509 - RNA, 22 nt, Human
gcccuuggaacagccuccugcu

SEQ ID NO: 183510 - RNA, 22 nt, Human
ugggagcacccugaggagcuuc

SEQ ID NO: 183511 - RNA, 22 nt, Human
gcaggcuggucugaccaucccu

SEQ ID NO: 183512 - RNA, 22 nt, Human
uugcagcuuagugauguuaucu

SEQ ID NO: 183513 - RNA, 22 nt, Human
gccagguggcugagcagcugca

SEQ ID NO: 183514 - RNA, 22 nt, Human
agagugguacuucuuuuucuuc

SEQ ID NO: 183515 - RNA, 22 nt, Human
cacaugaggugacuuccaagcu

SEQ ID NO: 183516 - RNA, 22 nt, Human
cagggagcuuucccaggacccu

SEQ ID NO: 183517 - RNA, 22 nt, Human
gcaguccucucauuggccuccu

SEQ ID NO: 183518 - RNA, 22 nt, Human
uggagaugcacgagcaggugga

SEQ ID NO: 183519 - RNA, 22 nt, Human
ugggagagcacugcagccccgg

SEQ ID NO: 183520 - RNA, 22 nt, Human
cacaccucacaccucgcaugcu

SEQ ID NO: 183521 - RNA, 22 nt, Human
uaacaacuggacaauguugcuc

SEQ ID NO: 183522 - RNA, 22 nt, Human
cccacucccuacgacacgcucc

SEQ ID NO: 183523 - RNA, 21 nt, Human
agccagucucaguacuguacu

SEQ ID NO: 183524 - RNA, 22 nt, Human
uaauaauagcaguagcugccac

SEQ ID NO: 183525 - RNA, 22 nt, Human
uuacuguuuuuaacuaauugug

SEQ ID NO: 183526 - RNA, 22 nt, Human
uugguaaauccccuuacacaaa

SEQ ID NO: 183527 - RNA, 22 nt, Human
gaagagaagcaucaauagguaa

SEQ ID NO: 183528 - RNA, 22 nt, Human
ugagcugggaagagcagccaga

SEQ ID NO: 183529 - RNA, 22 nt, Human
aaucaauguuagucaugaauuu

SEQ ID NO: 183530 - RNA, 22 nt, Human
uucccuugaccccagacccugg

SEQ ID NO: 183531 - RNA, 22 nt, Human
cccagugugguugugaauucug

SEQ ID NO: 183532 - RNA, 20 nt, Human
aggucugaaugucagggcug

SEQ ID NO: 183533 - RNA, 22 nt, Human
agacuuaggagcugacaucucu

SEQ ID NO: 183534 - RNA, 22 nt, Human
gucaggggccaugggccaagga

SEQ ID NO: 183535 - RNA, 22 nt, Human
uccacaucaagggcagagaggu

SEQ ID NO: 183536 - RNA, 22 nt, Human
uccagccaccaccuugauugcc

SEQ ID NO: 183537 - RNA, 22 nt, Human
aacuuacaaggaugauagcugc

SEQ ID NO: 183538 - RNA, 22 nt, Human
gggcucuggacccaggcaagag

SEQ ID NO: 183539 - RNA, 22 nt, Human
gacagacuaaauggcuguagga

SEQ ID NO: 183540 - RNA, 22 nt, Human
agcaggcaggcugccagugaau

SEQ ID NO: 183541 - RNA, 22 nt, Human
gcugcugguccucagagcucau

SEQ ID NO: 183542 - RNA, 21 nt, Human
cacagagauauuggugagccu

SEQ ID NO: 183543 - RNA, 22 nt, Human
gaggccagaagucugagaucag

SEQ ID NO: 183544 - RNA, 22 nt, Human
cuguggcucucagaggcugcug

SEQ ID NO: 183545 - RNA, 22 nt, Human
cugcacccaugagcucaaggga

SEQ ID NO: 183546 - RNA, 22 nt, Human
uagcugcuucagucuaggucuc

SEQ ID NO: 183547 - RNA, 22 nt, Human
ugggccacaagccaugggacca

SEQ ID NO: 183548 - RNA, 22 nt, Human
cauuguuaccaucuuuuaccua

SEQ ID NO: 183549 - RNA, 22 nt, Human
cugcacugagcucucccagccc

SEQ ID NO: 183550 - RNA, 22 nt, Human
uucuagaaugauaugagguacu

SEQ ID NO: 183551 - RNA, 22 nt, Human
uuuuuuauagcaaugaacccac

SEQ ID NO: 183552 - RNA, 22 nt, Human
acagccuuauucuuuaguuuac

SEQ ID NO: 183553 - RNA, 22 nt, Human
cacauuaaaauccuaacuucca

SEQ ID NO: 183554 - RNA, 22 nt, Human
aagucagcacuccaggaagcca

SEQ ID NO: 183555 - RNA, 22 nt, Human
uacaguauggaaaauguauagu

SEQ ID NO: 183556 - RNA, 22 nt, Human
cugcacagggauauggggagcu

SEQ ID NO: 183557 - RNA, 22 nt, Human
gagucuggacuauucuggucuu

SEQ ID NO: 183558 - RNA, 22 nt, Human
uuccuggcugaacugaacuccu

SEQ ID NO: 183559 - RNA, 22 nt, Human
cagcuuguuuuauuuggggacc

SEQ ID NO: 183560 - RNA, 22 nt, Human
agugcuccugaagcuugaggca

SEQ ID NO: 183561 - RNA, 19 nt, Human
ucuguggccuucccugaug

SEQ ID NO: 183562 - RNA, 22 nt, Human
auaauaucgcuccuuuuuuuga

SEQ ID NO: 183563 - RNA, 22 nt, Human
ugggcaaagucacauacaugau

SEQ ID NO: 183564 - RNA, 22 nt, Human
uuagagaaaggguuugauuccg

SEQ ID NO: 183565 - RNA, 22 nt, Human
ugggacacacaaggucagcucu

SEQ ID NO: 183566 - RNA, 23 nt, Human
uaaagacagccuucaggauucug

SEQ ID NO: 183567 - RNA, 22 nt, Human
ucauuacaguguuuauaugucu

SEQ ID NO: 183568 - RNA, 22 nt, Human
agacacugaaauguauugaaga

SEQ ID NO: 183569 - RNA, 22 nt, Human
gucacaggcaguaacuaggacc

SEQ ID NO: 183570 - RNA, 20 nt, Human
caguccaaucagaggccacc

SEQ ID NO: 183571 - RNA, 21 nt, Human
ggagcugcaggagccgaaggc

SEQ ID NO: 183572 - RNA, 22 nt, Human
guguguccaaggcacggaugac

SEQ ID NO: 183573 - RNA, 22 nt, Human
caggaaagaaaugagaacacca

SEQ ID NO: 183574 - RNA, 22 nt, Human
cguggcuggggaggucagccag

SEQ ID NO: 183575 - RNA, 22 nt, Human
cugaagcaugcguuuguaaacu

SEQ ID NO: 183576 - RNA, 22 nt, Human
uuguggaagcccuaugagagac

SEQ ID NO: 183577 - RNA, 22 nt, Human
ccaggaagccucagaugcugag

SEQ ID NO: 183578 - RNA, 22 nt, Human
auuuggcuguaguaacuggauc

SEQ ID NO: 183579 - RNA, 22 nt, Human
gcccucagaaugggcucuaauc

SEQ ID NO: 183580 - RNA, 22 nt, Human
agugacauuauuuuguguacua

SEQ ID NO: 183581 - RNA, 22 nt, Human
auucaaguggcugcuauguuaa

SEQ ID NO: 183582 - RNA, 22 nt, Human
gccaggaggcuuaacuggacag

SEQ ID NO: 183583 - RNA, 22 nt, Human
caccagguggaaaugucacagc

SEQ ID NO: 183584 - RNA, 22 nt, Human
uugcugggcaugucuuaauucu

SEQ ID NO: 183585 - RNA, 22 nt, Human
uguuucuagagaaaauauuuac

SEQ ID NO: 183586 - RNA, 22 nt, Human
uguaaagaaauagcauuuguag

SEQ ID NO: 183587 - RNA, 22 nt, Human
uuugaagcaccaaaggagaaaa

SEQ ID NO: 183588 - RNA, 22 nt, Human
uauuucagguauggugugaaau

SEQ ID NO: 183589 - RNA, 22 nt, Human
gagcccugugauucuguugugu

SEQ ID NO: 183590 - RNA, 22 nt, Human
agagacaggaguucuguuucca

SEQ ID NO: 183591 - RNA, 20 nt, Human
uuacagaaaugauguuauuu

SEQ ID NO: 183592 - RNA, 22 nt, Human
uggcaguggauaggggagcggu

SEQ ID NO: 183593 - RNA, 22 nt, Human
aggaaacugauguuuuuuacaa

SEQ ID NO: 183594 - RNA, 22 nt, Human
ccaggcauggggagagccagau

SEQ ID NO: 183595 - RNA, 23 nt, Human
ugugggaauguuggagaggaaac

SEQ ID NO: 183596 - RNA, 22 nt, Human
aucuggaauccuuguggacaau

SEQ ID NO: 183597 - RNA, 22 nt, Human
aaacucuaguaaaauguauuca

SEQ ID NO: 183598 - RNA, 22 nt, Human
auugaaaauaaggccagaaaca

SEQ ID NO: 183599 - RNA, 22 nt, Human
auugaaagauaggcuacugugg

SEQ ID NO: 183600 - RNA, 22 nt, Human
gaauuagguaauagaacuagua

SEQ ID NO: 183601 - RNA, 22 nt, Human
ugcaaucucggcacuuugggag

SEQ ID NO: 183602 - RNA, 22 nt, Human
ggagggcaacuuuucaguaggu

SEQ ID NO: 183603 - RNA, 22 nt, Human
ggcagcuggguuggccagaaac

SEQ ID NO: 183604 - RNA, 22 nt, Human
gauuaguugauuaagagucaga

SEQ ID NO: 183605 - RNA, 22 nt, Human
augcaacaaauugugugcaaua

SEQ ID NO: 183606 - RNA, 23 nt, Human
uccagccaaaucuggcugacagu

SEQ ID NO: 183607 - RNA, 22 nt, Human
ggcaugugccugaggucacaca

SEQ ID NO: 183608 - RNA, 22 nt, Human
gagaauguuaauguugaaguau

SEQ ID NO: 183609 - RNA, 22 nt, Human
uuuccagucccuggauuuaacc

SEQ ID NO: 183610 - RNA, 21 nt, Human
ugcaggcuguuuaagaggcaa

SEQ ID NO: 183611 - RNA, 22 nt, Human
gacccugauaggaguagaagaa

SEQ ID NO: 183612 - RNA, 20 nt, Human
uccagcauauaaacuccucu

SEQ ID NO: 183613 - RNA, 22 nt, Human
auaauacaugguuaaccucuuu

SEQ ID NO: 183614 - RNA, 21 nt, Human
gccagcugggucuugcaggag

SEQ ID NO: 183615 - RNA, 22 nt, Human
uguuggaaaagaauuaacuagg

SEQ ID NO: 183616 - RNA, 22 nt, Human
acagguguaugaauauguucca

SEQ ID NO: 183617 - RNA, 22 nt, Human
ucacauuugcaauugcauuguu

SEQ ID NO: 183618 - RNA, 22 nt, Human
guugugcagaagugccucagua

SEQ ID NO: 183619 - RNA, 22 nt, Human
uuaagaaggcuguuugcuagac

SEQ ID NO: 183620 - RNA, 20 nt, Human
agcagcagauguuggaggug

SEQ ID NO: 183621 - RNA, 22 nt, Human
cugugucccagccaggauaaug

SEQ ID NO: 183622 - RNA, 22 nt, Human
gccacuguccugugccugugcu

SEQ ID NO: 183623 - RNA, 22 nt, Human
uaaaggcuucggagugcacacu

SEQ ID NO: 183624 - RNA, 22 nt, Human
uuuauugacccaaagcgagagu

SEQ ID NO: 183625 - RNA, 22 nt, Human
ccauuuugucugacuucuugcu

SEQ ID NO: 183626 - RNA, 22 nt, Human
caggacagaccaagaucgugcu

SEQ ID NO: 183627 - RNA, 22 nt, Human
acuguucacuagugaggguuga

SEQ ID NO: 183628 - RNA, 22 nt, Human
guuacaaaugccaaagcugaga

SEQ ID NO: 183629 - RNA, 22 nt, Human
cagcacaucugauuauaugacu

SEQ ID NO: 183630 - RNA, 22 nt, Human
ugcuccaggcugcugaagaucu

SEQ ID NO: 183631 - RNA, 22 nt, Human
ccuuuaugagauccugggguga

SEQ ID NO: 183632 - RNA, 22 nt, Human
ucuugccucuuccccuuuccau

SEQ ID NO: 183633 - RNA, 23 nt, Human
ggcugagaagucccaugauaggu

SEQ ID NO: 183634 - RNA, 18 nt, Human
cguuuuuccgggauugca

SEQ ID NO: 183635 - RNA, 22 nt, Human
auaaagcaauagauuguguaau

SEQ ID NO: 183636 - RNA, 22 nt, Human
caggaggguguggaaaacuggg

SEQ ID NO: 183637 - RNA, 22 nt, Human
augguuuaaagaguaugacuuu

SEQ ID NO: 183638 - RNA, 22 nt, Human
agcagcagcucuguugcccuac

SEQ ID NO: 183639 - RNA, 22 nt, Human
cuuuccuagauggccaucuuuc

SEQ ID NO: 183640 - RNA, 22 nt, Human
gagaaaaugucagacuuggucg

SEQ ID NO: 183641 - RNA, 22 nt, Human
aaucucagcucaugcaauucca

SEQ ID NO: 183642 - RNA, 22 nt, Human
cagcuggcagaaccugcaucca

SEQ ID NO: 183643 - RNA, 22 nt, Human
gcauguuuugcaacaagugacc

SEQ ID NO: 183644 - RNA, 22 nt, Human
ugcugggcacugucucugggga

SEQ ID NO: 183645 - RNA, 22 nt, Human
cuuacagcauuguucagaggcu

SEQ ID NO: 183646 - RNA, 22 nt, Human
ucaauguuuguucaugaaaaua

SEQ ID NO: 183647 - RNA, 22 nt, Human
cagagcugguaagugguagagg

SEQ ID NO: 183648 - RNA, 19 nt, Human
acaguuugggaaaugagca

SEQ ID NO: 183649 - RNA, 22 nt, Human
gaagccucaacaucucugcguc

SEQ ID NO: 183650 - RNA, 21 nt, Human
aaguuuuauguugccauuugu

SEQ ID NO: 183651 - RNA, 22 nt, Human
agucuggugcucgcucugcuuc

SEQ ID NO: 183652 - RNA, 22 nt, Human
aaaugucaaggugauagaugca

SEQ ID NO: 183653 - RNA, 22 nt, Human
cuauuuuucuguacccuaauuu

SEQ ID NO: 183654 - RNA, 22 nt, Human
cauuuuacugacucuugaauua

SEQ ID NO: 183655 - RNA, 22 nt, Human
guauuaggaggaacacaggccu

SEQ ID NO: 183656 - RNA, 17 nt, Human
augcaggugugaggggc

SEQ ID NO: 183657 - RNA, 22 nt, Human
cacagaggacuguagcggggag

SEQ ID NO: 183658 - RNA, 22 nt, Human
guaugaaaauuguaaaguucuu

SEQ ID NO: 183659 - RNA, 22 nt, Human
aggcucugccaauuccuuccuc

SEQ ID NO: 183660 - RNA, 22 nt, Human
auauauaucgaguucaugucuc

SEQ ID NO: 183661 - RNA, 22 nt, Human
gggaggaaugcaacuuauuuag

SEQ ID NO: 183662 - RNA, 22 nt, Human
cucauuuauguaaugauuaagg

SEQ ID NO: 183663 - RNA, 22 nt, Human
gcaagaacugcaauuacuuuug

SEQ ID NO: 183664 - RNA, 22 nt, Human
ccugucuuagggaaagacugga

SEQ ID NO: 183665 - RNA, 23 nt, Human
auauaaacaccagauagauugua

SEQ ID NO: 183666 - RNA, 22 nt, Human
ucaguggauuguagaaggcuua

SEQ ID NO: 183667 - RNA, 22 nt, Human
acucauguccuaggaguaaagc

SEQ ID NO: 183668 - RNA, 17 nt, Human
uguagcuucuccuucuc

SEQ ID NO: 183669 - RNA, 22 nt, Human
uugguuuaucuguggaucucuu

SEQ ID NO: 183670 - RNA, 22 nt, Human
agcagguggacagaggaagaaa

SEQ ID NO: 183671 - RNA, 22 nt, Human
cagccacuguggucuagcugca

SEQ ID NO: 183672 - RNA, 22 nt, Human
caugacccauuuuucuugcugu

SEQ ID NO: 183673 - RNA, 22 nt, Human
ucuucacaggagccugccugcc

SEQ ID NO: 183674 - RNA, 22 nt, Human
gugguacagcugaaaggcuugc

SEQ ID NO: 183675 - RNA, 19 nt, Human
cagaugagaaaagugaggu

SEQ ID NO: 183676 - RNA, 17 nt, Human
agccugggaaggaguga

SEQ ID NO: 183677 - RNA, 22 nt, Human
uuauucagauuggcuacaggau

SEQ ID NO: 183678 - RNA, 22 nt, Human
agagggcccauguugggcugcu

SEQ ID NO: 183679 - RNA, 22 nt, Human
cacagcagaaaguguaggagga

SEQ ID NO: 183680 - RNA, 23 nt, Human
gccuuggagaagucacucaggga

SEQ ID NO: 183681 - RNA, 22 nt, Human
ggucccaggaaucuguguucua

SEQ ID NO: 183682 - RNA, 22 nt, Human
ugcugaaacaauaacauacugg

SEQ ID NO: 183683 - RNA, 22 nt, Human
aggacccagaaggugcagcaga

SEQ ID NO: 183684 - RNA, 21 nt, Human
ccucuguaguuaaguuuccua

SEQ ID NO: 183685 - RNA, 22 nt, Human
gcagagugagauaugaacccag

SEQ ID NO: 183686 - RNA, 22 nt, Human
ugagcuggagucuguggcuccu

SEQ ID NO: 183687 - RNA, 20 nt, Human
gugguauucaguaacaguga

SEQ ID NO: 183688 - RNA, 17 nt, Human
cagguauuuaggcauug

SEQ ID NO: 183689 - RNA, 22 nt, Human
acaacaguaggaaaacaugucu

SEQ ID NO: 183690 - RNA, 22 nt, Human
cccugguucagguuucucugaa

SEQ ID NO: 183691 - RNA, 22 nt, Human
ccaggcuagagugcaguggcgu

SEQ ID NO: 183692 - RNA, 22 nt, Human
ugcagccccuaucgcggacagg

SEQ ID NO: 183693 - RNA, 22 nt, Human
uacagggauuguuuuaaucacc

SEQ ID NO: 183694 - RNA, 22 nt, Human
caggcccugggcaggaucagcc

SEQ ID NO: 183695 - RNA, 22 nt, Human
aacaugcugccuuucuacgagu

SEQ ID NO: 183696 - RNA, 22 nt, Human
ugucagcaugaacccugaauua

SEQ ID NO: 183697 - RNA, 22 nt, Human
guucuucagauuccauuucagu

SEQ ID NO: 183698 - RNA, 22 nt, Human
acaggcagcacuaaucucuggu

SEQ ID NO: 183699 - RNA, 23 nt, Human
agcagcuguggaguuuugcauuu

SEQ ID NO: 183700 - RNA, 22 nt, Human
uagaaacucacguuaucauugc

SEQ ID NO: 183701 - RNA, 22 nt, Human
aaagcaggguccaaggagaugu

SEQ ID NO: 183702 - RNA, 22 nt, Human
uauuucuugaguggucaguuuc

SEQ ID NO: 183703 - RNA, 22 nt, Human
uuccaugccucuauuuagaauu

SEQ ID NO: 183704 - RNA, 22 nt, Human
augcagcugugggcaagaaaug

SEQ ID NO: 183705 - RNA, 22 nt, Human
agugauuugcaguauuuacuaa

SEQ ID NO: 183706 - RNA, 22 nt, Human
aggaaccagacagaacugaaug

SEQ ID NO: 183707 - RNA, 22 nt, Human
uuuucuucuaccugcuguccaa

SEQ ID NO: 183708 - RNA, 22 nt, Human
uccucagauaccuggcagauca

SEQ ID NO: 183709 - RNA, 21 nt, Human
aguuugaugcaauuucugaga

SEQ ID NO: 183710 - RNA, 22 nt, Human
uggcagguagucagaggcgaca

SEQ ID NO: 183711 - RNA, 22 nt, Human
uuuaguuuuaacugaaagcuau

SEQ ID NO: 183712 - RNA, 22 nt, Human
uugcagagcaguaggaauauag

SEQ ID NO: 183713 - RNA, 22 nt, Human
gagguggcccuugcucagccuu

SEQ ID NO: 183714 - RNA, 21 nt, Human
aggaaaggccagcacguaggg

SEQ ID NO: 183715 - RNA, 22 nt, Human
caggaauaguggagcaacaaga

SEQ ID NO: 183716 - RNA, 22 nt, Human
aggcccagacucagcggggcgg

SEQ ID NO: 183717 - RNA, 22 nt, Human
ccugagcuagggaaggaagacc

SEQ ID NO: 183718 - RNA, 22 nt, Human
agcaacagaagauagagugaau

SEQ ID NO: 183719 - RNA, 17 nt, Human
acagagcacaucaagau

SEQ ID NO: 183720 - RNA, 22 nt, Human
gaaggccuaggaaggaagccuu

SEQ ID NO: 183721 - RNA, 22 nt, Human
uaugaacacacuuuggaaguga

SEQ ID NO: 183722 - RNA, 22 nt, Human
cuguccuuacugcuucuggcuu

SEQ ID NO: 183723 - RNA, 22 nt, Human
cuggcuuuaacccuacaaaccu

SEQ ID NO: 183724 - RNA, 22 nt, Human
uccuggugcugacacccauagc

SEQ ID NO: 183725 - RNA, 18 nt, Human
gcuggcuugcuggguuug

SEQ ID NO: 183726 - RNA, 22 nt, Human
ggagacagcaggaagaaauauc

SEQ ID NO: 183727 - RNA, 22 nt, Human
caggucccguuccccagagauu

SEQ ID NO: 183728 - RNA, 22 nt, Human
aggaggaaaaaggccacagcaa

SEQ ID NO: 183729 - RNA, 22 nt, Human
ccacugccuauuugcagggccc

SEQ ID NO: 183730 - RNA, 22 nt, Human
cagcugggcuaagaguagaggc

SEQ ID NO: 183731 - RNA, 23 nt, Human
ggagugugaagaccugauauagc

SEQ ID NO: 183732 - RNA, 22 nt, Human
ggagggagucagcugauuagaa

SEQ ID NO: 183733 - RNA, 22 nt, Human
accagcacggauuagaaugcuu

SEQ ID NO: 183734 - RNA, 22 nt, Human
ccuugagacacagccaaagaug

SEQ ID NO: 183735 - RNA, 22 nt, Human
ccugccagacgcaccagggggc

SEQ ID NO: 183736 - RNA, 22 nt, Human
uguguaaauuuauuuacauaaa

SEQ ID NO: 183737 - RNA, 22 nt, Human
ugauuacaauugucuuagauuu

SEQ ID NO: 183738 - RNA, 22 nt, Human
gauggcaggcaggugaguagag

SEQ ID NO: 183739 - RNA, 22 nt, Human
cccagagggaagggaaugaggu

SEQ ID NO: 183740 - RNA, 23 nt, Human
uuugaaguugacugccuuccaga

SEQ ID NO: 183741 - RNA, 22 nt, Human
uggcagggccugcucaucaucc

SEQ ID NO: 183742 - RNA, 22 nt, Human
gugaccauuugacauauccuug

SEQ ID NO: 183743 - RNA, 22 nt, Human
auucucagggaguauuuucuau

SEQ ID NO: 183744 - RNA, 22 nt, Human
ccucugggcugccugcacgggu

SEQ ID NO: 183745 - RNA, 22 nt, Human
agagcaauggcauccagcugau

SEQ ID NO: 183746 - RNA, 22 nt, Human
guacucaguaauauaacauauu

SEQ ID NO: 183747 - RNA, 22 nt, Human
uugccaggagacaaagugggcc

SEQ ID NO: 183748 - RNA, 22 nt, Human
uagcagcugcaucauuuuacag

SEQ ID NO: 183749 - RNA, 23 nt, Human
uccuccagaggcccuccuuggcc

SEQ ID NO: 183750 - RNA, 22 nt, Human
uacaguaccagaaaugcuaaga

SEQ ID NO: 183751 - RNA, 22 nt, Human
ccugggucuugguucaugcucu

SEQ ID NO: 183752 - RNA, 22 nt, Human
ucucugggaguugagcagcagc

SEQ ID NO: 183753 - RNA, 22 nt, Human
gaccuggccugcacagcccuua

SEQ ID NO: 183754 - RNA, 22 nt, Human
gaauauauuggugaaaauaguu

SEQ ID NO: 183755 - RNA, 22 nt, Human
ucacuuuacagcuaagguuguu

SEQ ID NO: 183756 - RNA, 20 nt, Human
ggccauggguugccugaggu

SEQ ID NO: 183757 - RNA, 22 nt, Human
aaggcauacauauuguuauagg

SEQ ID NO: 183758 - RNA, 22 nt, Human
aaggaaccuggaguagagggag

SEQ ID NO: 183759 - RNA, 22 nt, Human
aggccuccuggcuccaggccuu

SEQ ID NO: 183760 - RNA, 22 nt, Human
gccugugcuguucccucugcca

SEQ ID NO: 183761 - RNA, 22 nt, Human
aagggcuguuauguuuuuauac

SEQ ID NO: 183762 - RNA, 22 nt, Human
agaaguauuuggcuaaaagaca

SEQ ID NO: 183763 - RNA, 22 nt, Human
uugaggcagggcaugguggccc

SEQ ID NO: 183764 - RNA, 22 nt, Human
gccagccugugcuuggccaggc

SEQ ID NO: 183765 - RNA, 22 nt, Human
ugauagaagcagaagcauacca

SEQ ID NO: 183766 - RNA, 22 nt, Human
cagauuaguugugcuauggccu

SEQ ID NO: 183767 - RNA, 18 nt, Human
gcccugguggagcuggug

SEQ ID NO: 183768 - RNA, 22 nt, Human
uaagacagggucuauucuuagu

SEQ ID NO: 183769 - RNA, 22 nt, Human
uaaaacugcuugguauggucua

SEQ ID NO: 183770 - RNA, 22 nt, Human
caaaauugaugaauguaugauu

SEQ ID NO: 183771 - RNA, 22 nt, Human
cuggcacaacuccaccucagcg

SEQ ID NO: 183772 - RNA, 22 nt, Human
uccugggaacucggaaagcucu

SEQ ID NO: 183773 - RNA, 22 nt, Human
gcugagggggaaggaaagcuga

SEQ ID NO: 183774 - RNA, 22 nt, Human
ggaacugaggaacgaacuggga

SEQ ID NO: 183775 - RNA, 19 nt, Human
auguucuauccuccaaguu

SEQ ID NO: 183776 - RNA, 22 nt, Human
ccuuggcuugcacacggccacc

SEQ ID NO: 183777 - RNA, 15 nt, Human
gaggccaggcaugug

SEQ ID NO: 183778 - RNA, 22 nt, Human
aguagcagugacagcugaggua

SEQ ID NO: 183779 - RNA, 22 nt, Human
gggcuccagcagaggcagccgg

SEQ ID NO: 183780 - RNA, 20 nt, Human
ucacucugaugcuagggugg

SEQ ID NO: 183781 - RNA, 22 nt, Human
agaagauuauuagagacuuugu

SEQ ID NO: 183782 - RNA, 22 nt, Human
cucacaggguucuaucgaagag

SEQ ID NO: 183783 - RNA, 23 nt, Human
ggccucagcgcacagaaacugcu

SEQ ID NO: 183784 - RNA, 22 nt, Human
uagcugaauauaggcacaacag

SEQ ID NO: 183785 - RNA, 22 nt, Human
ggagaaugauauauagcucagu

SEQ ID NO: 183786 - RNA, 22 nt, Human
gaggacagagccgccuggcaag

SEQ ID NO: 183787 - RNA, 22 nt, Human
agacagugagaaugaguugaaa

SEQ ID NO: 183788 - RNA, 22 nt, Human
uuguacaacacauauucuacag

SEQ ID NO: 183789 - RNA, 19 nt, Human
gcccaggggcccgaugcug

SEQ ID NO: 183790 - RNA, 22 nt, Human
ccuggcuccugccucugcaggg

SEQ ID NO: 183791 - RNA, 23 nt, Human
uagagcagggaaaucugucagag

SEQ ID NO: 183792 - RNA, 22 nt, Human
cagcugucuggggagugcucgc

SEQ ID NO: 183793 - RNA, 22 nt, Human
aaauggauggaauugacauuua

SEQ ID NO: 183794 - RNA, 22 nt, Human
augguuuauuagcugcacaggc

SEQ ID NO: 183795 - RNA, 22 nt, Human
ggauguuuggcguuugaauugc

SEQ ID NO: 183796 - RNA, 22 nt, Human
auagggcaguggcaucucuuaa

SEQ ID NO: 183797 - RNA, 21 nt, Human
cugcuuccucucuucauggca

SEQ ID NO: 183798 - RNA, 22 nt, Human
cagggcuggcuguggcaaucuc

SEQ ID NO: 183799 - RNA, 22 nt, Human
auucuauagacagaaggucaau

SEQ ID NO: 183800 - RNA, 18 nt, Human
uggggggcuugucugaag

SEQ ID NO: 183801 - RNA, 22 nt, Human
cuucuggcaaucccagggucuu

SEQ ID NO: 183802 - RNA, 22 nt, Human
uguuccugaaugccuggcuggc

SEQ ID NO: 183803 - RNA, 22 nt, Human
caucauaauaacccagacacag

SEQ ID NO: 183804 - RNA, 22 nt, Human
ugugugcauguuaaugagaaaa

SEQ ID NO: 183805 - RNA, 22 nt, Human
ggcaaaguuuucaucucauaac

SEQ ID NO: 183806 - RNA, 22 nt, Human
uccagcccugcuuccugccuca

SEQ ID NO: 183807 - RNA, 22 nt, Human
ggucuggccucgggcaccccca

SEQ ID NO: 183808 - RNA, 22 nt, Human
ugcuuucugcucuggaaacagg

SEQ ID NO: 183809 - RNA, 19 nt, Human
cagcugcaccgugaccauc

SEQ ID NO: 183810 - RNA, 22 nt, Human
cucagccaugggguggaucagc

SEQ ID NO: 183811 - RNA, 19 nt, Human
gggcaguggcacuagggag

SEQ ID NO: 183812 - RNA, 22 nt, Human
acaagcgggccacagugcuggu

SEQ ID NO: 183813 - RNA, 22 nt, Human
uggagaugccuggagauuaggg

SEQ ID NO: 183814 - RNA, 22 nt, Human
gucuucaacaauaacuaccacu

SEQ ID NO: 183815 - RNA, 22 nt, Human
acugggcccagugguguggcug

SEQ ID NO: 183816 - RNA, 22 nt, Human
aggaagagcaucuuugggucug

SEQ ID NO: 183817 - RNA, 22 nt, Human
guagggcauguaagucaccaua

SEQ ID NO: 183818 - RNA, 22 nt, Human
aauguuuuauagcucaagcaau

SEQ ID NO: 183819 - RNA, 22 nt, Human
ucccugcuugcucucagcccuu

SEQ ID NO: 183820 - RNA, 22 nt, Human
gcagcucaaaggccacggacgg

SEQ ID NO: 183821 - RNA, 22 nt, Human
gucuuucucuggaacaguaaaa

SEQ ID NO: 183822 - RNA, 22 nt, Human
gagaaaaucuugggucaagaau

SEQ ID NO: 183823 - RNA, 22 nt, Human
cccagagcugauuguuggagcc

SEQ ID NO: 183824 - RNA, 22 nt, Human
agaaucaggaccuguggcuguc

SEQ ID NO: 183825 - RNA, 22 nt, Human
cuguccauggugcuggacgguc

SEQ ID NO: 183826 - RNA, 22 nt, Human
gaggccagaugucaugucuuau

SEQ ID NO: 183827 - RNA, 21 nt, Human
gauuuuaaagagacugccaca

SEQ ID NO: 183828 - RNA, 23 nt, Human
auccacauuacaguaucauacaa

SEQ ID NO: 183829 - RNA, 22 nt, Human
ggagccugacagugcccagcau

SEQ ID NO: 183830 - RNA, 22 nt, Human
uaucuguauccccaucuagcua

SEQ ID NO: 183831 - RNA, 22 nt, Human
gcccuucaguuacuccuugaug

SEQ ID NO: 183832 - RNA, 22 nt, Human
cuacaugaaaauaaguuugaaa

SEQ ID NO: 183833 - RNA, 22 nt, Human
aauuccaagagcuuccuaagug

SEQ ID NO: 183834 - RNA, 22 nt, Human
gugucuuuugaggcugaccagu

SEQ ID NO: 183835 - RNA, 22 nt, Human
augcacccagugucuggacuau

SEQ ID NO: 183836 - RNA, 22 nt, Human
gaugauuccuuuguucauugug

SEQ ID NO: 183837 - RNA, 23 nt, Human
uggucugaagccucagguuccuc

SEQ ID NO: 183838 - RNA, 22 nt, Human
cuuguauucuuguaccuuucaa

SEQ ID NO: 183839 - RNA, 23 nt, Human
caggagauggcugcugugucagc

SEQ ID NO: 183840 - RNA, 22 nt, Human
gguccagggaacuuugaaggau

SEQ ID NO: 183841 - RNA, 20 nt, Human
caccuucaaauuuccuggca

SEQ ID NO: 183842 - RNA, 22 nt, Human
acaugcuguccugucuuuguca

SEQ ID NO: 183843 - RNA, 22 nt, Human
cugcaucuuagucaaaaucugu

SEQ ID NO: 183844 - RNA, 22 nt, Human
gcacccagggacuuggcuggcc

SEQ ID NO: 183845 - RNA, 22 nt, Human
guagcaacuguagcccaaauuc

SEQ ID NO: 183846 - RNA, 21 nt, Human
cucaaaugccaguuuuauuua

SEQ ID NO: 183847 - RNA, 21 nt, Human
ugucugauguauuuuuugccu

SEQ ID NO: 183848 - RNA, 22 nt, Human
ugagcccugaggaucuguucgg

SEQ ID NO: 183849 - RNA, 22 nt, Human
ggccucgcggcuucugguggcu

SEQ ID NO: 183850 - RNA, 22 nt, Human
uccacaggcaagucucuuggca

SEQ ID NO: 183851 - RNA, 22 nt, Human
acugggccugauugggucggag

SEQ ID NO: 183852 - RNA, 22 nt, Human
cugcaggguucggagaguuccc

SEQ ID NO: 183853 - RNA, 22 nt, Human
cagcuucuccagaugacccuca

SEQ ID NO: 183854 - RNA, 22 nt, Human
uggcuugguaaggaccagcagg

SEQ ID NO: 183855 - RNA, 22 nt, Human
uccaggucaucuuggagagcug

SEQ ID NO: 183856 - RNA, 22 nt, Human
cagggcucccucuggcucccag

SEQ ID NO: 183857 - RNA, 22 nt, Human
aggaugagccgcgcaagcugac

SEQ ID NO: 183858 - RNA, 22 nt, Human
agagugggccuagcuguaaaag

SEQ ID NO: 183859 - RNA, 22 nt, Human
uucuaaaaccaauucugcuucu

SEQ ID NO: 183860 - RNA, 22 nt, Human
aaaguaguuagucaugugaaaa

SEQ ID NO: 183861 - RNA, 22 nt, Human
uguguguguuuacaguuucuca

SEQ ID NO: 183862 - RNA, 22 nt, Human
cucccugaguuuguggcuaagu

SEQ ID NO: 183863 - RNA, 21 nt, Human
ccucagucucccugcuccacu

SEQ ID NO: 183864 - RNA, 22 nt, Human
ccaaggacuggacacacagguu

SEQ ID NO: 183865 - RNA, 18 nt, Human
gguggcucagucaugggg

SEQ ID NO: 183866 - RNA, 22 nt, Human
ccagcccugucaccaacuggag

SEQ ID NO: 183867 - RNA, 22 nt, Human
ggccagcugggccaccaggugc

SEQ ID NO: 183868 - RNA, 22 nt, Human
acagauuauggauauaugugga

SEQ ID NO: 183869 - RNA, 22 nt, Human
ugcagugguugagagcccagac

SEQ ID NO: 183870 - RNA, 22 nt, Human
uggauaaaacguucugaaaaac

SEQ ID NO: 183871 - RNA, 22 nt, Human
caagauaauuuauucugaguuu

SEQ ID NO: 183872 - RNA, 22 nt, Human
agcugggaugaggagcauccuu

SEQ ID NO: 183873 - RNA, 22 nt, Human
ggaagacugcauggcauaguga

SEQ ID NO: 183874 - RNA, 22 nt, Human
ugcuuuauucccuucugaugug

SEQ ID NO: 183875 - RNA, 22 nt, Human
augguuuacugaucuuuuuggu

SEQ ID NO: 183876 - RNA, 20 nt, Human
ggccuuagggagggcuguaa

SEQ ID NO: 183877 - RNA, 22 nt, Human
uccaggccaggguaagaggaga

SEQ ID NO: 183878 - RNA, 22 nt, Human
ucagggaggugucugccagaga

SEQ ID NO: 183879 - RNA, 22 nt, Human
agaaucaauuagauucuaugag

SEQ ID NO: 183880 - RNA, 22 nt, Human
ugacaauucauuauaucuacag

SEQ ID NO: 183881 - RNA, 22 nt, Human
ugagacgaagucuugcucuguu

SEQ ID NO: 183882 - RNA, 22 nt, Human
ucccagagccaagcuauggaug

SEQ ID NO: 183883 - RNA, 20 nt, Human
cucuccucacccgugucagg

SEQ ID NO: 183884 - RNA, 22 nt, Human
auauuuucacagaacuugcaaa

SEQ ID NO: 183885 - RNA, 22 nt, Human
gcuguggcggcagcagcuggug

SEQ ID NO: 183886 - RNA, 22 nt, Human
aacugaggccaagugaggaaag

SEQ ID NO: 183887 - RNA, 22 nt, Human
uugggccugggguagugucgga

SEQ ID NO: 183888 - RNA, 22 nt, Human
uuguauuucuccacuuucuguu

SEQ ID NO: 183889 - RNA, 22 nt, Human
cccagacagugauuuacuuaau

SEQ ID NO: 183890 - RNA, 20 nt, Human
cagaggcauuuucagacucu

SEQ ID NO: 183891 - RNA, 23 nt, Human
augcaacauugccaguaugggca

SEQ ID NO: 183892 - RNA, 22 nt, Human
aagggacccuggaucaaaugga

SEQ ID NO: 183893 - RNA, 23 nt, Human
ucugaaagggaugcugggcagga

SEQ ID NO: 183894 - RNA, 22 nt, Human
cuccaggagggggauggcugua

SEQ ID NO: 183895 - RNA, 22 nt, Human
ugagcagaaaagaaugcugagc

SEQ ID NO: 183896 - RNA, 21 nt, Human
caggcucugcugggugcuggg

SEQ ID NO: 183897 - RNA, 22 nt, Human
agcugcugcccauaggugacau

SEQ ID NO: 183898 - RNA, 22 nt, Human
uucauguauuuaucauguaaau

SEQ ID NO: 183899 - RNA, 22 nt, Human
caggaagauuguggaggugguu

SEQ ID NO: 183900 - RNA, 22 nt, Human
uucuguggguaauaccucauac

SEQ ID NO: 183901 - RNA, 20 nt, Human
uggcuccagccuccccuacc

SEQ ID NO: 183902 - RNA, 22 nt, Human
gccaggaauuucaagagccacu

SEQ ID NO: 183903 - RNA, 22 nt, Human
aggggaauggguagacuguuga

SEQ ID NO: 183904 - RNA, 22 nt, Human
aauaucugucucuaaugcauau

SEQ ID NO: 183905 - RNA, 22 nt, Human
cagugcugggcagaggagagcg

SEQ ID NO: 183906 - RNA, 22 nt, Human
auagcaaaacccacugcauuac

SEQ ID NO: 183907 - RNA, 22 nt, Human
ugcagagauccuggacugagcg

SEQ ID NO: 183908 - RNA, 22 nt, Human
cuggccugcugggugagguccu

SEQ ID NO: 183909 - RNA, 22 nt, Human
gcaaaaaaugcuuguugcuuag

SEQ ID NO: 183910 - RNA, 20 nt, Human
ucccuccugcagauagagaa

SEQ ID NO: 183911 - RNA, 22 nt, Human
aaacuuuuuauucuaaugucua

SEQ ID NO: 183912 - RNA, 22 nt, Human
acauauuuugaaagcuuucuaa

SEQ ID NO: 183913 - RNA, 22 nt, Human
ucaucucuagacaggaggcugg

SEQ ID NO: 183914 - RNA, 22 nt, Human
acagagagaaacaaucagcagc

SEQ ID NO: 183915 - RNA, 22 nt, Human
gaggucuucacaaagaacagca

SEQ ID NO: 183916 - RNA, 21 nt, Human
aggaggggucuuucccacuga

SEQ ID NO: 183917 - RNA, 22 nt, Human
uuguuucagcccagaucuuuac

SEQ ID NO: 183918 - RNA, 22 nt, Human
aagaaucucucuacuuuauuac

SEQ ID NO: 183919 - RNA, 22 nt, Human
uugaagagaaucagaagguuga

SEQ ID NO: 183920 - RNA, 22 nt, Human
aggcuccagcccaaggcugcag

SEQ ID NO: 183921 - RNA, 22 nt, Human
ccagacccuuucuuggcaugug

SEQ ID NO: 183922 - RNA, 22 nt, Human
ucugggcagccaugugccuggc

SEQ ID NO: 183923 - RNA, 22 nt, Human
uuucucugggcuguuggcagcc

SEQ ID NO: 183924 - RNA, 22 nt, Human
aggaauguggaagguggcggcg

SEQ ID NO: 183925 - RNA, 22 nt, Human
agagucugaugucaacaguucu

SEQ ID NO: 183926 - RNA, 22 nt, Human
uggaaaacauugagauaccaag

SEQ ID NO: 183927 - RNA, 22 nt, Human
gucugcagacaacuuagaagca

SEQ ID NO: 183928 - RNA, 22 nt, Human
gaaagcauguagccuguaucca

SEQ ID NO: 183929 - RNA, 18 nt, Human
ucacagaauauugagugg

SEQ ID NO: 183930 - RNA, 19 nt, Human
gcaggugugaauccguaga

SEQ ID NO: 183931 - RNA, 19 nt, Human
uuccuggcucuucuguuuu

SEQ ID NO: 183932 - RNA, 22 nt, Human
ucugagaacuccggguuagauc

SEQ ID NO: 183933 - RNA, 23 nt, Human
ucacaggggccagcgcucugugg

SEQ ID NO: 183934 - RNA, 22 nt, Human
cuguggccuuggaccagcaucu

SEQ ID NO: 183935 - RNA, 22 nt, Human
agcugggugaaggcagauggcu

SEQ ID NO: 183936 - RNA, 22 nt, Human
cagcuagcuucccugcagugcu

SEQ ID NO: 183937 - RNA, 22 nt, Human
acaguggaagcaugaugcuauc

SEQ ID NO: 183938 - RNA, 22 nt, Human
ucaaagcagcacauucgcaagc

SEQ ID NO: 183939 - RNA, 19 nt, Human
ucuuucauuucuagcucug

SEQ ID NO: 183940 - RNA, 22 nt, Human
cugaagcagauguggcugagau

SEQ ID NO: 183941 - RNA, 22 nt, Human
ugcaaauuuaaugaaacuaugu

SEQ ID NO: 183942 - RNA, 22 nt, Human
aaagucaguuggccagaucacu

SEQ ID NO: 183943 - RNA, 18 nt, Human
auggucucauacugggag

SEQ ID NO: 183944 - RNA, 22 nt, Human
uuccuuguaagaccuauuuuug

SEQ ID NO: 183945 - RNA, 19 nt, Human
cagauguuuucaguucauu

SEQ ID NO: 183946 - RNA, 22 nt, Human
gcuggcaggguucucacugaaa

SEQ ID NO: 183947 - RNA, 22 nt, Human
acccaggcuggagugcaguguc

SEQ ID NO: 183948 - RNA, 22 nt, Human
acugaaguccacacauguagga

SEQ ID NO: 183949 - RNA, 22 nt, Human
aagauguuauugucuuccuugc

SEQ ID NO: 183950 - RNA, 22 nt, Human
ucccucagggugcaguugcuuu

SEQ ID NO: 183951 - RNA, 22 nt, Human
uccuggccuugcgucuugggag

SEQ ID NO: 183952 - RNA, 22 nt, Human
cacagggcuuugauggcugagu

SEQ ID NO: 183953 - RNA, 22 nt, Human
ugcucuguccagugcaccauca

SEQ ID NO: 183954 - RNA, 22 nt, Human
uccugcccagagcucuccacuc

SEQ ID NO: 183955 - RNA, 22 nt, Human
aggcuccucggggcugacggcg

SEQ ID NO: 183956 - RNA, 22 nt, Human
uucucaggugaggcugaggcug

SEQ ID NO: 183957 - RNA, 22 nt, Human
gaaauuaagcaggggucugugg

SEQ ID NO: 183958 - RNA, 22 nt, Human
agugcucacucuccacagugcc

SEQ ID NO: 183959 - RNA, 22 nt, Human
aggaagcaguuuauaaugcauu

SEQ ID NO: 183960 - RNA, 22 nt, Human
ugucucugcuuuccuugcaggg

SEQ ID NO: 183961 - RNA, 22 nt, Human
ccugccuggcugucagcagagc

SEQ ID NO: 183962 - RNA, 22 nt, Human
agugucugcuuugagucaggug

SEQ ID NO: 183963 - RNA, 19 nt, Human
gacucacaccuuccgcugu

SEQ ID NO: 183964 - RNA, 22 nt, Human
cugaggacauugaugaggcaau

SEQ ID NO: 183965 - RNA, 22 nt, Human
uuccaagugaaaguagcuuugu

SEQ ID NO: 183966 - RNA, 22 nt, Human
gagaggcuccgccacugcucag

SEQ ID NO: 183967 - RNA, 22 nt, Human
cuggcaggaaguuagaugguaa

SEQ ID NO: 183968 - RNA, 22 nt, Human
auauauuacaaaagaggaagga

SEQ ID NO: 183969 - RNA, 22 nt, Human
caccauaaaaauaagagaugcc

SEQ ID NO: 183970 - RNA, 22 nt, Human
caaguauuugcggaguuccacg

SEQ ID NO: 183971 - RNA, 22 nt, Human
gcugucugcaucucuagagcuu

SEQ ID NO: 183972 - RNA, 22 nt, Human
uuagaaaggagcuuauuucuuu

SEQ ID NO: 183973 - RNA, 22 nt, Human
ccauuguaaagaguauacuuug

SEQ ID NO: 183974 - RNA, 22 nt, Human
accuugucuuuuauagaacaag

SEQ ID NO: 183975 - RNA, 22 nt, Human
acacuguucuuugcacugagaa

SEQ ID NO: 183976 - RNA, 22 nt, Human
ucacaacaggaaggaccagcug

SEQ ID NO: 183977 - RNA, 22 nt, Human
ucaugaauauugaaugcuucau

SEQ ID NO: 183978 - RNA, 22 nt, Human
uggaaagacauucagccgcugg

SEQ ID NO: 183979 - RNA, 22 nt, Human
aguaaagcagaguugcaguaca

SEQ ID NO: 183980 - RNA, 22 nt, Human
aguuacauauaagaagacagac

SEQ ID NO: 183981 - RNA, 22 nt, Human
agcagggcuucugugccugugc

SEQ ID NO: 183982 - RNA, 22 nt, Human
aucauuugaacagaauuuguuu

SEQ ID NO: 183983 - RNA, 22 nt, Human
ccagcugucugguuccagagcc

SEQ ID NO: 183984 - RNA, 22 nt, Human
cuggagcugccagggcugccgc

SEQ ID NO: 183985 - RNA, 22 nt, Human
cgugagcaaaauggacacuccc

SEQ ID NO: 183986 - RNA, 22 nt, Human
ggcuguggcauuaggugaggcc

SEQ ID NO: 183987 - RNA, 22 nt, Human
uugggaaacaguauagcuaaca

SEQ ID NO: 183988 - RNA, 22 nt, Human
agcugugggccugggagagcug

SEQ ID NO: 183989 - RNA, 22 nt, Human
uugcauuccaugguuuuccuuc

SEQ ID NO: 183990 - RNA, 22 nt, Human
guccuggggauuauagaguguu

SEQ ID NO: 183991 - RNA, 20 nt, Human
cagagcuaucccuuuauuua

SEQ ID NO: 183992 - RNA, 22 nt, Human
ucagggcaggacaguguaggcc

SEQ ID NO: 183993 - RNA, 22 nt, Human
cauaaauucaguucugccucuu

SEQ ID NO: 183994 - RNA, 22 nt, Human
ugaggccugucauugucuuguu

SEQ ID NO: 183995 - RNA, 22 nt, Human
gugacccagguagguaagcaau

SEQ ID NO: 183996 - RNA, 22 nt, Human
cacugggcaauucugagccuaa

SEQ ID NO: 183997 - RNA, 22 nt, Human
agauuuacuggagucuuuggug

SEQ ID NO: 183998 - RNA, 22 nt, Human
acuuucuucuacuacuuggaga

SEQ ID NO: 183999 - RNA, 22 nt, Human
uuuguaaauagcaguacucaug

SEQ ID NO: 184000 - RNA, 19 nt, Human
cuggcuucaagcaguccuc

SEQ ID NO: 184001 - RNA, 22 nt, Human
cuccugggucauugccagcaaa

SEQ ID NO: 184002 - RNA, 22 nt, Human
acagcagguagcuuugugccuc

SEQ ID NO: 184003 - RNA, 22 nt, Human
aacugguaucucuucaguguaa

SEQ ID NO: 184004 - RNA, 22 nt, Human
augugcaaaguaaaguaauuuu

SEQ ID NO: 184005 - RNA, 22 nt, Human
uuucacauuuguuuuaagaagu

SEQ ID NO: 184006 - RNA, 18 nt, Human
auaauaggagauaaaaau

SEQ ID NO: 184007 - RNA, 21 nt, Human
agcaccaguuuuaugccaggc

SEQ ID NO: 184008 - RNA, 22 nt, Human
uccugggccaagggcugugagg

SEQ ID NO: 184009 - RNA, 22 nt, Human
uuacaaagagaaguuguagaau

SEQ ID NO: 184010 - RNA, 22 nt, Human
aguuuauucugcuuggcccucc

SEQ ID NO: 184011 - RNA, 22 nt, Human
ucuggcucacuucaggcuucac

SEQ ID NO: 184012 - RNA, 22 nt, Human
aaguacauguuguucaaaagcc

SEQ ID NO: 184013 - RNA, 22 nt, Human
gauggccuggguccccuuccgg

SEQ ID NO: 184014 - RNA, 22 nt, Human
gaacuauaucuucaagaaaaug

SEQ ID NO: 184015 - RNA, 22 nt, Human
uuagaaucuuuagagucucacu

SEQ ID NO: 184016 - RNA, 22 nt, Human
uucuuuccucccagccuuugga

SEQ ID NO: 184017 - RNA, 22 nt, Human
auaauggauucagaaccgucaa

SEQ ID NO: 184018 - RNA, 22 nt, Human
aagcagggcucccuggggacuc

SEQ ID NO: 184019 - RNA, 22 nt, Human
ggccagguggcuguccuggcgu

SEQ ID NO: 184020 - RNA, 22 nt, Human
agguggggcugggaaagauucc

SEQ ID NO: 184021 - RNA, 22 nt, Human
acagauggcaccuuuuugcugu

SEQ ID NO: 184022 - RNA, 19 nt, Human
aagcauggugccucaccuc

SEQ ID NO: 184023 - RNA, 22 nt, Human
aguuucuugaagacugauguuu

SEQ ID NO: 184024 - RNA, 22 nt, Human
acagaauacuacagacugguua

SEQ ID NO: 184025 - RNA, 17 nt, Human
ucuccuggcucuaucag

SEQ ID NO: 184026 - RNA, 19 nt, Human
aagaagcaauaagcuguga

SEQ ID NO: 184027 - RNA, 22 nt, Human
uacaugcaauuaagagggugaa

SEQ ID NO: 184028 - RNA, 22 nt, Human
ugcuucucccaaccagggccug

SEQ ID NO: 184029 - RNA, 22 nt, Human
ucugggaacgaaggcuaauaug

SEQ ID NO: 184030 - RNA, 18 nt, Human
gaugaggcugucugagaa

SEQ ID NO: 184031 - RNA, 22 nt, Human
uaauacuugucauaaaggcauu

SEQ ID NO: 184032 - RNA, 22 nt, Human
cugaggccuaagacaugaauga

SEQ ID NO: 184033 - RNA, 22 nt, Human
uagcaaaggccuuggacacgcu

SEQ ID NO: 184034 - RNA, 22 nt, Human
uccuggcccuguggccugcagu

SEQ ID NO: 184035 - RNA, 22 nt, Human
gagaaucuuuccccacagaagg

SEQ ID NO: 184036 - RNA, 22 nt, Human
ccaggauggggagcagauagaa

SEQ ID NO: 184037 - RNA, 22 nt, Human
ucugaaagcauaauuuguccca

SEQ ID NO: 184038 - RNA, 23 nt, Human
aucucucugguggucacagucag

SEQ ID NO: 184039 - RNA, 19 nt, Human
gccagcagaaugaugaggc

SEQ ID NO: 184040 - RNA, 22 nt, Human
ccuccuagaggaaccccagggc

SEQ ID NO: 184041 - RNA, 20 nt, Human
uuagaaguggcuauuuccuc

SEQ ID NO: 184042 - RNA, 22 nt, Human
uaacugguccucggauguugug

SEQ ID NO: 184043 - RNA, 22 nt, Human
uauuuaaaauagugcuccagca

SEQ ID NO: 184044 - RNA, 20 nt, Human
cccugcagccaugggagugg

SEQ ID NO: 184045 - RNA, 22 nt, Human
gucccuggaauggacucugcgc

SEQ ID NO: 184046 - RNA, 22 nt, Human
ugccugccaggcaaccugggag

SEQ ID NO: 184047 - RNA, 22 nt, Human
gacaucugaggcccucagagcc

SEQ ID NO: 184048 - RNA, 22 nt, Human
caagauuuguauugggccucug

SEQ ID NO: 184049 - RNA, 22 nt, Human
gccagagcuucccccgagugug

SEQ ID NO: 184050 - RNA, 22 nt, Human
cuuugcauucucagcacagagc

SEQ ID NO: 184051 - RNA, 23 nt, Human
ugcugcccacucuuccagcccuc

SEQ ID NO: 184052 - RNA, 22 nt, Human
aaagacagauggcaaggaugau

SEQ ID NO: 184053 - RNA, 22 nt, Human
caggcuugcugcuagagcacuu

SEQ ID NO: 184054 - RNA, 19 nt, Human
auuuggaaauaaggucuuc

SEQ ID NO: 184055 - RNA, 22 nt, Human
ucagaggcuugaagcccaagcc

SEQ ID NO: 184056 - RNA, 20 nt, Human
ccugcugugcuuuccaugga

SEQ ID NO: 184057 - RNA, 22 nt, Human
uggcaggagguuuucuccagga

SEQ ID NO: 184058 - RNA, 23 nt, Human
ugucuccaucucauuacuugggg

SEQ ID NO: 184059 - RNA, 22 nt, Human
auccugggaagcugacauugaa

SEQ ID NO: 184060 - RNA, 22 nt, Human
gaaccugcuuccuuuuauauua

SEQ ID NO: 184061 - RNA, 22 nt, Human
ggaccaggggcgcacucccugc

SEQ ID NO: 184062 - RNA, 22 nt, Human
ccagaagaggacacagugugga

SEQ ID NO: 184063 - RNA, 22 nt, Human
aucuaagaggaugguuggaaau

SEQ ID NO: 184064 - RNA, 23 nt, Human
ucucugugugccucaguuucuuc

SEQ ID NO: 184065 - RNA, 22 nt, Human
cacugguguauuagagcuagaa

SEQ ID NO: 184066 - RNA, 22 nt, Human
ccccacccucgcuccauuucgg

SEQ ID NO: 184067 - RNA, 22 nt, Human
cauguaaagcauccuucuaggg

SEQ ID NO: 184068 - RNA, 22 nt, Human
gcuggccaaaguguaccuggag

SEQ ID NO: 184069 - RNA, 22 nt, Human
aaacuugaggcaaugaaggugu

SEQ ID NO: 184070 - RNA, 22 nt, Human
uaacauugucaguucaacugcu

SEQ ID NO: 184071 - RNA, 22 nt, Human
gcaggcugaugacuggaguugg

SEQ ID NO: 184072 - RNA, 22 nt, Human
aaggguugcaaggucagaggaa

SEQ ID NO: 184073 - RNA, 22 nt, Human
aaaaguauuuuggaucucagau

SEQ ID NO: 184074 - RNA, 22 nt, Human
aguuauauaacuaucuagaugc

SEQ ID NO: 184075 - RNA, 22 nt, Human
uuagaaccacugaagacucaca

SEQ ID NO: 184076 - RNA, 22 nt, Human
aauuucuccaagaaugcuuaga

SEQ ID NO: 184077 - RNA, 22 nt, Human
ucuggcaggguguguauuuaca

SEQ ID NO: 184078 - RNA, 22 nt, Human
ugcuggcuuugcgagaugcauu

SEQ ID NO: 184079 - RNA, 22 nt, Human
auacaaaaauuagccgggagua

SEQ ID NO: 184080 - RNA, 22 nt, Human
gucaggucuuggaagauaggcu

SEQ ID NO: 184081 - RNA, 22 nt, Human
uccuggccacccgacagaaguc

SEQ ID NO: 184082 - RNA, 22 nt, Human
cagaugcuaaguuaucagcagg

SEQ ID NO: 184083 - RNA, 22 nt, Human
gcucugggcugcccucuggaca

SEQ ID NO: 184084 - RNA, 21 nt, Human
uuuguucaggcaaguuacagu

SEQ ID NO: 184085 - RNA, 22 nt, Human
acccugggucauauacagugug

SEQ ID NO: 184086 - RNA, 22 nt, Human
aaauugauguucccaguugaaa

SEQ ID NO: 184087 - RNA, 22 nt, Human
guguguccacacauacauacau

SEQ ID NO: 184088 - RNA, 22 nt, Human
cccuucaagcucucuggguuuu

SEQ ID NO: 184089 - RNA, 22 nt, Human
uuagcgcacaucacagggggaa

SEQ ID NO: 184090 - RNA, 22 nt, Human
gcucaggcaccauaugaugugu

SEQ ID NO: 184091 - RNA, 22 nt, Human
gcuucugucuuagcuaccuccc

SEQ ID NO: 184092 - RNA, 22 nt, Human
ccagaagacaagaauguucuua

SEQ ID NO: 184093 - RNA, 19 nt, Human
cuaaacuuaugugaccaca

SEQ ID NO: 184094 - RNA, 22 nt, Human
auggccucuagcugagaccaau

SEQ ID NO: 184095 - RNA, 22 nt, Human
cacacuugugaccgauauaaug

SEQ ID NO: 184096 - RNA, 22 nt, Human
ugcagggcaucuuugaagugug

SEQ ID NO: 184097 - RNA, 22 nt, Human
acucagagccucgagggacugc

SEQ ID NO: 184098 - RNA, 22 nt, Human
aacaugaaaguugcuaagugca

SEQ ID NO: 184099 - RNA, 22 nt, Human
aguguacauguuuacagcaucu

SEQ ID NO: 184100 - RNA, 22 nt, Human
uuguacaaagauuucacagcuc

SEQ ID NO: 184101 - RNA, 22 nt, Human
gccuuguuucauuacacguggu

SEQ ID NO: 184102 - RNA, 22 nt, Human
agguaaacaggagaaaaugaga

SEQ ID NO: 184103 - RNA, 22 nt, Human
gcucuagcuggcgcugaccugg

SEQ ID NO: 184104 - RNA, 22 nt, Human
gugaggcauugaagaccggaau

SEQ ID NO: 184105 - RNA, 22 nt, Human
ugccugaagcugcauuccuagu

SEQ ID NO: 184106 - RNA, 22 nt, Human
uuuugaaagccagguuuguaug

SEQ ID NO: 184107 - RNA, 20 nt, Human
ggaccagcugucugaggggc

SEQ ID NO: 184108 - RNA, 22 nt, Human
cagcccugccauggagccuccu

SEQ ID NO: 184109 - RNA, 22 nt, Human
ggaggccaagucacugaccugg

SEQ ID NO: 184110 - RNA, 22 nt, Human
cuugccugaggaacagagggua

SEQ ID NO: 184111 - RNA, 22 nt, Human
guagcuucaaguacucucccug

SEQ ID NO: 184112 - RNA, 22 nt, Human
guccugguuuucacagaccuuu

SEQ ID NO: 184113 - RNA, 22 nt, Human
uuugggaacucuaucauggaaa

SEQ ID NO: 184114 - RNA, 22 nt, Human
accuggcauaagggcuugaguc

SEQ ID NO: 184115 - RNA, 22 nt, Human
cacauuucuggaauugacuugg

SEQ ID NO: 184116 - RNA, 22 nt, Human
gcagagcuucuguccuucagga

SEQ ID NO: 184117 - RNA, 22 nt, Human
agaaagcccacccagaagaugu

SEQ ID NO: 184118 - RNA, 22 nt, Human
cuccagggagcuuggaaagacc

SEQ ID NO: 184119 - RNA, 22 nt, Human
caauguaucaaccagaaaguuc

SEQ ID NO: 184120 - RNA, 22 nt, Human
cuggcuuuaaaaugcuccugga

SEQ ID NO: 184121 - RNA, 22 nt, Human
augcuguguuuuaaauggaaau

SEQ ID NO: 184122 - RNA, 19 nt, Human
uaggccagaaguuuuccac

SEQ ID NO: 184123 - RNA, 22 nt, Human
ugggccaggucugugucagcug

SEQ ID NO: 184124 - RNA, 22 nt, Human
cuccugggggacagcggcaggg

SEQ ID NO: 184125 - RNA, 22 nt, Human
gggcagagagcuggaacuccuu

SEQ ID NO: 184126 - RNA, 22 nt, Human
uccugugagcagcacagagaca

SEQ ID NO: 184127 - RNA, 22 nt, Human
uuuggucaggguaggacaguug

SEQ ID NO: 184128 - RNA, 23 nt, Human
ugagaagccauuagagcaggugg

SEQ ID NO: 184129 - RNA, 22 nt, Human
uuaccaagcucugcauguuaag

SEQ ID NO: 184130 - RNA, 22 nt, Human
cugucaaagacuaagguucuua

SEQ ID NO: 184131 - RNA, 22 nt, Human
acuggguguauuagugguguuu

SEQ ID NO: 184132 - RNA, 22 nt, Human
uugaggaggacagaaacauuua

SEQ ID NO: 184133 - RNA, 22 nt, Human
uccauacauugaaauaccauuc

SEQ ID NO: 184134 - RNA, 22 nt, Human
ccaggcccugcuccucacacca

SEQ ID NO: 184135 - RNA, 22 nt, Human
gccaggcucuugguuauguuuu

SEQ ID NO: 184136 - RNA, 22 nt, Human
cagcuuccaucuccacugcccu

SEQ ID NO: 184137 - RNA, 23 nt, Human
ucugugccaguuuccaugucugu

SEQ ID NO: 184138 - RNA, 22 nt, Human
cuaucucuuguuuuccugaagc

SEQ ID NO: 184139 - RNA, 22 nt, Human
cugccucucaggucccugagau

SEQ ID NO: 184140 - RNA, 22 nt, Human
uccugggcuuaagugauccucc

SEQ ID NO: 184141 - RNA, 22 nt, Human
cugggcuuguguuagcugacaa

SEQ ID NO: 184142 - RNA, 22 nt, Human
auuuggcuaccaugaggauggg

SEQ ID NO: 184143 - RNA, 22 nt, Human
ggcuuggaccagucacaguggu

SEQ ID NO: 184144 - RNA, 22 nt, Human
ugacaagagaccccuccgcagg

SEQ ID NO: 184145 - RNA, 22 nt, Human
auggauaaauacuuggugguau

SEQ ID NO: 184146 - RNA, 22 nt, Human
ucccugccaaugauuggagcaa

SEQ ID NO: 184147 - RNA, 22 nt, Human
guccucuggaagaugaguucuu

SEQ ID NO: 184148 - RNA, 22 nt, Human
aggcugagcaaagggccuuacc

SEQ ID NO: 184149 - RNA, 22 nt, Human
uaaaaaguugaaaggacuuauc

SEQ ID NO: 184150 - RNA, 22 nt, Human
acagcaggcccauacuggaagg

SEQ ID NO: 184151 - RNA, 22 nt, Human
aaacuagaaaucagcaagauag

SEQ ID NO: 184152 - RNA, 22 nt, Human
agaaacuauuaugguaaacaaa

SEQ ID NO: 184153 - RNA, 22 nt, Human
uucugcaucugaauuuaaguac

SEQ ID NO: 184154 - RNA, 22 nt, Human
uagauuugauguaagcauaguc

SEQ ID NO: 184155 - RNA, 22 nt, Human
ugaaacauugcacuguaugaau

SEQ ID NO: 184156 - RNA, 22 nt, Human
aguggcuguuccaggugaggac

SEQ ID NO: 184157 - RNA, 22 nt, Human
augucuguacgaguuacaaugg

SEQ ID NO: 184158 - RNA, 22 nt, Human
ccaggaaccgaugaucagaggg

SEQ ID NO: 184159 - RNA, 21 nt, Human
agccugaaucccaccaguuca

SEQ ID NO: 184160 - RNA, 20 nt, Human
cuaaacucugcagauuuagu

SEQ ID NO: 184161 - RNA, 22 nt, Human
ucugcccuuggcucucuuguug

SEQ ID NO: 184162 - RNA, 23 nt, Human
uaggggaaaaaucuucugcaauu

SEQ ID NO: 184163 - RNA, 22 nt, Human
acuguggcaaagaagcaggcuc

SEQ ID NO: 184164 - RNA, 22 nt, Human
acugaaauauuuagaagugaag

SEQ ID NO: 184165 - RNA, 18 nt, Human
guguccuggcugcggcgc

SEQ ID NO: 184166 - RNA, 22 nt, Human
aagauaacaggaggaguuugua

SEQ ID NO: 184167 - RNA, 22 nt, Human
uguguucauguugauucauagc

SEQ ID NO: 184168 - RNA, 22 nt, Human
accaggaggcuacacuguccca

SEQ ID NO: 184169 - RNA, 22 nt, Human
ccagaagucaaugcagauguga

SEQ ID NO: 184170 - RNA, 23 nt, Human
uguccuuuuugaggccuccuccu

SEQ ID NO: 184171 - RNA, 22 nt, Human
cccaguuguugccggcucugga

SEQ ID NO: 184172 - RNA, 22 nt, Human
acaguguuuauguacagauugu

SEQ ID NO: 184173 - RNA, 22 nt, Human
augucugcggcccaggccaggg

SEQ ID NO: 184174 - RNA, 22 nt, Human
uaaggcagauguggaaucaauu

SEQ ID NO: 184175 - RNA, 22 nt, Human
gaacaaacauuuuuggcaguau

SEQ ID NO: 184176 - RNA, 18 nt, Human
cagucuaauucccuuccc

SEQ ID NO: 184177 - RNA, 22 nt, Human
auguggauagcacaggaauggu

SEQ ID NO: 184178 - RNA, 21 nt, Human
gcugggcuccagucugccgcu

SEQ ID NO: 184179 - RNA, 22 nt, Human
acucagcuaaacucagucuaug

SEQ ID NO: 184180 - RNA, 21 nt, Human
uagggcaggcauuggaagaga

SEQ ID NO: 184181 - RNA, 22 nt, Human
auuugaauggcuuaacacaacg

SEQ ID NO: 184182 - RNA, 22 nt, Human
ggacaggcccggggagccugga

SEQ ID NO: 184183 - RNA, 22 nt, Human
gcagcccacagcuggaggccua

SEQ ID NO: 184184 - RNA, 22 nt, Human
agugucugaucaguugacuaga

SEQ ID NO: 184185 - RNA, 22 nt, Human
uugaggaguuaggauguuuaua

SEQ ID NO: 184186 - RNA, 22 nt, Human
aacacaggccagccugugcagu

SEQ ID NO: 184187 - RNA, 22 nt, Human
cuggucagggcucuuugggagc

SEQ ID NO: 184188 - RNA, 22 nt, Human
cugccauguagucuauggggcg

SEQ ID NO: 184189 - RNA, 22 nt, Human
gcaggacaggcguugguccagu

SEQ ID NO: 184190 - RNA, 22 nt, Human
ccccuuccaggaagcagaaucg

SEQ ID NO: 184191 - RNA, 22 nt, Human
ggcuucccagucccugcucuca

SEQ ID NO: 184192 - RNA, 22 nt, Human
ucagaagccaccuuuuguuggg

SEQ ID NO: 184193 - RNA, 22 nt, Human
gagugaguagcuacaguuuuua

SEQ ID NO: 184194 - RNA, 22 nt, Human
ggaucaaagggaaccuguuagg

SEQ ID NO: 184195 - RNA, 22 nt, Human
ucgucugugaaauugggauaag

SEQ ID NO: 184196 - RNA, 22 nt, Human
cagcucagcuuccugggugugu

SEQ ID NO: 184197 - RNA, 22 nt, Human
uccuuggcaagacacagcacag

SEQ ID NO: 184198 - RNA, 22 nt, Human
uggcuuccuguuucccagaaag

SEQ ID NO: 184199 - RNA, 22 nt, Human
ggagaaggcacacccaccucug

SEQ ID NO: 184200 - RNA, 22 nt, Human
uuacauuucccccuuggaggcu

SEQ ID NO: 184201 - RNA, 22 nt, Human
acagugcaaacccucgggaaag

SEQ ID NO: 184202 - RNA, 22 nt, Human
gcagggauugugcagggggcua

SEQ ID NO: 184203 - RNA, 19 nt, Human
ugagccagggaggccaugc

SEQ ID NO: 184204 - RNA, 22 nt, Human
guagaaaaagcaguaagucuca

SEQ ID NO: 184205 - RNA, 22 nt, Human
aauuaggggaggacguaucaua

SEQ ID NO: 184206 - RNA, 22 nt, Human
cugaauuagaugaaaaaggcuc

SEQ ID NO: 184207 - RNA, 22 nt, Human
uggagccuuuuacccacaggag

SEQ ID NO: 184208 - RNA, 22 nt, Human
guggcuucacauggcauuuggc

SEQ ID NO: 184209 - RNA, 22 nt, Human
cugucagguuucccggcucacg

SEQ ID NO: 184210 - RNA, 22 nt, Human
ggcacugggaaugcagugauga

SEQ ID NO: 184211 - RNA, 22 nt, Human
cauuuguuggucagauuguagu

SEQ ID NO: 184212 - RNA, 22 nt, Human
gcuuagaaagugauugauacau

SEQ ID NO: 184213 - RNA, 22 nt, Human
aucauucagucucugggacagu

SEQ ID NO: 184214 - RNA, 22 nt, Human
guaguuauugcuguuuacuucu

SEQ ID NO: 184215 - RNA, 22 nt, Human
aggcaugaugugcaguggcaaa

SEQ ID NO: 184216 - RNA, 22 nt, Human
ucucugggugauggcagggcac

SEQ ID NO: 184217 - RNA, 22 nt, Human
cugagaauggacagcagggcag

SEQ ID NO: 184218 - RNA, 22 nt, Human
auuugcaauuuuacuuugcagu

SEQ ID NO: 184219 - RNA, 22 nt, Human
cuguauaaacauauuuucaagu

SEQ ID NO: 184220 - RNA, 22 nt, Human
uaaaguauccaguuauucuucu

SEQ ID NO: 184221 - RNA, 22 nt, Human
acaugaaacuguugcauuagaa

SEQ ID NO: 184222 - RNA, 22 nt, Human
ugauuucauaguauauacauga

SEQ ID NO: 184223 - RNA, 22 nt, Human
acacauuauaggcaaucaaaag

SEQ ID NO: 184224 - RNA, 21 nt, Human
uucuagaaccgugggcgguuc

SEQ ID NO: 184225 - RNA, 22 nt, Human
cuggcagcagcuucuggaucga

SEQ ID NO: 184226 - RNA, 22 nt, Human
aggcugagcuggcccuugaaau

SEQ ID NO: 184227 - RNA, 19 nt, Human
cuguccugguuuggucccu

SEQ ID NO: 184228 - RNA, 22 nt, Human
ggacacaggcagcugggugggu

SEQ ID NO: 184229 - RNA, 22 nt, Human
ugacauguaagauggaaaagcg

SEQ ID NO: 184230 - RNA, 22 nt, Human
uggcuggcgccgggcuagccac

SEQ ID NO: 184231 - RNA, 22 nt, Human
ucucaaauggacaauauugugg

SEQ ID NO: 184232 - RNA, 22 nt, Human
aggcagcuggaggcagagacua

SEQ ID NO: 184233 - RNA, 22 nt, Human
gcuucuggaagcugcuucugcc

SEQ ID NO: 184234 - RNA, 22 nt, Human
agaagccagauuguagugggac

SEQ ID NO: 184235 - RNA, 22 nt, Human
acacggcacuuuaggaaggggc

SEQ ID NO: 184236 - RNA, 22 nt, Human
ccauucugagucuuaugucuuu

SEQ ID NO: 184237 - RNA, 22 nt, Human
augacacauaaaacaaggacug

SEQ ID NO: 184238 - RNA, 17 nt, Human
acacagagauuaacaca

SEQ ID NO: 184239 - RNA, 22 nt, Human
aacuuucagcaaguaauucugg

SEQ ID NO: 184240 - RNA, 22 nt, Human
ggauuuacccaauggauagaug

SEQ ID NO: 184241 - RNA, 21 nt, Human
acauacauuaucuuuuuaaaa

SEQ ID NO: 184242 - RNA, 22 nt, Human
gccuuccugcagcucugagcgu

SEQ ID NO: 184243 - RNA, 22 nt, Human
gacagaggagaagaugcugugg

SEQ ID NO: 184244 - RNA, 22 nt, Human
uccagaccuagggcaccccagu

SEQ ID NO: 184245 - RNA, 22 nt, Human
ugugacuuauaacauagaauuu

SEQ ID NO: 184246 - RNA, 22 nt, Human
aauguuauuacacuugugaaau

SEQ ID NO: 184247 - RNA, 22 nt, Human
uuugaaagcuacuuucggguca

SEQ ID NO: 184248 - RNA, 22 nt, Human
acugaggucucagguggggaag

SEQ ID NO: 184249 - RNA, 22 nt, Human
uggugcaguucccagggccggg

SEQ ID NO: 184250 - RNA, 22 nt, Human
gaaaauacuucaguguucuggc

SEQ ID NO: 184251 - RNA, 22 nt, Human
cugguacagggaaauaaaggaa

SEQ ID NO: 184252 - RNA, 22 nt, Human
acacaaauuguaggauaauugc

SEQ ID NO: 184253 - RNA, 22 nt, Human
guggccaggucagggacuugug

SEQ ID NO: 184254 - RNA, 20 nt, Human
ccacaggaguccagucgacc

SEQ ID NO: 184255 - RNA, 22 nt, Human
cugaucaugugggaggauaugu

SEQ ID NO: 184256 - RNA, 22 nt, Human
uagguucagugucuuguucugc

SEQ ID NO: 184257 - RNA, 22 nt, Human
uggcaguuucaugugauucaac

SEQ ID NO: 184258 - RNA, 22 nt, Human
gacacagaugaucaggugugga

SEQ ID NO: 184259 - RNA, 22 nt, Human
uguaggucacagucccuauccc

SEQ ID NO: 184260 - RNA, 22 nt, Human
cccugcccaccacaugcuggga

SEQ ID NO: 184261 - RNA, 22 nt, Human
gcagaagaccaugguggaaaga

SEQ ID NO: 184262 - RNA, 20 nt, Human
cuacuuuaggcacugagaau

SEQ ID NO: 184263 - RNA, 22 nt, Human
caggcuucagcauccacuuagu

SEQ ID NO: 184264 - RNA, 22 nt, Human
agaagccagaggcaguggguac

SEQ ID NO: 184265 - RNA, 22 nt, Human
ggaugggaacuugguagggcau

SEQ ID NO: 184266 - RNA, 22 nt, Human
uuccugggccuuaaaucuuuug

SEQ ID NO: 184267 - RNA, 22 nt, Human
gaaaucugaacaacagcuguca

SEQ ID NO: 184268 - RNA, 22 nt, Human
guaucuaugauccuuuauaucu

SEQ ID NO: 184269 - RNA, 22 nt, Human
uacagugcgggugcgggccucu

SEQ ID NO: 184270 - RNA, 22 nt, Human
gcugguagaccucacugcacuc

SEQ ID NO: 184271 - RNA, 22 nt, Human
caaauggcuggcauccuucuac

SEQ ID NO: 184272 - RNA, 22 nt, Human
agggccagggaagcuguauuuu

SEQ ID NO: 184273 - RNA, 22 nt, Human
cagaggcagccgggggagaacg

SEQ ID NO: 184274 - RNA, 22 nt, Human
cuggaggacagaggccaugucu

SEQ ID NO: 184275 - RNA, 22 nt, Human
uccugggcuugcuccuccagcu

SEQ ID NO: 184276 - RNA, 22 nt, Human
uugcccagaguccacagcguac

SEQ ID NO: 184277 - RNA, 22 nt, Human
uagauccugagcccuaucuacu

SEQ ID NO: 184278 - RNA, 20 nt, Human
ucagacagucgcaguucugg

SEQ ID NO: 184279 - RNA, 22 nt, Human
ggcuccugcaccugucccucug

SEQ ID NO: 184280 - RNA, 22 nt, Human
cuauuugggguagaagauggau

SEQ ID NO: 184281 - RNA, 22 nt, Human
ccagaagaccccguccaccucc

SEQ ID NO: 184282 - RNA, 22 nt, Human
augugcugaguguguauauaca

SEQ ID NO: 184283 - RNA, 22 nt, Human
aucauacagccuuuguuagugu

SEQ ID NO: 184284 - RNA, 22 nt, Human
ggggcaggagguguucucuuuu

SEQ ID NO: 184285 - RNA, 22 nt, Human
aguacuuuagcauaaagcaguu

SEQ ID NO: 184286 - RNA, 22 nt, Human
ccacagcaggacuggagccgcc

SEQ ID NO: 184287 - RNA, 22 nt, Human
cagcaucucugggagaagcauc

SEQ ID NO: 184288 - RNA, 23 nt, Human
acugccugcuacuaugcccacgg

SEQ ID NO: 184289 - RNA, 21 nt, Human
acauguaagagaguuucaaga

SEQ ID NO: 184290 - RNA, 22 nt, Human
auccaggccccaagaccccgac

SEQ ID NO: 184291 - RNA, 22 nt, Human
caaaugaagguggugggucauu

SEQ ID NO: 184292 - RNA, 22 nt, Human
aagucccugugggguggaggcu

SEQ ID NO: 184293 - RNA, 22 nt, Human
ugcauuaaggccauugaaauuu

SEQ ID NO: 184294 - RNA, 22 nt, Human
uugaggcagcccuuaauuggga

SEQ ID NO: 184295 - RNA, 22 nt, Human
cugcccaggcugaaggaacauc

SEQ ID NO: 184296 - RNA, 22 nt, Human
uucucacuauguauguagauug

SEQ ID NO: 184297 - RNA, 22 nt, Human
ugauuugcauggagaauaacag

SEQ ID NO: 184298 - RNA, 18 nt, Human
gagaaggccacuuguuuu

SEQ ID NO: 184299 - RNA, 22 nt, Human
uugcuuuucccugucucugauu

SEQ ID NO: 184300 - RNA, 22 nt, Human
cucugugggaagcuggguguga

SEQ ID NO: 184301 - RNA, 22 nt, Human
acugucaaaugcaaugaacuca

SEQ ID NO: 184302 - RNA, 22 nt, Human
caucucugagaccucagcuggg

SEQ ID NO: 184303 - RNA, 22 nt, Human
caggcaugaugggaagugccug

SEQ ID NO: 184304 - RNA, 22 nt, Human
aucuuugucacucuacugucua

SEQ ID NO: 184305 - RNA, 22 nt, Human
uauuaggguaaauuugacaugc

SEQ ID NO: 184306 - RNA, 22 nt, Human
aacaucucauggacuacauucu

SEQ ID NO: 184307 - RNA, 22 nt, Human
cugccuuugugaucaguucuuu

SEQ ID NO: 184308 - RNA, 22 nt, Human
auguccagggcacacagcagug

SEQ ID NO: 184309 - RNA, 22 nt, Human
ccuaaggaccagggcuuccagc

SEQ ID NO: 184310 - RNA, 22 nt, Human
aggagcuccagcccagggaagu

SEQ ID NO: 184311 - RNA, 22 nt, Human
acaccaccgucccagccuccug

SEQ ID NO: 184312 - RNA, 22 nt, Human
uacacaaucuguuuuuccauuu

SEQ ID NO: 184313 - RNA, 22 nt, Human
ccugggccuugaccucgugggc

SEQ ID NO: 184314 - RNA, 22 nt, Human
uuucaucauguuggcagauugg

SEQ ID NO: 184315 - RNA, 22 nt, Human
agaagugcuccagugaguuggg

SEQ ID NO: 184316 - RNA, 22 nt, Human
agcgugaaggcgggcagucggc

SEQ ID NO: 184317 - RNA, 22 nt, Human
ccaggcacuucaucauuagggu

SEQ ID NO: 184318 - RNA, 22 nt, Human
uacuucauuccuuuguaaaaug

SEQ ID NO: 184319 - RNA, 22 nt, Human
cugggcuuaggaccuggugcgg

SEQ ID NO: 184320 - RNA, 21 nt, Human
ugggcucagccccagcccugc

SEQ ID NO: 184321 - RNA, 22 nt, Human
uauuuuguaauuggucauagcu

SEQ ID NO: 184322 - RNA, 20 nt, Human
caggugagcagaucugggug

SEQ ID NO: 184323 - RNA, 22 nt, Human
aaacugcaauuauuuuugcaau

SEQ ID NO: 184324 - RNA, 22 nt, Human
aagcccuggcaaugucagauga

SEQ ID NO: 184325 - RNA, 22 nt, Human
ucccagaggcaguugguaacuu

SEQ ID NO: 184326 - RNA, 22 nt, Human
agcucugggaguaguuccaccu

SEQ ID NO: 184327 - RNA, 22 nt, Human
cagggagaucuuggcuccuggu

SEQ ID NO: 184328 - RNA, 22 nt, Human
uuugaaauaugaggcauuauga

SEQ ID NO: 184329 - RNA, 22 nt, Human
ggcuuggcagaggugggugcuu

SEQ ID NO: 184330 - RNA, 22 nt, Human
ucagaacauccugguuuaaaau

SEQ ID NO: 184331 - RNA, 22 nt, Human
agacauuuuacauucuuccauu

SEQ ID NO: 184332 - RNA, 18 nt, Human
acccaggcucaugguccu

SEQ ID NO: 184333 - RNA, 22 nt, Human
gaacuggugagaguucacggga

SEQ ID NO: 184334 - RNA, 22 nt, Human
uuuuacaagcugagucguuaaa

SEQ ID NO: 184335 - RNA, 22 nt, Human
cuguccugcccacccugcaggg

SEQ ID NO: 184336 - RNA, 20 nt, Human
gaguuccccauuucuccugg

SEQ ID NO: 184337 - RNA, 22 nt, Human
ggcaggcuguucaccugcuuuu

SEQ ID NO: 184338 - RNA, 22 nt, Human
acagcagagugugagauagcca

SEQ ID NO: 184339 - RNA, 22 nt, Human
ggagucaccaaguaggagucuu

SEQ ID NO: 184340 - RNA, 22 nt, Human
gccuuuaucccuguacaaggug

SEQ ID NO: 184341 - RNA, 22 nt, Human
ccucuguaaugauucacugaau

SEQ ID NO: 184342 - RNA, 22 nt, Human
caaguccuuagaugguucuuug

SEQ ID NO: 184343 - RNA, 22 nt, Human
ggagaggguagggguccugccc

SEQ ID NO: 184344 - RNA, 20 nt, Human
auucacaaagccaguguugc

SEQ ID NO: 184345 - RNA, 22 nt, Human
uggcagaguggaccauacucaa

SEQ ID NO: 184346 - RNA, 22 nt, Human
cgaaaucagcaucuugaggcaa

SEQ ID NO: 184347 - RNA, 22 nt, Human
uucucugggguucaguaucucu

SEQ ID NO: 184348 - RNA, 22 nt, Human
gcaggcuccaggccggccccuu

SEQ ID NO: 184349 - RNA, 22 nt, Human
cuggguucuauuuuuggcuuca

SEQ ID NO: 184350 - RNA, 23 nt, Human
acccugggcaagucaccuaaccu

SEQ ID NO: 184351 - RNA, 22 nt, Human
acuauacaccaaaauauuaagg

SEQ ID NO: 184352 - RNA, 22 nt, Human
uccaugaggaccaaauucguag

SEQ ID NO: 184353 - RNA, 22 nt, Human
gcuucauuucucucuguagacc

SEQ ID NO: 184354 - RNA, 23 nt, Human
ggggacagagggcagcccgcauc

SEQ ID NO: 184355 - RNA, 22 nt, Human
aacuuucuaauuuuggcugagc

SEQ ID NO: 184356 - RNA, 22 nt, Human
cucugggccaugcuacugcucu

SEQ ID NO: 184357 - RNA, 22 nt, Human
uucccaggcugugcuaccagag

SEQ ID NO: 184358 - RNA, 22 nt, Human
uuugaauauacuucaaacaaag

SEQ ID NO: 184359 - RNA, 22 nt, Human
caucugaagugaauugcuuuuu

SEQ ID NO: 184360 - RNA, 20 nt, Human
agugcauggagggagagggc

SEQ ID NO: 184361 - RNA, 22 nt, Human
uguguaaagcuuguuccagaaa

SEQ ID NO: 184362 - RNA, 22 nt, Human
ccuccccucagacagagacugg

SEQ ID NO: 184363 - RNA, 22 nt, Human
ugcuggagaccugcuugcacca

SEQ ID NO: 184364 - RNA, 22 nt, Human
ggccaccucugcccuacugagu

SEQ ID NO: 184365 - RNA, 22 nt, Human
ucuaugaaucaauuuuaacauc

SEQ ID NO: 184366 - RNA, 22 nt, Human
uugcacucaccacauuucaggu

SEQ ID NO: 184367 - RNA, 22 nt, Human
uccugggaccgagggaagagcu

SEQ ID NO: 184368 - RNA, 18 nt, Human
uuugggauccucuuuucu

SEQ ID NO: 184369 - RNA, 22 nt, Human
acauguaaacauuuacaguauu

SEQ ID NO: 184370 - RNA, 19 nt, Human
agugcauuuuauguuucaa

SEQ ID NO: 184371 - RNA, 22 nt, Human
acagaaguggcuucaaagagca

SEQ ID NO: 184372 - RNA, 22 nt, Human
aggcccuggcccccagagauuc

SEQ ID NO: 184373 - RNA, 22 nt, Human
ucacagccuggucacucugccc

SEQ ID NO: 184374 - RNA, 22 nt, Human
ccaaggacguacaggagauaau

SEQ ID NO: 184375 - RNA, 22 nt, Human
aaguccuucccaagcauguacc

SEQ ID NO: 184376 - RNA, 22 nt, Human
acaagauuuggcugaaacucca

SEQ ID NO: 184377 - RNA, 22 nt, Human
agcaguuauauugaaauaaaaa

SEQ ID NO: 184378 - RNA, 22 nt, Human
acaggcugccacuugcauccaa

SEQ ID NO: 184379 - RNA, 22 nt, Human
acugccugccuuccagguacug

SEQ ID NO: 184380 - RNA, 22 nt, Human
agaaggcacagugcugcuaaga

SEQ ID NO: 184381 - RNA, 19 nt, Human
cuggaauguggcuggugca

SEQ ID NO: 184382 - RNA, 22 nt, Human
uuuccaauguagaugucucugg

SEQ ID NO: 184383 - RNA, 22 nt, Human
agagacagaggcaauauagcuu

SEQ ID NO: 184384 - RNA, 22 nt, Human
gcuucucuggcuggucugccac

SEQ ID NO: 184385 - RNA, 22 nt, Human
aggccuuggaagccagggagcc

SEQ ID NO: 184386 - RNA, 22 nt, Human
uaugagcuuuggaaugagaaac

SEQ ID NO: 184387 - RNA, 22 nt, Human
agcaaacuaauugcaguucugg

SEQ ID NO: 184388 - RNA, 22 nt, Human
uuuuauugucuguauugccuau

SEQ ID NO: 184389 - RNA, 22 nt, Human
augcaauuuacuguacauaaau

SEQ ID NO: 184390 - RNA, 22 nt, Human
ugucgcagcugaaaaucucaau

SEQ ID NO: 184391 - RNA, 22 nt, Human
cccuugagccuggaggagcucu

SEQ ID NO: 184392 - RNA, 22 nt, Human
guauuuucaugauuucagacca

SEQ ID NO: 184393 - RNA, 22 nt, Human
gacauuagacuaauguagcauu

SEQ ID NO: 184394 - RNA, 20 nt, Human
acuguuaguauacuugugcc

SEQ ID NO: 184395 - RNA, 22 nt, Human
caguagcuucaguugaggccug

SEQ ID NO: 184396 - RNA, 22 nt, Human
gcagccaggaaagcuggacccu

SEQ ID NO: 184397 - RNA, 22 nt, Human
uaugccuggaaccuuucucuuu

SEQ ID NO: 184398 - RNA, 21 nt, Human
uuugaaagcuacaucuauagc

SEQ ID NO: 184399 - RNA, 22 nt, Human
ugauuuaccaguuacuaucuug

SEQ ID NO: 184400 - RNA, 22 nt, Human
cagagccauuauggagacuugc

SEQ ID NO: 184401 - RNA, 22 nt, Human
acccucaggcagaauguauucu

SEQ ID NO: 184402 - RNA, 22 nt, Human
uccaggacuuggcaggagauga

SEQ ID NO: 184403 - RNA, 22 nt, Human
cugaggcaggggcagcuggaga

SEQ ID NO: 184404 - RNA, 22 nt, Human
aaaggcuugguucuuugaugac

SEQ ID NO: 184405 - RNA, 18 nt, Human
agacccucuaagggcagu

SEQ ID NO: 184406 - RNA, 22 nt, Human
agagccagccuucucagcuuac

SEQ ID NO: 184407 - RNA, 22 nt, Human
cuccugccugugggacugagga

SEQ ID NO: 184408 - RNA, 19 nt, Human
agcaggccaggcagguggc

SEQ ID NO: 184409 - RNA, 22 nt, Human
gcaugucaugucauguaggaau

SEQ ID NO: 184410 - RNA, 22 nt, Human
ccugcaccugccaugugagaua

SEQ ID NO: 184411 - RNA, 22 nt, Human
acaugcauacacguacauaccu

SEQ ID NO: 184412 - RNA, 22 nt, Human
ugccagggucagcugcagcucu

SEQ ID NO: 184413 - RNA, 22 nt, Human
accccaggagcugugccuaguc

SEQ ID NO: 184414 - RNA, 22 nt, Human
caaauucagaaaauugguagag

SEQ ID NO: 184415 - RNA, 22 nt, Human
ucagcaggcaggaggcaugcca

SEQ ID NO: 184416 - RNA, 22 nt, Human
auugcuuuucagacaaugaggc

SEQ ID NO: 184417 - RNA, 22 nt, Human
gcuuuauuuugugagggauuac

SEQ ID NO: 184418 - RNA, 22 nt, Human
uaauuucaccguugcuagaaau

SEQ ID NO: 184419 - RNA, 22 nt, Human
ucaguguuuccugugguacagc

SEQ ID NO: 184420 - RNA, 22 nt, Human
ggcugaaguguaguggcucacu

SEQ ID NO: 184421 - RNA, 23 nt, Human
cauggaaaacugaaagcugaccu

SEQ ID NO: 184422 - RNA, 22 nt, Human
gugggcagagcaagggaacuca

SEQ ID NO: 184423 - RNA, 22 nt, Human
ggagcaguuguugagcaagcca

SEQ ID NO: 184424 - RNA, 22 nt, Human
acauggauaaauuuuacuuucc

SEQ ID NO: 184425 - RNA, 22 nt, Human
ccuucccaggcuagaccaacau

SEQ ID NO: 184426 - RNA, 22 nt, Human
uccagggaugguaaugagcagu

SEQ ID NO: 184427 - RNA, 22 nt, Human
cauuauugccagccauacugaa

SEQ ID NO: 184428 - RNA, 22 nt, Human
gaugagguuuuugaaaugugga

SEQ ID NO: 184429 - RNA, 22 nt, Human
uacagguagagucucuaguuua

SEQ ID NO: 184430 - RNA, 22 nt, Human
ucuguucagcugccucagggua

SEQ ID NO: 184431 - RNA, 22 nt, Human
uggcucugguaacauuggguag

SEQ ID NO: 184432 - RNA, 22 nt, Human
ggcucugaauuauuccugaguc

SEQ ID NO: 184433 - RNA, 22 nt, Human
gacccauaggaaucuguugucc

SEQ ID NO: 184434 - RNA, 23 nt, Human
aggcauggcauggaugguggcuc

SEQ ID NO: 184435 - RNA, 19 nt, Human
caucucugcaaggagcugc

SEQ ID NO: 184436 - RNA, 22 nt, Human
gucuuuggaggcacuguugagu

SEQ ID NO: 184437 - RNA, 22 nt, Human
uuguuucagcuguaugcuaugu

SEQ ID NO: 184438 - RNA, 22 nt, Human
cuuugcaaaaguuaauuguuga

SEQ ID NO: 184439 - RNA, 22 nt, Human
auguccucuucugccucaggcc

SEQ ID NO: 184440 - RNA, 22 nt, Human
aucuuuagacaggaagcaauca

SEQ ID NO: 184441 - RNA, 22 nt, Human
caccagguuccgggcagagcug

SEQ ID NO: 184442 - RNA, 22 nt, Human
guuucuuucuauugacugaaca

SEQ ID NO: 184443 - RNA, 17 nt, Human
caaggccagcaucuuca

SEQ ID NO: 184444 - RNA, 22 nt, Human
uuccuucuccagaacuucuagg

SEQ ID NO: 184445 - RNA, 22 nt, Human
gcaggcuccaaggccugggaga

SEQ ID NO: 184446 - RNA, 22 nt, Human
cauuugaaccuggauguucuua

SEQ ID NO: 184447 - RNA, 22 nt, Human
ucuucacagaugcauauacuuc

SEQ ID NO: 184448 - RNA, 22 nt, Human
accagucuguuguugcagagug

SEQ ID NO: 184449 - RNA, 22 nt, Human
ugcaacuaggagguucuuagcu

SEQ ID NO: 184450 - RNA, 22 nt, Human
gccuccacuuuugcuggcuucu

SEQ ID NO: 184451 - RNA, 22 nt, Human
ucaguaaaugaaugaauauaug

SEQ ID NO: 184452 - RNA, 21 nt, Human
aggcucccagaaaugggcauc

SEQ ID NO: 184453 - RNA, 22 nt, Human
caugcuuugggucagaaaugcc

SEQ ID NO: 184454 - RNA, 22 nt, Human
ggcugccugaacuuuggggaaa

SEQ ID NO: 184455 - RNA, 20 nt, Human
caguggcugauaacaaauua

SEQ ID NO: 184456 - RNA, 22 nt, Human
auuuccaacuaccccuccauuu

SEQ ID NO: 184457 - RNA, 22 nt, Human
ucucuucuaacacuagaaauuc

SEQ ID NO: 184458 - RNA, 22 nt, Human
acucugugaagaugcaggcuug

SEQ ID NO: 184459 - RNA, 22 nt, Human
ugaguccgaaguugcagugagc

SEQ ID NO: 184460 - RNA, 22 nt, Human
aagcauggcugagugcaauggu

SEQ ID NO: 184461 - RNA, 22 nt, Human
aaauucuguccugaaugccauu

SEQ ID NO: 184462 - RNA, 22 nt, Human
aaggaagagcaaagaauuaugu

SEQ ID NO: 184463 - RNA, 22 nt, Human
gcagcucucuggccugcccugg

SEQ ID NO: 184464 - RNA, 22 nt, Human
cacuggcuugauggguaaugcc

SEQ ID NO: 184465 - RNA, 22 nt, Human
uuucuucacaggguauugggug

SEQ ID NO: 184466 - RNA, 22 nt, Human
ugagaggucauuaggccaugag

SEQ ID NO: 184467 - RNA, 22 nt, Human
acuggcuggccgcgcucuucgc

SEQ ID NO: 184468 - RNA, 22 nt, Human
uuuccaaaggcuaaacucaguu

SEQ ID NO: 184469 - RNA, 22 nt, Human
cagugcugccaaagggaccuug

SEQ ID NO: 184470 - RNA, 22 nt, Human
aggaccuacugauaucuuagca

SEQ ID NO: 184471 - RNA, 22 nt, Human
aaguaugugugggaugcuggga

SEQ ID NO: 184472 - RNA, 22 nt, Human
acagcaaaggacgaacacucug

SEQ ID NO: 184473 - RNA, 22 nt, Human
auccugaagcaugaaugucaaa

SEQ ID NO: 184474 - RNA, 22 nt, Human
agaggaaguaaucaggaccugc

SEQ ID NO: 184475 - RNA, 22 nt, Human
auucuuugcaucucuggguggc

SEQ ID NO: 184476 - RNA, 21 nt, Human
ccagcuuucccaagucccuuu

SEQ ID NO: 184477 - RNA, 22 nt, Human
aaguuucugauauuguuaaagc

SEQ ID NO: 184478 - RNA, 22 nt, Human
ggugcccagagccaggaaugag

SEQ ID NO: 184479 - RNA, 22 nt, Human
aacuguagcaaagaacagcucu

SEQ ID NO: 184480 - RNA, 22 nt, Human
auaaccuguuucagacauuugu

SEQ ID NO: 184481 - RNA, 22 nt, Human
uccagccucauuucuccugcuu

SEQ ID NO: 184482 - RNA, 22 nt, Human
cauuaucugagaguguccuaca

SEQ ID NO: 184483 - RNA, 22 nt, Human
aucuguggcgcaaacaaaggcu

SEQ ID NO: 184484 - RNA, 21 nt, Human
gcaugccugcaucuuaguguu

SEQ ID NO: 184485 - RNA, 22 nt, Human
uuuauuuauaagccacuugcug

SEQ ID NO: 184486 - RNA, 22 nt, Human
gguuucaacucagcuaguaagg

SEQ ID NO: 184487 - RNA, 22 nt, Human
gcccuguggacccaggaacucu

SEQ ID NO: 184488 - RNA, 22 nt, Human
uucaggcccaacgcacagcuuc

SEQ ID NO: 184489 - RNA, 22 nt, Human
ggcaucuggaucugcuucuccc

SEQ ID NO: 184490 - RNA, 22 nt, Human
caggccuuuuuuccugcagugu

SEQ ID NO: 184491 - RNA, 22 nt, Human
accaggcuugauaccaagaaau

SEQ ID NO: 184492 - RNA, 22 nt, Human
ucugaauuuugaugugcauuga

SEQ ID NO: 184493 - RNA, 22 nt, Human
aauggcaaggaaaccguuacca

SEQ ID NO: 184494 - RNA, 22 nt, Human
guucuucaaagugacaacuaaa

SEQ ID NO: 184495 - RNA, 22 nt, Human
ucuggagccacaaaccucagcu

SEQ ID NO: 184496 - RNA, 22 nt, Human
acagugcuucugauaugaugcc

SEQ ID NO: 184497 - RNA, 22 nt, Human
uccagccaaucaacuauuguuu

SEQ ID NO: 184498 - RNA, 22 nt, Human
cccagcagccuugucccuucuc

SEQ ID NO: 184499 - RNA, 22 nt, Human
gagagaauguacaugcuagggg

SEQ ID NO: 184500 - RNA, 22 nt, Human
gcagauggaaagugcuugaggg

SEQ ID NO: 184501 - RNA, 22 nt, Human
gagaggucaucucccaucagca

SEQ ID NO: 184502 - RNA, 23 nt, Human
aaagugcaguugaggaaucauag

SEQ ID NO: 184503 - RNA, 22 nt, Human
gugcccugacacaccuggugug

SEQ ID NO: 184504 - RNA, 22 nt, Human
cacaggaggcaaugguaagauu

SEQ ID NO: 184505 - RNA, 22 nt, Human
auacagcagugaauaagauaaa

SEQ ID NO: 184506 - RNA, 21 nt, Human
ucucuccucaagcucgacccc

SEQ ID NO: 184507 - RNA, 22 nt, Human
aucuuuauauaucuccucugaa

SEQ ID NO: 184508 - RNA, 22 nt, Human
ucagagaguccuggucauuugc

SEQ ID NO: 184509 - RNA, 17 nt, Human
uuucaucugggaccacc

SEQ ID NO: 184510 - RNA, 22 nt, Human
agaauccuauugucagauucuu

SEQ ID NO: 184511 - RNA, 22 nt, Human
aauaauaguugcaaaguguuua

SEQ ID NO: 184512 - RNA, 22 nt, Human
gacugagaaucauagaaggcaa

SEQ ID NO: 184513 - RNA, 22 nt, Human
gggaucugauuuaggaugggag

SEQ ID NO: 184514 - RNA, 21 nt, Human
ccugugugugucccuuuaaga

SEQ ID NO: 184515 - RNA, 22 nt, Human
aagucuaaccuauuccgguguu

SEQ ID NO: 184516 - RNA, 22 nt, Human
uaggccaggacagagcuuccag

SEQ ID NO: 184517 - RNA, 22 nt, Human
gggcuguguuaggugcgguuac

SEQ ID NO: 184518 - RNA, 17 nt, Human
gaggagcuccaguaggu

SEQ ID NO: 184519 - RNA, 22 nt, Human
ugaacuuuugcacagaggauuu

SEQ ID NO: 184520 - RNA, 22 nt, Human
acaauuacccuggcuugauaaa

SEQ ID NO: 184521 - RNA, 22 nt, Human
cugggccuuuaccuacggaguu

SEQ ID NO: 184522 - RNA, 22 nt, Human
auuccaaagacagaagcagcug

SEQ ID NO: 184523 - RNA, 22 nt, Human
aagaacauugauauugucuaug

SEQ ID NO: 184524 - RNA, 22 nt, Human
agacaaauggaguaugagcaac

SEQ ID NO: 184525 - RNA, 22 nt, Human
ccaggccuuucuucuuggucug

SEQ ID NO: 184526 - RNA, 22 nt, Human
uuucagauggagguuuaggaca

SEQ ID NO: 184527 - RNA, 22 nt, Human
uaggaaagcaguagagccagga

SEQ ID NO: 184528 - RNA, 22 nt, Human
aaggccugggaggccucucuuc

SEQ ID NO: 184529 - RNA, 22 nt, Human
gcacaguggguggucauguaca

SEQ ID NO: 184530 - RNA, 22 nt, Human
aagagcuggucacagguccauu

SEQ ID NO: 184531 - RNA, 22 nt, Human
uagaaacaaugacaugcuugua

SEQ ID NO: 184532 - RNA, 22 nt, Human
uuaaagacaucacagauuacac

SEQ ID NO: 184533 - RNA, 22 nt, Human
uaugaagaaaccuauccucuag

SEQ ID NO: 184534 - RNA, 17 nt, Human
gccuuccuuccuccaca

SEQ ID NO: 184535 - RNA, 22 nt, Human
uaacuguauauuaagguggccc

SEQ ID NO: 184536 - RNA, 22 nt, Human
aauuuccagaucagaugacuca

SEQ ID NO: 184537 - RNA, 22 nt, Human
uaguuacagagaaaugauuuga

SEQ ID NO: 184538 - RNA, 19 nt, Human
cuggccaggccaggggccc

SEQ ID NO: 184539 - RNA, 22 nt, Human
ggcaggugacggggaugaguau

SEQ ID NO: 184540 - RNA, 22 nt, Human
uuccagagguagcaaugacuug

SEQ ID NO: 184541 - RNA, 22 nt, Human
aggacccaagcacaguuccugg

SEQ ID NO: 184542 - RNA, 22 nt, Human
aacaaauggaacacaaaucuuu

SEQ ID NO: 184543 - RNA, 22 nt, Human
gaggggcagugcacccgggccc

SEQ ID NO: 184544 - RNA, 22 nt, Human
aagcugaaauuccuccugaaau

SEQ ID NO: 184545 - RNA, 22 nt, Human
aacuuagacuuguuucuuggua

SEQ ID NO: 184546 - RNA, 22 nt, Human
uccuccuguuucucaggccugg

SEQ ID NO: 184547 - RNA, 22 nt, Human
gaagggugugugugagggacac

SEQ ID NO: 184548 - RNA, 22 nt, Human
ucacaucuauacccaauaauuu

SEQ ID NO: 184549 - RNA, 22 nt, Human
ucagaggaauuugcuuuucaug

SEQ ID NO: 184550 - RNA, 22 nt, Human
cugccugccacguucagcugua

SEQ ID NO: 184551 - RNA, 19 nt, Human
agucaguucugaggaggaa

SEQ ID NO: 184552 - RNA, 22 nt, Human
agccuccuguagcccucaccca

SEQ ID NO: 184553 - RNA, 22 nt, Human
agacuguugccugaacuuagcc

SEQ ID NO: 184554 - RNA, 22 nt, Human
cugggacauggugcugucuuua

SEQ ID NO: 184555 - RNA, 22 nt, Human
gcaaagugcuucagugggagcu

SEQ ID NO: 184556 - RNA, 22 nt, Human
ucaggugugggcagagaaacca

SEQ ID NO: 184557 - RNA, 22 nt, Human
gcagggcucagccgcucccacc

SEQ ID NO: 184558 - RNA, 22 nt, Human
cagaggcagaauggagauuugg

SEQ ID NO: 184559 - RNA, 22 nt, Human
augugucucuaaaauuuaguaa

SEQ ID NO: 184560 - RNA, 22 nt, Human
uaagucuucauagucuaauguc

SEQ ID NO: 184561 - RNA, 22 nt, Human
ugauagaaaggaaauuaauugg

SEQ ID NO: 184562 - RNA, 22 nt, Human
agaccuggaugugagggaagua

SEQ ID NO: 184563 - RNA, 19 nt, Human
ccuggcccugcugcgcggg

SEQ ID NO: 184564 - RNA, 15 nt, Human
cuauuucauccuucu

SEQ ID NO: 184565 - RNA, 22 nt, Human
uacaaugauuagcuaacuugcc

SEQ ID NO: 184566 - RNA, 17 nt, Human
gcugaacaaggaaaaua

SEQ ID NO: 184567 - RNA, 22 nt, Human
gauucaaaguuaaugaagaugc

SEQ ID NO: 184568 - RNA, 22 nt, Human
uuauuuaaaauguagguuggga

SEQ ID NO: 184569 - RNA, 22 nt, Human
agguggcugguccaggcugcag

SEQ ID NO: 184570 - RNA, 22 nt, Human
aagggagguaaagcuauuuaaa

SEQ ID NO: 184571 - RNA, 21 nt, Human
gccugccugcgugacccucuu

SEQ ID NO: 184572 - RNA, 22 nt, Human
uuuggaauuacuuacucaagcc

SEQ ID NO: 184573 - RNA, 22 nt, Human
ggggccucugcagucacgcugg

SEQ ID NO: 184574 - RNA, 22 nt, Human
uuagaaaauuugcuucuuugga

SEQ ID NO: 184575 - RNA, 22 nt, Human
agugcauuccuggggaagaagc

SEQ ID NO: 184576 - RNA, 22 nt, Human
cugagcugucaggaauggaaag

SEQ ID NO: 184577 - RNA, 22 nt, Human
gucacaggccuggaugaggggc

SEQ ID NO: 184578 - RNA, 22 nt, Human
aaucacauuacagcauaucugu

SEQ ID NO: 184579 - RNA, 22 nt, Human
agcaccugucacaagcagaagg

SEQ ID NO: 184580 - RNA, 22 nt, Human
ccuguucagagcuaagcaucau

SEQ ID NO: 184581 - RNA, 18 nt, Human
caggaugagugaugggga

SEQ ID NO: 184582 - RNA, 22 nt, Human
ugaggagucgagaagggguaau

SEQ ID NO: 184583 - RNA, 22 nt, Human
agucacugagauggugaggcua

SEQ ID NO: 184584 - RNA, 22 nt, Human
aacagcagggaugacauggcca

SEQ ID NO: 184585 - RNA, 22 nt, Human
ugcugaggacuaaaggagauga

SEQ ID NO: 184586 - RNA, 21 nt, Human
aaaaguuugacaggaaaggga

SEQ ID NO: 184587 - RNA, 23 nt, Human
augcaggguuacagggcugacuu

SEQ ID NO: 184588 - RNA, 22 nt, Human
uuuggacugcaugaugaucugg

SEQ ID NO: 184589 - RNA, 22 nt, Human
acccuaauaaucacagacuagu

SEQ ID NO: 184590 - RNA, 22 nt, Human
ugcagaauuauggugcuggcuu

SEQ ID NO: 184591 - RNA, 22 nt, Human
gggcaggaggcuaauucugcau

SEQ ID NO: 184592 - RNA, 18 nt, Human
gcagugcaggaagaagag

SEQ ID NO: 184593 - RNA, 22 nt, Human
acaaaguagucaaaguagauga

SEQ ID NO: 184594 - RNA, 22 nt, Human
ggagacacagagcaacaaaaua

SEQ ID NO: 184595 - RNA, 22 nt, Human
uauucauguguuggaaaggaac

SEQ ID NO: 184596 - RNA, 22 nt, Human
aggguccuaagccucagauaag

SEQ ID NO: 184597 - RNA, 22 nt, Human
uuuuuccuuggaugugucucuc

SEQ ID NO: 184598 - RNA, 17 nt, Human
ucuggccuuccugaacu

SEQ ID NO: 184599 - RNA, 19 nt, Human
gucagcuggaacucugaaa

SEQ ID NO: 184600 - RNA, 22 nt, Human
gcugagcacagccuguguccuc

SEQ ID NO: 184601 - RNA, 22 nt, Human
caagggcucaaacggugguugc

SEQ ID NO: 184602 - RNA, 22 nt, Human
agaaaucucuagcacaucgaau

SEQ ID NO: 184603 - RNA, 22 nt, Human
ucagcagaggggaaggcaucug

SEQ ID NO: 184604 - RNA, 22 nt, Human
gcuggccagcccucuuccucca

SEQ ID NO: 184605 - RNA, 22 nt, Human
cuuagcuuguuuucaccuaaga

SEQ ID NO: 184606 - RNA, 22 nt, Human
ggcugagacuagagugaggcau

SEQ ID NO: 184607 - RNA, 22 nt, Human
cagcaggucucagcagcuccuu

SEQ ID NO: 184608 - RNA, 22 nt, Human
agaguugcuaccaagaugcuag

SEQ ID NO: 184609 - RNA, 22 nt, Human
aaucuggaauauuugcauugua

SEQ ID NO: 184610 - RNA, 22 nt, Human
uuguaaagcugauuagaaagcc

SEQ ID NO: 184611 - RNA, 22 nt, Human
aggugcuuggcucgugcacaca

SEQ ID NO: 184612 - RNA, 22 nt, Human
gcacagggcugccaggcggcuu

SEQ ID NO: 184613 - RNA, 22 nt, Human
ucuuauaugcacauacauuggg

SEQ ID NO: 184614 - RNA, 23 nt, Human
aagaacuuugguccugcagaguc

SEQ ID NO: 184615 - RNA, 23 nt, Human
augguuuauguuguugugaagca

SEQ ID NO: 184616 - RNA, 18 nt, Human
cuccucccuaagggcuca

SEQ ID NO: 184617 - RNA, 22 nt, Human
gaaaguuuucauauauaccaaa

SEQ ID NO: 184618 - RNA, 22 nt, Human
agauacaacuguuuaaacauua

SEQ ID NO: 184619 - RNA, 22 nt, Human
agggagaaugaccaagguauau

SEQ ID NO: 184620 - RNA, 22 nt, Human
gagagaagggggauaugagccu

SEQ ID NO: 184621 - RNA, 20 nt, Human
ugcugagguugacaugccca

SEQ ID NO: 184622 - RNA, 20 nt, Human
gagucacagaagaagcugaa

SEQ ID NO: 184623 - RNA, 20 nt, Human
agguauaagaaaugugauuu

SEQ ID NO: 184624 - RNA, 22 nt, Human
ugauuuacacaucaaagcagca

SEQ ID NO: 184625 - RNA, 22 nt, Human
ggcaggcacauuugggggccgu

SEQ ID NO: 184626 - RNA, 18 nt, Human
auggcuucugaguggagg

SEQ ID NO: 184627 - RNA, 22 nt, Human
uuacaaugacagguguaucauu

SEQ ID NO: 184628 - RNA, 22 nt, Human
cauucuuauauuuacucauuca

SEQ ID NO: 184629 - RNA, 22 nt, Human
ucugggagagcacguggcugac

SEQ ID NO: 184630 - RNA, 22 nt, Human
ggccacagugggaaauccuggg

SEQ ID NO: 184631 - RNA, 22 nt, Human
uuaggaaagaagcagcuaggag

SEQ ID NO: 184632 - RNA, 21 nt, Human
ggcagagcuggggccuccagc

SEQ ID NO: 184633 - RNA, 22 nt, Human
ggcuuuguggggugaaguaaag

SEQ ID NO: 184634 - RNA, 22 nt, Human
agcuggugcugaagcucuugag

SEQ ID NO: 184635 - RNA, 22 nt, Human
agauaucugcaauauaauuuaa

SEQ ID NO: 184636 - RNA, 22 nt, Human
uggcugagggggcucugcucag

SEQ ID NO: 184637 - RNA, 22 nt, Human
auuucuagccucugaaguagga

SEQ ID NO: 184638 - RNA, 22 nt, Human
ccagcuuucugggugguuucug

SEQ ID NO: 184639 - RNA, 22 nt, Human
uacaccagguuaccaaucacug

SEQ ID NO: 184640 - RNA, 22 nt, Human
gcaccugggcaaggauucagag

SEQ ID NO: 184641 - RNA, 22 nt, Human
cagagcagaagcgguccucaca

SEQ ID NO: 184642 - RNA, 22 nt, Human
acagauuuuaaaugacacuccc

SEQ ID NO: 184643 - RNA, 22 nt, Human
auagcaaacuggcagcuugugg

SEQ ID NO: 184644 - RNA, 22 nt, Human
cagggcagugaagaacacacgu

SEQ ID NO: 184645 - RNA, 22 nt, Human
acacauauauuugcauauacac

SEQ ID NO: 184646 - RNA, 22 nt, Human
ugauuuacccguaacuauuucu

SEQ ID NO: 184647 - RNA, 22 nt, Human
gaggggcuggguagggcaaccc

SEQ ID NO: 184648 - RNA, 22 nt, Human
aguuaucaucccuuacacuuug

SEQ ID NO: 184649 - RNA, 22 nt, Human
gcuggagauaguaggauccaua

SEQ ID NO: 184650 - RNA, 22 nt, Human
cucaugauguagcgaaugagaa

SEQ ID NO: 184651 - RNA, 18 nt, Human
uguaaacacuuucauucu

SEQ ID NO: 184652 - RNA, 23 nt, Human
cagcucagaguguguccuguuuc

SEQ ID NO: 184653 - RNA, 22 nt, Human
aagccagauagaagaacucauu

SEQ ID NO: 184654 - RNA, 22 nt, Human
cacagaaauauugugucccuug

SEQ ID NO: 184655 - RNA, 22 nt, Human
auuuacugcuugacacauuggu

SEQ ID NO: 184656 - RNA, 22 nt, Human
caggccucaggggcucaggcug

SEQ ID NO: 184657 - RNA, 22 nt, Human
augccuuaaggcgagauacuua

SEQ ID NO: 184658 - RNA, 22 nt, Human
cuccugggaaaugaaggggcag

SEQ ID NO: 184659 - RNA, 22 nt, Human
ggucuggccuccgggcaggugg

SEQ ID NO: 184660 - RNA, 22 nt, Human
ccagaugucugagccacacucc

SEQ ID NO: 184661 - RNA, 22 nt, Human
uugcaaauuccaauccaauauu

SEQ ID NO: 184662 - RNA, 23 nt, Human
cuggcuucuggggccucuguuuc

SEQ ID NO: 184663 - RNA, 22 nt, Human
acuugaauaggaaagccacaaa

SEQ ID NO: 184664 - RNA, 22 nt, Human
uugccauguugccaaggcuggu

SEQ ID NO: 184665 - RNA, 22 nt, Human
ccaagaugaucuuuacaguguu

SEQ ID NO: 184666 - RNA, 22 nt, Human
agugaccaaucacugaaugauu

SEQ ID NO: 184667 - RNA, 22 nt, Human
ucagucauaguuuggagagaau

SEQ ID NO: 184668 - RNA, 22 nt, Human
uguagaaccuguuuauuauaga

SEQ ID NO: 184669 - RNA, 22 nt, Human
cucuggaguucuucaagcuacu

SEQ ID NO: 184670 - RNA, 22 nt, Human
augggcaguuaggaggccagga

SEQ ID NO: 184671 - RNA, 22 nt, Human
gauuccacagcuucgaggucuu

SEQ ID NO: 184672 - RNA, 22 nt, Human
gagugcaguuggggugagggga

SEQ ID NO: 184673 - RNA, 22 nt, Human
uggcacugaaaaaggagagguu

SEQ ID NO: 184674 - RNA, 22 nt, Human
auauuaggugcucaauacaugc

SEQ ID NO: 184675 - RNA, 21 nt, Human
acucugucuugagccaucugu

SEQ ID NO: 184676 - RNA, 22 nt, Human
gagggcuccacacgggcccagc

SEQ ID NO: 184677 - RNA, 22 nt, Human
uaaauuaugucacaugacucug

SEQ ID NO: 184678 - RNA, 22 nt, Human
ucauuuaauugguuuugcucgu

SEQ ID NO: 184679 - RNA, 22 nt, Human
uagucaguugggucuaguggca

SEQ ID NO: 184680 - RNA, 22 nt, Human
cucuggccuggggccugcuccc

SEQ ID NO: 184681 - RNA, 22 nt, Human
gaauucugguuuugaaaugaau

SEQ ID NO: 184682 - RNA, 22 nt, Human
cugcagugcaagcccagaugga

SEQ ID NO: 184683 - RNA, 22 nt, Human
ccaggccugcaucugcugcgca

SEQ ID NO: 184684 - RNA, 22 nt, Human
cugcaaaagucauugugguuuu

SEQ ID NO: 184685 - RNA, 22 nt, Human
cacccaggacaggccagaugug

SEQ ID NO: 184686 - RNA, 22 nt, Human
gcagggcugagucaugugugcc

SEQ ID NO: 184687 - RNA, 20 nt, Human
uuucaccaucuuggccaggc

SEQ ID NO: 184688 - RNA, 22 nt, Human
gggauagguuuggaagaggugg

SEQ ID NO: 184689 - RNA, 22 nt, Human
cugcaggagcaaagccucugcu

SEQ ID NO: 184690 - RNA, 22 nt, Human
aaacucaaagucagaucagaga

SEQ ID NO: 184691 - RNA, 19 nt, Human
ggcugucucggcccagcca

SEQ ID NO: 184692 - RNA, 22 nt, Human
ugagaauauuugaagauguuag

SEQ ID NO: 184693 - RNA, 21 nt, Human
uauuugcugccaucuuugagg

SEQ ID NO: 184694 - RNA, 22 nt, Human
uuugaaccugagcuucugcaug

SEQ ID NO: 184695 - RNA, 22 nt, Human
cccacagguccccaugaacucg

SEQ ID NO: 184696 - RNA, 18 nt, Human
ggccucuggacuggcagc

SEQ ID NO: 184697 - RNA, 22 nt, Human
gcagccaggcuacagcgggcuu

SEQ ID NO: 184698 - RNA, 22 nt, Human
caggcugugaaacugagaugcg

SEQ ID NO: 184699 - RNA, 22 nt, Human
cucaggauuaaggaaucuaaau

SEQ ID NO: 184700 - RNA, 22 nt, Human
uagaacuuauuuggcauuauuu

SEQ ID NO: 184701 - RNA, 22 nt, Human
uuugcaaauuagccacccuguu

SEQ ID NO: 184702 - RNA, 22 nt, Human
aauaaugucugcuauuuuaaaa

SEQ ID NO: 184703 - RNA, 22 nt, Human
caacagaaaucaauuuucccau

SEQ ID NO: 184704 - RNA, 22 nt, Human
uagauaucagaaauagaauuua

SEQ ID NO: 184705 - RNA, 22 nt, Human
ugcuucuuuaugauguaugauu

SEQ ID NO: 184706 - RNA, 22 nt, Human
uauaccaaaaaaauucuugucu

SEQ ID NO: 184707 - RNA, 22 nt, Human
ggagaagggacagacucagcuu

SEQ ID NO: 184708 - RNA, 22 nt, Human
cucccucauauacccagcgaga

SEQ ID NO: 184709 - RNA, 23 nt, Human
agagcuuucuaaaauguaaaucu

SEQ ID NO: 184710 - RNA, 22 nt, Human
gaaacccaaacuaagacaguag

SEQ ID NO: 184711 - RNA, 17 nt, Human
gcucuggcacaggauug

SEQ ID NO: 184712 - RNA, 22 nt, Human
ccacuguuuuucaguuaacuuu

SEQ ID NO: 184713 - RNA, 22 nt, Human
aagccuggacuaucgcgugugc

SEQ ID NO: 184714 - RNA, 22 nt, Human
uguuuuaugagccauauaaccu

SEQ ID NO: 184715 - RNA, 22 nt, Human
gagggaaagguuaauacaugau

SEQ ID NO: 184716 - RNA, 22 nt, Human
cucugcaacuucuagcaguguc

SEQ ID NO: 184717 - RNA, 22 nt, Human
uccaaagccgacugacaucuga

SEQ ID NO: 184718 - RNA, 23 nt, Human
uucaaagcuuaagcucuuuccac

SEQ ID NO: 184719 - RNA, 22 nt, Human
gucagcauaguucacacacagu

SEQ ID NO: 184720 - RNA, 22 nt, Human
augcuuuauuguuaggucaugu

SEQ ID NO: 184721 - RNA, 22 nt, Human
guaguucugcagugucaccuga

SEQ ID NO: 184722 - RNA, 22 nt, Human
guugaaaaugacuuuauaccau

SEQ ID NO: 184723 - RNA, 22 nt, Human
cugcaaaucaaguucuuauaau

SEQ ID NO: 184724 - RNA, 22 nt, Human
uggaugaggcuggguuaggcag

SEQ ID NO: 184725 - RNA, 22 nt, Human
uaggguggagacuggaagcagg

SEQ ID NO: 184726 - RNA, 22 nt, Human
uuucuaggacaugauaggauau

SEQ ID NO: 184727 - RNA, 22 nt, Human
aaagcugguuauucugaggcag

SEQ ID NO: 184728 - RNA, 21 nt, Human
ccuccaggugauuccgugcuc

SEQ ID NO: 184729 - RNA, 20 nt, Human
ucucugcagcagaggcuggg

SEQ ID NO: 184730 - RNA, 22 nt, Human
uaaaagauuuuauaggaacaag

SEQ ID NO: 184731 - RNA, 22 nt, Human
gccgugcgugcgcaggugcugu

SEQ ID NO: 184732 - RNA, 22 nt, Human
agagcuggacgucugagcccua

SEQ ID NO: 184733 - RNA, 22 nt, Human
ugcauauuguccuugauauuau

SEQ ID NO: 184734 - RNA, 22 nt, Human
uaaaucucucaguggccagaga

SEQ ID NO: 184735 - RNA, 22 nt, Human
uucugucuucccacugaggagc

SEQ ID NO: 184736 - RNA, 22 nt, Human
ugcagaguagugaggggacaga

SEQ ID NO: 184737 - RNA, 22 nt, Human
agcagcuguacuuucaucuguu

SEQ ID NO: 184738 - RNA, 22 nt, Human
agagaaggaaagcugacauggg

SEQ ID NO: 184739 - RNA, 22 nt, Human
ugcaaauacaaaaugguacagc

SEQ ID NO: 184740 - RNA, 22 nt, Human
uccucccugaguggggacagcu

SEQ ID NO: 184741 - RNA, 22 nt, Human
uuucuauaaucuaccaugccag

SEQ ID NO: 184742 - RNA, 22 nt, Human
gauaaacuuguggaguuuuggu

SEQ ID NO: 184743 - RNA, 22 nt, Human
ccugucucuguuaccacauuug

SEQ ID NO: 184744 - RNA, 22 nt, Human
auucucugcugcacugauaaca

SEQ ID NO: 184745 - RNA, 22 nt, Human
agcagugugcuucguuucauga

SEQ ID NO: 184746 - RNA, 22 nt, Human
guuacucuuccccggggucugg

SEQ ID NO: 184747 - RNA, 22 nt, Human
agcagcagugacagccgaaagc

SEQ ID NO: 184748 - RNA, 22 nt, Human
cucugggcccacuuaaaucugg

SEQ ID NO: 184749 - RNA, 21 nt, Human
cucaaaauucuuucuguugga

SEQ ID NO: 184750 - RNA, 22 nt, Human
agcaaugaccagugaucuugua

SEQ ID NO: 184751 - RNA, 22 nt, Human
aagguggugaguacaguuaggu

SEQ ID NO: 184752 - RNA, 22 nt, Human
gccuucccaagacgccugaguu

SEQ ID NO: 184753 - RNA, 22 nt, Human
ccucuggguuaguuuagggagc

SEQ ID NO: 184754 - RNA, 22 nt, Human
uaaaggaacagaggacucauuu

SEQ ID NO: 184755 - RNA, 22 nt, Human
guccugggcccaggggcugccu

SEQ ID NO: 184756 - RNA, 22 nt, Human
cauuggucuucuaacagagaga

SEQ ID NO: 184757 - RNA, 20 nt, Human
aggagcugaauuagaggguu

SEQ ID NO: 184758 - RNA, 23 nt, Human
ccagcugugccuggcccaggagc

SEQ ID NO: 184759 - RNA, 22 nt, Human
cauuuguaauacugacuugcag

SEQ ID NO: 184760 - RNA, 22 nt, Human
uucuagaacaggcaaaaccaau

SEQ ID NO: 184761 - RNA, 22 nt, Human
uggucaagggacagagcugaac

SEQ ID NO: 184762 - RNA, 22 nt, Human
aucaaaguaucucaauauggua

SEQ ID NO: 184763 - RNA, 22 nt, Human
agaaauucaauucuaauuagcu

SEQ ID NO: 184764 - RNA, 22 nt, Human
aaagaugucaguuugaaauaac

SEQ ID NO: 184765 - RNA, 22 nt, Human
cccagguguuuguggcagaggu

SEQ ID NO: 184766 - RNA, 22 nt, Human
guacagggccccucagcagggc

SEQ ID NO: 184767 - RNA, 22 nt, Human
cauggcggucaggauguaggug

SEQ ID NO: 184768 - RNA, 22 nt, Human
ccucuggccacaugggacauag

SEQ ID NO: 184769 - RNA, 22 nt, Human
ggcugcugacaaacaugaucau

SEQ ID NO: 184770 - RNA, 21 nt, Human
uucacaguggauaacuuucug

SEQ ID NO: 184771 - RNA, 22 nt, Human
aaaggccacuugaaggauuuuu

SEQ ID NO: 184772 - RNA, 20 nt, Human
ugcuccaucuaaagugauua

SEQ ID NO: 184773 - RNA, 22 nt, Human
cugccucuggccucaggcccag

SEQ ID NO: 184774 - RNA, 22 nt, Human
uaggcucccagaucguuugcug

SEQ ID NO: 184775 - RNA, 22 nt, Human
uuaaaugaggcugauguagauu

SEQ ID NO: 184776 - RNA, 17 nt, Human
ugguuccaaccauacgc

SEQ ID NO: 184777 - RNA, 22 nt, Human
gauaaacauucuugcacaugug

SEQ ID NO: 184778 - RNA, 22 nt, Human
uuuggaaaguugucacuuuaga

SEQ ID NO: 184779 - RNA, 22 nt, Human
aagguuagugcaucuuuuguuu

SEQ ID NO: 184780 - RNA, 22 nt, Human
gaccuucaguguguuucucaca

SEQ ID NO: 184781 - RNA, 22 nt, Human
uaaaaugguaacuuucauuugc

SEQ ID NO: 184782 - RNA, 22 nt, Human
uuccauaaaggugauaguauac

SEQ ID NO: 184783 - RNA, 23 nt, Human
aaugaguugggcagcauacaggc

SEQ ID NO: 184784 - RNA, 19 nt, Human
ccuggcucugagcccagcc

SEQ ID NO: 184785 - RNA, 22 nt, Human
gugccugggacuugcuccggau

SEQ ID NO: 184786 - RNA, 22 nt, Human
uggcacaguccugggugccugc

SEQ ID NO: 184787 - RNA, 22 nt, Human
gaggagacggggugccuggagc

SEQ ID NO: 184788 - RNA, 19 nt, Human
aggguggcaaaggagggug

SEQ ID NO: 184789 - RNA, 16 nt, Human
gcagaggaaaggggag

SEQ ID NO: 184790 - RNA, 22 nt, Human
uugcugcucccaagaggcagcu

SEQ ID NO: 184791 - RNA, 19 nt, Human
ccuugccugucccugcagc

SEQ ID NO: 184792 - RNA, 22 nt, Human
ccugccaggacauugcuugaag

SEQ ID NO: 184793 - RNA, 22 nt, Human
ugaggcaggaauggggaaaagu

SEQ ID NO: 184794 - RNA, 22 nt, Human
gacccagcuaaccaggugggga

SEQ ID NO: 184795 - RNA, 22 nt, Human
gaggggagacagggaaaucagu

SEQ ID NO: 184796 - RNA, 22 nt, Human
acuuguauggagacuuggaacc

SEQ ID NO: 184797 - RNA, 22 nt, Human
cuggcuugcagcucaucauaaa

SEQ ID NO: 184798 - RNA, 22 nt, Human
acagccagcagagcuguuuccu

SEQ ID NO: 184799 - RNA, 22 nt, Human
gcccagggcugcaaguggacgc

SEQ ID NO: 184800 - RNA, 22 nt, Human
auaguguuagagccaguauguu

SEQ ID NO: 184801 - RNA, 17 nt, Human
uuucaagguuacguucc

SEQ ID NO: 184802 - RNA, 22 nt, Human
ucaggagcugugaauacaaagg

SEQ ID NO: 184803 - RNA, 22 nt, Human
ccucaggaaccacauugcugcu

SEQ ID NO: 184804 - RNA, 22 nt, Human
cagggcucuucaucacacagua

SEQ ID NO: 184805 - RNA, 22 nt, Human
uaacagaaaggcucaggugcuc

SEQ ID NO: 184806 - RNA, 22 nt, Human
gcuucuaaccugcuuccuguag

SEQ ID NO: 184807 - RNA, 22 nt, Human
ugaaguuugaacuguguugcug

SEQ ID NO: 184808 - RNA, 22 nt, Human
gacaggcuuagggagggugcuc

SEQ ID NO: 184809 - RNA, 22 nt, Human
uuuggcuuaacuuacaugauau

SEQ ID NO: 184810 - RNA, 22 nt, Human
uagaaaauggccaagcaggacu

SEQ ID NO: 184811 - RNA, 22 nt, Human
gggcucuggggucagacagccu

SEQ ID NO: 184812 - RNA, 22 nt, Human
uugcaaggugauaaaagaauga

SEQ ID NO: 184813 - RNA, 22 nt, Human
aucaaauaaagguaccuagcuu

SEQ ID NO: 184814 - RNA, 17 nt, Human
aggaagcgagcuggccu

SEQ ID NO: 184815 - RNA, 22 nt, Human
ucagaaguuucaaucccagcug

SEQ ID NO: 184816 - RNA, 21 nt, Human
agccugcaauguagguaccgg

SEQ ID NO: 184817 - RNA, 22 nt, Human
auaucaaagcuaguggaaauuu

SEQ ID NO: 184818 - RNA, 22 nt, Human
ggcaccagcacuugggauggcu

SEQ ID NO: 184819 - RNA, 22 nt, Human
aauucacauauacauuauuccu

SEQ ID NO: 184820 - RNA, 22 nt, Human
ucugcagguagagcucaggaau

SEQ ID NO: 184821 - RNA, 23 nt, Human
uaauacugcuucagaggcuuaga

SEQ ID NO: 184822 - RNA, 22 nt, Human
augaggcaaggcuggccguguu

SEQ ID NO: 184823 - RNA, 22 nt, Human
aaugccuuggagagccuagagg

SEQ ID NO: 184824 - RNA, 22 nt, Human
guauuagguuggugcaaaauug

SEQ ID NO: 184825 - RNA, 22 nt, Human
aggcaguuuauccccagagccu

SEQ ID NO: 184826 - RNA, 21 nt, Human
auugugaccaucauuuuggaa

SEQ ID NO: 184827 - RNA, 22 nt, Human
ggacagagcccugguggccuaa

SEQ ID NO: 184828 - RNA, 22 nt, Human
agccacagugcaagagagaaaa

SEQ ID NO: 184829 - RNA, 22 nt, Human
auuucucaucaagugccaacuc

SEQ ID NO: 184830 - RNA, 22 nt, Human
caccugcagggggagucaagag

SEQ ID NO: 184831 - RNA, 22 nt, Human
aaggccaguggauaaaaccucu

SEQ ID NO: 184832 - RNA, 22 nt, Human
uguuuucuagaaacaaugccua

SEQ ID NO: 184833 - RNA, 22 nt, Human
aaaucagugcucauuugaaagg

SEQ ID NO: 184834 - RNA, 22 nt, Human
gggcagaggcucuggcccaucc

SEQ ID NO: 184835 - RNA, 22 nt, Human
uucugggcagagcuggagcugc

SEQ ID NO: 184836 - RNA, 22 nt, Human
auugucauuggcuucuaugucu

SEQ ID NO: 184837 - RNA, 22 nt, Human
cuuuauguccaccagacugcaa

SEQ ID NO: 184838 - RNA, 22 nt, Human
ccaggcucacagcaucccagga

SEQ ID NO: 184839 - RNA, 22 nt, Human
cuuggccugggccgcagccacu

SEQ ID NO: 184840 - RNA, 22 nt, Human
gcucaggcucucccaggggaau

SEQ ID NO: 184841 - RNA, 22 nt, Human
uagcuucagggaaaccacugcu

SEQ ID NO: 184842 - RNA, 19 nt, Human
uacagugaaccaggaggag

SEQ ID NO: 184843 - RNA, 22 nt, Human
ugagcuguguccugggggcagu

SEQ ID NO: 184844 - RNA, 22 nt, Human
auggcuggcaugugcauaacgg

SEQ ID NO: 184845 - RNA, 22 nt, Human
agacagcuagggcugcagggac

SEQ ID NO: 184846 - RNA, 22 nt, Human
ccaggagagcauugcacagagg

SEQ ID NO: 184847 - RNA, 22 nt, Human
gagacugggggcuuggccuuuu

SEQ ID NO: 184848 - RNA, 22 nt, Human
aagacacagcgaaauguuccug

SEQ ID NO: 184849 - RNA, 22 nt, Human
augacaagaguguucagggaga

SEQ ID NO: 184850 - RNA, 22 nt, Human
aaacaucaauugcaucucccaa

SEQ ID NO: 184851 - RNA, 21 nt, Human
uuaaugcuaugcagaaaaucu

SEQ ID NO: 184852 - RNA, 22 nt, Human
cuuguagaauugaaauggucuc

SEQ ID NO: 184853 - RNA, 22 nt, Human
aacauucaaaacccaguucagu

SEQ ID NO: 184854 - RNA, 18 nt, Human
gugugcucagagagugag

SEQ ID NO: 184855 - RNA, 22 nt, Human
agguggcagcagaaucagggag

SEQ ID NO: 184856 - RNA, 20 nt, Human
uuuaagaaguuucugaggaa

SEQ ID NO: 184857 - RNA, 22 nt, Human
ccaaaggccaagcucagguaaa

SEQ ID NO: 184858 - RNA, 22 nt, Human
agcagguggccuccugucuguc

SEQ ID NO: 184859 - RNA, 20 nt, Human
cuccugugccucucugggcc

SEQ ID NO: 184860 - RNA, 22 nt, Human
agucccagagaggucggggcca

SEQ ID NO: 184861 - RNA, 22 nt, Human
gauggacaccuccugagguucu

SEQ ID NO: 184862 - RNA, 22 nt, Human
cucuccagaucugcugagccag

SEQ ID NO: 184863 - RNA, 22 nt, Human
uuggaggauugcucucagccca

SEQ ID NO: 184864 - RNA, 22 nt, Human
aggucaagauucuacauuugua

SEQ ID NO: 184865 - RNA, 22 nt, Human
uuccauauuguacucuuuggag

SEQ ID NO: 184866 - RNA, 22 nt, Human
cccacauuuuugagucuucauc

SEQ ID NO: 184867 - RNA, 22 nt, Human
gaggaaacauuguagaagcagu

SEQ ID NO: 184868 - RNA, 22 nt, Human
uugggccucucaaagugcuggg

SEQ ID NO: 184869 - RNA, 22 nt, Human
ugacacaguaucaaacaugauu

SEQ ID NO: 184870 - RNA, 22 nt, Human
ucugaaagcauuacaguuuauu

SEQ ID NO: 184871 - RNA, 22 nt, Human
gaagagccaggugucgcugugg

SEQ ID NO: 184872 - RNA, 22 nt, Human
agggccugggccagcacccuuu

SEQ ID NO: 184873 - RNA, 22 nt, Human
uuuggcucaucucaguccuagg

SEQ ID NO: 184874 - RNA, 22 nt, Human
gcauauuaguaaucuuucaaca

SEQ ID NO: 184875 - RNA, 22 nt, Human
acaaugcaccuauuuuaaaacu

SEQ ID NO: 184876 - RNA, 23 nt, Human
aagauccauucaaauuauguauc

SEQ ID NO: 184877 - RNA, 23 nt, Human
uggacgccgacuuuggaggcgcu

SEQ ID NO: 184878 - RNA, 22 nt, Human
caaguccucaaagggcucugcu

SEQ ID NO: 184879 - RNA, 22 nt, Human
uaacaaacuggaaauugacauu

SEQ ID NO: 184880 - RNA, 22 nt, Human
gcucagagcuugaaguuccacu

SEQ ID NO: 184881 - RNA, 22 nt, Human
cucugggaugaggccuaggcac

SEQ ID NO: 184882 - RNA, 22 nt, Human
ugggcacuccuggggacagcug

SEQ ID NO: 184883 - RNA, 22 nt, Human
gcuccuggucuggagcuucaag

SEQ ID NO: 184884 - RNA, 22 nt, Human
cagcagcuggugagacacagcc

SEQ ID NO: 184885 - RNA, 22 nt, Human
gugagcuucugccucucagucc

SEQ ID NO: 184886 - RNA, 22 nt, Human
gugcaaagugcauggggaaggg

SEQ ID NO: 184887 - RNA, 23 nt, Human
uuuugugugacuuaauaucucuu

SEQ ID NO: 184888 - RNA, 22 nt, Human
cagcuuuguggccuugaccucg

SEQ ID NO: 184889 - RNA, 22 nt, Human
uuaguucauagaauguaacagg

SEQ ID NO: 184890 - RNA, 22 nt, Human
ucugaaagaugagugguccauu

SEQ ID NO: 184891 - RNA, 22 nt, Human
ccugcagacacuuguccagcaa

SEQ ID NO: 184892 - RNA, 22 nt, Human
guccagcuccagggaggcaggc

SEQ ID NO: 184893 - RNA, 23 nt, Human
uaggcuucugcuguccccgacgc

SEQ ID NO: 184894 - RNA, 22 nt, Human
aucucuucugagcaauuccugu

SEQ ID NO: 184895 - RNA, 22 nt, Human
uucuaauuguguuugcauaucu

SEQ ID NO: 184896 - RNA, 20 nt, Human
uagggcucauuaugaucucc

SEQ ID NO: 184897 - RNA, 22 nt, Human
uggcuucugggacuugugagca

SEQ ID NO: 184898 - RNA, 22 nt, Human
ccagggcagcagaauuggggca

SEQ ID NO: 184899 - RNA, 22 nt, Human
gccugucaauuuuguguacaau

SEQ ID NO: 184900 - RNA, 22 nt, Human
ugccagcuuguggucagaggcu

SEQ ID NO: 184901 - RNA, 22 nt, Human
acugaugaaaacuaauaaauua

SEQ ID NO: 184902 - RNA, 22 nt, Human
cuucaggaaaaucucuaaggau

SEQ ID NO: 184903 - RNA, 22 nt, Human
ugucagaggcucagggucucag

SEQ ID NO: 184904 - RNA, 22 nt, Human
ugauuuaggaaacagcuacagg

SEQ ID NO: 184905 - RNA, 19 nt, Human
ccauggcaaugaucugaug

SEQ ID NO: 184906 - RNA, 22 nt, Human
ccuauacaggcuucuuuacaug

SEQ ID NO: 184907 - RNA, 22 nt, Human
cuguggcugcgcccugggggag

SEQ ID NO: 184908 - RNA, 22 nt, Human
gcagggcucauugccaggcauu

SEQ ID NO: 184909 - RNA, 22 nt, Human
uaauucuagauugacauuuuga

SEQ ID NO: 184910 - RNA, 21 nt, Human
ugauugauauuugcaaacaga

SEQ ID NO: 184911 - RNA, 22 nt, Human
ugugucugcacugaguccucac

SEQ ID NO: 184912 - RNA, 17 nt, Human
uuauuuuuugggcugag

SEQ ID NO: 184913 - RNA, 22 nt, Human
uaaaauugcggugaauauuucc

SEQ ID NO: 184914 - RNA, 22 nt, Human
agagccugugggagaugcagcu

SEQ ID NO: 184915 - RNA, 22 nt, Human
gucaguuauucaauugguuuaa

SEQ ID NO: 184916 - RNA, 22 nt, Human
gcauggccaggaaagguagaaa

SEQ ID NO: 184917 - RNA, 22 nt, Human
uuuaaugugagucccuuucaag

SEQ ID NO: 184918 - RNA, 22 nt, Human
agaggucucaguuauguuuaaa

SEQ ID NO: 184919 - RNA, 22 nt, Human
gaauacauuggaaaucagaaua

SEQ ID NO: 184920 - RNA, 22 nt, Human
ucauggggcucuucaaguggag

SEQ ID NO: 184921 - RNA, 17 nt, Human
agaggcagauacuugga

SEQ ID NO: 184922 - RNA, 22 nt, Human
aauaucuucuaaggauagaacu

SEQ ID NO: 184923 - RNA, 22 nt, Human
cucagggcuggaaagccaggaa

SEQ ID NO: 184924 - RNA, 21 nt, Human
agguggggcugcaccucugcu

SEQ ID NO: 184925 - RNA, 22 nt, Human
aacacugagaacaauacagagu

SEQ ID NO: 184926 - RNA, 22 nt, Human
ccucccugccggcuggacuagu

SEQ ID NO: 184927 - RNA, 22 nt, Human
cagccucuugcacuuugaaggc

SEQ ID NO: 184928 - RNA, 22 nt, Human
caaggcuuauuuuccuccuucc

SEQ ID NO: 184929 - RNA, 22 nt, Human
uguggcugacuccuggucccca

SEQ ID NO: 184930 - RNA, 21 nt, Human
cucuggagucaagagcuucca

SEQ ID NO: 184931 - RNA, 22 nt, Human
uucugggcauguuacauucugu

SEQ ID NO: 184932 - RNA, 22 nt, Human
uggucugauaccggauuccagu

SEQ ID NO: 184933 - RNA, 20 nt, Human
caggaugauuggacacgaug

SEQ ID NO: 184934 - RNA, 22 nt, Human
cuccugggcucaagugauccuc

SEQ ID NO: 184935 - RNA, 19 nt, Human
ugcucuggagccagcucuc

SEQ ID NO: 184936 - RNA, 22 nt, Human
ugguccagucguuccuuuccuu

SEQ ID NO: 184937 - RNA, 21 nt, Human
aguugcugcugcugcagguga

SEQ ID NO: 184938 - RNA, 22 nt, Human
ucugcuucuccuacuucauggg

SEQ ID NO: 184939 - RNA, 22 nt, Human
uguuuuaguucugucuugcaug

SEQ ID NO: 184940 - RNA, 22 nt, Human
acuuuaaggaggcacucaucuc

SEQ ID NO: 184941 - RNA, 22 nt, Human
auuggucuaggcuuuaaaaaga

SEQ ID NO: 184942 - RNA, 22 nt, Human
ugggugugccauauuccauuuc

SEQ ID NO: 184943 - RNA, 22 nt, Human
ccuuaaacuuuaucuugugaga

SEQ ID NO: 184944 - RNA, 22 nt, Human
ccccacccaccuaagagaaacu

SEQ ID NO: 184945 - RNA, 22 nt, Human
ccagguggugaaagugggcccu

SEQ ID NO: 184946 - RNA, 22 nt, Human
ugucucagguacaugcguccug

SEQ ID NO: 184947 - RNA, 22 nt, Human
uuguagaacaugcagcacaaug

SEQ ID NO: 184948 - RNA, 22 nt, Human
ugcugaaauauuuaugggucaa

SEQ ID NO: 184949 - RNA, 22 nt, Human
cugggagagaagcgaagcuggg

SEQ ID NO: 184950 - RNA, 22 nt, Human
uugaggagcaggaugggaggcu

SEQ ID NO: 184951 - RNA, 22 nt, Human
ucccaaaguauuagcauuucaa

SEQ ID NO: 184952 - RNA, 18 nt, Human
agcccaggcaucgucugc

SEQ ID NO: 184953 - RNA, 22 nt, Human
uuggaauuugcuucagcuaaua

SEQ ID NO: 184954 - RNA, 21 nt, Human
aguccaggaggaggccagguu

SEQ ID NO: 184955 - RNA, 22 nt, Human
cugcacugaagaaaggagcucu

SEQ ID NO: 184956 - RNA, 22 nt, Human
ccagcuccucuugucucuagca

SEQ ID NO: 184957 - RNA, 22 nt, Human
cgccccagccaguugagcggcg

SEQ ID NO: 184958 - RNA, 20 nt, Human
ccuucagaacuuacauagua

SEQ ID NO: 184959 - RNA, 22 nt, Human
gaagcuggagaaugggucuagg

SEQ ID NO: 184960 - RNA, 22 nt, Human
cccaaggcugcagugagcauga

SEQ ID NO: 184961 - RNA, 22 nt, Human
uguuuacagcugaucaggcauc

SEQ ID NO: 184962 - RNA, 22 nt, Human
aggcuuggaaguggcagaacug

SEQ ID NO: 184963 - RNA, 22 nt, Human
caucaagagucuuacuaucagu

SEQ ID NO: 184964 - RNA, 20 nt, Human
ucauuacagugcuaagaugu

SEQ ID NO: 184965 - RNA, 22 nt, Human
gaggaagaagcaaaccagcuaa

SEQ ID NO: 184966 - RNA, 22 nt, Human
aucucuguuagaucugcuuaaa

SEQ ID NO: 184967 - RNA, 22 nt, Human
agcugguguccuccuggagcug

SEQ ID NO: 184968 - RNA, 22 nt, Human
auguuuugcuggauguuggcua

SEQ ID NO: 184969 - RNA, 22 nt, Human
aagagacuauggugucuaugaa

SEQ ID NO: 184970 - RNA, 22 nt, Human
ucacagaaaaguggagagccua

SEQ ID NO: 184971 - RNA, 22 nt, Human
uucuggguaguaugguuaguuu

SEQ ID NO: 184972 - RNA, 22 nt, Human
auuuaauuaaucauggugaauu

SEQ ID NO: 184973 - RNA, 22 nt, Human
aucucugcguccccagcaucga

SEQ ID NO: 184974 - RNA, 22 nt, Human
auguggggacaaaaugauggcc

SEQ ID NO: 184975 - RNA, 22 nt, Human
uguccagggggcuuaccuggag

SEQ ID NO: 184976 - RNA, 22 nt, Human
ggacaggaugcugaagaugaag

SEQ ID NO: 184977 - RNA, 22 nt, Human
gcucucucgugaacaggugguu

SEQ ID NO: 184978 - RNA, 22 nt, Human
agugauuagaaaguacacuugg

SEQ ID NO: 184979 - RNA, 22 nt, Human
agcugcccaaggucacagagcu

SEQ ID NO: 184980 - RNA, 22 nt, Human
uaaaauguagcuucuaggcugg

SEQ ID NO: 184981 - RNA, 22 nt, Human
caucauacuguuuacacucaaa

SEQ ID NO: 184982 - RNA, 22 nt, Human
uacaaaaggaagagggaucuua

SEQ ID NO: 184983 - RNA, 22 nt, Human
uguuagaaaggcuauuggacca

SEQ ID NO: 184984 - RNA, 22 nt, Human
augcaggguucugggcuagaga

SEQ ID NO: 184985 - RNA, 22 nt, Human
uggaaacuagagaguuuguauu

SEQ ID NO: 184986 - RNA, 21 nt, Human
aaggcugagacaacucaggag

SEQ ID NO: 184987 - RNA, 22 nt, Human
caggcagggagcuggaaaggau

SEQ ID NO: 184988 - RNA, 22 nt, Human
uaaaugaagaaauggagauugu

SEQ ID NO: 184989 - RNA, 22 nt, Human
uaugcagcaccacucacugcag

SEQ ID NO: 184990 - RNA, 22 nt, Human
guugaaaauacagauuccuagg

SEQ ID NO: 184991 - RNA, 22 nt, Human
uuugcaguguucaucaguauuu

SEQ ID NO: 184992 - RNA, 21 nt, Human
uucuucaggccaaugcucauu

SEQ ID NO: 184993 - RNA, 22 nt, Human
aaaugcagauugucauucagga

SEQ ID NO: 184994 - RNA, 22 nt, Human
ccugggagguggagguugcagc

SEQ ID NO: 184995 - RNA, 22 nt, Human
ccuggagcacagcccaguccca

SEQ ID NO: 184996 - RNA, 22 nt, Human
ugaggcaggaguuaaugugcuc

SEQ ID NO: 184997 - RNA, 22 nt, Human
aucucuguaauuacaugauauu

SEQ ID NO: 184998 - RNA, 22 nt, Human
cugagcaguagagggucucuuu

SEQ ID NO: 184999 - RNA, 22 nt, Human
agcaguuuggaaaauacuagaa

SEQ ID NO: 185000 - RNA, 22 nt, Human
acuuguuuggucucauguuuaa

SEQ ID NO: 185001 - RNA, 22 nt, Human
cugugugccuagaggguggccg

SEQ ID NO: 185002 - RNA, 22 nt, Human
cuuuucugugaugcugacaguc

SEQ ID NO: 185003 - RNA, 22 nt, Human
aaaaguuaccucuguaauauaa

SEQ ID NO: 185004 - RNA, 22 nt, Human
gccagaagggguggauccaggc

SEQ ID NO: 185005 - RNA, 22 nt, Human
uuuucaguuacuguuuauguga

SEQ ID NO: 185006 - RNA, 22 nt, Human
gaggcagcggcucacagagaaa

SEQ ID NO: 185007 - RNA, 22 nt, Human
uacagucaagcauaagaaguca

SEQ ID NO: 185008 - RNA, 22 nt, Human
uguauauucacugagcaagggg

SEQ ID NO: 185009 - RNA, 22 nt, Human
caaauacuggguaaguuaauuu

SEQ ID NO: 185010 - RNA, 22 nt, Human
agagucagaaagcagacagggg

SEQ ID NO: 185011 - RNA, 22 nt, Human
aacaugcaugaagaaguuauau

SEQ ID NO: 185012 - RNA, 22 nt, Human
aaaaaccucaauuacuuuugca

SEQ ID NO: 185013 - RNA, 22 nt, Human
caccagggccccaggcugugcc

SEQ ID NO: 185014 - RNA, 22 nt, Human
aucuuuggguacaaacuugccu

SEQ ID NO: 185015 - RNA, 22 nt, Human
gugaccauccugguaaugaauc

SEQ ID NO: 185016 - RNA, 22 nt, Human
cugggcugcuguccacuagggu

SEQ ID NO: 185017 - RNA, 22 nt, Human
gcugggagaggcagcuuucgga

SEQ ID NO: 185018 - RNA, 22 nt, Human
acauuucuaauuuaauguaaca

SEQ ID NO: 185019 - RNA, 22 nt, Human
uaucagcucggaaucuguugaa

SEQ ID NO: 185020 - RNA, 22 nt, Human
caggccuugcgucccauggccu

SEQ ID NO: 185021 - RNA, 17 nt, Human
accagccucuccugggg

SEQ ID NO: 185022 - RNA, 23 nt, Human
auugaugacuugauuacacuuuu

SEQ ID NO: 185023 - RNA, 21 nt, Human
uuuguucauagcucacucuuu

SEQ ID NO: 185024 - RNA, 22 nt, Human
ccccacaggugucugaggcagg

SEQ ID NO: 185025 - RNA, 22 nt, Human
gugugcuguuguucagguagaa

SEQ ID NO: 185026 - RNA, 22 nt, Human
ucaguucugcuagaaaaacagu

SEQ ID NO: 185027 - RNA, 22 nt, Human
cugaagcaaaugaaacagcucu

SEQ ID NO: 185028 - RNA, 22 nt, Human
cagugucugggacagaaaguca

SEQ ID NO: 185029 - RNA, 22 nt, Human
gccuccaguuuuuuucugaacu

SEQ ID NO: 185030 - RNA, 22 nt, Human
acuuucauuuguaauaaacuuc

SEQ ID NO: 185031 - RNA, 22 nt, Human
gagucagaauuguauuuuaaac

SEQ ID NO: 185032 - RNA, 22 nt, Human
ucuccccagggguauggguauu

SEQ ID NO: 185033 - RNA, 22 nt, Human
cucccuggcacagcgagagguu

SEQ ID NO: 185034 - RNA, 22 nt, Human
uuugcuuuguuuaaaaguggua

SEQ ID NO: 185035 - RNA, 22 nt, Human
gacaggccagacaggagacuga

SEQ ID NO: 185036 - RNA, 22 nt, Human
agaaagcuggaagagcugggau

SEQ ID NO: 185037 - RNA, 18 nt, Human
uccuggcagucagagagg

SEQ ID NO: 185038 - RNA, 22 nt, Human
ugagaugcuaaagggcugcuca

SEQ ID NO: 185039 - RNA, 22 nt, Human
ucaauucuagagccuuacauug

SEQ ID NO: 185040 - RNA, 22 nt, Human
uuauucacaugggcucauucua

SEQ ID NO: 185041 - RNA, 22 nt, Human
gcuccuggcucuggccaaggga

SEQ ID NO: 185042 - RNA, 22 nt, Human
ucuuccagcuucuagaggaugc

SEQ ID NO: 185043 - RNA, 22 nt, Human
aagugcauuagauagaaugaug

SEQ ID NO: 185044 - RNA, 22 nt, Human
aucaagagaaggggaagaugaa

SEQ ID NO: 185045 - RNA, 22 nt, Human
acucuguagccuguaagagagc

SEQ ID NO: 185046 - RNA, 18 nt, Human
gacacaggagagaguccc

SEQ ID NO: 185047 - RNA, 22 nt, Human
auucucaaacaagugguuugau

SEQ ID NO: 185048 - RNA, 22 nt, Human
uccugugcuuuggaugcuuaga

SEQ ID NO: 185049 - RNA, 22 nt, Human
ggcucaggccuguaauccuagc

SEQ ID NO: 185050 - RNA, 23 nt, Human
guaaaauacgcagugcaguguga

SEQ ID NO: 185051 - RNA, 22 nt, Human
agggcugcccagugugagagcu

SEQ ID NO: 185052 - RNA, 22 nt, Human
cauccugagaggucucucuacc

SEQ ID NO: 185053 - RNA, 22 nt, Human
aauaagagcacuggcuuuggag

SEQ ID NO: 185054 - RNA, 22 nt, Human
auaugcuuaugaugguuaauuu

SEQ ID NO: 185055 - RNA, 22 nt, Human
acccagagaacugugccuugag

SEQ ID NO: 185056 - RNA, 21 nt, Human
guuugcaugaacaagucagcc

SEQ ID NO: 185057 - RNA, 22 nt, Human
ugaaauuauucuuaccaaggug

SEQ ID NO: 185058 - RNA, 22 nt, Human
cagcugaauggcucccugcuaa

SEQ ID NO: 185059 - RNA, 22 nt, Human
ggaggaaaggcucccucccucu

SEQ ID NO: 185060 - RNA, 22 nt, Human
uucaauucugaugaaggcaaua

SEQ ID NO: 185061 - RNA, 22 nt, Human
ugaagccauaggacagaggaua

SEQ ID NO: 185062 - RNA, 22 nt, Human
agggccagcugcagaauuagca

SEQ ID NO: 185063 - RNA, 22 nt, Human
cagauucacuaauagcuggccu

SEQ ID NO: 185064 - RNA, 22 nt, Human
gauggcuggcuauaucagggga

SEQ ID NO: 185065 - RNA, 20 nt, Human
caucaucacaugagccaauu

SEQ ID NO: 185066 - RNA, 22 nt, Human
gacacagguagaauaaaguacu

SEQ ID NO: 185067 - RNA, 22 nt, Human
aggccuggccccaguugcuagg

SEQ ID NO: 185068 - RNA, 22 nt, Human
agaaguggucugucuuccagau

SEQ ID NO: 185069 - RNA, 22 nt, Human
gagucuggcccugaugcaucau

SEQ ID NO: 185070 - RNA, 22 nt, Human
gauuagaauaugucagucauaa

SEQ ID NO: 185071 - RNA, 20 nt, Human
auauuucuuaagaacuuuca

SEQ ID NO: 185072 - RNA, 22 nt, Human
cauccauagauugagagauggu

SEQ ID NO: 185073 - RNA, 22 nt, Human
ugcccauguuucucuguauccc

SEQ ID NO: 185074 - RNA, 22 nt, Human
cuguuuaucucuaaccuguuua

SEQ ID NO: 185075 - RNA, 22 nt, Human
ucugauauaaaagugacauuca

SEQ ID NO: 185076 - RNA, 22 nt, Human
cuucucagcauuuugucagucu

SEQ ID NO: 185077 - RNA, 20 nt, Human
ucagguagaucuuugagguc

SEQ ID NO: 185078 - RNA, 22 nt, Human
aucacaucucaccacugcaacc

SEQ ID NO: 185079 - RNA, 22 nt, Human
ugaggccauggaacuagcuugg

SEQ ID NO: 185080 - RNA, 22 nt, Human
gcgugugugauaugccucugca

SEQ ID NO: 185081 - RNA, 22 nt, Human
uaauuauagcauuggaguggcc

SEQ ID NO: 185082 - RNA, 22 nt, Human
ugauuaaauuaauuaagaugag

SEQ ID NO: 185083 - RNA, 22 nt, Human
acaggaaaugaaaugguaucua

SEQ ID NO: 185084 - RNA, 22 nt, Human
aacuagaacgagaaagcugaac

SEQ ID NO: 185085 - RNA, 22 nt, Human
acggugcuggguauugggguuc

SEQ ID NO: 185086 - RNA, 22 nt, Human
auggcagcaguccauugccuca

SEQ ID NO: 185087 - RNA, 22 nt, Human
gugaaguugauuguuaucguca

SEQ ID NO: 185088 - RNA, 22 nt, Human
agucaguguagaaagcccaggc

SEQ ID NO: 185089 - RNA, 22 nt, Human
gugcugugugauccaugcuggc

SEQ ID NO: 185090 - RNA, 22 nt, Human
cacaguuaugggaaacguaguu

SEQ ID NO: 185091 - RNA, 22 nt, Human
ucugcugugucccuggucuccu

SEQ ID NO: 185092 - RNA, 22 nt, Human
accaugaugcauccuuaaggaa

SEQ ID NO: 185093 - RNA, 20 nt, Human
gcagugcuggugccucugcu

SEQ ID NO: 185094 - RNA, 22 nt, Human
ggagccugguuacuagagccug

SEQ ID NO: 185095 - RNA, 22 nt, Human
cugccuggggaaugugaggauu

SEQ ID NO: 185096 - RNA, 22 nt, Human
caggaaacauucccauaacaca

SEQ ID NO: 185097 - RNA, 22 nt, Human
uuuccaaguacugagcugucaa

SEQ ID NO: 185098 - RNA, 22 nt, Human
auuucagagaaugaaccuaauc

SEQ ID NO: 185099 - RNA, 19 nt, Human
aguuuagagagacucuaaa

SEQ ID NO: 185100 - RNA, 22 nt, Human
ggucaggaaaagacuccccaga

SEQ ID NO: 185101 - RNA, 22 nt, Human
agccugcugggaagggaggcuu

SEQ ID NO: 185102 - RNA, 22 nt, Human
uccagaaaaaguaauuuauuug

SEQ ID NO: 185103 - RNA, 22 nt, Human
agugggagcggcagucggggac

SEQ ID NO: 185104 - RNA, 22 nt, Human
agggcugaaacauaauccuucu

SEQ ID NO: 185105 - RNA, 21 nt, Human
uucaaaguuugccuaaagauu

SEQ ID NO: 185106 - RNA, 22 nt, Human
agagcuuugggacauuugcuag

SEQ ID NO: 185107 - RNA, 22 nt, Human
cauguacaguuuuucuguccug

SEQ ID NO: 185108 - RNA, 23 nt, Human
ugacagaccuucccagacaguca

SEQ ID NO: 185109 - RNA, 22 nt, Human
aaagugcagcugaaaacauccu

SEQ ID NO: 185110 - RNA, 22 nt, Human
uuucauucauuauacaguagag

SEQ ID NO: 185111 - RNA, 22 nt, Human
aggcucugucaggcggagcagc

SEQ ID NO: 185112 - RNA, 22 nt, Human
ccuugaaacccugacacucugu

SEQ ID NO: 185113 - RNA, 22 nt, Human
agcacaauagagcaguuaaaaa

SEQ ID NO: 185114 - RNA, 22 nt, Human
gagggugcaggaggaugguagu

SEQ ID NO: 185115 - RNA, 23 nt, Human
uuacaugugugcacacauucugg

SEQ ID NO: 185116 - RNA, 22 nt, Human
ggcucuugggagcucagaguug

SEQ ID NO: 185117 - RNA, 22 nt, Human
cuuuggaguucccuaauuuccc

SEQ ID NO: 185118 - RNA, 22 nt, Human
ugggccacacacagaagaauca

SEQ ID NO: 185119 - RNA, 22 nt, Human
ucacacauuugaaggccuguca

SEQ ID NO: 185120 - RNA, 22 nt, Human
uacauaauugucuuuguccuca

SEQ ID NO: 185121 - RNA, 22 nt, Human
aaaucccaaugcuagacccggu

SEQ ID NO: 185122 - RNA, 21 nt, Human
ccugugccaaaguguguuagg

SEQ ID NO: 185123 - RNA, 22 nt, Human
ugucuucagaauuaagaguaug

SEQ ID NO: 185124 - RNA, 22 nt, Human
ccagccuggggaggcagcuucu

SEQ ID NO: 185125 - RNA, 22 nt, Human
gagaugaagaggcccuuggagu

SEQ ID NO: 185126 - RNA, 22 nt, Human
uucccagucccaagaaaagcca

SEQ ID NO: 185127 - RNA, 21 nt, Human
uggaggaauaaagcacagaag

SEQ ID NO: 185128 - RNA, 19 nt, Human
uuucauguuuuuggugaga

SEQ ID NO: 185129 - RNA, 21 nt, Human
cucugcccagggccuccugcc

SEQ ID NO: 185130 - RNA, 22 nt, Human
acauucuauucugcaggacaag

SEQ ID NO: 185131 - RNA, 22 nt, Human
acuccugugggcauggcacccc

SEQ ID NO: 185132 - RNA, 20 nt, Human
guuuccuauuuaccuccuca

SEQ ID NO: 185133 - RNA, 22 nt, Human
gcauaggcacuuuccuccuccu

SEQ ID NO: 185134 - RNA, 22 nt, Human
gcagaggaucaggcucuggaaa

SEQ ID NO: 185135 - RNA, 22 nt, Human
cccugccuugggguccacaccg

SEQ ID NO: 185136 - RNA, 22 nt, Human
aagugauucuagucaugauucu

SEQ ID NO: 185137 - RNA, 22 nt, Human
uaaauacuuaguuuugugucua

SEQ ID NO: 185138 - RNA, 22 nt, Human
gcuccucuccucggagucgggg

SEQ ID NO: 185139 - RNA, 22 nt, Human
uuugacuccuuugugaaaagag

SEQ ID NO: 185140 - RNA, 22 nt, Human
ucaagcaacagaacugugagac

SEQ ID NO: 185141 - RNA, 22 nt, Human
ucuuguuucuucuaagcagcag

SEQ ID NO: 185142 - RNA, 22 nt, Human
aagguauuggggaauauuugac

SEQ ID NO: 185143 - RNA, 22 nt, Human
cauauuugguauaacuuaagca

SEQ ID NO: 185144 - RNA, 22 nt, Human
aaaguacaugcaauucuucuga

SEQ ID NO: 185145 - RNA, 22 nt, Human
ggcaagcucaggccucaggugu

SEQ ID NO: 185146 - RNA, 22 nt, Human
uccaggagguuuggaggaagca

SEQ ID NO: 185147 - RNA, 22 nt, Human
gcagggcacagacagugccaag

SEQ ID NO: 185148 - RNA, 17 nt, Human
ugagacagggcaggccc

SEQ ID NO: 185149 - RNA, 22 nt, Human
ugguggcuucugaggauggcga

SEQ ID NO: 185150 - RNA, 22 nt, Human
agugggaccggugcuauuccag

SEQ ID NO: 185151 - RNA, 22 nt, Human
gcugucugggaggccuccacuu

SEQ ID NO: 185152 - RNA, 22 nt, Human
cugcagggcauuguaacucuuu

SEQ ID NO: 185153 - RNA, 22 nt, Human
ugcaaauauuuccuuauagcca

SEQ ID NO: 185154 - RNA, 22 nt, Human
cccagcaggucggugcugccug

SEQ ID NO: 185155 - RNA, 22 nt, Human
ccugguccuuacgucauugcuu

SEQ ID NO: 185156 - RNA, 22 nt, Human
agcucccagcuccuuugagaga

SEQ ID NO: 185157 - RNA, 23 nt, Human
accagcugcccugaacuuugugc

SEQ ID NO: 185158 - RNA, 22 nt, Human
uggaagcuguggcauaacugag

SEQ ID NO: 185159 - RNA, 20 nt, Human
uggcagaguugucccaccca

SEQ ID NO: 185160 - RNA, 22 nt, Human
uagguucacuuagcugugggaa

SEQ ID NO: 185161 - RNA, 22 nt, Human
ugagcacagcuuucacuagaaa

SEQ ID NO: 185162 - RNA, 22 nt, Human
auacuuuagagcuagauugccu

SEQ ID NO: 185163 - RNA, 22 nt, Human
aaggccaggcagggagcuguga

SEQ ID NO: 185164 - RNA, 22 nt, Human
ggcugcccucgucuacugccca

SEQ ID NO: 185165 - RNA, 18 nt, Human
agcuccuggucucaggga

SEQ ID NO: 185166 - RNA, 22 nt, Human
uacaaacuuguuuuaaguaagu

SEQ ID NO: 185167 - RNA, 22 nt, Human
cacagcagacagggaggcggcu

SEQ ID NO: 185168 - RNA, 22 nt, Human
augugaaaaauuucuuauuaca

SEQ ID NO: 185169 - RNA, 22 nt, Human
gaaacauuuguugaguacuugc

SEQ ID NO: 185170 - RNA, 22 nt, Human
uccaguuuccaaucacugcacg

SEQ ID NO: 185171 - RNA, 22 nt, Human
uuagaacaguagaagaaagggu

SEQ ID NO: 185172 - RNA, 22 nt, Human
gaaaggcucagauucccccagg

SEQ ID NO: 185173 - RNA, 22 nt, Human
uuucuuuccagagugauuggca

SEQ ID NO: 185174 - RNA, 22 nt, Human
ucuggcucuauaacuccuagcu

SEQ ID NO: 185175 - RNA, 22 nt, Human
cugugugucauuugucaauccu

SEQ ID NO: 185176 - RNA, 22 nt, Human
cauaacauuaagccucuauuuc

SEQ ID NO: 185177 - RNA, 22 nt, Human
ccugggaggcggagguugcagg

SEQ ID NO: 185178 - RNA, 22 nt, Human
cugcauaugauagaugccuugc

SEQ ID NO: 185179 - RNA, 22 nt, Human
ucagcuguguaucccagggccu

SEQ ID NO: 185180 - RNA, 22 nt, Human
uggcugugucccuguccagagu

SEQ ID NO: 185181 - RNA, 22 nt, Human
ucauuuaugcaggaauggcaua

SEQ ID NO: 185182 - RNA, 22 nt, Human
gggugggacucuuuggccugag

SEQ ID NO: 185183 - RNA, 22 nt, Human
uuaagacacauuucucagacgg

SEQ ID NO: 185184 - RNA, 22 nt, Human
uggcucagccagcccuaggaac

SEQ ID NO: 185185 - RNA, 22 nt, Human
uguuagcagagcagcugacaga

SEQ ID NO: 185186 - RNA, 22 nt, Human
agcauaaaggucaacguuuuag

SEQ ID NO: 185187 - RNA, 22 nt, Human
gagucagaaacucacucuauag

SEQ ID NO: 185188 - RNA, 22 nt, Human
aagggcuggucuagaaagggag

SEQ ID NO: 185189 - RNA, 20 nt, Human
ugguccugucccacccacuc

SEQ ID NO: 185190 - RNA, 22 nt, Human
cagcugaguuuccaagucugcc

SEQ ID NO: 185191 - RNA, 22 nt, Human
gacaagcucgccugccccggaa

SEQ ID NO: 185192 - RNA, 22 nt, Human
uacaaugcugugcauguaaugg

SEQ ID NO: 185193 - RNA, 16 nt, Human
gaggcuggcagauguc

SEQ ID NO: 185194 - RNA, 22 nt, Human
ucauggaaacagcaaugcuaau

SEQ ID NO: 185195 - RNA, 23 nt, Human
uuucacagcuuuuauucugcauc

SEQ ID NO: 185196 - RNA, 22 nt, Human
agccccagccccucucucacaa

SEQ ID NO: 185197 - RNA, 22 nt, Human
agaguguuucagucuuccuaga

SEQ ID NO: 185198 - RNA, 22 nt, Human
auguuucugaguguauauacau

SEQ ID NO: 185199 - RNA, 22 nt, Human
ucaauaacuuuguuuagcauug

SEQ ID NO: 185200 - RNA, 22 nt, Human
agagaagggccuguauguaauc

SEQ ID NO: 185201 - RNA, 22 nt, Human
uagguguccucguccaaagauu

SEQ ID NO: 185202 - RNA, 22 nt, Human
cucccuggaggugagcuggcac

SEQ ID NO: 185203 - RNA, 22 nt, Human
caggcugcauggagggguacag

SEQ ID NO: 185204 - RNA, 22 nt, Human
augagagccaccaugcuucugu

SEQ ID NO: 185205 - RNA, 22 nt, Human
uucacauucucacaagaggaaa

SEQ ID NO: 185206 - RNA, 22 nt, Human
agcuuuaucacaauauuggcua

SEQ ID NO: 185207 - RNA, 22 nt, Human
guacauucagcuuagcacuucu

SEQ ID NO: 185208 - RNA, 22 nt, Human
guuuauugauaaaagcuggaca

SEQ ID NO: 185209 - RNA, 22 nt, Human
gaaggccucacucugcagcaua

SEQ ID NO: 185210 - RNA, 22 nt, Human
caggcagcaucagucugcugua

SEQ ID NO: 185211 - RNA, 22 nt, Human
aggcccuggucaggucuggcug

SEQ ID NO: 185212 - RNA, 23 nt, Human
cacuccuguuucuaagccagcau

SEQ ID NO: 185213 - RNA, 19 nt, Human
guucuuuucaccucugugc

SEQ ID NO: 185214 - RNA, 18 nt, Human
gcaggcuuuuccuggguc

SEQ ID NO: 185215 - RNA, 22 nt, Human
uaaaucuucuacaucaucauaa

SEQ ID NO: 185216 - RNA, 22 nt, Human
guauacaauacacaaugcucug

SEQ ID NO: 185217 - RNA, 22 nt, Human
aagcauuuauagauaagaauuu

SEQ ID NO: 185218 - RNA, 22 nt, Human
ucuucuguauuguuaacucagg

SEQ ID NO: 185219 - RNA, 17 nt, Human
ggaaaaggaugauacag

SEQ ID NO: 185220 - RNA, 22 nt, Human
ucaaaggcgguccaggaauaaa

SEQ ID NO: 185221 - RNA, 22 nt, Human
uuuauucacuggggucugcccg

SEQ ID NO: 185222 - RNA, 22 nt, Human
gccaguguuuauagcagugagg

SEQ ID NO: 185223 - RNA, 22 nt, Human
gaguguauggaaggaagagauu

SEQ ID NO: 185224 - RNA, 22 nt, Human
cuuaaaggucauucuguugaua

SEQ ID NO: 185225 - RNA, 22 nt, Human
aaaauucucuugaucuugacag

SEQ ID NO: 185226 - RNA, 22 nt, Human
gucuaugauauuuuguuauagc

SEQ ID NO: 185227 - RNA, 22 nt, Human
aaucuucuacuugacaguucuc

SEQ ID NO: 185228 - RNA, 22 nt, Human
ggacaggugugaggcuggcaca

SEQ ID NO: 185229 - RNA, 22 nt, Human
gcuccagcaccuagagcagguc

SEQ ID NO: 185230 - RNA, 17 nt, Human
auuucacuuagcaugag

SEQ ID NO: 185231 - RNA, 22 nt, Human
agacaauggaccaagcaccuuc

SEQ ID NO: 185232 - RNA, 22 nt, Human
gaggcaguggucugaugcaagg

SEQ ID NO: 185233 - RNA, 22 nt, Human
uucagucucaagugcugcucac

SEQ ID NO: 185234 - RNA, 22 nt, Human
ucagaacauuuaaaaagugguu

SEQ ID NO: 185235 - RNA, 22 nt, Human
uaugaacugugagugugauggg

SEQ ID NO: 185236 - RNA, 22 nt, Human
ccucccacuucuugcugagguc

SEQ ID NO: 185237 - RNA, 17 nt, Human
uuucaaagcagucagga

SEQ ID NO: 185238 - RNA, 22 nt, Human
uccaggcuagccugguagagaa

SEQ ID NO: 185239 - RNA, 22 nt, Human
auucuucauggcugugaguccu

SEQ ID NO: 185240 - RNA, 21 nt, Human
ucuccaguugacagugucucc

SEQ ID NO: 185241 - RNA, 22 nt, Human
cauggcagccugcccugcuugc

SEQ ID NO: 185242 - RNA, 22 nt, Human
gacaggcuggcaaugcccugcu

SEQ ID NO: 185243 - RNA, 22 nt, Human
acaggcagagaacucagccaga

SEQ ID NO: 185244 - RNA, 22 nt, Human
aguggcagguguuucguggugc

SEQ ID NO: 185245 - RNA, 22 nt, Human
cucugaggaagucaaguagcca

SEQ ID NO: 185246 - RNA, 22 nt, Human
caggaagauuagaccaagagcu

SEQ ID NO: 185247 - RNA, 22 nt, Human
gcuguggcgauugguaucgauu

SEQ ID NO: 185248 - RNA, 22 nt, Human
agauaaacccaacuuaaugaag

SEQ ID NO: 185249 - RNA, 22 nt, Human
uuugaaaggugucgagaugugu

SEQ ID NO: 185250 - RNA, 22 nt, Human
ugcugggcuugaaagcugcuaa

SEQ ID NO: 185251 - RNA, 19 nt, Human
ugccuggcaccagcuccac

SEQ ID NO: 185252 - RNA, 22 nt, Human
uuucaaaguggagaauuagaca

SEQ ID NO: 185253 - RNA, 22 nt, Human
acuuuacucuucauaugugaca

SEQ ID NO: 185254 - RNA, 22 nt, Human
cacugagaccagagucccugac

SEQ ID NO: 185255 - RNA, 22 nt, Human
cugccagggaggcugggaaguu

SEQ ID NO: 185256 - RNA, 18 nt, Human
ugggcacaaugaacagca

SEQ ID NO: 185257 - RNA, 22 nt, Human
uauuccagaugaaaucauucag

SEQ ID NO: 185258 - RNA, 22 nt, Human
aauagcauguuaauaaccagag

SEQ ID NO: 185259 - RNA, 22 nt, Human
cauuuguaguuaaaaaugucuc

SEQ ID NO: 185260 - RNA, 23 nt, Human
acagggcuuaucugucacucauc

SEQ ID NO: 185261 - RNA, 22 nt, Human
ggcugaggggcccagaggaaca

SEQ ID NO: 185262 - RNA, 22 nt, Human
gggcucuggaguucuagaaaga

SEQ ID NO: 185263 - RNA, 22 nt, Human
uaccucaaguuccaggaaagcg

SEQ ID NO: 185264 - RNA, 22 nt, Human
auuucucauuuugcuucaaagg

SEQ ID NO: 185265 - RNA, 22 nt, Human
ccaggcuguuuucaaacuuggg

SEQ ID NO: 185266 - RNA, 19 nt, Human
uuucuaguuucagcuuguc

SEQ ID NO: 185267 - RNA, 22 nt, Human
aaauauguuuuccaguugucau

SEQ ID NO: 185268 - RNA, 22 nt, Human
ccuuugugguggcccagugugg

SEQ ID NO: 185269 - RNA, 22 nt, Human
gcccugguuuuagaggagcagg

SEQ ID NO: 185270 - RNA, 22 nt, Human
aguuuacaaaguuucacuguuc

SEQ ID NO: 185271 - RNA, 22 nt, Human
caucacuacaaauuuaagaaau

SEQ ID NO: 185272 - RNA, 19 nt, Human
aaugaguuccaugaaaaga

SEQ ID NO: 185273 - RNA, 22 nt, Human
uaaaguuuguagcaauugauau

SEQ ID NO: 185274 - RNA, 22 nt, Human
uucuagaaacuggagcaaacag

SEQ ID NO: 185275 - RNA, 22 nt, Human
agauccaucaucauauuuucua

SEQ ID NO: 185276 - RNA, 22 nt, Human
gagcugcagcggcugacgcaac

SEQ ID NO: 185277 - RNA, 22 nt, Human
acauuugagcauauuucuuguc

SEQ ID NO: 185278 - RNA, 22 nt, Human
auuuacaggacagcuuggcauu

SEQ ID NO: 185279 - RNA, 22 nt, Human
cugaggaagacagcagcugugu

SEQ ID NO: 185280 - RNA, 22 nt, Human
uauagcaacuccaaagagacuu

SEQ ID NO: 185281 - RNA, 17 nt, Human
ucagcaaagacaaagga

SEQ ID NO: 185282 - RNA, 22 nt, Human
gcuguucuccgaugaccccgug

SEQ ID NO: 185283 - RNA, 22 nt, Human
auuagauacacagauuuccacu

SEQ ID NO: 185284 - RNA, 22 nt, Human
uucuuuuuaaaguguguaugca

SEQ ID NO: 185285 - RNA, 22 nt, Human
cggcagagcggcgagccccucc

SEQ ID NO: 185286 - RNA, 22 nt, Human
aaagcagugcaccuuaauugau

SEQ ID NO: 185287 - RNA, 19 nt, Human
uggcugagcuggacugagg

SEQ ID NO: 185288 - RNA, 22 nt, Human
uguacauagaaaggauacagcu

SEQ ID NO: 185289 - RNA, 20 nt, Human
accagagauagcaauagugc

SEQ ID NO: 185290 - RNA, 22 nt, Human
auuucuguuugcuacuauaagu

SEQ ID NO: 185291 - RNA, 22 nt, Human
gugaauuacauguauuuuuaag

SEQ ID NO: 185292 - RNA, 22 nt, Human
ucuuuuaagccucuggcauagg

SEQ ID NO: 185293 - RNA, 22 nt, Human
ggcagugcaaggcagccuggau

SEQ ID NO: 185294 - RNA, 22 nt, Human
cuacccagcaccuaggcugccu

SEQ ID NO: 185295 - RNA, 19 nt, Human
acauugaauuuucuucuuu

SEQ ID NO: 185296 - RNA, 22 nt, Human
gagcugccuacauugccaagag

SEQ ID NO: 185297 - RNA, 22 nt, Human
ugagggcuccccgcugcugugu

SEQ ID NO: 185298 - RNA, 22 nt, Human
aggcccugcccagugccacaag

SEQ ID NO: 185299 - RNA, 22 nt, Human
cugaggccgucugggucugcag

SEQ ID NO: 185300 - RNA, 22 nt, Human
aggauaacuuugaaaguaaauu

SEQ ID NO: 185301 - RNA, 22 nt, Human
agccagaggaacuugaugacug

SEQ ID NO: 185302 - RNA, 20 nt, Human
cagggccacgcuccaaggca

SEQ ID NO: 185303 - RNA, 22 nt, Human
agaaucuucagucuaauuccua

SEQ ID NO: 185304 - RNA, 20 nt, Human
ccacagaggacagggcugug

SEQ ID NO: 185305 - RNA, 22 nt, Human
agcacauaccagaaccacaggu

SEQ ID NO: 185306 - RNA, 22 nt, Human
aggaggcuguggagcacuccau

SEQ ID NO: 185307 - RNA, 22 nt, Human
aggcuucugugagcucauacaa

SEQ ID NO: 185308 - RNA, 22 nt, Human
gagaauuagggcguaauucaga

SEQ ID NO: 185309 - RNA, 22 nt, Human
cugggccuagcaacagaggagu

SEQ ID NO: 185310 - RNA, 22 nt, Human
agacagguaaauagagaugcug

SEQ ID NO: 185311 - RNA, 22 nt, Human
ugaggggauacgguacacauug

SEQ ID NO: 185312 - RNA, 22 nt, Human
cucugugauucucauguaccac

SEQ ID NO: 185313 - RNA, 22 nt, Human
cuuuaauucucaggugcacaua

SEQ ID NO: 185314 - RNA, 22 nt, Human
uggagaagauuggucaccauuc

SEQ ID NO: 185315 - RNA, 22 nt, Human
ucugggugaugaaaugcacugu

SEQ ID NO: 185316 - RNA, 22 nt, Human
ugcucugcacaucccucacaaa

SEQ ID NO: 185317 - RNA, 22 nt, Human
cagcuccugggccaucuccuag

SEQ ID NO: 185318 - RNA, 20 nt, Human
aaugaaguuauuaaugaugu

SEQ ID NO: 185319 - RNA, 22 nt, Human
gccaccagugggggccugggca

SEQ ID NO: 185320 - RNA, 22 nt, Human
uuggaggaagcucaugggggau

SEQ ID NO: 185321 - RNA, 22 nt, Human
ggcaagagguccaagaggucuc

SEQ ID NO: 185322 - RNA, 22 nt, Human
acagcuuuguguuaaugggaag

SEQ ID NO: 185323 - RNA, 22 nt, Human
ccuggaaaacaugggaaucaca

SEQ ID NO: 185324 - RNA, 22 nt, Human
uggggcucaccuaggcuggaag

SEQ ID NO: 185325 - RNA, 22 nt, Human
ugguacaaucacagcucacugu

SEQ ID NO: 185326 - RNA, 22 nt, Human
uucuagaggggagauacuagua

SEQ ID NO: 185327 - RNA, 22 nt, Human
uuucaguugccaagcuaauucu

SEQ ID NO: 185328 - RNA, 22 nt, Human
aggguccaguaacagaugccag

SEQ ID NO: 185329 - RNA, 22 nt, Human
uuggcagagggaccagccuaca

SEQ ID NO: 185330 - RNA, 22 nt, Human
uuucuuagcgaugcuugauaaa

SEQ ID NO: 185331 - RNA, 22 nt, Human
caaggcauuucgcuuagagaga

SEQ ID NO: 185332 - RNA, 22 nt, Human
agacagugacuuagugaccaga

SEQ ID NO: 185333 - RNA, 22 nt, Human
aggaagugaaagggaaggaguu

SEQ ID NO: 185334 - RNA, 19 nt, Human
uccucagugacaaccucag

SEQ ID NO: 185335 - RNA, 21 nt, Human
augugaaauaucaucagagca

SEQ ID NO: 185336 - RNA, 22 nt, Human
aacacuuuuuauauauuguauc

SEQ ID NO: 185337 - RNA, 22 nt, Human
gccaggaaauucaugccagauc

SEQ ID NO: 185338 - RNA, 22 nt, Human
agggccugcaucaggagcuugg

SEQ ID NO: 185339 - RNA, 18 nt, Human
ucagggaaucuuggccuu

SEQ ID NO: 185340 - RNA, 22 nt, Human
cucuccccacacccucugcaug

SEQ ID NO: 185341 - RNA, 22 nt, Human
ucuuguuucuguauauaaugac

SEQ ID NO: 185342 - RNA, 22 nt, Human
uuuuuuggugcuccuaggaagg

SEQ ID NO: 185343 - RNA, 22 nt, Human
gcacagcucgagcucaggaggg

SEQ ID NO: 185344 - RNA, 22 nt, Human
aaggccuccgccaauggcagag

SEQ ID NO: 185345 - RNA, 22 nt, Human
acacuguagcugagggcaugcg

SEQ ID NO: 185346 - RNA, 22 nt, Human
uccaguguguguccagcugcug

SEQ ID NO: 185347 - RNA, 23 nt, Human
gauugcuguaugcaggagcauuc

SEQ ID NO: 185348 - RNA, 22 nt, Human
uuucauuacguguuugacuugu

SEQ ID NO: 185349 - RNA, 22 nt, Human
aauuuguuauaacuugggcuga

SEQ ID NO: 185350 - RNA, 22 nt, Human
gcccucugcucagcuccucagc

SEQ ID NO: 185351 - RNA, 20 nt, Human
cccagccccuaccuguugcc

SEQ ID NO: 185352 - RNA, 22 nt, Human
gaaaucuacuuagugucuggau

SEQ ID NO: 185353 - RNA, 22 nt, Human
ggcuccacugcugaccacucca

SEQ ID NO: 185354 - RNA, 22 nt, Human
agugucugcaaaaugaaagagc

SEQ ID NO: 185355 - RNA, 22 nt, Human
cagcagcauugcucuggauucc

SEQ ID NO: 185356 - RNA, 22 nt, Human
caucccugguuccuguguuuaa

SEQ ID NO: 185357 - RNA, 22 nt, Human
ccuaggccuuacuuuccugugc

SEQ ID NO: 185358 - RNA, 22 nt, Human
uugugagaugauuugaaagugu

SEQ ID NO: 185359 - RNA, 22 nt, Human
gcuuucagggucacugucaaca

SEQ ID NO: 185360 - RNA, 22 nt, Human
aguucacagccauguucaugug

SEQ ID NO: 185361 - RNA, 20 nt, Human
uccagcccugcuucucucuu

SEQ ID NO: 185362 - RNA, 22 nt, Human
accugggauggggccagguuua

SEQ ID NO: 185363 - RNA, 22 nt, Human
uggcugagaccaucagggugua

SEQ ID NO: 185364 - RNA, 22 nt, Human
augcuuuuuaaacuuaauugga

SEQ ID NO: 185365 - RNA, 22 nt, Human
aagauuuucucaacuguauuug

SEQ ID NO: 185366 - RNA, 22 nt, Human
ucaugccaaaauccaguggcuu

SEQ ID NO: 185367 - RNA, 22 nt, Human
cagggagcaggcucuguccauc

SEQ ID NO: 185368 - RNA, 22 nt, Human
gcagggaggaagagaugcuucc

SEQ ID NO: 185369 - RNA, 22 nt, Human
uggugcccauguaucccuucac

SEQ ID NO: 185370 - RNA, 22 nt, Human
cuacauuucccagcugccuucc

SEQ ID NO: 185371 - RNA, 22 nt, Human
ucugaaauagaagugucuuucu

SEQ ID NO: 185372 - RNA, 22 nt, Human
gguggggccugcuccagcggcc

SEQ ID NO: 185373 - RNA, 22 nt, Human
agagcacagaagaauaggugcu

SEQ ID NO: 185374 - RNA, 22 nt, Human
ucccagggucaguggugaggcc

SEQ ID NO: 185375 - RNA, 22 nt, Human
acauuucuuccacaugcugcug

SEQ ID NO: 185376 - RNA, 22 nt, Human
gaggcaguguuuacugcccugu

SEQ ID NO: 185377 - RNA, 22 nt, Human
ugaggaaggaauugagguuuua

SEQ ID NO: 185378 - RNA, 22 nt, Human
ugccuuccugcuuugaguucug

SEQ ID NO: 185379 - RNA, 22 nt, Human
caguggcagagccguugccauc

SEQ ID NO: 185380 - RNA, 22 nt, Human
aauaacagugccaugaaauuga

SEQ ID NO: 185381 - RNA, 22 nt, Human
uuguccagcgaccaggcucugu

SEQ ID NO: 185382 - RNA, 22 nt, Human
agaacucuauauucaugaacaa

SEQ ID NO: 185383 - RNA, 19 nt, Human
ucugaggguccagaugcau

SEQ ID NO: 185384 - RNA, 22 nt, Human
gcccaggagguugggcugugca

SEQ ID NO: 185385 - RNA, 22 nt, Human
gaggcuuuauaacuauuuguuc

SEQ ID NO: 185386 - RNA, 22 nt, Human
acccagagcccuuagcacagac

SEQ ID NO: 185387 - RNA, 22 nt, Human
aauauguuccacuuaaagcugg

SEQ ID NO: 185388 - RNA, 22 nt, Human
uuucauugucaauaaacuguau

SEQ ID NO: 185389 - RNA, 22 nt, Human
gaacuauucauucucauuagcg

SEQ ID NO: 185390 - RNA, 22 nt, Human
uguccuuugggagggcacagcu

SEQ ID NO: 185391 - RNA, 22 nt, Human
agaacagaggccuuauguuuca

SEQ ID NO: 185392 - RNA, 22 nt, Human
acucugggaauccucaccuucc

SEQ ID NO: 185393 - RNA, 22 nt, Human
cuggcucccgucugguggccau

SEQ ID NO: 185394 - RNA, 22 nt, Human
agucacagguucuugggauuag

SEQ ID NO: 185395 - RNA, 22 nt, Human
ucucagcucuuuuuucacagaa

SEQ ID NO: 185396 - RNA, 22 nt, Human
uucauguuuccucuugugcugc

SEQ ID NO: 185397 - RNA, 22 nt, Human
cagagcacccaaggagcauuug

SEQ ID NO: 185398 - RNA, 22 nt, Human
uccaugaggcagggaggcuggc

SEQ ID NO: 185399 - RNA, 22 nt, Human
gaaucauucauugcucaauuaa

SEQ ID NO: 185400 - RNA, 22 nt, Human
ccuggcuccugcacagaucuuu

SEQ ID NO: 185401 - RNA, 22 nt, Human
ccugguggcuucuggguggacg

SEQ ID NO: 185402 - RNA, 22 nt, Human
agcucccugagaugccacagca

SEQ ID NO: 185403 - RNA, 22 nt, Human
ccaggccucaccugcccaccua

SEQ ID NO: 185404 - RNA, 20 nt, Human
caggccagagguuugauggc

SEQ ID NO: 185405 - RNA, 22 nt, Human
ccagaggaaaaauaucucccua

SEQ ID NO: 185406 - RNA, 22 nt, Human
cggagggguuugaacagaggag

SEQ ID NO: 185407 - RNA, 22 nt, Human
uuagaacaauauucucccuaca

SEQ ID NO: 185408 - RNA, 22 nt, Human
ucugcucuguacugcacuggcc

SEQ ID NO: 185409 - RNA, 22 nt, Human
aggggcugacuggaaagugcca

SEQ ID NO: 185410 - RNA, 22 nt, Human
caggcacaauuauuucccuuuc

SEQ ID NO: 185411 - RNA, 22 nt, Human
ucagaggucagcagcuugccca

SEQ ID NO: 185412 - RNA, 22 nt, Human
cugcuuuaauguaagauauacc

SEQ ID NO: 185413 - RNA, 22 nt, Human
ugagauuuuccuaaauauaaug

SEQ ID NO: 185414 - RNA, 22 nt, Human
aagcacaguaaaagcagauuuu

SEQ ID NO: 185415 - RNA, 18 nt, Human
ggaaaaggagugucuagc

SEQ ID NO: 185416 - RNA, 21 nt, Human
gcuccuggugcugcguggcgc

SEQ ID NO: 185417 - RNA, 22 nt, Human
aggcacagagagguuaaaugca

SEQ ID NO: 185418 - RNA, 22 nt, Human
ucagagaccuagcaagaaauug

SEQ ID NO: 185419 - RNA, 22 nt, Human
uccauacuggaguccacaguuc

SEQ ID NO: 185420 - RNA, 22 nt, Human
gccagcugguaggcaccuagcc

SEQ ID NO: 185421 - RNA, 22 nt, Human
ucaucuuuguaucccuaacaca

SEQ ID NO: 185422 - RNA, 22 nt, Human
cugugucccaguaccuugggua

SEQ ID NO: 185423 - RNA, 22 nt, Human
aagugcaggaguggggaaagua

SEQ ID NO: 185424 - RNA, 19 nt, Human
ccagcagacacagcugccc

SEQ ID NO: 185425 - RNA, 22 nt, Human
aauauguugagucuaucuuuau

SEQ ID NO: 185426 - RNA, 22 nt, Human
aguuugaagaaggugagaugca

SEQ ID NO: 185427 - RNA, 22 nt, Human
ucacacagugagaaagugcgga

SEQ ID NO: 185428 - RNA, 22 nt, Human
ggcucugcuggauugaggccag

SEQ ID NO: 185429 - RNA, 22 nt, Human
uggaaagaaaaacaggccauga

SEQ ID NO: 185430 - RNA, 22 nt, Human
gaggccuggugugucucccgcu

SEQ ID NO: 185431 - RNA, 22 nt, Human
ccacaguagcauccaaacagua

SEQ ID NO: 185432 - RNA, 22 nt, Human
acuguucauuuguccuguaucu

SEQ ID NO: 185433 - RNA, 22 nt, Human
aagaaaggauauaugggaggua

SEQ ID NO: 185434 - RNA, 22 nt, Human
gaggaccacagaugagccugca

SEQ ID NO: 185435 - RNA, 22 nt, Human
aaugcacauaaauauggucuua

SEQ ID NO: 185436 - RNA, 22 nt, Human
ccccucagguacccgugcagca

SEQ ID NO: 185437 - RNA, 22 nt, Human
acaagugugugcaguuuguaaa

SEQ ID NO: 185438 - RNA, 22 nt, Human
uuccccuugggcuguggaggag

SEQ ID NO: 185439 - RNA, 18 nt, Human
cacuggaagauuaggguc

SEQ ID NO: 185440 - RNA, 22 nt, Human
ucuuggacucaaaauugccuua

SEQ ID NO: 185441 - RNA, 22 nt, Human
gccuggccgcuccgagcuccgc

SEQ ID NO: 185442 - RNA, 22 nt, Human
uuauuccauuauuucacuuagg

SEQ ID NO: 185443 - RNA, 22 nt, Human
uugguacagaugagguauucuc

SEQ ID NO: 185444 - RNA, 22 nt, Human
ucugugcaggauuugaggaacc

SEQ ID NO: 185445 - RNA, 22 nt, Human
cuguaaaacacuguaguaucug

SEQ ID NO: 185446 - RNA, 20 nt, Human
ucccucccuccagcucuggg

SEQ ID NO: 185447 - RNA, 22 nt, Human
agaaauagucacauuggaggaa

SEQ ID NO: 185448 - RNA, 22 nt, Human
uggccaggcagguagaacggcc

SEQ ID NO: 185449 - RNA, 22 nt, Human
cacaucuucuuaacuccaaagu

SEQ ID NO: 185450 - RNA, 22 nt, Human
gagcaagacccuggguucucuc

SEQ ID NO: 185451 - RNA, 23 nt, Human
cugugggaagucggggagcgcgc

SEQ ID NO: 185452 - RNA, 22 nt, Human
ccuggcuccaaagcugugacuc

SEQ ID NO: 185453 - RNA, 22 nt, Human
guuuuccauggaggucugaccu

SEQ ID NO: 185454 - RNA, 22 nt, Human
ucacagugauaacuaaguccug

SEQ ID NO: 185455 - RNA, 22 nt, Human
uccaggagguugagugaguucc

SEQ ID NO: 185456 - RNA, 22 nt, Human
ccaggcucagcuauuaagaaac

SEQ ID NO: 185457 - RNA, 22 nt, Human
uacauacagagaugcuaguuaa

SEQ ID NO: 185458 - RNA, 22 nt, Human
uuauacauguuuauaagguuga

SEQ ID NO: 185459 - RNA, 22 nt, Human
gcuggaguuggcaaggcaugua

SEQ ID NO: 185460 - RNA, 22 nt, Human
agcaggcaguguagagccuuca

SEQ ID NO: 185461 - RNA, 22 nt, Human
gccaggcagcaggaagccagug

SEQ ID NO: 185462 - RNA, 22 nt, Human
gugcccaggugucccugagaag

SEQ ID NO: 185463 - RNA, 22 nt, Human
agguacagaugaaagucuaguu

SEQ ID NO: 185464 - RNA, 22 nt, Human
gggcccucagucccaggccuuc

SEQ ID NO: 185465 - RNA, 22 nt, Human
cacugguacacugaauggcguu

SEQ ID NO: 185466 - RNA, 22 nt, Human
uccucagagaugggcaucuaag

SEQ ID NO: 185467 - RNA, 22 nt, Human
ucagggcaaugucccucagaag

SEQ ID NO: 185468 - RNA, 22 nt, Human
ucccucaggugguucuuguuuc

SEQ ID NO: 185469 - RNA, 22 nt, Human
ucugaggaauaagaaggaagug

SEQ ID NO: 185470 - RNA, 22 nt, Human
augauuuaaagucauugugaac

SEQ ID NO: 185471 - RNA, 22 nt, Human
gguccaaggcucgguggcgggg

SEQ ID NO: 185472 - RNA, 22 nt, Human
gaggcugguaggaaaggaaaca

SEQ ID NO: 185473 - RNA, 22 nt, Human
uuacuguuuugguaccucauug

SEQ ID NO: 185474 - RNA, 22 nt, Human
agaaucuucgguaacuggaaga

SEQ ID NO: 185475 - RNA, 22 nt, Human
uguguucauuuaacuguucuuu

SEQ ID NO: 185476 - RNA, 21 nt, Human
uugcugcccucccuuuccuca

SEQ ID NO: 185477 - RNA, 22 nt, Human
ucugccugcggcugcagguggc

SEQ ID NO: 185478 - RNA, 23 nt, Human
ucucagaaaggagaaguaauuug

SEQ ID NO: 185479 - RNA, 22 nt, Human
caggggcucuaaugcaugauca

SEQ ID NO: 185480 - RNA, 22 nt, Human
gcauucuucacuaggugagagc

SEQ ID NO: 185481 - RNA, 16 nt, Human
caccaguccuuccugc

SEQ ID NO: 185482 - RNA, 22 nt, Human
ugggagcaagcuggugcuggag

SEQ ID NO: 185483 - RNA, 22 nt, Human
gacaucuggaggagaugaaugg

SEQ ID NO: 185484 - RNA, 22 nt, Human
augccaaagcccaaguucauca

SEQ ID NO: 185485 - RNA, 18 nt, Human
ugacauuuccagagugua

SEQ ID NO: 185486 - RNA, 22 nt, Human
uggguccucgucuuccaaggca

SEQ ID NO: 185487 - RNA, 20 nt, Human
aggcacaguuccuaguuggg

SEQ ID NO: 185488 - RNA, 22 nt, Human
aaaucacugauuaaaguuagaa

SEQ ID NO: 185489 - RNA, 22 nt, Human
uggcucagauaauucaaggggc

SEQ ID NO: 185490 - RNA, 22 nt, Human
uuacaacagcgauuuaccuguc

SEQ ID NO: 185491 - RNA, 22 nt, Human
guuaaaagaacaacucggaggu

SEQ ID NO: 185492 - RNA, 21 nt, Human
gagccuucccucugcccuuuc

SEQ ID NO: 185493 - RNA, 22 nt, Human
cuguggcucuuuaguugagcac

SEQ ID NO: 185494 - RNA, 22 nt, Human
agccacagucuguagccagcuu

SEQ ID NO: 185495 - RNA, 22 nt, Human
cuggcagccaagugggauacuc

SEQ ID NO: 185496 - RNA, 22 nt, Human
cacaauguauauguauaucaaa

SEQ ID NO: 185497 - RNA, 22 nt, Human
ugcaaaaaggcagacuggugau

SEQ ID NO: 185498 - RNA, 22 nt, Human
ugcaccccauuuuacauuuaca

SEQ ID NO: 185499 - RNA, 22 nt, Human
aaaauccucuaauucuagaaua

SEQ ID NO: 185500 - RNA, 22 nt, Human
ucccagcagucagagcuaugug

SEQ ID NO: 185501 - RNA, 22 nt, Human
cagacucuugagcugauuguau

SEQ ID NO: 185502 - RNA, 22 nt, Human
auucuuucaaggaauaguuauu

SEQ ID NO: 185503 - RNA, 22 nt, Human
cugaaugagggauucugagggc

SEQ ID NO: 185504 - RNA, 22 nt, Human
cagcucuguucauagauggugc

SEQ ID NO: 185505 - RNA, 22 nt, Human
aacacuuucuauuauuaugguu

SEQ ID NO: 185506 - RNA, 23 nt, Human
gcccagagaggcucaccaggaau

SEQ ID NO: 185507 - RNA, 22 nt, Human
acaguucugcaagauauuuuuu

SEQ ID NO: 185508 - RNA, 22 nt, Human
ugccucugugggccuuccuggc

SEQ ID NO: 185509 - RNA, 22 nt, Human
uguuuacuagccaacauggaga

SEQ ID NO: 185510 - RNA, 22 nt, Human
aaggcagauauaaagacuagag

SEQ ID NO: 185511 - RNA, 22 nt, Human
cucaggaugaaagucaugguga

SEQ ID NO: 185512 - RNA, 21 nt, Human
ugucagaaauaagcaugugau

SEQ ID NO: 185513 - RNA, 22 nt, Human
ucaauuauuugauaugaaaggg

SEQ ID NO: 185514 - RNA, 22 nt, Human
uccugaggucugaaaaaggagc

SEQ ID NO: 185515 - RNA, 22 nt, Human
ggcugcagaggcgaucugaggu

SEQ ID NO: 185516 - RNA, 22 nt, Human
ugcccuggcacacacacagcug

SEQ ID NO: 185517 - RNA, 22 nt, Human
uagauugagcuugacaguguug

SEQ ID NO: 185518 - RNA, 22 nt, Human
gcuggcugcgucaucacagggc

SEQ ID NO: 185519 - RNA, 22 nt, Human
aaguacauuauaugagcagaau

SEQ ID NO: 185520 - RNA, 22 nt, Human
cuggccacuggagguggcaccc

SEQ ID NO: 185521 - RNA, 22 nt, Human
cauaaagucucauaauucacuu

SEQ ID NO: 185522 - RNA, 21 nt, Human
aggacacagagacaccuauug

SEQ ID NO: 185523 - RNA, 22 nt, Human
ucugaagaacugucuagagaac

SEQ ID NO: 185524 - RNA, 22 nt, Human
uuuuaaucaugcuucuaugucc

SEQ ID NO: 185525 - RNA, 22 nt, Human
auggcugcagagaccugaagaa

SEQ ID NO: 185526 - RNA, 22 nt, Human
ugcagugugaccuguagcgagc

SEQ ID NO: 185527 - RNA, 22 nt, Human
ucauccaguucacauggugagu

SEQ ID NO: 185528 - RNA, 22 nt, Human
aaacuguauauuuauggcaugu

SEQ ID NO: 185529 - RNA, 20 nt, Human
ggcugcagugcaccucaucu

SEQ ID NO: 185530 - RNA, 22 nt, Human
gugcucagggccuggcugggga

SEQ ID NO: 185531 - RNA, 22 nt, Human
gaagagcauaugaagagcauau

SEQ ID NO: 185532 - RNA, 22 nt, Human
gacaugcaugaaugcaggucuc

SEQ ID NO: 185533 - RNA, 22 nt, Human
ucagagaaaggccaaaauauca

SEQ ID NO: 185534 - RNA, 22 nt, Human
gcaugcagagucccucugcauu

SEQ ID NO: 185535 - RNA, 22 nt, Human
ucccucagcucauauuuaugcc

SEQ ID NO: 185536 - RNA, 22 nt, Human
gggauugaauugggggaucaca

SEQ ID NO: 185537 - RNA, 22 nt, Human
ggcucaggagaggggcuaaaag

SEQ ID NO: 185538 - RNA, 22 nt, Human
caugagugaguaucucaagaua

SEQ ID NO: 185539 - RNA, 22 nt, Human
ucagaaaagagaaaaucuuaua

SEQ ID NO: 185540 - RNA, 22 nt, Human
uaucagaaaugccuuaaauugg

SEQ ID NO: 185541 - RNA, 22 nt, Human
ggaggaguguggggcacucugc

SEQ ID NO: 185542 - RNA, 22 nt, Human
uucaaaugauggcaguccuggc

SEQ ID NO: 185543 - RNA, 22 nt, Human
uggcuguagaaucagagacuug

SEQ ID NO: 185544 - RNA, 22 nt, Human
cccugguguggaugugauuggc

SEQ ID NO: 185545 - RNA, 22 nt, Human
gucaggacaggcucuggacuga

SEQ ID NO: 185546 - RNA, 22 nt, Human
acauuucugcaucucagagcua

SEQ ID NO: 185547 - RNA, 22 nt, Human
gaggccaggggucagcaauugg

SEQ ID NO: 185548 - RNA, 17 nt, Human
gagagcugcugcuuccg

SEQ ID NO: 185549 - RNA, 22 nt, Human
auaacagaguugggaagugaaa

SEQ ID NO: 185550 - RNA, 22 nt, Human
uuuuggcuuaaagagaauguau

SEQ ID NO: 185551 - RNA, 22 nt, Human
ugacaagaauuugggacuguua

SEQ ID NO: 185552 - RNA, 22 nt, Human
augguggacgggagacaggacu

SEQ ID NO: 185553 - RNA, 22 nt, Human
cugggucccaauagcuuuuguu

SEQ ID NO: 185554 - RNA, 22 nt, Human
aaacaaguuuagaauaaugaau

SEQ ID NO: 185555 - RNA, 22 nt, Human
ggggugugucugacaaugguau

SEQ ID NO: 185556 - RNA, 22 nt, Human
aauuuagauugauaaacaugga

SEQ ID NO: 185557 - RNA, 22 nt, Human
agaugauuaugauagcacuguu

SEQ ID NO: 185558 - RNA, 22 nt, Human
uauuguuucuggcuguggcagc

SEQ ID NO: 185559 - RNA, 22 nt, Human
aggagagagaacacuugggucc

SEQ ID NO: 185560 - RNA, 23 nt, Human
ccagaaucuacucauuggaauga

SEQ ID NO: 185561 - RNA, 22 nt, Human
ggcacagggagaggcggauuuu

SEQ ID NO: 185562 - RNA, 22 nt, Human
uguuaagaagaggcaguacuua

SEQ ID NO: 185563 - RNA, 22 nt, Human
ucucuuuaaagacucagagauu

SEQ ID NO: 185564 - RNA, 22 nt, Human
ggcaggugugagcuguaaagga

SEQ ID NO: 185565 - RNA, 22 nt, Human
uacaucuuugucuaugaccagc

SEQ ID NO: 185566 - RNA, 21 nt, Human
agcaggcccaauggagggggc

SEQ ID NO: 185567 - RNA, 22 nt, Human
gugcauuacauguaauaaaaua

SEQ ID NO: 185568 - RNA, 15 nt, Human
gggcaggucuggggc

SEQ ID NO: 185569 - RNA, 22 nt, Human
gcccacauccacuagacaugca

SEQ ID NO: 185570 - RNA, 22 nt, Human
uaacagaaauaguaggugaggg

SEQ ID NO: 185571 - RNA, 22 nt, Human
acaguggaaagaacauggauuu

SEQ ID NO: 185572 - RNA, 22 nt, Human
gggggacuggaccguccugggu

SEQ ID NO: 185573 - RNA, 22 nt, Human
ggccccaaaugucaauaguacu

SEQ ID NO: 185574 - RNA, 22 nt, Human
guggggagggagaugcugaagu

SEQ ID NO: 185575 - RNA, 22 nt, Human
aaucacaugugcucaauuuuaa

SEQ ID NO: 185576 - RNA, 22 nt, Human
ucaguaaccuuuagcacaguug

SEQ ID NO: 185577 - RNA, 22 nt, Human
aucccccucuuggauggcggca

SEQ ID NO: 185578 - RNA, 22 nt, Human
accagccagccacaguggcucc

SEQ ID NO: 185579 - RNA, 22 nt, Human
ucaagaugaaccaggacauuca

SEQ ID NO: 185580 - RNA, 22 nt, Human
agcagcucuuaacaaagcaugg

SEQ ID NO: 185581 - RNA, 22 nt, Human
ucuggcugucauuggaggcccc

SEQ ID NO: 185582 - RNA, 22 nt, Human
gcagcaggagaguaauagcggu

SEQ ID NO: 185583 - RNA, 22 nt, Human
aagcuugggaaccacgguaauc

SEQ ID NO: 185584 - RNA, 22 nt, Human
gcagcagagaacacaaugaugg

SEQ ID NO: 185585 - RNA, 22 nt, Human
uaugaaauuuaaacacagauca

SEQ ID NO: 185586 - RNA, 22 nt, Human
ugauugauacaacucaauccaa

SEQ ID NO: 185587 - RNA, 22 nt, Human
uacauguauguuuaucuugaga

SEQ ID NO: 185588 - RNA, 22 nt, Human
agcauccaggccagguugggca

SEQ ID NO: 185589 - RNA, 22 nt, Human
gggcugacucugcacugagcca

SEQ ID NO: 185590 - RNA, 22 nt, Human
uuucuguagugugguauguagg

SEQ ID NO: 185591 - RNA, 22 nt, Human
ccaggugucaugcgugugaccc

SEQ ID NO: 185592 - RNA, 22 nt, Human
auaagacacgccccacucacuc

SEQ ID NO: 185593 - RNA, 22 nt, Human
agguccugucuuaucucuguaa

SEQ ID NO: 185594 - RNA, 22 nt, Human
ucagcaggcacggacaggcugc

SEQ ID NO: 185595 - RNA, 22 nt, Human
ucaacaguugcacuggagaggu

SEQ ID NO: 185596 - RNA, 22 nt, Human
uuuuccucugcagagcaguuag

SEQ ID NO: 185597 - RNA, 21 nt, Human
uccuguaagcuuggguggcuc

SEQ ID NO: 185598 - RNA, 22 nt, Human
ggaaagaaucaagugauccugu

SEQ ID NO: 185599 - RNA, 22 nt, Human
gcacauaacugaccacaucuaa

SEQ ID NO: 185600 - RNA, 22 nt, Human
uauagaaguaagcauugugaug

SEQ ID NO: 185601 - RNA, 23 nt, Human
acaaaguaauuccugcuuccaaa

SEQ ID NO: 185602 - RNA, 22 nt, Human
gaguccaguucuuuccagcagu

SEQ ID NO: 185603 - RNA, 22 nt, Human
gucaggaugcuauuguuauuaa

SEQ ID NO: 185604 - RNA, 22 nt, Human
uaggaaacucucagcuggucau

SEQ ID NO: 185605 - RNA, 22 nt, Human
ggagcacccugcucagccaagc

SEQ ID NO: 185606 - RNA, 22 nt, Human
caagagcuucugcucuucaugg

SEQ ID NO: 185607 - RNA, 22 nt, Human
ucccagagaaagucaaggucuu

SEQ ID NO: 185608 - RNA, 22 nt, Human
aagucugggccagggcacagcc

SEQ ID NO: 185609 - RNA, 22 nt, Human
agccugagccccauccagcuga

SEQ ID NO: 185610 - RNA, 22 nt, Human
auggcugcugccuuccccugcu

SEQ ID NO: 185611 - RNA, 22 nt, Human
uugcuugacuuuguguaccugu

SEQ ID NO: 185612 - RNA, 22 nt, Human
uuacaaugcacucaccuuuaga

SEQ ID NO: 185613 - RNA, 20 nt, Human
cagggcucugggccuggccu

SEQ ID NO: 185614 - RNA, 23 nt, Human
aaugacagugugugauugaagaa

SEQ ID NO: 185615 - RNA, 22 nt, Human
cccaggcuggccuccgcagugc

SEQ ID NO: 185616 - RNA, 22 nt, Human
acauuaaagaguaagguuaguu

SEQ ID NO: 185617 - RNA, 22 nt, Human
ucuuucaaagcaaaaugaggcu

SEQ ID NO: 185618 - RNA, 22 nt, Human
ugccuggaaggcccaugggaag

SEQ ID NO: 185619 - RNA, 22 nt, Human
auauaaagaaguggaaaaugag

SEQ ID NO: 185620 - RNA, 22 nt, Human
aaucuucagcacuccagagacu

SEQ ID NO: 185621 - RNA, 22 nt, Human
uaguaacaacaacuagcauuuu

SEQ ID NO: 185622 - RNA, 22 nt, Human
cagcagcuuugccaagucagcc

SEQ ID NO: 185623 - RNA, 20 nt, Human
augcaaaucccaaaaucagg

SEQ ID NO: 185624 - RNA, 22 nt, Human
gaaucaauuauccaggcuguug

SEQ ID NO: 185625 - RNA, 22 nt, Human
uuuccuuccuugcuagccugag

SEQ ID NO: 185626 - RNA, 22 nt, Human
gccuguuggugacuuucuguug

SEQ ID NO: 185627 - RNA, 22 nt, Human
aaaaagggauuugugauccagg

SEQ ID NO: 185628 - RNA, 21 nt, Human
uccuucucuaugauugucuga

SEQ ID NO: 185629 - RNA, 19 nt, Human
uuugauagggcauaauaua

SEQ ID NO: 185630 - RNA, 22 nt, Human
gcagggcugaaggucccaggcc

SEQ ID NO: 185631 - RNA, 22 nt, Human
uuagccaugcccuagaagagga

SEQ ID NO: 185632 - RNA, 22 nt, Human
agcagccaauuggaggaugaag

SEQ ID NO: 185633 - RNA, 22 nt, Human
ggccacuguccucuagcccaga

SEQ ID NO: 185634 - RNA, 22 nt, Human
uugacaaguggagauauuuaag

SEQ ID NO: 185635 - RNA, 22 nt, Human
cucagcuucuaccuccugagug

SEQ ID NO: 185636 - RNA, 22 nt, Human
aaagccacugcauguguaguau

SEQ ID NO: 185637 - RNA, 22 nt, Human
ucuggugucaguauucuuugaa

SEQ ID NO: 185638 - RNA, 22 nt, Human
uguuauacuauuuagagguaca

SEQ ID NO: 185639 - RNA, 21 nt, Human
acagucuccccagaucucucc

SEQ ID NO: 185640 - RNA, 22 nt, Human
aggcuuggugccaaggagccug

SEQ ID NO: 185641 - RNA, 22 nt, Human
guuugccugugauguacauuuc

SEQ ID NO: 185642 - RNA, 22 nt, Human
cuggacaaccacucagccucag

SEQ ID NO: 185643 - RNA, 20 nt, Human
cauugcaaaguagcagacug

SEQ ID NO: 185644 - RNA, 22 nt, Human
acauaugcucaucugcauuccc

SEQ ID NO: 185645 - RNA, 22 nt, Human
aaguacaugcuguaaugauugg

SEQ ID NO: 185646 - RNA, 22 nt, Human
ugccugugcccuucuuggcauu

SEQ ID NO: 185647 - RNA, 22 nt, Human
ugacaaaccaguagcaauaaag

SEQ ID NO: 185648 - RNA, 16 nt, Human
ucacacauuuguuggu

SEQ ID NO: 185649 - RNA, 22 nt, Human
aucuguggucaaaauagaaacu

SEQ ID NO: 185650 - RNA, 22 nt, Human
gucagaggggcagcugccaggc

SEQ ID NO: 185651 - RNA, 22 nt, Human
cagcugaguuacucugaggucu

SEQ ID NO: 185652 - RNA, 22 nt, Human
uauauaacuacuauuuugcuca

SEQ ID NO: 185653 - RNA, 22 nt, Human
uuccaugaaggagacugagaag

SEQ ID NO: 185654 - RNA, 22 nt, Human
aaaugcuaacaaggaaugcugc

SEQ ID NO: 185655 - RNA, 22 nt, Human
gagcuggcugugguugagugca

SEQ ID NO: 185656 - RNA, 22 nt, Human
ugcaauccacuauucuaaagcc

SEQ ID NO: 185657 - RNA, 22 nt, Human
uuuauuagauuaucaaagaggu

SEQ ID NO: 185658 - RNA, 22 nt, Human
ucaguggaacugucugggugag

SEQ ID NO: 185659 - RNA, 22 nt, Human
uagaaacccugccuuaguagcu

SEQ ID NO: 185660 - RNA, 22 nt, Human
augcagcugucagggagaacau

SEQ ID NO: 185661 - RNA, 22 nt, Human
uggagccagagcgcagccuggg

SEQ ID NO: 185662 - RNA, 22 nt, Human
uggaaucugugcuguuuuagug

SEQ ID NO: 185663 - RNA, 22 nt, Human
uagagcagaacuuguuaacacc

SEQ ID NO: 185664 - RNA, 22 nt, Human
ucucaaauucccuuuuccuccu

SEQ ID NO: 185665 - RNA, 22 nt, Human
ucuacauuuucuuuauguacau

SEQ ID NO: 185666 - RNA, 22 nt, Human
ugcacuguugcuuuauaugauu

SEQ ID NO: 185667 - RNA, 22 nt, Human
aucuguggauaugaccuuccug

SEQ ID NO: 185668 - RNA, 22 nt, Human
acauguguaagaugugauauau

SEQ ID NO: 185669 - RNA, 22 nt, Human
ggguggggccaggcaauuugca

SEQ ID NO: 185670 - RNA, 22 nt, Human
guguacagugauuugaguucac

SEQ ID NO: 185671 - RNA, 22 nt, Human
uuuccuuccaaaugcccgggag

SEQ ID NO: 185672 - RNA, 22 nt, Human
uacagagaugugaaaagcucua

SEQ ID NO: 185673 - RNA, 22 nt, Human
gcagggaccuugcccacccucc

SEQ ID NO: 185674 - RNA, 22 nt, Human
ccagcuggaaacaaauagagug

SEQ ID NO: 185675 - RNA, 22 nt, Human
ccucaugcugcaucucugaggu

SEQ ID NO: 185676 - RNA, 22 nt, Human
guacaguagagccagguucagu

SEQ ID NO: 185677 - RNA, 22 nt, Human
gcacagaggaagcacagacucu

SEQ ID NO: 185678 - RNA, 22 nt, Human
aggccacacaacucuuagagau

SEQ ID NO: 185679 - RNA, 22 nt, Human
uuucuuaauuugaguuccacua

SEQ ID NO: 185680 - RNA, 22 nt, Human
ugggcaugaguggacagagaag

SEQ ID NO: 185681 - RNA, 22 nt, Human
cucaggcaguucuguagccucc

SEQ ID NO: 185682 - RNA, 22 nt, Human
ccagaggggugggccugguuua

SEQ ID NO: 185683 - RNA, 22 nt, Human
caaagugcuggaauuacaggug

SEQ ID NO: 185684 - RNA, 22 nt, Human
cagcugcuguucaguuuuguuu

SEQ ID NO: 185685 - RNA, 16 nt, Human
aggaggggaauuagga

SEQ ID NO: 185686 - RNA, 22 nt, Human
acaagauucaaugaauugauug

SEQ ID NO: 185687 - RNA, 20 nt, Human
ucacaggagggaaggcaggu

SEQ ID NO: 185688 - RNA, 22 nt, Human
ucccugcugagagugcucuccc

SEQ ID NO: 185689 - RNA, 22 nt, Human
uggccaggccggggacagaacu

SEQ ID NO: 185690 - RNA, 22 nt, Human
cccucuccuggcugcauggagc

SEQ ID NO: 185691 - RNA, 22 nt, Human
cuuugaauuccaguacaauaac

SEQ ID NO: 185692 - RNA, 22 nt, Human
aaacagauugaaauucguagua

SEQ ID NO: 185693 - RNA, 22 nt, Human
cagcaagauggugaaugagacg

SEQ ID NO: 185694 - RNA, 22 nt, Human
auaguuacauacagaaauauuu

SEQ ID NO: 185695 - RNA, 22 nt, Human
aauuccaaguagcaucccauca

SEQ ID NO: 185696 - RNA, 22 nt, Human
uagaaucauugagaauaacagg

SEQ ID NO: 185697 - RNA, 22 nt, Human
aauuucuucagcucuaaaaugg

SEQ ID NO: 185698 - RNA, 22 nt, Human
ccuggcucucugcagauccugg

SEQ ID NO: 185699 - RNA, 22 nt, Human
uaaguggaagguuauaugcuaa

SEQ ID NO: 185700 - RNA, 22 nt, Human
caagcuggcugggagaggcacg

SEQ ID NO: 185701 - RNA, 20 nt, Human
ggcuucacucugcaccacca

SEQ ID NO: 185702 - RNA, 22 nt, Human
ggguggcaggauuggcaggagu

SEQ ID NO: 185703 - RNA, 22 nt, Human
uguucccauuuucugcauaauc

SEQ ID NO: 185704 - RNA, 22 nt, Human
ggucuggaauaagguccaggaa

SEQ ID NO: 185705 - RNA, 22 nt, Human
gcugccuccacuggcucccagu

SEQ ID NO: 185706 - RNA, 22 nt, Human
uuugucuugaggcuggggaagu

SEQ ID NO: 185707 - RNA, 22 nt, Human
ucccagaggacuguuggugcua

SEQ ID NO: 185708 - RNA, 22 nt, Human
ucuucuguccuaagucaaagca

SEQ ID NO: 185709 - RNA, 20 nt, Human
gcagggcaagggauaugaaa

SEQ ID NO: 185710 - RNA, 22 nt, Human
cagcccuuggcuggcuccuugc

SEQ ID NO: 185711 - RNA, 22 nt, Human
guuggcaaguguuccuuccucu

SEQ ID NO: 185712 - RNA, 22 nt, Human
ucccaggacaggccacauggaa

SEQ ID NO: 185713 - RNA, 22 nt, Human
ggcugcagagcuggugcccugg

SEQ ID NO: 185714 - RNA, 22 nt, Human
uccuggguccugggaagcccug

SEQ ID NO: 185715 - RNA, 23 nt, Human
gcccucaguagaaaauguuagaa

SEQ ID NO: 185716 - RNA, 22 nt, Human
uuuauugagcacccguugugcg

SEQ ID NO: 185717 - RNA, 22 nt, Human
ccucuuggagucuaucauucug

SEQ ID NO: 185718 - RNA, 22 nt, Human
acaguaaaucaacagaauaucu

SEQ ID NO: 185719 - RNA, 22 nt, Human
cuggcagauauuugcagacaug

SEQ ID NO: 185720 - RNA, 22 nt, Human
acaggcaacuucaaaucucacu

SEQ ID NO: 185721 - RNA, 22 nt, Human
uguaaccaugaugagcagguau

SEQ ID NO: 185722 - RNA, 22 nt, Human
auccaaagcccuaaguuaacug

SEQ ID NO: 185723 - RNA, 22 nt, Human
cuucaggaguaguuaccuagca

SEQ ID NO: 185724 - RNA, 22 nt, Human
agaguucugcucuucucaguga

SEQ ID NO: 185725 - RNA, 22 nt, Human
uguggggacccaugccaugggc

SEQ ID NO: 185726 - RNA, 22 nt, Human
gcccggcagucacacacccagg

SEQ ID NO: 185727 - RNA, 22 nt, Human
uugggaagaauggaggugguua

SEQ ID NO: 185728 - RNA, 22 nt, Human
agaacucuaggauuggcuggau

SEQ ID NO: 185729 - RNA, 21 nt, Human
caugugucauuggagagcaau

SEQ ID NO: 185730 - RNA, 22 nt, Human
uguugauuaguguuuagacuua

SEQ ID NO: 185731 - RNA, 22 nt, Human
cacacaugguuccgcaggaugc

SEQ ID NO: 185732 - RNA, 22 nt, Human
ggcaucaggaucugucuugcuu

SEQ ID NO: 185733 - RNA, 22 nt, Human
acaugggaucaaugaggcaggc

SEQ ID NO: 185734 - RNA, 22 nt, Human
gaaggaaaacagaucugccuga

SEQ ID NO: 185735 - RNA, 22 nt, Human
cacaaauaccaguuuccuaaca

SEQ ID NO: 185736 - RNA, 22 nt, Human
ucaucugugcaggacucagaag

SEQ ID NO: 185737 - RNA, 22 nt, Human
cuggcagauuggggucagcagu

SEQ ID NO: 185738 - RNA, 22 nt, Human
accaggcucugccaguguuuac

SEQ ID NO: 185739 - RNA, 22 nt, Human
acagugcuaaugaugccaagau

SEQ ID NO: 185740 - RNA, 22 nt, Human
aaagccagugguaugagagaaa

SEQ ID NO: 185741 - RNA, 22 nt, Human
cuccucccugcgauugcucugc

SEQ ID NO: 185742 - RNA, 20 nt, Human
uacagaaugcaauaaaaugg

SEQ ID NO: 185743 - RNA, 22 nt, Human
cagggaaacuaggaaauaagcu

SEQ ID NO: 185744 - RNA, 22 nt, Human
uuccuggggcuccagcuaccag

SEQ ID NO: 185745 - RNA, 22 nt, Human
gagccuggguccuucccuggga

SEQ ID NO: 185746 - RNA, 22 nt, Human
agacagcaugagccugcugaug

SEQ ID NO: 185747 - RNA, 22 nt, Human
ucugugccuuuaagaagcucau

SEQ ID NO: 185748 - RNA, 22 nt, Human
ugcaggugucucugucuagcgu

SEQ ID NO: 185749 - RNA, 22 nt, Human
ggcaguuuuaacagagguagua

SEQ ID NO: 185750 - RNA, 22 nt, Human
uagagcugauaaugaggccaag

SEQ ID NO: 185751 - RNA, 22 nt, Human
ucuacccagagcuaugaccuga

SEQ ID NO: 185752 - RNA, 15 nt, Human
aaagugcacccaaua

SEQ ID NO: 185753 - RNA, 22 nt, Human
caggggcuguggcacauggugu

SEQ ID NO: 185754 - RNA, 22 nt, Human
ccaggcagccugcuccauucug

SEQ ID NO: 185755 - RNA, 22 nt, Human
ccuccuggaggcucuagggaaa

SEQ ID NO: 185756 - RNA, 22 nt, Human
cugggugauuccuguccaggca

SEQ ID NO: 185757 - RNA, 22 nt, Human
ugaggcaggagaaucacaugaa

SEQ ID NO: 185758 - RNA, 20 nt, Human
caauaauuuacuucccuauu

SEQ ID NO: 185759 - RNA, 22 nt, Human
uugagcccuaccucagacuuuc

SEQ ID NO: 185760 - RNA, 22 nt, Human
ccuggggagccgccugagcccc

SEQ ID NO: 185761 - RNA, 23 nt, Human
gccugggacucaggaggagcuca

SEQ ID NO: 185762 - RNA, 22 nt, Human
ugcuggaggggccugaccagga

SEQ ID NO: 185763 - RNA, 22 nt, Human
uucaguuuugcuuuuaaucaug

SEQ ID NO: 185764 - RNA, 22 nt, Human
uucuaaguguugacaaagucua

SEQ ID NO: 185765 - RNA, 22 nt, Human
gcagcaggacugccguuaaagu

SEQ ID NO: 185766 - RNA, 22 nt, Human
ucuuucugcagcacaggggcag

SEQ ID NO: 185767 - RNA, 18 nt, Human
gaaagugcggggcagggg

SEQ ID NO: 185768 - RNA, 22 nt, Human
gcuuuuucaaaugaaagcuggu

SEQ ID NO: 185769 - RNA, 22 nt, Human
aaaaccugauugaauucuauuu

SEQ ID NO: 185770 - RNA, 23 nt, Human
agcuuggaacaaugcaaauacag

SEQ ID NO: 185771 - RNA, 22 nt, Human
gugaagagcuguugcagagauu

SEQ ID NO: 185772 - RNA, 22 nt, Human
ccuggacucaggcugugggcac

SEQ ID NO: 185773 - RNA, 22 nt, Human
cuuuacauuaauuucuacugau

SEQ ID NO: 185774 - RNA, 22 nt, Human
gcuggacuagaagcagggcuca

SEQ ID NO: 185775 - RNA, 22 nt, Human
aacaagaagggaaggcaugauu

SEQ ID NO: 185776 - RNA, 22 nt, Human
caucaaaguugauauccaauua

SEQ ID NO: 185777 - RNA, 16 nt, Human
aagccuaaauuacaga

SEQ ID NO: 185778 - RNA, 22 nt, Human
acuaaaguaucuccuauuucau

SEQ ID NO: 185779 - RNA, 22 nt, Human
acugagcagaagagaucuguga

SEQ ID NO: 185780 - RNA, 22 nt, Human
gggcuucucccuaaggacucug

SEQ ID NO: 185781 - RNA, 22 nt, Human
agaauacaguaugcaaaaagau

SEQ ID NO: 185782 - RNA, 22 nt, Human
ggcugccuucagacuccagcuu

SEQ ID NO: 185783 - RNA, 22 nt, Human
guggucagaaaucucaguggca

SEQ ID NO: 185784 - RNA, 22 nt, Human
cugagacccagacaccugagga

SEQ ID NO: 185785 - RNA, 21 nt, Human
gccugggaagagaaagguaag

SEQ ID NO: 185786 - RNA, 22 nt, Human
caaguuuugcauaguucuguau

SEQ ID NO: 185787 - RNA, 22 nt, Human
uuuacaguauaguaggacucau

SEQ ID NO: 185788 - RNA, 22 nt, Human
aggcccaguguggcuuccugga

SEQ ID NO: 185789 - RNA, 22 nt, Human
auucuggguuugcuguacaaag

SEQ ID NO: 185790 - RNA, 22 nt, Human
gaagaaggugcuacacagggca

SEQ ID NO: 185791 - RNA, 22 nt, Human
augcaaacauguuuccucuaag

SEQ ID NO: 185792 - RNA, 22 nt, Human
gccuguuugacuggucucugcu

SEQ ID NO: 185793 - RNA, 22 nt, Human
uuucuucuugaguaaccagauu

SEQ ID NO: 185794 - RNA, 22 nt, Human
cccaggcugcguauccacaaua

SEQ ID NO: 185795 - RNA, 22 nt, Human
cccacaucucacaucuuggaac

SEQ ID NO: 185796 - RNA, 22 nt, Human
uagcucauguaauccgaacaua

SEQ ID NO: 185797 - RNA, 22 nt, Human
auucacaugauguauguagggc

SEQ ID NO: 185798 - RNA, 22 nt, Human
gaggguggggaauagacugcua

SEQ ID NO: 185799 - RNA, 22 nt, Human
acauguaaaagauaaauuaaca

SEQ ID NO: 185800 - RNA, 22 nt, Human
uaaaugaguaauauagcuguuu

SEQ ID NO: 185801 - RNA, 22 nt, Human
gagcaugagggaaggcagcaga

SEQ ID NO: 185802 - RNA, 22 nt, Human
gcugccuugcuuacuccacugc

SEQ ID NO: 185803 - RNA, 22 nt, Human
uggagagaugucuguucaaggu

SEQ ID NO: 185804 - RNA, 22 nt, Human
ccuucuccccucugcagggugu

SEQ ID NO: 185805 - RNA, 22 nt, Human
aagcuguggcuuggaggaaaca

SEQ ID NO: 185806 - RNA, 21 nt, Human
gggagcugacagcagcacggc

SEQ ID NO: 185807 - RNA, 19 nt, Human
ccagcccauaguccaucac

SEQ ID NO: 185808 - RNA, 22 nt, Human
caggaaaauggaaucaccugua

SEQ ID NO: 185809 - RNA, 22 nt, Human
uugagaaaggggucaauaucuc

SEQ ID NO: 185810 - RNA, 21 nt, Human
augauucugcaaaugaguagu

SEQ ID NO: 185811 - RNA, 22 nt, Human
gcugcaggaugaggcucugcuc

SEQ ID NO: 185812 - RNA, 23 nt, Human
agccaucauccugcugcuggggc

SEQ ID NO: 185813 - RNA, 22 nt, Human
uuccuggccucuuccaccacca

SEQ ID NO: 185814 - RNA, 22 nt, Human
ccaggagaugggaaaguagcag

SEQ ID NO: 185815 - RNA, 17 nt, Human
cccuggcucuaggugga

SEQ ID NO: 185816 - RNA, 22 nt, Human
gguguucaaaugaacacaugca

SEQ ID NO: 185817 - RNA, 21 nt, Human
cuggcaugaggagcuuuguuu

SEQ ID NO: 185818 - RNA, 22 nt, Human
cuuccagagauccaugaauacc

SEQ ID NO: 185819 - RNA, 20 nt, Human
accauaauguuaauuacaaa

SEQ ID NO: 185820 - RNA, 22 nt, Human
aggugggggcuguguccuugac

SEQ ID NO: 185821 - RNA, 22 nt, Human
cacccuggcuggaggugcagug

SEQ ID NO: 185822 - RNA, 22 nt, Human
agggaccucauguaaguggauu

SEQ ID NO: 185823 - RNA, 22 nt, Human
ccccacagcuuguggagagaau

SEQ ID NO: 185824 - RNA, 22 nt, Human
gugugcucagcucauuuggaua

SEQ ID NO: 185825 - RNA, 22 nt, Human
augcaaagcacacacagaaucc

SEQ ID NO: 185826 - RNA, 22 nt, Human
uaaggaggcgagguggugagca

SEQ ID NO: 185827 - RNA, 22 nt, Human
gaaucaauugugaagacuauga

SEQ ID NO: 185828 - RNA, 22 nt, Human
uggggauguaaaugaggugaua

SEQ ID NO: 185829 - RNA, 22 nt, Human
auuagucuucucauuuggaucc

SEQ ID NO: 185830 - RNA, 22 nt, Human
gccaggcauuuguuaggugcug

SEQ ID NO: 185831 - RNA, 22 nt, Human
uaggccagaggagcagcuuugg

SEQ ID NO: 185832 - RNA, 22 nt, Human
caggaggcagagguugcaguga

SEQ ID NO: 185833 - RNA, 22 nt, Human
ucugcugccaccuuguggugag

SEQ ID NO: 185834 - RNA, 22 nt, Human
gggcuugcuaagaagagcgcau

SEQ ID NO: 185835 - RNA, 22 nt, Human
ccaaggagcugcaggcacuugu

SEQ ID NO: 185836 - RNA, 22 nt, Human
gugguaaagcugauugaauuga

SEQ ID NO: 185837 - RNA, 22 nt, Human
gaauacaugcacgacacggggg

SEQ ID NO: 185838 - RNA, 22 nt, Human
aaagauaauguuuccuuauucu

SEQ ID NO: 185839 - RNA, 18 nt, Human
ggcagcaagaagggaggg

SEQ ID NO: 185840 - RNA, 22 nt, Human
gcagcuuuguaaaguaugaagc

SEQ ID NO: 185841 - RNA, 22 nt, Human
aggcucccaagcacugacccca

SEQ ID NO: 185842 - RNA, 22 nt, Human
uuaauaugcugcuucuugaaaa

SEQ ID NO: 185843 - RNA, 22 nt, Human
ggcacccuuggggggccacagc

SEQ ID NO: 185844 - RNA, 22 nt, Human
aagcacaguucuuagaguuaca

SEQ ID NO: 185845 - RNA, 22 nt, Human
cagcuuggaggaggaucuaaga

SEQ ID NO: 185846 - RNA, 22 nt, Human
gugaaggcuacaagagaucaag

SEQ ID NO: 185847 - RNA, 22 nt, Human
cauuaaaucuuccagaccucac

SEQ ID NO: 185848 - RNA, 22 nt, Human
gaggagggccuggugucccuuc

SEQ ID NO: 185849 - RNA, 22 nt, Human
ugagcaggacugaccggccuua

SEQ ID NO: 185850 - RNA, 22 nt, Human
gauauagguucauaguguuaca

SEQ ID NO: 185851 - RNA, 22 nt, Human
aggacaguuaguuaggaaguuu

SEQ ID NO: 185852 - RNA, 22 nt, Human
ccaggucuggcacuggccaguc

SEQ ID NO: 185853 - RNA, 22 nt, Human
ugcaauuaugggcaauuuuuaa

SEQ ID NO: 185854 - RNA, 22 nt, Human
uggccugggugcugcugacauc

SEQ ID NO: 185855 - RNA, 22 nt, Human
cucagcagguaccacaugaucu

SEQ ID NO: 185856 - RNA, 22 nt, Human
aauaagauaagauuucugcucu

SEQ ID NO: 185857 - RNA, 22 nt, Human
ugcccugcuaaccuugguucca

SEQ ID NO: 185858 - RNA, 22 nt, Human
guccuucagcaccucccucggc

SEQ ID NO: 185859 - RNA, 22 nt, Human
gugagggagguagauuucauca

SEQ ID NO: 185860 - RNA, 22 nt, Human
acaaggccaagcauucuagcaa

SEQ ID NO: 185861 - RNA, 22 nt, Human
gaagccuuaucagucacuuaua

SEQ ID NO: 185862 - RNA, 21 nt, Human
ugugucagucuuuggaagcaa

SEQ ID NO: 185863 - RNA, 20 nt, Human
uccaguuuuggagacauucu

SEQ ID NO: 185864 - RNA, 22 nt, Human
uacauaauuaaucuuuaaguuc

SEQ ID NO: 185865 - RNA, 22 nt, Human
augcagggagguaagaggugcc

SEQ ID NO: 185866 - RNA, 22 nt, Human
uuuccugguuugaagcagcagc

SEQ ID NO: 185867 - RNA, 22 nt, Human
ucccacacuugaaacaaggcug

SEQ ID NO: 185868 - RNA, 22 nt, Human
agggccuggcgcguggccgccg

SEQ ID NO: 185869 - RNA, 22 nt, Human
cugaaagcaaaguaauucuuaa

SEQ ID NO: 185870 - RNA, 22 nt, Human
uggauuaguuucaaggcagcaa

SEQ ID NO: 185871 - RNA, 22 nt, Human
aaacagauaagggacaauuuca

SEQ ID NO: 185872 - RNA, 22 nt, Human
cauuaaguauuucaguuacugu

SEQ ID NO: 185873 - RNA, 22 nt, Human
caggucuguuuucaaggucagu

SEQ ID NO: 185874 - RNA, 22 nt, Human
auuauucuuaugucaucauggc

SEQ ID NO: 185875 - RNA, 22 nt, Human
caaaucuaggaugcauguagug

SEQ ID NO: 185876 - RNA, 19 nt, Human
uugaaauuguuugauaugg

SEQ ID NO: 185877 - RNA, 22 nt, Human
cugccuucuuucaaggguaagc

SEQ ID NO: 185878 - RNA, 22 nt, Human
gaggcucaacccacagggguug

SEQ ID NO: 185879 - RNA, 22 nt, Human
uuuaucugaggaaagcagacaa

SEQ ID NO: 185880 - RNA, 22 nt, Human
cuuuuuguuguccacacuagga

SEQ ID NO: 185881 - RNA, 22 nt, Human
ggaagccagagugcugggcagg

SEQ ID NO: 185882 - RNA, 22 nt, Human
uggaaacuauccucacaacuag

SEQ ID NO: 185883 - RNA, 23 nt, Human
acucaaauuucgcuuggaguuca

SEQ ID NO: 185884 - RNA, 22 nt, Human
cacuuuacuaucuauaaaauaa

SEQ ID NO: 185885 - RNA, 21 nt, Human
ucuggcaguggucuuucaaau

SEQ ID NO: 185886 - RNA, 22 nt, Human
gguggcacucauuaucaggugc

SEQ ID NO: 185887 - RNA, 22 nt, Human
uggccuggcugcccugucugga

SEQ ID NO: 185888 - RNA, 22 nt, Human
cucuucuugaaagaggaauuca

SEQ ID NO: 185889 - RNA, 21 nt, Human
gcugugcacauaguagaagug

SEQ ID NO: 185890 - RNA, 22 nt, Human
gaucuuuucagucuugguaguu

SEQ ID NO: 185891 - RNA, 22 nt, Human
acagugcuaaacacuucuugaa

SEQ ID NO: 185892 - RNA, 22 nt, Human
agucucagcaagcauggcuagu

SEQ ID NO: 185893 - RNA, 17 nt, Human
gcaagggaugggagauu

SEQ ID NO: 185894 - RNA, 22 nt, Human
cuggcugcaguagcaagagacu

SEQ ID NO: 185895 - RNA, 22 nt, Human
cacaagggcuuuguaggcuuug

SEQ ID NO: 185896 - RNA, 22 nt, Human
uauaucaccaaaaacaguucug

SEQ ID NO: 185897 - RNA, 22 nt, Human
agggccagcuagagcccucgcc

SEQ ID NO: 185898 - RNA, 22 nt, Human
acacucacccucccacugccug

SEQ ID NO: 185899 - RNA, 22 nt, Human
cugccagacacguuaugcucau

SEQ ID NO: 185900 - RNA, 22 nt, Human
aaagauuaggcggcaacugggc

SEQ ID NO: 185901 - RNA, 22 nt, Human
gagcuugggugccaugcugagc

SEQ ID NO: 185902 - RNA, 22 nt, Human
uuuacauguccuucaagagcag

SEQ ID NO: 185903 - RNA, 22 nt, Human
cgacccuacagacagugcugag

SEQ ID NO: 185904 - RNA, 21 nt, Human
uguggcagauguugggaggca

SEQ ID NO: 185905 - RNA, 22 nt, Human
aggcagguccccuggaaggcac

SEQ ID NO: 185906 - RNA, 23 nt, Human
agaguggccuacucacacucauu

SEQ ID NO: 185907 - RNA, 22 nt, Human
gaaucauuuauuuuugacagca

SEQ ID NO: 185908 - RNA, 22 nt, Human
uagcagaggcaaggaugugaau

SEQ ID NO: 185909 - RNA, 22 nt, Human
gaugugucuccguuucaaggca

SEQ ID NO: 185910 - RNA, 22 nt, Human
aagagccagcuagugaagaggc

SEQ ID NO: 185911 - RNA, 22 nt, Human
gcauggaauucccuuaugggcc

SEQ ID NO: 185912 - RNA, 23 nt, Human
gggcccagcacaggaccuggcag

SEQ ID NO: 185913 - RNA, 22 nt, Human
gcacagccugucccuguccugg

SEQ ID NO: 185914 - RNA, 19 nt, Human
cuucuucuuggcagccaag

SEQ ID NO: 185915 - RNA, 22 nt, Human
uggugggagugagggcaugcca

SEQ ID NO: 185916 - RNA, 21 nt, Human
uguauaacuucucucccucag

SEQ ID NO: 185917 - RNA, 19 nt, Human
agggccaggauucuggaac

SEQ ID NO: 185918 - RNA, 22 nt, Human
gugcagcaaaguuugagauaua

SEQ ID NO: 185919 - RNA, 22 nt, Human
aucugguauuuccuuugauagc

SEQ ID NO: 185920 - RNA, 22 nt, Human
cagcagucaggccugugggaga

SEQ ID NO: 185921 - RNA, 22 nt, Human
cuucccagacgggguggcagcc

SEQ ID NO: 185922 - RNA, 22 nt, Human
aacccuggggcugcucugccug

SEQ ID NO: 185923 - RNA, 22 nt, Human
uucuucagauggugagaccucc

SEQ ID NO: 185924 - RNA, 22 nt, Human
aggcuuggcugcacgccucgcu

SEQ ID NO: 185925 - RNA, 22 nt, Human
uggacauguccggccagacaau

SEQ ID NO: 185926 - RNA, 22 nt, Human
gcuucccaggcgccugaccuuu

SEQ ID NO: 185927 - RNA, 22 nt, Human
cauggcaggaaggacaugcacu

SEQ ID NO: 185928 - RNA, 22 nt, Human
agugcauucaguauucauaggc

SEQ ID NO: 185929 - RNA, 22 nt, Human
acaugacagugacuuuauaaga

SEQ ID NO: 185930 - RNA, 22 nt, Human
aggcuggagagugcaguggcgu

SEQ ID NO: 185931 - RNA, 22 nt, Human
ugaaugaugguguguucuugcc

SEQ ID NO: 185932 - RNA, 22 nt, Human
aggagaggcaucaagaaaaucg

SEQ ID NO: 185933 - RNA, 22 nt, Human
ugucacagagcgugcaacagaa

SEQ ID NO: 185934 - RNA, 22 nt, Human
cugcaauaugaugucugagaaa

SEQ ID NO: 185935 - RNA, 22 nt, Human
caugccauuaacauuagcuagc

SEQ ID NO: 185936 - RNA, 22 nt, Human
cacauuucuaggaaauuaaaug

SEQ ID NO: 185937 - RNA, 22 nt, Human
cacaauuuccaagucauguuau

SEQ ID NO: 185938 - RNA, 22 nt, Human
gaggugucaugagggccugcuc

SEQ ID NO: 185939 - RNA, 22 nt, Human
gugcauuaguuuccuauugcug

SEQ ID NO: 185940 - RNA, 20 nt, Human
agcaaacucuucccaucuuc

SEQ ID NO: 185941 - RNA, 22 nt, Human
agacagugcuaucccaucugug

SEQ ID NO: 185942 - RNA, 22 nt, Human
gcucccuggaauguuggcugcc

SEQ ID NO: 185943 - RNA, 22 nt, Human
auccauuugacauaauuucagc

SEQ ID NO: 185944 - RNA, 22 nt, Human
gugugcagggcugccugugccg

SEQ ID NO: 185945 - RNA, 21 nt, Human
gggccuggcugcgcaggacgg

SEQ ID NO: 185946 - RNA, 22 nt, Human
ggcuguaccugccucuccucua

SEQ ID NO: 185947 - RNA, 22 nt, Human
ggaggcaggaaagacagguuca

SEQ ID NO: 185948 - RNA, 22 nt, Human
ucaugaaucguggaaugauuua

SEQ ID NO: 185949 - RNA, 22 nt, Human
uacaguuucccagcagaugcaa

SEQ ID NO: 185950 - RNA, 22 nt, Human
cuuuggaaggaagaccuuucag

SEQ ID NO: 185951 - RNA, 22 nt, Human
uauuucagcaagaagaaugugg

SEQ ID NO: 185952 - RNA, 21 nt, Human
ggcugguguuuagcugugaua

SEQ ID NO: 185953 - RNA, 22 nt, Human
auaucacaguaguuguuuaguu

SEQ ID NO: 185954 - RNA, 22 nt, Human
agccuggguuaggguucuuccc

SEQ ID NO: 185955 - RNA, 18 nt, Human
gcuuuauuucuuggggaa

SEQ ID NO: 185956 - RNA, 22 nt, Human
ggaagccagaaagugagaauau

SEQ ID NO: 185957 - RNA, 22 nt, Human
ugacgucaacugcaaaggccuu

SEQ ID NO: 185958 - RNA, 22 nt, Human
aaugcaaagcaagcagagauuu

SEQ ID NO: 185959 - RNA, 22 nt, Human
gaggaagcauugacauaaucuc

SEQ ID NO: 185960 - RNA, 22 nt, Human
auucauaacggcaaaugucacc

SEQ ID NO: 185961 - RNA, 22 nt, Human
ggagacacauauacagaaagag

SEQ ID NO: 185962 - RNA, 22 nt, Human
gaggcugaaguguacaugggug

SEQ ID NO: 185963 - RNA, 22 nt, Human
uucauagcagucccuuucuggg

SEQ ID NO: 185964 - RNA, 22 nt, Human
ucuaauuuuggcauuuuaaccu

SEQ ID NO: 185965 - RNA, 22 nt, Human
ugcugagguaaccauauccugc

SEQ ID NO: 185966 - RNA, 22 nt, Human
aggcugcuucaauggauaagau

SEQ ID NO: 185967 - RNA, 20 nt, Human
gugcagaggcagccuguggg

SEQ ID NO: 185968 - RNA, 22 nt, Human
uaaggccaaggggccauagucu

SEQ ID NO: 185969 - RNA, 22 nt, Human
auucaaacaggccaauugaccu

SEQ ID NO: 185970 - RNA, 23 nt, Human
acaaguguuuccaauauggcugg

SEQ ID NO: 185971 - RNA, 22 nt, Human
ccugguucagucuuucuaugcu

SEQ ID NO: 185972 - RNA, 23 nt, Human
cugggcuguccugaggucaccuc

SEQ ID NO: 185973 - RNA, 22 nt, Human
auggaauugaagacagcauagg

SEQ ID NO: 185974 - RNA, 20 nt, Human
ugcagguguuggagaaggua

SEQ ID NO: 185975 - RNA, 22 nt, Human
gugcaugcaaauuacuguaaag

SEQ ID NO: 185976 - RNA, 22 nt, Human
gcuguggccgggcccaggccgc

SEQ ID NO: 185977 - RNA, 22 nt, Human
aauuucuguaugaauagagaaa

SEQ ID NO: 185978 - RNA, 22 nt, Human
aaugguauuugucaagcauagu

SEQ ID NO: 185979 - RNA, 22 nt, Human
ucugggagauccaagcagaacu

SEQ ID NO: 185980 - RNA, 22 nt, Human
aucaggaugaagcuguagcgaa

SEQ ID NO: 185981 - RNA, 20 nt, Human
ucucaguuucuagagucagg

SEQ ID NO: 185982 - RNA, 17 nt, Human
aaugaaugaauucuuug

SEQ ID NO: 185983 - RNA, 22 nt, Human
aucucuguaaaccauaaauuga

SEQ ID NO: 185984 - RNA, 22 nt, Human
acaagauuuagcuuaaagggcu

SEQ ID NO: 185985 - RNA, 22 nt, Human
acaguaauuuauugaacaccuu

SEQ ID NO: 185986 - RNA, 22 nt, Human
uauugcuggggugggccauguu

SEQ ID NO: 185987 - RNA, 22 nt, Human
ucuguggcaugguaucuggagg

SEQ ID NO: 185988 - RNA, 22 nt, Human
cagcuacaggaccugaugcacc

SEQ ID NO: 185989 - RNA, 22 nt, Human
gcaggcaguuugcuuuucccuc

SEQ ID NO: 185990 - RNA, 22 nt, Human
aacagcagcuuucaggaucauc

SEQ ID NO: 185991 - RNA, 22 nt, Human
cuggagcucuguguguuccuga

SEQ ID NO: 185992 - RNA, 22 nt, Human
uggugcugccucagaugccuua

SEQ ID NO: 185993 - RNA, 22 nt, Human
agcugguugucauucagaauug

SEQ ID NO: 185994 - RNA, 22 nt, Human
uuagaaaugcacccaagaccua

SEQ ID NO: 185995 - RNA, 22 nt, Human
uuuguucaccuagcaaacuuuu

SEQ ID NO: 185996 - RNA, 22 nt, Human
cgcaggugggcccuucauugau

SEQ ID NO: 185997 - RNA, 22 nt, Human
gcucaggucuuacccaugccug

SEQ ID NO: 185998 - RNA, 22 nt, Human
ggccuugauccuccagagcacu

SEQ ID NO: 185999 - RNA, 23 nt, Human
aaauagagauaggccagcuuugc

SEQ ID NO: 186000 - RNA, 22 nt, Human
gcagaggagcaaguugcuacag

SEQ ID NO: 186001 - RNA, 22 nt, Human
gccaggcugcuccagggaggcc

SEQ ID NO: 186002 - RNA, 22 nt, Human
aauugcuucauuaacauuuagg

SEQ ID NO: 186003 - RNA, 22 nt, Human
ggccugaucuuugacccucauc

SEQ ID NO: 186004 - RNA, 22 nt, Human
gcuguucagggcacucaugggc

SEQ ID NO: 186005 - RNA, 22 nt, Human
ggagcucauaacaagguagcca

SEQ ID NO: 186006 - RNA, 22 nt, Human
ggcucuggcggcucuuucaaua

SEQ ID NO: 186007 - RNA, 22 nt, Human
cacugugucagaguaugaugau

SEQ ID NO: 186008 - RNA, 19 nt, Human
cuucuggcccugagccacc

SEQ ID NO: 186009 - RNA, 17 nt, Human
cagcuuuaugcuacugu

SEQ ID NO: 186010 - RNA, 22 nt, Human
gggucuggagauccgggugaag

SEQ ID NO: 186011 - RNA, 22 nt, Human
ccuacaguuauauucuugauug

SEQ ID NO: 186012 - RNA, 22 nt, Human
uggaaagcaguucuuagaaucg

SEQ ID NO: 186013 - RNA, 22 nt, Human
aacagaaaagguagguggcuuu

SEQ ID NO: 186014 - RNA, 22 nt, Human
ucuggcagcaagauaacaaugg

SEQ ID NO: 186015 - RNA, 21 nt, Human
aucauucuggaaaauucaagc

SEQ ID NO: 186016 - RNA, 22 nt, Human
ugaggauggaaugcugugcaag

SEQ ID NO: 186017 - RNA, 22 nt, Human
ccuuccuugucuacaaaagcuc

SEQ ID NO: 186018 - RNA, 22 nt, Human
auccugaaaauugaauggaagg

SEQ ID NO: 186019 - RNA, 22 nt, Human
auuuucauggcuucugcucagu

SEQ ID NO: 186020 - RNA, 22 nt, Human
gugagcagccucaccugagggu

SEQ ID NO: 186021 - RNA, 20 nt, Human
aaggcagaguggguuggagc

SEQ ID NO: 186022 - RNA, 22 nt, Human
agaaauguugaauacacaaaau

SEQ ID NO: 186023 - RNA, 18 nt, Human
ccagggagcuuauuagga

SEQ ID NO: 186024 - RNA, 22 nt, Human
ucucugugucuuagugaaggga

SEQ ID NO: 186025 - RNA, 22 nt, Human
gcucugcucuaacauuccugac

SEQ ID NO: 186026 - RNA, 22 nt, Human
uaguuacaauggguucugugac

SEQ ID NO: 186027 - RNA, 22 nt, Human
aggcccuguuaugagccacugu

SEQ ID NO: 186028 - RNA, 22 nt, Human
agggaagaggaccagagucucu

SEQ ID NO: 186029 - RNA, 22 nt, Human
agcagagguguuuauuauggga

SEQ ID NO: 186030 - RNA, 22 nt, Human
aucuccagcaauggggagcucu

SEQ ID NO: 186031 - RNA, 22 nt, Human
gggcacagagaagguuuuagug

SEQ ID NO: 186032 - RNA, 21 nt, Human
aggaccuagaaaagugccuag

SEQ ID NO: 186033 - RNA, 22 nt, Human
gagggucccugcucagggccag

SEQ ID NO: 186034 - RNA, 22 nt, Human
aagcuuagguacagaaguuaag

SEQ ID NO: 186035 - RNA, 22 nt, Human
ucuuccuugcuccuugucacuu

SEQ ID NO: 186036 - RNA, 22 nt, Human
aggccacaguacuuugcagacc

SEQ ID NO: 186037 - RNA, 22 nt, Human
gcccugaggcaaaagaacaguc

SEQ ID NO: 186038 - RNA, 17 nt, Human
cugcuuggccucugggg

SEQ ID NO: 186039 - RNA, 17 nt, Human
aggccucugccggugcc

SEQ ID NO: 186040 - RNA, 22 nt, Human
ucuaauuuuaggcauuuguuca

SEQ ID NO: 186041 - RNA, 17 nt, Human
auuuccugcaagccccu

SEQ ID NO: 186042 - RNA, 22 nt, Human
auauuauaaguuauuucaaguu

SEQ ID NO: 186043 - RNA, 22 nt, Human
ugcaggcuccaugaggacaggc

SEQ ID NO: 186044 - RNA, 22 nt, Human
uuugcaaaugcucugcagagcu

SEQ ID NO: 186045 - RNA, 22 nt, Human
augauucuaggcauugaagaua

SEQ ID NO: 186046 - RNA, 22 nt, Human
agagucagacuaagccauggug

SEQ ID NO: 186047 - RNA, 22 nt, Human
uucuguacccaacauuuuuacu

SEQ ID NO: 186048 - RNA, 17 nt, Human
acccaggcucuaucuug

SEQ ID NO: 186049 - RNA, 22 nt, Human
agcagggccuggcacuccuggg

SEQ ID NO: 186050 - RNA, 22 nt, Human
uuugggauuuuacauuguaugg

SEQ ID NO: 186051 - RNA, 22 nt, Human
aucaccaguaaguuuucaguuu

SEQ ID NO: 186052 - RNA, 22 nt, Human
uacacaucauacacugggauua

SEQ ID NO: 186053 - RNA, 22 nt, Human
auacgccauaggcuccucacuu

SEQ ID NO: 186054 - RNA, 22 nt, Human
uuuguucauuuugagcucauca

SEQ ID NO: 186055 - RNA, 22 nt, Human
agguccugugguuuggguaaaa

SEQ ID NO: 186056 - RNA, 22 nt, Human
uguucaguccaauguuggaaaa

SEQ ID NO: 186057 - RNA, 22 nt, Human
gcaggugugaaugugaauuaag

SEQ ID NO: 186058 - RNA, 22 nt, Human
aaggcugagccagggccccuau

SEQ ID NO: 186059 - RNA, 22 nt, Human
aagagucuuauaguguaauuaa

SEQ ID NO: 186060 - RNA, 23 nt, Human
caguggagacucaugcuuccuua

SEQ ID NO: 186061 - RNA, 22 nt, Human
ugucaccaccggaagaaacugc

SEQ ID NO: 186062 - RNA, 22 nt, Human
ucucugguggcuccaucaguag

SEQ ID NO: 186063 - RNA, 22 nt, Human
cagacaaggccaucuuucauuu

SEQ ID NO: 186064 - RNA, 22 nt, Human
uaguaaucagagguaaacuuua

SEQ ID NO: 186065 - RNA, 22 nt, Human
guucuucaggccauccucccag

SEQ ID NO: 186066 - RNA, 22 nt, Human
aggagcugauagucuauggaga

SEQ ID NO: 186067 - RNA, 22 nt, Human
aagucucucugugugggauaag

SEQ ID NO: 186068 - RNA, 21 nt, Human
agccagucugccagagaagcc

SEQ ID NO: 186069 - RNA, 22 nt, Human
guuauuuuaacuucucaguaau

SEQ ID NO: 186070 - RNA, 21 nt, Human
uuucuccaagugacugauucc

SEQ ID NO: 186071 - RNA, 22 nt, Human
aacuacauagaaauuaguauuu

SEQ ID NO: 186072 - RNA, 22 nt, Human
agcaggaaggucugugugaguc

SEQ ID NO: 186073 - RNA, 19 nt, Human
acauggcaucccaggaggu

SEQ ID NO: 186074 - RNA, 21 nt, Human
ucaccuggcuucugaccuggc

SEQ ID NO: 186075 - RNA, 22 nt, Human
uuacaaucaucuaggauaaaga

SEQ ID NO: 186076 - RNA, 22 nt, Human
gcaugcaacucccaguucugcc

SEQ ID NO: 186077 - RNA, 22 nt, Human
agggcuuucuuuguaaaagaag

SEQ ID NO: 186078 - RNA, 22 nt, Human
ugcccuggagucaguggcuauu

SEQ ID NO: 186079 - RNA, 22 nt, Human
guccagagguccaggaucaagg

SEQ ID NO: 186080 - RNA, 22 nt, Human
aagcccauaaaaagaggucccu

SEQ ID NO: 186081 - RNA, 22 nt, Human
aaggugguuugcuaaucccaac

SEQ ID NO: 186082 - RNA, 22 nt, Human
gaacuacaguaagaauugaugu

SEQ ID NO: 186083 - RNA, 22 nt, Human
ucugcucuccauacuuccgcac

SEQ ID NO: 186084 - RNA, 22 nt, Human
uucacauuucucugcuguuuga

SEQ ID NO: 186085 - RNA, 22 nt, Human
uaugucaugucuuagagaauga

SEQ ID NO: 186086 - RNA, 22 nt, Human
uauuugcaggcuuuugucaugg

SEQ ID NO: 186087 - RNA, 22 nt, Human
gccuccuggauuuuagugccau

SEQ ID NO: 186088 - RNA, 22 nt, Human
ggaggcacuucccgucucagcc

SEQ ID NO: 186089 - RNA, 22 nt, Human
ccaggagcaccaggccugugcc

SEQ ID NO: 186090 - RNA, 22 nt, Human
uaagugaugaaagcagaugucu

SEQ ID NO: 186091 - RNA, 22 nt, Human
cuccugggcugucggcgcucug

SEQ ID NO: 186092 - RNA, 21 nt, Human
uguguaauauguauaagaaua

SEQ ID NO: 186093 - RNA, 22 nt, Human
ucugcaggaagcuggcggcuga

SEQ ID NO: 186094 - RNA, 23 nt, Human
agcaaucuguguuucagcaagcc

SEQ ID NO: 186095 - RNA, 22 nt, Human
uuccuacaucaccagggggagu

SEQ ID NO: 186096 - RNA, 22 nt, Human
accccagcgcauauggucugcg

SEQ ID NO: 186097 - RNA, 22 nt, Human
cuugaauguccuguggcaaagu

SEQ ID NO: 186098 - RNA, 22 nt, Human
agugcaugcgcuugggaggggu

SEQ ID NO: 186099 - RNA, 22 nt, Human
gcagggcaguaagagcuagagu

SEQ ID NO: 186100 - RNA, 22 nt, Human
gcugcuguggcagauuggauuc

SEQ ID NO: 186101 - RNA, 22 nt, Human
aggaaacuucagaguuuugguc

SEQ ID NO: 186102 - RNA, 22 nt, Human
ccugcagggugcugccacagau

SEQ ID NO: 186103 - RNA, 22 nt, Human
agaagccacaggaaagcagcuu

SEQ ID NO: 186104 - RNA, 22 nt, Human
aauguuuugcauuaguuuucua

SEQ ID NO: 186105 - RNA, 22 nt, Human
aggcagguuacaaaaacuuuau

SEQ ID NO: 186106 - RNA, 17 nt, Human
ucagacccugugucagg

SEQ ID NO: 186107 - RNA, 22 nt, Human
ugcugcagaucagcugaguccu

SEQ ID NO: 186108 - RNA, 22 nt, Human
uccaaggaggcuuugacgucca

SEQ ID NO: 186109 - RNA, 22 nt, Human
aauaucuguuguucuaagccac

SEQ ID NO: 186110 - RNA, 22 nt, Human
gccugccaaaagaagcugcugg

SEQ ID NO: 186111 - RNA, 18 nt, Human
ccagguggugacagagau

SEQ ID NO: 186112 - RNA, 17 nt, Human
gcagccagugcagcagg

SEQ ID NO: 186113 - RNA, 22 nt, Human
uccuuuaaacuccuuucaaguc

SEQ ID NO: 186114 - RNA, 22 nt, Human
cacugaaaggaaaccagagcau

SEQ ID NO: 186115 - RNA, 21 nt, Human
ucccucagaagguagccaagc

SEQ ID NO: 186116 - RNA, 22 nt, Human
ucuuaagaaagugacaaauagg

SEQ ID NO: 186117 - RNA, 22 nt, Human
ugcugaggucauuuccaaguga

SEQ ID NO: 186118 - RNA, 22 nt, Human
gggauggggagcuggaaagggg

SEQ ID NO: 186119 - RNA, 22 nt, Human
cagcaggacauggaggaguaaa

SEQ ID NO: 186120 - RNA, 19 nt, Human
uccuggggaggggcauggc

SEQ ID NO: 186121 - RNA, 22 nt, Human
ccuggggcuccagagcagcgga

SEQ ID NO: 186122 - RNA, 22 nt, Human
uuaucuugaguauugagauucu

SEQ ID NO: 186123 - RNA, 22 nt, Human
agcagagguuuguuggaaaccu

SEQ ID NO: 186124 - RNA, 22 nt, Human
accacuguacuauuugaguggc

SEQ ID NO: 186125 - RNA, 23 nt, Human
cauguuuuucuaucucagcgugu

SEQ ID NO: 186126 - RNA, 22 nt, Human
aacuuaguuggggacaccaugg

SEQ ID NO: 186127 - RNA, 22 nt, Human
guggcugcagcggcuguggaga

SEQ ID NO: 186128 - RNA, 22 nt, Human
uguguucaaucccuagucucag

SEQ ID NO: 186129 - RNA, 22 nt, Human
auuagcagcuuucuggucucua

SEQ ID NO: 186130 - RNA, 22 nt, Human
ucccaggcaaaggcagcucauu

SEQ ID NO: 186131 - RNA, 22 nt, Human
cuguguguccucggacgaguuu

SEQ ID NO: 186132 - RNA, 22 nt, Human
gaggcaagcccagugggucuaa

SEQ ID NO: 186133 - RNA, 23 nt, Human
gguccaggaaaggcagcagcacc

SEQ ID NO: 186134 - RNA, 22 nt, Human
ccuccccacccacggcuggugg

SEQ ID NO: 186135 - RNA, 22 nt, Human
uagaaucuuuaaaauucauagu

SEQ ID NO: 186136 - RNA, 22 nt, Human
aggcacagaauggcauucagug

SEQ ID NO: 186137 - RNA, 22 nt, Human
cacagaggaugcccaagcgauc

SEQ ID NO: 186138 - RNA, 22 nt, Human
uacauucacaguuguucaucuc

SEQ ID NO: 186139 - RNA, 22 nt, Human
acaugucucuucugaaagacaa

SEQ ID NO: 186140 - RNA, 22 nt, Human
aaagcuggccucucaggcuuua

SEQ ID NO: 186141 - RNA, 22 nt, Human
cauuuauugguuaggccagcag

SEQ ID NO: 186142 - RNA, 22 nt, Human
gaacaacuccaagggacaucau

SEQ ID NO: 186143 - RNA, 22 nt, Human
auucuuuaauucaauugaagga

SEQ ID NO: 186144 - RNA, 21 nt, Human
acagaacuguauagugauaaa

SEQ ID NO: 186145 - RNA, 22 nt, Human
auuucaugaguuauuauagugg

SEQ ID NO: 186146 - RNA, 22 nt, Human
gaugcucaucuguccuuugaug

SEQ ID NO: 186147 - RNA, 22 nt, Human
aauuguaagugcugaguuaagg

SEQ ID NO: 186148 - RNA, 22 nt, Human
aggcagugccuggaccccagcu

SEQ ID NO: 186149 - RNA, 17 nt, Human
ggcugugccaggugaga

SEQ ID NO: 186150 - RNA, 20 nt, Human
uccugagccuccaccauguc

SEQ ID NO: 186151 - RNA, 22 nt, Human
agcugccuucccucucauuagg

SEQ ID NO: 186152 - RNA, 22 nt, Human
ugaggcagggagaguggauaug

SEQ ID NO: 186153 - RNA, 22 nt, Human
cacuaaguugguguuaauuagu

SEQ ID NO: 186154 - RNA, 22 nt, Human
acagacugugaguaugcauagu

SEQ ID NO: 186155 - RNA, 22 nt, Human
augcccugggagugcuguacca

SEQ ID NO: 186156 - RNA, 17 nt, Human
aguguuuccuuaucauu

SEQ ID NO: 186157 - RNA, 22 nt, Human
gugcuggcccuguccucgagcu

SEQ ID NO: 186158 - RNA, 22 nt, Human
gugcauuauucuuaccuuucuu

SEQ ID NO: 186159 - RNA, 22 nt, Human
cccaggcuggcacugcugaagu

SEQ ID NO: 186160 - RNA, 22 nt, Human
ggcucccuguucuauucccugg

SEQ ID NO: 186161 - RNA, 22 nt, Human
cugucucagcaggaagucauca

SEQ ID NO: 186162 - RNA, 22 nt, Human
gcagccagggagagaaccaggg

SEQ ID NO: 186163 - RNA, 22 nt, Human
cagcaaucgggugauaugcaau

SEQ ID NO: 186164 - RNA, 22 nt, Human
acaaugaauaucaugaaguacu

SEQ ID NO: 186165 - RNA, 22 nt, Human
gagggggcuagcgcagugccca

SEQ ID NO: 186166 - RNA, 22 nt, Human
ggaagaaaagcuuccagcgccu

SEQ ID NO: 186167 - RNA, 22 nt, Human
agucucuuacccaagcagaaug

SEQ ID NO: 186168 - RNA, 22 nt, Human
uuucaaagacagccauauuugu

SEQ ID NO: 186169 - RNA, 22 nt, Human
gaggagaggggcucccaagagc

SEQ ID NO: 186170 - RNA, 19 nt, Human
uccaggaggcugccauuga

SEQ ID NO: 186171 - RNA, 22 nt, Human
caaucugaguugggaauguauu

SEQ ID NO: 186172 - RNA, 22 nt, Human
auuucacucauucauguuacuu

SEQ ID NO: 186173 - RNA, 22 nt, Human
ggggcccagggcagcagugcag

SEQ ID NO: 186174 - RNA, 22 nt, Human
acugagcucccugagggcaggc

SEQ ID NO: 186175 - RNA, 22 nt, Human
ugucagcuggagauggcauggg

SEQ ID NO: 186176 - RNA, 22 nt, Human
augucuuucgcaucaguagcua

SEQ ID NO: 186177 - RNA, 22 nt, Human
acauuucagauguaaugugaug

SEQ ID NO: 186178 - RNA, 22 nt, Human
gggucucucucggcuccacgcg

SEQ ID NO: 186179 - RNA, 23 nt, Human
cccagaggagcagggcgugagau

SEQ ID NO: 186180 - RNA, 22 nt, Human
cuaacugucaugcacauguguu

SEQ ID NO: 186181 - RNA, 22 nt, Human
ggguagggugacuuaggcuggc

SEQ ID NO: 186182 - RNA, 22 nt, Human
ugcucagggagcauagugaauu

SEQ ID NO: 186183 - RNA, 22 nt, Human
aauucacauguugaaguccuaa

SEQ ID NO: 186184 - RNA, 19 nt, Human
ucccaggcaaaggcuucuc

SEQ ID NO: 186185 - RNA, 22 nt, Human
gggaccugaggagggguuucag

SEQ ID NO: 186186 - RNA, 22 nt, Human
uguaacaguuauaacaaugugg

SEQ ID NO: 186187 - RNA, 22 nt, Human
aagugcugggauuacaggcguc

SEQ ID NO: 186188 - RNA, 20 nt, Human
cuucuucaguaguuuguucu

SEQ ID NO: 186189 - RNA, 22 nt, Human
uaaagguagugugacauauugu

SEQ ID NO: 186190 - RNA, 20 nt, Human
caucagugccugacaggucc

SEQ ID NO: 186191 - RNA, 22 nt, Human
gcagcaucaauccaugcuucuc

SEQ ID NO: 186192 - RNA, 22 nt, Human
uuccacuggcuuucagugaucu

SEQ ID NO: 186193 - RNA, 22 nt, Human
ugugccagccucuggcuguguc

SEQ ID NO: 186194 - RNA, 22 nt, Human
ccagcccugaacccugcugcau

SEQ ID NO: 186195 - RNA, 23 nt, Human
gguuauuugcauccuguaauuau

SEQ ID NO: 186196 - RNA, 22 nt, Human
caggacaguuugcuuugcccug

SEQ ID NO: 186197 - RNA, 22 nt, Human
cccaggagagaggggauaaagc

SEQ ID NO: 186198 - RNA, 22 nt, Human
uugggaucucaaauccagcuau

SEQ ID NO: 186199 - RNA, 22 nt, Human
gggcuggcugauuuuccucucu

SEQ ID NO: 186200 - RNA, 22 nt, Human
cugcaggacagggaggagcaag

SEQ ID NO: 186201 - RNA, 22 nt, Human
auuugcaugaccuuugcaagug

SEQ ID NO: 186202 - RNA, 22 nt, Human
ccuuucuguguugcccuauuug

SEQ ID NO: 186203 - RNA, 22 nt, Human
uccaggcuuuuucaugcugucu

SEQ ID NO: 186204 - RNA, 22 nt, Human
aagugcugaaugaagacacaaa

SEQ ID NO: 186205 - RNA, 22 nt, Human
agggagcagcagccacaggaug

SEQ ID NO: 186206 - RNA, 19 nt, Human
cauauugugcuugcauuuu

SEQ ID NO: 186207 - RNA, 22 nt, Human
aucaggaagaagaauguguugg

SEQ ID NO: 186208 - RNA, 22 nt, Human
gaucaaugguguaacuuguccu

SEQ ID NO: 186209 - RNA, 22 nt, Human
ugagggaguguggauacaguag

SEQ ID NO: 186210 - RNA, 22 nt, Human
aggccccaaagcagugcaagua

SEQ ID NO: 186211 - RNA, 22 nt, Human
gggaccagaagaaggaugguga

SEQ ID NO: 186212 - RNA, 22 nt, Human
cagaucuuguacucauuauuga

SEQ ID NO: 186213 - RNA, 22 nt, Human
agcaccaggcaguauaucaaag

SEQ ID NO: 186214 - RNA, 22 nt, Human
ucuggagaggggccuagaauuu

SEQ ID NO: 186215 - RNA, 22 nt, Human
gauuuguuucaaguuagcaucu

SEQ ID NO: 186216 - RNA, 22 nt, Human
uggcugcagaucugugggacac

SEQ ID NO: 186217 - RNA, 22 nt, Human
uuuuauuaucuuugaaugggac

SEQ ID NO: 186218 - RNA, 22 nt, Human
ugacauuucagauaugguauuu

SEQ ID NO: 186219 - RNA, 22 nt, Human
ucacagaaaagcugagcaucag

SEQ ID NO: 186220 - RNA, 22 nt, Human
ucagaggaaacaaucuuuagua

SEQ ID NO: 186221 - RNA, 22 nt, Human
uauugaggaucuccugcuaauu

SEQ ID NO: 186222 - RNA, 22 nt, Human
aacuacaauauguauguaugua

SEQ ID NO: 186223 - RNA, 22 nt, Human
gaggccuggucuaugagauguu

SEQ ID NO: 186224 - RNA, 22 nt, Human
ccugagggcguaauuaacagug

SEQ ID NO: 186225 - RNA, 22 nt, Human
cagcccugaaacaaccuccucu

SEQ ID NO: 186226 - RNA, 22 nt, Human
cagaggccaccuguggccacug

SEQ ID NO: 186227 - RNA, 18 nt, Human
gagcucagcguguuucua

SEQ ID NO: 186228 - RNA, 22 nt, Human
uguuauuuaucugagcauuuau

SEQ ID NO: 186229 - RNA, 22 nt, Human
agaguuguuguacaaacuaaau

SEQ ID NO: 186230 - RNA, 20 nt, Human
gagcugugcucucaggagcc

SEQ ID NO: 186231 - RNA, 22 nt, Human
uugugcaauaguuuucucauga

SEQ ID NO: 186232 - RNA, 22 nt, Human
ucaggaagauuaguuuccuacc

SEQ ID NO: 186233 - RNA, 22 nt, Human
acaggcugcugagccauuugcu

SEQ ID NO: 186234 - RNA, 22 nt, Human
ggccucaguuucuccauggguu

SEQ ID NO: 186235 - RNA, 22 nt, Human
ugcuggcuuccugugcacagca

SEQ ID NO: 186236 - RNA, 22 nt, Human
gggaaacuucugcuaaaaccag

SEQ ID NO: 186237 - RNA, 22 nt, Human
uagguacagcuaaaaauuaucu

SEQ ID NO: 186238 - RNA, 22 nt, Human
agagggcaugcuugguggccug

SEQ ID NO: 186239 - RNA, 22 nt, Human
aguguccuggcaaggguuucag

SEQ ID NO: 186240 - RNA, 22 nt, Human
cuggcuggggaagucauuugau

SEQ ID NO: 186241 - RNA, 22 nt, Human
uuauauaaagauaacuuuucuu

SEQ ID NO: 186242 - RNA, 18 nt, Human
uggcagcaggaagccauu

SEQ ID NO: 186243 - RNA, 22 nt, Human
ucucuguaauaucuuuuacaac

SEQ ID NO: 186244 - RNA, 22 nt, Human
acuuggaaagaugcaacacagu

SEQ ID NO: 186245 - RNA, 22 nt, Human
ucuagaucugcacuguuggaca

SEQ ID NO: 186246 - RNA, 22 nt, Human
cuucuucauaggcaguccuguu

SEQ ID NO: 186247 - RNA, 22 nt, Human
uccagccacucagcagggauug

SEQ ID NO: 186248 - RNA, 20 nt, Human
gauaaauugucucuuaagug

SEQ ID NO: 186249 - RNA, 22 nt, Human
cagguggcuucucugcagccuu

SEQ ID NO: 186250 - RNA, 22 nt, Human
agucuggugagaacauaaauag

SEQ ID NO: 186251 - RNA, 21 nt, Human
gccugcaguuuugaagcccuu

SEQ ID NO: 186252 - RNA, 22 nt, Human
ucuggcugaaaggggcugugcc

SEQ ID NO: 186253 - RNA, 22 nt, Human
auguaauuugcccucaaguuaa

SEQ ID NO: 186254 - RNA, 16 nt, Human
uggcuuggguuucaug

SEQ ID NO: 186255 - RNA, 22 nt, Human
aggaaacugggccucagguuag

SEQ ID NO: 186256 - RNA, 22 nt, Human
caggcaugagccaggccccucc

SEQ ID NO: 186257 - RNA, 22 nt, Human
ccuggcacaagagcagcauugg

SEQ ID NO: 186258 - RNA, 22 nt, Human
gcugccuugaacauccuaagua

SEQ ID NO: 186259 - RNA, 22 nt, Human
ugagccaggcucaagugauccu

SEQ ID NO: 186260 - RNA, 22 nt, Human
uuugcaaauucuugucuagccu

SEQ ID NO: 186261 - RNA, 22 nt, Human
uccagcuccacagccucccugu

SEQ ID NO: 186262 - RNA, 22 nt, Human
ugagcaggucaggaaguacauu

SEQ ID NO: 186263 - RNA, 22 nt, Human
uagauucuggagagacagcagu

SEQ ID NO: 186264 - RNA, 22 nt, Human
ucauuucaaugauacuacuaag

SEQ ID NO: 186265 - RNA, 22 nt, Human
agcauucucagaaugucauuuu

SEQ ID NO: 186266 - RNA, 22 nt, Human
caggagguugguagcaguagau

SEQ ID NO: 186267 - RNA, 18 nt, Human
gcagagcugggauuccca

SEQ ID NO: 186268 - RNA, 21 nt, Human
cccugggaugggcuuggacuu

SEQ ID NO: 186269 - RNA, 21 nt, Human
cagagguggccugaccucuga

SEQ ID NO: 186270 - RNA, 22 nt, Human
acaaacagaguugaaaaauagg

SEQ ID NO: 186271 - RNA, 22 nt, Human
uguaaacaugcugaggcuggag

SEQ ID NO: 186272 - RNA, 23 nt, Human
guaggaauuuucacuuccucuug

SEQ ID NO: 186273 - RNA, 21 nt, Human
uucucuggucaagcacacaua

SEQ ID NO: 186274 - RNA, 22 nt, Human
ucccaggauguuggcggcaggu

SEQ ID NO: 186275 - RNA, 22 nt, Human
aauuuacacuucauuuggaggg

SEQ ID NO: 186276 - RNA, 22 nt, Human
uguuugcuauauccuacuucau

SEQ ID NO: 186277 - RNA, 22 nt, Human
ggccacagaacagcuacaggac

SEQ ID NO: 186278 - RNA, 22 nt, Human
cacauuucuguacuuagguaga

SEQ ID NO: 186279 - RNA, 22 nt, Human
auucacaguucauuagcuguaa

SEQ ID NO: 186280 - RNA, 22 nt, Human
acacauuuauuacaugcaugug

SEQ ID NO: 186281 - RNA, 22 nt, Human
cacagccuuacugagauccacu

SEQ ID NO: 186282 - RNA, 22 nt, Human
uggccaguagauaggcaggcaa

SEQ ID NO: 186283 - RNA, 22 nt, Human
auuuccaggagaaaggauuuua

SEQ ID NO: 186284 - RNA, 20 nt, Human
ucaagcuaguuuccaaaguu

SEQ ID NO: 186285 - RNA, 22 nt, Human
acagcuggaggucugugagcac

SEQ ID NO: 186286 - RNA, 16 nt, Human
aaggcugauuuucccu

SEQ ID NO: 186287 - RNA, 22 nt, Human
caggacccaaccucccugcucu

SEQ ID NO: 186288 - RNA, 21 nt, Human
aggggacagaguagcuccagg

SEQ ID NO: 186289 - RNA, 22 nt, Human
gauuuaaaguagaccuuuguuu

SEQ ID NO: 186290 - RNA, 22 nt, Human
ggcucagguuuaaagugcuuua

SEQ ID NO: 186291 - RNA, 22 nt, Human
ucccagggauccuccgggucgc

SEQ ID NO: 186292 - RNA, 22 nt, Human
agcuccagcccaucugcucgug

SEQ ID NO: 186293 - RNA, 22 nt, Human
uuccccaguagugacaaucaaa

SEQ ID NO: 186294 - RNA, 22 nt, Human
cuggaggaauaaucuccuaccc

SEQ ID NO: 186295 - RNA, 22 nt, Human
augcauuugacgggauauauuu

SEQ ID NO: 186296 - RNA, 22 nt, Human
agacagacugguuugaauuggu

SEQ ID NO: 186297 - RNA, 22 nt, Human
ugauucaacuuucuugaaugca

SEQ ID NO: 186298 - RNA, 22 nt, Human
aagacucaaggaacaacacagu

SEQ ID NO: 186299 - RNA, 22 nt, Human
cucuccucugaaguggugaccc

SEQ ID NO: 186300 - RNA, 22 nt, Human
cccaggaggacauuccauaccc

SEQ ID NO: 186301 - RNA, 23 nt, Human
ucagaagugggauacaaagcuga

SEQ ID NO: 186302 - RNA, 22 nt, Human
cugccuggaaugccagcuucuc

SEQ ID NO: 186303 - RNA, 22 nt, Human
ucucauugccuucacucuucag

SEQ ID NO: 186304 - RNA, 22 nt, Human
accaaagggcagaacaugagca

SEQ ID NO: 186305 - RNA, 22 nt, Human
uucuuuauaucugcuagugggu

SEQ ID NO: 186306 - RNA, 22 nt, Human
gggcuccaacggugagcaugga

SEQ ID NO: 186307 - RNA, 22 nt, Human
caggacaggcccuguggggucu

SEQ ID NO: 186308 - RNA, 22 nt, Human
ccaggcuccccaggaggcccuu

SEQ ID NO: 186309 - RNA, 22 nt, Human
aguguacaucagaacauaucaa

SEQ ID NO: 186310 - RNA, 22 nt, Human
cccagugggucacugcaucuca

SEQ ID NO: 186311 - RNA, 19 nt, Human
uccccaagaguucuagcuc

SEQ ID NO: 186312 - RNA, 22 nt, Human
uugaagaguuugauagaguuga

SEQ ID NO: 186313 - RNA, 22 nt, Human
uggacagguuugggugccuguu

SEQ ID NO: 186314 - RNA, 20 nt, Human
aagaaguugguaagcagugc

SEQ ID NO: 186315 - RNA, 17 nt, Human
gcaguuaaauuaagaug

SEQ ID NO: 186316 - RNA, 22 nt, Human
acugggcuaccccaccauuacc

SEQ ID NO: 186317 - RNA, 23 nt, Human
augcccuguagaggcugcugacc

SEQ ID NO: 186318 - RNA, 22 nt, Human
agccaacagccagcaucaacca

SEQ ID NO: 186319 - RNA, 22 nt, Human
gggcucuguuuagaccagagau

SEQ ID NO: 186320 - RNA, 22 nt, Human
ccagguggaaggucugugcucu

SEQ ID NO: 186321 - RNA, 22 nt, Human
ugguggaaggcagagcuacacc

SEQ ID NO: 186322 - RNA, 23 nt, Human
cacugggcccaggguguggaggc

SEQ ID NO: 186323 - RNA, 22 nt, Human
acugaaauggggacaguccuua

SEQ ID NO: 186324 - RNA, 22 nt, Human
gcaggccuguaaugaagggaca

SEQ ID NO: 186325 - RNA, 22 nt, Human
ucaacaguucuguccaauuaau

SEQ ID NO: 186326 - RNA, 22 nt, Human
uuuauaugaaagugaccagugg

SEQ ID NO: 186327 - RNA, 22 nt, Human
agggcugacaguggcguggcgu

SEQ ID NO: 186328 - RNA, 22 nt, Human
uuaauguuuuaaguuauagaga

SEQ ID NO: 186329 - RNA, 22 nt, Human
aaggcugagagucacaguccua

SEQ ID NO: 186330 - RNA, 22 nt, Human
uaugugucucaguugugauuga

SEQ ID NO: 186331 - RNA, 22 nt, Human
gcaaagcagaacccucucuauc

SEQ ID NO: 186332 - RNA, 22 nt, Human
auggcagagaaagcgagccaca

SEQ ID NO: 186333 - RNA, 22 nt, Human
cuucccagaacaauguaggcuu

SEQ ID NO: 186334 - RNA, 21 nt, Human
auucagaaagggaauaaacuc

SEQ ID NO: 186335 - RNA, 22 nt, Human
uucuuguuccaugaaagacaga

SEQ ID NO: 186336 - RNA, 22 nt, Human
acuguccauaauauuggugaac

SEQ ID NO: 186337 - RNA, 22 nt, Human
ugcuggcucuaggcugagacag

SEQ ID NO: 186338 - RNA, 22 nt, Human
aguuuacauaaaaaggcagagg

SEQ ID NO: 186339 - RNA, 22 nt, Human
uuccaggaugcugcugcuuuuu

SEQ ID NO: 186340 - RNA, 22 nt, Human
cuuuuaaugggagcaguauuug

SEQ ID NO: 186341 - RNA, 22 nt, Human
gaggcuccuugaaagggggacu

SEQ ID NO: 186342 - RNA, 22 nt, Human
caccagcuugcagucuuaaccc

SEQ ID NO: 186343 - RNA, 22 nt, Human
ggaacuggguuagggucucuuc

SEQ ID NO: 186344 - RNA, 22 nt, Human
cuggcuggccaugcagcgccag

SEQ ID NO: 186345 - RNA, 22 nt, Human
ucugagcccagugagucucgca

SEQ ID NO: 186346 - RNA, 22 nt, Human
aagacccuucucugaggaggaa

SEQ ID NO: 186347 - RNA, 22 nt, Human
augacagcauucaagacauaga

SEQ ID NO: 186348 - RNA, 22 nt, Human
cuggccugggagcugcuagcgu

SEQ ID NO: 186349 - RNA, 22 nt, Human
gggagccacaguuuauagugau

SEQ ID NO: 186350 - RNA, 22 nt, Human
aggcucuggacagugaggaguu

SEQ ID NO: 186351 - RNA, 20 nt, Human
ugacuucuucaugcuguacu

SEQ ID NO: 186352 - RNA, 22 nt, Human
gagagcugggcuuugggugaag

SEQ ID NO: 186353 - RNA, 22 nt, Human
uggcugccaauggcuuggaaag

SEQ ID NO: 186354 - RNA, 22 nt, Human
gaugugaggacucauguggagg

SEQ ID NO: 186355 - RNA, 22 nt, Human
acuugguuggucucacccuguu

SEQ ID NO: 186356 - RNA, 22 nt, Human
uguacaaauucauugaacugua

SEQ ID NO: 186357 - RNA, 22 nt, Human
ugaaugcuuggagucauaaaau

SEQ ID NO: 186358 - RNA, 23 nt, Human
uuucucauccagagagucagucc

SEQ ID NO: 186359 - RNA, 22 nt, Human
agggcacaagacucugagcccc

SEQ ID NO: 186360 - RNA, 20 nt, Human
cucugggcugcacccucgcc

SEQ ID NO: 186361 - RNA, 23 nt, Human
ccaggcaguagcuauugaaguga

SEQ ID NO: 186362 - RNA, 22 nt, Human
uucaaacaguguagaauauaug

SEQ ID NO: 186363 - RNA, 22 nt, Human
cagucucagaggugggaguggg

SEQ ID NO: 186364 - RNA, 22 nt, Human
agucaccuugaaaugucuugaa

SEQ ID NO: 186365 - RNA, 22 nt, Human
ucaggcugauaggaggaacuga

SEQ ID NO: 186366 - RNA, 22 nt, Human
acaggacaaggggaagaagaua

SEQ ID NO: 186367 - RNA, 22 nt, Human
ccugccugacagagaagguuca

SEQ ID NO: 186368 - RNA, 21 nt, Human
ucauuugugaucugauuucca

SEQ ID NO: 186369 - RNA, 20 nt, Human
ccuggcugcauucaggacgg

SEQ ID NO: 186370 - RNA, 22 nt, Human
cucuggcuggcugggccucagu

SEQ ID NO: 186371 - RNA, 22 nt, Human
uugccuauuguucuuacauguu

SEQ ID NO: 186372 - RNA, 23 nt, Human
gugucauuacuguaauuauugug

SEQ ID NO: 186373 - RNA, 22 nt, Human
uguccuuuuggcugucuauggu

SEQ ID NO: 186374 - RNA, 22 nt, Human
uucagugucacaagagcaagcc

SEQ ID NO: 186375 - RNA, 22 nt, Human
uggccuggccacauccagcagg

SEQ ID NO: 186376 - RNA, 22 nt, Human
ucuggcaucacucgcaagagca

SEQ ID NO: 186377 - RNA, 22 nt, Human
cugagucucccggcaguggagg

SEQ ID NO: 186378 - RNA, 18 nt, Human
ggagccagucugucucug

SEQ ID NO: 186379 - RNA, 22 nt, Human
caucuucagguucauggucaua

SEQ ID NO: 186380 - RNA, 16 nt, Human
aggcagagauuuaccc

SEQ ID NO: 186381 - RNA, 18 nt, Human
ugcugggcauuaggcuua

SEQ ID NO: 186382 - RNA, 22 nt, Human
acugggcuucacuuggcacauc

SEQ ID NO: 186383 - RNA, 18 nt, Human
guagauccuugagcuacc

SEQ ID NO: 186384 - RNA, 18 nt, Human
ggucugagaucguuuuuc

SEQ ID NO: 186385 - RNA, 22 nt, Human
uuggaauccugagaugagaauu

SEQ ID NO: 186386 - RNA, 22 nt, Human
cugguaguuugcaaaauggugu

SEQ ID NO: 186387 - RNA, 23 nt, Human
aucuccugagaacccacaguggu

SEQ ID NO: 186388 - RNA, 22 nt, Human
ccaggcuggaguguagucgcau

SEQ ID NO: 186389 - RNA, 22 nt, Human
acagacauucauauccucggua

SEQ ID NO: 186390 - RNA, 22 nt, Human
caaaggcucaguaaaucuuugu

SEQ ID NO: 186391 - RNA, 22 nt, Human
agcaggcuuguuaugucugaga

SEQ ID NO: 186392 - RNA, 22 nt, Human
ggcagauggagaagcagcaggu

SEQ ID NO: 186393 - RNA, 22 nt, Human
auuaucuauguagaaugauuuu

SEQ ID NO: 186394 - RNA, 22 nt, Human
ucaagcuggcuguugcuauuuc

SEQ ID NO: 186395 - RNA, 19 nt, Human
uucuccagccugaccugag

SEQ ID NO: 186396 - RNA, 22 nt, Human
augagugucauguaugagauau

SEQ ID NO: 186397 - RNA, 22 nt, Human
caccucuuugauuugaggcaag

SEQ ID NO: 186398 - RNA, 22 nt, Human
ucuuccuggcauugaugcugca

SEQ ID NO: 186399 - RNA, 22 nt, Human
agggccugagaccguggcuuga

SEQ ID NO: 186400 - RNA, 22 nt, Human
cucaggaguuggaggcuacagu

SEQ ID NO: 186401 - RNA, 22 nt, Human
gugugacuuuauuuggaaauag

SEQ ID NO: 186402 - RNA, 22 nt, Human
cuucagaauccagaaucagaau

SEQ ID NO: 186403 - RNA, 22 nt, Human
ucaggauaaaauguaauggcaa

SEQ ID NO: 186404 - RNA, 20 nt, Human
ugcagggcugccucccagcu

SEQ ID NO: 186405 - RNA, 21 nt, Human
ucuguggcggacucuaggccc

SEQ ID NO: 186406 - RNA, 22 nt, Human
cagcugguuuuagcacaguuag

SEQ ID NO: 186407 - RNA, 22 nt, Human
ugcccugccaagacucaguggu

SEQ ID NO: 186408 - RNA, 22 nt, Human
uuagaagcacuaauuacucaca

SEQ ID NO: 186409 - RNA, 22 nt, Human
cugcaggggaccaaagucugac

SEQ ID NO: 186410 - RNA, 22 nt, Human
agcagugaugcaugacagccua

SEQ ID NO: 186411 - RNA, 22 nt, Human
uucuccagaccacugccucugu

SEQ ID NO: 186412 - RNA, 22 nt, Human
ucagauggauuuauacuauuuc

SEQ ID NO: 186413 - RNA, 22 nt, Human
ggcagaaggcaauuagagacug

SEQ ID NO: 186414 - RNA, 22 nt, Human
uguaaauugaaggaaauuugug

SEQ ID NO: 186415 - RNA, 22 nt, Human
ucugagacaggaaguggagggu

SEQ ID NO: 186416 - RNA, 22 nt, Human
uggcuucucccuacaacaugcc

SEQ ID NO: 186417 - RNA, 22 nt, Human
agacucuuggagaagagcuaua

SEQ ID NO: 186418 - RNA, 22 nt, Human
aggcuguggcccuggucuagca

SEQ ID NO: 186419 - RNA, 22 nt, Human
uggcccuguguccugcugccag

SEQ ID NO: 186420 - RNA, 22 nt, Human
uguugaguauauaccuacaagu

SEQ ID NO: 186421 - RNA, 22 nt, Human
ucugaaagucugaaacaguguc

SEQ ID NO: 186422 - RNA, 22 nt, Human
uagcucagcaggugggacaggu

SEQ ID NO: 186423 - RNA, 22 nt, Human
ccugguuuuucaaacauacaag

SEQ ID NO: 186424 - RNA, 22 nt, Human
gcaggugaaugauggacuagga

SEQ ID NO: 186425 - RNA, 22 nt, Human
gcuguggucugugagcuccaaa

SEQ ID NO: 186426 - RNA, 22 nt, Human
gcuggaaaaggaggcaaaauau

SEQ ID NO: 186427 - RNA, 22 nt, Human
ccaugccagcugcuaggucaca

SEQ ID NO: 186428 - RNA, 20 nt, Human
aggagggaccuggauuggcg

SEQ ID NO: 186429 - RNA, 22 nt, Human
gcaaacaucuuuauuuggcaag

SEQ ID NO: 186430 - RNA, 22 nt, Human
cagggauggccuggcgggccac

SEQ ID NO: 186431 - RNA, 22 nt, Human
agaaagcacucugucuuuuacc

SEQ ID NO: 186432 - RNA, 22 nt, Human
aagauuuucagcuaauggugca

SEQ ID NO: 186433 - RNA, 22 nt, Human
gagagggauacugaguuuuggu

SEQ ID NO: 186434 - RNA, 22 nt, Human
cacacagggagaaagaaagccu

SEQ ID NO: 186435 - RNA, 22 nt, Human
acuguucacagauuagucgaug

SEQ ID NO: 186436 - RNA, 22 nt, Human
cccuucagcugagugggacagc

SEQ ID NO: 186437 - RNA, 17 nt, Human
gucugggcuuuagagac

SEQ ID NO: 186438 - RNA, 22 nt, Human
uagagaaaaccacuggugagcu

SEQ ID NO: 186439 - RNA, 22 nt, Human
gggagggacacaaagaguuccc

SEQ ID NO: 186440 - RNA, 22 nt, Human
uaggcagagaggccauaagaau

SEQ ID NO: 186441 - RNA, 23 nt, Human
acagggcauugcuggccucgagg

SEQ ID NO: 186442 - RNA, 22 nt, Human
acucuggccccaggaucugugu

SEQ ID NO: 186443 - RNA, 20 nt, Human
ugcagggccuaaaaagggaa

SEQ ID NO: 186444 - RNA, 17 nt, Human
uuagagcuacauguuga

SEQ ID NO: 186445 - RNA, 22 nt, Human
auggcuggauuugauccauggg

SEQ ID NO: 186446 - RNA, 22 nt, Human
uuacuguugguguauccauagc

SEQ ID NO: 186447 - RNA, 22 nt, Human
ccaguggaaauguggucaggau

SEQ ID NO: 186448 - RNA, 22 nt, Human
gcugcaggcuguggcaggggag

SEQ ID NO: 186449 - RNA, 22 nt, Human
auuuauuaagcaucugcuaugu

SEQ ID NO: 186450 - RNA, 22 nt, Human
ucaaauaguugacauuaacuug

SEQ ID NO: 186451 - RNA, 22 nt, Human
gaggagcccuguuccccaggcc

SEQ ID NO: 186452 - RNA, 19 nt, Human
cucugggcugcaucuuggu

SEQ ID NO: 186453 - RNA, 22 nt, Human
uuuacaugucaagacuggcagu

SEQ ID NO: 186454 - RNA, 22 nt, Human
caaauacuacgauucuugcagu

SEQ ID NO: 186455 - RNA, 22 nt, Human
ccugcccuucuuuccccagcau

SEQ ID NO: 186456 - RNA, 22 nt, Human
ggcccucugcucacuuccuauu

SEQ ID NO: 186457 - RNA, 22 nt, Human
ucugaaaugaacucuugaacuu

SEQ ID NO: 186458 - RNA, 22 nt, Human
gagcuuggacaccuuggcaggu

SEQ ID NO: 186459 - RNA, 22 nt, Human
auacaaaguauugauccugagu

SEQ ID NO: 186460 - RNA, 22 nt, Human
aaacaauguagauuaccauuua

SEQ ID NO: 186461 - RNA, 22 nt, Human
aguacaaaggcccuugauuacu

SEQ ID NO: 186462 - RNA, 22 nt, Human
ucucugggaauucacaagcccu

SEQ ID NO: 186463 - RNA, 22 nt, Human
ccucugggcagguagcagcagc

SEQ ID NO: 186464 - RNA, 22 nt, Human
agggggcaggagagaccugcug

SEQ ID NO: 186465 - RNA, 19 nt, Human
ccagcagguucauuucagg

SEQ ID NO: 186466 - RNA, 22 nt, Human
gaauucaucgucuuagcugcca

SEQ ID NO: 186467 - RNA, 22 nt, Human
auagagugauguaagguaugug

SEQ ID NO: 186468 - RNA, 22 nt, Human
gugggcagacagugcuuugcag

SEQ ID NO: 186469 - RNA, 22 nt, Human
uuagaaaucaccucugaagauc

SEQ ID NO: 186470 - RNA, 22 nt, Human
guuaaauucgaugauggauaaa

SEQ ID NO: 186471 - RNA, 22 nt, Human
augcacaugaggcaagcaaaau

SEQ ID NO: 186472 - RNA, 22 nt, Human
ugucauuuaguccucugugugu

SEQ ID NO: 186473 - RNA, 22 nt, Human
uccuagaaugcaccucugcugu

SEQ ID NO: 186474 - RNA, 22 nt, Human
aucuccagaacauuuauaaacg

SEQ ID NO: 186475 - RNA, 22 nt, Human
ucuccugggaggacaaggaagg

SEQ ID NO: 186476 - RNA, 22 nt, Human
uggcagagaauaaaucuugacu

SEQ ID NO: 186477 - RNA, 22 nt, Human
caugaccccccaaggccugcag

SEQ ID NO: 186478 - RNA, 17 nt, Human
auuuacauugucaccga

SEQ ID NO: 186479 - RNA, 21 nt, Human
gccuggcagguggaagggcuc

SEQ ID NO: 186480 - RNA, 22 nt, Human
auuagaucagaucggcaguaau

SEQ ID NO: 186481 - RNA, 22 nt, Human
cagcccucucugggccccaagg

SEQ ID NO: 186482 - RNA, 22 nt, Human
uucuucuuuccaauuacauggu

SEQ ID NO: 186483 - RNA, 22 nt, Human
agguauauauucugguccuuau

SEQ ID NO: 186484 - RNA, 22 nt, Human
auuuaucaacauguaccauugg

SEQ ID NO: 186485 - RNA, 22 nt, Human
cagugucuuucagacucagaaa

SEQ ID NO: 186486 - RNA, 22 nt, Human
cugcccuguagcuguucuagca

SEQ ID NO: 186487 - RNA, 22 nt, Human
uaggccucaggaccccagggcu

SEQ ID NO: 186488 - RNA, 22 nt, Human
ugcuagaagauagcuagaagau

SEQ ID NO: 186489 - RNA, 21 nt, Human
gccuggcucucacuggccugg

SEQ ID NO: 186490 - RNA, 22 nt, Human
uucaaaguaccguacuuaaugg

SEQ ID NO: 186491 - RNA, 22 nt, Human
acacaugagaaacaucaguugu

SEQ ID NO: 186492 - RNA, 22 nt, Human
uaaagcacgucuauuuaaugau

SEQ ID NO: 186493 - RNA, 22 nt, Human
gagacaaagcuuccugugggua

SEQ ID NO: 186494 - RNA, 22 nt, Human
gccaccuguuucgcuugcccag

SEQ ID NO: 186495 - RNA, 22 nt, Human
gcagggcugauggcuucccuca

SEQ ID NO: 186496 - RNA, 22 nt, Human
uccagaccaugugagaggcgca

SEQ ID NO: 186497 - RNA, 22 nt, Human
gaggcagaggaagguggucucu

SEQ ID NO: 186498 - RNA, 22 nt, Human
aaaguguuuugugagcagucug

SEQ ID NO: 186499 - RNA, 22 nt, Human
ucaggcugaaucauccuagcuu

SEQ ID NO: 186500 - RNA, 22 nt, Human
cuggauguuuugcuaaggacuc

SEQ ID NO: 186501 - RNA, 22 nt, Human
cacauaauacauguuccacuua

SEQ ID NO: 186502 - RNA, 22 nt, Human
ucagcuccagaguugcacagug

SEQ ID NO: 186503 - RNA, 22 nt, Human
ucugguggugggccacaagcau

SEQ ID NO: 186504 - RNA, 22 nt, Human
caccagcuacuccagggccgug

SEQ ID NO: 186505 - RNA, 22 nt, Human
ugugauuucacuggugacaugu

SEQ ID NO: 186506 - RNA, 22 nt, Human
cuucuuuaccaagagauagagu

SEQ ID NO: 186507 - RNA, 22 nt, Human
ucuggggagcagcccuggugag

SEQ ID NO: 186508 - RNA, 22 nt, Human
cuucguuuuuaguagcaauguu

SEQ ID NO: 186509 - RNA, 19 nt, Human
uucuggucuggaaucaagg

SEQ ID NO: 186510 - RNA, 22 nt, Human
agucaacaccugguucuauuac

SEQ ID NO: 186511 - RNA, 22 nt, Human
aggcagaaccagcugggacuuu

SEQ ID NO: 186512 - RNA, 22 nt, Human
aaaugcugucaguguuauugga

SEQ ID NO: 186513 - RNA, 22 nt, Human
uguuuacugcauucuauuugcu

SEQ ID NO: 186514 - RNA, 22 nt, Human
ccauaaucuggcuuugagagag

SEQ ID NO: 186515 - RNA, 20 nt, Human
gcugggcuuugacugacaca

SEQ ID NO: 186516 - RNA, 22 nt, Human
gucucugagcucugagcuggcu

SEQ ID NO: 186517 - RNA, 22 nt, Human
cugacugugagagcaggaaugg

SEQ ID NO: 186518 - RNA, 22 nt, Human
acuuugcagguacaugagcauc

SEQ ID NO: 186519 - RNA, 23 nt, Human
agaagcagcuucuggaguaucgg

SEQ ID NO: 186520 - RNA, 22 nt, Human
ucaagcaacugaauucuaaaag

SEQ ID NO: 186521 - RNA, 18 nt, Human
ucuuggaguaaugaucaa

SEQ ID NO: 186522 - RNA, 22 nt, Human
uccaggcucccucaggaugcac

SEQ ID NO: 186523 - RNA, 22 nt, Human
gcuggccugaccagccacaggc

SEQ ID NO: 186524 - RNA, 22 nt, Human
caaggcuuagguggcucccugu

SEQ ID NO: 186525 - RNA, 22 nt, Human
uuauuagguuauucucuguacu

SEQ ID NO: 186526 - RNA, 22 nt, Human
cagcuucuguuucuagccccug

SEQ ID NO: 186527 - RNA, 23 nt, Human
uuuaccagaauagcaggggagag

SEQ ID NO: 186528 - RNA, 22 nt, Human
ugacauuucgguguaugugaug

SEQ ID NO: 186529 - RNA, 22 nt, Human
acaguggagaaggcaugaggcu

SEQ ID NO: 186530 - RNA, 21 nt, Human
cuggcucuguugucacccggc

SEQ ID NO: 186531 - RNA, 23 nt, Human
aaugaacugagaaucuguacagu

SEQ ID NO: 186532 - RNA, 22 nt, Human
agcagguugugauacacucaga

SEQ ID NO: 186533 - RNA, 22 nt, Human
gagcccuguagcaagucauguc

SEQ ID NO: 186534 - RNA, 22 nt, Human
auuaagugacuaaaguaaugcu

SEQ ID NO: 186535 - RNA, 22 nt, Human
uccuuggcagcagggagcauga

SEQ ID NO: 186536 - RNA, 22 nt, Human
agaaggcuaaaguaacuuagua

SEQ ID NO: 186537 - RNA, 22 nt, Human
ucucacugauuugagaccaagg

SEQ ID NO: 186538 - RNA, 20 nt, Human
aucaaaauccuauugagguu

SEQ ID NO: 186539 - RNA, 22 nt, Human
cuuccuuccuuccccgaaaugc

SEQ ID NO: 186540 - RNA, 22 nt, Human
uucugggcacacaggcccuggu

SEQ ID NO: 186541 - RNA, 22 nt, Human
ccugggcuccacuccaagagca

SEQ ID NO: 186542 - RNA, 22 nt, Human
cagaugugauucuucccucagc

SEQ ID NO: 186543 - RNA, 22 nt, Human
uuaauugagccagaaaguaucu

SEQ ID NO: 186544 - RNA, 22 nt, Human
uagugaaacaguuaucaaucug

SEQ ID NO: 186545 - RNA, 22 nt, Human
auucacauuuacaaagcacuca

SEQ ID NO: 186546 - RNA, 22 nt, Human
cugcagggcagggccuccuggc

SEQ ID NO: 186547 - RNA, 22 nt, Human
cugggggcaagcagacagcugu

SEQ ID NO: 186548 - RNA, 22 nt, Human
uagaauuuucugcuuugauagu

SEQ ID NO: 186549 - RNA, 22 nt, Human
uccaaggacucuugucagcugu

SEQ ID NO: 186550 - RNA, 22 nt, Human
aagcugugcaggaacugcuugc

SEQ ID NO: 186551 - RNA, 22 nt, Human
aguguuucaccguauguucuca

SEQ ID NO: 186552 - RNA, 22 nt, Human
ugcauggacucaucagacaaga

SEQ ID NO: 186553 - RNA, 22 nt, Human
gcaggccaagcccucgcagaga

SEQ ID NO: 186554 - RNA, 22 nt, Human
cccagcccaucucaaaggucua

SEQ ID NO: 186555 - RNA, 22 nt, Human
aucaaaauggaagaauuuggcu

SEQ ID NO: 186556 - RNA, 22 nt, Human
gcacacuuaauacucacugugc

SEQ ID NO: 186557 - RNA, 18 nt, Human
agaacacuugguuagauc

SEQ ID NO: 186558 - RNA, 22 nt, Human
uccaugagaacccuuggagaua

SEQ ID NO: 186559 - RNA, 21 nt, Human
guuuagaaguagucuggcuca

SEQ ID NO: 186560 - RNA, 22 nt, Human
ucauuuuucacacagggucacc

SEQ ID NO: 186561 - RNA, 22 nt, Human
acagugugugggaaaugugacu

SEQ ID NO: 186562 - RNA, 22 nt, Human
cuggcagugcccucagccccca

SEQ ID NO: 186563 - RNA, 22 nt, Human
cagggcauccgugcuccaugcu

SEQ ID NO: 186564 - RNA, 22 nt, Human
gaguuucuccagugcuaguugu

SEQ ID NO: 186565 - RNA, 22 nt, Human
ccaggcuucccccauccuagga

SEQ ID NO: 186566 - RNA, 23 nt, Human
ugauuacaagggccaaagaaagg

SEQ ID NO: 186567 - RNA, 22 nt, Human
gagguucaguaaggaauacuga

SEQ ID NO: 186568 - RNA, 23 nt, Human
uuaaaggcagauguugaguauua

SEQ ID NO: 186569 - RNA, 22 nt, Human
gcgugcaacagccucuuccauu

SEQ ID NO: 186570 - RNA, 22 nt, Human
ccuggccauagggcccaggaaa

SEQ ID NO: 186571 - RNA, 22 nt, Human
cccuccaccaagcagggcgcca

SEQ ID NO: 186572 - RNA, 22 nt, Human
uuugggaaauaguagaaaaugu

SEQ ID NO: 186573 - RNA, 22 nt, Human
cagcaagauuaagggcagaaaa

SEQ ID NO: 186574 - RNA, 22 nt, Human
auggaggaugugcagcaugggc

SEQ ID NO: 186575 - RNA, 22 nt, Human
ccugugcaggcuccauaauaga

SEQ ID NO: 186576 - RNA, 22 nt, Human
ugguccugccccgugcacagag

SEQ ID NO: 186577 - RNA, 22 nt, Human
ugucugguggguugacaggcag

SEQ ID NO: 186578 - RNA, 22 nt, Human
ccagagucuaugaguccucauu

SEQ ID NO: 186579 - RNA, 22 nt, Human
ccauuguaguaucuguuuuagu

SEQ ID NO: 186580 - RNA, 22 nt, Human
cuggguuccauguagccaagag

SEQ ID NO: 186581 - RNA, 22 nt, Human
caaggaaaaagcgagcucgggg

SEQ ID NO: 186582 - RNA, 22 nt, Human
ucagagcuuuggagaccaggaa

SEQ ID NO: 186583 - RNA, 22 nt, Human
aaacaguuguuauuuuuauaug

SEQ ID NO: 186584 - RNA, 17 nt, Human
ugcugacagcugugugu

SEQ ID NO: 186585 - RNA, 21 nt, Human
uuucagaccuaucuuugaagg

SEQ ID NO: 186586 - RNA, 22 nt, Human
aucuggcugagcgaggcccaca

SEQ ID NO: 186587 - RNA, 22 nt, Human
uugaggagcacuagucagguau

SEQ ID NO: 186588 - RNA, 22 nt, Human
gacuggggcucuagccaggccu

SEQ ID NO: 186589 - RNA, 22 nt, Human
ggcagcugucucugaguuagca

SEQ ID NO: 186590 - RNA, 22 nt, Human
auacauagauagauaaucuggc

SEQ ID NO: 186591 - RNA, 22 nt, Human
uaguuaugucugcaugcauauu

SEQ ID NO: 186592 - RNA, 21 nt, Human
uuccagagauuguuucaccug

SEQ ID NO: 186593 - RNA, 22 nt, Human
guggauggacaugggcaagagg

SEQ ID NO: 186594 - RNA, 22 nt, Human
ugauugaacugagcuucaagau

SEQ ID NO: 186595 - RNA, 22 nt, Human
cauuagaauuagguuguuuacc

SEQ ID NO: 186596 - RNA, 22 nt, Human
ugcaggcauaaccgauguugau

SEQ ID NO: 186597 - RNA, 22 nt, Human
guccugugucccagagaaagag

SEQ ID NO: 186598 - RNA, 22 nt, Human
uuuuucugagaauaugagagga

SEQ ID NO: 186599 - RNA, 22 nt, Human
agguucuguuuggcugaggauc

SEQ ID NO: 186600 - RNA, 22 nt, Human
uucucaagaacauauguagggu

SEQ ID NO: 186601 - RNA, 22 nt, Human
ccuggucaccccucucucugca

SEQ ID NO: 186602 - RNA, 22 nt, Human
ucacagaagcuugaagauuuuc

SEQ ID NO: 186603 - RNA, 22 nt, Human
cugaggaccccacaggaggccc

SEQ ID NO: 186604 - RNA, 22 nt, Human
aggagacauacuauaggaauau

SEQ ID NO: 186605 - RNA, 22 nt, Human
ugagacaguaauuguauaguuu

SEQ ID NO: 186606 - RNA, 22 nt, Human
agacaucucccaugcauuuuua

SEQ ID NO: 186607 - RNA, 22 nt, Human
ucccugggccuaucuuagcucc

SEQ ID NO: 186608 - RNA, 22 nt, Human
gcucagagaaaacuggggcuug

SEQ ID NO: 186609 - RNA, 22 nt, Human
ucagcccugggcuuccucaugg

SEQ ID NO: 186610 - RNA, 22 nt, Human
ugaguacugauuuaagauacac

SEQ ID NO: 186611 - RNA, 22 nt, Human
uuagaagccaggauggagcagg

SEQ ID NO: 186612 - RNA, 22 nt, Human
ccaggagaagcaucugagugua

SEQ ID NO: 186613 - RNA, 22 nt, Human
cuggcagcuucaggacacucgg

SEQ ID NO: 186614 - RNA, 22 nt, Human
uaacuguauuuuucugagauuc

SEQ ID NO: 186615 - RNA, 22 nt, Human
aaauaucauuuauaacuuuuaa

SEQ ID NO: 186616 - RNA, 22 nt, Human
ugccuguccugaggaugagggu

SEQ ID NO: 186617 - RNA, 22 nt, Human
uuuuuuguagcaagcgcagaua

SEQ ID NO: 186618 - RNA, 22 nt, Human
ugacaggcagugcugggcaugu

SEQ ID NO: 186619 - RNA, 22 nt, Human
acagaggccgccucucucacgg

SEQ ID NO: 186620 - RNA, 22 nt, Human
uccuggccuagaguuuguguuc

SEQ ID NO: 186621 - RNA, 22 nt, Human
acaauacuauuuucaguauccu

SEQ ID NO: 186622 - RNA, 22 nt, Human
uuucugcugugcuuucuugcgu

SEQ ID NO: 186623 - RNA, 22 nt, Human
cagauucucacuguauucaggu

SEQ ID NO: 186624 - RNA, 22 nt, Human
acauaauagguaccugaauaau

SEQ ID NO: 186625 - RNA, 22 nt, Human
uccaguuugcacuguauaauag

SEQ ID NO: 186626 - RNA, 22 nt, Human
ggcugguccuuucucuguccua

SEQ ID NO: 186627 - RNA, 22 nt, Human
ggcccaggcuggagugcggugg

SEQ ID NO: 186628 - RNA, 22 nt, Human
ccugagauuggcuaguaugagu

SEQ ID NO: 186629 - RNA, 22 nt, Human
gacaggcuagguugcuguccuc

SEQ ID NO: 186630 - RNA, 22 nt, Human
aagauacugaugauguaggcua

SEQ ID NO: 186631 - RNA, 22 nt, Human
ccaggagcagccggcccaccug

SEQ ID NO: 186632 - RNA, 19 nt, Human
auacacguguauacauaca

SEQ ID NO: 186633 - RNA, 22 nt, Human
aggcagcaugggcccagagucc

SEQ ID NO: 186634 - RNA, 22 nt, Human
aacauucugguucuaaaaaccu

SEQ ID NO: 186635 - RNA, 22 nt, Human
agucacuaggcugaaaguggag

SEQ ID NO: 186636 - RNA, 22 nt, Human
ugaggccugacagaccaagccu

SEQ ID NO: 186637 - RNA, 22 nt, Human
ccaggaagccuuuuucuuugac

SEQ ID NO: 186638 - RNA, 18 nt, Human
uugagggaggggcagagu

SEQ ID NO: 186639 - RNA, 22 nt, Human
ggaacauuuuuuaaggcagaaa

SEQ ID NO: 186640 - RNA, 22 nt, Human
cuugaaugggccauaagacggu

SEQ ID NO: 186641 - RNA, 22 nt, Human
auuuucugaguccagaauuuac

SEQ ID NO: 186642 - RNA, 22 nt, Human
aggcagaagccagccagggucc

SEQ ID NO: 186643 - RNA, 22 nt, Human
agaacuguccuuggaggagagu

SEQ ID NO: 186644 - RNA, 22 nt, Human
ccuccaggaacuugagagacac

SEQ ID NO: 186645 - RNA, 22 nt, Human
aacaggcaaacugugggauccc

SEQ ID NO: 186646 - RNA, 22 nt, Human
auucuggggcugguuauuuuga

SEQ ID NO: 186647 - RNA, 22 nt, Human
agaaaagguugaaaguaggauu

SEQ ID NO: 186648 - RNA, 22 nt, Human
ccagugucuagucacagguacu

SEQ ID NO: 186649 - RNA, 22 nt, Human
cuggaagguaacaaggccauua

SEQ ID NO: 186650 - RNA, 22 nt, Human
agcuucucggcugggaguauuu

SEQ ID NO: 186651 - RNA, 22 nt, Human
ggacauuuaguuucauugggca

SEQ ID NO: 186652 - RNA, 21 nt, Human
ucugagaacuucugcugcagc

SEQ ID NO: 186653 - RNA, 22 nt, Human
uacuucuguucuuaaaccaaga

SEQ ID NO: 186654 - RNA, 22 nt, Human
aaaggcuugacuagaagggaga

SEQ ID NO: 186655 - RNA, 22 nt, Human
gugcagcugugugagagcucca

SEQ ID NO: 186656 - RNA, 22 nt, Human
gaaugaauuuuggauggugaag

SEQ ID NO: 186657 - RNA, 22 nt, Human
uccuggagugucuuccccaagg

SEQ ID NO: 186658 - RNA, 20 nt, Human
acgggcugggacccaugcac

SEQ ID NO: 186659 - RNA, 22 nt, Human
uucacaagugugaaggcagagc

SEQ ID NO: 186660 - RNA, 22 nt, Human
agguggcuucuggccaggugug

SEQ ID NO: 186661 - RNA, 22 nt, Human
cagguggaucucuaaggacuga

SEQ ID NO: 186662 - RNA, 22 nt, Human
aaugucugcucuacucaggagg

SEQ ID NO: 186663 - RNA, 22 nt, Human
aaacaucaccauuuuaccuaau

SEQ ID NO: 186664 - RNA, 22 nt, Human
cugacucccaaagaggacgcgu

SEQ ID NO: 186665 - RNA, 22 nt, Human
ucagacagcuugggauaacuga

SEQ ID NO: 186666 - RNA, 22 nt, Human
uucugggagauucauaugaaaa

SEQ ID NO: 186667 - RNA, 23 nt, Human
aagaauaaaugacauuaaaggug

SEQ ID NO: 186668 - RNA, 22 nt, Human
caggauggagaguuguugguug

SEQ ID NO: 186669 - RNA, 22 nt, Human
gggaucuugaaacagcuggauu

SEQ ID NO: 186670 - RNA, 21 nt, Human
uuucuucacuuugccccaugu

SEQ ID NO: 186671 - RNA, 23 nt, Human
auuuuacaggucaguuccuugaa

SEQ ID NO: 186672 - RNA, 22 nt, Human
cuggagaggcugggaacagguu

SEQ ID NO: 186673 - RNA, 22 nt, Human
ccaggccagcaggcacaccugc

SEQ ID NO: 186674 - RNA, 22 nt, Human
gaaaguuuauagguuauauaau

SEQ ID NO: 186675 - RNA, 22 nt, Human
cauuagaacuaagauguccagg

SEQ ID NO: 186676 - RNA, 22 nt, Human
ugguccuguagcucucuaaguu

SEQ ID NO: 186677 - RNA, 20 nt, Human
gaugagacccaugcaugaga

SEQ ID NO: 186678 - RNA, 22 nt, Human
auugcugaaaugaaaggauaug

SEQ ID NO: 186679 - RNA, 22 nt, Human
cugccucucagccugaccgcca

SEQ ID NO: 186680 - RNA, 23 nt, Human
auaucacacccaguacagucucc

SEQ ID NO: 186681 - RNA, 22 nt, Human
aacaugaaguuuucuauaguga

SEQ ID NO: 186682 - RNA, 22 nt, Human
uuguucaugguuguaaguuuga

SEQ ID NO: 186683 - RNA, 23 nt, Human
agcugaggcugugggugucagag

SEQ ID NO: 186684 - RNA, 22 nt, Human
augguuuauccuuuaccagucg

SEQ ID NO: 186685 - RNA, 22 nt, Human
ucuguucaguuguaccuucccc

SEQ ID NO: 186686 - RNA, 22 nt, Human
caggauaaauaguaaauguaag

SEQ ID NO: 186687 - RNA, 22 nt, Human
uuuaguauauaaaaagagaagu

SEQ ID NO: 186688 - RNA, 22 nt, Human
uggggggcaugaaccuccacgg

SEQ ID NO: 186689 - RNA, 22 nt, Human
ucucuuccauguuucagcccca

SEQ ID NO: 186690 - RNA, 22 nt, Human
aaugauuuggcaaaggaaucca

SEQ ID NO: 186691 - RNA, 22 nt, Human
gcucagggcuaaggcugagggg

SEQ ID NO: 186692 - RNA, 22 nt, Human
ggugcagugcaggguaauuaua

SEQ ID NO: 186693 - RNA, 22 nt, Human
gcugggagcaaagccaugcaua

SEQ ID NO: 186694 - RNA, 22 nt, Human
cugagcagugcuuugcaguggg

SEQ ID NO: 186695 - RNA, 22 nt, Human
agccuguggaucccugcacugg

SEQ ID NO: 186696 - RNA, 22 nt, Human
ucuuagaaaaaugguauguuuu

SEQ ID NO: 186697 - RNA, 23 nt, Human
aaauggguuucuguuuuguggac

SEQ ID NO: 186698 - RNA, 22 nt, Human
accccaggucaucugagagucc

SEQ ID NO: 186699 - RNA, 22 nt, Human
gggcagagacucagaaacagaa

SEQ ID NO: 186700 - RNA, 22 nt, Human
acagggauuuuccaggcuaccc

SEQ ID NO: 186701 - RNA, 22 nt, Human
uguuucaggaccuaucuuuuag

SEQ ID NO: 186702 - RNA, 22 nt, Human
ccuguucaaguugcagggcugg

SEQ ID NO: 186703 - RNA, 22 nt, Human
agugguauaagucugaagauca

SEQ ID NO: 186704 - RNA, 22 nt, Human
cuguuagucuuuugcaggagag

SEQ ID NO: 186705 - RNA, 22 nt, Human
gaguccaguaguuaggacagag

SEQ ID NO: 186706 - RNA, 22 nt, Human
caguggaauauauaggggauuu

SEQ ID NO: 186707 - RNA, 22 nt, Human
gggaagcagcauugugcuggcu

SEQ ID NO: 186708 - RNA, 22 nt, Human
ugauuuuacuuagcaugauguu

SEQ ID NO: 186709 - RNA, 19 nt, Human
accaggcuuauggucagug

SEQ ID NO: 186710 - RNA, 21 nt, Human
agagucugagugugcaagggc

SEQ ID NO: 186711 - RNA, 22 nt, Human
aacucuuuggucucaggaaagg

SEQ ID NO: 186712 - RNA, 22 nt, Human
aucuacagugcacaggacagcc

SEQ ID NO: 186713 - RNA, 22 nt, Human
ucugcacccacguaccuuggcu

SEQ ID NO: 186714 - RNA, 22 nt, Human
uuuggaaacugccucagcucuu

SEQ ID NO: 186715 - RNA, 22 nt, Human
caggccaguuuugauuuaagcc

SEQ ID NO: 186716 - RNA, 22 nt, Human
auugaaaauauaauucuaggag

SEQ ID NO: 186717 - RNA, 22 nt, Human
acauguguaaaaguggauaaaa

SEQ ID NO: 186718 - RNA, 22 nt, Human
ucuguuuuagauaagaaaggcu

SEQ ID NO: 186719 - RNA, 22 nt, Human
cggucaggugcagcguuggcac

SEQ ID NO: 186720 - RNA, 22 nt, Human
acuaaacacaugagauuccugc

SEQ ID NO: 186721 - RNA, 22 nt, Human
ccagcagggaaaaacccaccaa

SEQ ID NO: 186722 - RNA, 22 nt, Human
ugcauuaagggccuggagauac

SEQ ID NO: 186723 - RNA, 22 nt, Human
guggaauuuuuaccuaugaaug

SEQ ID NO: 186724 - RNA, 22 nt, Human
caucugucugcuguuagcugca

SEQ ID NO: 186725 - RNA, 22 nt, Human
uuagagaaguuuuacuuaagaa

SEQ ID NO: 186726 - RNA, 22 nt, Human
cuggugccuccucucccagguc

SEQ ID NO: 186727 - RNA, 23 nt, Human
gagggcucugagugcuugggcca

SEQ ID NO: 186728 - RNA, 22 nt, Human
agagaagagucuugucaaauua

SEQ ID NO: 186729 - RNA, 20 nt, Human
caaagcaguaggauaaaaau

SEQ ID NO: 186730 - RNA, 22 nt, Human
gaacaaacacaucccagcagug

SEQ ID NO: 186731 - RNA, 22 nt, Human
ugagaugucauaguucaguuca

SEQ ID NO: 186732 - RNA, 22 nt, Human
ccugcugugaaacuggcauaug

SEQ ID NO: 186733 - RNA, 22 nt, Human
uucuccagcucaucagggaggg

SEQ ID NO: 186734 - RNA, 22 nt, Human
gcugcccucuguguuuguccuu

SEQ ID NO: 186735 - RNA, 22 nt, Human
acaugccaagauccucgucuuu

SEQ ID NO: 186736 - RNA, 22 nt, Human
uggggucuggaguugcccauga

SEQ ID NO: 186737 - RNA, 22 nt, Human
ucaaugagccagaauguaguac

SEQ ID NO: 186738 - RNA, 15 nt, Human
ucccucagcuaaaga

SEQ ID NO: 186739 - RNA, 22 nt, Human
ugacaauugcagacacagaagu

SEQ ID NO: 186740 - RNA, 22 nt, Human
gaagaacaccugcugcccagug

SEQ ID NO: 186741 - RNA, 19 nt, Human
uucugggcagcacaugaau

SEQ ID NO: 186742 - RNA, 22 nt, Human
acacauuauagagaguauaaua

SEQ ID NO: 186743 - RNA, 22 nt, Human
ucucuggagggcuccaggcggg

SEQ ID NO: 186744 - RNA, 22 nt, Human
ucagguguuagaagaaauuuca

SEQ ID NO: 186745 - RNA, 19 nt, Human
uauauauuuugggguugug

SEQ ID NO: 186746 - RNA, 22 nt, Human
acacagagccagggaauacagu

SEQ ID NO: 186747 - RNA, 22 nt, Human
cauuuguucugauuucaaaagg

SEQ ID NO: 186748 - RNA, 22 nt, Human
uuggaugagguugagaaucauu

SEQ ID NO: 186749 - RNA, 19 nt, Human
uauucuguuaaccuuuguc

SEQ ID NO: 186750 - RNA, 22 nt, Human
aggcccagcugggccaggaaca

SEQ ID NO: 186751 - RNA, 22 nt, Human
agcuuccuugaauucuguagaa

SEQ ID NO: 186752 - RNA, 22 nt, Human
uugauacaugcucuagaguuga

SEQ ID NO: 186753 - RNA, 22 nt, Human
gcaucucuuacccacgagccag

SEQ ID NO: 186754 - RNA, 22 nt, Human
acacaucuauauugcaucugca

SEQ ID NO: 186755 - RNA, 22 nt, Human
ucagccugcuccaagugcugcc

SEQ ID NO: 186756 - RNA, 22 nt, Human
auuggaaauacaguagaaaaau

SEQ ID NO: 186757 - RNA, 22 nt, Human
aaugcaaacagcccagaaucca

SEQ ID NO: 186758 - RNA, 22 nt, Human
uuugaaaauuagacacaggcua

SEQ ID NO: 186759 - RNA, 22 nt, Human
aagacagaagugauuugaugug

SEQ ID NO: 186760 - RNA, 22 nt, Human
uacaagagguauauagaaacag

SEQ ID NO: 186761 - RNA, 20 nt, Human
uucuagaaugcccagggaca

SEQ ID NO: 186762 - RNA, 23 nt, Human
caggcaggaugaggacuacacuc

SEQ ID NO: 186763 - RNA, 22 nt, Human
ggcuccagauguccccuggcaa

SEQ ID NO: 186764 - RNA, 22 nt, Human
uaugcacacauuagcacagggu

SEQ ID NO: 186765 - RNA, 22 nt, Human
ucugugcaggaagucauuauga

SEQ ID NO: 186766 - RNA, 22 nt, Human
gcaggcaucucuguagccaggg

SEQ ID NO: 186767 - RNA, 22 nt, Human
aguggggacaaugagagcaggu

SEQ ID NO: 186768 - RNA, 22 nt, Human
ugaguauuccuuaucugaaaug

SEQ ID NO: 186769 - RNA, 22 nt, Human
ugacaggucauauaagcuugca

SEQ ID NO: 186770 - RNA, 22 nt, Human
ccaggagggaccgcggcauccc

SEQ ID NO: 186771 - RNA, 22 nt, Human
augaggaggccaguaagagccu

SEQ ID NO: 186772 - RNA, 22 nt, Human
auacauuagcucauaugauuaa

SEQ ID NO: 186773 - RNA, 22 nt, Human
gaaaguauuuaaguccauauuu

SEQ ID NO: 186774 - RNA, 22 nt, Human
agcuccugaaaauccagacugg

SEQ ID NO: 186775 - RNA, 22 nt, Human
agggccaguaccaggugggugg

SEQ ID NO: 186776 - RNA, 22 nt, Human
aauuuuacaagaaggccucgua

SEQ ID NO: 186777 - RNA, 22 nt, Human
auaugaagucagacaaacuggg

SEQ ID NO: 186778 - RNA, 22 nt, Human
gaugaggucuacauuguuaaaa

SEQ ID NO: 186779 - RNA, 22 nt, Human
agaaggccagauggacggggcu

SEQ ID NO: 186780 - RNA, 22 nt, Human
caaauguuucuugaacaccaac

SEQ ID NO: 186781 - RNA, 22 nt, Human
ccugagggaucuguggaauagc

SEQ ID NO: 186782 - RNA, 22 nt, Human
uuuaucagaaguuagagaaaga

SEQ ID NO: 186783 - RNA, 22 nt, Human
ggccuugcugcuuccagaaggu

SEQ ID NO: 186784 - RNA, 22 nt, Human
ucacagugaggaguuacaguuu

SEQ ID NO: 186785 - RNA, 22 nt, Human
accagcucagaagccagaaaga

SEQ ID NO: 186786 - RNA, 21 nt, Human
aaagaaaucucccauugguag

SEQ ID NO: 186787 - RNA, 22 nt, Human
gaaggccacuuuguguugagaa

SEQ ID NO: 186788 - RNA, 22 nt, Human
auuuauucuccagauggcgaga

SEQ ID NO: 186789 - RNA, 22 nt, Human
ccugggagcuguggaaaggcug

SEQ ID NO: 186790 - RNA, 22 nt, Human
uagggggcuguccugugcauua

SEQ ID NO: 186791 - RNA, 22 nt, Human
uagcuacaaucacuguccuuug

SEQ ID NO: 186792 - RNA, 21 nt, Human
uggcugacucuuccuaucauu

SEQ ID NO: 186793 - RNA, 22 nt, Human
cugcugcugagagcucagccug

SEQ ID NO: 186794 - RNA, 22 nt, Human
ucuuugaaguuccccuggaaga

SEQ ID NO: 186795 - RNA, 22 nt, Human
uuucuugucuuuaguaucuggc

SEQ ID NO: 186796 - RNA, 22 nt, Human
auucaccuguuaguaaaaaucu

SEQ ID NO: 186797 - RNA, 22 nt, Human
uugagggagauguugacuucag

SEQ ID NO: 186798 - RNA, 22 nt, Human
ugguccauguccuccaucucuc

SEQ ID NO: 186799 - RNA, 22 nt, Human
auguaaaagauuauuuuccugu

SEQ ID NO: 186800 - RNA, 22 nt, Human
uaucuaagagagucaauauuua

SEQ ID NO: 186801 - RNA, 22 nt, Human
cuuucucuucacugucaugauc

SEQ ID NO: 186802 - RNA, 22 nt, Human
ggcagcugcaaaucugcucugu

SEQ ID NO: 186803 - RNA, 22 nt, Human
ugaagucucuguuuucucauuu

SEQ ID NO: 186804 - RNA, 22 nt, Human
auacacgugccauguuggugug

SEQ ID NO: 186805 - RNA, 22 nt, Human
ucauacaucuguccuggagcuc

SEQ ID NO: 186806 - RNA, 22 nt, Human
augcauaucagugauuguuugc

SEQ ID NO: 186807 - RNA, 22 nt, Human
augagucacucagcagaaaagg

SEQ ID NO: 186808 - RNA, 22 nt, Human
cucugagaagaguucaaguaaa

SEQ ID NO: 186809 - RNA, 22 nt, Human
acuucauuguaauauuauagca

SEQ ID NO: 186810 - RNA, 22 nt, Human
uucacauuagccaagagaugga

SEQ ID NO: 186811 - RNA, 20 nt, Human
agggcagcuugaggagccgg

SEQ ID NO: 186812 - RNA, 22 nt, Human
ucaucuguggcugcuuuugugc

SEQ ID NO: 186813 - RNA, 22 nt, Human
aggaggugagcggucauguggu

SEQ ID NO: 186814 - RNA, 22 nt, Human
caauuauucagugacuuaagag

SEQ ID NO: 186815 - RNA, 22 nt, Human
cagagggcuucagguucaggau

SEQ ID NO: 186816 - RNA, 22 nt, Human
gggagggaggugaugcuuggcu

SEQ ID NO: 186817 - RNA, 22 nt, Human
gcaggaagcauagaagaaugcc

SEQ ID NO: 186818 - RNA, 22 nt, Human
auccacaggucauguaaugugg

SEQ ID NO: 186819 - RNA, 22 nt, Human
gcugccacauuuucaggacuaa

SEQ ID NO: 186820 - RNA, 22 nt, Human
cacauacaugcacaccuaaaua

SEQ ID NO: 186821 - RNA, 22 nt, Human
ugaccugcguaggugguuucug

SEQ ID NO: 186822 - RNA, 22 nt, Human
uccuggguaaacacugaccuuu

SEQ ID NO: 186823 - RNA, 22 nt, Human
acauuuuuauucaucaaagcag

SEQ ID NO: 186824 - RNA, 22 nt, Human
cagcuguuguguaucaggcaga

SEQ ID NO: 186825 - RNA, 22 nt, Human
acaucuaagccaauuuugauuu

SEQ ID NO: 186826 - RNA, 22 nt, Human
uucugugugucucagcaagcug

SEQ ID NO: 186827 - RNA, 22 nt, Human
aggagccaaauuacuagcucug

SEQ ID NO: 186828 - RNA, 22 nt, Human
agucaggguuguaggcucaccc

SEQ ID NO: 186829 - RNA, 22 nt, Human
aaugguuuaacauaugcuugag

SEQ ID NO: 186830 - RNA, 22 nt, Human
ccagcuuuucuuaucauuauaa

SEQ ID NO: 186831 - RNA, 22 nt, Human
ggcucugggccuccaaggucug

SEQ ID NO: 186832 - RNA, 22 nt, Human
guggagcaaucagagggucagu

SEQ ID NO: 186833 - RNA, 22 nt, Human
uuagcuguggaagcuucagcca

SEQ ID NO: 186834 - RNA, 22 nt, Human
uuuuagaaagaucccuggcagg

SEQ ID NO: 186835 - RNA, 22 nt, Human
agaugcugggaggcugagugca

SEQ ID NO: 186836 - RNA, 22 nt, Human
augggacacacaaggaaguaaa

SEQ ID NO: 186837 - RNA, 22 nt, Human
ccaggcugcagucaaggggcau

SEQ ID NO: 186838 - RNA, 22 nt, Human
uagaacuugugaaauaucaaug

SEQ ID NO: 186839 - RNA, 22 nt, Human
uagaggcagaagaaauugacaa

SEQ ID NO: 186840 - RNA, 22 nt, Human
cuucaugcucccauuuccuaca

SEQ ID NO: 186841 - RNA, 22 nt, Human
uuaccaaaucccgugcacauuc

SEQ ID NO: 186842 - RNA, 22 nt, Human
gucaaaugcacagaaccauuaa

SEQ ID NO: 186843 - RNA, 22 nt, Human
ugucccaacccugagaagauuc

SEQ ID NO: 186844 - RNA, 22 nt, Human
cugucuccuccacugcauggga

SEQ ID NO: 186845 - RNA, 22 nt, Human
uuucaguuuuugcucgauguau

SEQ ID NO: 186846 - RNA, 22 nt, Human
uacacaugcucagauuccugug

SEQ ID NO: 186847 - RNA, 22 nt, Human
ugagcuuuguuguuaguauauu

SEQ ID NO: 186848 - RNA, 20 nt, Human
ccucaguguccuggacuggg

SEQ ID NO: 186849 - RNA, 22 nt, Human
ucgccucaucauccuaauuaca

SEQ ID NO: 186850 - RNA, 22 nt, Human
gcucccagguucuugggccuug

SEQ ID NO: 186851 - RNA, 22 nt, Human
ccugggagugugccaucucugu

SEQ ID NO: 186852 - RNA, 22 nt, Human
guccuguguaagccaggacaau

SEQ ID NO: 186853 - RNA, 22 nt, Human
uagcuacauacuuggccauucu

SEQ ID NO: 186854 - RNA, 21 nt, Human
agcaggucuacagguucauag

SEQ ID NO: 186855 - RNA, 22 nt, Human
cucacugugccuuuucccaaac

SEQ ID NO: 186856 - RNA, 22 nt, Human
ucagcuggugaguggauagaca

SEQ ID NO: 186857 - RNA, 22 nt, Human
uuaaagcauguugcuuaacagg

SEQ ID NO: 186858 - RNA, 22 nt, Human
uuucucauuuagaguggcaggg

SEQ ID NO: 186859 - RNA, 22 nt, Human
cuggccuggucuggccucucca

SEQ ID NO: 186860 - RNA, 22 nt, Human
cugcccugggccaggaagcggc

SEQ ID NO: 186861 - RNA, 22 nt, Human
cauuugauuccuuuacucuuau

SEQ ID NO: 186862 - RNA, 22 nt, Human
ucccagggauuaggacauggau

SEQ ID NO: 186863 - RNA, 22 nt, Human
uuacaugcuuagagaugcaugc

SEQ ID NO: 186864 - RNA, 21 nt, Human
gcugggucagcagguccucug

SEQ ID NO: 186865 - RNA, 21 nt, Human
uauuaauaugucuaagcugau

SEQ ID NO: 186866 - RNA, 20 nt, Human
ucauggcagccacccacagg

SEQ ID NO: 186867 - RNA, 22 nt, Human
aggaaacuccccuacaucucaa

SEQ ID NO: 186868 - RNA, 22 nt, Human
uuucucaaguacugcacaugaa

SEQ ID NO: 186869 - RNA, 19 nt, Human
gcugggcuuggguuuguag

SEQ ID NO: 186870 - RNA, 22 nt, Human
accuccccacaugguagugagu

SEQ ID NO: 186871 - RNA, 22 nt, Human
cuuuacuaucaggaauaaacaa

SEQ ID NO: 186872 - RNA, 22 nt, Human
gcucagggcgcgagggacgugg

SEQ ID NO: 186873 - RNA, 22 nt, Human
uagggaugaugucuaaaaucau

SEQ ID NO: 186874 - RNA, 22 nt, Human
cagacagggcccugugauggua

SEQ ID NO: 186875 - RNA, 22 nt, Human
gacuauugcacacuucucucac

SEQ ID NO: 186876 - RNA, 22 nt, Human
caggugcugugaaucuucauaa

SEQ ID NO: 186877 - RNA, 22 nt, Human
cucauuuacuacucaugugacc

SEQ ID NO: 186878 - RNA, 22 nt, Human
uuaaauggggaugaguagaugg

SEQ ID NO: 186879 - RNA, 22 nt, Human
uuaguuaauugacuauguugca

SEQ ID NO: 186880 - RNA, 22 nt, Human
uccagccaugacucggacagug

SEQ ID NO: 186881 - RNA, 22 nt, Human
ggagucuggaguggggcccaag

SEQ ID NO: 186882 - RNA, 22 nt, Human
ucccugcuuggaaugacccuua

SEQ ID NO: 186883 - RNA, 22 nt, Human
ggcaggguccacaccugggaaa

SEQ ID NO: 186884 - RNA, 22 nt, Human
agaauacaguucaguaauggau

SEQ ID NO: 186885 - RNA, 17 nt, Human
agguggcugcugcgccu

SEQ ID NO: 186886 - RNA, 22 nt, Human
aaacaugagcaucucuucaagc

SEQ ID NO: 186887 - RNA, 22 nt, Human
acagugcacauccugagugauu

SEQ ID NO: 186888 - RNA, 22 nt, Human
agcccugagccagccuggucag

SEQ ID NO: 186889 - RNA, 22 nt, Human
agauccugccaauggaagcagg

SEQ ID NO: 186890 - RNA, 22 nt, Human
ggcuuccuccuuccugcuguca

SEQ ID NO: 186891 - RNA, 22 nt, Human
cagcugaggucuuuuuuaugug

SEQ ID NO: 186892 - RNA, 22 nt, Human
aaggaugaacauuaauacauca

SEQ ID NO: 186893 - RNA, 22 nt, Human
uuacacuuaccuguccauugaa

SEQ ID NO: 186894 - RNA, 22 nt, Human
gcucuguguaaauguagggucc

SEQ ID NO: 186895 - RNA, 20 nt, Human
ccuuuagaaacucauaugua

SEQ ID NO: 186896 - RNA, 22 nt, Human
gauuuacaaagcucucuagugu

SEQ ID NO: 186897 - RNA, 22 nt, Human
cugccagguuggcgcucgcucu

SEQ ID NO: 186898 - RNA, 22 nt, Human
cauguaaaaaauuaggucaucu

SEQ ID NO: 186899 - RNA, 22 nt, Human
ccagggcauguccaagacuuag

SEQ ID NO: 186900 - RNA, 20 nt, Human
uucacauuucuguagugauu

SEQ ID NO: 186901 - RNA, 22 nt, Human
uaggccaguugguggcccugga

SEQ ID NO: 186902 - RNA, 21 nt, Human
gccuggcuagaagcuccuagc

SEQ ID NO: 186903 - RNA, 22 nt, Human
gcuguauucaacagugaaaaga

SEQ ID NO: 186904 - RNA, 22 nt, Human
caaaaccaagaacauucauuuc

SEQ ID NO: 186905 - RNA, 22 nt, Human
uuucuuuccaugagccuaugua

SEQ ID NO: 186906 - RNA, 22 nt, Human
uccaggccgcauaguuacucug

SEQ ID NO: 186907 - RNA, 22 nt, Human
gcacagggcccugugcguaggu

SEQ ID NO: 186908 - RNA, 20 nt, Human
uacagaaacaggacuuuugg

SEQ ID NO: 186909 - RNA, 22 nt, Human
uauuaucauuaacuguugaauu

SEQ ID NO: 186910 - RNA, 21 nt, Human
gcuuuuuguauggcccaggaa

SEQ ID NO: 186911 - RNA, 20 nt, Human
gggaucuuccaggcucuccu

SEQ ID NO: 186912 - RNA, 19 nt, Human
ucuccaaaaccaaucacua

SEQ ID NO: 186913 - RNA, 22 nt, Human
cuuggaauugaugauuuucaua

SEQ ID NO: 186914 - RNA, 22 nt, Human
gugcaauccucauagaacucau

SEQ ID NO: 186915 - RNA, 22 nt, Human
ccacuggagacuggucucugug

SEQ ID NO: 186916 - RNA, 22 nt, Human
uggugggggaggcugucuagca

SEQ ID NO: 186917 - RNA, 22 nt, Human
ggagcugaaggggugggcucag

SEQ ID NO: 186918 - RNA, 21 nt, Human
auuuucauuuccaggggagga

SEQ ID NO: 186919 - RNA, 22 nt, Human
ucagagaagcugccaggcgagc

SEQ ID NO: 186920 - RNA, 22 nt, Human
acagcuggagugaggauggagu

SEQ ID NO: 186921 - RNA, 22 nt, Human
uagaaugagaaaguguagcagg

SEQ ID NO: 186922 - RNA, 21 nt, Human
aggguccuacagggcucagga

SEQ ID NO: 186923 - RNA, 20 nt, Human
ugagccaggcuaggaagggc

SEQ ID NO: 186924 - RNA, 22 nt, Human
gaccccagaggaaggggcgccg

SEQ ID NO: 186925 - RNA, 22 nt, Human
acaaauuucauaggcaaauuuu

SEQ ID NO: 186926 - RNA, 22 nt, Human
cccgggaggaggaaguugcagu

SEQ ID NO: 186927 - RNA, 22 nt, Human
cucuuuuagagaugaaaauugg

SEQ ID NO: 186928 - RNA, 22 nt, Human
cagcaugauuggugucugguga

SEQ ID NO: 186929 - RNA, 20 nt, Human
ucaguuaaguugcugaaucu

SEQ ID NO: 186930 - RNA, 22 nt, Human
uuucagaaaucaaaaccagggu

SEQ ID NO: 186931 - RNA, 22 nt, Human
gcaguuccuacaguggaaagcg

SEQ ID NO: 186932 - RNA, 22 nt, Human
ccaggacaggaguuggcuucgc

SEQ ID NO: 186933 - RNA, 22 nt, Human
cauucauuagaauagauaugua

SEQ ID NO: 186934 - RNA, 22 nt, Human
uacacaguaaaugguaaauaca

SEQ ID NO: 186935 - RNA, 22 nt, Human
ucuagguggaugaggaacauag

SEQ ID NO: 186936 - RNA, 22 nt, Human
aauuuuacuucccucaguguag

SEQ ID NO: 186937 - RNA, 22 nt, Human
cugcugucaaaaaucacuccau

SEQ ID NO: 186938 - RNA, 17 nt, Human
uucucugagcuguauug

SEQ ID NO: 186939 - RNA, 22 nt, Human
cuagaaucuccaaguuuacuca

SEQ ID NO: 186940 - RNA, 22 nt, Human
ugaggccagccacagccacccu

SEQ ID NO: 186941 - RNA, 20 nt, Human
ggggaagaaaaggaugugau

SEQ ID NO: 186942 - RNA, 22 nt, Human
ccaaggcagaagauggcucuug

SEQ ID NO: 186943 - RNA, 22 nt, Human
aauuauauugaaguugaauguc

SEQ ID NO: 186944 - RNA, 22 nt, Human
auuuccuucggacaguuugggu

SEQ ID NO: 186945 - RNA, 22 nt, Human
cacuguuuuauuccaacauagg

SEQ ID NO: 186946 - RNA, 22 nt, Human
aacuggaaagaucaguaggaag

SEQ ID NO: 186947 - RNA, 22 nt, Human
gugggggcaggcagugcuagga

SEQ ID NO: 186948 - RNA, 23 nt, Human
uccugcagauaagcugguugaca

SEQ ID NO: 186949 - RNA, 22 nt, Human
agucucucuugggugugguuug

SEQ ID NO: 186950 - RNA, 22 nt, Human
ucaucaguuuagaaaaaauaug

SEQ ID NO: 186951 - RNA, 22 nt, Human
ugagcuacacacuaggcauggg

SEQ ID NO: 186952 - RNA, 22 nt, Human
uucaaguuuacuuugaaguuua

SEQ ID NO: 186953 - RNA, 22 nt, Human
agaggccaauaguagguggcau

SEQ ID NO: 186954 - RNA, 22 nt, Human
acuuucaaauaucaugauucua

SEQ ID NO: 186955 - RNA, 22 nt, Human
aacagcuaguaccaauccacua

SEQ ID NO: 186956 - RNA, 22 nt, Human
uuccuggcaaagugagcaucac

SEQ ID NO: 186957 - RNA, 22 nt, Human
uccuuggcaagcugcaauggga

SEQ ID NO: 186958 - RNA, 22 nt, Human
gggugggaucuguggagccuca

SEQ ID NO: 186959 - RNA, 21 nt, Human
aaggaaaagcuuggucucuga

SEQ ID NO: 186960 - RNA, 22 nt, Human
cccagggaagggcuaccugagg

SEQ ID NO: 186961 - RNA, 22 nt, Human
ccaggccagggcugcagcgagc

SEQ ID NO: 186962 - RNA, 22 nt, Human
gucaucuucgcagagugauuuu

SEQ ID NO: 186963 - RNA, 22 nt, Human
auuugggaauuauuugccuaau

SEQ ID NO: 186964 - RNA, 19 nt, Human
gaggagcuaucggagacag

SEQ ID NO: 186965 - RNA, 22 nt, Human
aggcacuuaauaaggauucaau

SEQ ID NO: 186966 - RNA, 17 nt, Human
ggcaccagacggagagu

SEQ ID NO: 186967 - RNA, 22 nt, Human
gcacaguggugaaagcaugggu

SEQ ID NO: 186968 - RNA, 22 nt, Human
uaggugugggcucaggaaugug

SEQ ID NO: 186969 - RNA, 22 nt, Human
gaaggcuggaaggcaaguagga

SEQ ID NO: 186970 - RNA, 22 nt, Human
uuaggaaagucucuuggcuggg

SEQ ID NO: 186971 - RNA, 22 nt, Human
cuuccugcuccccugccaauuc

SEQ ID NO: 186972 - RNA, 22 nt, Human
caugcauauaugcuacaugcaa

SEQ ID NO: 186973 - RNA, 17 nt, Human
ucugggcuucagugguc

SEQ ID NO: 186974 - RNA, 20 nt, Human
ucagaugggagugagccauc

SEQ ID NO: 186975 - RNA, 22 nt, Human
ugcugugcuggcggcagaggcc

SEQ ID NO: 186976 - RNA, 22 nt, Human
ucagugucuucucuuuccuacc

SEQ ID NO: 186977 - RNA, 22 nt, Human
ugucuuuauauauuuggaaaau

SEQ ID NO: 186978 - RNA, 22 nt, Human
caaaacauucagagagcucacu

SEQ ID NO: 186979 - RNA, 22 nt, Human
cagagggacaguguaaugcaua

SEQ ID NO: 186980 - RNA, 22 nt, Human
gacuuuauuuuaacggagauuc

SEQ ID NO: 186981 - RNA, 21 nt, Human
agguggucugcagcagcugaa

SEQ ID NO: 186982 - RNA, 22 nt, Human
gcagagugauggaaugugggug

SEQ ID NO: 186983 - RNA, 22 nt, Human
acugccuguuuggcauggcccc

SEQ ID NO: 186984 - RNA, 22 nt, Human
gcuacccugggaaucucccuca

SEQ ID NO: 186985 - RNA, 23 nt, Human
ccugugacacuguuugugguaag

SEQ ID NO: 186986 - RNA, 22 nt, Human
acaugauauuaaugucuuauuu

SEQ ID NO: 186987 - RNA, 22 nt, Human
gaaaugauuuuaguuuaucaug

SEQ ID NO: 186988 - RNA, 22 nt, Human
cugcuguuugccgucauugccu

SEQ ID NO: 186989 - RNA, 22 nt, Human
guucuggguagauguaucuuuu

SEQ ID NO: 186990 - RNA, 22 nt, Human
uuuuccagagcugucucuugca

SEQ ID NO: 186991 - RNA, 18 nt, Human
uacaugcauaaaugaagc

SEQ ID NO: 186992 - RNA, 22 nt, Human
agaaaggcaauauuaacuacac

SEQ ID NO: 186993 - RNA, 22 nt, Human
aagucacuggcaaaagcugcag

SEQ ID NO: 186994 - RNA, 22 nt, Human
aaagaucugacuuagacacaga

SEQ ID NO: 186995 - RNA, 22 nt, Human
gacauuuagaaguuagauucaa

SEQ ID NO: 186996 - RNA, 21 nt, Human
agaacugauuaaauaagcagu

SEQ ID NO: 186997 - RNA, 22 nt, Human
cugggguggauggguccaaguu

SEQ ID NO: 186998 - RNA, 22 nt, Human
auuuggaagguuuacaaagaga

SEQ ID NO: 186999 - RNA, 22 nt, Human
aaauucagcagugaaaugcccc

SEQ ID NO: 187000 - RNA, 22 nt, Human
cagagacaggcuugcccuccac

SEQ ID NO: 187001 - RNA, 19 nt, Human
caacaguacugguuugucc

SEQ ID NO: 187002 - RNA, 22 nt, Human
uggaaugucauaccauaaaaga

SEQ ID NO: 187003 - RNA, 20 nt, Human
accaggccccgggcccugca

SEQ ID NO: 187004 - RNA, 19 nt, Human
cacaacuucgcuugauucc

SEQ ID NO: 187005 - RNA, 22 nt, Human
cuuuacagaaagagaacucugg

SEQ ID NO: 187006 - RNA, 20 nt, Human
uuguuuauuauguucugauc

SEQ ID NO: 187007 - RNA, 22 nt, Human
ggaaucuuaauggcauggaguu

SEQ ID NO: 187008 - RNA, 22 nt, Human
cagaagcauugacuccuugcuc

SEQ ID NO: 187009 - RNA, 22 nt, Human
cccaucccugauuuucacucgu

SEQ ID NO: 187010 - RNA, 22 nt, Human
aaacacacagaaaugaaugagg

SEQ ID NO: 187011 - RNA, 22 nt, Human
aguuuccuuggauucaauuugg

SEQ ID NO: 187012 - RNA, 22 nt, Human
uaugcacauucacacaaaaaug

SEQ ID NO: 187013 - RNA, 22 nt, Human
acaggcagagaguggcggacuc

SEQ ID NO: 187014 - RNA, 22 nt, Human
augugaggaagaaagagguaag

SEQ ID NO: 187015 - RNA, 22 nt, Human
cuccaggugcagaaggacucag

SEQ ID NO: 187016 - RNA, 22 nt, Human
uggaaagguguaaagcagaacc

SEQ ID NO: 187017 - RNA, 22 nt, Human
agucccagcuacucaagaggcu

SEQ ID NO: 187018 - RNA, 22 nt, Human
uaauucaugggcccagugauau

SEQ ID NO: 187019 - RNA, 22 nt, Human
aaagacacacagugcuucaguu

SEQ ID NO: 187020 - RNA, 22 nt, Human
ugggcagggagcuggaaccaca

SEQ ID NO: 187021 - RNA, 22 nt, Human
aggacagagggaccagagccca

SEQ ID NO: 187022 - RNA, 19 nt, Human
guccugcaacuggcucucc

SEQ ID NO: 187023 - RNA, 22 nt, Human
cccaguauugagcuacaggccu

SEQ ID NO: 187024 - RNA, 22 nt, Human
cagucuaagacucacgccaaga

SEQ ID NO: 187025 - RNA, 22 nt, Human
cauguguuucgagacuguugag

SEQ ID NO: 187026 - RNA, 22 nt, Human
cugcagggaugugaggcccguu

SEQ ID NO: 187027 - RNA, 22 nt, Human
ucucacaggugcacguggcugu

SEQ ID NO: 187028 - RNA, 22 nt, Human
uugcacuaggaaaaggcagcca

SEQ ID NO: 187029 - RNA, 22 nt, Human
uggcaaaggcgcucacaugccu

SEQ ID NO: 187030 - RNA, 22 nt, Human
cacacgaugugaauucuugccc

SEQ ID NO: 187031 - RNA, 23 nt, Human
augaaaugcuggcucagggaggu

SEQ ID NO: 187032 - RNA, 22 nt, Human
aucucagggguuccuucuagag

SEQ ID NO: 187033 - RNA, 22 nt, Human
uuucuccacuucucuugccaac

SEQ ID NO: 187034 - RNA, 22 nt, Human
guaaacauuuucaucugugccc

SEQ ID NO: 187035 - RNA, 22 nt, Human
ccugggccuauccuagaaccaa

SEQ ID NO: 187036 - RNA, 22 nt, Human
ggaagacagaagccuacagcuu

SEQ ID NO: 187037 - RNA, 22 nt, Human
agucuacauuuuuguuaauggu

SEQ ID NO: 187038 - RNA, 22 nt, Human
aggagcucauugaaguggauga

SEQ ID NO: 187039 - RNA, 20 nt, Human
ugcccacaucacucaggagu

SEQ ID NO: 187040 - RNA, 22 nt, Human
gaacuugggagaagggagugug

SEQ ID NO: 187041 - RNA, 22 nt, Human
gccuggguuccaugaucuccag

SEQ ID NO: 187042 - RNA, 22 nt, Human
gagcugggaguuauagcauguu

SEQ ID NO: 187043 - RNA, 22 nt, Human
ugaccugcagucaagaggggaa

SEQ ID NO: 187044 - RNA, 22 nt, Human
ucacucaauaucccaguggggc

SEQ ID NO: 187045 - RNA, 22 nt, Human
cauuucuagggaucauaaagua

SEQ ID NO: 187046 - RNA, 22 nt, Human
gcuaaugaaaaauagauuauag

SEQ ID NO: 187047 - RNA, 22 nt, Human
uguguccucauguggcagagag

SEQ ID NO: 187048 - RNA, 22 nt, Human
ugucuccaggggcaggccagcc

SEQ ID NO: 187049 - RNA, 22 nt, Human
ugaaugauauauugggaauaau

SEQ ID NO: 187050 - RNA, 19 nt, Human
acagggcucuggacgccau

SEQ ID NO: 187051 - RNA, 22 nt, Human
cuucuaauucuuauguaagcuu

SEQ ID NO: 187052 - RNA, 22 nt, Human
cagcccacuucccagcaccuac

SEQ ID NO: 187053 - RNA, 22 nt, Human
guauucagggcuagucagagga

SEQ ID NO: 187054 - RNA, 22 nt, Human
auaaugagcuuuugaauacuga

SEQ ID NO: 187055 - RNA, 22 nt, Human
auuuccuucccagauuugguuc

SEQ ID NO: 187056 - RNA, 22 nt, Human
gggaugaggaucaaucagggag

SEQ ID NO: 187057 - RNA, 22 nt, Human
gauuucuugauaauucaaaucc

SEQ ID NO: 187058 - RNA, 22 nt, Human
guucacuggcugugugacucug

SEQ ID NO: 187059 - RNA, 22 nt, Human
cugguuuauucgucacaccgga

SEQ ID NO: 187060 - RNA, 22 nt, Human
agcagcagggcaugucuuacuc

SEQ ID NO: 187061 - RNA, 22 nt, Human
gcucugggugaacuuggagcaa

SEQ ID NO: 187062 - RNA, 22 nt, Human
ugaaaaacacuaauuggaaagc

SEQ ID NO: 187063 - RNA, 19 nt, Human
auucuuguuaagugucauc

SEQ ID NO: 187064 - RNA, 22 nt, Human
aacuuuuaaaauacacagacaa

SEQ ID NO: 187065 - RNA, 22 nt, Human
ugccaggaguguagagugguuu

SEQ ID NO: 187066 - RNA, 22 nt, Human
cacaugcaggagccaauguaca

SEQ ID NO: 187067 - RNA, 22 nt, Human
ugcuccagugagcuggccaucc

SEQ ID NO: 187068 - RNA, 22 nt, Human
cucugaagggagggccaagccc

SEQ ID NO: 187069 - RNA, 22 nt, Human
gaacucuugcagugaaagcuua

SEQ ID NO: 187070 - RNA, 22 nt, Human
cucagcaguaaacguccggaac

SEQ ID NO: 187071 - RNA, 22 nt, Human
aaugaguuagaugagaaaauaa

SEQ ID NO: 187072 - RNA, 22 nt, Human
aaauuagaaauacuuucaaagc

SEQ ID NO: 187073 - RNA, 22 nt, Human
gcaccaugauggagccucauua

SEQ ID NO: 187074 - RNA, 22 nt, Human
aguggaugguauugggaccagg

SEQ ID NO: 187075 - RNA, 22 nt, Human
ucacucuguggcccaggcagug

SEQ ID NO: 187076 - RNA, 22 nt, Human
uacaguuuaacacuuuggagaa

SEQ ID NO: 187077 - RNA, 22 nt, Human
agcuaggauaagcagagacugg

SEQ ID NO: 187078 - RNA, 22 nt, Human
ugugaaaugcuauugugacaaa

SEQ ID NO: 187079 - RNA, 23 nt, Human
uugaauaggguggcaacaaacug

SEQ ID NO: 187080 - RNA, 22 nt, Human
ugaagggguucagcaugggggu

SEQ ID NO: 187081 - RNA, 22 nt, Human
uccaucaccacagaggacagag

SEQ ID NO: 187082 - RNA, 22 nt, Human
uucaaaguuucaaucuguauca

SEQ ID NO: 187083 - RNA, 22 nt, Human
ugaaggcauuugaguuggugag

SEQ ID NO: 187084 - RNA, 20 nt, Human
aguuuauuccaggagaacug

SEQ ID NO: 187085 - RNA, 22 nt, Human
aguguggggucaccggcccagg

SEQ ID NO: 187086 - RNA, 22 nt, Human
uuguuaaaaugaggucauucug

SEQ ID NO: 187087 - RNA, 22 nt, Human
cugcuguacuuaggaagaggaa

SEQ ID NO: 187088 - RNA, 22 nt, Human
agaggaggcucugggaucgucc

SEQ ID NO: 187089 - RNA, 19 nt, Human
gauaggcagccaugagccc

SEQ ID NO: 187090 - RNA, 22 nt, Human
agcaccaggcaccaaagggccu

SEQ ID NO: 187091 - RNA, 19 nt, Human
ccuacaugaguaagcuugg

SEQ ID NO: 187092 - RNA, 22 nt, Human
ggcacagcacagagcacaugua

SEQ ID NO: 187093 - RNA, 22 nt, Human
agcccuaacucccaguaucuug

SEQ ID NO: 187094 - RNA, 22 nt, Human
agggcuagaguugagaugggga

SEQ ID NO: 187095 - RNA, 22 nt, Human
agcuggaacccgggugggcagc

SEQ ID NO: 187096 - RNA, 22 nt, Human
ugcugccacauuuaaagagggg

SEQ ID NO: 187097 - RNA, 22 nt, Human
cugcccugaccugccucagagu

SEQ ID NO: 187098 - RNA, 19 nt, Human
gaggcaaggaguuuaagcc

SEQ ID NO: 187099 - RNA, 22 nt, Human
acucccagguugccuggcaggc

SEQ ID NO: 187100 - RNA, 22 nt, Human
cucauaaagugagaauaugacc

SEQ ID NO: 187101 - RNA, 22 nt, Human
aguuuuucuccccuggcuucau

SEQ ID NO: 187102 - RNA, 22 nt, Human
caggcacaagaucggcuagaua

SEQ ID NO: 187103 - RNA, 22 nt, Human
aaauguguuccuuugcuacaga

SEQ ID NO: 187104 - RNA, 22 nt, Human
cacuagagaaacgcccaggcuc

SEQ ID NO: 187105 - RNA, 22 nt, Human
cucagccccaauuugcccucuu

SEQ ID NO: 187106 - RNA, 22 nt, Human
uccauuuagcuggcaaacaaug

SEQ ID NO: 187107 - RNA, 22 nt, Human
gggugggguguaucggauccua

SEQ ID NO: 187108 - RNA, 22 nt, Human
uaaagugcuuaugauaaccaag

SEQ ID NO: 187109 - RNA, 22 nt, Human
acaggugguaaaauggacuguc

SEQ ID NO: 187110 - RNA, 21 nt, Human
gagaacugaaccagagcagcu

SEQ ID NO: 187111 - RNA, 22 nt, Human
cucugggcaccaaagagcagcu

SEQ ID NO: 187112 - RNA, 22 nt, Human
uauuucaacguaugaaaagcug

SEQ ID NO: 187113 - RNA, 23 nt, Human
ugcuucucugcuugacaguucug

SEQ ID NO: 187114 - RNA, 18 nt, Human
ucccuucucccuugccuc

SEQ ID NO: 187115 - RNA, 22 nt, Human
uugcagggauaaaacaagugaa

SEQ ID NO: 187116 - RNA, 22 nt, Human
uuacagagcuggguggagagag

SEQ ID NO: 187117 - RNA, 22 nt, Human
aacaugcagguuuuaggguugc

SEQ ID NO: 187118 - RNA, 22 nt, Human
ucugcccuggggucagccucca

SEQ ID NO: 187119 - RNA, 22 nt, Human
aauacuauguagccaaaauaau

SEQ ID NO: 187120 - RNA, 22 nt, Human
cuagagaauggcaaagauuaga

SEQ ID NO: 187121 - RNA, 22 nt, Human
cuggcagacuuaccaucagaca

SEQ ID NO: 187122 - RNA, 22 nt, Human
ccugguuucaggaacauaaucu

SEQ ID NO: 187123 - RNA, 22 nt, Human
uggcugccagcuccucgccuug

SEQ ID NO: 187124 - RNA, 22 nt, Human
ucacaggagcccaggggagcug

SEQ ID NO: 187125 - RNA, 22 nt, Human
ccaggcaguggaagcuaaaauu

SEQ ID NO: 187126 - RNA, 22 nt, Human
uaacuguacaacugguuaguca

SEQ ID NO: 187127 - RNA, 22 nt, Human
cagcuagcuaagaaggccagag

SEQ ID NO: 187128 - RNA, 22 nt, Human
aggagguguagauuuccuguca

SEQ ID NO: 187129 - RNA, 22 nt, Human
acauuuaacccucagguuucug

SEQ ID NO: 187130 - RNA, 22 nt, Human
uccaggcuggagugcaguggcg

SEQ ID NO: 187131 - RNA, 22 nt, Human
guuuucaugucuauugggcaua

SEQ ID NO: 187132 - RNA, 22 nt, Human
ccuggcucccuggaccucauua

SEQ ID NO: 187133 - RNA, 22 nt, Human
cauauuucagucuaagaugugu

SEQ ID NO: 187134 - RNA, 22 nt, Human
gcuccuggugcaaaguuucuuc

SEQ ID NO: 187135 - RNA, 22 nt, Human
uucaacaaaauauauuuuucca

SEQ ID NO: 187136 - RNA, 18 nt, Human
gguccugggccuggcuca

SEQ ID NO: 187137 - RNA, 22 nt, Human
uuagacaaucuguugguaaggu

SEQ ID NO: 187138 - RNA, 22 nt, Human
ucucuagggaucuguuuuaauu

SEQ ID NO: 187139 - RNA, 22 nt, Human
ugcacaguuggcuacaucgugg

SEQ ID NO: 187140 - RNA, 22 nt, Human
gggcuaggcuuggccagcacug

SEQ ID NO: 187141 - RNA, 22 nt, Human
cccugcagaucagugagaacuu

SEQ ID NO: 187142 - RNA, 22 nt, Human
cuuggcaguuucggaaggauga

SEQ ID NO: 187143 - RNA, 22 nt, Human
gagauuuauugacuuaacagua

SEQ ID NO: 187144 - RNA, 22 nt, Human
agccccaguaagggagggccug

SEQ ID NO: 187145 - RNA, 22 nt, Human
aggagacccagaauguugcugu

SEQ ID NO: 187146 - RNA, 22 nt, Human
uugagaauaaauuagcagacau

SEQ ID NO: 187147 - RNA, 22 nt, Human
guggcugcuacagagcuggagg

SEQ ID NO: 187148 - RNA, 22 nt, Human
ggagcugagguaacagugagug

SEQ ID NO: 187149 - RNA, 22 nt, Human
acagagcugggaucugaaccca

SEQ ID NO: 187150 - RNA, 22 nt, Human
ugcuuuaacauaagauaucuuu

SEQ ID NO: 187151 - RNA, 22 nt, Human
ggucccaagugcuuuuccugca

SEQ ID NO: 187152 - RNA, 22 nt, Human
ucuccuggcauuugguugagua

SEQ ID NO: 187153 - RNA, 22 nt, Human
aaauagauugcugaggcauuac

SEQ ID NO: 187154 - RNA, 22 nt, Human
gagaggcugguaaagucugaac

SEQ ID NO: 187155 - RNA, 22 nt, Human
gcacaguauugcacaacucuag

SEQ ID NO: 187156 - RNA, 22 nt, Human
agagaagagcaaugauaaauuu

SEQ ID NO: 187157 - RNA, 22 nt, Human
gcugcagugagccaagaucgug

SEQ ID NO: 187158 - RNA, 20 nt, Human
ccuuccccacccgcugaggu

SEQ ID NO: 187159 - RNA, 22 nt, Human
auuuugcugugguacauuagga

SEQ ID NO: 187160 - RNA, 22 nt, Human
ucagcaaacauugauuggacuu

SEQ ID NO: 187161 - RNA, 22 nt, Human
auacuguuucucuucuacauga

SEQ ID NO: 187162 - RNA, 22 nt, Human
agccaguccaucacuaaugggu

SEQ ID NO: 187163 - RNA, 19 nt, Human
uuugaaagaguuuuauugg

SEQ ID NO: 187164 - RNA, 22 nt, Human
gucccugggucuaaggcaguaa

SEQ ID NO: 187165 - RNA, 22 nt, Human
acagguuuagcucuuaguaguc

SEQ ID NO: 187166 - RNA, 22 nt, Human
cuggcuggaaguuagagaacuu

SEQ ID NO: 187167 - RNA, 22 nt, Human
cugccugcucaccagggcucug

SEQ ID NO: 187168 - RNA, 22 nt, Human
uuaacauuguccuuagcagauu

SEQ ID NO: 187169 - RNA, 22 nt, Human
aggaagcuagaaggucuucuuu

SEQ ID NO: 187170 - RNA, 22 nt, Human
uacuuguucuuucaagagauag

SEQ ID NO: 187171 - RNA, 23 nt, Human
ccuggggagcuguauccagagug

SEQ ID NO: 187172 - RNA, 21 nt, Human
uuacaaagcaagugcuguguc

SEQ ID NO: 187173 - RNA, 22 nt, Human
uugagggacuuucucuauuauu

SEQ ID NO: 187174 - RNA, 22 nt, Human
gugugcucccucugucgucaua

SEQ ID NO: 187175 - RNA, 22 nt, Human
cucccagagagcaggugggccg

SEQ ID NO: 187176 - RNA, 22 nt, Human
agauuuguaugucuaaauguaa

SEQ ID NO: 187177 - RNA, 22 nt, Human
cucaggauugugccuagggaga

SEQ ID NO: 187178 - RNA, 22 nt, Human
aaaugcugggaaccauuggauc

SEQ ID NO: 187179 - RNA, 22 nt, Human
cugauauggaugccucauuguc

SEQ ID NO: 187180 - RNA, 22 nt, Human
gcuggggucugugaggagggcu

SEQ ID NO: 187181 - RNA, 22 nt, Human
gcugucuuccuugcuccaaggg

SEQ ID NO: 187182 - RNA, 22 nt, Human
ugcuggagugcaguggcuuaac

SEQ ID NO: 187183 - RNA, 22 nt, Human
uggcacagccacugaaucggga

SEQ ID NO: 187184 - RNA, 22 nt, Human
acuuccuguaaauagaauucca

SEQ ID NO: 187185 - RNA, 22 nt, Human
aaauuagaccagggcuccugga

SEQ ID NO: 187186 - RNA, 22 nt, Human
ccugcccuagagaugacacaau

SEQ ID NO: 187187 - RNA, 22 nt, Human
gucuuagauuucaccgauaaug

SEQ ID NO: 187188 - RNA, 22 nt, Human
gccaucugcgcgguguccagcu

SEQ ID NO: 187189 - RNA, 18 nt, Human
uuucuuucugccuggggc

SEQ ID NO: 187190 - RNA, 22 nt, Human
cuccucagacuuuccuuguccg

SEQ ID NO: 187191 - RNA, 22 nt, Human
augcaacaggucagccaggaag

SEQ ID NO: 187192 - RNA, 22 nt, Human
uagcaagaagcugucacaggug

SEQ ID NO: 187193 - RNA, 22 nt, Human
uggacaguuacugagcuugagu

SEQ ID NO: 187194 - RNA, 22 nt, Human
ucacugucugaaagaaauggcc

SEQ ID NO: 187195 - RNA, 22 nt, Human
agauggugagggcagaaguaac

SEQ ID NO: 187196 - RNA, 22 nt, Human
agcugggcaaaaugugagguug

SEQ ID NO: 187197 - RNA, 22 nt, Human
ucuccuggaagugauuccccug

SEQ ID NO: 187198 - RNA, 22 nt, Human
ucugucauguuuccauuacaug

SEQ ID NO: 187199 - RNA, 22 nt, Human
agagccaggcucuaccuggguu

SEQ ID NO: 187200 - RNA, 22 nt, Human
aaagucauguuuuuguuuagca

SEQ ID NO: 187201 - RNA, 19 nt, Human
uguggccaugguucagcug

SEQ ID NO: 187202 - RNA, 22 nt, Human
ugaugacagcaaaaaaugcuag

SEQ ID NO: 187203 - RNA, 22 nt, Human
acauaaguuauggauaaaaugu

SEQ ID NO: 187204 - RNA, 22 nt, Human
gcuuggaaguaggauugggaga

SEQ ID NO: 187205 - RNA, 15 nt, Human
ucugugcagcaaggg

SEQ ID NO: 187206 - RNA, 22 nt, Human
ccaguccagugccaugcauggc

SEQ ID NO: 187207 - RNA, 22 nt, Human
uucauuuaaucagaaucucuaa

SEQ ID NO: 187208 - RNA, 22 nt, Human
uucaauucaauucuaaauauau

SEQ ID NO: 187209 - RNA, 22 nt, Human
augcuauguaacuggcagauag

SEQ ID NO: 187210 - RNA, 20 nt, Human
auuucaguguuugcaauuuc

SEQ ID NO: 187211 - RNA, 22 nt, Human
auacacaugcacacaugugugu

SEQ ID NO: 187212 - RNA, 22 nt, Human
ugccugucuuaauaucuggaaa

SEQ ID NO: 187213 - RNA, 22 nt, Human
aagcugccagcugagcugaggc

SEQ ID NO: 187214 - RNA, 22 nt, Human
aauaaugauaaugguuauagcu

SEQ ID NO: 187215 - RNA, 22 nt, Human
uacagagagauaaguguaaaag

SEQ ID NO: 187216 - RNA, 22 nt, Human
ccaggcuuucuccugacucaca

SEQ ID NO: 187217 - RNA, 22 nt, Human
uucucagauauuuacugagcau

SEQ ID NO: 187218 - RNA, 22 nt, Human
uacugugaauacaaaauaaauu

SEQ ID NO: 187219 - RNA, 22 nt, Human
cauuuguucaaccauucucgcu

SEQ ID NO: 187220 - RNA, 22 nt, Human
uccccuccucuccugauauggg

SEQ ID NO: 187221 - RNA, 22 nt, Human
gaggugaguggaucacgagguc

SEQ ID NO: 187222 - RNA, 20 nt, Human
cauuaugguugggcacagug

SEQ ID NO: 187223 - RNA, 22 nt, Human
ucuguugaccaagucuucuucc

SEQ ID NO: 187224 - RNA, 22 nt, Human
uguguccuuucuuaagagugag

SEQ ID NO: 187225 - RNA, 22 nt, Human
ccagggccaagagaccucgagg

SEQ ID NO: 187226 - RNA, 22 nt, Human
agccccugggaguagcugcugc

SEQ ID NO: 187227 - RNA, 22 nt, Human
acagaugguagcauuauguugg

SEQ ID NO: 187228 - RNA, 22 nt, Human
gcuacugauugaccuuggagag

SEQ ID NO: 187229 - RNA, 22 nt, Human
auguuuccauagaagucacagu

SEQ ID NO: 187230 - RNA, 22 nt, Human
cccaggagguggagcuugcagu

SEQ ID NO: 187231 - RNA, 22 nt, Human
caggaugagaggcccagggaag

SEQ ID NO: 187232 - RNA, 22 nt, Human
gaagcaguagauuccuacucau

SEQ ID NO: 187233 - RNA, 17 nt, Human
aaucagauuucugagga

SEQ ID NO: 187234 - RNA, 22 nt, Human
aaacaucauaggcaugcaugau

SEQ ID NO: 187235 - RNA, 22 nt, Human
agacuccuucucacugccugua

SEQ ID NO: 187236 - RNA, 22 nt, Human
aaacacauuuuaggaaaaucua

SEQ ID NO: 187237 - RNA, 22 nt, Human
ugcucagcacagaccaggccag

SEQ ID NO: 187238 - RNA, 22 nt, Human
accaggaauauuuugcucauuu

SEQ ID NO: 187239 - RNA, 22 nt, Human
aaaucaaaagacauguguuuua

SEQ ID NO: 187240 - RNA, 22 nt, Human
gcaaauauucaagacuuuucca

SEQ ID NO: 187241 - RNA, 22 nt, Human
gaagccaucuuuguuccccacc

SEQ ID NO: 187242 - RNA, 22 nt, Human
ucugaaauaaaugcacuguuag

SEQ ID NO: 187243 - RNA, 22 nt, Human
uucacauuucauaccacagcuu

SEQ ID NO: 187244 - RNA, 18 nt, Human
uccagcaggucugaggug

SEQ ID NO: 187245 - RNA, 22 nt, Human
gcagcugcagacccucagugcu

SEQ ID NO: 187246 - RNA, 22 nt, Human
aacuguuucagaaauauuguug

SEQ ID NO: 187247 - RNA, 22 nt, Human
cacuggguaaauuugaggcuga

SEQ ID NO: 187248 - RNA, 22 nt, Human
cagagacauccauguuaguugg

SEQ ID NO: 187249 - RNA, 22 nt, Human
cuuguuuauuaugcacuguaga

SEQ ID NO: 187250 - RNA, 22 nt, Human
gaggcccagcagcgcaggucuu

SEQ ID NO: 187251 - RNA, 22 nt, Human
ucuucagacuccaaauguuuua

SEQ ID NO: 187252 - RNA, 22 nt, Human
uuauacuaaaacgcauugaauu

SEQ ID NO: 187253 - RNA, 20 nt, Human
ugugugcaucuguauguauu

SEQ ID NO: 187254 - RNA, 22 nt, Human
auacaaugauugguucucaccc

SEQ ID NO: 187255 - RNA, 22 nt, Human
ccucccugguggcucuggucua

SEQ ID NO: 187256 - RNA, 22 nt, Human
gcaggccuccccugcuggagcu

SEQ ID NO: 187257 - RNA, 22 nt, Human
ucagauggaaugaugccacugc

SEQ ID NO: 187258 - RNA, 22 nt, Human
uacagugcuugguaucuaguaa

SEQ ID NO: 187259 - RNA, 22 nt, Human
gcugaggcucaauccccuucug

SEQ ID NO: 187260 - RNA, 22 nt, Human
aauccauagaauaaaauugcag

SEQ ID NO: 187261 - RNA, 22 nt, Human
ggaacagggauuuggccugguu

SEQ ID NO: 187262 - RNA, 22 nt, Human
uuccugggguacuggagaaaau

SEQ ID NO: 187263 - RNA, 22 nt, Human
aaaggcuucucagaaaggccuu

SEQ ID NO: 187264 - RNA, 22 nt, Human
augugaaauagcuggauaugaa

SEQ ID NO: 187265 - RNA, 22 nt, Human
aaauuggauugggagaauguga

SEQ ID NO: 187266 - RNA, 22 nt, Human
cagcucaggaaggaaggccggc

SEQ ID NO: 187267 - RNA, 22 nt, Human
uccacuccuuaugccagacggu

SEQ ID NO: 187268 - RNA, 22 nt, Human
acagaggccaugagcugccacc

SEQ ID NO: 187269 - RNA, 22 nt, Human
ccaaggcugagguuuccaguug

SEQ ID NO: 187270 - RNA, 21 nt, Human
aggcuuggaucuagacaggcc

SEQ ID NO: 187271 - RNA, 23 nt, Human
ugcaguaggauggggcugggccu

SEQ ID NO: 187272 - RNA, 22 nt, Human
agucaaagaugaccgaguuccu

SEQ ID NO: 187273 - RNA, 22 nt, Human
ggcagggagagcaugcugauaa

SEQ ID NO: 187274 - RNA, 22 nt, Human
agcacagggcccagccuaggcc

SEQ ID NO: 187275 - RNA, 22 nt, Human
agcuuuauagaaaggaucagug

SEQ ID NO: 187276 - RNA, 22 nt, Human
aauuuuacauaggggauauggg

SEQ ID NO: 187277 - RNA, 22 nt, Human
ggcagcacgacaggaguggaag

SEQ ID NO: 187278 - RNA, 22 nt, Human
uucugcugaaaacagccaugua

SEQ ID NO: 187279 - RNA, 22 nt, Human
gcacugugcuagaagccagggg

SEQ ID NO: 187280 - RNA, 21 nt, Human
uguuacaguccaaauguuugu

SEQ ID NO: 187281 - RNA, 22 nt, Human
gcagaagcugggagaagggauu

SEQ ID NO: 187282 - RNA, 22 nt, Human
gaggagugccagccguggaguc

SEQ ID NO: 187283 - RNA, 22 nt, Human
cuuugcaauagaggcacacaug

SEQ ID NO: 187284 - RNA, 22 nt, Human
auuagcuuuauuugaaauagga

SEQ ID NO: 187285 - RNA, 22 nt, Human
cugugggcucccagcuucucuc

SEQ ID NO: 187286 - RNA, 22 nt, Human
aagcacugagcacaguggcuga

SEQ ID NO: 187287 - RNA, 22 nt, Human
ugguguggggauaagcacucug

SEQ ID NO: 187288 - RNA, 22 nt, Human
uuuaaauuauaguuaaugucug

SEQ ID NO: 187289 - RNA, 22 nt, Human
gaggcugguucccuugaucuuu

SEQ ID NO: 187290 - RNA, 22 nt, Human
ucaagaugcauggguggcauaa

SEQ ID NO: 187291 - RNA, 22 nt, Human
gaaagucauggaugaacacuac

SEQ ID NO: 187292 - RNA, 22 nt, Human
gccuugccgcucagcagugggg

SEQ ID NO: 187293 - RNA, 22 nt, Human
gagugugggggugcugaggaca

SEQ ID NO: 187294 - RNA, 22 nt, Human
gcagcagauuguuuuuucaccu

SEQ ID NO: 187295 - RNA, 22 nt, Human
augguggacucuugauucaggc

SEQ ID NO: 187296 - RNA, 22 nt, Human
uuggaaacuuucaagcauaaug

SEQ ID NO: 187297 - RNA, 22 nt, Human
ggaaagggcauggccuuuucac

SEQ ID NO: 187298 - RNA, 22 nt, Human
ugacaauugugggcaguuugug

SEQ ID NO: 187299 - RNA, 22 nt, Human
ucuugagguuauuaagcuguua

SEQ ID NO: 187300 - RNA, 22 nt, Human
aguuugaagcaaaauugaggaa

SEQ ID NO: 187301 - RNA, 22 nt, Human
ccccugccauagucaaaucuaa

SEQ ID NO: 187302 - RNA, 22 nt, Human
gaagcagccacggggagacaga

SEQ ID NO: 187303 - RNA, 22 nt, Human
gcaggaagggaaagguugacuc

SEQ ID NO: 187304 - RNA, 22 nt, Human
ggaaggaauuccaagacuaaag

SEQ ID NO: 187305 - RNA, 22 nt, Human
auagcaaagaucacuuccuuga

SEQ ID NO: 187306 - RNA, 22 nt, Human
gaggcugaggguuagagaguca

SEQ ID NO: 187307 - RNA, 22 nt, Human
cccacaucccuuccccgcugug

SEQ ID NO: 187308 - RNA, 20 nt, Human
uuguuagaggaaugccauag

SEQ ID NO: 187309 - RNA, 23 nt, Human
gcagagcugcccuauugccuugg

SEQ ID NO: 187310 - RNA, 22 nt, Human
cugagccaaaaagcagagcuug

SEQ ID NO: 187311 - RNA, 22 nt, Human
ucaaaguuuuugagaauuacau

SEQ ID NO: 187312 - RNA, 22 nt, Human
ccaguguguuaguggauuuccc

SEQ ID NO: 187313 - RNA, 22 nt, Human
ggagccuuagacaucugauccu

SEQ ID NO: 187314 - RNA, 22 nt, Human
acagcugcugcuucucacuggg

SEQ ID NO: 187315 - RNA, 22 nt, Human
cggcuucuauuaggucggugca

SEQ ID NO: 187316 - RNA, 22 nt, Human
aagcuguuaauggcuugcagcu

SEQ ID NO: 187317 - RNA, 22 nt, Human
acacauuaucucauuaaauacu

SEQ ID NO: 187318 - RNA, 21 nt, Human
uaagcauaucagauagacucu

SEQ ID NO: 187319 - RNA, 22 nt, Human
caggcaccaacuuccuggggag

SEQ ID NO: 187320 - RNA, 22 nt, Human
cuccuggcucgcccccagcuga

SEQ ID NO: 187321 - RNA, 22 nt, Human
acacugugugacuucugagacu

SEQ ID NO: 187322 - RNA, 22 nt, Human
aaguggggccuggugguacagu

SEQ ID NO: 187323 - RNA, 22 nt, Human
ccugggcuuugagggcaggaug

SEQ ID NO: 187324 - RNA, 22 nt, Human
ggcaucugagcuguguaugguu

SEQ ID NO: 187325 - RNA, 22 nt, Human
gcucuguaucuuacaacagggu

SEQ ID NO: 187326 - RNA, 22 nt, Human
agaaugcauuuuguguagcuau

SEQ ID NO: 187327 - RNA, 22 nt, Human
cuuguucaguccugacuuccug

SEQ ID NO: 187328 - RNA, 22 nt, Human
guccugucccccaaggcugugg

SEQ ID NO: 187329 - RNA, 22 nt, Human
uaugcuccuauuggaaugauag

SEQ ID NO: 187330 - RNA, 23 nt, Human
uggggagaguuacccuggaagcg

SEQ ID NO: 187331 - RNA, 22 nt, Human
agaaguauucugcauguacuga

SEQ ID NO: 187332 - RNA, 22 nt, Human
cuggccucauagccaagcugug

SEQ ID NO: 187333 - RNA, 22 nt, Human
aggaauguaaaucuagauuuua

SEQ ID NO: 187334 - RNA, 22 nt, Human
gcagugcaggaacauagcuucu

SEQ ID NO: 187335 - RNA, 22 nt, Human
uguagaaggcuauagacuagga

SEQ ID NO: 187336 - RNA, 22 nt, Human
caauuucucgaacucuaaucca

SEQ ID NO: 187337 - RNA, 22 nt, Human
gcucagugaaacaucaaauagu

SEQ ID NO: 187338 - RNA, 22 nt, Human
gagauuuagcugcuuaacuccu

SEQ ID NO: 187339 - RNA, 22 nt, Human
ucucaaacuaacaaugauuaua

SEQ ID NO: 187340 - RNA, 22 nt, Human
acugugaugcaguugccaucca

SEQ ID NO: 187341 - RNA, 22 nt, Human
uggcagagaaccugggcuuugu

SEQ ID NO: 187342 - RNA, 22 nt, Human
uaauuucuaauucauuuucagu

SEQ ID NO: 187343 - RNA, 22 nt, Human
acuucccaggugguguggaguu

SEQ ID NO: 187344 - RNA, 22 nt, Human
ucacauucuucccugacuucuu

SEQ ID NO: 187345 - RNA, 20 nt, Human
aaaugaugggaauaaucuau

SEQ ID NO: 187346 - RNA, 22 nt, Human
agcucagaaaugccaguaggua

SEQ ID NO: 187347 - RNA, 22 nt, Human
uaaauguguuagucaugguuuu

SEQ ID NO: 187348 - RNA, 22 nt, Human
gccucugggguggagcccagca

SEQ ID NO: 187349 - RNA, 22 nt, Human
gcagccucugcaguucaggagg

SEQ ID NO: 187350 - RNA, 22 nt, Human
auuuugaaaagcauuugaguaa

SEQ ID NO: 187351 - RNA, 22 nt, Human
cauuuuaagaugaccugguuuc

SEQ ID NO: 187352 - RNA, 19 nt, Human
cugcucaggucagucuguc

SEQ ID NO: 187353 - RNA, 22 nt, Human
guacccagaggcaugaucccag

SEQ ID NO: 187354 - RNA, 22 nt, Human
aaaacagacagccaguguagag

SEQ ID NO: 187355 - RNA, 22 nt, Human
gacaggcugugauggccgggag

SEQ ID NO: 187356 - RNA, 22 nt, Human
gagcccagucugcuccugcgcc

SEQ ID NO: 187357 - RNA, 20 nt, Human
acugagguuagauaacaggu

SEQ ID NO: 187358 - RNA, 22 nt, Human
gcagagugaggaagagcuucca

SEQ ID NO: 187359 - RNA, 22 nt, Human
agaguguaccaaauauccuaca

SEQ ID NO: 187360 - RNA, 22 nt, Human
acuggggccuccuccaugcucu

SEQ ID NO: 187361 - RNA, 19 nt, Human
ccagagucaugucuccccc

SEQ ID NO: 187362 - RNA, 22 nt, Human
aguagugugacaauuaauauuu

SEQ ID NO: 187363 - RNA, 22 nt, Human
guuuuauuggaacacagccaug

SEQ ID NO: 187364 - RNA, 22 nt, Human
aacacaaagaagcugcaggauc

SEQ ID NO: 187365 - RNA, 22 nt, Human
gcuggcuuugucaagggcagca

SEQ ID NO: 187366 - RNA, 22 nt, Human
ugcuuuaagacacuaaguuuga

SEQ ID NO: 187367 - RNA, 22 nt, Human
auauaauacaaccugcuaagug

SEQ ID NO: 187368 - RNA, 22 nt, Human
ugcuucucaaagaagcauaaug

SEQ ID NO: 187369 - RNA, 22 nt, Human
uccagccauaucuuguagcccu

SEQ ID NO: 187370 - RNA, 20 nt, Human
ucucuggguucucacucagc

SEQ ID NO: 187371 - RNA, 22 nt, Human
acagcagggguggaauaaacgu

SEQ ID NO: 187372 - RNA, 21 nt, Human
uucugggccggagaaggggcg

SEQ ID NO: 187373 - RNA, 22 nt, Human
auaauagcuaacacagagugcu

SEQ ID NO: 187374 - RNA, 22 nt, Human
uuuccaaaggaggaaccaguuu

SEQ ID NO: 187375 - RNA, 22 nt, Human
gagcugcacaucugaggcuaau

SEQ ID NO: 187376 - RNA, 22 nt, Human
uaagacauaccaaguuguguga

SEQ ID NO: 187377 - RNA, 22 nt, Human
ggcuccuucaagccugucacug

SEQ ID NO: 187378 - RNA, 22 nt, Human
ugucagcagcugguuugcuguu

SEQ ID NO: 187379 - RNA, 22 nt, Human
cugagcugguucucuugugaaa

SEQ ID NO: 187380 - RNA, 22 nt, Human
ugcuuaaaauaguucauuuuug

SEQ ID NO: 187381 - RNA, 22 nt, Human
agaaaguuagcagacucuuggc

SEQ ID NO: 187382 - RNA, 22 nt, Human
acccagaguaacagauggauuc

SEQ ID NO: 187383 - RNA, 22 nt, Human
ccugagucccauaauguugcca

SEQ ID NO: 187384 - RNA, 22 nt, Human
agucagucaccauuuaagaaca

SEQ ID NO: 187385 - RNA, 21 nt, Human
cccugcaggccagggcugagc

SEQ ID NO: 187386 - RNA, 22 nt, Human
uuugcaaacacuuaagaagaga

SEQ ID NO: 187387 - RNA, 23 nt, Human
aauucaaauucagugugacuagg

SEQ ID NO: 187388 - RNA, 22 nt, Human
auuuuucucucacacuuaccag

SEQ ID NO: 187389 - RNA, 18 nt, Human
ccuguguguguugcaggc

SEQ ID NO: 187390 - RNA, 22 nt, Human
agagggcauuaacucugucuug

SEQ ID NO: 187391 - RNA, 18 nt, Human
guuaauuuugaaguucau

SEQ ID NO: 187392 - RNA, 22 nt, Human
cugugcaguaggucagggcugg

SEQ ID NO: 187393 - RNA, 22 nt, Human
aagauguugucguuagugauga

SEQ ID NO: 187394 - RNA, 22 nt, Human
aaaguguuuacauugcuauaag

SEQ ID NO: 187395 - RNA, 22 nt, Human
ccuggagcaaaaaucuaaggag

SEQ ID NO: 187396 - RNA, 22 nt, Human
gagaaucucaggcacccagaag

SEQ ID NO: 187397 - RNA, 22 nt, Human
cugggagcggcugucacugguu

SEQ ID NO: 187398 - RNA, 22 nt, Human
ugcagcugauuaaagggcagac

SEQ ID NO: 187399 - RNA, 22 nt, Human
ggugacagcgggucaagaggag

SEQ ID NO: 187400 - RNA, 22 nt, Human
uccaggccucuagcccucucuu

SEQ ID NO: 187401 - RNA, 22 nt, Human
ugggguugaagaaaggaucuag

SEQ ID NO: 187402 - RNA, 22 nt, Human
uucucagauccaucagaagucc

SEQ ID NO: 187403 - RNA, 22 nt, Human
gcuuaauucuggcucaguuucc

SEQ ID NO: 187404 - RNA, 22 nt, Human
acagaaagaugauuugaaaugg

SEQ ID NO: 187405 - RNA, 22 nt, Human
gccuuggcccacagugcuccug

SEQ ID NO: 187406 - RNA, 22 nt, Human
ugcccugcuucucuugggacag

SEQ ID NO: 187407 - RNA, 22 nt, Human
ucugacccguggcucugccucc

SEQ ID NO: 187408 - RNA, 22 nt, Human
uacacaaugacuuaagauguca

SEQ ID NO: 187409 - RNA, 22 nt, Human
uaagacuuccaggaaaaggugg

SEQ ID NO: 187410 - RNA, 22 nt, Human
auuuagguagcugucuaagugu

SEQ ID NO: 187411 - RNA, 22 nt, Human
uuucacaauuuuaaggagcaaa

SEQ ID NO: 187412 - RNA, 22 nt, Human
aacugcaacuuguuugauucuu

SEQ ID NO: 187413 - RNA, 23 nt, Human
gccagccuugcucuccugcagcc

SEQ ID NO: 187414 - RNA, 22 nt, Human
ucacaagaauuuguagaugaaa

SEQ ID NO: 187415 - RNA, 22 nt, Human
uggaaccuggugauguacaagu

SEQ ID NO: 187416 - RNA, 22 nt, Human
uuuuaucaaucauuaagacauu

SEQ ID NO: 187417 - RNA, 22 nt, Human
aggcuguguucugcccucuccc

SEQ ID NO: 187418 - RNA, 22 nt, Human
gaaaggcucacuuuagaucaug

SEQ ID NO: 187419 - RNA, 22 nt, Human
uucugguuacauuguuacagcu

SEQ ID NO: 187420 - RNA, 22 nt, Human
cagagaugugauccagcugucu

SEQ ID NO: 187421 - RNA, 22 nt, Human
agcagaaucuguccuuggaaga

SEQ ID NO: 187422 - RNA, 22 nt, Human
aggaugggucagcuagagucca

SEQ ID NO: 187423 - RNA, 22 nt, Human
acucugagucaugcacuccuug

SEQ ID NO: 187424 - RNA, 22 nt, Human
aauuuuauuagaaggcaagggg

SEQ ID NO: 187425 - RNA, 22 nt, Human
uugugcaaggucuggacuauag

SEQ ID NO: 187426 - RNA, 22 nt, Human
gccugggauucucaaaggggug

SEQ ID NO: 187427 - RNA, 22 nt, Human
auacugauuaguugagaaagca

SEQ ID NO: 187428 - RNA, 22 nt, Human
ucucugggaauuuuuuggacau

SEQ ID NO: 187429 - RNA, 22 nt, Human
aggucagcuagacagcucucug

SEQ ID NO: 187430 - RNA, 22 nt, Human
gcugaaauucagauuccuaggc

SEQ ID NO: 187431 - RNA, 22 nt, Human
agcuucucaucuuccaaaauug

SEQ ID NO: 187432 - RNA, 17 nt, Human
gaccaggagaaaccagg

SEQ ID NO: 187433 - RNA, 22 nt, Human
cagggcucgcucuugcccuucg

SEQ ID NO: 187434 - RNA, 19 nt, Human
ugggagaggcaacagagua

SEQ ID NO: 187435 - RNA, 22 nt, Human
cuggcugcuuguuuugaugggu

SEQ ID NO: 187436 - RNA, 21 nt, Human
cacacagugaucuauccacau

SEQ ID NO: 187437 - RNA, 21 nt, Human
caaagccaggcaacucucucc

SEQ ID NO: 187438 - RNA, 22 nt, Human
uuguuugucauaauaucauuac

SEQ ID NO: 187439 - RNA, 22 nt, Human
uguggauaaugcacuauccaua

SEQ ID NO: 187440 - RNA, 21 nt, Human
uuagaguugccauuauaugua

SEQ ID NO: 187441 - RNA, 22 nt, Human
cuggugcuguagccugauugag

SEQ ID NO: 187442 - RNA, 22 nt, Human
uaauuuuccacucuguuuaucu

SEQ ID NO: 187443 - RNA, 22 nt, Human
uauuuccaggccccacucuaga

SEQ ID NO: 187444 - RNA, 22 nt, Human
uuuauugacuucagugagucuu

SEQ ID NO: 187445 - RNA, 22 nt, Human
acaguuaauuaacauuaagggg

SEQ ID NO: 187446 - RNA, 17 nt, Human
uuacaacaauucaugag

SEQ ID NO: 187447 - RNA, 22 nt, Human
aagauccaugggaauguuuggc

SEQ ID NO: 187448 - RNA, 22 nt, Human
gcaggccugcagguauggccgg

SEQ ID NO: 187449 - RNA, 22 nt, Human
cuucuguagccaguaacauaua

SEQ ID NO: 187450 - RNA, 22 nt, Human
aaagccuucuucggucugugau

SEQ ID NO: 187451 - RNA, 22 nt, Human
uggcuucagacuucugcuacgu

SEQ ID NO: 187452 - RNA, 22 nt, Human
gcacugggcuccaggaaggagg

SEQ ID NO: 187453 - RNA, 22 nt, Human
cucuagggcucugugagguugg

SEQ ID NO: 187454 - RNA, 22 nt, Human
ugcuccagcaccaagagcucca

SEQ ID NO: 187455 - RNA, 22 nt, Human
aggagccauuuuccaagggcga

SEQ ID NO: 187456 - RNA, 22 nt, Human
uagcccucuccagcgaggucug

SEQ ID NO: 187457 - RNA, 22 nt, Human
aagcuguuuuggccuuaguuga

SEQ ID NO: 187458 - RNA, 23 nt, Human
acaucagaguuaguucaaucagg

SEQ ID NO: 187459 - RNA, 22 nt, Human
augucaaaucaguuuuaucaga

SEQ ID NO: 187460 - RNA, 20 nt, Human
aggacagcagcugccacuug

SEQ ID NO: 187461 - RNA, 22 nt, Human
uauuccucccaguaaguacaac

SEQ ID NO: 187462 - RNA, 22 nt, Human
cgugggaguggugggugcucag

SEQ ID NO: 187463 - RNA, 22 nt, Human
cuuacauugugugcaugagggg

SEQ ID NO: 187464 - RNA, 22 nt, Human
uggagccagaagagccaguuca

SEQ ID NO: 187465 - RNA, 22 nt, Human
aaguguuuauuuauaacgaucu

SEQ ID NO: 187466 - RNA, 22 nt, Human
caggugguuugauaggauaacu

SEQ ID NO: 187467 - RNA, 23 nt, Human
agagccuuuucacacuucaaugu

SEQ ID NO: 187468 - RNA, 22 nt, Human
agcagccuuagguauugugauu

SEQ ID NO: 187469 - RNA, 22 nt, Human
cuggccucacagaggcuaagcc

SEQ ID NO: 187470 - RNA, 22 nt, Human
gaaucuuauccccaguccuuaa

SEQ ID NO: 187471 - RNA, 22 nt, Human
augacagaugcuguggggaggu

SEQ ID NO: 187472 - RNA, 22 nt, Human
ucucagaaauacuauguuguca

SEQ ID NO: 187473 - RNA, 22 nt, Human
ucaggcuguggcuuugaccgca

SEQ ID NO: 187474 - RNA, 22 nt, Human
augcugaaugaaagaaauuagu

SEQ ID NO: 187475 - RNA, 19 nt, Human
gggcuucugggaucaagag

SEQ ID NO: 187476 - RNA, 22 nt, Human
augcaaagcaccacacuaagau

SEQ ID NO: 187477 - RNA, 22 nt, Human
uguuacuucuuauuucuuacau

SEQ ID NO: 187478 - RNA, 22 nt, Human
cuuucuuauaccugucagggcc

SEQ ID NO: 187479 - RNA, 22 nt, Human
acaccuuugccccaagucauag

SEQ ID NO: 187480 - RNA, 22 nt, Human
gcuccucuucucccacugaaug

SEQ ID NO: 187481 - RNA, 22 nt, Human
cugccuccaggcucaccuugac

SEQ ID NO: 187482 - RNA, 22 nt, Human
ucugagccccuagaacugagcg

SEQ ID NO: 187483 - RNA, 22 nt, Human
acacugaauauacaaugaauau

SEQ ID NO: 187484 - RNA, 22 nt, Human
uggccagcccucuucccacacu

SEQ ID NO: 187485 - RNA, 22 nt, Human
accaggaggaaguguuaaugau

SEQ ID NO: 187486 - RNA, 22 nt, Human
auuauuauauagggaaaguccc

SEQ ID NO: 187487 - RNA, 22 nt, Human
cccacaggcaggggcagagaca

SEQ ID NO: 187488 - RNA, 19 nt, Human
uggcagggagugauauuag

SEQ ID NO: 187489 - RNA, 22 nt, Human
ccagcuccccucagcagguaau

SEQ ID NO: 187490 - RNA, 22 nt, Human
ucuguuuauucaauuucuauau

SEQ ID NO: 187491 - RNA, 22 nt, Human
ucugaaauauugguaauacuuu

SEQ ID NO: 187492 - RNA, 22 nt, Human
agagggcuggacgcagguugga

SEQ ID NO: 187493 - RNA, 22 nt, Human
ucagaagcaagcuucuacuucu

SEQ ID NO: 187494 - RNA, 22 nt, Human
gcagacaggauuggguuaauag

SEQ ID NO: 187495 - RNA, 22 nt, Human
aggcuugggucagaaggcuugu

SEQ ID NO: 187496 - RNA, 22 nt, Human
cucaggcacuuuugucacagac

SEQ ID NO: 187497 - RNA, 22 nt, Human
ugcaaacaguuaagaugcaggc

SEQ ID NO: 187498 - RNA, 22 nt, Human
aaauuugauaagccauuguuac

SEQ ID NO: 187499 - RNA, 22 nt, Human
ugagcagagucgcuccagagug

SEQ ID NO: 187500 - RNA, 22 nt, Human
ugaaaauggccugaagaagcaa

SEQ ID NO: 187501 - RNA, 22 nt, Human
cugagcugagccaaaucugucu

SEQ ID NO: 187502 - RNA, 22 nt, Human
aggaagccaggcccuugggugg

SEQ ID NO: 187503 - RNA, 22 nt, Human
aguguuacuacagacugguuaa

SEQ ID NO: 187504 - RNA, 23 nt, Human
uugggaaauaguuaagacaugag

SEQ ID NO: 187505 - RNA, 22 nt, Human
agugucugccugggaggagcau

SEQ ID NO: 187506 - RNA, 22 nt, Human
uaggccaggaaucagcaagcuu

SEQ ID NO: 187507 - RNA, 22 nt, Human
aucugggcguauaggugcaagu

SEQ ID NO: 187508 - RNA, 22 nt, Human
gagcugcaugcaacucgaaaau

SEQ ID NO: 187509 - RNA, 22 nt, Human
cagaaaaggguguuuguucagg

SEQ ID NO: 187510 - RNA, 22 nt, Human
ucucugcagucuugggcaggca

SEQ ID NO: 187511 - RNA, 22 nt, Human
gggagguagcaagccugcagcu

SEQ ID NO: 187512 - RNA, 22 nt, Human
cuacucugaaaacccagaaacu

SEQ ID NO: 187513 - RNA, 22 nt, Human
ucucagcagccagauccagagc

SEQ ID NO: 187514 - RNA, 22 nt, Human
auuuccuauggauacaggcaga

SEQ ID NO: 187515 - RNA, 19 nt, Human
gaacuuggccaggcacagu

SEQ ID NO: 187516 - RNA, 22 nt, Human
gucugccccacaggcucaguug

SEQ ID NO: 187517 - RNA, 22 nt, Human
uguguucuccuacagauaagga

SEQ ID NO: 187518 - RNA, 22 nt, Human
aaacaguucuccaggaagccag

SEQ ID NO: 187519 - RNA, 22 nt, Human
agugcaugaaagcauacaaggc

SEQ ID NO: 187520 - RNA, 22 nt, Human
uuuacauuucccucugucaguu

SEQ ID NO: 187521 - RNA, 22 nt, Human
gcauuuuaaugagguuuaugag

SEQ ID NO: 187522 - RNA, 22 nt, Human
gaguuacuggguggaaggcacu

SEQ ID NO: 187523 - RNA, 22 nt, Human
caggaugcagugggacccaggg

SEQ ID NO: 187524 - RNA, 22 nt, Human
gcuaguccacagccauccaggc

SEQ ID NO: 187525 - RNA, 22 nt, Human
agcaguguucaaugauacacug

SEQ ID NO: 187526 - RNA, 22 nt, Human
ugaggcaggaugcuugcacagg

SEQ ID NO: 187527 - RNA, 22 nt, Human
uccuuagacaaagagugggcuu

SEQ ID NO: 187528 - RNA, 22 nt, Human
agagccugagccugaaagcccu

SEQ ID NO: 187529 - RNA, 22 nt, Human
cccccaccguguuccugcucgg

SEQ ID NO: 187530 - RNA, 22 nt, Human
ccucagagacugcaucuucccu

SEQ ID NO: 187531 - RNA, 22 nt, Human
guuccucagcccuuacuuagcc

SEQ ID NO: 187532 - RNA, 22 nt, Human
cacaggcuuccaguccccagcu

SEQ ID NO: 187533 - RNA, 20 nt, Human
caugcaacagauuauuuccc

SEQ ID NO: 187534 - RNA, 22 nt, Human
uaggcuucccgcucacaugccc

SEQ ID NO: 187535 - RNA, 23 nt, Human
gaauucuuaaggucacuaaaguc

SEQ ID NO: 187536 - RNA, 22 nt, Human
auagauuauuugcucauuacuu

SEQ ID NO: 187537 - RNA, 22 nt, Human
uccugagagcagaguccaggug

SEQ ID NO: 187538 - RNA, 22 nt, Human
agcauguucaucuucuguuggu

SEQ ID NO: 187539 - RNA, 22 nt, Human
uaaggcacccuucugaguagag

SEQ ID NO: 187540 - RNA, 19 nt, Human
agucuuguauuuuucaagc

SEQ ID NO: 187541 - RNA, 21 nt, Human
uuucucaguugugugagcagc

SEQ ID NO: 187542 - RNA, 22 nt, Human
ccacugagaagggguugggguc

SEQ ID NO: 187543 - RNA, 22 nt, Human
uccacaguuuugccacuagcug

SEQ ID NO: 187544 - RNA, 22 nt, Human
aggaggcagaugcuuggcugua

SEQ ID NO: 187545 - RNA, 22 nt, Human
acaagcuuccaggugaugcuga

SEQ ID NO: 187546 - RNA, 22 nt, Human
cagugagggaagaucucagcac

SEQ ID NO: 187547 - RNA, 22 nt, Human
cagaugaacucuauccuguggc

SEQ ID NO: 187548 - RNA, 22 nt, Human
uggcuugcuacugaggugucag

SEQ ID NO: 187549 - RNA, 22 nt, Human
cugggccaguuaugucucaucu

SEQ ID NO: 187550 - RNA, 22 nt, Human
uccauuuacuauucucauaucg

SEQ ID NO: 187551 - RNA, 22 nt, Human
cagagccucugcccugggcacu

SEQ ID NO: 187552 - RNA, 20 nt, Human
cacagaugggacaggaaagg

SEQ ID NO: 187553 - RNA, 22 nt, Human
aaggcaguuaauuuggcuagaa

SEQ ID NO: 187554 - RNA, 22 nt, Human
cuggcccuggcuggagcccagg

SEQ ID NO: 187555 - RNA, 21 nt, Human
cccagggaagccgcagucacc

SEQ ID NO: 187556 - RNA, 22 nt, Human
ucccuaguagacccagaucauu

SEQ ID NO: 187557 - RNA, 22 nt, Human
gcuggagugcugaggugcagug

SEQ ID NO: 187558 - RNA, 22 nt, Human
cagcugaaccuuucccuggagc

SEQ ID NO: 187559 - RNA, 22 nt, Human
gcuuucugccugggcuccauuu

SEQ ID NO: 187560 - RNA, 22 nt, Human
agcagugaaacagcugcauaug

SEQ ID NO: 187561 - RNA, 22 nt, Human
uacagcuagagggcacgugaac

SEQ ID NO: 187562 - RNA, 22 nt, Human
auucuuuacauuggcuucuucc

SEQ ID NO: 187563 - RNA, 22 nt, Human
ugaccauuugaucuacauucca

SEQ ID NO: 187564 - RNA, 22 nt, Human
gaaaguaugccaucuaccucuu

SEQ ID NO: 187565 - RNA, 22 nt, Human
ucacagugaugacgugggagca

SEQ ID NO: 187566 - RNA, 22 nt, Human
ugaggccaggcaaaggcgaucu

SEQ ID NO: 187567 - RNA, 22 nt, Human
agaggcaaugaaagcagucucu

SEQ ID NO: 187568 - RNA, 22 nt, Human
cuuguggagauauccaugucug

SEQ ID NO: 187569 - RNA, 22 nt, Human
uugcaaaugguaccaagggucu

SEQ ID NO: 187570 - RNA, 22 nt, Human
cuucagaagaaaagcagugugu

SEQ ID NO: 187571 - RNA, 22 nt, Human
ucagugcacaaugacgguggcu

SEQ ID NO: 187572 - RNA, 22 nt, Human
cuucucccaaguaugcaguuug

SEQ ID NO: 187573 - RNA, 22 nt, Human
gugcagaggucacaaaagugaa

SEQ ID NO: 187574 - RNA, 21 nt, Human
ggaggaaaaaggaaugacuug

SEQ ID NO: 187575 - RNA, 22 nt, Human
ucaggcuuuuucucaaccucuu

SEQ ID NO: 187576 - RNA, 22 nt, Human
augguaaugauuuauguaaauu

SEQ ID NO: 187577 - RNA, 22 nt, Human
caggcuuccgccagguuuccag

SEQ ID NO: 187578 - RNA, 22 nt, Human
ucagcuuuuaaaaacaagaagu

SEQ ID NO: 187579 - RNA, 22 nt, Human
ccugaggcaaggacuugguggc

SEQ ID NO: 187580 - RNA, 22 nt, Human
aguccacugccccagcuccucg

SEQ ID NO: 187581 - RNA, 22 nt, Human
aguaaacaguaucuuuaguguc

SEQ ID NO: 187582 - RNA, 22 nt, Human
uguuacaguggcuuuuuaaaca

SEQ ID NO: 187583 - RNA, 22 nt, Human
uguagaacugacauuuuggacu

SEQ ID NO: 187584 - RNA, 22 nt, Human
aauaacuggcacauaucacaua

SEQ ID NO: 187585 - RNA, 22 nt, Human
ccaugaccccuggcauccaggg

SEQ ID NO: 187586 - RNA, 22 nt, Human
gcagcuuugucacggagugucg

SEQ ID NO: 187587 - RNA, 22 nt, Human
cauuuacagugagaguuuuuac

SEQ ID NO: 187588 - RNA, 22 nt, Human
aauaccaugcagaaauaacaua

SEQ ID NO: 187589 - RNA, 22 nt, Human
cugaggagucagcuuacucacu

SEQ ID NO: 187590 - RNA, 22 nt, Human
aucacauucuuucaaagcaguc

SEQ ID NO: 187591 - RNA, 18 nt, Human
cugaaggcaccagggcag

SEQ ID NO: 187592 - RNA, 22 nt, Human
uugcuuauuugauuaaaugucu

SEQ ID NO: 187593 - RNA, 22 nt, Human
gaggcucccucaacucugggug

SEQ ID NO: 187594 - RNA, 22 nt, Human
aaugucuauuugcuacaaagcc

SEQ ID NO: 187595 - RNA, 22 nt, Human
cucuucuugucucugguuagaa

SEQ ID NO: 187596 - RNA, 22 nt, Human
ugugacagaucuuuaaauaaug

SEQ ID NO: 187597 - RNA, 22 nt, Human
uuugcugaauaaaugugugacu

SEQ ID NO: 187598 - RNA, 22 nt, Human
ucuuucugaauauuugaccuca

SEQ ID NO: 187599 - RNA, 22 nt, Human
aaaacucugcaguuaguuucua

SEQ ID NO: 187600 - RNA, 22 nt, Human
uguaaugagaaagagagugaau

SEQ ID NO: 187601 - RNA, 22 nt, Human
gcccagcaaggaccaagggccg

SEQ ID NO: 187602 - RNA, 22 nt, Human
acauugugauccgacugauuaa

SEQ ID NO: 187603 - RNA, 22 nt, Human
guuuccuauaacucaggcacca

SEQ ID NO: 187604 - RNA, 22 nt, Human
ggcuguggcagcuggaaguggu

SEQ ID NO: 187605 - RNA, 22 nt, Human
ccuuuuauacucagugauauca

SEQ ID NO: 187606 - RNA, 22 nt, Human
ugggcugcacccucagccucug

SEQ ID NO: 187607 - RNA, 22 nt, Human
ucugggcagccgccccauagga

SEQ ID NO: 187608 - RNA, 22 nt, Human
agggcugcuuugcuaaauaugg

SEQ ID NO: 187609 - RNA, 22 nt, Human
agcaaagucaguggaaccaucc

SEQ ID NO: 187610 - RNA, 22 nt, Human
uucuaguuaaaguauguauuag

SEQ ID NO: 187611 - RNA, 23 nt, Human
ugccguguuagaaauguuuuaca

SEQ ID NO: 187612 - RNA, 22 nt, Human
cagcuggccaaucagggcgccc

SEQ ID NO: 187613 - RNA, 22 nt, Human
uuaguuguaaaauggaauuugu

SEQ ID NO: 187614 - RNA, 22 nt, Human
ggaacuuuuuaacaagcugcug

SEQ ID NO: 187615 - RNA, 22 nt, Human
uccaaauauucggucuuucuga

SEQ ID NO: 187616 - RNA, 22 nt, Human
cuggacucagggugcuccagcg

SEQ ID NO: 187617 - RNA, 22 nt, Human
uuggaagcaguguacacuguac

SEQ ID NO: 187618 - RNA, 22 nt, Human
uggcucaguuccaucaucugga

SEQ ID NO: 187619 - RNA, 14 nt, Human
aggaauguccuagg

SEQ ID NO: 187620 - RNA, 22 nt, Human
auuuacagaugaugcuauuuga

SEQ ID NO: 187621 - RNA, 22 nt, Human
gagcuucagagaccacuuaacu

SEQ ID NO: 187622 - RNA, 22 nt, Human
cacagcagaaauaugaaggcag

SEQ ID NO: 187623 - RNA, 22 nt, Human
guucucugccggcaccuacccg

SEQ ID NO: 187624 - RNA, 20 nt, Human
aggucugauuccagaaucag

SEQ ID NO: 187625 - RNA, 18 nt, Human
gcuccuggaccaggucac

SEQ ID NO: 187626 - RNA, 22 nt, Human
cuggccagacuacacaugugug

SEQ ID NO: 187627 - RNA, 22 nt, Human
gaagaaagauuggcaugcuuca

SEQ ID NO: 187628 - RNA, 17 nt, Human
aggagggaaauagcuug

SEQ ID NO: 187629 - RNA, 22 nt, Human
caggagacuauggcccaaggcc

SEQ ID NO: 187630 - RNA, 22 nt, Human
acacaggaagagagauaauaau

SEQ ID NO: 187631 - RNA, 22 nt, Human
auagacaacacuuauuauuccu

SEQ ID NO: 187632 - RNA, 22 nt, Human
agccacagcaacaagugcaauu

SEQ ID NO: 187633 - RNA, 22 nt, Human
gccuggugcuaugagggccagc

SEQ ID NO: 187634 - RNA, 18 nt, Human
gcagaugaguaguguacc

SEQ ID NO: 187635 - RNA, 22 nt, Human
cugauaauguccugcaguaaau

SEQ ID NO: 187636 - RNA, 22 nt, Human
ucugagcuaauccuguugccga

SEQ ID NO: 187637 - RNA, 22 nt, Human
gcccagcaccucucucaggguu

SEQ ID NO: 187638 - RNA, 22 nt, Human
caggucagagucccccuguccu

SEQ ID NO: 187639 - RNA, 22 nt, Human
ucacaugucaagaagauaauuu

SEQ ID NO: 187640 - RNA, 22 nt, Human
aagucuaaacacauauuuaaaa

SEQ ID NO: 187641 - RNA, 22 nt, Human
agaccugcagggccaggccugc

SEQ ID NO: 187642 - RNA, 22 nt, Human
cuguuacccagcaaccccagca

SEQ ID NO: 187643 - RNA, 22 nt, Human
auauuagguuggugcaaaagua

SEQ ID NO: 187644 - RNA, 22 nt, Human
uccauuuuagaagaaaauccac

SEQ ID NO: 187645 - RNA, 22 nt, Human
uuagguaaguaggaucaaaaaa

SEQ ID NO: 187646 - RNA, 22 nt, Human
agucugagguaauauuuuucuc

SEQ ID NO: 187647 - RNA, 22 nt, Human
ucuaguucuagaucccugagga

SEQ ID NO: 187648 - RNA, 20 nt, Human
uugaggagauauugaauacu

SEQ ID NO: 187649 - RNA, 22 nt, Human
uuuguucagcucucauugauua

SEQ ID NO: 187650 - RNA, 22 nt, Human
gcaagcaagcagguagagcuga

SEQ ID NO: 187651 - RNA, 22 nt, Human
uauuccagguuucuuguuguau

SEQ ID NO: 187652 - RNA, 22 nt, Human
cucuccaggagagcacuuugag

SEQ ID NO: 187653 - RNA, 22 nt, Human
uuugacucuuagcccaggacuc

SEQ ID NO: 187654 - RNA, 22 nt, Human
uuccugguuugccuggaaucca

SEQ ID NO: 187655 - RNA, 22 nt, Human
ugagguuauuuauuaugcauga

SEQ ID NO: 187656 - RNA, 22 nt, Human
ccuggcagggcugcaguaaugg

SEQ ID NO: 187657 - RNA, 22 nt, Human
gcagguggaucaccacgucagg

SEQ ID NO: 187658 - RNA, 22 nt, Human
ccacaauuuuaugauuuaggag

SEQ ID NO: 187659 - RNA, 22 nt, Human
ucauuccauuuccagcucugaa

SEQ ID NO: 187660 - RNA, 22 nt, Human
uuggcucagugugagggagaug

SEQ ID NO: 187661 - RNA, 22 nt, Human
cagagaaagggugaauuccuuc

SEQ ID NO: 187662 - RNA, 22 nt, Human
uuuguucugcaucacagaaaaa

SEQ ID NO: 187663 - RNA, 22 nt, Human
gcacugcuuuuaccuaggugag

SEQ ID NO: 187664 - RNA, 22 nt, Human
uguacaguguaaauaaguggau

SEQ ID NO: 187665 - RNA, 22 nt, Human
aaguuuuucacauugcuguugu

SEQ ID NO: 187666 - RNA, 23 nt, Human
auguuauuauuagcagucuugcc

SEQ ID NO: 187667 - RNA, 22 nt, Human
auugaggcagcauaguucaggg

SEQ ID NO: 187668 - RNA, 22 nt, Human
cgcaacucagcaacuuaacugc

SEQ ID NO: 187669 - RNA, 22 nt, Human
agaguuauauugguugagaauu

SEQ ID NO: 187670 - RNA, 22 nt, Human
ggccaccaguccucuggcaggg

SEQ ID NO: 187671 - RNA, 22 nt, Human
auucuucaucagagaugcacua

SEQ ID NO: 187672 - RNA, 22 nt, Human
aucuagaacuuaaagucaguca

SEQ ID NO: 187673 - RNA, 22 nt, Human
aauaucagcacuuuugugguau

SEQ ID NO: 187674 - RNA, 22 nt, Human
uggcaguugugagguucauauu

SEQ ID NO: 187675 - RNA, 22 nt, Human
aagccaaggccugucuggggcu

SEQ ID NO: 187676 - RNA, 22 nt, Human
gcagagugaagggagaggugug

SEQ ID NO: 187677 - RNA, 22 nt, Human
ugcuucaggagaugucaccaug

SEQ ID NO: 187678 - RNA, 21 nt, Human
gguggcucaccugauuggaua

SEQ ID NO: 187679 - RNA, 22 nt, Human
gcagaauacauuugggauuacu

SEQ ID NO: 187680 - RNA, 22 nt, Human
uacaguuuguauggucaggaau

SEQ ID NO: 187681 - RNA, 22 nt, Human
uucucaggcucugagacccuau

SEQ ID NO: 187682 - RNA, 22 nt, Human
guuucuuuugugaucaccaacc

SEQ ID NO: 187683 - RNA, 22 nt, Human
uuucuguuuagcauaaaguggc

SEQ ID NO: 187684 - RNA, 16 nt, Human
ucccugggaguggugg

SEQ ID NO: 187685 - RNA, 22 nt, Human
agcuggaggaguuucuccuagc

SEQ ID NO: 187686 - RNA, 19 nt, Human
uuuuguguagcugcugguu

SEQ ID NO: 187687 - RNA, 22 nt, Human
agcugguccuuggcaguucuca

SEQ ID NO: 187688 - RNA, 22 nt, Human
cugaauauuagucaugucugau

SEQ ID NO: 187689 - RNA, 22 nt, Human
acaguucccgucuugcacagcu

SEQ ID NO: 187690 - RNA, 22 nt, Human
auuuccaagguaauuuugagua

SEQ ID NO: 187691 - RNA, 17 nt, Human
uggccaggccccgccag

SEQ ID NO: 187692 - RNA, 22 nt, Human
caagaggagcaggcaggugugc

SEQ ID NO: 187693 - RNA, 22 nt, Human
uuccugagggccccagaggagg

SEQ ID NO: 187694 - RNA, 22 nt, Human
ccugcacccaggccgcaccucu

SEQ ID NO: 187695 - RNA, 22 nt, Human
acuccuggguugcaguccucaa

SEQ ID NO: 187696 - RNA, 22 nt, Human
aggcagcuuuguaguaaagcua

SEQ ID NO: 187697 - RNA, 21 nt, Human
caauuacuaugaaccaguuga

SEQ ID NO: 187698 - RNA, 22 nt, Human
uaggacagaguucccugauggc

SEQ ID NO: 187699 - RNA, 22 nt, Human
gcagugcuugcucaggcuucau

SEQ ID NO: 187700 - RNA, 22 nt, Human
ucuuucccuuagaacauuaaca

SEQ ID NO: 187701 - RNA, 22 nt, Human
agggaagcuuguuacugagaag

SEQ ID NO: 187702 - RNA, 20 nt, Human
gcacugaaauucaauguuug

SEQ ID NO: 187703 - RNA, 22 nt, Human
guccacccaugacaccugccug

SEQ ID NO: 187704 - RNA, 22 nt, Human
ccugcaggcugcaggccaguuc

SEQ ID NO: 187705 - RNA, 23 nt, Human
cagaugagguuggcagcaugguc

SEQ ID NO: 187706 - RNA, 22 nt, Human
uaggcugcucaccaggcucaga

SEQ ID NO: 187707 - RNA, 22 nt, Human
uggagcucagcgggugguuucu

SEQ ID NO: 187708 - RNA, 22 nt, Human
agggcagcccuucugggagggc

SEQ ID NO: 187709 - RNA, 22 nt, Human
gccuggcaggggccugggagug

SEQ ID NO: 187710 - RNA, 22 nt, Human
cagggcucaggcucugggauuc

SEQ ID NO: 187711 - RNA, 22 nt, Human
augcacaagaggcuagaaaaga

SEQ ID NO: 187712 - RNA, 22 nt, Human
ccucucagccggacugucaggc

SEQ ID NO: 187713 - RNA, 22 nt, Human
uugauagguuuuauguauaguu

SEQ ID NO: 187714 - RNA, 22 nt, Human
agcucccagcagagcuggccac

SEQ ID NO: 187715 - RNA, 22 nt, Human
ucuggggaugagguccagugau

SEQ ID NO: 187716 - RNA, 22 nt, Human
auggaugaguccuugagacaca

SEQ ID NO: 187717 - RNA, 22 nt, Human
uucauucccuuauauuagcauu

SEQ ID NO: 187718 - RNA, 22 nt, Human
augaggcagucuggccugaggg

SEQ ID NO: 187719 - RNA, 22 nt, Human
ucacagaagagcauuaagauga

SEQ ID NO: 187720 - RNA, 22 nt, Human
agcugggucuugggccaggaga

SEQ ID NO: 187721 - RNA, 22 nt, Human
aaccagagugacacucuacaga

SEQ ID NO: 187722 - RNA, 22 nt, Human
cagugguuuccaaacuuguucc

SEQ ID NO: 187723 - RNA, 22 nt, Human
auacuuuuaauuccuucugagu

SEQ ID NO: 187724 - RNA, 22 nt, Human
uaagaugggggaaagaaauagu

SEQ ID NO: 187725 - RNA, 22 nt, Human
agcaguccuucuuuagagagcc

SEQ ID NO: 187726 - RNA, 22 nt, Human
gucaggaaaacccggguugacu

SEQ ID NO: 187727 - RNA, 18 nt, Human
uggcaggaaaugcacuuu

SEQ ID NO: 187728 - RNA, 22 nt, Human
ccuggcucuggggcggacagcu

SEQ ID NO: 187729 - RNA, 22 nt, Human
ucccugcugcacucacaccuac

SEQ ID NO: 187730 - RNA, 22 nt, Human
gagcuuaaauggcuaaauauaa

SEQ ID NO: 187731 - RNA, 22 nt, Human
uccuggcauuuacaaacccacc

SEQ ID NO: 187732 - RNA, 22 nt, Human
augcagaaugaguucacgaucu

SEQ ID NO: 187733 - RNA, 22 nt, Human
acauugauauuucaaauacagg

SEQ ID NO: 187734 - RNA, 22 nt, Human
guucuuuaaguggagaaggaaa

SEQ ID NO: 187735 - RNA, 22 nt, Human
gucuccuguccugcaggaugga

SEQ ID NO: 187736 - RNA, 22 nt, Human
cagaagugaaugugauaaacca

SEQ ID NO: 187737 - RNA, 22 nt, Human
uaggcugacuuguuucauaaag

SEQ ID NO: 187738 - RNA, 22 nt, Human
cuuuaauucagauuugaaggga

SEQ ID NO: 187739 - RNA, 19 nt, Human
aagcuacagcccaggucug

SEQ ID NO: 187740 - RNA, 22 nt, Human
caggaaacugugggcuuaaauc

SEQ ID NO: 187741 - RNA, 22 nt, Human
aaaagccuggauacuaucauua

SEQ ID NO: 187742 - RNA, 22 nt, Human
ucccagcaggaguccaguuccc

SEQ ID NO: 187743 - RNA, 22 nt, Human
uggcucccacaaacucacuacu

SEQ ID NO: 187744 - RNA, 22 nt, Human
agccucugaugaucacaggggg

SEQ ID NO: 187745 - RNA, 22 nt, Human
ucagagcaacuuuuccugcuuu

SEQ ID NO: 187746 - RNA, 22 nt, Human
cugaggugagaggaggccaugu

SEQ ID NO: 187747 - RNA, 22 nt, Human
uuuucuuuaaucugguggggug

SEQ ID NO: 187748 - RNA, 22 nt, Human
caguuuuauacacugcagcucc

SEQ ID NO: 187749 - RNA, 22 nt, Human
acaugcaaaaauauauuuauga

SEQ ID NO: 187750 - RNA, 22 nt, Human
ugcuguaauacuuaagguuaag

SEQ ID NO: 187751 - RNA, 22 nt, Human
ucacaucuugugauguuuucau

SEQ ID NO: 187752 - RNA, 22 nt, Human
ugguaaaauauuacaaggcacu

SEQ ID NO: 187753 - RNA, 22 nt, Human
cugggcccuauggaagaaaggg

SEQ ID NO: 187754 - RNA, 22 nt, Human
gacugagguauuaagauggcuu

SEQ ID NO: 187755 - RNA, 22 nt, Human
acacaguugguggcucagucug

SEQ ID NO: 187756 - RNA, 19 nt, Human
agcuggcucuucuuugucu

SEQ ID NO: 187757 - RNA, 22 nt, Human
uuugacauuaaggaacauauau

SEQ ID NO: 187758 - RNA, 22 nt, Human
gaauuagacaugcuuugcuuuu

SEQ ID NO: 187759 - RNA, 22 nt, Human
aggaaugucugagaaagaggca

SEQ ID NO: 187760 - RNA, 22 nt, Human
caagcugcuuauucucugcucu

SEQ ID NO: 187761 - RNA, 22 nt, Human
uuagggaagcauggaggagaug

SEQ ID NO: 187762 - RNA, 20 nt, Human
cuggaguguagcaguggcug

SEQ ID NO: 187763 - RNA, 21 nt, Human
gcugugcagaggauggagugg

SEQ ID NO: 187764 - RNA, 20 nt, Human
uuucugcagauguuuacaug

SEQ ID NO: 187765 - RNA, 18 nt, Human
cccagaggaaugccugga

SEQ ID NO: 187766 - RNA, 22 nt, Human
agagcuggccagggaucacucu

SEQ ID NO: 187767 - RNA, 22 nt, Human
agacagguguuuuacaacuucg

SEQ ID NO: 187768 - RNA, 22 nt, Human
cuguccugguacuuugagguuc

SEQ ID NO: 187769 - RNA, 16 nt, Human
uggcugagagaggguu

SEQ ID NO: 187770 - RNA, 22 nt, Human
gggagcugcugaacacaagggu

SEQ ID NO: 187771 - RNA, 22 nt, Human
aaacagguagcccuagccuucu

SEQ ID NO: 187772 - RNA, 22 nt, Human
caguuucuuggaugccaauuuc

SEQ ID NO: 187773 - RNA, 22 nt, Human
ggcaggcuccagagcccucucc

SEQ ID NO: 187774 - RNA, 22 nt, Human
aacaucacaauuucauuuaugc

SEQ ID NO: 187775 - RNA, 22 nt, Human
uggggugggguuacucauucug

SEQ ID NO: 187776 - RNA, 22 nt, Human
cagcuccagcccaggcagcucc

SEQ ID NO: 187777 - RNA, 22 nt, Human
cuggcugcgucugcucugacag

SEQ ID NO: 187778 - RNA, 22 nt, Human
acagggugacuuugugacagau

SEQ ID NO: 187779 - RNA, 22 nt, Human
uaccaggaauggggucaccguc

SEQ ID NO: 187780 - RNA, 22 nt, Human
gagggggacguauccugguaug

SEQ ID NO: 187781 - RNA, 22 nt, Human
ucugucauccaggcuggaauau

SEQ ID NO: 187782 - RNA, 22 nt, Human
ccaggcacgguggcucaugccu

SEQ ID NO: 187783 - RNA, 22 nt, Human
acauuuugagaaaugacaagcu

SEQ ID NO: 187784 - RNA, 22 nt, Human
aagagacaagaauuccaacgcu

SEQ ID NO: 187785 - RNA, 23 nt, Human
ugaaauauucuuuugcaugagcu

SEQ ID NO: 187786 - RNA, 22 nt, Human
uauucauaguaaacaaaagugg

SEQ ID NO: 187787 - RNA, 22 nt, Human
ucuccacauucuauuggcuaua

SEQ ID NO: 187788 - RNA, 22 nt, Human
aaagaacaaauuagcuguuuua

SEQ ID NO: 187789 - RNA, 22 nt, Human
uggcagccucagacaaggaccu

SEQ ID NO: 187790 - RNA, 22 nt, Human
ccucuccagcggccucagggcc

SEQ ID NO: 187791 - RNA, 22 nt, Human
cagccccuuguccgguagccac

SEQ ID NO: 187792 - RNA, 22 nt, Human
gaugaugaggccaugaggcagg

SEQ ID NO: 187793 - RNA, 22 nt, Human
gaccuagauuaacauucuguga

SEQ ID NO: 187794 - RNA, 22 nt, Human
ucagugucccgucucuuaacuc

SEQ ID NO: 187795 - RNA, 22 nt, Human
acaaaaagcuccauuacugucc

SEQ ID NO: 187796 - RNA, 22 nt, Human
aggaggaaggcuucauuagguu

SEQ ID NO: 187797 - RNA, 22 nt, Human
auaugcauuuaccuggcauaua

SEQ ID NO: 187798 - RNA, 22 nt, Human
cuguuuauucucaucuaaaaug

SEQ ID NO: 187799 - RNA, 20 nt, Human
ucagagaagggacugagauu

SEQ ID NO: 187800 - RNA, 22 nt, Human
cacuugaaaaucagaggaaauu

SEQ ID NO: 187801 - RNA, 22 nt, Human
gcagugauuggaucagagaugg

SEQ ID NO: 187802 - RNA, 22 nt, Human
gagaggaagccuucuguacuug

SEQ ID NO: 187803 - RNA, 17 nt, Human
acacagccagguucucc

SEQ ID NO: 187804 - RNA, 22 nt, Human
ccuggaagucauuccucguucc

SEQ ID NO: 187805 - RNA, 22 nt, Human
gccaggaccucagaugcagggc

SEQ ID NO: 187806 - RNA, 22 nt, Human
aaaaacuguaauuacuuuugca

SEQ ID NO: 187807 - RNA, 22 nt, Human
gaaauguuuuacaaggcauacu

SEQ ID NO: 187808 - RNA, 22 nt, Human
uacaucauguaagcagaaucau

SEQ ID NO: 187809 - RNA, 22 nt, Human
acauguguaaggucucucaguc

SEQ ID NO: 187810 - RNA, 22 nt, Human
ugcuuagacgucaaguacagcc

SEQ ID NO: 187811 - RNA, 22 nt, Human
uauuuugcguugagucagauuu

SEQ ID NO: 187812 - RNA, 22 nt, Human
uucccaugccuggccccuaucc

SEQ ID NO: 187813 - RNA, 22 nt, Human
uaucagaaaucaacacacagug

SEQ ID NO: 187814 - RNA, 22 nt, Human
gaacaguauuuccaggaauccc

SEQ ID NO: 187815 - RNA, 22 nt, Human
uaucagcaggccaaagcugcaa

SEQ ID NO: 187816 - RNA, 19 nt, Human
uggcuucuggcaacagaug

SEQ ID NO: 187817 - RNA, 22 nt, Human
uugugugguagcuucauugaac

SEQ ID NO: 187818 - RNA, 22 nt, Human
cagcugugcugauugcucagua

SEQ ID NO: 187819 - RNA, 17 nt, Human
ggcaggugcggggccgc

SEQ ID NO: 187820 - RNA, 22 nt, Human
cccagccucagcuuuacuucca

SEQ ID NO: 187821 - RNA, 22 nt, Human
aaaggauuaaauaaaugugcug

SEQ ID NO: 187822 - RNA, 20 nt, Human
aguaacuuagcaacucuagg

SEQ ID NO: 187823 - RNA, 22 nt, Human
cuguacagaguucugaguguac

SEQ ID NO: 187824 - RNA, 22 nt, Human
ugguggggccagacuucagcuc

SEQ ID NO: 187825 - RNA, 22 nt, Human
gcuccuguccuuagccccagag

SEQ ID NO: 187826 - RNA, 22 nt, Human
accuaaauucuggcugauuagg

SEQ ID NO: 187827 - RNA, 22 nt, Human
uucauugagcuguacacuuagg

SEQ ID NO: 187828 - RNA, 22 nt, Human
uugguaaauguugauuguggcu

SEQ ID NO: 187829 - RNA, 21 nt, Human
accaggcuugugggagggagc

SEQ ID NO: 187830 - RNA, 22 nt, Human
gaaaggcuucuuaagcuucacu

SEQ ID NO: 187831 - RNA, 22 nt, Human
ugucugucugcacagcucaugg

SEQ ID NO: 187832 - RNA, 22 nt, Human
uucagaaguagcuaagcaguca

SEQ ID NO: 187833 - RNA, 22 nt, Human
acaaagugugcggagcccaggg

SEQ ID NO: 187834 - RNA, 22 nt, Human
ugacugaaauggcgacagugaa

SEQ ID NO: 187835 - RNA, 20 nt, Human
agccaagaacaggcagaacc

SEQ ID NO: 187836 - RNA, 22 nt, Human
guggcacagugggagagcccca

SEQ ID NO: 187837 - RNA, 22 nt, Human
gccagcugggccuuagggcugg

SEQ ID NO: 187838 - RNA, 22 nt, Human
ucugcaugaugaacaaaugagc

SEQ ID NO: 187839 - RNA, 22 nt, Human
uuguacagguuccuagggugga

SEQ ID NO: 187840 - RNA, 22 nt, Human
uuuauuggaacacagccaugac

SEQ ID NO: 187841 - RNA, 22 nt, Human
uuuggccucaugaauuucuugc

SEQ ID NO: 187842 - RNA, 22 nt, Human
ucuuucuugguauucugagcua

SEQ ID NO: 187843 - RNA, 22 nt, Human
uucuucuaaaugugcuuauuaa

SEQ ID NO: 187844 - RNA, 22 nt, Human
uauuucuucgggauucaagcua

SEQ ID NO: 187845 - RNA, 22 nt, Human
gccagccaguuugcugauggcu

SEQ ID NO: 187846 - RNA, 22 nt, Human
ugaggcagcccacuuuccuuag

SEQ ID NO: 187847 - RNA, 22 nt, Human
uacuuucaguuucagcugaagu

SEQ ID NO: 187848 - RNA, 22 nt, Human
gcagugcuaaguagcuggccca

SEQ ID NO: 187849 - RNA, 22 nt, Human
auagacauauggcuuuguuucu

SEQ ID NO: 187850 - RNA, 22 nt, Human
uagucaguagcaagguauuuug

SEQ ID NO: 187851 - RNA, 22 nt, Human
aaggaagcagcaaugcaugauu

SEQ ID NO: 187852 - RNA, 20 nt, Human
gagggcucguggauggauaa

SEQ ID NO: 187853 - RNA, 22 nt, Human
gggggcaggucuggaacuuuga

SEQ ID NO: 187854 - RNA, 22 nt, Human
ccaggcuagagugcaauggcgc

SEQ ID NO: 187855 - RNA, 22 nt, Human
cuggcuggucugagcagucgca

SEQ ID NO: 187856 - RNA, 22 nt, Human
uugaaaauaucacaggagcagc

SEQ ID NO: 187857 - RNA, 22 nt, Human
uucccucccccagccuggcagg

SEQ ID NO: 187858 - RNA, 22 nt, Human
uguugaagauaaaguucucauu

SEQ ID NO: 187859 - RNA, 22 nt, Human
auuccucagcaggccuuuuguu

SEQ ID NO: 187860 - RNA, 22 nt, Human
augucuuucuaguuaagagcua

SEQ ID NO: 187861 - RNA, 22 nt, Human
cacacuguugaggacgagaugu

SEQ ID NO: 187862 - RNA, 22 nt, Human
aaaggccacacagagcagggag

SEQ ID NO: 187863 - RNA, 18 nt, Human
gcucugguuccuucaacc

SEQ ID NO: 187864 - RNA, 22 nt, Human
auguccaagucacagauuuuca

SEQ ID NO: 187865 - RNA, 22 nt, Human
auugugcaaauauuaucuguag

SEQ ID NO: 187866 - RNA, 22 nt, Human
uuaauuuuaaccuguuuguguc

SEQ ID NO: 187867 - RNA, 22 nt, Human
uguguccuuucuaaugcccaga

SEQ ID NO: 187868 - RNA, 19 nt, Human
gccaggagggcucuggcug

SEQ ID NO: 187869 - RNA, 22 nt, Human
ucugaggcagcuugccacucua

SEQ ID NO: 187870 - RNA, 22 nt, Human
aaguuucugccauacuguggug

SEQ ID NO: 187871 - RNA, 22 nt, Human
ugcuggaacucagugaaucauu

SEQ ID NO: 187872 - RNA, 22 nt, Human
caguuuuaaauuguuagauaau

SEQ ID NO: 187873 - RNA, 17 nt, Human
aggggagagugggaaga

SEQ ID NO: 187874 - RNA, 22 nt, Human
gcuguucacggaggaggauggg

SEQ ID NO: 187875 - RNA, 22 nt, Human
aggaaauguaguccucaucucc

SEQ ID NO: 187876 - RNA, 20 nt, Human
cuccugguccaggagccuga

SEQ ID NO: 187877 - RNA, 22 nt, Human
cugcauuagucaugcuuugcag

SEQ ID NO: 187878 - RNA, 22 nt, Human
auuauuaaagcuuaggucuuau

SEQ ID NO: 187879 - RNA, 22 nt, Human
gugagucuguggaccgggcacu

SEQ ID NO: 187880 - RNA, 22 nt, Human
agcugccagcaucccggaaggg

SEQ ID NO: 187881 - RNA, 22 nt, Human
gaaagugcuuagagugugguau

SEQ ID NO: 187882 - RNA, 22 nt, Human
ggcuagggagacagagggcaug

SEQ ID NO: 187883 - RNA, 22 nt, Human
aacccgggaggcagagguugug

SEQ ID NO: 187884 - RNA, 22 nt, Human
ccaucuccaaauaccaucacau

SEQ ID NO: 187885 - RNA, 22 nt, Human
guaaaauucuagcaucugaaag

SEQ ID NO: 187886 - RNA, 22 nt, Human
aaccaaagaaaacuguggugag

SEQ ID NO: 187887 - RNA, 22 nt, Human
cuggaggaauaauggcaucuug

SEQ ID NO: 187888 - RNA, 22 nt, Human
cuuggcauguucaucugcuugg

SEQ ID NO: 187889 - RNA, 22 nt, Human
aagucucugguugcuugcaugg

SEQ ID NO: 187890 - RNA, 16 nt, Human
cuacccagugagaagg

SEQ ID NO: 187891 - RNA, 22 nt, Human
gagucaggaguccugugugaga

SEQ ID NO: 187892 - RNA, 22 nt, Human
uauugguagauggagagagaca

SEQ ID NO: 187893 - RNA, 22 nt, Human
gcccagucucuucuggcccugu

SEQ ID NO: 187894 - RNA, 22 nt, Human
uagaaucugauggcccgucugg

SEQ ID NO: 187895 - RNA, 22 nt, Human
uagaagauucauuuccucugaa

SEQ ID NO: 187896 - RNA, 22 nt, Human
cuacccuugccugccaggugac

SEQ ID NO: 187897 - RNA, 22 nt, Human
uuacagagccucauuuuagaga

SEQ ID NO: 187898 - RNA, 22 nt, Human
ugauuuacuucccagcuggguu

SEQ ID NO: 187899 - RNA, 23 nt, Human
aagguauuuauuuuaaagguaag

SEQ ID NO: 187900 - RNA, 22 nt, Human
cacuggaauauggcguugaacc

SEQ ID NO: 187901 - RNA, 22 nt, Human
aaguaaaauucaaucuucacug

SEQ ID NO: 187902 - RNA, 22 nt, Human
gcugccucugcgacucugggcg

SEQ ID NO: 187903 - RNA, 22 nt, Human
gggcagucacagugcuggagca

SEQ ID NO: 187904 - RNA, 22 nt, Human
uuuggagagcagcuaggcccuu

SEQ ID NO: 187905 - RNA, 22 nt, Human
acacacaauuaguuuuaugcuu

SEQ ID NO: 187906 - RNA, 22 nt, Human
ccugaggcccuggcugugcuga

SEQ ID NO: 187907 - RNA, 22 nt, Human
cuauuuuaagaggccauuaggu

SEQ ID NO: 187908 - RNA, 22 nt, Human
ucuacauuuuaacaagaugccc

SEQ ID NO: 187909 - RNA, 22 nt, Human
ccucagaguuauuugaagugaa

SEQ ID NO: 187910 - RNA, 22 nt, Human
uaaacagccuaaaacuuucuuu

SEQ ID NO: 187911 - RNA, 22 nt, Human
caucacagaaauaaacauaccu

SEQ ID NO: 187912 - RNA, 22 nt, Human
acaauagaguucucauaggaca

SEQ ID NO: 187913 - RNA, 22 nt, Human
uauuaaguaucuugaugacaaa

SEQ ID NO: 187914 - RNA, 22 nt, Human
ucugcaggacugaggccuguuu

SEQ ID NO: 187915 - RNA, 22 nt, Human
gccagacacuccccugggcagg

SEQ ID NO: 187916 - RNA, 19 nt, Human
ugggaguggggaagguccu

SEQ ID NO: 187917 - RNA, 22 nt, Human
aagugccccaggcuguuaacau

SEQ ID NO: 187918 - RNA, 23 nt, Human
uacuacagggucuugcuaugaau

SEQ ID NO: 187919 - RNA, 22 nt, Human
cagcuuuccccgugccucagcc

SEQ ID NO: 187920 - RNA, 22 nt, Human
uuucacaugguacugccuguuu

SEQ ID NO: 187921 - RNA, 22 nt, Human
ggaggucaaauggagggcuggg

SEQ ID NO: 187922 - RNA, 22 nt, Human
gucuggcucaguccuagcugua

SEQ ID NO: 187923 - RNA, 22 nt, Human
cuccugugcaccuccagcggca

SEQ ID NO: 187924 - RNA, 22 nt, Human
ggcucaggggccaggccugucc

SEQ ID NO: 187925 - RNA, 22 nt, Human
aguguucucagcuacuagagag

SEQ ID NO: 187926 - RNA, 22 nt, Human
accagcaagauuuugcuuugca

SEQ ID NO: 187927 - RNA, 22 nt, Human
ugccuggcaaugccagaagcca

SEQ ID NO: 187928 - RNA, 22 nt, Human
cagguuuacaaaguaaagugug

SEQ ID NO: 187929 - RNA, 22 nt, Human
uccagaccauggauggcugcaa

SEQ ID NO: 187930 - RNA, 22 nt, Human
cauuugugcuuuuauaaaauag

SEQ ID NO: 187931 - RNA, 22 nt, Human
ccuacauucucugaguuuuccu

SEQ ID NO: 187932 - RNA, 22 nt, Human
cauucaaaggcauguccuauuu

SEQ ID NO: 187933 - RNA, 22 nt, Human
cucagauaaucuuugagucuuc

SEQ ID NO: 187934 - RNA, 21 nt, Human
ugcaggcaggcagagaugcug

SEQ ID NO: 187935 - RNA, 18 nt, Human
ggacccagggccucaccc

SEQ ID NO: 187936 - RNA, 20 nt, Human
aggaaaaggguggugguaga

SEQ ID NO: 187937 - RNA, 22 nt, Human
acagcuuugggcaaugcuauga

SEQ ID NO: 187938 - RNA, 22 nt, Human
agagcagcucgcuaccucucua

SEQ ID NO: 187939 - RNA, 22 nt, Human
agccacaggccaugagauacca

SEQ ID NO: 187940 - RNA, 21 nt, Human
ucacuagugccuucugucauu

SEQ ID NO: 187941 - RNA, 18 nt, Human
gccugcucugcucucccc

SEQ ID NO: 187942 - RNA, 22 nt, Human
aacuucugaccucaagaacugu

SEQ ID NO: 187943 - RNA, 22 nt, Human
gaauuguauugauuuuucagag

SEQ ID NO: 187944 - RNA, 22 nt, Human
gaggaguggaguugcuggguug

SEQ ID NO: 187945 - RNA, 22 nt, Human
uucuggaaguuggaaauagcag

SEQ ID NO: 187946 - RNA, 22 nt, Human
cgccugcucucacuggacagcu

SEQ ID NO: 187947 - RNA, 17 nt, Human
gagccacccugugcgag

SEQ ID NO: 187948 - RNA, 22 nt, Human
ccagaggagggcucugaugagg

SEQ ID NO: 187949 - RNA, 22 nt, Human
auguucuuguucaaaugucagu

SEQ ID NO: 187950 - RNA, 22 nt, Human
ucaaaggaauuugauuuugaug

SEQ ID NO: 187951 - RNA, 22 nt, Human
agaggagugggaagcagugcaa

SEQ ID NO: 187952 - RNA, 21 nt, Human
agacaugugaacuaaagguga

SEQ ID NO: 187953 - RNA, 22 nt, Human
uuuccucacucaugucaucagu

SEQ ID NO: 187954 - RNA, 18 nt, Human
aauuucuuugacaacuua

SEQ ID NO: 187955 - RNA, 22 nt, Human
aaggagcucccggcagaccagg

SEQ ID NO: 187956 - RNA, 22 nt, Human
caagacuuagagcaucuugaaa

SEQ ID NO: 187957 - RNA, 22 nt, Human
uguuaacagguaacugaggcug

SEQ ID NO: 187958 - RNA, 22 nt, Human
gccuccugagaagccacaggcu

SEQ ID NO: 187959 - RNA, 20 nt, Human
ucccaagggcugagaggauc

SEQ ID NO: 187960 - RNA, 22 nt, Human
auucuucacaaauauauagaag

SEQ ID NO: 187961 - RNA, 22 nt, Human
cuucacagucuuuauuuccucc

SEQ ID NO: 187962 - RNA, 22 nt, Human
ugagcaguaacagcucacaggg

SEQ ID NO: 187963 - RNA, 23 nt, Human
ccucccaggcugcgagucccgag

SEQ ID NO: 187964 - RNA, 22 nt, Human
aacagagcugaccagugagggc

SEQ ID NO: 187965 - RNA, 22 nt, Human
ugaggcuccagccaggccagca

SEQ ID NO: 187966 - RNA, 22 nt, Human
gccuuggaaagcuggagcaguu

SEQ ID NO: 187967 - RNA, 17 nt, Human
aggaagggcaaguuucu

SEQ ID NO: 187968 - RNA, 22 nt, Human
uuacaguuguucuaucagcaug

SEQ ID NO: 187969 - RNA, 23 nt, Human
ugccagcagggaaugggaaggac

SEQ ID NO: 187970 - RNA, 22 nt, Human
gcgagugccgagagggcagggc

SEQ ID NO: 187971 - RNA, 22 nt, Human
aucuagguuuggaagauagagu

SEQ ID NO: 187972 - RNA, 22 nt, Human
ugaggacauuaggaagugaagg

SEQ ID NO: 187973 - RNA, 16 nt, Human
aauugcuucuugcugc

SEQ ID NO: 187974 - RNA, 22 nt, Human
ugguuuaccccuguccuauauc

SEQ ID NO: 187975 - RNA, 20 nt, Human
ccucugccuuucuagucuga

SEQ ID NO: 187976 - RNA, 22 nt, Human
uuaggaaucaccugcagaucuu

SEQ ID NO: 187977 - RNA, 22 nt, Human
aaagcugcccagcugccuguuu

SEQ ID NO: 187978 - RNA, 22 nt, Human
augcauauugucauuuaguccu

SEQ ID NO: 187979 - RNA, 22 nt, Human
aagaguuuucucugauggcauu

SEQ ID NO: 187980 - RNA, 22 nt, Human
cuugaaauccagauuucagagg

SEQ ID NO: 187981 - RNA, 22 nt, Human
agguccugaugaucucugagag

SEQ ID NO: 187982 - RNA, 22 nt, Human
cucagagggaggacugggcugg

SEQ ID NO: 187983 - RNA, 22 nt, Human
uauugcugcuauugucaguuca

SEQ ID NO: 187984 - RNA, 22 nt, Human
cuggggaaggcggugacugcgc

SEQ ID NO: 187985 - RNA, 23 nt, Human
agggccucugucccccagcacuc

SEQ ID NO: 187986 - RNA, 22 nt, Human
uggguccugucuccuuguucug

SEQ ID NO: 187987 - RNA, 22 nt, Human
agcaucugugauauuuuguuau

SEQ ID NO: 187988 - RNA, 22 nt, Human
gcucuagcccauuuccugcuug

SEQ ID NO: 187989 - RNA, 22 nt, Human
caugugucuuuauggagccaca

SEQ ID NO: 187990 - RNA, 22 nt, Human
gaauuacaugacccugaguaga

SEQ ID NO: 187991 - RNA, 22 nt, Human
aaggcaguaggaucuuccacag

SEQ ID NO: 187992 - RNA, 22 nt, Human
cacugguacguagguuggggca

SEQ ID NO: 187993 - RNA, 22 nt, Human
ugccacccuggcggcagccugc

SEQ ID NO: 187994 - RNA, 22 nt, Human
guuuaauucccacaccugcccu

SEQ ID NO: 187995 - RNA, 22 nt, Human
aggcuucuccuuccuaccuucc

SEQ ID NO: 187996 - RNA, 22 nt, Human
cagcacuuuagcggaggcauca

SEQ ID NO: 187997 - RNA, 22 nt, Human
uucagcaaauggcuugagauaa

SEQ ID NO: 187998 - RNA, 22 nt, Human
cuaggcagacugagcucuaggg

SEQ ID NO: 187999 - RNA, 22 nt, Human
uauguucaucuggugcaucagu

SEQ ID NO: 188000 - RNA, 22 nt, Human
uuagaaacuuuggaggauagau

SEQ ID NO: 188001 - RNA, 22 nt, Human
gaaaaugugucaucccuacugu

SEQ ID NO: 188002 - RNA, 22 nt, Human
aggugacugguuuaucuggcag

SEQ ID NO: 188003 - RNA, 22 nt, Human
uacaggcuagggagagugacug

SEQ ID NO: 188004 - RNA, 22 nt, Human
cagagacauucuccccauugga

SEQ ID NO: 188005 - RNA, 22 nt, Human
ugccuaguaggguuguuguagg

SEQ ID NO: 188006 - RNA, 22 nt, Human
ggaaggaagugcagacuuuaaa

SEQ ID NO: 188007 - RNA, 22 nt, Human
uauuucuuuucgugacuuauug

SEQ ID NO: 188008 - RNA, 22 nt, Human
guggccuggcuggcaccaccuc

SEQ ID NO: 188009 - RNA, 22 nt, Human
cuuaauaaaugguagcuguuau

SEQ ID NO: 188010 - RNA, 22 nt, Human
agaguuuggugaagcaauuuga

SEQ ID NO: 188011 - RNA, 22 nt, Human
ggcaggcucagcagccaaggag

SEQ ID NO: 188012 - RNA, 22 nt, Human
uugagacacaaggcacaguaag

SEQ ID NO: 188013 - RNA, 22 nt, Human
uccuucuccuccuugagugaca

SEQ ID NO: 188014 - RNA, 22 nt, Human
gaccacagguaugggcuuggca

SEQ ID NO: 188015 - RNA, 22 nt, Human
cucuggucaagcaaagagguuu

SEQ ID NO: 188016 - RNA, 22 nt, Human
aaggcaguuugggccaccaucu

SEQ ID NO: 188017 - RNA, 22 nt, Human
acugucacuccaacugagucgu

SEQ ID NO: 188018 - RNA, 22 nt, Human
ggaaacacaugaucagacaucu

SEQ ID NO: 188019 - RNA, 22 nt, Human
agcuguguguuuccacugagcu

SEQ ID NO: 188020 - RNA, 22 nt, Human
agggccucugagccaguucugg

SEQ ID NO: 188021 - RNA, 21 nt, Human
uuucacaaaaguaugugacaa

SEQ ID NO: 188022 - RNA, 22 nt, Human
cuuuggaggucauagccaagag

SEQ ID NO: 188023 - RNA, 20 nt, Human
uuacucauaggaccacaagc

SEQ ID NO: 188024 - RNA, 22 nt, Human
aggagcuggccacuaggaugca

SEQ ID NO: 188025 - RNA, 22 nt, Human
gguggcagcgucuaucugacau

SEQ ID NO: 188026 - RNA, 22 nt, Human
acuaaaugcauugguaucuauu

SEQ ID NO: 188027 - RNA, 22 nt, Human
uagggcuguuaguaauucucag

SEQ ID NO: 188028 - RNA, 22 nt, Human
agcaacaggaccauggagccca

SEQ ID NO: 188029 - RNA, 20 nt, Human
gcagggcaucuuggccccca

SEQ ID NO: 188030 - RNA, 22 nt, Human
ggagaagggaacugaguuuuug

SEQ ID NO: 188031 - RNA, 22 nt, Human
uugaaaguccuucuugaguuac

SEQ ID NO: 188032 - RNA, 22 nt, Human
gguggcaggcccugagcauccc

SEQ ID NO: 188033 - RNA, 22 nt, Human
gcagugcauuacucacauguuu

SEQ ID NO: 188034 - RNA, 22 nt, Human
cugcagagcaugaggaggucug

SEQ ID NO: 188035 - RNA, 22 nt, Human
cugccaggggccucacaggcca

SEQ ID NO: 188036 - RNA, 22 nt, Human
uuuagugugacaguccccagua

SEQ ID NO: 188037 - RNA, 22 nt, Human
ggucagagggugggcugccugu

SEQ ID NO: 188038 - RNA, 22 nt, Human
augcagaagcagaacuuacaca

SEQ ID NO: 188039 - RNA, 22 nt, Human
ccagagcagauguggccuuggu

SEQ ID NO: 188040 - RNA, 22 nt, Human
ggauagugggagaaugcuaugu

SEQ ID NO: 188041 - RNA, 22 nt, Human
auuacuagauugucaagauuua

SEQ ID NO: 188042 - RNA, 22 nt, Human
ugcaguggaagagguggagauc

SEQ ID NO: 188043 - RNA, 22 nt, Human
uauguagguaaacacagacaua

SEQ ID NO: 188044 - RNA, 22 nt, Human
uugcucaggcuggugugcagug

SEQ ID NO: 188045 - RNA, 21 nt, Human
ucuggcagcaguuuguugagu

SEQ ID NO: 188046 - RNA, 22 nt, Human
cagagcacagagcuugggacaa

SEQ ID NO: 188047 - RNA, 20 nt, Human
gagugggccauggagugaga

SEQ ID NO: 188048 - RNA, 19 nt, Human
ccucucccaugcuuaccuc

SEQ ID NO: 188049 - RNA, 22 nt, Human
aggaggugcguggugauccccu

SEQ ID NO: 188050 - RNA, 18 nt, Human
gagcucugccucccaguc

SEQ ID NO: 188051 - RNA, 22 nt, Human
ugccagugaaacauggaagaau

SEQ ID NO: 188052 - RNA, 22 nt, Human
auagccuugacucacagcucuu

SEQ ID NO: 188053 - RNA, 22 nt, Human
gcccugcucauuucacguguuu

SEQ ID NO: 188054 - RNA, 22 nt, Human
accuguuuacccugggcucccc

SEQ ID NO: 188055 - RNA, 22 nt, Human
ucuggcaggauaucgaagugaa

SEQ ID NO: 188056 - RNA, 21 nt, Human
uacaacagguuuuauuucgau

SEQ ID NO: 188057 - RNA, 22 nt, Human
aucagaagaaauggaugugacu

SEQ ID NO: 188058 - RNA, 21 nt, Human
aggagcucuccaaggacaaag

SEQ ID NO: 188059 - RNA, 22 nt, Human
gcuccaggagcucacagcucgc

SEQ ID NO: 188060 - RNA, 22 nt, Human
ugcuuucuccugucugaaagau

SEQ ID NO: 188061 - RNA, 23 nt, Human
ugguggggucuuggagacagcac

SEQ ID NO: 188062 - RNA, 22 nt, Human
auuugcuucauagaucugugga

SEQ ID NO: 188063 - RNA, 22 nt, Human
uggaggcaugacagugucugga

SEQ ID NO: 188064 - RNA, 19 nt, Human
uucacauuggaagaaguag

SEQ ID NO: 188065 - RNA, 22 nt, Human
acugagcacuugguauauuucc

SEQ ID NO: 188066 - RNA, 22 nt, Human
uccuguggaagacaguguuggg

SEQ ID NO: 188067 - RNA, 22 nt, Human
agggaagaaaauccaucgcugc

SEQ ID NO: 188068 - RNA, 22 nt, Human
ucucauugcacaaugcagagug

SEQ ID NO: 188069 - RNA, 22 nt, Human
gagguggcacugugaggagcac

SEQ ID NO: 188070 - RNA, 17 nt, Human
ucauuucaguaaaucca

SEQ ID NO: 188071 - RNA, 22 nt, Human
uauccauuaggucuauggucaa

SEQ ID NO: 188072 - RNA, 22 nt, Human
guccauggcagagcccuucugc

SEQ ID NO: 188073 - RNA, 22 nt, Human
gauuuauuuuuaaucagcaggg

SEQ ID NO: 188074 - RNA, 22 nt, Human
cagcuggggagagacauggcag

SEQ ID NO: 188075 - RNA, 22 nt, Human
guucugcugugucucagcaggu

SEQ ID NO: 188076 - RNA, 22 nt, Human
gccuggaggggacagucucugg

SEQ ID NO: 188077 - RNA, 22 nt, Human
gaagacaauucuggguggagga

SEQ ID NO: 188078 - RNA, 23 nt, Human
acaugauacacaauuagcaaacc

SEQ ID NO: 188079 - RNA, 22 nt, Human
aaauugcugaccaaguauauuc

SEQ ID NO: 188080 - RNA, 22 nt, Human
uggcuucagagacagaaucuau

SEQ ID NO: 188081 - RNA, 22 nt, Human
cugagcagcaauugcuggccca

SEQ ID NO: 188082 - RNA, 22 nt, Human
aggccacagguggaagccagag

SEQ ID NO: 188083 - RNA, 20 nt, Human
uggguccugcuucuuccuga

SEQ ID NO: 188084 - RNA, 22 nt, Human
uagaaauaaaucugcagcuggg

SEQ ID NO: 188085 - RNA, 22 nt, Human
caggcagccaggggaccugucc

SEQ ID NO: 188086 - RNA, 22 nt, Human
cugggagaggaaccucgagggu

SEQ ID NO: 188087 - RNA, 22 nt, Human
ucaaaacacuauuaccuuuaau

SEQ ID NO: 188088 - RNA, 22 nt, Human
ugaggcagcaauugauuauuca

SEQ ID NO: 188089 - RNA, 22 nt, Human
aacaguuucaguuacugaugag

SEQ ID NO: 188090 - RNA, 22 nt, Human
uccugggaaguggcuggcugag

SEQ ID NO: 188091 - RNA, 22 nt, Human
uccucuguggaccgggcuuugg

SEQ ID NO: 188092 - RNA, 22 nt, Human
gcagaugggagccccaggggag

SEQ ID NO: 188093 - RNA, 22 nt, Human
gaggcugacggcaccaucuucu

SEQ ID NO: 188094 - RNA, 20 nt, Human
gcuggcagaugucuugagau

SEQ ID NO: 188095 - RNA, 22 nt, Human
cagugucuacaguggcuggagg

SEQ ID NO: 188096 - RNA, 22 nt, Human
ucucuguagcagcuuccuuccu

SEQ ID NO: 188097 - RNA, 22 nt, Human
gggagcuggccuacuauuagau

SEQ ID NO: 188098 - RNA, 15 nt, Human
gcccucaggcgacac

SEQ ID NO: 188099 - RNA, 22 nt, Human
gagcugcacuggggguggaaug

SEQ ID NO: 188100 - RNA, 22 nt, Human
aauaauuuccagccaacuggaa

SEQ ID NO: 188101 - RNA, 22 nt, Human
uuacucugaauguuucuacuga

SEQ ID NO: 188102 - RNA, 22 nt, Human
aggcucuggaguuagccaggca

SEQ ID NO: 188103 - RNA, 22 nt, Human
agaucuuuagugaagcuaaauc

SEQ ID NO: 188104 - RNA, 22 nt, Human
gcucagggaguuucacagugua

SEQ ID NO: 188105 - RNA, 22 nt, Human
cucagagagguugaacaacuug

SEQ ID NO: 188106 - RNA, 22 nt, Human
agcugaggccugauuucgccgu

SEQ ID NO: 188107 - RNA, 22 nt, Human
ccucuguaagccuuagucuaga

SEQ ID NO: 188108 - RNA, 22 nt, Human
gccuggacaccgcccuugcaga

SEQ ID NO: 188109 - RNA, 22 nt, Human
agcaccuggauuugauagucag

SEQ ID NO: 188110 - RNA, 22 nt, Human
agacagacagagaauuuaaaua

SEQ ID NO: 188111 - RNA, 22 nt, Human
gcauguguuauuucucuguggg

SEQ ID NO: 188112 - RNA, 22 nt, Human
acucagaggaccaaaaggaaag

SEQ ID NO: 188113 - RNA, 22 nt, Human
gccuggagaauuaaaaggaagg

SEQ ID NO: 188114 - RNA, 22 nt, Human
gcuggcagaagagcugguucaa

SEQ ID NO: 188115 - RNA, 22 nt, Human
uucuaaauuuuggaagaugcag

SEQ ID NO: 188116 - RNA, 22 nt, Human
cugcuguccaggagugcccugu

SEQ ID NO: 188117 - RNA, 22 nt, Human
auguucuuggauguuguguaua

SEQ ID NO: 188118 - RNA, 22 nt, Human
ugccuggcaccccagucugcac

SEQ ID NO: 188119 - RNA, 22 nt, Human
cacagcugcccuacuccaugug

SEQ ID NO: 188120 - RNA, 22 nt, Human
gcugcaggcagaaucucccaau

SEQ ID NO: 188121 - RNA, 22 nt, Human
gcacccagaauaaggacaggac

SEQ ID NO: 188122 - RNA, 22 nt, Human
aaguaacacauguuacuucugc

SEQ ID NO: 188123 - RNA, 22 nt, Human
uugagggagaaagcugaggugu

SEQ ID NO: 188124 - RNA, 22 nt, Human
agcuguguaagucauguaggug

SEQ ID NO: 188125 - RNA, 22 nt, Human
aucucaggugaaacuucuaggu

SEQ ID NO: 188126 - RNA, 22 nt, Human
gcacagccggaccgaggaaaag

SEQ ID NO: 188127 - RNA, 22 nt, Human
aggcuguguuuccccuggagcu

SEQ ID NO: 188128 - RNA, 22 nt, Human
ugccagccagggaagcucaccc

SEQ ID NO: 188129 - RNA, 22 nt, Human
ugaggcaauguccuucauccuu

SEQ ID NO: 188130 - RNA, 22 nt, Human
aaggcuuuuaacuacuguuuua

SEQ ID NO: 188131 - RNA, 22 nt, Human
aaagcagggaugaggcuagagg

SEQ ID NO: 188132 - RNA, 21 nt, Human
uggcagagugcagucuauaca

SEQ ID NO: 188133 - RNA, 22 nt, Human
gagcucccuggagguucagaua

SEQ ID NO: 188134 - RNA, 21 nt, Human
cuggaggcagguggugccagg

SEQ ID NO: 188135 - RNA, 22 nt, Human
aagccaagugcuggccaugggc

SEQ ID NO: 188136 - RNA, 22 nt, Human
uggguggauuaggauaggguau

SEQ ID NO: 188137 - RNA, 22 nt, Human
accagaggcucugccaccucca

SEQ ID NO: 188138 - RNA, 22 nt, Human
gucuuacccacagcaucuagaa

SEQ ID NO: 188139 - RNA, 22 nt, Human
gccaggcuggggggagaugucu

SEQ ID NO: 188140 - RNA, 22 nt, Human
uucugaauccucgaaacauagc

SEQ ID NO: 188141 - RNA, 22 nt, Human
uuguaacagguacuaaauaacu

SEQ ID NO: 188142 - RNA, 22 nt, Human
aggcucugggcucuagauuuug

SEQ ID NO: 188143 - RNA, 22 nt, Human
uaacagaaauauuuccagguga

SEQ ID NO: 188144 - RNA, 22 nt, Human
acauucccaccaacaguguaaa

SEQ ID NO: 188145 - RNA, 22 nt, Human
cugggcuccacucccacagugu

SEQ ID NO: 188146 - RNA, 22 nt, Human
gagcugggccucagaacacagu

SEQ ID NO: 188147 - RNA, 22 nt, Human
acugggcuuauuucuugugaac

SEQ ID NO: 188148 - RNA, 20 nt, Human
ccuccaggcacacccaugug

SEQ ID NO: 188149 - RNA, 22 nt, Human
guugggaaggugaacaugaugc

SEQ ID NO: 188150 - RNA, 22 nt, Human
augggaaguguuagaagauuuu

SEQ ID NO: 188151 - RNA, 20 nt, Human
agucugucaauuuacagugg

SEQ ID NO: 188152 - RNA, 22 nt, Human
uuacauucauugaagugauuca

SEQ ID NO: 188153 - RNA, 22 nt, Human
agucuccacuugacaucagcag

SEQ ID NO: 188154 - RNA, 22 nt, Human
gucauuuuaugggaacagauuu

SEQ ID NO: 188155 - RNA, 22 nt, Human
agcaggucgccgaagauagcuc

SEQ ID NO: 188156 - RNA, 22 nt, Human
gacagcugcucccguuucugcu

SEQ ID NO: 188157 - RNA, 22 nt, Human
uaggcuguaagagagggcagag

SEQ ID NO: 188158 - RNA, 22 nt, Human
gcugccugguuucucagcugca

SEQ ID NO: 188159 - RNA, 22 nt, Human
cagcagagcauuugguaggagg

SEQ ID NO: 188160 - RNA, 22 nt, Human
gggcaggucugggucagccuga

SEQ ID NO: 188161 - RNA, 22 nt, Human
uucugagggaaccuuguucuug

SEQ ID NO: 188162 - RNA, 22 nt, Human
gaggaagggcugccugccgggc

SEQ ID NO: 188163 - RNA, 22 nt, Human
ugggcuccuugggagcaaguga

SEQ ID NO: 188164 - RNA, 22 nt, Human
gauaauuuaagucuugggggcu

SEQ ID NO: 188165 - RNA, 22 nt, Human
uuuguuaauucuuauguuagag

SEQ ID NO: 188166 - RNA, 22 nt, Human
uaaaauguuugcaagagaccag

SEQ ID NO: 188167 - RNA, 22 nt, Human
aggaagccugcaggugacugcu

SEQ ID NO: 188168 - RNA, 23 nt, Human
uuucaaauuacucugcagaugac

SEQ ID NO: 188169 - RNA, 22 nt, Human
uuggcucugauggggaucagga

SEQ ID NO: 188170 - RNA, 17 nt, Human
aaggagcugagagaugg

SEQ ID NO: 188171 - RNA, 22 nt, Human
ucaggcuugucucuagagcaau

SEQ ID NO: 188172 - RNA, 22 nt, Human
auggcuugcagagaaaagaggu

SEQ ID NO: 188173 - RNA, 22 nt, Human
uacacaugcauguacuccagga

SEQ ID NO: 188174 - RNA, 22 nt, Human
ucacagacucaagggcauagga

SEQ ID NO: 188175 - RNA, 22 nt, Human
agcgcuggcuggcgcuccuucc

SEQ ID NO: 188176 - RNA, 22 nt, Human
acaguacaccacuguguacagu

SEQ ID NO: 188177 - RNA, 22 nt, Human
gcaaauguuuuugaguguuuac

SEQ ID NO: 188178 - RNA, 22 nt, Human
ugaggcagggaguuuaauuguc

SEQ ID NO: 188179 - RNA, 22 nt, Human
uggacaaaugauuucuaccuuu

SEQ ID NO: 188180 - RNA, 22 nt, Human
ucaggaaggcuucacacgagug

SEQ ID NO: 188181 - RNA, 22 nt, Human
cuuucuaguugacagcaugcca

SEQ ID NO: 188182 - RNA, 22 nt, Human
uugauacagcagccugugaucc

SEQ ID NO: 188183 - RNA, 22 nt, Human
ucccaaggauaagagagucuga

SEQ ID NO: 188184 - RNA, 22 nt, Human
caacauuauauagccacaugcc

SEQ ID NO: 188185 - RNA, 22 nt, Human
agaugcugucacacacacuguu

SEQ ID NO: 188186 - RNA, 22 nt, Human
agagaaaguaaagauucuaccu

SEQ ID NO: 188187 - RNA, 22 nt, Human
caagaggcaaauugucuagaag

SEQ ID NO: 188188 - RNA, 19 nt, Human
cccagccaggucuugcauc

SEQ ID NO: 188189 - RNA, 22 nt, Human
cuccccaccuucgcggucccug

SEQ ID NO: 188190 - RNA, 21 nt, Human
gugcacaguccugcacacagg

SEQ ID NO: 188191 - RNA, 22 nt, Human
aauuagggaaaacauuugcuuu

SEQ ID NO: 188192 - RNA, 22 nt, Human
acaguacagugcagaggaagau

SEQ ID NO: 188193 - RNA, 22 nt, Human
ugacugugccuguugaaugaau

SEQ ID NO: 188194 - RNA, 23 nt, Human
uguaaaaugggguaguguuacca

SEQ ID NO: 188195 - RNA, 22 nt, Human
auagucuuagaucagauaaagu

SEQ ID NO: 188196 - RNA, 22 nt, Human
ucuauaaauuaugcagucucag

SEQ ID NO: 188197 - RNA, 22 nt, Human
gaaggaggugucaguuggacug

SEQ ID NO: 188198 - RNA, 22 nt, Human
uccccagucccggcggugggug

SEQ ID NO: 188199 - RNA, 22 nt, Human
aggcaagcugcagagaguccuu

SEQ ID NO: 188200 - RNA, 22 nt, Human
ggcacagcccucucuguggaca

SEQ ID NO: 188201 - RNA, 22 nt, Human
guccagccugaagagugggggc

SEQ ID NO: 188202 - RNA, 22 nt, Human
acacaugaaucacugguggaag

SEQ ID NO: 188203 - RNA, 22 nt, Human
ugucucugagaugacucccacc

SEQ ID NO: 188204 - RNA, 22 nt, Human
uaacuguuuuugaaauauaucu

SEQ ID NO: 188205 - RNA, 22 nt, Human
ugucacaugaagccaacauagc

SEQ ID NO: 188206 - RNA, 22 nt, Human
uguuacagaaaguuuaugaaug

SEQ ID NO: 188207 - RNA, 22 nt, Human
ggggaccuggccacccauccuu

SEQ ID NO: 188208 - RNA, 22 nt, Human
ucuauguuagagauacauccua

SEQ ID NO: 188209 - RNA, 22 nt, Human
ccaucagagggcugcucugcaa

SEQ ID NO: 188210 - RNA, 22 nt, Human
ucugugugcccaccugacaccu

SEQ ID NO: 188211 - RNA, 22 nt, Human
gaacugaaacuugguuuaaagc

SEQ ID NO: 188212 - RNA, 22 nt, Human
ugggcaggggcccugcuuccgu

SEQ ID NO: 188213 - RNA, 22 nt, Human
cugagcugguguuucaggguca

SEQ ID NO: 188214 - RNA, 22 nt, Human
auggcagcccacgauggcaaug

SEQ ID NO: 188215 - RNA, 22 nt, Human
aacauucaaguucugguuuaug

SEQ ID NO: 188216 - RNA, 22 nt, Human
auggcagauccacaguuugaag

SEQ ID NO: 188217 - RNA, 22 nt, Human
ucucauugaaaugugacugagu

SEQ ID NO: 188218 - RNA, 22 nt, Human
uugaauuuagauuguauguuga

SEQ ID NO: 188219 - RNA, 22 nt, Human
uccugcaggccuguucccagua

SEQ ID NO: 188220 - RNA, 23 nt, Human
acauaaacagaaggugugcuucc

SEQ ID NO: 188221 - RNA, 22 nt, Human
ugggcagccaucccagccucuc

SEQ ID NO: 188222 - RNA, 22 nt, Human
cauaacauugagcagcauuccu

SEQ ID NO: 188223 - RNA, 18 nt, Human
cuccuccacagccccugc

SEQ ID NO: 188224 - RNA, 22 nt, Human
agugcauguccaguaguuuaug

SEQ ID NO: 188225 - RNA, 22 nt, Human
gcccugagcacacaguagcaaa

SEQ ID NO: 188226 - RNA, 22 nt, Human
aacuagaaccacuuguauuucc

SEQ ID NO: 188227 - RNA, 22 nt, Human
acucuacuguaguaugggcacu

SEQ ID NO: 188228 - RNA, 22 nt, Human
aacucuagugcuccuuggagga

SEQ ID NO: 188229 - RNA, 22 nt, Human
gaauacauguguguauagaggu

SEQ ID NO: 188230 - RNA, 22 nt, Human
cuggagcucagcccagguucca

SEQ ID NO: 188231 - RNA, 22 nt, Human
agccacugucugaacuucugug

SEQ ID NO: 188232 - RNA, 22 nt, Human
agcaggugaugugagucuggaa

SEQ ID NO: 188233 - RNA, 19 nt, Human
ggcauccacgaaugcagag

SEQ ID NO: 188234 - RNA, 22 nt, Human
aucaauaucagaucagacagga

SEQ ID NO: 188235 - RNA, 23 nt, Human
uccaggacccugguagacacaca

SEQ ID NO: 188236 - RNA, 22 nt, Human
ucaguaucaggcuggaauuaag

SEQ ID NO: 188237 - RNA, 22 nt, Human
uuaaaauuauggcccauuugga

SEQ ID NO: 188238 - RNA, 22 nt, Human
gaggagcucaugaaagcggugu

SEQ ID NO: 188239 - RNA, 22 nt, Human
auggcugcaucauccugguuga

SEQ ID NO: 188240 - RNA, 22 nt, Human
ugagucucccagcguuaaaccu

SEQ ID NO: 188241 - RNA, 20 nt, Human
aggugcaaggcauggcaugu

SEQ ID NO: 188242 - RNA, 21 nt, Human
acagaugggaugagcacacug

SEQ ID NO: 188243 - RNA, 22 nt, Human
aggccagaacagcucugcacca

SEQ ID NO: 188244 - RNA, 22 nt, Human
caggacugauguuccuccagcc

SEQ ID NO: 188245 - RNA, 22 nt, Human
agcuacaagucaucagcuauca

SEQ ID NO: 188246 - RNA, 22 nt, Human
agcccagaggcugggcgugcau

SEQ ID NO: 188247 - RNA, 20 nt, Human
guagaaccaugugugcuggg

SEQ ID NO: 188248 - RNA, 22 nt, Human
uuagauaaauugcaacuugauu

SEQ ID NO: 188249 - RNA, 22 nt, Human
aaggcagccauagcaccaucca

SEQ ID NO: 188250 - RNA, 19 nt, Human
gaauguuucugucucuucu

SEQ ID NO: 188251 - RNA, 22 nt, Human
cacagauaaggauguuaauuuu

SEQ ID NO: 188252 - RNA, 22 nt, Human
gcucuggcuacuguggcuaccg

SEQ ID NO: 188253 - RNA, 22 nt, Human
ggcaugcaaaugugggugaccu

SEQ ID NO: 188254 - RNA, 23 nt, Human
agacaaaagccucagucuuaggc

SEQ ID NO: 188255 - RNA, 22 nt, Human
cgugggaggaaaaaugggcuuc

SEQ ID NO: 188256 - RNA, 22 nt, Human
agugagggaugaagaacugcgg

SEQ ID NO: 188257 - RNA, 22 nt, Human
ugggccucugccacgcuccccc

SEQ ID NO: 188258 - RNA, 21 nt, Human
ggcagcccgcccucuccuggc

SEQ ID NO: 188259 - RNA, 22 nt, Human
uugaaagaggcaaaguuugauc

SEQ ID NO: 188260 - RNA, 22 nt, Human
uucaugaacgaacauauguaua

SEQ ID NO: 188261 - RNA, 22 nt, Human
gagggagugccagagggccagc

SEQ ID NO: 188262 - RNA, 22 nt, Human
aagagaauacaagcaggcagga

SEQ ID NO: 188263 - RNA, 22 nt, Human
cagagccuggcgaugucaugga

SEQ ID NO: 188264 - RNA, 22 nt, Human
uccacagugguugaacuaguaa

SEQ ID NO: 188265 - RNA, 22 nt, Human
aagaacaacugcuuuaaaagca

SEQ ID NO: 188266 - RNA, 22 nt, Human
gcucaguguguucaagggcuca

SEQ ID NO: 188267 - RNA, 22 nt, Human
aagauuuauuagaugcuuaccu

SEQ ID NO: 188268 - RNA, 22 nt, Human
ugacaaagacaaagauaugucc

SEQ ID NO: 188269 - RNA, 22 nt, Human
ggugaagggccuuaggagacag

SEQ ID NO: 188270 - RNA, 22 nt, Human
agugcccuggcccagcuggacc

SEQ ID NO: 188271 - RNA, 22 nt, Human
acugaauagugcugcauuguac

SEQ ID NO: 188272 - RNA, 22 nt, Human
acaaauguuggauuugucuucc

SEQ ID NO: 188273 - RNA, 22 nt, Human
cugcuuccauaaauaaugugcu

SEQ ID NO: 188274 - RNA, 22 nt, Human
uuccucuggggccaggccaaca

SEQ ID NO: 188275 - RNA, 22 nt, Human
gagggaccccaggcuggcccuu

SEQ ID NO: 188276 - RNA, 22 nt, Human
ccugagggcgccgagcucccag

SEQ ID NO: 188277 - RNA, 22 nt, Human
auugcugacaccaaguaguagc

SEQ ID NO: 188278 - RNA, 22 nt, Human
gggaccugggccagaggacagu

SEQ ID NO: 188279 - RNA, 22 nt, Human
gccugaaggagucagagagggc

SEQ ID NO: 188280 - RNA, 22 nt, Human
uauuuaaaaagaggccagcugg

SEQ ID NO: 188281 - RNA, 22 nt, Human
uguucacauguacaugaauauu

SEQ ID NO: 188282 - RNA, 22 nt, Human
cuggugcauguggccuugcucu

SEQ ID NO: 188283 - RNA, 22 nt, Human
gcacggcuaauuuuuguauuuu

SEQ ID NO: 188284 - RNA, 22 nt, Human
uuuggagauggagagagggcau

SEQ ID NO: 188285 - RNA, 22 nt, Human
aaggcaaaagaggugucaucac

SEQ ID NO: 188286 - RNA, 22 nt, Human
uucaggaaucaaccaagucauu

SEQ ID NO: 188287 - RNA, 22 nt, Human
gcuacagagcucugugaagaga

SEQ ID NO: 188288 - RNA, 22 nt, Human
gcuggccauagaagccaaagag

SEQ ID NO: 188289 - RNA, 22 nt, Human
uaugccagacugugagcuucuu

SEQ ID NO: 188290 - RNA, 22 nt, Human
acuagaaagaaguuuuuugaga

SEQ ID NO: 188291 - RNA, 22 nt, Human
guacaaauguacacuuguauaa

SEQ ID NO: 188292 - RNA, 22 nt, Human
ucaggcaaggcccuuagagugu

SEQ ID NO: 188293 - RNA, 22 nt, Human
cugagguguugaugaccuaugc

SEQ ID NO: 188294 - RNA, 23 nt, Human
aaugggugcaacuauccaugaca

SEQ ID NO: 188295 - RNA, 22 nt, Human
ccugggugcccggcccuucucu

SEQ ID NO: 188296 - RNA, 22 nt, Human
aagcacauuuggaaaacaugga

SEQ ID NO: 188297 - RNA, 22 nt, Human
gcagcccaggucucucucacuc

SEQ ID NO: 188298 - RNA, 22 nt, Human
ucacaagacagaaaacauuuag

SEQ ID NO: 188299 - RNA, 22 nt, Human
agcuuccuuggcgcugaggccu

SEQ ID NO: 188300 - RNA, 22 nt, Human
uacaggaaagaaauuugaacuc

SEQ ID NO: 188301 - RNA, 22 nt, Human
agaggugaaagaauuuggcucu

SEQ ID NO: 188302 - RNA, 22 nt, Human
cucuggaagaauacacuuagaa

SEQ ID NO: 188303 - RNA, 22 nt, Human
uucaaauccuagcccuguggcc

SEQ ID NO: 188304 - RNA, 20 nt, Human
uauaagcagcuccaggcaga

SEQ ID NO: 188305 - RNA, 22 nt, Human
ccugucagccccacuucugccu

SEQ ID NO: 188306 - RNA, 22 nt, Human
gauggccuuguuuucucccuuc

SEQ ID NO: 188307 - RNA, 23 nt, Human
gcccacccucagcguccucacgg

SEQ ID NO: 188308 - RNA, 22 nt, Human
uccaaaacagaacucugugaau

SEQ ID NO: 188309 - RNA, 22 nt, Human
aacccuggggcagcugcuaggg

SEQ ID NO: 188310 - RNA, 22 nt, Human
uuuauugucuucguggugccua

SEQ ID NO: 188311 - RNA, 22 nt, Human
acaaggcuggcugggaaaaacu

SEQ ID NO: 188312 - RNA, 22 nt, Human
caaagauaaucacagaauaccc

SEQ ID NO: 188313 - RNA, 22 nt, Human
cugugggaauacugcgagugua

SEQ ID NO: 188314 - RNA, 22 nt, Human
caugugugaaucuugugaucau

SEQ ID NO: 188315 - RNA, 22 nt, Human
auggcugccuagaggugagaug

SEQ ID NO: 188316 - RNA, 22 nt, Human
gcugcugucuggucugagggcu

SEQ ID NO: 188317 - RNA, 22 nt, Human
auugcagauucuucucagggag

SEQ ID NO: 188318 - RNA, 22 nt, Human
ugagcccugaccuagccuggcc

SEQ ID NO: 188319 - RNA, 22 nt, Human
cccaugagaccugguuuaaggc

SEQ ID NO: 188320 - RNA, 22 nt, Human
agcuccuggaggugcgcacucg

SEQ ID NO: 188321 - RNA, 18 nt, Human
agccugggcucugccugg

SEQ ID NO: 188322 - RNA, 17 nt, Human
cuuuuaauuuacuuccc

SEQ ID NO: 188323 - RNA, 18 nt, Human
gccugcaggcacgggggu

SEQ ID NO: 188324 - RNA, 22 nt, Human
cuugucagccaauuguggauuu

SEQ ID NO: 188325 - RNA, 22 nt, Human
guucuugccagcauccucaggu

SEQ ID NO: 188326 - RNA, 22 nt, Human
gaggugucuguuaggaauaggc

SEQ ID NO: 188327 - RNA, 22 nt, Human
ccaggcugugguuuagauagag

SEQ ID NO: 188328 - RNA, 22 nt, Human
auaggagccauaaauaaaaucu

SEQ ID NO: 188329 - RNA, 22 nt, Human
ugcagagagauccucaggguuu

SEQ ID NO: 188330 - RNA, 22 nt, Human
ucagaacaauugggaaccauua

SEQ ID NO: 188331 - RNA, 23 nt, Human
aguguugagcagaugcaaagguu

SEQ ID NO: 188332 - RNA, 22 nt, Human
cuggcuggcguuuuccaaaagc

SEQ ID NO: 188333 - RNA, 22 nt, Human
gagcauggauagaaggugggau

SEQ ID NO: 188334 - RNA, 22 nt, Human
auuagaaaaacucaagggcucu

SEQ ID NO: 188335 - RNA, 22 nt, Human
ucugagcaccuuauauucuuga

SEQ ID NO: 188336 - RNA, 22 nt, Human
cacacacaguuuuguauucugu

SEQ ID NO: 188337 - RNA, 18 nt, Human
gccugggagaaguuucac

SEQ ID NO: 188338 - RNA, 22 nt, Human
aaacuacacuuugggaccagca

SEQ ID NO: 188339 - RNA, 22 nt, Human
caggaagcaguagaacuuuucc

SEQ ID NO: 188340 - RNA, 22 nt, Human
cagccagugguugaagaugcag

SEQ ID NO: 188341 - RNA, 18 nt, Human
agucuucugauccauuuu

SEQ ID NO: 188342 - RNA, 22 nt, Human
uggugagaauugguuggauuua

SEQ ID NO: 188343 - RNA, 23 nt, Human
acagaauaccauugacuaggugu

SEQ ID NO: 188344 - RNA, 22 nt, Human
acauggaagcaaaguucuauuu

SEQ ID NO: 188345 - RNA, 22 nt, Human
acagauuuuauuauucagguau

SEQ ID NO: 188346 - RNA, 22 nt, Human
uccaggcaaagccuuguagacg

SEQ ID NO: 188347 - RNA, 22 nt, Human
cagcaugacagucugcagcaga

SEQ ID NO: 188348 - RNA, 22 nt, Human
ugagcugggcugggcugagcug

SEQ ID NO: 188349 - RNA, 22 nt, Human
uagaaagcguuaaaucuacaga

SEQ ID NO: 188350 - RNA, 22 nt, Human
caggacaauuuccacuugguaa

SEQ ID NO: 188351 - RNA, 22 nt, Human
gaggaaccaaaucagcuugcac

SEQ ID NO: 188352 - RNA, 22 nt, Human
ccuugcucggggagcugcagga

SEQ ID NO: 188353 - RNA, 22 nt, Human
auuuccuauccuggucuuaaaa

SEQ ID NO: 188354 - RNA, 22 nt, Human
cagcccagccgagggccuggcu

SEQ ID NO: 188355 - RNA, 17 nt, Human
ugaagaugcauggcagc

SEQ ID NO: 188356 - RNA, 22 nt, Human
ccucuuccagcuguugcuucca

SEQ ID NO: 188357 - RNA, 22 nt, Human
aacaagucuuugguuuuggcua

SEQ ID NO: 188358 - RNA, 22 nt, Human
cagcaggcggcccgcgggcccg

SEQ ID NO: 188359 - RNA, 22 nt, Human
aguuggagugaacaugagauug

SEQ ID NO: 188360 - RNA, 23 nt, Human
uaucucagaggaauguaguuacu

SEQ ID NO: 188361 - RNA, 22 nt, Human
uccugaggugcucagccaggaa

SEQ ID NO: 188362 - RNA, 22 nt, Human
acaggacuguggaaggaucucu

SEQ ID NO: 188363 - RNA, 22 nt, Human
gugaggagcugacacuggggug

SEQ ID NO: 188364 - RNA, 22 nt, Human
guguuacuuaauuagaaucugc

SEQ ID NO: 188365 - RNA, 22 nt, Human
agugggaauuucagugcuaaaa

SEQ ID NO: 188366 - RNA, 22 nt, Human
cuucucagaucucagcuuugag

SEQ ID NO: 188367 - RNA, 22 nt, Human
cugaggaaagcugcagcgguac

SEQ ID NO: 188368 - RNA, 22 nt, Human
gugucccaauguucaggacggc

SEQ ID NO: 188369 - RNA, 22 nt, Human
aggcagacaaggacacaguggg

SEQ ID NO: 188370 - RNA, 22 nt, Human
acaacaaucuacccuagcuucu

SEQ ID NO: 188371 - RNA, 22 nt, Human
gguccagcacaacacuggcaug

SEQ ID NO: 188372 - RNA, 22 nt, Human
aaggccaucuacuuacggaauu

SEQ ID NO: 188373 - RNA, 22 nt, Human
ugaggggcggccugcagaggcc

SEQ ID NO: 188374 - RNA, 22 nt, Human
ucauugccauggcauuugcaga

SEQ ID NO: 188375 - RNA, 23 nt, Human
ucaauuaucaauggaaagaaguu

SEQ ID NO: 188376 - RNA, 22 nt, Human
ugaaguucaagggcuacauuug

SEQ ID NO: 188377 - RNA, 22 nt, Human
uuacagaguagugcagaacuca

SEQ ID NO: 188378 - RNA, 22 nt, Human
uucuguaggcacacaguuucaa

SEQ ID NO: 188379 - RNA, 22 nt, Human
cugaggcugcccagggccaggu

SEQ ID NO: 188380 - RNA, 22 nt, Human
uccagaggcuccaaagggagau

SEQ ID NO: 188381 - RNA, 22 nt, Human
accuggacaccugcugucaucu

SEQ ID NO: 188382 - RNA, 22 nt, Human
uuucuaguucuaccacaguaau

SEQ ID NO: 188383 - RNA, 22 nt, Human
gugcaaaaguaauuacaguuuu

SEQ ID NO: 188384 - RNA, 22 nt, Human
uucccucuccaggagcccugag

SEQ ID NO: 188385 - RNA, 22 nt, Human
cugccccaggaccucuucugga

SEQ ID NO: 188386 - RNA, 22 nt, Human
acugccuucugcucaggguuca

SEQ ID NO: 188387 - RNA, 22 nt, Human
agcuccuggcuuuccucucacc

SEQ ID NO: 188388 - RNA, 22 nt, Human
uaaaggcuuuuagugaugguaa

SEQ ID NO: 188389 - RNA, 22 nt, Human
gaggacugaaacuuacaggaaa

SEQ ID NO: 188390 - RNA, 23 nt, Human
ugggguugaauuguagcugugcc

SEQ ID NO: 188391 - RNA, 22 nt, Human
gggauggggucgggacccugcu

SEQ ID NO: 188392 - RNA, 20 nt, Human
uucagagucagcaaaugcag

SEQ ID NO: 188393 - RNA, 22 nt, Human
cccauucauccucgcuuccuuc

SEQ ID NO: 188394 - RNA, 22 nt, Human
uugcagcuucgagucuaucugu

SEQ ID NO: 188395 - RNA, 22 nt, Human
uaaaguguggacaguaucuaua

SEQ ID NO: 188396 - RNA, 22 nt, Human
agggagcucuuuggucuugccg

SEQ ID NO: 188397 - RNA, 22 nt, Human
uaaaaucagccgaccauggugg

SEQ ID NO: 188398 - RNA, 22 nt, Human
ucgugcaaaggcccaugugggu

SEQ ID NO: 188399 - RNA, 22 nt, Human
ggcugugcuugguguccuugga

SEQ ID NO: 188400 - RNA, 22 nt, Human
agggaacagugaaaggcaucag

SEQ ID NO: 188401 - RNA, 22 nt, Human
acuguucauuuggauuucucug

SEQ ID NO: 188402 - RNA, 22 nt, Human
ggcuggagacaacguccugccc

SEQ ID NO: 188403 - RNA, 22 nt, Human
cagcacuguucccagaccacug

SEQ ID NO: 188404 - RNA, 22 nt, Human
aaaaguaauugcaguuuuguca

SEQ ID NO: 188405 - RNA, 21 nt, Human
ugcuggcugaaaggcacagag

SEQ ID NO: 188406 - RNA, 22 nt, Human
auggaagacagauaaggcagaa

SEQ ID NO: 188407 - RNA, 22 nt, Human
gaacugggaaugcugucccauc

SEQ ID NO: 188408 - RNA, 22 nt, Human
agcuggaagcugaugagcacag

SEQ ID NO: 188409 - RNA, 22 nt, Human
aaucuuucccuauuaaaugugg

SEQ ID NO: 188410 - RNA, 19 nt, Human
aaaauugcguauuuugagg

SEQ ID NO: 188411 - RNA, 22 nt, Human
ucuggccccgcaugcacuuuau

SEQ ID NO: 188412 - RNA, 22 nt, Human
uugagguauugauauuuuauga

SEQ ID NO: 188413 - RNA, 22 nt, Human
guauuauuggguaguaugguaa

SEQ ID NO: 188414 - RNA, 22 nt, Human
ugaggugguuacuguggugcuc

SEQ ID NO: 188415 - RNA, 22 nt, Human
ccaggacuuauuacaguauaac

SEQ ID NO: 188416 - RNA, 22 nt, Human
aauggaaugccucacauguauu

SEQ ID NO: 188417 - RNA, 22 nt, Human
ugccagacuuucuuaccagugu

SEQ ID NO: 188418 - RNA, 22 nt, Human
caugcagcagaauaaugacuau

SEQ ID NO: 188419 - RNA, 22 nt, Human
ugggagaaagaacccugaguga

SEQ ID NO: 188420 - RNA, 18 nt, Human
gugggguguugugaggau

SEQ ID NO: 188421 - RNA, 22 nt, Human
guggcccaggcacccugaugac

SEQ ID NO: 188422 - RNA, 20 nt, Human
guccaggacccagcaggagg

SEQ ID NO: 188423 - RNA, 22 nt, Human
ggcuuagauugacacugaucuc

SEQ ID NO: 188424 - RNA, 22 nt, Human
auuguacagguuggaggaagug

SEQ ID NO: 188425 - RNA, 19 nt, Human
ccuacuuguuugagggaag

SEQ ID NO: 188426 - RNA, 22 nt, Human
gcaugugugagaccuuuuagca

SEQ ID NO: 188427 - RNA, 19 nt, Human
ucugagcugauaugacauu

SEQ ID NO: 188428 - RNA, 22 nt, Human
uuauuuaauuuucucacucaga

SEQ ID NO: 188429 - RNA, 22 nt, Human
agggcucuuuaggccgaggcca

SEQ ID NO: 188430 - RNA, 22 nt, Human
gaucaguaagugaauaaugagu

SEQ ID NO: 188431 - RNA, 22 nt, Human
uauugauaaggauggcugcaau

SEQ ID NO: 188432 - RNA, 22 nt, Human
ccuuuucuacaagcaaaugugc

SEQ ID NO: 188433 - RNA, 22 nt, Human
uugguaaauacuauaaucaaau

SEQ ID NO: 188434 - RNA, 22 nt, Human
aaguguccucauucaacaugca

SEQ ID NO: 188435 - RNA, 22 nt, Human
gacauauacuauggaugguucu

SEQ ID NO: 188436 - RNA, 22 nt, Human
gaaggcuugcagcucuguggca

SEQ ID NO: 188437 - RNA, 22 nt, Human
aggcagggcucauuucuuaggc

SEQ ID NO: 188438 - RNA, 22 nt, Human
agggggugcuacuuccagaguu

SEQ ID NO: 188439 - RNA, 22 nt, Human
agauugaauauagagauucuug

SEQ ID NO: 188440 - RNA, 22 nt, Human
cuuaagaaauugcauucuaauc

SEQ ID NO: 188441 - RNA, 22 nt, Human
agggcacuugaggcugggccug

SEQ ID NO: 188442 - RNA, 22 nt, Human
uucauugucucuguuugccuuc

SEQ ID NO: 188443 - RNA, 22 nt, Human
agggcuccgggccaccggccug

SEQ ID NO: 188444 - RNA, 22 nt, Human
uaaaguucuuagaacaaggccu

SEQ ID NO: 188445 - RNA, 22 nt, Human
caggaagagaacauggaggcug

SEQ ID NO: 188446 - RNA, 22 nt, Human
aaacugaggaguuagacuaggg

SEQ ID NO: 188447 - RNA, 22 nt, Human
ggccagagaauaugccuuacgu

SEQ ID NO: 188448 - RNA, 22 nt, Human
agguucuuggugagcauuuggu

SEQ ID NO: 188449 - RNA, 20 nt, Human
cucuuaaauguaaaguaggc

SEQ ID NO: 188450 - RNA, 19 nt, Human
agagacacagguaaguagg

SEQ ID NO: 188451 - RNA, 22 nt, Human
uccugccuaccuugcggaggug

SEQ ID NO: 188452 - RNA, 22 nt, Human
aaucuagagacaauuugaauau

SEQ ID NO: 188453 - RNA, 22 nt, Human
cugcagggcuuaccuugcucug

SEQ ID NO: 188454 - RNA, 22 nt, Human
agacaugucaccaauucuuacu

SEQ ID NO: 188455 - RNA, 22 nt, Human
gucugagggacagaguccuggc

SEQ ID NO: 188456 - RNA, 22 nt, Human
uguguucaguaugacauucaca

SEQ ID NO: 188457 - RNA, 18 nt, Human
ucucagaggccauccuag

SEQ ID NO: 188458 - RNA, 22 nt, Human
gucucugggugugugaugccaa

SEQ ID NO: 188459 - RNA, 22 nt, Human
gaagaauauauaaugauuuugu

SEQ ID NO: 188460 - RNA, 22 nt, Human
ggugucagauacauaggaagua

SEQ ID NO: 188461 - RNA, 22 nt, Human
aagggcuggcccugggaagagu

SEQ ID NO: 188462 - RNA, 22 nt, Human
uaguaagccucuccagagacag

SEQ ID NO: 188463 - RNA, 22 nt, Human
gccucccuccaccacugcaggu

SEQ ID NO: 188464 - RNA, 22 nt, Human
cugggcagugguggcaucuuug

SEQ ID NO: 188465 - RNA, 22 nt, Human
gcucagaccccacccuggcaga

SEQ ID NO: 188466 - RNA, 22 nt, Human
uccagggagagccgcugcucca

SEQ ID NO: 188467 - RNA, 17 nt, Human
ucuccaggacgagcuca

SEQ ID NO: 188468 - RNA, 22 nt, Human
acuguucacccagcacuagcag

SEQ ID NO: 188469 - RNA, 22 nt, Human
uaauacuguauacugcaaauuu

SEQ ID NO: 188470 - RNA, 22 nt, Human
gcugcucugcuguguaagcagg

SEQ ID NO: 188471 - RNA, 22 nt, Human
uuucucaguaguaauggcaguc

SEQ ID NO: 188472 - RNA, 16 nt, Human
cuuuuucuccccucuu

SEQ ID NO: 188473 - RNA, 22 nt, Human
uuacacuuguaaauggcaugua

SEQ ID NO: 188474 - RNA, 22 nt, Human
cauggaacuguauaaaggcacu

SEQ ID NO: 188475 - RNA, 22 nt, Human
caggaaggaaaggguguggaga

SEQ ID NO: 188476 - RNA, 22 nt, Human
gcaaacauguugugagauacca

SEQ ID NO: 188477 - RNA, 22 nt, Human
aagucugccuaaccuucauguu

SEQ ID NO: 188478 - RNA, 19 nt, Human
cugggacaaugaaagcauc

SEQ ID NO: 188479 - RNA, 19 nt, Human
uagcccuggccaucaugag

SEQ ID NO: 188480 - RNA, 20 nt, Human
ugaaauagauacucagagau

SEQ ID NO: 188481 - RNA, 22 nt, Human
ggccaaggaugguggcucuggu

SEQ ID NO: 188482 - RNA, 22 nt, Human
uuuccauguguacuggccagaa

SEQ ID NO: 188483 - RNA, 22 nt, Human
aaggcugccucugccagaggag

SEQ ID NO: 188484 - RNA, 22 nt, Human
uccugggcuuuguuucucuccu

SEQ ID NO: 188485 - RNA, 22 nt, Human
auggcuucucgcuggcaccugu

SEQ ID NO: 188486 - RNA, 22 nt, Human
agaucauaugcaguaaugaacu

SEQ ID NO: 188487 - RNA, 22 nt, Human
ugcacagaucugguggcaagga

SEQ ID NO: 188488 - RNA, 22 nt, Human
uuuauaaccaaguucugcuugu

SEQ ID NO: 188489 - RNA, 20 nt, Human
cucaggauacugcaaaguug

SEQ ID NO: 188490 - RNA, 22 nt, Human
aaauaggggaccaggaaaggag

SEQ ID NO: 188491 - RNA, 20 nt, Human
agagagcacaggcaggaaag

SEQ ID NO: 188492 - RNA, 22 nt, Human
acauuccugaaugggcacauuu

SEQ ID NO: 188493 - RNA, 22 nt, Human
aggagaggucucccuuccccag

SEQ ID NO: 188494 - RNA, 22 nt, Human
gcuggguuuucuuccgggccua

SEQ ID NO: 188495 - RNA, 22 nt, Human
aucucaaagcauggagcagaau

SEQ ID NO: 188496 - RNA, 22 nt, Human
augucacagucugacucaguga

SEQ ID NO: 188497 - RNA, 22 nt, Human
ccccucuugugggcucagguca

SEQ ID NO: 188498 - RNA, 22 nt, Human
aaggccaggagacuuggaguca

SEQ ID NO: 188499 - RNA, 17 nt, Human
aaucuguuuacagucag

SEQ ID NO: 188500 - RNA, 22 nt, Human
aucuccagguugugccugcguc

SEQ ID NO: 188501 - RNA, 22 nt, Human
auggcugggucaccaucagggu

SEQ ID NO: 188502 - RNA, 22 nt, Human
uuaaaaugcagauucugauuca

SEQ ID NO: 188503 - RNA, 22 nt, Human
ccaugagcuucaacugacacag

SEQ ID NO: 188504 - RNA, 22 nt, Human
cccagcccagcguucgaggggu

SEQ ID NO: 188505 - RNA, 22 nt, Human
ccccacucucggccagauaggc

SEQ ID NO: 188506 - RNA, 22 nt, Human
uuguagaaaauucucuuggaua

SEQ ID NO: 188507 - RNA, 22 nt, Human
uuuauucauuguuucgucgcag

SEQ ID NO: 188508 - RNA, 22 nt, Human
ccuugggguguuggaggcagcc

SEQ ID NO: 188509 - RNA, 22 nt, Human
ugagcugucuaugguccugucu

SEQ ID NO: 188510 - RNA, 22 nt, Human
uuucagaaauggcacugaaauc

SEQ ID NO: 188511 - RNA, 22 nt, Human
guuuccuacacuguaguauuau

SEQ ID NO: 188512 - RNA, 22 nt, Human
aagccaguguuuuugagaguug

SEQ ID NO: 188513 - RNA, 22 nt, Human
gugacccagaggcugacuaaca

SEQ ID NO: 188514 - RNA, 22 nt, Human
agcauccagaaaacucucagaa

SEQ ID NO: 188515 - RNA, 21 nt, Human
cugcuguggcccccgacaugc

SEQ ID NO: 188516 - RNA, 21 nt, Human
uuucccagcagagauagcugg

SEQ ID NO: 188517 - RNA, 22 nt, Human
cauggaaagcacucagcccagu

SEQ ID NO: 188518 - RNA, 22 nt, Human
aagaaaugcacacaacugcugg

SEQ ID NO: 188519 - RNA, 22 nt, Human
uuauucaccucuauuagacuca

SEQ ID NO: 188520 - RNA, 22 nt, Human
caucacagggggcuagaagucu

SEQ ID NO: 188521 - RNA, 22 nt, Human
auuuguuucagggccuugguau

SEQ ID NO: 188522 - RNA, 22 nt, Human
ugcugaggagguggcugugcuu

SEQ ID NO: 188523 - RNA, 22 nt, Human
ggucuggauuuuaucuacugua

SEQ ID NO: 188524 - RNA, 22 nt, Human
gagauggagucuuuuucuguca

SEQ ID NO: 188525 - RNA, 22 nt, Human
ggucagagccguuagcauucag

SEQ ID NO: 188526 - RNA, 22 nt, Human
ucucuggcagacuggcugggcu

SEQ ID NO: 188527 - RNA, 22 nt, Human
gcagcucacagucuccgccauc

SEQ ID NO: 188528 - RNA, 22 nt, Human
ucuggagagcagaugccucugg

SEQ ID NO: 188529 - RNA, 22 nt, Human
aaauuagucgguuuaggaauuu

SEQ ID NO: 188530 - RNA, 19 nt, Human
aucuuuagggauguggcuu

SEQ ID NO: 188531 - RNA, 22 nt, Human
uggaagaauagaagaugguuga

SEQ ID NO: 188532 - RNA, 22 nt, Human
ccucagcauccucaugcucagu

SEQ ID NO: 188533 - RNA, 22 nt, Human
augaaaugcugagaggugcuuc

SEQ ID NO: 188534 - RNA, 22 nt, Human
ugacauuucuuguugauauaaa

SEQ ID NO: 188535 - RNA, 22 nt, Human
gucuagagccugaugaggauga

SEQ ID NO: 188536 - RNA, 22 nt, Human
ccagcagagcauggggaggaag

SEQ ID NO: 188537 - RNA, 21 nt, Human
auaagcaugcugauuacauuu

SEQ ID NO: 188538 - RNA, 22 nt, Human
augaaacucuaacuuaacaagu

SEQ ID NO: 188539 - RNA, 22 nt, Human
uggcuggcguuggggccaguga

SEQ ID NO: 188540 - RNA, 22 nt, Human
auucucuuuguauaacaucuug

SEQ ID NO: 188541 - RNA, 22 nt, Human
gggcagcaaaucugagucuggu

SEQ ID NO: 188542 - RNA, 22 nt, Human
acagcuguauucaaguugcaag

SEQ ID NO: 188543 - RNA, 22 nt, Human
cugggacuuuguaggccaguug

SEQ ID NO: 188544 - RNA, 17 nt, Human
aggugcagaggcagagc

SEQ ID NO: 188545 - RNA, 22 nt, Human
acagagcuguacaugugccaug

SEQ ID NO: 188546 - RNA, 22 nt, Human
cugcugccaagggugccacagg

SEQ ID NO: 188547 - RNA, 22 nt, Human
ugguccugaggcuuguuuccac

SEQ ID NO: 188548 - RNA, 22 nt, Human
cagagagaggccacugcuauua

SEQ ID NO: 188549 - RNA, 19 nt, Human
aauucuguuucagcagauc

SEQ ID NO: 188550 - RNA, 16 nt, Human
ucucuggguugcacag

SEQ ID NO: 188551 - RNA, 22 nt, Human
ucauaacagcuaagucccuuuc

SEQ ID NO: 188552 - RNA, 22 nt, Human
auacuguuggcuuuggugaugg

SEQ ID NO: 188553 - RNA, 22 nt, Human
cuacaugaacucuuaagucaca

SEQ ID NO: 188554 - RNA, 22 nt, Human
uauuagaaagcuuaauaucgug

SEQ ID NO: 188555 - RNA, 22 nt, Human
aucugaaauagucuuaucugag

SEQ ID NO: 188556 - RNA, 18 nt, Human
cagacacucugcucugca

SEQ ID NO: 188557 - RNA, 22 nt, Human
ugucagcucccagucagagaga

SEQ ID NO: 188558 - RNA, 22 nt, Human
ucugcccucauugcugccugga

SEQ ID NO: 188559 - RNA, 22 nt, Human
ucagagucuuaacuauucagag

SEQ ID NO: 188560 - RNA, 22 nt, Human
uuucaguuugaaggaaaggcca

SEQ ID NO: 188561 - RNA, 22 nt, Human
uucuggcaugagagaugggggu

SEQ ID NO: 188562 - RNA, 22 nt, Human
ucuugaaagcaugagauggaca

SEQ ID NO: 188563 - RNA, 22 nt, Human
uggaggcacuaaauggccacaa

SEQ ID NO: 188564 - RNA, 22 nt, Human
agauuuacugagaacugauuac

SEQ ID NO: 188565 - RNA, 22 nt, Human
auggcuuccucuggauuggauu

SEQ ID NO: 188566 - RNA, 22 nt, Human
cauuuacauuuaagguuaauau

SEQ ID NO: 188567 - RNA, 22 nt, Human
aaaccaacccuggcuggccuag

SEQ ID NO: 188568 - RNA, 22 nt, Human
ucaguggucuuggcugauuguu

SEQ ID NO: 188569 - RNA, 22 nt, Human
gcagguguggagaguggucggg

SEQ ID NO: 188570 - RNA, 22 nt, Human
auacacauauauacacguuuaa

SEQ ID NO: 188571 - RNA, 22 nt, Human
gcuccaggcgagcuggaccaga

SEQ ID NO: 188572 - RNA, 22 nt, Human
aaacauuuuucuucaucauccu

SEQ ID NO: 188573 - RNA, 22 nt, Human
gcaacaugaagaaaacagaacc

SEQ ID NO: 188574 - RNA, 22 nt, Human
gccuggcugcuuagccuacuuc

SEQ ID NO: 188575 - RNA, 22 nt, Human
uacaagaauuucuuucugguug

SEQ ID NO: 188576 - RNA, 22 nt, Human
ggcucacacaugacugggcucu

SEQ ID NO: 188577 - RNA, 22 nt, Human
ccaaauuaaaucauacagacag

SEQ ID NO: 188578 - RNA, 22 nt, Human
acugucuugcuaugagcuccca

SEQ ID NO: 188579 - RNA, 22 nt, Human
ggccacugaccuacaucugggg

SEQ ID NO: 188580 - RNA, 22 nt, Human
agugauguugacuagcuauaag

SEQ ID NO: 188581 - RNA, 23 nt, Human
cagaggguuccauggagcauggu

SEQ ID NO: 188582 - RNA, 20 nt, Human
caucugagcccacagaaguc

SEQ ID NO: 188583 - RNA, 22 nt, Human
aggcuccacccuacagagcucc

SEQ ID NO: 188584 - RNA, 19 nt, Human
uaguacaaaagcagccaua

SEQ ID NO: 188585 - RNA, 22 nt, Human
caggccagcggcccgcgcguuc

SEQ ID NO: 188586 - RNA, 22 nt, Human
gccucagggggagaggccagcu

SEQ ID NO: 188587 - RNA, 22 nt, Human
uaaaggcucacuggcuuggggu

SEQ ID NO: 188588 - RNA, 22 nt, Human
ucaggccugagaaaaauccuuu

SEQ ID NO: 188589 - RNA, 22 nt, Human
aacacugaccucuacccucagu

SEQ ID NO: 188590 - RNA, 22 nt, Human
gcugggcuccaggccaggguga

SEQ ID NO: 188591 - RNA, 22 nt, Human
gagauccagauuuccauuccuu

SEQ ID NO: 188592 - RNA, 22 nt, Human
gcagugaaaaagugcacccugu

SEQ ID NO: 188593 - RNA, 22 nt, Human
gcuggagugaugccugugucuc

SEQ ID NO: 188594 - RNA, 22 nt, Human
gucuguagauauucacuccuuc

SEQ ID NO: 188595 - RNA, 23 nt, Human
cagaaaguuugagaagauacauc

SEQ ID NO: 188596 - RNA, 22 nt, Human
gagaugcugaaaucugagugua

SEQ ID NO: 188597 - RNA, 22 nt, Human
uugcagggaaacaguuuaggaa

SEQ ID NO: 188598 - RNA, 22 nt, Human
uuccuacaauuagagccucuuu

SEQ ID NO: 188599 - RNA, 22 nt, Human
ucugccugagcagagggaggcc

SEQ ID NO: 188600 - RNA, 22 nt, Human
ucccagccaggcucuaccacuu

SEQ ID NO: 188601 - RNA, 22 nt, Human
ucugaaaucuaaugcucugugg

SEQ ID NO: 188602 - RNA, 22 nt, Human
gagggcugugaaggagcggguu

SEQ ID NO: 188603 - RNA, 22 nt, Human
ucucaggcuccugacauauaug

SEQ ID NO: 188604 - RNA, 22 nt, Human
cauaacuuuaaagacagugugg

SEQ ID NO: 188605 - RNA, 21 nt, Human
uguuuacucccugcaagcacg

SEQ ID NO: 188606 - RNA, 22 nt, Human
cucugugggggagaggcagcug

SEQ ID NO: 188607 - RNA, 22 nt, Human
uuauccuggauuauauauguga

SEQ ID NO: 188608 - RNA, 22 nt, Human
aaugcaaauuaucaggcuucuc

SEQ ID NO: 188609 - RNA, 22 nt, Human
ucacagaaaucuguuuuuucua

SEQ ID NO: 188610 - RNA, 22 nt, Human
uauugguaggacucagcugaga

SEQ ID NO: 188611 - RNA, 22 nt, Human
aucugggggagcugcucaugga

SEQ ID NO: 188612 - RNA, 22 nt, Human
gccaguggcaugcggcagggac

SEQ ID NO: 188613 - RNA, 22 nt, Human
agugaaggaaguuugucuuggg

SEQ ID NO: 188614 - RNA, 22 nt, Human
aaggcagccagauccuuugggu

SEQ ID NO: 188615 - RNA, 22 nt, Human
uauuuccugcauggugauguaa

SEQ ID NO: 188616 - RNA, 23 nt, Human
guguuacucugauaggugcuuuu

SEQ ID NO: 188617 - RNA, 22 nt, Human
ggagccuuacuagaaugugagc

SEQ ID NO: 188618 - RNA, 22 nt, Human
gcuggagggguaauaggauggg

SEQ ID NO: 188619 - RNA, 22 nt, Human
uucauuccuucccuaagcaacu

SEQ ID NO: 188620 - RNA, 22 nt, Human
aaggaacuuugcagaggugauu

SEQ ID NO: 188621 - RNA, 22 nt, Human
cagagccccucagcucucuccc

SEQ ID NO: 188622 - RNA, 22 nt, Human
auuucuugugggaaaugcagca

SEQ ID NO: 188623 - RNA, 22 nt, Human
gucaacaaguaguuuucuucca

SEQ ID NO: 188624 - RNA, 22 nt, Human
ggcccagccucagacaugcccu

SEQ ID NO: 188625 - RNA, 22 nt, Human
ucuaucuggccccuuuuauaua

SEQ ID NO: 188626 - RNA, 22 nt, Human
ucuggaagaacggggcaugcug

SEQ ID NO: 188627 - RNA, 22 nt, Human
ccugagggaggguauaggcugu

SEQ ID NO: 188628 - RNA, 22 nt, Human
cagugccaaggagaaggacagc

SEQ ID NO: 188629 - RNA, 22 nt, Human
uuggucagcucaauggagaggg

SEQ ID NO: 188630 - RNA, 20 nt, Human
gcaacuagggagacacagcu

SEQ ID NO: 188631 - RNA, 22 nt, Human
ucuguggcuuucuuauguugua

SEQ ID NO: 188632 - RNA, 22 nt, Human
uucuaaacugaaguauuuuaaa

SEQ ID NO: 188633 - RNA, 22 nt, Human
ugugucuguuuugcucaccauu

SEQ ID NO: 188634 - RNA, 22 nt, Human
gacaggaaacaagaaggcagga

SEQ ID NO: 188635 - RNA, 22 nt, Human
cacccagcacagagggaggcga

SEQ ID NO: 188636 - RNA, 22 nt, Human
aaggccucuucucucuggagau

SEQ ID NO: 188637 - RNA, 22 nt, Human
uuuggaauuccauuucugcauu

SEQ ID NO: 188638 - RNA, 22 nt, Human
acagguguuuuggaggaugauu

SEQ ID NO: 188639 - RNA, 21 nt, Human
augcagagaacuccagggaag

SEQ ID NO: 188640 - RNA, 22 nt, Human
gauuguaauucuacuuuccgcu

SEQ ID NO: 188641 - RNA, 20 nt, Human
aggugcaagcaguaaauugc

SEQ ID NO: 188642 - RNA, 22 nt, Human
uucagugucccuaguagaaguu

SEQ ID NO: 188643 - RNA, 22 nt, Human
uuuguaaagucuguucugaguu

SEQ ID NO: 188644 - RNA, 22 nt, Human
ucucagaggucuucagccucug

SEQ ID NO: 188645 - RNA, 22 nt, Human
gcaggucuguugauuacaguca

SEQ ID NO: 188646 - RNA, 22 nt, Human
gggcacauguaaagcuggagaa

SEQ ID NO: 188647 - RNA, 22 nt, Human
uccagcccgggggcaggugacc

SEQ ID NO: 188648 - RNA, 22 nt, Human
cacaguuuaugaucucagugaa

SEQ ID NO: 188649 - RNA, 22 nt, Human
uuccaggaugggcuguccuacu

SEQ ID NO: 188650 - RNA, 22 nt, Human
aagagggguggucugugaggau

SEQ ID NO: 188651 - RNA, 22 nt, Human
auuauucaaucauauuaaaagu

SEQ ID NO: 188652 - RNA, 22 nt, Human
cuggaggcaguugccccaguca

SEQ ID NO: 188653 - RNA, 22 nt, Human
cuuaggaagcgggaccugugca

SEQ ID NO: 188654 - RNA, 22 nt, Human
uuucacauaaauggaguaaaga

SEQ ID NO: 188655 - RNA, 23 nt, Human
ccuccccaccagacucuaacaua

SEQ ID NO: 188656 - RNA, 22 nt, Human
aauuugauuuucuuaaaccaua

SEQ ID NO: 188657 - RNA, 22 nt, Human
ggaggaaaugaaaggaggguuu

SEQ ID NO: 188658 - RNA, 20 nt, Human
cugggcucaagugauccucc

SEQ ID NO: 188659 - RNA, 22 nt, Human
ucuggcccagccccugauccca

SEQ ID NO: 188660 - RNA, 22 nt, Human
aguaacauuuagcuucucacug

SEQ ID NO: 188661 - RNA, 22 nt, Human
cccaggagaauauaauguucuu

SEQ ID NO: 188662 - RNA, 22 nt, Human
cagaggcagacccuccagggcg

SEQ ID NO: 188663 - RNA, 22 nt, Human
uuaugcaaggacuuauuacagu

SEQ ID NO: 188664 - RNA, 22 nt, Human
cuacuucuaaguacauggugau

SEQ ID NO: 188665 - RNA, 22 nt, Human
cccagacauaacagcagagagg

SEQ ID NO: 188666 - RNA, 22 nt, Human
ugccuugacaguuguaagaccu

SEQ ID NO: 188667 - RNA, 22 nt, Human
uuugguaaaugcagguucuucu

SEQ ID NO: 188668 - RNA, 22 nt, Human
ucugagcugcagaguggggugg

SEQ ID NO: 188669 - RNA, 22 nt, Human
agaugguccaugcacagauaug

SEQ ID NO: 188670 - RNA, 20 nt, Human
ccagguggugccuggagagg

SEQ ID NO: 188671 - RNA, 22 nt, Human
gggagagaugcugauugccaau

SEQ ID NO: 188672 - RNA, 19 nt, Human
ugacagagagcaggguggu

SEQ ID NO: 188673 - RNA, 22 nt, Human
uguuuuuccaugugcagaacaa

SEQ ID NO: 188674 - RNA, 22 nt, Human
aaauacagauuccagggucuua

SEQ ID NO: 188675 - RNA, 22 nt, Human
aaaaacugcaauuacuuuuguc

SEQ ID NO: 188676 - RNA, 21 nt, Human
ucugggagugggaaaaugguc

SEQ ID NO: 188677 - RNA, 22 nt, Human
ggcugccuugacccuggcuccg

SEQ ID NO: 188678 - RNA, 22 nt, Human
uccagcacucgcccagggcuug

SEQ ID NO: 188679 - RNA, 22 nt, Human
agcuguuuccauaaaugagaca

SEQ ID NO: 188680 - RNA, 22 nt, Human
ggcagagguagcuggaaccagg

SEQ ID NO: 188681 - RNA, 22 nt, Human
gggacauggcuaggauuccaau

SEQ ID NO: 188682 - RNA, 22 nt, Human
uuuuagaaauacugauuuagug

SEQ ID NO: 188683 - RNA, 22 nt, Human
aucuuuggugcuuggugcuccc

SEQ ID NO: 188684 - RNA, 22 nt, Human
uagcaccuagaguauuuuauca

SEQ ID NO: 188685 - RNA, 22 nt, Human
ggcuucaucucguugacaccuc

SEQ ID NO: 188686 - RNA, 23 nt, Human
auaguuuucccugguucuugcca

SEQ ID NO: 188687 - RNA, 22 nt, Human
gaggaggcuggcgccgccugcc

SEQ ID NO: 188688 - RNA, 22 nt, Human
uccuggcucugcugccuccuag

SEQ ID NO: 188689 - RNA, 22 nt, Human
cagggacagggaucauuugcuu

SEQ ID NO: 188690 - RNA, 22 nt, Human
cacaugugcaguuacaugaauu

SEQ ID NO: 188691 - RNA, 22 nt, Human
aaguucugggguaaugagaauu

SEQ ID NO: 188692 - RNA, 22 nt, Human
uagggaggcuacuucuuguagg

SEQ ID NO: 188693 - RNA, 22 nt, Human
agaggccagaucaucauagaug

SEQ ID NO: 188694 - RNA, 22 nt, Human
agaaacugaacacaagagucgg

SEQ ID NO: 188695 - RNA, 22 nt, Human
gaggagggagcuggaagcucuu

SEQ ID NO: 188696 - RNA, 19 nt, Human
uggcagggagaguuugaag

SEQ ID NO: 188697 - RNA, 22 nt, Human
augaauuaaggauaacuggucu

SEQ ID NO: 188698 - RNA, 22 nt, Human
uucagugugaagcuucugaaag

SEQ ID NO: 188699 - RNA, 22 nt, Human
aagccaggcugcacuugcuggg

SEQ ID NO: 188700 - RNA, 22 nt, Human
acagcagagccugguacuuacu

SEQ ID NO: 188701 - RNA, 22 nt, Human
gugggcuuguuuugaugagauc

SEQ ID NO: 188702 - RNA, 21 nt, Human
gaagacacauaaccucucucc

SEQ ID NO: 188703 - RNA, 22 nt, Human
uuuaagcuaaugucauaauuag

SEQ ID NO: 188704 - RNA, 22 nt, Human
ugaggcagccugcauuaaagag

SEQ ID NO: 188705 - RNA, 22 nt, Human
uccuggccuagcucacccugga

SEQ ID NO: 188706 - RNA, 22 nt, Human
ugguaauuaauuugauagguuc

SEQ ID NO: 188707 - RNA, 22 nt, Human
cagcaggacguccaagugcuau

SEQ ID NO: 188708 - RNA, 22 nt, Human
gcaguccaaaguggcucucacc

SEQ ID NO: 188709 - RNA, 22 nt, Human
agugcuuuccuucuugugacau

SEQ ID NO: 188710 - RNA, 22 nt, Human
ugggagcucagaaagggagguc

SEQ ID NO: 188711 - RNA, 22 nt, Human
agggccagaaucccucagucua

SEQ ID NO: 188712 - RNA, 22 nt, Human
agaauccuguuuuacuucauca

SEQ ID NO: 188713 - RNA, 22 nt, Human
ugagaaaauccagaggcuaguu

SEQ ID NO: 188714 - RNA, 22 nt, Human
aggcagagcuaggaagaauugu

SEQ ID NO: 188715 - RNA, 20 nt, Human
uugagcuuuuaguacagaca

SEQ ID NO: 188716 - RNA, 22 nt, Human
gcuggcuuaauguagcuaaaaa

SEQ ID NO: 188717 - RNA, 22 nt, Human
uuuucaauuuugaggcaguggu

SEQ ID NO: 188718 - RNA, 22 nt, Human
uuacagugcucuucaagacuuc

SEQ ID NO: 188719 - RNA, 22 nt, Human
gaacaguacaguugaguaguug

SEQ ID NO: 188720 - RNA, 22 nt, Human
augggacacguuuuaaggaaaa

SEQ ID NO: 188721 - RNA, 22 nt, Human
acaaaugugucuaauugugccu

SEQ ID NO: 188722 - RNA, 22 nt, Human
cucugcaggccugugaagggug

SEQ ID NO: 188723 - RNA, 21 nt, Human
gcagccacugccuucaacaau

SEQ ID NO: 188724 - RNA, 22 nt, Human
auauacacaucuuuuuaaauau

SEQ ID NO: 188725 - RNA, 22 nt, Human
ucaggucuauacuaugagaggc

SEQ ID NO: 188726 - RNA, 22 nt, Human
cacagaggucugggcccagcag

SEQ ID NO: 188727 - RNA, 22 nt, Human
cugaggagcguuggucacgugu

SEQ ID NO: 188728 - RNA, 22 nt, Human
agugucuguuguucagaacucu

SEQ ID NO: 188729 - RNA, 22 nt, Human
uacaagucacuuccuuucuaaa

SEQ ID NO: 188730 - RNA, 22 nt, Human
caccagcuuacagucucacccc

SEQ ID NO: 188731 - RNA, 22 nt, Human
cagggcucccaaauaucucuuc

SEQ ID NO: 188732 - RNA, 18 nt, Human
ggauaggaccuuaggcag

SEQ ID NO: 188733 - RNA, 20 nt, Human
uuuuccagaaaguaucauug

SEQ ID NO: 188734 - RNA, 18 nt, Human
acucugcggaggccccag

SEQ ID NO: 188735 - RNA, 22 nt, Human
gggcagguuauuggaguaggga

SEQ ID NO: 188736 - RNA, 22 nt, Human
agugcaggccccaggccaggcc

SEQ ID NO: 188737 - RNA, 20 nt, Human
acagagacugagacacuugc

SEQ ID NO: 188738 - RNA, 22 nt, Human
aaggcugagguagggccuaaaa

SEQ ID NO: 188739 - RNA, 22 nt, Human
uuccaggcuucucuggggcguc

SEQ ID NO: 188740 - RNA, 22 nt, Human
ccauguguugauucucugcaga

SEQ ID NO: 188741 - RNA, 22 nt, Human
acauuugagaugccuuuuaggu

SEQ ID NO: 188742 - RNA, 22 nt, Human
uugaaugaaugguccauauaga

SEQ ID NO: 188743 - RNA, 22 nt, Human
cauaacauccuugcuacuuuga

SEQ ID NO: 188744 - RNA, 22 nt, Human
acaguuaucuuugaaauagaga

SEQ ID NO: 188745 - RNA, 18 nt, Human
ccucugccauagccagca

SEQ ID NO: 188746 - RNA, 22 nt, Human
aaaucuaguaccuuuuugauua

SEQ ID NO: 188747 - RNA, 22 nt, Human
uuuaguguaagcauaaagaaca

SEQ ID NO: 188748 - RNA, 22 nt, Human
agaggcuguuacacucccagau

SEQ ID NO: 188749 - RNA, 21 nt, Human
guauucuuuaugaagugaaaa

SEQ ID NO: 188750 - RNA, 22 nt, Human
aucagaguguaaguucuuuccu

SEQ ID NO: 188751 - RNA, 22 nt, Human
gcucaggaucagccaccucuuu

SEQ ID NO: 188752 - RNA, 22 nt, Human
agcacuuuagaauuuagaguug

SEQ ID NO: 188753 - RNA, 22 nt, Human
gcaguguuuacauauuagaaac

SEQ ID NO: 188754 - RNA, 22 nt, Human
auucaagguauuuaaaacauaa

SEQ ID NO: 188755 - RNA, 22 nt, Human
uaauuagagucacaaguaacca

SEQ ID NO: 188756 - RNA, 22 nt, Human
agccuugaaccaauuguuuagc

SEQ ID NO: 188757 - RNA, 22 nt, Human
agcaaauacauuuuuagcauaa

SEQ ID NO: 188758 - RNA, 21 nt, Human
ugguacagaggaggugaagug

SEQ ID NO: 188759 - RNA, 22 nt, Human
ucucugggacacugggucaguu

SEQ ID NO: 188760 - RNA, 22 nt, Human
acucaggccccaucgcccaucu

SEQ ID NO: 188761 - RNA, 22 nt, Human
gugugucccuccucuccugagu

SEQ ID NO: 188762 - RNA, 22 nt, Human
ucucagugaagaguauaacaaa

SEQ ID NO: 188763 - RNA, 22 nt, Human
gcagcaggcacuuaccguugcu

SEQ ID NO: 188764 - RNA, 22 nt, Human
acuacaguaagggaggcagcau

SEQ ID NO: 188765 - RNA, 22 nt, Human
aagaguuauauaauguguaguu

SEQ ID NO: 188766 - RNA, 22 nt, Human
cagaaggcauagaugaaggccu

SEQ ID NO: 188767 - RNA, 22 nt, Human
agccuggcggucgucggucagg

SEQ ID NO: 188768 - RNA, 22 nt, Human
uggcagccucccagcugcauuc

SEQ ID NO: 188769 - RNA, 22 nt, Human
uggagguggcacaagggagguc

SEQ ID NO: 188770 - RNA, 22 nt, Human
guugccaggggcugcugucacc

SEQ ID NO: 188771 - RNA, 22 nt, Human
agucuagauguguacuagguua

SEQ ID NO: 188772 - RNA, 22 nt, Human
aaugggaaagagacuagaugcu

SEQ ID NO: 188773 - RNA, 22 nt, Human
uaucacuacacuaagauacaga

SEQ ID NO: 188774 - RNA, 20 nt, Human
auagacaaagacaugccaga

SEQ ID NO: 188775 - RNA, 19 nt, Human
ggggccugugauggucaca

SEQ ID NO: 188776 - RNA, 22 nt, Human
aagaauguggguggauaugaug

SEQ ID NO: 188777 - RNA, 22 nt, Human
gaguuaauucgaauauucuagc

SEQ ID NO: 188778 - RNA, 22 nt, Human
uugugcuccugugagaaucuag

SEQ ID NO: 188779 - RNA, 22 nt, Human
acagaguggaguucaguaaaua

SEQ ID NO: 188780 - RNA, 22 nt, Human
caggaggugacuuccagggguu

SEQ ID NO: 188781 - RNA, 22 nt, Human
uccaauauuucucacauaugga

SEQ ID NO: 188782 - RNA, 22 nt, Human
gccaggcauguccucugcagaa

SEQ ID NO: 188783 - RNA, 22 nt, Human
ucuggcaggcaaucggcucugg

SEQ ID NO: 188784 - RNA, 22 nt, Human
auucacauuuagacaucaggua

SEQ ID NO: 188785 - RNA, 22 nt, Human
cagaaagcgggaugcagcaugu

SEQ ID NO: 188786 - RNA, 22 nt, Human
cauuuugugcuagacacuaugg

SEQ ID NO: 188787 - RNA, 22 nt, Human
ugggagccauuuuagaggcugc

SEQ ID NO: 188788 - RNA, 22 nt, Human
cuccccuccuuaggucuucuag

SEQ ID NO: 188789 - RNA, 17 nt, Human
caggcacaugaagccag

SEQ ID NO: 188790 - RNA, 22 nt, Human
ggcugaaagcgcgacuugcccc

SEQ ID NO: 188791 - RNA, 22 nt, Human
auguaaacuuagauaagcagua

SEQ ID NO: 188792 - RNA, 20 nt, Human
aaagagaagccucaccuugu

SEQ ID NO: 188793 - RNA, 22 nt, Human
ugcaaacagccuugaaagaggg

SEQ ID NO: 188794 - RNA, 22 nt, Human
cccugggauucaauuucacucu

SEQ ID NO: 188795 - RNA, 22 nt, Human
cucauuuaccuuugcaaucaag

SEQ ID NO: 188796 - RNA, 20 nt, Human
ccagagcagccacugaaguu

SEQ ID NO: 188797 - RNA, 22 nt, Human
uuccuucuggaagcuucagggg

SEQ ID NO: 188798 - RNA, 22 nt, Human
ugcaaauguguagguuuacaua

SEQ ID NO: 188799 - RNA, 22 nt, Human
caggacucuugucaucaucagu

SEQ ID NO: 188800 - RNA, 22 nt, Human
ugcaggcucacccuggagcuga

SEQ ID NO: 188801 - RNA, 22 nt, Human
ccugagaguaggugucucuuua

SEQ ID NO: 188802 - RNA, 22 nt, Human
ugguauuuccaggcuuauggua

SEQ ID NO: 188803 - RNA, 22 nt, Human
ucugagacacucuugugauggg

SEQ ID NO: 188804 - RNA, 22 nt, Human
gaaggcuugccgggaagcggca

SEQ ID NO: 188805 - RNA, 20 nt, Human
uucucuggauagccagaugu

SEQ ID NO: 188806 - RNA, 22 nt, Human
acacuugauaggucaaaucagu

SEQ ID NO: 188807 - RNA, 21 nt, Human
agcugcagucaagccagaggu

SEQ ID NO: 188808 - RNA, 22 nt, Human
ucucauugguaugauguguaga

SEQ ID NO: 188809 - RNA, 22 nt, Human
augcuguguggucaaguuaauu

SEQ ID NO: 188810 - RNA, 22 nt, Human
gauaauauuagaagauacaaau

SEQ ID NO: 188811 - RNA, 22 nt, Human
aagugcauauuuuuguuguaga

SEQ ID NO: 188812 - RNA, 22 nt, Human
cuuuauauccagauguuuggug

SEQ ID NO: 188813 - RNA, 22 nt, Human
ucagugcaggaaucucuagcca

SEQ ID NO: 188814 - RNA, 22 nt, Human
uuuuuaagcuccuuugauguca

SEQ ID NO: 188815 - RNA, 22 nt, Human
aaggaaauuagguuauuuugcu

SEQ ID NO: 188816 - RNA, 22 nt, Human
ccuggcacaucuaacucacucu

SEQ ID NO: 188817 - RNA, 22 nt, Human
ccacugcccccugaagaccagg

SEQ ID NO: 188818 - RNA, 22 nt, Human
ucuggcaguuugagaaaggcua

SEQ ID NO: 188819 - RNA, 22 nt, Human
agugcagggccugcccagcagg

SEQ ID NO: 188820 - RNA, 22 nt, Human
gugagcaggauuucauggugua

SEQ ID NO: 188821 - RNA, 22 nt, Human
uggccaggcauucagauaagac

SEQ ID NO: 188822 - RNA, 22 nt, Human
cugaggagcagcuggcccgcua

SEQ ID NO: 188823 - RNA, 22 nt, Human
ugggcucucgucccugcagaag

SEQ ID NO: 188824 - RNA, 22 nt, Human
acaagauagcuuagaagauuca

SEQ ID NO: 188825 - RNA, 22 nt, Human
aaggaacacuacaaggcuggga

SEQ ID NO: 188826 - RNA, 20 nt, Human
ugcugcagacagggccauug

SEQ ID NO: 188827 - RNA, 22 nt, Human
uccugcagaucaaagccuuuga

SEQ ID NO: 188828 - RNA, 22 nt, Human
gcuccuguaauuuuuaaaaguc

SEQ ID NO: 188829 - RNA, 22 nt, Human
cucuuuggggugccccacuggu

SEQ ID NO: 188830 - RNA, 22 nt, Human
ucuguaggcuuacgcggcuucu

SEQ ID NO: 188831 - RNA, 22 nt, Human
agggucaguucugugagguguu

SEQ ID NO: 188832 - RNA, 22 nt, Human
guggcagauugcucaccauggu

SEQ ID NO: 188833 - RNA, 22 nt, Human
ccuggagggcgccgcacagucc

SEQ ID NO: 188834 - RNA, 19 nt, Human
agugugagacuccaucuca

SEQ ID NO: 188835 - RNA, 22 nt, Human
gcuguggcucucacaagcaaau

SEQ ID NO: 188836 - RNA, 22 nt, Human
ggugccagaguggcccaggggc

SEQ ID NO: 188837 - RNA, 22 nt, Human
caagggaagaggacagggaccu

SEQ ID NO: 188838 - RNA, 22 nt, Human
gcacauaugcuguaagcacaug

SEQ ID NO: 188839 - RNA, 22 nt, Human
ucaccaggcuccuguuaagaug

SEQ ID NO: 188840 - RNA, 22 nt, Human
ugucacaguuuguacuuuauag

SEQ ID NO: 188841 - RNA, 22 nt, Human
aacauauaaacucuuaaguuca

SEQ ID NO: 188842 - RNA, 22 nt, Human
gagcacagcuggagguagcauu

SEQ ID NO: 188843 - RNA, 22 nt, Human
uuuggaagacagggcaggaaag

SEQ ID NO: 188844 - RNA, 22 nt, Human
gcauccaaaccauucaucagcc

SEQ ID NO: 188845 - RNA, 22 nt, Human
ggugcaaaaguaauuugguuuu

SEQ ID NO: 188846 - RNA, 22 nt, Human
ggagcugagacccaguggcuga

SEQ ID NO: 188847 - RNA, 22 nt, Human
ccugugcauugaccacacucuc

SEQ ID NO: 188848 - RNA, 22 nt, Human
gccaccuguuucagaugugguu

SEQ ID NO: 188849 - RNA, 22 nt, Human
cacagcauuaacugggacagcu

SEQ ID NO: 188850 - RNA, 22 nt, Human
guggguggggagcucucuggag

SEQ ID NO: 188851 - RNA, 22 nt, Human
ucugaauucugacaauuugaau

SEQ ID NO: 188852 - RNA, 22 nt, Human
acaguguggggugagauggaac

SEQ ID NO: 188853 - RNA, 22 nt, Human
gagggcucugaaaggaggucac

SEQ ID NO: 188854 - RNA, 22 nt, Human
gcuggagguuucaccugaguuu

SEQ ID NO: 188855 - RNA, 22 nt, Human
uugggaaguaauaugguggucu

SEQ ID NO: 188856 - RNA, 22 nt, Human
auucuuauuauaguaaaacagu

SEQ ID NO: 188857 - RNA, 22 nt, Human
gaguccuucuggcuggcaggau

SEQ ID NO: 188858 - RNA, 22 nt, Human
gacaagauaaugaagugcaauu

SEQ ID NO: 188859 - RNA, 22 nt, Human
agugucaguugccuugucauaa

SEQ ID NO: 188860 - RNA, 22 nt, Human
gguggcagaauaauugaagguc

SEQ ID NO: 188861 - RNA, 22 nt, Human
ugagcagaagcccuccuggacu

SEQ ID NO: 188862 - RNA, 22 nt, Human
ccuggccucuccgaguaaccug

SEQ ID NO: 188863 - RNA, 22 nt, Human
uuuuuacacuuagcauugagcg

SEQ ID NO: 188864 - RNA, 23 nt, Human
ucagagaggcccccugcagagau

SEQ ID NO: 188865 - RNA, 22 nt, Human
ccucagaggugaacaucagugc

SEQ ID NO: 188866 - RNA, 22 nt, Human
uagaagcaguaauagaaauagg

SEQ ID NO: 188867 - RNA, 22 nt, Human
cacugguagagagaagacaagg

SEQ ID NO: 188868 - RNA, 22 nt, Human
ugguccuuuaagucuuucucug

SEQ ID NO: 188869 - RNA, 22 nt, Human
uggcaaaggaaaugauuuaaga

SEQ ID NO: 188870 - RNA, 22 nt, Human
ucuccagggacauguuucugga

SEQ ID NO: 188871 - RNA, 22 nt, Human
auguuaaaagugaggauggcca

SEQ ID NO: 188872 - RNA, 22 nt, Human
guucucugaguccuggcaaaau

SEQ ID NO: 188873 - RNA, 22 nt, Human
acacagaugcauuacacaucua

SEQ ID NO: 188874 - RNA, 22 nt, Human
cauuuguaguaucuguuuauau

SEQ ID NO: 188875 - RNA, 22 nt, Human
ggcccugagucuagcugcucuu

SEQ ID NO: 188876 - RNA, 22 nt, Human
aggcaucuaacagagaucuuua

SEQ ID NO: 188877 - RNA, 22 nt, Human
caggugcucugcugcagguaag

SEQ ID NO: 188878 - RNA, 22 nt, Human
caggcuggagugaguguagugg

SEQ ID NO: 188879 - RNA, 23 nt, Human
ugucuucgacuccugcgugcuuc

SEQ ID NO: 188880 - RNA, 22 nt, Human
ucagcaggcacaccaaaaacug

SEQ ID NO: 188881 - RNA, 22 nt, Human
agcuaggccauuuguucaguga

SEQ ID NO: 188882 - RNA, 22 nt, Human
uugagcaaugcugcaaagagau

SEQ ID NO: 188883 - RNA, 22 nt, Human
uuggcuaugcuuguguucaguu

SEQ ID NO: 188884 - RNA, 22 nt, Human
cccaggcugcaugaguccaugg

SEQ ID NO: 188885 - RNA, 19 nt, Human
acugagaccacagacaagu

SEQ ID NO: 188886 - RNA, 18 nt, Human
gcacagagcccaggcucu

SEQ ID NO: 188887 - RNA, 22 nt, Human
agagccagcauuugggcccugc

SEQ ID NO: 188888 - RNA, 22 nt, Human
ccagcuccaggacugggagcug

SEQ ID NO: 188889 - RNA, 22 nt, Human
cagagucauugacuuccaggag

SEQ ID NO: 188890 - RNA, 22 nt, Human
cauggcagugauucagccuuug

SEQ ID NO: 188891 - RNA, 22 nt, Human
aauugcuuagagaauccaggua

SEQ ID NO: 188892 - RNA, 21 nt, Human
aauagcauucaggaugggcuc

SEQ ID NO: 188893 - RNA, 22 nt, Human
gaaagcacaguucugaccaugu

SEQ ID NO: 188894 - RNA, 19 nt, Human
ugccucagggcuuugagga

SEQ ID NO: 188895 - RNA, 22 nt, Human
cugugucccccucagccaggug

SEQ ID NO: 188896 - RNA, 22 nt, Human
uggcuuuacuuaaacugaauca

SEQ ID NO: 188897 - RNA, 22 nt, Human
cacacuuugugcuaaucuauuu

SEQ ID NO: 188898 - RNA, 22 nt, Human
ucucuuuguggccaggagagga

SEQ ID NO: 188899 - RNA, 22 nt, Human
cucagccaugcaacaugcuggg

SEQ ID NO: 188900 - RNA, 22 nt, Human
uaagcugugggagauuggcaua

SEQ ID NO: 188901 - RNA, 22 nt, Human
augcaaaauaaggcagaaacau

SEQ ID NO: 188902 - RNA, 22 nt, Human
gugaaauauuuaacguccaggu

SEQ ID NO: 188903 - RNA, 22 nt, Human
gcaggcagaucaccugucagga

SEQ ID NO: 188904 - RNA, 22 nt, Human
uggaguugcagcuaccagacau

SEQ ID NO: 188905 - RNA, 22 nt, Human
agucacauucugggguacuggg

SEQ ID NO: 188906 - RNA, 22 nt, Human
uuggaacaggauucaauuaaag

SEQ ID NO: 188907 - RNA, 22 nt, Human
caugaggugauaaagcugggau

SEQ ID NO: 188908 - RNA, 17 nt, Human
gccuggcccagccuggc

SEQ ID NO: 188909 - RNA, 22 nt, Human
uuaaaagagacuuccuuuguuu

SEQ ID NO: 188910 - RNA, 22 nt, Human
guguguccucaguaguggcaug

SEQ ID NO: 188911 - RNA, 22 nt, Human
uaugauaaccuguuguaguuug

SEQ ID NO: 188912 - RNA, 19 nt, Human
ugaggccagcuggcauuuu

SEQ ID NO: 188913 - RNA, 22 nt, Human
aagauggcugcagcaauuccaa

SEQ ID NO: 188914 - RNA, 22 nt, Human
ucccagggcacucacccucccu

SEQ ID NO: 188915 - RNA, 22 nt, Human
ucuuuccaaggacucuguagca

SEQ ID NO: 188916 - RNA, 22 nt, Human
uuacaaacaacagacauuuauu

SEQ ID NO: 188917 - RNA, 22 nt, Human
cuuucucuucgaaaaccugccc

SEQ ID NO: 188918 - RNA, 22 nt, Human
cugcugguugcacagagcuagg

SEQ ID NO: 188919 - RNA, 22 nt, Human
gggaacuugccccagaggaauu

SEQ ID NO: 188920 - RNA, 22 nt, Human
ugccaccccucugcacccucag

SEQ ID NO: 188921 - RNA, 22 nt, Human
agcaccagcaacuaugggcugc

SEQ ID NO: 188922 - RNA, 22 nt, Human
ggcuucuugugugucaggcucu

SEQ ID NO: 188923 - RNA, 22 nt, Human
ccagcaggacuuuggaaauaug

SEQ ID NO: 188924 - RNA, 22 nt, Human
ugcuggagaugaaagggcccug

SEQ ID NO: 188925 - RNA, 22 nt, Human
acacauuuacauguuuacguau

SEQ ID NO: 188926 - RNA, 22 nt, Human
ucauuagaaaugcagauucuca

SEQ ID NO: 188927 - RNA, 22 nt, Human
agauggugauagagcugggauu

SEQ ID NO: 188928 - RNA, 22 nt, Human
ccuuccuuuuacugucuccgga

SEQ ID NO: 188929 - RNA, 22 nt, Human
auuucuucagguucuucuagga

SEQ ID NO: 188930 - RNA, 22 nt, Human
cagguccccuccccuaccaggc

SEQ ID NO: 188931 - RNA, 22 nt, Human
guggcccaggcuuggcgcuggc

SEQ ID NO: 188932 - RNA, 22 nt, Human
uuuccucugggcccugccaccc

SEQ ID NO: 188933 - RNA, 22 nt, Human
cuggcugugcagucuuccagaa

SEQ ID NO: 188934 - RNA, 22 nt, Human
acuuuuuaguuuccucaaacau

SEQ ID NO: 188935 - RNA, 17 nt, Human
gauuagaaaacacauga

SEQ ID NO: 188936 - RNA, 22 nt, Human
gaggaagccccauugaagccag

SEQ ID NO: 188937 - RNA, 22 nt, Human
ugaaggaggaauguggccucca

SEQ ID NO: 188938 - RNA, 17 nt, Human
uguccauuugccuggag

SEQ ID NO: 188939 - RNA, 22 nt, Human
ucagcuuucucuucuaucgaua

SEQ ID NO: 188940 - RNA, 22 nt, Human
ccccuuggcugcucucaagucc

SEQ ID NO: 188941 - RNA, 22 nt, Human
acacaguucuuucacuguuggu

SEQ ID NO: 188942 - RNA, 22 nt, Human
aaagcuauuuauuacagagaau

SEQ ID NO: 188943 - RNA, 22 nt, Human
ucaggcaggacaauuauuuagg

SEQ ID NO: 188944 - RNA, 23 nt, Human
ccacuggagaaaguggcaggugg

SEQ ID NO: 188945 - RNA, 22 nt, Human
auaguacauggguguccucaca

SEQ ID NO: 188946 - RNA, 22 nt, Human
uacaacaguucaugaaaugaaa

SEQ ID NO: 188947 - RNA, 22 nt, Human
uugaggcaaaaucaacgggaag

SEQ ID NO: 188948 - RNA, 23 nt, Human
cguguccuucagggagagugugg

SEQ ID NO: 188949 - RNA, 22 nt, Human
agcggcuggaccagcguucaag

SEQ ID NO: 188950 - RNA, 22 nt, Human
aauaugauccuuaaccuucaug

SEQ ID NO: 188951 - RNA, 22 nt, Human
caggagugaguuggggucuaca

SEQ ID NO: 188952 - RNA, 22 nt, Human
cugccuuugcccuugacacugu

SEQ ID NO: 188953 - RNA, 22 nt, Human
uacuuuauuguaaaugcugaug

SEQ ID NO: 188954 - RNA, 22 nt, Human
uggagcagaggcugagguuggg

SEQ ID NO: 188955 - RNA, 22 nt, Human
ucaagacauauuaaaugugcga

SEQ ID NO: 188956 - RNA, 22 nt, Human
gacagacauuuccugauccaau

SEQ ID NO: 188957 - RNA, 22 nt, Human
aguguccuugauuccuguuguu

SEQ ID NO: 188958 - RNA, 22 nt, Human
ugacugaaggacuagauugauu

SEQ ID NO: 188959 - RNA, 22 nt, Human
uucuacaaauauuuacuguucc

SEQ ID NO: 188960 - RNA, 22 nt, Human
uugucauugggguuauuuguua

SEQ ID NO: 188961 - RNA, 22 nt, Human
guggagggaaugaaucuucucu

SEQ ID NO: 188962 - RNA, 22 nt, Human
caagggccaucugagggcacug

SEQ ID NO: 188963 - RNA, 22 nt, Human
ggaggauuugucaucugaagau

SEQ ID NO: 188964 - RNA, 22 nt, Human
uagcugaauaaugcgucugcag

SEQ ID NO: 188965 - RNA, 22 nt, Human
ucuuuggauggaaaauguauuc

SEQ ID NO: 188966 - RNA, 22 nt, Human
aaagccaucuguauuaagugaa

SEQ ID NO: 188967 - RNA, 22 nt, Human
caugagaaugaagaagacuuaa

SEQ ID NO: 188968 - RNA, 22 nt, Human
cuguggcucauucuugguggca

SEQ ID NO: 188969 - RNA, 22 nt, Human
aggugacaggacaggagcuggu

SEQ ID NO: 188970 - RNA, 22 nt, Human
caggagacaauggcuguggggc

SEQ ID NO: 188971 - RNA, 22 nt, Human
uguuacaggaaauagaauuacc

SEQ ID NO: 188972 - RNA, 21 nt, Human
cagagccagacugcugaauuu

SEQ ID NO: 188973 - RNA, 22 nt, Human
caggcuuggagggcaguggcau

SEQ ID NO: 188974 - RNA, 22 nt, Human
cuugggauguaaccuuuguucc

SEQ ID NO: 188975 - RNA, 22 nt, Human
caaagcugugaauuccuacaaa

SEQ ID NO: 188976 - RNA, 23 nt, Human
ucucaaauaugaucugggucauc

SEQ ID NO: 188977 - RNA, 22 nt, Human
uggcccaguagaaaagggaucg

SEQ ID NO: 188978 - RNA, 22 nt, Human
uggugcugccaggcuccugcca

SEQ ID NO: 188979 - RNA, 22 nt, Human
uccaggcagagcaacaaaauau

SEQ ID NO: 188980 - RNA, 22 nt, Human
auugagcagcuucucugccauc

SEQ ID NO: 188981 - RNA, 23 nt, Human
gggagcuguggugaaaagaggug

SEQ ID NO: 188982 - RNA, 22 nt, Human
aguggacucuucccagugcuug

SEQ ID NO: 188983 - RNA, 20 nt, Human
ggaaucaggguaauguacug

SEQ ID NO: 188984 - RNA, 22 nt, Human
uggcagguagaguucugagaug

SEQ ID NO: 188985 - RNA, 22 nt, Human
uugcacaucuaauaaugcuaga

SEQ ID NO: 188986 - RNA, 22 nt, Human
uguggcagaaccagaauucaaa

SEQ ID NO: 188987 - RNA, 22 nt, Human
ugggagcccaagggagcugccg

SEQ ID NO: 188988 - RNA, 22 nt, Human
aggaagaguguuaccuaugggu

SEQ ID NO: 188989 - RNA, 22 nt, Human
uuagagcugauaguacacuggu

SEQ ID NO: 188990 - RNA, 22 nt, Human
gccuccccugcaauuguccuug

SEQ ID NO: 188991 - RNA, 22 nt, Human
acaguuuagagcaugaugacca

SEQ ID NO: 188992 - RNA, 22 nt, Human
agaggaaggaugcauauccaaa

SEQ ID NO: 188993 - RNA, 22 nt, Human
cugcucuggcuguguacuucag

SEQ ID NO: 188994 - RNA, 22 nt, Human
aagggcugaaagaccuugggca

SEQ ID NO: 188995 - RNA, 22 nt, Human
ccugggccaggcuugggaaugc

SEQ ID NO: 188996 - RNA, 22 nt, Human
gcucugagcccccagaagcaga

SEQ ID NO: 188997 - RNA, 22 nt, Human
aaaggcuaauuaaccaccuggu

SEQ ID NO: 188998 - RNA, 22 nt, Human
uuucauaaccucaagcuacagu

SEQ ID NO: 188999 - RNA, 22 nt, Human
uggagagucucugagccagggc

SEQ ID NO: 189000 - RNA, 18 nt, Human
acucaggaaaugaugaca

SEQ ID NO: 189001 - RNA, 18 nt, Human
agcuccugaacucugugg

SEQ ID NO: 189002 - RNA, 22 nt, Human
cccucagagccugaagcaagca

SEQ ID NO: 189003 - RNA, 21 nt, Human
aacuacaguuguuccuucauu

SEQ ID NO: 189004 - RNA, 23 nt, Human
cucuccaccuucccacccaggga

SEQ ID NO: 189005 - RNA, 18 nt, Human
cucaguguuugcugaaaa

SEQ ID NO: 189006 - RNA, 22 nt, Human
ugcuuccugcuaaggcugccug

SEQ ID NO: 189007 - RNA, 22 nt, Human
agcuggcuuuaugguuggcuaa

SEQ ID NO: 189008 - RNA, 22 nt, Human
cuucuggcguuggaggucugag

SEQ ID NO: 189009 - RNA, 22 nt, Human
ugagcaguucgacuucuucccc

SEQ ID NO: 189010 - RNA, 22 nt, Human
cuguggcugaguuccuuauguu

SEQ ID NO: 189011 - RNA, 22 nt, Human
uacaugcuuaaaaugcaauguu

SEQ ID NO: 189012 - RNA, 22 nt, Human
ccagccacgaagcucccuucau

SEQ ID NO: 189013 - RNA, 22 nt, Human
cacuuauuaugggcuaggaacu

SEQ ID NO: 189014 - RNA, 22 nt, Human
uccuucugaaaaaugcacacga

SEQ ID NO: 189015 - RNA, 19 nt, Human
gccacaucuguaccccuuu

SEQ ID NO: 189016 - RNA, 22 nt, Human
aucuuuauuuauugagcacuua

SEQ ID NO: 189017 - RNA, 21 nt, Human
ugcucagucugucuccagcuu

SEQ ID NO: 189018 - RNA, 22 nt, Human
gagagggcugccuggugugagg

SEQ ID NO: 189019 - RNA, 22 nt, Human
aauauuuauauuucucuucccu

SEQ ID NO: 189020 - RNA, 21 nt, Human
ccagucuguaaaauggggaca

SEQ ID NO: 189021 - RNA, 18 nt, Human
ucagcuggggcugcagcc

SEQ ID NO: 189022 - RNA, 21 nt, Human
ccaggguccagcugccauggu

SEQ ID NO: 189023 - RNA, 22 nt, Human
uaacacugugcccagaguccca

SEQ ID NO: 189024 - RNA, 22 nt, Human
acaggcugcugggcuccgugcu

SEQ ID NO: 189025 - RNA, 22 nt, Human
uuucccaauugagagguucugu

SEQ ID NO: 189026 - RNA, 23 nt, Human
agcuggguggccugcgugaagcu

SEQ ID NO: 189027 - RNA, 22 nt, Human
ucugagggugggagaaggagcu

SEQ ID NO: 189028 - RNA, 22 nt, Human
caaauacuuuuagccuauugag

SEQ ID NO: 189029 - RNA, 22 nt, Human
uuuuacaggugaaaaaugaaga

SEQ ID NO: 189030 - RNA, 22 nt, Human
uccucagaauccaaacugcagu

SEQ ID NO: 189031 - RNA, 22 nt, Human
acccagggcagccagcggggag

SEQ ID NO: 189032 - RNA, 22 nt, Human
guggcagaaauauucuugcucu

SEQ ID NO: 189033 - RNA, 22 nt, Human
ugcagaaauucagaaagcauaa

SEQ ID NO: 189034 - RNA, 22 nt, Human
uucacuguaugagagggcuuga

SEQ ID NO: 189035 - RNA, 22 nt, Human
agugaaauaaagcugccuaugg

SEQ ID NO: 189036 - RNA, 22 nt, Human
uguguucaugucacuggaaucc

SEQ ID NO: 189037 - RNA, 22 nt, Human
aucacuguguauguauaugcag

SEQ ID NO: 189038 - RNA, 22 nt, Human
cugccuggccugaucuccacgc

SEQ ID NO: 189039 - RNA, 22 nt, Human
ucaguaguuuugaucugagcag

SEQ ID NO: 189040 - RNA, 22 nt, Human
gcucugggguuggaaagugauc

SEQ ID NO: 189041 - RNA, 22 nt, Human
ggucaggauccaagucugugcu

SEQ ID NO: 189042 - RNA, 22 nt, Human
cuuguauuaagcuuagagaggc

SEQ ID NO: 189043 - RNA, 22 nt, Human
uaaagcaagacacacccauagc

SEQ ID NO: 189044 - RNA, 22 nt, Human
ccccucugcaaauagccaggcu

SEQ ID NO: 189045 - RNA, 22 nt, Human
uuucaucucucuaaaagacagu

SEQ ID NO: 189046 - RNA, 22 nt, Human
aaucauaauuguauacauucau

SEQ ID NO: 189047 - RNA, 22 nt, Human
agcugcagauucucuacuucau

SEQ ID NO: 189048 - RNA, 22 nt, Human
ggaggaggggugacugaaugcu

SEQ ID NO: 189049 - RNA, 22 nt, Human
cauucugacccuaugauuuaag

SEQ ID NO: 189050 - RNA, 22 nt, Human
uuucaaagggaaguuaugaagu

SEQ ID NO: 189051 - RNA, 22 nt, Human
uacugaaagacugaauauuuag

SEQ ID NO: 189052 - RNA, 22 nt, Human
agauaacugguuuacauuauug

SEQ ID NO: 189053 - RNA, 22 nt, Human
gcugcugcaagagccagcucuu

SEQ ID NO: 189054 - RNA, 22 nt, Human
ccacaggacggaggucuggccg

SEQ ID NO: 189055 - RNA, 22 nt, Human
gacugaaggucucagcauguga

SEQ ID NO: 189056 - RNA, 22 nt, Human
aacacagguucauucugugagg

SEQ ID NO: 189057 - RNA, 23 nt, Human
acagacauuguacaucuuguuuu

SEQ ID NO: 189058 - RNA, 16 nt, Human
gggagggaguuggugg

SEQ ID NO: 189059 - RNA, 22 nt, Human
ucuuccucccuacagagcucag

SEQ ID NO: 189060 - RNA, 22 nt, Human
aagagcauuuccacuggcacug

SEQ ID NO: 189061 - RNA, 22 nt, Human
aggaagaacagauaauggacgc

SEQ ID NO: 189062 - RNA, 22 nt, Human
uuuacaguccccaggugaggau

SEQ ID NO: 189063 - RNA, 22 nt, Human
acugggaaggaaaggaauguaa

SEQ ID NO: 189064 - RNA, 22 nt, Human
aagaaucuuuccaguuuugaug

SEQ ID NO: 189065 - RNA, 19 nt, Human
augaugcagagcugacuca

SEQ ID NO: 189066 - RNA, 22 nt, Human
caguggggggacugaggccuga

SEQ ID NO: 189067 - RNA, 22 nt, Human
ucccagugcugcuaaagaggua

SEQ ID NO: 189068 - RNA, 22 nt, Human
acaggcugagcguccaucuuca

SEQ ID NO: 189069 - RNA, 22 nt, Human
caaauagaacucacagacaaga

SEQ ID NO: 189070 - RNA, 22 nt, Human
gguccuggaaguguaaguggca

SEQ ID NO: 189071 - RNA, 21 nt, Human
uuccuggcggcagaaacguga

SEQ ID NO: 189072 - RNA, 22 nt, Human
uugcugggcucuucaacacaca

SEQ ID NO: 189073 - RNA, 22 nt, Human
uucauuaguucugaagaugucu

SEQ ID NO: 189074 - RNA, 22 nt, Human
aggccacagccugggaggugac

SEQ ID NO: 189075 - RNA, 22 nt, Human
uggaggcagguggaggagugaa

SEQ ID NO: 189076 - RNA, 17 nt, Human
uggucuggaagaacuga

SEQ ID NO: 189077 - RNA, 22 nt, Human
gagagguuccucccugcuuuac

SEQ ID NO: 189078 - RNA, 22 nt, Human
uggaagccucaguuugccuucu

SEQ ID NO: 189079 - RNA, 22 nt, Human
gaaaaggauugguaaaauaucu

SEQ ID NO: 189080 - RNA, 22 nt, Human
gccagcuggcugcaggucccag

SEQ ID NO: 189081 - RNA, 22 nt, Human
caggguggcccuguggucucau

SEQ ID NO: 189082 - RNA, 23 nt, Human
uggauaaaauacuuacauucaac

SEQ ID NO: 189083 - RNA, 17 nt, Human
ugaggccauggcaccau

SEQ ID NO: 189084 - RNA, 22 nt, Human
cugcccugggauggucugugcg

SEQ ID NO: 189085 - RNA, 22 nt, Human
uggcaggaagacguggggcacc

SEQ ID NO: 189086 - RNA, 22 nt, Human
gaauguuagagauucuuagguu

SEQ ID NO: 189087 - RNA, 22 nt, Human
uuucacaaucaaauggugaaau

SEQ ID NO: 189088 - RNA, 22 nt, Human
cguccaggaagaucggccgaug

SEQ ID NO: 189089 - RNA, 22 nt, Human
accuuggcaguuucuaccuuuu

SEQ ID NO: 189090 - RNA, 22 nt, Human
ucugcaagaucauuaaagcaga

SEQ ID NO: 189091 - RNA, 22 nt, Human
uucaacaaugaaagcuaaggaa

SEQ ID NO: 189092 - RNA, 22 nt, Human
guguguccaaggccacaauagc

SEQ ID NO: 189093 - RNA, 18 nt, Human
ucaggcucucuggcuaga

SEQ ID NO: 189094 - RNA, 22 nt, Human
ugggagcagcugggaacacagc

SEQ ID NO: 189095 - RNA, 22 nt, Human
gggagggaggugcugguucacg

SEQ ID NO: 189096 - RNA, 22 nt, Human
ucucagcacguuguuuucauug

SEQ ID NO: 189097 - RNA, 22 nt, Human
gaccacagaggugugggagaga

SEQ ID NO: 189098 - RNA, 22 nt, Human
agcagcucauggaguaggcacu

SEQ ID NO: 189099 - RNA, 22 nt, Human
accaggagggacccugguggcc

SEQ ID NO: 189100 - RNA, 22 nt, Human
uuauugaguuuacagcuuuaga

SEQ ID NO: 189101 - RNA, 22 nt, Human
caaaugaaguccaaagggcuua

SEQ ID NO: 189102 - RNA, 22 nt, Human
ucagugcuugccucuggaggag

SEQ ID NO: 189103 - RNA, 22 nt, Human
uccugugggcucucggccucca

SEQ ID NO: 189104 - RNA, 20 nt, Human
agcaggugacggggccugcu

SEQ ID NO: 189105 - RNA, 22 nt, Human
aucaggaucaugcuggguggga

SEQ ID NO: 189106 - RNA, 22 nt, Human
cugggaggcagucucucuagaa

SEQ ID NO: 189107 - RNA, 22 nt, Human
ucaucugaacaugcagccugug

SEQ ID NO: 189108 - RNA, 22 nt, Human
ugcccugguagacacagacugu

SEQ ID NO: 189109 - RNA, 21 nt, Human
ugucuucauaugagauggugu

SEQ ID NO: 189110 - RNA, 22 nt, Human
aacaggaugucauuucucaugu

SEQ ID NO: 189111 - RNA, 23 nt, Human
ggacaugucucuggguauuuuga

SEQ ID NO: 189112 - RNA, 22 nt, Human
augcccugccaagcaggcuaaa

SEQ ID NO: 189113 - RNA, 22 nt, Human
acaagagauuaucuacagauga

SEQ ID NO: 189114 - RNA, 22 nt, Human
cagccccagcacuuagcugagu

SEQ ID NO: 189115 - RNA, 22 nt, Human
ucuuguguggaacugcuuuucu

SEQ ID NO: 189116 - RNA, 22 nt, Human
ugagaaucagcugcacagaggu

SEQ ID NO: 189117 - RNA, 22 nt, Human
uuacuaaguuuuaugcaacuua

SEQ ID NO: 189118 - RNA, 22 nt, Human
gcagcagcccagggcucucaga

SEQ ID NO: 189119 - RNA, 22 nt, Human
uggcagguacccauuggcugua

SEQ ID NO: 189120 - RNA, 22 nt, Human
ucaacuaacucuauuauuugaa

SEQ ID NO: 189121 - RNA, 22 nt, Human
cauuguaagaggcuuugcagca

SEQ ID NO: 189122 - RNA, 22 nt, Human
gucuggcuuuauauuugcuauu

SEQ ID NO: 189123 - RNA, 22 nt, Human
gcuuuugucauucaaaugcucu

SEQ ID NO: 189124 - RNA, 22 nt, Human
accagcagaguugaggaggaca

SEQ ID NO: 189125 - RNA, 22 nt, Human
uccucagaugcucuuggacgcc

SEQ ID NO: 189126 - RNA, 22 nt, Human
ggaaggguuuggaaagccgaga

SEQ ID NO: 189127 - RNA, 22 nt, Human
uggugagcucuggcagucugug

SEQ ID NO: 189128 - RNA, 18 nt, Human
gcagggcugcacacgcau

SEQ ID NO: 189129 - RNA, 22 nt, Human
ucugggaagcugcgugccuguu

SEQ ID NO: 189130 - RNA, 22 nt, Human
cagugcaggcugggggcccugc

SEQ ID NO: 189131 - RNA, 22 nt, Human
ggccagcauauagagugaagua

SEQ ID NO: 189132 - RNA, 22 nt, Human
ucagcucugcaaggucaccucc

SEQ ID NO: 189133 - RNA, 22 nt, Human
aggcucuccagagagcugcuuu

SEQ ID NO: 189134 - RNA, 22 nt, Human
cagaacuguuauaacagcuguu

SEQ ID NO: 189135 - RNA, 22 nt, Human
agacauccuggggagggcaaug

SEQ ID NO: 189136 - RNA, 22 nt, Human
agcccugccucuccaaugccca

SEQ ID NO: 189137 - RNA, 22 nt, Human
cagcugguagguagcagauuug

SEQ ID NO: 189138 - RNA, 22 nt, Human
ugcaacuuguuuggagagaaag

SEQ ID NO: 189139 - RNA, 22 nt, Human
aggcagcuggaaaacuccaggc

SEQ ID NO: 189140 - RNA, 22 nt, Human
uccacagggaugccugcggcuu

SEQ ID NO: 189141 - RNA, 22 nt, Human
uagcugaagggcauuuaauaaa

SEQ ID NO: 189142 - RNA, 22 nt, Human
acuucauguuguuuacaacuua

SEQ ID NO: 189143 - RNA, 22 nt, Human
ccugugcucccauagcuucugu

SEQ ID NO: 189144 - RNA, 22 nt, Human
uaaggaauagugcuaugaaaaa

SEQ ID NO: 189145 - RNA, 22 nt, Human
agcaggcauagaguagcacuca

SEQ ID NO: 189146 - RNA, 22 nt, Human
uggugcaguagagcugucuggg

SEQ ID NO: 189147 - RNA, 22 nt, Human
ugaggaauguuuugagugccga

SEQ ID NO: 189148 - RNA, 22 nt, Human
caauucaugugagcggacucuu

SEQ ID NO: 189149 - RNA, 22 nt, Human
ucuuuucuguaacucagugucu

SEQ ID NO: 189150 - RNA, 22 nt, Human
ucccaggcuaggccucugcguu

SEQ ID NO: 189151 - RNA, 22 nt, Human
ugggcaggugcuauuuuccaug

SEQ ID NO: 189152 - RNA, 22 nt, Human
aaagguaucauguccauacagu

SEQ ID NO: 189153 - RNA, 20 nt, Human
uccucccccaccuuugcagc

SEQ ID NO: 189154 - RNA, 22 nt, Human
uuucaugaggcugcauaaggag

SEQ ID NO: 189155 - RNA, 22 nt, Human
aaguguuuccauugugcaggcu

SEQ ID NO: 189156 - RNA, 22 nt, Human
ucugaggaaaaguucuugucac

SEQ ID NO: 189157 - RNA, 19 nt, Human
aggacccuuauccuggcuu

SEQ ID NO: 189158 - RNA, 21 nt, Human
cccaggagaagaaaagaugca

SEQ ID NO: 189159 - RNA, 18 nt, Human
uuacacuagccuugguuc

SEQ ID NO: 189160 - RNA, 22 nt, Human
cagcagagaugagauuccuaua

SEQ ID NO: 189161 - RNA, 22 nt, Human
uaaugcuucaauuuccuugauu

SEQ ID NO: 189162 - RNA, 21 nt, Human
ggguguggaaauuacauccug

SEQ ID NO: 189163 - RNA, 19 nt, Human
gcccugaguaagcuaggag

SEQ ID NO: 189164 - RNA, 22 nt, Human
cugcugcaacucuuuagagggu

SEQ ID NO: 189165 - RNA, 23 nt, Human
ugucaacaaaacuuucaggagaa

SEQ ID NO: 189166 - RNA, 22 nt, Human
gcagccaggggcugugaccugu

SEQ ID NO: 189167 - RNA, 22 nt, Human
aguccuggcauauagguccuca

SEQ ID NO: 189168 - RNA, 22 nt, Human
accaauuuuuacagcugugguu

SEQ ID NO: 189169 - RNA, 22 nt, Human
uucuuuaugcuucuguuuaggc

SEQ ID NO: 189170 - RNA, 22 nt, Human
uauuucugagaaccaacuuacc

SEQ ID NO: 189171 - RNA, 22 nt, Human
caugugcuguagcagagaggaa

SEQ ID NO: 189172 - RNA, 22 nt, Human
acccagagccagggucaggagc

SEQ ID NO: 189173 - RNA, 22 nt, Human
acaggcucgugcgcgcacgugu

SEQ ID NO: 189174 - RNA, 22 nt, Human
aaggugcucacgggcucaggga

SEQ ID NO: 189175 - RNA, 22 nt, Human
uuacaguuuaguccaagccaga

SEQ ID NO: 189176 - RNA, 22 nt, Human
gccuggugauaagcagugaccu

SEQ ID NO: 189177 - RNA, 22 nt, Human
cacucuggggaugcaaggagag

SEQ ID NO: 189178 - RNA, 22 nt, Human
cuuccaaauguaaauaaguuuc

SEQ ID NO: 189179 - RNA, 22 nt, Human
gugagagaucccccacucaucu

SEQ ID NO: 189180 - RNA, 19 nt, Human
ucucccagcugagaagggc

SEQ ID NO: 189181 - RNA, 22 nt, Human
uucugggucacccuucugcuca

SEQ ID NO: 189182 - RNA, 22 nt, Human
gcucagagaugucugcugccuu

SEQ ID NO: 189183 - RNA, 22 nt, Human
agcugccaucugaagaacugca

SEQ ID NO: 189184 - RNA, 22 nt, Human
cccaugagguggagguugcagu

SEQ ID NO: 189185 - RNA, 22 nt, Human
acuugccuguuacauuucuagu

SEQ ID NO: 189186 - RNA, 22 nt, Human
gauucauguuauagagagucag

SEQ ID NO: 189187 - RNA, 22 nt, Human
gcacagagucacuagcuaagca

SEQ ID NO: 189188 - RNA, 22 nt, Human
ugagcccaggaguaugaggcug

SEQ ID NO: 189189 - RNA, 22 nt, Human
agugaaauagcauuuaugaagc

SEQ ID NO: 189190 - RNA, 22 nt, Human
agcuccuguucugagagcagga

SEQ ID NO: 189191 - RNA, 22 nt, Human
uccagggcaugcucagacucag

SEQ ID NO: 189192 - RNA, 22 nt, Human
aaugcacauguuguaauaaaua

SEQ ID NO: 189193 - RNA, 22 nt, Human
gggaaggccgguccagucaggu

SEQ ID NO: 189194 - RNA, 22 nt, Human
gauauugugaugaugucuuugg

SEQ ID NO: 189195 - RNA, 22 nt, Human
cuccucuuuacccgcauggucu

SEQ ID NO: 189196 - RNA, 22 nt, Human
aucaggauguuuggcugucaua

SEQ ID NO: 189197 - RNA, 22 nt, Human
augggcuugacccuacagaaag

SEQ ID NO: 189198 - RNA, 22 nt, Human
ugcuacacucaaucagugcuau

SEQ ID NO: 189199 - RNA, 22 nt, Human
aagagcugcacauauuuauauc

SEQ ID NO: 189200 - RNA, 22 nt, Human
uuagggaaggcugcugucagcu

SEQ ID NO: 189201 - RNA, 22 nt, Human
aggaugagaagauuggaaucuu

SEQ ID NO: 189202 - RNA, 22 nt, Human
ugcccacauggugccauggcca

SEQ ID NO: 189203 - RNA, 22 nt, Human
ugcucuggaaauaaaugauuua

SEQ ID NO: 189204 - RNA, 22 nt, Human
aucaagaacuuauuuuggaaau

SEQ ID NO: 189205 - RNA, 22 nt, Human
uccuguggcuuccacgaccuaa

SEQ ID NO: 189206 - RNA, 22 nt, Human
cagacaggguccuguccgucac

SEQ ID NO: 189207 - RNA, 22 nt, Human
gagacugcauagauggccacaa

SEQ ID NO: 189208 - RNA, 22 nt, Human
cacaauuuguuuuaucaguauu

SEQ ID NO: 189209 - RNA, 19 nt, Human
uaaaucuguauucuucaaa

SEQ ID NO: 189210 - RNA, 22 nt, Human
cugcccucuagggaugcacugg

SEQ ID NO: 189211 - RNA, 22 nt, Human
ggaugugaaucugggcugagac

SEQ ID NO: 189212 - RNA, 22 nt, Human
acccugagggguauagcagaag

SEQ ID NO: 189213 - RNA, 22 nt, Human
aagaaucucucaagugugacaa

SEQ ID NO: 189214 - RNA, 22 nt, Human
uuagcuuuagagccauuacugg

SEQ ID NO: 189215 - RNA, 22 nt, Human
ucuagaagggugccgaucuuag

SEQ ID NO: 189216 - RNA, 22 nt, Human
cugcuuuggcucagugacauca

SEQ ID NO: 189217 - RNA, 22 nt, Human
caucuuauuuucuucuagugcu

SEQ ID NO: 189218 - RNA, 22 nt, Human
gaggcugguucugaaguacugu

SEQ ID NO: 189219 - RNA, 22 nt, Human
uuggaggaggcauuggaggauu

SEQ ID NO: 189220 - RNA, 22 nt, Human
aacaagauguuuugauauaugu

SEQ ID NO: 189221 - RNA, 22 nt, Human
ucagggaguaguuugugcuaug

SEQ ID NO: 189222 - RNA, 22 nt, Human
cccugggaaguauuccagcuau

SEQ ID NO: 189223 - RNA, 21 nt, Human
ggcugcagggagcccuggggu

SEQ ID NO: 189224 - RNA, 22 nt, Human
caucuuugagacagcauuaccc

SEQ ID NO: 189225 - RNA, 21 nt, Human
aauuuugaaggaagauuaagg

SEQ ID NO: 189226 - RNA, 23 nt, Human
aggaagaggcaauuucucuuaga

SEQ ID NO: 189227 - RNA, 22 nt, Human
ccaagcuacuuaggagucugag

SEQ ID NO: 189228 - RNA, 22 nt, Human
ucaggcugggagacaaucacug

SEQ ID NO: 189229 - RNA, 22 nt, Human
uaacuagaauggcuauuuugag

SEQ ID NO: 189230 - RNA, 22 nt, Human
ucaggacagaaggcugccaggg

SEQ ID NO: 189231 - RNA, 22 nt, Human
cucuggguccuggggcuacaag

SEQ ID NO: 189232 - RNA, 18 nt, Human
agaauuauucuuguccuc

SEQ ID NO: 189233 - RNA, 22 nt, Human
agcuuuauggugccucacuuga

SEQ ID NO: 189234 - RNA, 22 nt, Human
ggcccagagcucugggggagcu

SEQ ID NO: 189235 - RNA, 21 nt, Human
auauuucucauaagguuaugg

SEQ ID NO: 189236 - RNA, 22 nt, Human
aaaauccugcugacucgagaug

SEQ ID NO: 189237 - RNA, 22 nt, Human
cucuuuggcccccgaugauuca

SEQ ID NO: 189238 - RNA, 22 nt, Human
cucuggaauugaccugggaggg

SEQ ID NO: 189239 - RNA, 22 nt, Human
gcugcagaccucaugcaggugg

SEQ ID NO: 189240 - RNA, 22 nt, Human
gucuucuggaagagagccagcu

SEQ ID NO: 189241 - RNA, 22 nt, Human
augucccucacuccucauucag

SEQ ID NO: 189242 - RNA, 22 nt, Human
auuauuagugauguuguuacug

SEQ ID NO: 189243 - RNA, 22 nt, Human
uuccuacagcccugaaucucua

SEQ ID NO: 189244 - RNA, 18 nt, Human
ccugcagcccaggaggcc

SEQ ID NO: 189245 - RNA, 22 nt, Human
gcuccagcucguggcucccagc

SEQ ID NO: 189246 - RNA, 22 nt, Human
gagagacagcagaacgugcagc

SEQ ID NO: 189247 - RNA, 22 nt, Human
gguaggggaagacaagugaaaa

SEQ ID NO: 189248 - RNA, 22 nt, Human
uggggaaaaugcagaagauuac

SEQ ID NO: 189249 - RNA, 22 nt, Human
ucacaaaaggccauguggcuuc

SEQ ID NO: 189250 - RNA, 22 nt, Human
gguggcagagacauaggacaua

SEQ ID NO: 189251 - RNA, 22 nt, Human
cagagccugcugccuucugaag

SEQ ID NO: 189252 - RNA, 22 nt, Human
acagugcaggucucaacaauua

SEQ ID NO: 189253 - RNA, 22 nt, Human
aaacauagcacacacagcucuu

SEQ ID NO: 189254 - RNA, 22 nt, Human
aggcccuggcacugccugggag

SEQ ID NO: 189255 - RNA, 22 nt, Human
agacaucagcuugugugcaggg

SEQ ID NO: 189256 - RNA, 22 nt, Human
ugcuguauuacuuuuacaaacu

SEQ ID NO: 189257 - RNA, 22 nt, Human
ucccuccccacuucugagcuuu

SEQ ID NO: 189258 - RNA, 23 nt, Human
caggaagcagaugggguagaaga

SEQ ID NO: 189259 - RNA, 22 nt, Human
agguccuggacugcucuuguua

SEQ ID NO: 189260 - RNA, 22 nt, Human
aauuagggaaaauuuacuugua

SEQ ID NO: 189261 - RNA, 22 nt, Human
aaagaacaauguggaaucuccu

SEQ ID NO: 189262 - RNA, 22 nt, Human
agccaggccuuuucucaagguu

SEQ ID NO: 189263 - RNA, 20 nt, Human
gcucaguggagaaaugcacc

SEQ ID NO: 189264 - RNA, 22 nt, Human
agucuucuggguguuuccagag

SEQ ID NO: 189265 - RNA, 22 nt, Human
ggcugugagcaggcagaaugcu

SEQ ID NO: 189266 - RNA, 22 nt, Human
ccagguucaaauagcuguguga

SEQ ID NO: 189267 - RNA, 22 nt, Human
auggaacaucagguuaagaaau

SEQ ID NO: 189268 - RNA, 22 nt, Human
uuaauaacauuguguaucaccc

SEQ ID NO: 189269 - RNA, 22 nt, Human
uuucugcagguauugcauaagu

SEQ ID NO: 189270 - RNA, 22 nt, Human
ucugagagcucuggggccccuu

SEQ ID NO: 189271 - RNA, 22 nt, Human
acacaggaacucugagaggugg

SEQ ID NO: 189272 - RNA, 22 nt, Human
ggcaggcuugguggcaccgguu

SEQ ID NO: 189273 - RNA, 22 nt, Human
aagcugcagaugugccugugga

SEQ ID NO: 189274 - RNA, 22 nt, Human
guagccagaucugcugugucug

SEQ ID NO: 189275 - RNA, 22 nt, Human
ucaguuaacaacuauuuauuga

SEQ ID NO: 189276 - RNA, 22 nt, Human
agaggccagcacugcagggaag

SEQ ID NO: 189277 - RNA, 22 nt, Human
uuugaagggcacgacaauaguu

SEQ ID NO: 189278 - RNA, 22 nt, Human
uucaugcuaguaugugcuguuc

SEQ ID NO: 189279 - RNA, 22 nt, Human
uuugggcauauagcuguucccu

SEQ ID NO: 189280 - RNA, 22 nt, Human
ugaaacagcuaucaguagacug

SEQ ID NO: 189281 - RNA, 22 nt, Human
aacauacauauuucagugucca

SEQ ID NO: 189282 - RNA, 22 nt, Human
aggauuuaaucaguuggcauuu

SEQ ID NO: 189283 - RNA, 22 nt, Human
guagauuccaguggucuguguc

SEQ ID NO: 189284 - RNA, 22 nt, Human
gcagcuggugcaaaugucacuc

SEQ ID NO: 189285 - RNA, 22 nt, Human
ucugggagggagccucagaauc

SEQ ID NO: 189286 - RNA, 22 nt, Human
ugaugaaaguucaguagugaau

SEQ ID NO: 189287 - RNA, 22 nt, Human
accagagcucuucagcacagga

SEQ ID NO: 189288 - RNA, 22 nt, Human
gcuggcaguaaaggguuuggca

SEQ ID NO: 189289 - RNA, 19 nt, Human
acccagcccaggaguggca

SEQ ID NO: 189290 - RNA, 17 nt, Human
agcugagcuggccaggg

SEQ ID NO: 189291 - RNA, 22 nt, Human
gaggagaagcuaagaaacacag

SEQ ID NO: 189292 - RNA, 18 nt, Human
ugccugccccguaagggu

SEQ ID NO: 189293 - RNA, 22 nt, Human
cccacacauuuuucacuuaccg

SEQ ID NO: 189294 - RNA, 17 nt, Human
cauuugcugguuggcuc

SEQ ID NO: 189295 - RNA, 22 nt, Human
cugcccuguaucuucucccaau

SEQ ID NO: 189296 - RNA, 22 nt, Human
cccagcugauuuuugcagagau

SEQ ID NO: 189297 - RNA, 22 nt, Human
ucacaaaugaggaaaucgagca

SEQ ID NO: 189298 - RNA, 19 nt, Human
cccaguccuuguccugggc

SEQ ID NO: 189299 - RNA, 22 nt, Human
gccugccugcugugugcaaguu

SEQ ID NO: 189300 - RNA, 22 nt, Human
ugcaacaggcugugacauggaa

SEQ ID NO: 189301 - RNA, 22 nt, Human
uuggaaggauuuagagaugucu

SEQ ID NO: 189302 - RNA, 22 nt, Human
uaggaaauuugaaauauguggg

SEQ ID NO: 189303 - RNA, 22 nt, Human
ccagccagcaagcucccaguuc

SEQ ID NO: 189304 - RNA, 22 nt, Human
gaucacaugaguuaucuaacuu

SEQ ID NO: 189305 - RNA, 22 nt, Human
guuuaauaauguugaauuacua

SEQ ID NO: 189306 - RNA, 22 nt, Human
gugucugcacauaggaucucaa

SEQ ID NO: 189307 - RNA, 22 nt, Human
uugccugggcuaguaagccaga

SEQ ID NO: 189308 - RNA, 22 nt, Human
ucuccauuuuauagauaaugaa

SEQ ID NO: 189309 - RNA, 22 nt, Human
uaacugauguucccuuacugua

SEQ ID NO: 189310 - RNA, 21 nt, Human
aagaaguuuggauuuuguccu

SEQ ID NO: 189311 - RNA, 22 nt, Human
cagaggaaaguauuucuggaag

SEQ ID NO: 189312 - RNA, 22 nt, Human
aaugcaaacuucuuguuacuug

SEQ ID NO: 189313 - RNA, 22 nt, Human
uagaaagcccuguguucacugc

SEQ ID NO: 189314 - RNA, 23 nt, Human
agggucugcucagugucguucaa

SEQ ID NO: 189315 - RNA, 22 nt, Human
guggcugcaguaguguaggguc

SEQ ID NO: 189316 - RNA, 22 nt, Human
gagggcuggggcuuaggcuuag

SEQ ID NO: 189317 - RNA, 22 nt, Human
ugaaugaucuaguuuuguagac

SEQ ID NO: 189318 - RNA, 22 nt, Human
cuagaaguuggggcuagggaua

SEQ ID NO: 189319 - RNA, 22 nt, Human
cauuagaaccuauaaaaagcau

SEQ ID NO: 189320 - RNA, 22 nt, Human
ggaagcagccugaagccaaggg

SEQ ID NO: 189321 - RNA, 22 nt, Human
agcugguucauggacugccugg

SEQ ID NO: 189322 - RNA, 22 nt, Human
uggcccagaucucugaccuuga

SEQ ID NO: 189323 - RNA, 22 nt, Human
aaacaguagaaguguauuuuau

SEQ ID NO: 189324 - RNA, 22 nt, Human
cagugagagagaacgcauucau

SEQ ID NO: 189325 - RNA, 22 nt, Human
gucuucuguaagaugagguccc

SEQ ID NO: 189326 - RNA, 20 nt, Human
guccugggagccacagcaca

SEQ ID NO: 189327 - RNA, 22 nt, Human
cauagaaaagaguagguaaugu

SEQ ID NO: 189328 - RNA, 22 nt, Human
ggggaggagccauguaacuagu

SEQ ID NO: 189329 - RNA, 20 nt, Human
ugcuggaggcgccggcgcuc

SEQ ID NO: 189330 - RNA, 22 nt, Human
aggauuuacaaugauucuaggu

SEQ ID NO: 189331 - RNA, 22 nt, Human
gaggcuuuuggcuaauaacugu

SEQ ID NO: 189332 - RNA, 22 nt, Human
uuguguacacgccuuuaaauga

SEQ ID NO: 189333 - RNA, 22 nt, Human
cuggccacaacuagcccaggac

SEQ ID NO: 189334 - RNA, 22 nt, Human
cagaccagccauuugccucuuc

SEQ ID NO: 189335 - RNA, 22 nt, Human
guccuguggaaagcuagccgcu

SEQ ID NO: 189336 - RNA, 22 nt, Human
ucuccuguaugggacuggcgag

SEQ ID NO: 189337 - RNA, 21 nt, Human
gauaaggcaggaggauaagua

SEQ ID NO: 189338 - RNA, 22 nt, Human
gggaaacugcaacucagagagg

SEQ ID NO: 189339 - RNA, 22 nt, Human
uuggcuuuuaugcagcuuaggu

SEQ ID NO: 189340 - RNA, 22 nt, Human
uucugcauaggcuauauuuguu

SEQ ID NO: 189341 - RNA, 22 nt, Human
ccauuuguuguguauuaauauu

SEQ ID NO: 189342 - RNA, 22 nt, Human
uggcugccuagucccucagccu

SEQ ID NO: 189343 - RNA, 18 nt, Human
agcugcagaccaggaggu

SEQ ID NO: 189344 - RNA, 18 nt, Human
uuugaaggauggccugga

SEQ ID NO: 189345 - RNA, 22 nt, Human
uuuuuccuaagcaguggagcug

SEQ ID NO: 189346 - RNA, 22 nt, Human
cucacaggucaugugguggcuu

SEQ ID NO: 189347 - RNA, 22 nt, Human
uauaaagaaggcacagcaagac

SEQ ID NO: 189348 - RNA, 22 nt, Human
aaacugcaugaagcugauuuua

SEQ ID NO: 189349 - RNA, 22 nt, Human
gaauuauagguuugcaugcuaa

SEQ ID NO: 189350 - RNA, 22 nt, Human
uccaagaauacagauuugugaa

SEQ ID NO: 189351 - RNA, 22 nt, Human
cugggacacccaaggaaagagc

SEQ ID NO: 189352 - RNA, 22 nt, Human
uccagcccugcacugauuagau

SEQ ID NO: 189353 - RNA, 22 nt, Human
ucaggugugaacuauuuggaaa

SEQ ID NO: 189354 - RNA, 22 nt, Human
caaagggcauggccugagcacu

SEQ ID NO: 189355 - RNA, 22 nt, Human
guuauuguccagcacaguuggg

SEQ ID NO: 189356 - RNA, 22 nt, Human
uucugguaccgugucagaaacc

SEQ ID NO: 189357 - RNA, 22 nt, Human
uguucaguuaacacagacacca

SEQ ID NO: 189358 - RNA, 22 nt, Human
aagcaggagaugcaggaaugua

SEQ ID NO: 189359 - RNA, 22 nt, Human
uggccagguguggguucucaga

SEQ ID NO: 189360 - RNA, 22 nt, Human
cugggccuugccaggggugucu

SEQ ID NO: 189361 - RNA, 22 nt, Human
gaggggcaaugagggaaagagu

SEQ ID NO: 189362 - RNA, 22 nt, Human
uucuucuuaauguccugggaac

SEQ ID NO: 189363 - RNA, 22 nt, Human
caaauacuuuauauacuucaaa

SEQ ID NO: 189364 - RNA, 22 nt, Human
aaagccuucugucuagcagaua

SEQ ID NO: 189365 - RNA, 22 nt, Human
auucauguucggggccacguug

SEQ ID NO: 189366 - RNA, 22 nt, Human
uauugacauuuuuauagcuuga

SEQ ID NO: 189367 - RNA, 23 nt, Human
gggcuccagucucugcucaguug

SEQ ID NO: 189368 - RNA, 22 nt, Human
aaugguaucaccucacagaauu

SEQ ID NO: 189369 - RNA, 22 nt, Human
gcuuggggucaugaggcugcug

SEQ ID NO: 189370 - RNA, 22 nt, Human
caggggcucugggugaugugag

SEQ ID NO: 189371 - RNA, 22 nt, Human
aggcccucucauuccagaggca

SEQ ID NO: 189372 - RNA, 22 nt, Human
ggagucugacucugacccugga

SEQ ID NO: 189373 - RNA, 22 nt, Human
uagggaugagcaacugguagug

SEQ ID NO: 189374 - RNA, 22 nt, Human
ucagacagauuuugacacuugc

SEQ ID NO: 189375 - RNA, 22 nt, Human
auauguuuuuggaaagaacaca

SEQ ID NO: 189376 - RNA, 22 nt, Human
aaauccuaaaaguuugacuuaa

SEQ ID NO: 189377 - RNA, 22 nt, Human
auagcuguuagauuggggucga

SEQ ID NO: 189378 - RNA, 22 nt, Human
aagcaguuuagauaggcaaagg

SEQ ID NO: 189379 - RNA, 22 nt, Human
acauuguaaauaccuuuaucac

SEQ ID NO: 189380 - RNA, 22 nt, Human
cauggcaggaaaaugaacaggc

SEQ ID NO: 189381 - RNA, 22 nt, Human
gcaucuaauccaguccagcauc

SEQ ID NO: 189382 - RNA, 21 nt, Human
gaggaaaugcucugguguuca

SEQ ID NO: 189383 - RNA, 22 nt, Human
cagagacauguggccugcacgu

SEQ ID NO: 189384 - RNA, 16 nt, Human
gaaggcuuacugcagg

SEQ ID NO: 189385 - RNA, 22 nt, Human
cugaguccagggacagaggcgu

SEQ ID NO: 189386 - RNA, 22 nt, Human
uggagagcaaugaggggcaggc

SEQ ID NO: 189387 - RNA, 22 nt, Human
gcauucuugguggagugcuaaa

SEQ ID NO: 189388 - RNA, 22 nt, Human
agaaucagugagcaguugugau

SEQ ID NO: 189389 - RNA, 22 nt, Human
agcugcagucaagcugggccac

SEQ ID NO: 189390 - RNA, 22 nt, Human
aaggaaaugugccugacacugc

SEQ ID NO: 189391 - RNA, 22 nt, Human
uauaauuuaucaugucacaguu

SEQ ID NO: 189392 - RNA, 22 nt, Human
cugucuguuuuguauacaggcc

SEQ ID NO: 189393 - RNA, 22 nt, Human
ucuagaaugacaugcaagagua

SEQ ID NO: 189394 - RNA, 22 nt, Human
ccuuguccucugguuuccuguu

SEQ ID NO: 189395 - RNA, 22 nt, Human
uaggaagauaaacauuuguaug

SEQ ID NO: 189396 - RNA, 22 nt, Human
uucaaagugcuuuuaaccuuua

SEQ ID NO: 189397 - RNA, 22 nt, Human
aggaacugauuuauaacuuuag

SEQ ID NO: 189398 - RNA, 22 nt, Human
ugugaaaaaaguucuagaagga

SEQ ID NO: 189399 - RNA, 22 nt, Human
aggagugaguguccucagcaga

SEQ ID NO: 189400 - RNA, 20 nt, Human
cacaggccuugugagcagac

SEQ ID NO: 189401 - RNA, 19 nt, Human
agcugcuggcccagggacc

SEQ ID NO: 189402 - RNA, 22 nt, Human
aacuacaguauguccaaagaau

SEQ ID NO: 189403 - RNA, 22 nt, Human
ugucucagaauggcucauaaua

SEQ ID NO: 189404 - RNA, 22 nt, Human
gggaacacuccagggcuuggaa

SEQ ID NO: 189405 - RNA, 22 nt, Human
cauucccaugacuccugcucag

SEQ ID NO: 189406 - RNA, 22 nt, Human
cugagggauguggauuuugguc

SEQ ID NO: 189407 - RNA, 22 nt, Human
ugucuggcauaguugcucccug

SEQ ID NO: 189408 - RNA, 22 nt, Human
uuguuucauggggauguuuauu

SEQ ID NO: 189409 - RNA, 22 nt, Human
uggcugcagugcuugagauguc

SEQ ID NO: 189410 - RNA, 22 nt, Human
uucuucagacuacugaugauug

SEQ ID NO: 189411 - RNA, 22 nt, Human
auaguacagagggcuacugguu

SEQ ID NO: 189412 - RNA, 19 nt, Human
accaggagacagugagcuu

SEQ ID NO: 189413 - RNA, 20 nt, Human
gcucugggugguaaaugacu

SEQ ID NO: 189414 - RNA, 21 nt, Human
auauuguagguaaagugcagg

SEQ ID NO: 189415 - RNA, 23 nt, Human
ugccaggguuuguuugugguuca

SEQ ID NO: 189416 - RNA, 22 nt, Human
ucaucaguguccuuaucacuua

SEQ ID NO: 189417 - RNA, 22 nt, Human
uucaguuuguuugacuguuaga

SEQ ID NO: 189418 - RNA, 22 nt, Human
agcaacagguuuauuaucuuau

SEQ ID NO: 189419 - RNA, 23 nt, Human
acucagagaccccgggaagugac

SEQ ID NO: 189420 - RNA, 22 nt, Human
ccucagggucauccuaguaaua

SEQ ID NO: 189421 - RNA, 22 nt, Human
cccagugucucuugugccuuuc

SEQ ID NO: 189422 - RNA, 22 nt, Human
aaguuggaaucuggaacugauc

SEQ ID NO: 189423 - RNA, 22 nt, Human
ucucccucauuccugcuuccau

SEQ ID NO: 189424 - RNA, 22 nt, Human
gccuguguccuucccagugggg

SEQ ID NO: 189425 - RNA, 20 nt, Human
cccaguguccagccuugcca

SEQ ID NO: 189426 - RNA, 21 nt, Human
ucagaaucugugagcuaucuc

SEQ ID NO: 189427 - RNA, 22 nt, Human
cuuguaaaugcagauucugauu

SEQ ID NO: 189428 - RNA, 22 nt, Human
aaagcagcagcaccugcauuuc

SEQ ID NO: 189429 - RNA, 22 nt, Human
cugaggcucugggugucacugu

SEQ ID NO: 189430 - RNA, 22 nt, Human
uggcucaguaaucgagucuccu

SEQ ID NO: 189431 - RNA, 22 nt, Human
aaagcugcuaugaacauucuau

SEQ ID NO: 189432 - RNA, 22 nt, Human
cccagccucuguuugcuccucu

SEQ ID NO: 189433 - RNA, 22 nt, Human
ugggccugccccaggcuucagc

SEQ ID NO: 189434 - RNA, 20 nt, Human
caugugucaguucucaccca

SEQ ID NO: 189435 - RNA, 22 nt, Human
acagagucugacagguaggcgc

SEQ ID NO: 189436 - RNA, 22 nt, Human
auguuucaugacugagcaaaau

SEQ ID NO: 189437 - RNA, 22 nt, Human
ugaaggcuuuuagcucugaaaa

SEQ ID NO: 189438 - RNA, 22 nt, Human
uaggcugggcugagcuggacgg

SEQ ID NO: 189439 - RNA, 22 nt, Human
ugagaaaacaguuuguaauaau

SEQ ID NO: 189440 - RNA, 20 nt, Human
uucgcugggaguggccaggc

SEQ ID NO: 189441 - RNA, 22 nt, Human
ggcugggucccagcugggagga

SEQ ID NO: 189442 - RNA, 22 nt, Human
ucucugcaugacccaaggcuga

SEQ ID NO: 189443 - RNA, 22 nt, Human
cauuuagaagucuuagaacuau

SEQ ID NO: 189444 - RNA, 18 nt, Human
agcccagcggagugaauc

SEQ ID NO: 189445 - RNA, 22 nt, Human
gagcuuggugaugccuccuggu

SEQ ID NO: 189446 - RNA, 22 nt, Human
ucccuggcacaagaaggcuguc

SEQ ID NO: 189447 - RNA, 22 nt, Human
ugcauacacaagcauacaugua

SEQ ID NO: 189448 - RNA, 22 nt, Human
uuggugaacacauacacauuuu

SEQ ID NO: 189449 - RNA, 22 nt, Human
aucugaaagcuaggaguucuca

SEQ ID NO: 189450 - RNA, 19 nt, Human
cagugcccgacgcaggucu

SEQ ID NO: 189451 - RNA, 22 nt, Human
cagcuuggcuuccgcuuuacug

SEQ ID NO: 189452 - RNA, 22 nt, Human
cagcccucugaagaggcgcuug

SEQ ID NO: 189453 - RNA, 21 nt, Human
ccucagagacagauacgggug

SEQ ID NO: 189454 - RNA, 21 nt, Human
uucugcuguucaccaccaccc

SEQ ID NO: 189455 - RNA, 22 nt, Human
agggcagcuggaagguggcuuc

SEQ ID NO: 189456 - RNA, 22 nt, Human
ucaaauaccagcaauuucaugu

SEQ ID NO: 189457 - RNA, 22 nt, Human
ccugcuggcauucuugcucccu

SEQ ID NO: 189458 - RNA, 22 nt, Human
aaaugaacaucaagaauagccu

SEQ ID NO: 189459 - RNA, 22 nt, Human
gaaggcaacaccaggaugcacu

SEQ ID NO: 189460 - RNA, 22 nt, Human
agguccuguguccaggggccug

SEQ ID NO: 189461 - RNA, 23 nt, Human
uggccuggagagaaaagaugagu

SEQ ID NO: 189462 - RNA, 21 nt, Human
gacuuucuuaccagauuuuug

SEQ ID NO: 189463 - RNA, 22 nt, Human
agaguggcagcaagucagguag

SEQ ID NO: 189464 - RNA, 22 nt, Human
guguuuauacagcaaagagcau

SEQ ID NO: 189465 - RNA, 22 nt, Human
ucuuagcauuucauaacaacug

SEQ ID NO: 189466 - RNA, 22 nt, Human
ucagaccccagaaugaagccag

SEQ ID NO: 189467 - RNA, 19 nt, Human
uacaagcuuaaaguaaugu

SEQ ID NO: 189468 - RNA, 22 nt, Human
gcagauggacuguaugaccuga

SEQ ID NO: 189469 - RNA, 22 nt, Human
guucaguuugacaaccuuuaua

SEQ ID NO: 189470 - RNA, 22 nt, Human
uuucaguuuagacuaaagguag

SEQ ID NO: 189471 - RNA, 22 nt, Human
aagggcucccaacucaucuuuu

SEQ ID NO: 189472 - RNA, 22 nt, Human
ugcaauaaguauugcuuacaug

SEQ ID NO: 189473 - RNA, 19 nt, Human
ccaccccuuugcugggccc

SEQ ID NO: 189474 - RNA, 22 nt, Human
aggggccauuguucugcccgcu

SEQ ID NO: 189475 - RNA, 22 nt, Human
cuuauuucagcccugggcaccc

SEQ ID NO: 189476 - RNA, 23 nt, Human
aggucaaccacaagcugacaaac

SEQ ID NO: 189477 - RNA, 20 nt, Human
agacaaaaugacuucaugca

SEQ ID NO: 189478 - RNA, 22 nt, Human
cuagggcagggaguguuugcgc

SEQ ID NO: 189479 - RNA, 22 nt, Human
cuccucuggcuuccuggaggca

SEQ ID NO: 189480 - RNA, 22 nt, Human
ucugucagccccucagcuguca

SEQ ID NO: 189481 - RNA, 22 nt, Human
agcaggcuacuccuguguucgu

SEQ ID NO: 189482 - RNA, 22 nt, Human
gcacagcacagcaacauguuuu

SEQ ID NO: 189483 - RNA, 22 nt, Human
uucuuuccccauggaguucgga

SEQ ID NO: 189484 - RNA, 22 nt, Human
agaucaaugugucagaagagau

SEQ ID NO: 189485 - RNA, 22 nt, Human
ccuaaagaauuuucauagagcu

SEQ ID NO: 189486 - RNA, 20 nt, Human
accuacauguauagugaggg

SEQ ID NO: 189487 - RNA, 22 nt, Human
auugaaaaauucacaauucugg

SEQ ID NO: 189488 - RNA, 22 nt, Human
ccuggcacaugcaguacucaag

SEQ ID NO: 189489 - RNA, 22 nt, Human
gccauguccugggcaucugcca

SEQ ID NO: 189490 - RNA, 22 nt, Human
ucaaauaggcuuguagugacug

SEQ ID NO: 189491 - RNA, 22 nt, Human
uggcaccaccagacaccaggag

SEQ ID NO: 189492 - RNA, 20 nt, Human
uuucugugauagagaggugu

SEQ ID NO: 189493 - RNA, 22 nt, Human
aaaggaggaauggagagaugcu

SEQ ID NO: 189494 - RNA, 22 nt, Human
gaggcuggacgugcauuucuac

SEQ ID NO: 189495 - RNA, 16 nt, Human
cucuuuggcuuccaag

SEQ ID NO: 189496 - RNA, 22 nt, Human
cugggccuccagcucugccagc

SEQ ID NO: 189497 - RNA, 22 nt, Human
cuccuacacauagaugcuuuca

SEQ ID NO: 189498 - RNA, 22 nt, Human
cagcucagucuggagagaugca

SEQ ID NO: 189499 - RNA, 22 nt, Human
auguccucggcucugugcugcu

SEQ ID NO: 189500 - RNA, 22 nt, Human
aaaugacaauaaaaguccaugc

SEQ ID NO: 189501 - RNA, 22 nt, Human
aguugguucacuccuucaugcc

SEQ ID NO: 189502 - RNA, 22 nt, Human
agcugggcugggcugagcugag

SEQ ID NO: 189503 - RNA, 19 nt, Human
gcaggcaguggcauucgga

SEQ ID NO: 189504 - RNA, 22 nt, Human
uuucaaagucaauaucauuacc

SEQ ID NO: 189505 - RNA, 22 nt, Human
gcauggcuucugccaggcaccu

SEQ ID NO: 189506 - RNA, 22 nt, Human
cccuggcagaaugucucugggc

SEQ ID NO: 189507 - RNA, 21 nt, Human
auguuuacacugacuacugug

SEQ ID NO: 189508 - RNA, 22 nt, Human
gcaagcaaauuauuuauaggca

SEQ ID NO: 189509 - RNA, 22 nt, Human
uuggcugcaaucacagggacuc

SEQ ID NO: 189510 - RNA, 23 nt, Human
gggaucuguaaguugaagacaaa

SEQ ID NO: 189511 - RNA, 22 nt, Human
ggagacccagguuaggaaguaa

SEQ ID NO: 189512 - RNA, 18 nt, Human
cacaauuuacagaugaca

SEQ ID NO: 189513 - RNA, 22 nt, Human
ggcuuaggugucucucugcacc

SEQ ID NO: 189514 - RNA, 22 nt, Human
gauuuauugucccuguccugcu

SEQ ID NO: 189515 - RNA, 22 nt, Human
augacagacagaagggauuuuu

SEQ ID NO: 189516 - RNA, 22 nt, Human
gcuggcagccaagugaagaggg

SEQ ID NO: 189517 - RNA, 22 nt, Human
uggcugacaaauaggugcaguu

SEQ ID NO: 189518 - RNA, 22 nt, Human
gcugggcucuuuaccccuguac

SEQ ID NO: 189519 - RNA, 22 nt, Human
cagugcaagugacugaucaagg

SEQ ID NO: 189520 - RNA, 22 nt, Human
aagcaauugguuuuaguaaaau

SEQ ID NO: 189521 - RNA, 22 nt, Human
ugaaugauuucuuaggcaauug

SEQ ID NO: 189522 - RNA, 17 nt, Human
acaggccugcuugcacu

SEQ ID NO: 189523 - RNA, 22 nt, Human
gcauuugaaaugcaagaaagug

SEQ ID NO: 189524 - RNA, 22 nt, Human
gugaugucagcaagaauaggaa

SEQ ID NO: 189525 - RNA, 22 nt, Human
uuccagccaugguuucccuaug

SEQ ID NO: 189526 - RNA, 22 nt, Human
uguaacaguaguuacuauucuu

SEQ ID NO: 189527 - RNA, 20 nt, Human
guccuagguuugaagguaaa

SEQ ID NO: 189528 - RNA, 22 nt, Human
ucuccaggagaaauaugaagga

SEQ ID NO: 189529 - RNA, 22 nt, Human
ggacagagagugaauaugacau

SEQ ID NO: 189530 - RNA, 22 nt, Human
agggcaugugggagaggagccu

SEQ ID NO: 189531 - RNA, 22 nt, Human
uugcaggggaaggagcagagcu

SEQ ID NO: 189532 - RNA, 22 nt, Human
ucucucagggggaaggcugaag

SEQ ID NO: 189533 - RNA, 22 nt, Human
caggaggagggcagccgccucc

SEQ ID NO: 189534 - RNA, 22 nt, Human
uacacuauuuuacugauacaaa

SEQ ID NO: 189535 - RNA, 22 nt, Human
uuagaaaggggugaaucaaugg

SEQ ID NO: 189536 - RNA, 22 nt, Human
uggcuuccaguaaucaggauuu

SEQ ID NO: 189537 - RNA, 22 nt, Human
cagggcccaggccacuggguug

SEQ ID NO: 189538 - RNA, 22 nt, Human
cucucuguuaugcuuucaugaa

SEQ ID NO: 189539 - RNA, 22 nt, Human
cauggaggccaggaaacagccu

SEQ ID NO: 189540 - RNA, 22 nt, Human
accaguuucugggggagguugg

SEQ ID NO: 189541 - RNA, 22 nt, Human
ucuaagaauacucauaucuucu

SEQ ID NO: 189542 - RNA, 20 nt, Human
agugucugggccucaggccc

SEQ ID NO: 189543 - RNA, 22 nt, Human
aauugcuuacuguuuuucaccu

SEQ ID NO: 189544 - RNA, 22 nt, Human
cacacgugugagagcuguggca

SEQ ID NO: 189545 - RNA, 22 nt, Human
cucuucuuggcccccaugaggg

SEQ ID NO: 189546 - RNA, 22 nt, Human
uaagacacaaauaucuuuuaca

SEQ ID NO: 189547 - RNA, 22 nt, Human
cucccagguuacaucugagccu

SEQ ID NO: 189548 - RNA, 22 nt, Human
aaaugccaaggagagacuguua

SEQ ID NO: 189549 - RNA, 22 nt, Human
aaagccaggguccaggccugcc

SEQ ID NO: 189550 - RNA, 22 nt, Human
gagucuggucauuuucucuccc

SEQ ID NO: 189551 - RNA, 21 nt, Human
aucacauuggcuguuauuauu

SEQ ID NO: 189552 - RNA, 22 nt, Human
ccagcucccauucuucaccugu

SEQ ID NO: 189553 - RNA, 22 nt, Human
uguggcucugccuggcaguauu

SEQ ID NO: 189554 - RNA, 19 nt, Human
gcaaaucugaccaaauagu

SEQ ID NO: 189555 - RNA, 22 nt, Human
uuaucuuguagagauauuuucg

SEQ ID NO: 189556 - RNA, 22 nt, Human
agcaggaggguuuuguagaguc

SEQ ID NO: 189557 - RNA, 22 nt, Human
gcucucagaugcuccagcagcc

SEQ ID NO: 189558 - RNA, 21 nt, Human
ugcuccuuuaccccacaagac

SEQ ID NO: 189559 - RNA, 22 nt, Human
uaugcuauucuucagaguguuc

SEQ ID NO: 189560 - RNA, 22 nt, Human
ugcucagaauugcgcuggugga

SEQ ID NO: 189561 - RNA, 21 nt, Human
aucuagaaucucucuccccac

SEQ ID NO: 189562 - RNA, 22 nt, Human
cagcugcuuucagcaggaggga

SEQ ID NO: 189563 - RNA, 22 nt, Human
acuggcuuggcaggaggaagau

SEQ ID NO: 189564 - RNA, 22 nt, Human
caggugcaaugagacagcucug

SEQ ID NO: 189565 - RNA, 22 nt, Human
ggagcugaggaauagcuuugau

SEQ ID NO: 189566 - RNA, 22 nt, Human
gggcaguggcucacgccuguaa

SEQ ID NO: 189567 - RNA, 22 nt, Human
cacgugcaggucuuaggagaca

SEQ ID NO: 189568 - RNA, 22 nt, Human
aaggcaggaugggaaaagauuu

SEQ ID NO: 189569 - RNA, 22 nt, Human
ugucucaggggcauugaaauaa

SEQ ID NO: 189570 - RNA, 22 nt, Human
uuguaagaauaugaauacaaau

SEQ ID NO: 189571 - RNA, 22 nt, Human
uggggagcccacucaccucccc

SEQ ID NO: 189572 - RNA, 22 nt, Human
gaguguggaucccagaagcaga

SEQ ID NO: 189573 - RNA, 22 nt, Human
uggcucuguugugcugagccag

SEQ ID NO: 189574 - RNA, 22 nt, Human
cugcuguggaugcaggaccuca

SEQ ID NO: 189575 - RNA, 22 nt, Human
agcugcaggagucgccuaggau

SEQ ID NO: 189576 - RNA, 22 nt, Human
acacagaagcuuuuucuauucc

SEQ ID NO: 189577 - RNA, 19 nt, Human
auacacauacguaaacuga

SEQ ID NO: 189578 - RNA, 22 nt, Human
caggccugucugcacaugaggc

SEQ ID NO: 189579 - RNA, 21 nt, Human
ucugacuugaucuauucuccc

SEQ ID NO: 189580 - RNA, 22 nt, Human
agauaucugaugaaaauacucu

SEQ ID NO: 189581 - RNA, 20 nt, Human
ggaagccagcauccuugagg

SEQ ID NO: 189582 - RNA, 22 nt, Human
gccaggcauuuauugauugaau

SEQ ID NO: 189583 - RNA, 22 nt, Human
ucaggcugaaaggacuccaguu

SEQ ID NO: 189584 - RNA, 22 nt, Human
uacaguuccucucguggaggug

SEQ ID NO: 189585 - RNA, 22 nt, Human
ucgagcucuggagccaaggaug

SEQ ID NO: 189586 - RNA, 22 nt, Human
cagauggaaggcauagagguuu

SEQ ID NO: 189587 - RNA, 22 nt, Human
guucacaucccagaaagagcau

SEQ ID NO: 189588 - RNA, 22 nt, Human
guggcuucaccccaguugucuc

SEQ ID NO: 189589 - RNA, 22 nt, Human
ccagcucucuguccuccccaca

SEQ ID NO: 189590 - RNA, 22 nt, Human
aaucuguauuguuaacaaguaa

SEQ ID NO: 189591 - RNA, 22 nt, Human
uucuccagccuauuggccuauc

SEQ ID NO: 189592 - RNA, 20 nt, Human
ggguaaaaggcaguguugca

SEQ ID NO: 189593 - RNA, 22 nt, Human
ggccgugcuccaaagucaucgu

SEQ ID NO: 189594 - RNA, 22 nt, Human
ucagcugcucaaauuuauguca

SEQ ID NO: 189595 - RNA, 22 nt, Human
augcccugcugccaucuggccg

SEQ ID NO: 189596 - RNA, 22 nt, Human
ucucuggucccaccuggccauu

SEQ ID NO: 189597 - RNA, 22 nt, Human
aagguugcagcaguguugauga

SEQ ID NO: 189598 - RNA, 21 nt, Human
acagaaguggcuuggucucag

SEQ ID NO: 189599 - RNA, 22 nt, Human
agguuuauguuuggugcaggag

SEQ ID NO: 189600 - RNA, 22 nt, Human
caagggcagcagccucaagcgg

SEQ ID NO: 189601 - RNA, 22 nt, Human
ggcacuaugaguuauaagugga

SEQ ID NO: 189602 - RNA, 22 nt, Human
uccuguuguucgccugcgaugg

SEQ ID NO: 189603 - RNA, 22 nt, Human
caggcugaucagggcugggaug

SEQ ID NO: 189604 - RNA, 19 nt, Human
ggccaggcugacugugguc

SEQ ID NO: 189605 - RNA, 22 nt, Human
uuacaucauugagacauacaua

SEQ ID NO: 189606 - RNA, 22 nt, Human
gccaguggucacugaggaagaa

SEQ ID NO: 189607 - RNA, 20 nt, Human
uuacucaguuccugccaugc

SEQ ID NO: 189608 - RNA, 22 nt, Human
agauuuuauagauaauuuccca

SEQ ID NO: 189609 - RNA, 22 nt, Human
aguucuguugucuagggaagcc

SEQ ID NO: 189610 - RNA, 22 nt, Human
uuccggaagguucucuagaauu

SEQ ID NO: 189611 - RNA, 22 nt, Human
uaguuaaaccaccauucuggua

SEQ ID NO: 189612 - RNA, 22 nt, Human
ucagggauugcaaaauucaucc

SEQ ID NO: 189613 - RNA, 22 nt, Human
agaaggaaaaccugucuuaugu

SEQ ID NO: 189614 - RNA, 22 nt, Human
aauguuaaguuuagauuauaac

SEQ ID NO: 189615 - RNA, 22 nt, Human
caagauuuagcucccuuaucuc

SEQ ID NO: 189616 - RNA, 20 nt, Human
aguuuucagcagaacaccca

SEQ ID NO: 189617 - RNA, 22 nt, Human
augagggaggcaaggagaugcu

SEQ ID NO: 189618 - RNA, 22 nt, Human
agcugggcagacugcagugguu

SEQ ID NO: 189619 - RNA, 22 nt, Human
aauuuucacagugcugugagau

SEQ ID NO: 189620 - RNA, 22 nt, Human
gguaggaagauagagcaaaguu

SEQ ID NO: 189621 - RNA, 22 nt, Human
gaaagcacccaagauuuccuuc

SEQ ID NO: 189622 - RNA, 22 nt, Human
uuacauuuugggguaaggauaa

SEQ ID NO: 189623 - RNA, 22 nt, Human
ccagcacucgcugauuuuagga

SEQ ID NO: 189624 - RNA, 22 nt, Human
gaauaauagcagaaauuagcag

SEQ ID NO: 189625 - RNA, 22 nt, Human
ggauuuacacaccugccuguca

SEQ ID NO: 189626 - RNA, 23 nt, Human
uagaggaggaugugaugcauauu

SEQ ID NO: 189627 - RNA, 17 nt, Human
ugguggcuggagucagg

SEQ ID NO: 189628 - RNA, 22 nt, Human
gggcgagggcgaaagcgagagc

SEQ ID NO: 189629 - RNA, 20 nt, Human
uguccaggggaucguuggcc

SEQ ID NO: 189630 - RNA, 22 nt, Human
ggcaaaaacagcaaugacuuuu

SEQ ID NO: 189631 - RNA, 22 nt, Human
agcccugggaggccagcuugua

SEQ ID NO: 189632 - RNA, 22 nt, Human
auccaugaucaauuuauuacua

SEQ ID NO: 189633 - RNA, 22 nt, Human
agcccugcucaucuggaucccg

SEQ ID NO: 189634 - RNA, 22 nt, Human
cugcucuggucucuucauguuu

SEQ ID NO: 189635 - RNA, 22 nt, Human
ugcuggcuaauggaaaccagau

SEQ ID NO: 189636 - RNA, 22 nt, Human
acagugcugaacgacauggaag

SEQ ID NO: 189637 - RNA, 22 nt, Human
uucaguuucagucuugcaaaaa

SEQ ID NO: 189638 - RNA, 22 nt, Human
ucacaggccuggggcagagggc

SEQ ID NO: 189639 - RNA, 22 nt, Human
cagggagcugacaaccaaggag

SEQ ID NO: 189640 - RNA, 22 nt, Human
cucagagcugaggccagggaca

SEQ ID NO: 189641 - RNA, 22 nt, Human
gaaaggcuugguuuugaauaua

SEQ ID NO: 189642 - RNA, 22 nt, Human
cuauugcuuuugugugcuccca

SEQ ID NO: 189643 - RNA, 22 nt, Human
agcucagaacugcagacaugug

SEQ ID NO: 189644 - RNA, 22 nt, Human
aaaccugucugauuauggagac

SEQ ID NO: 189645 - RNA, 22 nt, Human
aaccuuuugcaagugccuugac

SEQ ID NO: 189646 - RNA, 22 nt, Human
uucauugagugguuuauucuaa

SEQ ID NO: 189647 - RNA, 22 nt, Human
uccuuucuccgggggacuguug

SEQ ID NO: 189648 - RNA, 22 nt, Human
acagaggaaggcugagcugccc

SEQ ID NO: 189649 - RNA, 16 nt, Human
gggcugggggauucug

SEQ ID NO: 189650 - RNA, 19 nt, Human
guguccauggagcauggag

SEQ ID NO: 189651 - RNA, 22 nt, Human
uucuugaaucacuuuagagaua

SEQ ID NO: 189652 - RNA, 21 nt, Human
ucuguuggaggccucucuucc

SEQ ID NO: 189653 - RNA, 22 nt, Human
gcaccuggacagugacccuagc

SEQ ID NO: 189654 - RNA, 22 nt, Human
uccucugggcucccugcaacag

SEQ ID NO: 189655 - RNA, 23 nt, Human
ucagagaacucgggcagaugacc

SEQ ID NO: 189656 - RNA, 22 nt, Human
ugcccagcaauaaaccagaaga

SEQ ID NO: 189657 - RNA, 22 nt, Human
ucacagcuaagcuuggucacug

SEQ ID NO: 189658 - RNA, 22 nt, Human
uguguucaccaaaguguagaaa

SEQ ID NO: 189659 - RNA, 22 nt, Human
uccuaguucucugccagucgcu

SEQ ID NO: 189660 - RNA, 22 nt, Human
guacaaauugauacagauuuga

SEQ ID NO: 189661 - RNA, 22 nt, Human
auucuucauaccuacugagguu

SEQ ID NO: 189662 - RNA, 22 nt, Human
caguuaaauuuggcuguuuucu

SEQ ID NO: 189663 - RNA, 22 nt, Human
cagcagcccacgcgugcugucc

SEQ ID NO: 189664 - RNA, 22 nt, Human
ggcaguagccagggacuggcag

SEQ ID NO: 189665 - RNA, 22 nt, Human
uucaguuugcuacaagcaacau

SEQ ID NO: 189666 - RNA, 22 nt, Human
guacacuugucuugaacagccu

SEQ ID NO: 189667 - RNA, 19 nt, Human
aggugacaugugacagccu

SEQ ID NO: 189668 - RNA, 20 nt, Human
ugggucugcuuggcuucagu

SEQ ID NO: 189669 - RNA, 22 nt, Human
uggagacugugcuaagggaguu

SEQ ID NO: 189670 - RNA, 20 nt, Human
cuaauuacagauuuuggaca

SEQ ID NO: 189671 - RNA, 22 nt, Human
uggagcauucagguuucccuuu

SEQ ID NO: 189672 - RNA, 23 nt, Human
uggcuacuuuaugagguugagga

SEQ ID NO: 189673 - RNA, 21 nt, Human
ugagcaggugcugcuuuuaug

SEQ ID NO: 189674 - RNA, 21 nt, Human
ugagucuuuuaauaggugcac

SEQ ID NO: 189675 - RNA, 23 nt, Human
agucagagagugugagacaacug

SEQ ID NO: 189676 - RNA, 22 nt, Human
cacccagccuucacacaggagu

SEQ ID NO: 189677 - RNA, 22 nt, Human
cuuccagguccuucuugagaag

SEQ ID NO: 189678 - RNA, 21 nt, Human
aaggagccuaggaggcucagg

SEQ ID NO: 189679 - RNA, 22 nt, Human
uucucugcucucacauacagaa

SEQ ID NO: 189680 - RNA, 22 nt, Human
uacauguacaugcauagguaga

SEQ ID NO: 189681 - RNA, 22 nt, Human
gccagccauaggccagcacugg

SEQ ID NO: 189682 - RNA, 22 nt, Human
uucauuuagcaugcuaaaccug

SEQ ID NO: 189683 - RNA, 22 nt, Human
auguccucaaaacugauugcag

SEQ ID NO: 189684 - RNA, 22 nt, Human
gaaagaggaaggagauguauua

SEQ ID NO: 189685 - RNA, 22 nt, Human
aucaguuuauacuuauaaaucu

SEQ ID NO: 189686 - RNA, 22 nt, Human
uggcaggugccaugggcucaga

SEQ ID NO: 189687 - RNA, 22 nt, Human
ccugacucuggccaggccagcu

SEQ ID NO: 189688 - RNA, 22 nt, Human
uaccauuucuacauaucuuguc

SEQ ID NO: 189689 - RNA, 22 nt, Human
aucugcuguucuucacagcuug

SEQ ID NO: 189690 - RNA, 22 nt, Human
ucaggaggaugucggcaaauuu

SEQ ID NO: 189691 - RNA, 22 nt, Human
cugccugcugcccuccagagcc

SEQ ID NO: 189692 - RNA, 22 nt, Human
uauacugagagcaaauacauuc

SEQ ID NO: 189693 - RNA, 19 nt, Human
agacaaguuuccagaagcc

SEQ ID NO: 189694 - RNA, 22 nt, Human
uucauguaacuuuucuucucca

SEQ ID NO: 189695 - RNA, 20 nt, Human
ucaggaugugcugagugaag

SEQ ID NO: 189696 - RNA, 22 nt, Human
uuuugcugggguggcuagcuua

SEQ ID NO: 189697 - RNA, 22 nt, Human
gaaacuguuucuggcuuuggug

SEQ ID NO: 189698 - RNA, 22 nt, Human
acagcuuuucugauagauccug

SEQ ID NO: 189699 - RNA, 22 nt, Human
ccacagagucuuccuucucuuc

SEQ ID NO: 189700 - RNA, 22 nt, Human
aacuuagagcucuccuaaauga

SEQ ID NO: 189701 - RNA, 22 nt, Human
gagcagagacaguacaacuggc

SEQ ID NO: 189702 - RNA, 22 nt, Human
uuaguugacccccaguccuggc

SEQ ID NO: 189703 - RNA, 22 nt, Human
aucuauuucugcuaauaacaau

SEQ ID NO: 189704 - RNA, 22 nt, Human
augucacaucugggauggcccu

SEQ ID NO: 189705 - RNA, 22 nt, Human
acugggcaucccauggcagagc

SEQ ID NO: 189706 - RNA, 22 nt, Human
gcagguuagauuuaauccauuc

SEQ ID NO: 189707 - RNA, 22 nt, Human
cagcaggugcaggugcggccgc

SEQ ID NO: 189708 - RNA, 18 nt, Human
agucuuuauuucuuucau

SEQ ID NO: 189709 - RNA, 22 nt, Human
cuuauauuuuaggaacagacaa

SEQ ID NO: 189710 - RNA, 22 nt, Human
ucagagaggcaauacuguuuaa

SEQ ID NO: 189711 - RNA, 22 nt, Human
agggcuggcaagggauugaaau

SEQ ID NO: 189712 - RNA, 20 nt, Human
ucccucaguuuccagcccug

SEQ ID NO: 189713 - RNA, 22 nt, Human
ugaaggcccagccacagaaugg

SEQ ID NO: 189714 - RNA, 22 nt, Human
aaugccaucuggugauguauua

SEQ ID NO: 189715 - RNA, 22 nt, Human
ccaguccacgucaagaagaggu

SEQ ID NO: 189716 - RNA, 22 nt, Human
acuuccagugucugcugcuagc

SEQ ID NO: 189717 - RNA, 22 nt, Human
augcaacaauguauuuauguau

SEQ ID NO: 189718 - RNA, 22 nt, Human
cuguccugagauaaagaugagg

SEQ ID NO: 189719 - RNA, 22 nt, Human
caggaagccacaggacagguag

SEQ ID NO: 189720 - RNA, 23 nt, Human
ccucagaggccucauagucuggc

SEQ ID NO: 189721 - RNA, 22 nt, Human
ugaguccauguggaggggaggu

SEQ ID NO: 189722 - RNA, 22 nt, Human
ggaaucagaauuacugaaugga

SEQ ID NO: 189723 - RNA, 17 nt, Human
cucugcagugcauggcu

SEQ ID NO: 189724 - RNA, 22 nt, Human
ucagcuggauguggaagugcua

SEQ ID NO: 189725 - RNA, 22 nt, Human
cuguauuaguccauuugagcug

SEQ ID NO: 189726 - RNA, 19 nt, Human
cugugcaggccgggcugag

SEQ ID NO: 189727 - RNA, 22 nt, Human
cuggaucuugcugcauugagaa

SEQ ID NO: 189728 - RNA, 22 nt, Human
ucauuguauucagaacugaaga

SEQ ID NO: 189729 - RNA, 22 nt, Human
ccagcuggagcucgcagauagg

SEQ ID NO: 189730 - RNA, 22 nt, Human
aaggucagagcaggaaggaguc

SEQ ID NO: 189731 - RNA, 22 nt, Human
acaguguagcaugguagcaaug

SEQ ID NO: 189732 - RNA, 21 nt, Human
gagagggcauuauaggaagug

SEQ ID NO: 189733 - RNA, 22 nt, Human
auuccucauuuguugagaacca

SEQ ID NO: 189734 - RNA, 21 nt, Human
aacacauccagaguauuugac

SEQ ID NO: 189735 - RNA, 22 nt, Human
aggcuucuugggcuucauucug

SEQ ID NO: 189736 - RNA, 22 nt, Human
uauucccugauguacacuggca

SEQ ID NO: 189737 - RNA, 22 nt, Human
uggccaugacauggaggcuuug

SEQ ID NO: 189738 - RNA, 23 nt, Human
gauacacucccugcugggcacug

SEQ ID NO: 189739 - RNA, 22 nt, Human
ucccugggguaucgcugaggca

SEQ ID NO: 189740 - RNA, 22 nt, Human
caggcugcguuugugaaaggua

SEQ ID NO: 189741 - RNA, 22 nt, Human
gggcugacaguuuccccugaaa

SEQ ID NO: 189742 - RNA, 22 nt, Human
uaacagaauagcagaaacagaa

SEQ ID NO: 189743 - RNA, 22 nt, Human
gaugaaaaauugcugugucaua

SEQ ID NO: 189744 - RNA, 22 nt, Human
cacacagcuagugacaggagaa

SEQ ID NO: 189745 - RNA, 19 nt, Human
caggaaacaccuacugcua

SEQ ID NO: 189746 - RNA, 22 nt, Human
gagucgagcagaaagccgucgg

SEQ ID NO: 189747 - RNA, 22 nt, Human
gauacaguauuuaaagagcaac

SEQ ID NO: 189748 - RNA, 22 nt, Human
ggcugugccucaaggcuacuca

SEQ ID NO: 189749 - RNA, 22 nt, Human
cgaggcagggaagcugcaaaag

SEQ ID NO: 189750 - RNA, 22 nt, Human
aagaaaacaaugacuugccagc

SEQ ID NO: 189751 - RNA, 22 nt, Human
ccuggcuuuagcugccuucccu

SEQ ID NO: 189752 - RNA, 22 nt, Human
uauaaaucuuuguuccuagaau

SEQ ID NO: 189753 - RNA, 19 nt, Human
ucuucccuggcugucaguc

SEQ ID NO: 189754 - RNA, 22 nt, Human
uuuuuacagucauggucacuca

SEQ ID NO: 189755 - RNA, 22 nt, Human
ucucaaauaggccuugguccug

SEQ ID NO: 189756 - RNA, 22 nt, Human
gaagauuuaagcacaauagucu

SEQ ID NO: 189757 - RNA, 22 nt, Human
agaauaaacugcuuuagggcag

SEQ ID NO: 189758 - RNA, 20 nt, Human
ggcucuggaaucuggugggc

SEQ ID NO: 189759 - RNA, 22 nt, Human
ccaaaguccacaguuuacauua

SEQ ID NO: 189760 - RNA, 22 nt, Human
cagacacuauuguguauaaauc

SEQ ID NO: 189761 - RNA, 22 nt, Human
agcaacagcccuguuucauuag

SEQ ID NO: 189762 - RNA, 22 nt, Human
gacaguaagucagagacuuggu

SEQ ID NO: 189763 - RNA, 22 nt, Human
uggaagccguaggguuugggaa

SEQ ID NO: 189764 - RNA, 22 nt, Human
aggagcugcuuuggugcgguuu

SEQ ID NO: 189765 - RNA, 22 nt, Human
aaauggcugacuaaauuaaauu

SEQ ID NO: 189766 - RNA, 22 nt, Human
uuuagggaagaagcccauggcc

SEQ ID NO: 189767 - RNA, 21 nt, Human
gccugggauaguggccuccgg

SEQ ID NO: 189768 - RNA, 22 nt, Human
uucagagccagcaacacuaggc

SEQ ID NO: 189769 - RNA, 22 nt, Human
uugaucucuguugcugucuuug

SEQ ID NO: 189770 - RNA, 22 nt, Human
uaaggaggcagucauuaucagg

SEQ ID NO: 189771 - RNA, 22 nt, Human
ucagcagaaguauagaggccau

SEQ ID NO: 189772 - RNA, 22 nt, Human
gagcuaaaugaaucauaaauca

SEQ ID NO: 189773 - RNA, 22 nt, Human
aagucucuuuucuuccuguauu

SEQ ID NO: 189774 - RNA, 22 nt, Human
uguaaacaaaugcauucuugcu

SEQ ID NO: 189775 - RNA, 22 nt, Human
uggagcaggugcucaggguaau

SEQ ID NO: 189776 - RNA, 22 nt, Human
uauguuuuuaagagaaugcauu

SEQ ID NO: 189777 - RNA, 22 nt, Human
uccuagaaggaucauucuagug

SEQ ID NO: 189778 - RNA, 22 nt, Human
uggagcugguaaacagugacau

SEQ ID NO: 189779 - RNA, 22 nt, Human
gagcuccaccaccuucaggcag

SEQ ID NO: 189780 - RNA, 22 nt, Human
aaaaucugcuuccuuuuacaga

SEQ ID NO: 189781 - RNA, 22 nt, Human
cugcaggcugagcgccugccgg

SEQ ID NO: 189782 - RNA, 22 nt, Human
gacaggcuauuuucuuacgggu

SEQ ID NO: 189783 - RNA, 22 nt, Human
cacuuuacccuuguuacucaug

SEQ ID NO: 189784 - RNA, 22 nt, Human
ccucagcugucuuuuccgaggu

SEQ ID NO: 189785 - RNA, 22 nt, Human
gacugccagaaugugaggccug

SEQ ID NO: 189786 - RNA, 22 nt, Human
uaggaaauucucuugcuaaguu

SEQ ID NO: 189787 - RNA, 22 nt, Human
gcuggagcugcagccugggccu

SEQ ID NO: 189788 - RNA, 22 nt, Human
cucuagaguacgggcuggcaug

SEQ ID NO: 189789 - RNA, 22 nt, Human
agagcugucacauagagccaga

SEQ ID NO: 189790 - RNA, 22 nt, Human
acccagagucauggcacuuagc

SEQ ID NO: 189791 - RNA, 22 nt, Human
ugcagaaacagucauuaaugua

SEQ ID NO: 189792 - RNA, 22 nt, Human
guagcuuacaucagaguugguu

SEQ ID NO: 189793 - RNA, 23 nt, Human
gcaggacaacagagugggaaggc

SEQ ID NO: 189794 - RNA, 22 nt, Human
ucucuggcagcuugugcuguug

SEQ ID NO: 189795 - RNA, 22 nt, Human
cugcugagguauacuaugugac

SEQ ID NO: 189796 - RNA, 22 nt, Human
gggaaaaauaaugcacagauau

SEQ ID NO: 189797 - RNA, 22 nt, Human
cugauagacaaucaccauggga

SEQ ID NO: 189798 - RNA, 22 nt, Human
uccaggcaaaaaccaacuacag

SEQ ID NO: 189799 - RNA, 17 nt, Human
ugguccagguggagcca

SEQ ID NO: 189800 - RNA, 22 nt, Human
gucugggcaucagacugcgggc

SEQ ID NO: 189801 - RNA, 22 nt, Human
ccucugaguuggccugucuugu

SEQ ID NO: 189802 - RNA, 22 nt, Human
cuggcugguaauggaacgacag

SEQ ID NO: 189803 - RNA, 22 nt, Human
aggggaggagcuuuucuugccu

SEQ ID NO: 189804 - RNA, 22 nt, Human
cugagggaaggcagucaguugg

SEQ ID NO: 189805 - RNA, 22 nt, Human
aagauggagcacgagcagaagc

SEQ ID NO: 189806 - RNA, 22 nt, Human
aggcaaauuauuguaugcaguu

SEQ ID NO: 189807 - RNA, 22 nt, Human
ccagagagucgaugggggacac

SEQ ID NO: 189808 - RNA, 22 nt, Human
cuuucauaaaggaaaugaugag

SEQ ID NO: 189809 - RNA, 22 nt, Human
gaagacauuaagucuaugucac

SEQ ID NO: 189810 - RNA, 22 nt, Human
gucaucuuaaggacugcuauag

SEQ ID NO: 189811 - RNA, 22 nt, Human
cuucucaaaguugugaaucagg

SEQ ID NO: 189812 - RNA, 22 nt, Human
accuguuucucucugaguuacu

SEQ ID NO: 189813 - RNA, 22 nt, Human
ggcugcaggcaggguauccacu

SEQ ID NO: 189814 - RNA, 22 nt, Human
uuuuaauugcaauuaugguccc

SEQ ID NO: 189815 - RNA, 22 nt, Human
acuauacaguauguacgugcac

SEQ ID NO: 189816 - RNA, 22 nt, Human
aauaagauccugaagauauguu

SEQ ID NO: 189817 - RNA, 22 nt, Human
auguuuuaaauauguguguaaa

SEQ ID NO: 189818 - RNA, 19 nt, Human
ugucccagacuccgugucu

SEQ ID NO: 189819 - RNA, 22 nt, Human
uaaaauagcaugugcagugaaa

SEQ ID NO: 189820 - RNA, 22 nt, Human
augcacauguaucuauauacaa

SEQ ID NO: 189821 - RNA, 22 nt, Human
ccaaggcuccucagcuggucuu

SEQ ID NO: 189822 - RNA, 22 nt, Human
uguggacuagagaauucuguug

SEQ ID NO: 189823 - RNA, 22 nt, Human
ccuguacaucugcucucauugc

SEQ ID NO: 189824 - RNA, 22 nt, Human
uucaucaauguguuuaauaaug

SEQ ID NO: 189825 - RNA, 22 nt, Human
gcagcagcucugaaugggcccc

SEQ ID NO: 189826 - RNA, 22 nt, Human
ugauaaacuuagaaagaauguu

SEQ ID NO: 189827 - RNA, 22 nt, Human
uuuaagagccuguacaaauauu

SEQ ID NO: 189828 - RNA, 22 nt, Human
uucaugugaucacagauuguaa

SEQ ID NO: 189829 - RNA, 22 nt, Human
gaggcucacgacgggacgaacu

SEQ ID NO: 189830 - RNA, 22 nt, Human
ccagaggugcugggagaggucu

SEQ ID NO: 189831 - RNA, 22 nt, Human
augcauaaagaaagcuaucugg

SEQ ID NO: 189832 - RNA, 22 nt, Human
agcugguaaaggggaaagcaga

SEQ ID NO: 189833 - RNA, 22 nt, Human
aagccagggucaggggccuccu

SEQ ID NO: 189834 - RNA, 22 nt, Human
uccugaccacacugccuucugc

SEQ ID NO: 189835 - RNA, 22 nt, Human
uccugcugccauuucaagugcu

SEQ ID NO: 189836 - RNA, 22 nt, Human
cuggguuuuauuacagugagcu

SEQ ID NO: 189837 - RNA, 22 nt, Human
ggagcccugcccuaggcagcuc

SEQ ID NO: 189838 - RNA, 22 nt, Human
ugcaggugcugugucaagagag

SEQ ID NO: 189839 - RNA, 22 nt, Human
aauucuauguucuugaguaaga

SEQ ID NO: 189840 - RNA, 22 nt, Human
aguggcugcuucugguugcucc

SEQ ID NO: 189841 - RNA, 19 nt, Human
ccaggcuuuaugcaaauac

SEQ ID NO: 189842 - RNA, 22 nt, Human
gucagagcuggaggcaaguucu

SEQ ID NO: 189843 - RNA, 22 nt, Human
guaacucuuuggaaaacauuuu

SEQ ID NO: 189844 - RNA, 22 nt, Human
agaggcugggaaggguccccgg

SEQ ID NO: 189845 - RNA, 23 nt, Human
uuucuucagaagccuugcgaggc

SEQ ID NO: 189846 - RNA, 22 nt, Human
uuuauaaaauagacugggucua

SEQ ID NO: 189847 - RNA, 22 nt, Human
gcucuuuguauuuuggaaucaa

SEQ ID NO: 189848 - RNA, 22 nt, Human
aauguauuugauguauuagccu

SEQ ID NO: 189849 - RNA, 22 nt, Human
ucagcagggccuccuugugcag

SEQ ID NO: 189850 - RNA, 22 nt, Human
ucucuucccuuuaugguaugug

SEQ ID NO: 189851 - RNA, 22 nt, Human
ucaguggauauuucuguggcug

SEQ ID NO: 189852 - RNA, 22 nt, Human
ucugugcccucggugcugggcc

SEQ ID NO: 189853 - RNA, 22 nt, Human
guugaaagaugucuugguuccc

SEQ ID NO: 189854 - RNA, 22 nt, Human
uucuauuaauauguuaauucug

SEQ ID NO: 189855 - RNA, 22 nt, Human
cucugccauuuaucagaacugu

SEQ ID NO: 189856 - RNA, 21 nt, Human
uuacaaagcuacagauguugc

SEQ ID NO: 189857 - RNA, 22 nt, Human
ugguugccucucagagauuccg

SEQ ID NO: 189858 - RNA, 22 nt, Human
uccugcagucugcacucugccu

SEQ ID NO: 189859 - RNA, 22 nt, Human
ugcaggguggagcggaagcgga

SEQ ID NO: 189860 - RNA, 22 nt, Human
aucucagaaggcauuuccaaga

SEQ ID NO: 189861 - RNA, 22 nt, Human
ucguacagcagacugaaguccu

SEQ ID NO: 189862 - RNA, 22 nt, Human
aguguccuacagcuccugccug

SEQ ID NO: 189863 - RNA, 22 nt, Human
uggggugguaauacaccguucu

SEQ ID NO: 189864 - RNA, 20 nt, Human
gcucagguuugggcuuugug

SEQ ID NO: 189865 - RNA, 22 nt, Human
cugccuugcaccggcucucugg

SEQ ID NO: 189866 - RNA, 18 nt, Human
ucaggcuggaaguuugcc

SEQ ID NO: 189867 - RNA, 22 nt, Human
uugaaauacugcauuguucagu

SEQ ID NO: 189868 - RNA, 22 nt, Human
gaagucugcugcucaggaguuu

SEQ ID NO: 189869 - RNA, 22 nt, Human
uuaaagucccugccuuaauucc

SEQ ID NO: 189870 - RNA, 22 nt, Human
acauucuuucaccuugugucca

SEQ ID NO: 189871 - RNA, 22 nt, Human
uguccuuuucuuuagugcagcu

SEQ ID NO: 189872 - RNA, 22 nt, Human
ucuuuggaaugcuagcauucua

SEQ ID NO: 189873 - RNA, 22 nt, Human
agauugggguccagacuccuga

SEQ ID NO: 189874 - RNA, 22 nt, Human
uuauuugaaugauggcacaauu

SEQ ID NO: 189875 - RNA, 22 nt, Human
aaugcuaaaacacagauuuuug

SEQ ID NO: 189876 - RNA, 22 nt, Human
uuucaaacauaucuucauuacu

SEQ ID NO: 189877 - RNA, 22 nt, Human
ucugccagaaguucugagagua

SEQ ID NO: 189878 - RNA, 21 nt, Human
ggugcucgcugaugaggagug

SEQ ID NO: 189879 - RNA, 22 nt, Human
gcauuuuaauaagauucauagg

SEQ ID NO: 189880 - RNA, 22 nt, Human
uaauuuugcugugaccauugaa

SEQ ID NO: 189881 - RNA, 22 nt, Human
gcccagugguaaaagcaggccu

SEQ ID NO: 189882 - RNA, 22 nt, Human
acaugcauaagccuagccauca

SEQ ID NO: 189883 - RNA, 22 nt, Human
aguauauaugaggaaccacaaa

SEQ ID NO: 189884 - RNA, 22 nt, Human
aguuuagacaaagucuugcauu

SEQ ID NO: 189885 - RNA, 22 nt, Human
cauuuauucaugaucuguagcu

SEQ ID NO: 189886 - RNA, 23 nt, Human
aggagccccuaauucugggcagc

SEQ ID NO: 189887 - RNA, 21 nt, Human
caggcucugcuagaggagccu

SEQ ID NO: 189888 - RNA, 23 nt, Human
uuggagagggugaguagugucag

SEQ ID NO: 189889 - RNA, 22 nt, Human
gggaggacgguccagggcaaag

SEQ ID NO: 189890 - RNA, 22 nt, Human
accaucuuuuccucugccuccu

SEQ ID NO: 189891 - RNA, 22 nt, Human
uguguccuuaugaaaauacugu

SEQ ID NO: 189892 - RNA, 22 nt, Human
ggcagagaaucuggcuguuuac

SEQ ID NO: 189893 - RNA, 22 nt, Human
caaacuuacguagucuuacuac

SEQ ID NO: 189894 - RNA, 22 nt, Human
gaaaauguuuccuguuauuugc

SEQ ID NO: 189895 - RNA, 22 nt, Human
uuguacaaguuuugagcuuaag

SEQ ID NO: 189896 - RNA, 22 nt, Human
agcagcauuaugauauaucuua

SEQ ID NO: 189897 - RNA, 22 nt, Human
uauuuugcaaaccugaguuuga

SEQ ID NO: 189898 - RNA, 22 nt, Human
augugcaugcacuuacaugugu

SEQ ID NO: 189899 - RNA, 22 nt, Human
ugaggccucugugccauccagg

SEQ ID NO: 189900 - RNA, 22 nt, Human
cauuuggaccaaaauagccaac

SEQ ID NO: 189901 - RNA, 21 nt, Human
ugaggccucuccugggcuggc

SEQ ID NO: 189902 - RNA, 22 nt, Human
ucaggagcugcacugggcccac

SEQ ID NO: 189903 - RNA, 22 nt, Human
agggccccauagucacugcccg

SEQ ID NO: 189904 - RNA, 22 nt, Human
uuccuuguugaaaaugucugca

SEQ ID NO: 189905 - RNA, 22 nt, Human
gcagagugggagcccagggcug

SEQ ID NO: 189906 - RNA, 19 nt, Human
cuuuagacacaccuggaca

SEQ ID NO: 189907 - RNA, 21 nt, Human
agggccucuguguacuggggg

SEQ ID NO: 189908 - RNA, 22 nt, Human
gguucucuaacuuugacuggag

SEQ ID NO: 189909 - RNA, 19 nt, Human
uccugggcugcgucuugcc

SEQ ID NO: 189910 - RNA, 22 nt, Human
gcaacaguuggauuccagagga

SEQ ID NO: 189911 - RNA, 23 nt, Human
gcacagagcaguuaggggaagau

SEQ ID NO: 189912 - RNA, 20 nt, Human
agggugugggccuuagccau

SEQ ID NO: 189913 - RNA, 22 nt, Human
gaccagcuggugaaaaccaauu

SEQ ID NO: 189914 - RNA, 22 nt, Human
acauggcuggcaccuuaaauuu

SEQ ID NO: 189915 - RNA, 22 nt, Human
caggccugcaggaaaggcuccc

SEQ ID NO: 189916 - RNA, 22 nt, Human
gggcaguagcuucguaggcauc

SEQ ID NO: 189917 - RNA, 22 nt, Human
uccuggccugucuggaguagcu

SEQ ID NO: 189918 - RNA, 22 nt, Human
ggcagaggugaaguucacaagg

SEQ ID NO: 189919 - RNA, 22 nt, Human
cugcccagauuuuaccaccugc

SEQ ID NO: 189920 - RNA, 22 nt, Human
auuucaaguguugagcucauaa

SEQ ID NO: 189921 - RNA, 20 nt, Human
agggaggugcugggccugag

SEQ ID NO: 189922 - RNA, 22 nt, Human
acaggcugaggaugauugcauc

SEQ ID NO: 189923 - RNA, 22 nt, Human
gugggagcuuuggcaucaggcu

SEQ ID NO: 189924 - RNA, 22 nt, Human
ugagaagcagcuuacagguguc

SEQ ID NO: 189925 - RNA, 22 nt, Human
ccagagagagaggucaauggca

SEQ ID NO: 189926 - RNA, 22 nt, Human
cagaaauauuuauugagugaca

SEQ ID NO: 189927 - RNA, 22 nt, Human
uugcagggauuaccuuauuuuu

SEQ ID NO: 189928 - RNA, 22 nt, Human
guggcuucaugaacacugauga

SEQ ID NO: 189929 - RNA, 22 nt, Human
ggcuggacuuuuugcaggucau

SEQ ID NO: 189930 - RNA, 22 nt, Human
guggcagugugaggauccugcu

SEQ ID NO: 189931 - RNA, 22 nt, Human
uguaauuauguuguuagaguau

SEQ ID NO: 189932 - RNA, 22 nt, Human
cagaaucuucuuaauuggcaca

SEQ ID NO: 189933 - RNA, 22 nt, Human
gaggcugggaaguccaauauca

SEQ ID NO: 189934 - RNA, 22 nt, Human
agggccucgaaggcagagggau

SEQ ID NO: 189935 - RNA, 22 nt, Human
cucuguuucucagccuauuucc

SEQ ID NO: 189936 - RNA, 21 nt, Human
aggagggcacaaggccaggaa

SEQ ID NO: 189937 - RNA, 22 nt, Human
auacuucuuuaagaguaagucu

SEQ ID NO: 189938 - RNA, 22 nt, Human
ucccuccaggcagcuggguacu

SEQ ID NO: 189939 - RNA, 22 nt, Human
aaaauacuacugucuucuuccc

SEQ ID NO: 189940 - RNA, 22 nt, Human
aaguacaugcuuuauucagagu

SEQ ID NO: 189941 - RNA, 22 nt, Human
uugaaaggugcugugugcugau

SEQ ID NO: 189942 - RNA, 22 nt, Human
gaguuaaauauuuucugaaguu

SEQ ID NO: 189943 - RNA, 22 nt, Human
ggccuugcggaacgcucaggcg

SEQ ID NO: 189944 - RNA, 22 nt, Human
gggaagguauuuagcugcugaa

SEQ ID NO: 189945 - RNA, 22 nt, Human
caaaguuuaaaguagauuucag

SEQ ID NO: 189946 - RNA, 23 nt, Human
uacuauaacgcugugucagcucc

SEQ ID NO: 189947 - RNA, 22 nt, Human
augcugggaaguccuaaccaca

SEQ ID NO: 189948 - RNA, 22 nt, Human
gaggcucuggaguagguacaca

SEQ ID NO: 189949 - RNA, 22 nt, Human
aaagucuuguuacguuccauug

SEQ ID NO: 189950 - RNA, 22 nt, Human
guuauuuauaagguguaacucc

SEQ ID NO: 189951 - RNA, 22 nt, Human
cucuucuugcuagacugagugc

SEQ ID NO: 189952 - RNA, 22 nt, Human
ccuggcugaaccaaugaagugg

SEQ ID NO: 189953 - RNA, 22 nt, Human
guccaaaagagccagccgggcg

SEQ ID NO: 189954 - RNA, 23 nt, Human
agccacagccagagcuaucucca

SEQ ID NO: 189955 - RNA, 22 nt, Human
ggaugucucccagcaccaaagu

SEQ ID NO: 189956 - RNA, 22 nt, Human
agaugcugaagcugaggcaaca

SEQ ID NO: 189957 - RNA, 22 nt, Human
agccugggaauuuagaguucgg

SEQ ID NO: 189958 - RNA, 22 nt, Human
uuuguacacaggauguuauaau

SEQ ID NO: 189959 - RNA, 22 nt, Human
aagugcauaaguaugauuauuu

SEQ ID NO: 189960 - RNA, 22 nt, Human
ugcagaagauggucugagcacc

SEQ ID NO: 189961 - RNA, 22 nt, Human
ccagguaacuugagaacaugag

SEQ ID NO: 189962 - RNA, 22 nt, Human
agcugaggaauaauaacaaggu

SEQ ID NO: 189963 - RNA, 16 nt, Human
acaaauacaacugcug

SEQ ID NO: 189964 - RNA, 22 nt, Human
uuuuuggguccaggcuguaucu

SEQ ID NO: 189965 - RNA, 22 nt, Human
uggccugccacugccacgccac

SEQ ID NO: 189966 - RNA, 22 nt, Human
caacaagcgcucagagcaaagc

SEQ ID NO: 189967 - RNA, 22 nt, Human
cucugaggcuuguucuauguau

SEQ ID NO: 189968 - RNA, 22 nt, Human
cagagacaggaucucgaagacu

SEQ ID NO: 189969 - RNA, 22 nt, Human
acugaggauggauaggucauau

SEQ ID NO: 189970 - RNA, 22 nt, Human
acagugcaaauaggacugucuu

SEQ ID NO: 189971 - RNA, 22 nt, Human
aucuucaaggaaaaaauacagu

SEQ ID NO: 189972 - RNA, 22 nt, Human
auucagugaccuaauuacuuac

SEQ ID NO: 189973 - RNA, 22 nt, Human
ucuuuccucugagcuccuguag

SEQ ID NO: 189974 - RNA, 22 nt, Human
uucucuggagggcugcccggcc

SEQ ID NO: 189975 - RNA, 22 nt, Human
ugcacacagaugguacaugcau

SEQ ID NO: 189976 - RNA, 22 nt, Human
agggagcuuuaccccagaucac

SEQ ID NO: 189977 - RNA, 22 nt, Human
uccuggguggcucugcccggcu

SEQ ID NO: 189978 - RNA, 22 nt, Human
cucuuccuacagucugcuaugc

SEQ ID NO: 189979 - RNA, 22 nt, Human
cacugagaaagugaccugccaa

SEQ ID NO: 189980 - RNA, 22 nt, Human
uuaaaucuguucucaugucugu

SEQ ID NO: 189981 - RNA, 22 nt, Human
aaugugaaaccgcacagaauaa

SEQ ID NO: 189982 - RNA, 22 nt, Human
cuuauucagauacagacucuug

SEQ ID NO: 189983 - RNA, 22 nt, Human
ucugagagagcaccuauccacu

SEQ ID NO: 189984 - RNA, 21 nt, Human
agcaggcagugggcuggauuu

SEQ ID NO: 189985 - RNA, 22 nt, Human
accuguuuuccuaucuagauug

SEQ ID NO: 189986 - RNA, 22 nt, Human
cccaaggaauaggaucccagga

SEQ ID NO: 189987 - RNA, 22 nt, Human
gggagaaggagcuaguucuuga

SEQ ID NO: 189988 - RNA, 22 nt, Human
ucccuucaucagugagcaagcc

SEQ ID NO: 189989 - RNA, 23 nt, Human
ugggcuucugagaaagcaccuaa

SEQ ID NO: 189990 - RNA, 18 nt, Human
gcugcccuagcuccccuc

SEQ ID NO: 189991 - RNA, 22 nt, Human
ucuccaggugcuaagugugccu

SEQ ID NO: 189992 - RNA, 22 nt, Human
aaauuccauuuugugacuauuc

SEQ ID NO: 189993 - RNA, 22 nt, Human
uggagggcauagcuguucuuuc

SEQ ID NO: 189994 - RNA, 22 nt, Human
ugacauuugagcauacauguaa

SEQ ID NO: 189995 - RNA, 22 nt, Human
gucuauauauugcuugaauaau

SEQ ID NO: 189996 - RNA, 23 nt, Human
gugagucuugccuuugcugugga

SEQ ID NO: 189997 - RNA, 22 nt, Human
cugaagccacgauagcuuccua

SEQ ID NO: 189998 - RNA, 22 nt, Human
gccagcugucuaagagaguaaa

SEQ ID NO: 189999 - RNA, 22 nt, Human
augggcaguaacaguggcaguc

SEQ ID NO: 190000 - RNA, 22 nt, Human
ugccaggcccagcuccagagcu

SEQ ID NO: 190001 - RNA, 22 nt, Human
acagguguagguacauuugcau

SEQ ID NO: 190002 - RNA, 22 nt, Human
caguaacauuucaagguagagg

SEQ ID NO: 190003 - RNA, 22 nt, Human
acaugcuaauggagaugccaag

SEQ ID NO: 190004 - RNA, 22 nt, Human
gguggccucgguggugcacagg

SEQ ID NO: 190005 - RNA, 22 nt, Human
ucagaaauguaagcugaugacu

SEQ ID NO: 190006 - RNA, 22 nt, Human
agggccagccaggcccuacaaa

SEQ ID NO: 190007 - RNA, 22 nt, Human
gcugauggcuugcuggcugaca

SEQ ID NO: 190008 - RNA, 22 nt, Human
ggguccagacacuccagaggaa

SEQ ID NO: 190009 - RNA, 22 nt, Human
cugagaggaacaucuuaugcuu

SEQ ID NO: 190010 - RNA, 22 nt, Human
uugcagcucugauccagggacc

SEQ ID NO: 190011 - RNA, 22 nt, Human
gagcccaggaugguguauggcu

SEQ ID NO: 190012 - RNA, 22 nt, Human
auagacaaugguuugccaagaa

SEQ ID NO: 190013 - RNA, 22 nt, Human
cuggagugacuuuguuccuuuu

SEQ ID NO: 190014 - RNA, 22 nt, Human
agauaacucauuuuguauaucc

SEQ ID NO: 190015 - RNA, 22 nt, Human
uuucacauuagauaugucauuu

SEQ ID NO: 190016 - RNA, 22 nt, Human
uagggcucgggcacaggacagg

SEQ ID NO: 190017 - RNA, 22 nt, Human
cagcuucucagaaagcugaggu

SEQ ID NO: 190018 - RNA, 22 nt, Human
ccucugggcggagaucugcugc

SEQ ID NO: 190019 - RNA, 22 nt, Human
cucagagaggcaguggaaguca

SEQ ID NO: 190020 - RNA, 22 nt, Human
cugaggagaaagaugguccaag

SEQ ID NO: 190021 - RNA, 22 nt, Human
aggccucaugucaaagcagcaa

SEQ ID NO: 190022 - RNA, 22 nt, Human
uauauucauuuuaaagccaucu

SEQ ID NO: 190023 - RNA, 22 nt, Human
ucacugcugcugccaugaugga

SEQ ID NO: 190024 - RNA, 23 nt, Human
ggggaaguggcagugagugaggc

SEQ ID NO: 190025 - RNA, 22 nt, Human
uuuccauguuaucuugcagacu

SEQ ID NO: 190026 - RNA, 22 nt, Human
acacauauaugucgaaguccuc

SEQ ID NO: 190027 - RNA, 22 nt, Human
gagaaggccaggaacccagugu

SEQ ID NO: 190028 - RNA, 22 nt, Human
uuuuuauaggucagggcaaguc

SEQ ID NO: 190029 - RNA, 20 nt, Human
uuggaugugcauggccgugc

SEQ ID NO: 190030 - RNA, 21 nt, Human
uucauaaaccauucucaugca

SEQ ID NO: 190031 - RNA, 22 nt, Human
ggguccagaguugaagagguua

SEQ ID NO: 190032 - RNA, 22 nt, Human
uccuggcccgaucccugugaag

SEQ ID NO: 190033 - RNA, 22 nt, Human
caugguuuggucuuuguagugg

SEQ ID NO: 190034 - RNA, 20 nt, Human
uuccuggggaaugauagaag

SEQ ID NO: 190035 - RNA, 17 nt, Human
gcaauuauugggcauuu

SEQ ID NO: 190036 - RNA, 22 nt, Human
aagccuugccuauuugaugaca

SEQ ID NO: 190037 - RNA, 22 nt, Human
acaggcucucagccaguuggca

SEQ ID NO: 190038 - RNA, 22 nt, Human
ggcacagagaggcccuggaagg

SEQ ID NO: 190039 - RNA, 19 nt, Human
ugcugcagucaggcgaggg

SEQ ID NO: 190040 - RNA, 22 nt, Human
gugcauuugugcaugcacaugu

SEQ ID NO: 190041 - RNA, 22 nt, Human
uggcaggaaaguaacagagcac

SEQ ID NO: 190042 - RNA, 22 nt, Human
gggaauuauagcugucacaggc

SEQ ID NO: 190043 - RNA, 22 nt, Human
ucucagagaacaguuggugcuu

SEQ ID NO: 190044 - RNA, 22 nt, Human
agggaggucuggcugcccugag

SEQ ID NO: 190045 - RNA, 21 nt, Human
auaguuuggagugggaaaguc

SEQ ID NO: 190046 - RNA, 22 nt, Human
cagcauuuagaauuugaagugu

SEQ ID NO: 190047 - RNA, 22 nt, Human
cccugcaggcucagacuggagu

SEQ ID NO: 190048 - RNA, 22 nt, Human
cuucuucaauagcaagcgcaua

SEQ ID NO: 190049 - RNA, 22 nt, Human
agggguuggauuuggccuagag

SEQ ID NO: 190050 - RNA, 22 nt, Human
gaagaagggagugacaaaugca

SEQ ID NO: 190051 - RNA, 22 nt, Human
uuugagaagcaucugguccacu

SEQ ID NO: 190052 - RNA, 20 nt, Human
cacugcccuccagccugagc

SEQ ID NO: 190053 - RNA, 22 nt, Human
uuggguuuugauacaugucuaa

SEQ ID NO: 190054 - RNA, 19 nt, Human
aggaaacugucuuuuccag

SEQ ID NO: 190055 - RNA, 22 nt, Human
aaagugguuucccaguucagua

SEQ ID NO: 190056 - RNA, 22 nt, Human
aggcucugaucagguggcugug

SEQ ID NO: 190057 - RNA, 22 nt, Human
aacauacuuauacuaaauaaug

SEQ ID NO: 190058 - RNA, 22 nt, Human
agugagaguauuaaugugaacu

SEQ ID NO: 190059 - RNA, 23 nt, Human
uagcaaaguuguuugggaaauuu

SEQ ID NO: 190060 - RNA, 22 nt, Human
uguggaagccggugggaagcag

SEQ ID NO: 190061 - RNA, 22 nt, Human
uccuggauuaauagggagcugu

SEQ ID NO: 190062 - RNA, 21 nt, Human
cuggacugaggagacagucgc

SEQ ID NO: 190063 - RNA, 22 nt, Human
ggagaugccuuguuucaggaac

SEQ ID NO: 190064 - RNA, 22 nt, Human
gggaaggagguggcuugaagug

SEQ ID NO: 190065 - RNA, 22 nt, Human
ggcaggcagauggcugcaccaa

SEQ ID NO: 190066 - RNA, 22 nt, Human
guggagcaggacuagcugagaa

SEQ ID NO: 190067 - RNA, 22 nt, Human
ugcuccagcgcugccaccaguu

SEQ ID NO: 190068 - RNA, 22 nt, Human
aaucucuuuggcucaaggaucc

SEQ ID NO: 190069 - RNA, 22 nt, Human
augagcagcauugcuccucuua

SEQ ID NO: 190070 - RNA, 22 nt, Human
ugagcuucuuuauuuggccaga

SEQ ID NO: 190071 - RNA, 19 nt, Human
uccagaacugcccuggccu

SEQ ID NO: 190072 - RNA, 22 nt, Human
cuugggugcuggaggcugccgc

SEQ ID NO: 190073 - RNA, 22 nt, Human
cccugcaggggaccugcagccu

SEQ ID NO: 190074 - RNA, 22 nt, Human
uguuuacaaggaguuuauauug

SEQ ID NO: 190075 - RNA, 22 nt, Human
gggacauggaggcgcgcaggca

SEQ ID NO: 190076 - RNA, 22 nt, Human
uauuuucauucugugugacugu

SEQ ID NO: 190077 - RNA, 22 nt, Human
ggcauggacgucucugaggcca

SEQ ID NO: 190078 - RNA, 22 nt, Human
caaggcagcguuccuuucugga

SEQ ID NO: 190079 - RNA, 22 nt, Human
gaacuugguauuccuuuuaaca

SEQ ID NO: 190080 - RNA, 22 nt, Human
uguguucugaaggagaagagug

SEQ ID NO: 190081 - RNA, 21 nt, Human
agagcugggacuugccugaga

SEQ ID NO: 190082 - RNA, 22 nt, Human
agggaguuccgaucugugcacc

SEQ ID NO: 190083 - RNA, 22 nt, Human
ccagggcuccauugcucauccu

SEQ ID NO: 190084 - RNA, 22 nt, Human
gggggagaagauucugcugcuu

SEQ ID NO: 190085 - RNA, 22 nt, Human
uauaaaacagaaagcacuaccu

SEQ ID NO: 190086 - RNA, 22 nt, Human
uuggcucuggaacuauuucuga

SEQ ID NO: 190087 - RNA, 22 nt, Human
gcuggagcugaguucccugggc

SEQ ID NO: 190088 - RNA, 22 nt, Human
cccugcagaaccacagacaaac

SEQ ID NO: 190089 - RNA, 22 nt, Human
gcuguccacgggguugguagag

SEQ ID NO: 190090 - RNA, 22 nt, Human
gccaaggagacacgguguugua

SEQ ID NO: 190091 - RNA, 22 nt, Human
uaucugagaaagaagcaccaga

SEQ ID NO: 190092 - RNA, 22 nt, Human
uggggcuggcacagucucuauu

SEQ ID NO: 190093 - RNA, 22 nt, Human
cugugcugauucagcacaggcc

SEQ ID NO: 190094 - RNA, 22 nt, Human
ugaugaaaauguucagcaauua

SEQ ID NO: 190095 - RNA, 22 nt, Human
aacaaacaguuaaguguggaug

SEQ ID NO: 190096 - RNA, 22 nt, Human
agugucugcuagguucaucaac

SEQ ID NO: 190097 - RNA, 22 nt, Human
ucccaggcuggcaggcagcagu

SEQ ID NO: 190098 - RNA, 22 nt, Human
ugcugucugcaacaguacuaca

SEQ ID NO: 190099 - RNA, 22 nt, Human
uguguccuuuggaggaucagcg

SEQ ID NO: 190100 - RNA, 23 nt, Human
ggucccaguggagaggccucacc

SEQ ID NO: 190101 - RNA, 22 nt, Human
aguccaggaguugggugacauu

SEQ ID NO: 190102 - RNA, 22 nt, Human
cauucuugcaccgugauggcuu

SEQ ID NO: 190103 - RNA, 22 nt, Human
aacuagaaaacaagaugcugau

SEQ ID NO: 190104 - RNA, 22 nt, Human
cuuccuucaauauaauuuuuac

SEQ ID NO: 190105 - RNA, 22 nt, Human
ggagcugagaguagucccuuuu

SEQ ID NO: 190106 - RNA, 22 nt, Human
uagcuuuaggcacguuugaauu

SEQ ID NO: 190107 - RNA, 22 nt, Human
uccagagagguuucuccaugcu

SEQ ID NO: 190108 - RNA, 22 nt, Human
cuggcuccaaauucugauguuc

SEQ ID NO: 190109 - RNA, 22 nt, Human
caggcccaaaugcaaccuucuu

SEQ ID NO: 190110 - RNA, 22 nt, Human
ccagugcucuuaaaggucauaa

SEQ ID NO: 190111 - RNA, 22 nt, Human
uucuccuuuguaauucucaucc

SEQ ID NO: 190112 - RNA, 22 nt, Human
cucugggucuaccuguggccag

SEQ ID NO: 190113 - RNA, 22 nt, Human
ugcacaguuaauaugugacaga

SEQ ID NO: 190114 - RNA, 22 nt, Human
ucaggagcauauauugaugucu

SEQ ID NO: 190115 - RNA, 22 nt, Human
gaacaguaucaguagugccagu

SEQ ID NO: 190116 - RNA, 22 nt, Human
auauaacauacauacagaaaag

SEQ ID NO: 190117 - RNA, 23 nt, Human
cuucucagaagucugugccagga

SEQ ID NO: 190118 - RNA, 22 nt, Human
gcucgcagaucaccugggggcg

SEQ ID NO: 190119 - RNA, 22 nt, Human
ucucuggaguauaaccagggau

SEQ ID NO: 190120 - RNA, 22 nt, Human
aauaggaaaauauuuaacaaga

SEQ ID NO: 190121 - RNA, 22 nt, Human
uuucccaaguguaaacauggca

SEQ ID NO: 190122 - RNA, 22 nt, Human
uuccugggacuggagcagccca

SEQ ID NO: 190123 - RNA, 19 nt, Human
acauuuagaauguacuugc

SEQ ID NO: 190124 - RNA, 22 nt, Human
cuguugcugagguucaaggguc

SEQ ID NO: 190125 - RNA, 20 nt, Human
uggagcuccagcguccaugu

SEQ ID NO: 190126 - RNA, 22 nt, Human
agauaaugucaaauucugucug

SEQ ID NO: 190127 - RNA, 21 nt, Human
agcuuccagagcacauuccau

SEQ ID NO: 190128 - RNA, 22 nt, Human
aacaguaaaaaucauuuaguug

SEQ ID NO: 190129 - RNA, 22 nt, Human
ucuuucauucuagucugagguu

SEQ ID NO: 190130 - RNA, 17 nt, Human
agggucaggugaaguuc

SEQ ID NO: 190131 - RNA, 22 nt, Human
uucuucuuuccuauaauuaauu

SEQ ID NO: 190132 - RNA, 22 nt, Human
ggccuugguggcuuugcugaug

SEQ ID NO: 190133 - RNA, 22 nt, Human
gaaguuuuagucaaaauguaga

SEQ ID NO: 190134 - RNA, 22 nt, Human
cagagugaaaacugagcucaaa

SEQ ID NO: 190135 - RNA, 22 nt, Human
uugaaaguagcagcugcauaug

SEQ ID NO: 190136 - RNA, 18 nt, Human
guccauggccuccaccca

SEQ ID NO: 190137 - RNA, 20 nt, Human
gagcaguggaguuuccaggg

SEQ ID NO: 190138 - RNA, 22 nt, Human
ccuggagcacucucccuggcug

SEQ ID NO: 190139 - RNA, 22 nt, Human
ccagcuuuuggggugacaauuu

SEQ ID NO: 190140 - RNA, 22 nt, Human
uucagagagaaaccagugggaa

SEQ ID NO: 190141 - RNA, 22 nt, Human
aauucuagcauugugaaaauau

SEQ ID NO: 190142 - RNA, 23 nt, Human
auuuuuugucuuuguaacuagau

SEQ ID NO: 190143 - RNA, 22 nt, Human
ugguuagaugaggcugguuuca

SEQ ID NO: 190144 - RNA, 22 nt, Human
cccuccuuucuaggcuuccagc

SEQ ID NO: 190145 - RNA, 22 nt, Human
uacaggcauguagcauggugau

SEQ ID NO: 190146 - RNA, 22 nt, Human
agccuggccaggccugcccagg

SEQ ID NO: 190147 - RNA, 22 nt, Human
aguccugggugugcaaggcaga

SEQ ID NO: 190148 - RNA, 22 nt, Human
uaauuauacaaaaaggcaugca

SEQ ID NO: 190149 - RNA, 22 nt, Human
ugcucagaaacgaggugcagcc

SEQ ID NO: 190150 - RNA, 22 nt, Human
ccacagcuucgcagucugcugc

SEQ ID NO: 190151 - RNA, 22 nt, Human
agugcucaugcacauuuauagu

SEQ ID NO: 190152 - RNA, 22 nt, Human
accaugccaguggcagccagac

SEQ ID NO: 190153 - RNA, 22 nt, Human
cuggucccagcagagcucugag

SEQ ID NO: 190154 - RNA, 22 nt, Human
ucugccaugcuaacuucaguau

SEQ ID NO: 190155 - RNA, 22 nt, Human
agggcugagaaugacagggccg

SEQ ID NO: 190156 - RNA, 22 nt, Human
uucagagcuggugucuacagcu

SEQ ID NO: 190157 - RNA, 22 nt, Human
uuuagaaguucacacauuuaaa

SEQ ID NO: 190158 - RNA, 19 nt, Human
uuggaaggagccagagugg

SEQ ID NO: 190159 - RNA, 22 nt, Human
ucuccagaaauggggcugggga

SEQ ID NO: 190160 - RNA, 22 nt, Human
uuucuauaugaggagcuaaagu

SEQ ID NO: 190161 - RNA, 22 nt, Human
agcagcugucccuuaacaucag

SEQ ID NO: 190162 - RNA, 21 nt, Human
agcugcaaaaacauacaguuc

SEQ ID NO: 190163 - RNA, 23 nt, Human
ucugggcugcuuaaggaucaagg

SEQ ID NO: 190164 - RNA, 22 nt, Human
cuaggcucagucucuggucugu

SEQ ID NO: 190165 - RNA, 16 nt, Human
uggcuucuuauuucua

SEQ ID NO: 190166 - RNA, 21 nt, Human
cucuggaguuugaaggcuggg

SEQ ID NO: 190167 - RNA, 22 nt, Human
cacagagcuggaaaggcugggc

SEQ ID NO: 190168 - RNA, 22 nt, Human
ccaggcccuugcaagucccacc

SEQ ID NO: 190169 - RNA, 22 nt, Human
augccuggacugacaugcacug

SEQ ID NO: 190170 - RNA, 22 nt, Human
ccccaggagauuugggagcaca

SEQ ID NO: 190171 - RNA, 22 nt, Human
aguguauuaucagaaacugugg

SEQ ID NO: 190172 - RNA, 22 nt, Human
auuuauaacgugcagccagggu

SEQ ID NO: 190173 - RNA, 22 nt, Human
ugaggccaugcccgugccggcc

SEQ ID NO: 190174 - RNA, 22 nt, Human
uggauuaguuaagaaauguuag

SEQ ID NO: 190175 - RNA, 22 nt, Human
acauaacaaucauaggacauag

SEQ ID NO: 190176 - RNA, 22 nt, Human
aucugcuugaaugagcaacagg

SEQ ID NO: 190177 - RNA, 22 nt, Human
agggcccuuacgcaggcccuuc

SEQ ID NO: 190178 - RNA, 22 nt, Human
ugccugccccacaagggguugc

SEQ ID NO: 190179 - RNA, 22 nt, Human
uccauuauacuucugauucaaa

SEQ ID NO: 190180 - RNA, 22 nt, Human
uacaacacuguucagccucuuc

SEQ ID NO: 190181 - RNA, 22 nt, Human
cucucugguacauagaguuugg

SEQ ID NO: 190182 - RNA, 22 nt, Human
cacugccuggaaggagagacau

SEQ ID NO: 190183 - RNA, 22 nt, Human
gccacuguacuccagccugcga

SEQ ID NO: 190184 - RNA, 22 nt, Human
auaguuugugaaacacagcagu

SEQ ID NO: 190185 - RNA, 22 nt, Human
auccuggcccagguguggaggg

SEQ ID NO: 190186 - RNA, 19 nt, Human
aaauggagcuaaucuuguc

SEQ ID NO: 190187 - RNA, 22 nt, Human
uggcccagcugcagauggugga

SEQ ID NO: 190188 - RNA, 22 nt, Human
uauugcugccucguccaggcug

SEQ ID NO: 190189 - RNA, 22 nt, Human
cuugauauuuuaaacauacagu

SEQ ID NO: 190190 - RNA, 22 nt, Human
cucaaggccaguucuucugacu

SEQ ID NO: 190191 - RNA, 22 nt, Human
caggaaauauaggaaaaggaac

SEQ ID NO: 190192 - RNA, 22 nt, Human
uggguagggagcuggaauccua

SEQ ID NO: 190193 - RNA, 22 nt, Human
agggcuacugccugccuucagg

SEQ ID NO: 190194 - RNA, 18 nt, Human
uaaaucucucuuuaguca

SEQ ID NO: 190195 - RNA, 23 nt, Human
agguccuggacauaugugcauca

SEQ ID NO: 190196 - RNA, 22 nt, Human
aggcuugcacaugcacgcacgu

SEQ ID NO: 190197 - RNA, 22 nt, Human
aucuggcugacuuugugggaca

SEQ ID NO: 190198 - RNA, 22 nt, Human
gcacacaugcaugcacaggagu

SEQ ID NO: 190199 - RNA, 22 nt, Human
ggcaggaagcauuaaaacgauu

SEQ ID NO: 190200 - RNA, 22 nt, Human
cuucugugagucaguguuucug

SEQ ID NO: 190201 - RNA, 22 nt, Human
aaaaagacuagucgagugcagu

SEQ ID NO: 190202 - RNA, 22 nt, Human
ccugugccauccugagcauccc

SEQ ID NO: 190203 - RNA, 23 nt, Human
gugcaaagauauaccacauggcu

SEQ ID NO: 190204 - RNA, 22 nt, Human
caugcuguccugaaaagauauu

SEQ ID NO: 190205 - RNA, 22 nt, Human
gaaaaggaaauuuauagagauc

SEQ ID NO: 190206 - RNA, 22 nt, Human
aauugcuuuugggggcaguuac

SEQ ID NO: 190207 - RNA, 22 nt, Human
aaaugugcuugugaucagcugu

SEQ ID NO: 190208 - RNA, 19 nt, Human
gacuccaacuuuaagcaug

SEQ ID NO: 190209 - RNA, 22 nt, Human
augucauugccaagaugcuaau

SEQ ID NO: 190210 - RNA, 22 nt, Human
aguggcagagccaggguuggga

SEQ ID NO: 190211 - RNA, 22 nt, Human
gcaaaggccacuggggcgaugg

SEQ ID NO: 190212 - RNA, 22 nt, Human
ggagcugaaccccaucgugcug

SEQ ID NO: 190213 - RNA, 22 nt, Human
auuuauuccuuuauggcuggag

SEQ ID NO: 190214 - RNA, 22 nt, Human
uaaaugagggcugacaugauug

SEQ ID NO: 190215 - RNA, 22 nt, Human
cucagaggggaugcuuggagaa

SEQ ID NO: 190216 - RNA, 22 nt, Human
uuugggaauagcagggacugag

SEQ ID NO: 190217 - RNA, 22 nt, Human
ugcaucaaaacuggacuccuuc

SEQ ID NO: 190218 - RNA, 22 nt, Human
caggaaauggcugaauaaauuc

SEQ ID NO: 190219 - RNA, 22 nt, Human
agucuuagauuuuauuuugguc

SEQ ID NO: 190220 - RNA, 22 nt, Human
agcacacaucacuucugcucau

SEQ ID NO: 190221 - RNA, 22 nt, Human
uauugagaacccucaggaggca

SEQ ID NO: 190222 - RNA, 22 nt, Human
gagcuuccugaugccgaccagu

SEQ ID NO: 190223 - RNA, 22 nt, Human
aaauuuuaguaaggaaguugag

SEQ ID NO: 190224 - RNA, 22 nt, Human
cuugcuacuaugccuggcuaau

SEQ ID NO: 190225 - RNA, 18 nt, Human
agcaggugcuguuucuuu

SEQ ID NO: 190226 - RNA, 22 nt, Human
uggccugaggcucggcaugggu

SEQ ID NO: 190227 - RNA, 22 nt, Human
ugggugugcccagauggugucc

SEQ ID NO: 190228 - RNA, 22 nt, Human
aacuuuggguaaugcuucaauu

SEQ ID NO: 190229 - RNA, 20 nt, Human
agagagagguaaauugagca

SEQ ID NO: 190230 - RNA, 22 nt, Human
agaggagguggugaugcuuuaa

SEQ ID NO: 190231 - RNA, 22 nt, Human
augccauuguauauucauugau

SEQ ID NO: 190232 - RNA, 22 nt, Human
aggggagguguccccaaaucuc

SEQ ID NO: 190233 - RNA, 22 nt, Human
ugaaggccagggauuugcagcc

SEQ ID NO: 190234 - RNA, 22 nt, Human
auaugcauguacgugugcacaa

SEQ ID NO: 190235 - RNA, 22 nt, Human
ucacucagguucaugucuuugu

SEQ ID NO: 190236 - RNA, 22 nt, Human
ggagcuggucagccuugagcau

SEQ ID NO: 190237 - RNA, 22 nt, Human
ugaugacaauguugcugcaaua

SEQ ID NO: 190238 - RNA, 22 nt, Human
uaacacuggagaguugguugug

SEQ ID NO: 190239 - RNA, 22 nt, Human
uggguccacggaagacuuaggg

SEQ ID NO: 190240 - RNA, 22 nt, Human
uuucaaguucuguuccuaaacu

SEQ ID NO: 190241 - RNA, 22 nt, Human
ucacaucaacauuauagcauga

SEQ ID NO: 190242 - RNA, 22 nt, Human
agcagccagaaagggcagucga

SEQ ID NO: 190243 - RNA, 22 nt, Human
ugggagcaaaugacugggagau

SEQ ID NO: 190244 - RNA, 22 nt, Human
cuggaugucuuggggacuccug

SEQ ID NO: 190245 - RNA, 22 nt, Human
auauccaccauucugcaccuuc

SEQ ID NO: 190246 - RNA, 22 nt, Human
aacugaaaucaaucagugauuc

SEQ ID NO: 190247 - RNA, 22 nt, Human
gagcccaggaaguggaggcuga

SEQ ID NO: 190248 - RNA, 22 nt, Human
ccagaggggcugagcaggucac

SEQ ID NO: 190249 - RNA, 22 nt, Human
cagccuccugggacacucaccg

SEQ ID NO: 190250 - RNA, 22 nt, Human
guucuuuaaccuagucucauuu

SEQ ID NO: 190251 - RNA, 20 nt, Human
aaauuuaggaaauuuuacgc

SEQ ID NO: 190252 - RNA, 21 nt, Human
aaauuucugcaagccucaacu

SEQ ID NO: 190253 - RNA, 22 nt, Human
cauuugaacuaauaacugugcu

SEQ ID NO: 190254 - RNA, 22 nt, Human
auuaaauuaaguggcuaauuua

SEQ ID NO: 190255 - RNA, 22 nt, Human
caugauuauauuaauggcuuca

SEQ ID NO: 190256 - RNA, 22 nt, Human
ccaggaggcagagguuguagug

SEQ ID NO: 190257 - RNA, 22 nt, Human
guccugggaacuggacagcuaa

SEQ ID NO: 190258 - RNA, 22 nt, Human
cugauuccagagucuguguucu

SEQ ID NO: 190259 - RNA, 22 nt, Human
gguggaguaauucgcagagguu

SEQ ID NO: 190260 - RNA, 22 nt, Human
guaggguuggagagcacaacca

SEQ ID NO: 190261 - RNA, 22 nt, Human
caguggagaggcaugcuuggca

SEQ ID NO: 190262 - RNA, 22 nt, Human
auucacacuguauacacaggau

SEQ ID NO: 190263 - RNA, 22 nt, Human
cacagaacauuuuuagaugcag

SEQ ID NO: 190264 - RNA, 22 nt, Human
caggucuccauuuugaugaguu

SEQ ID NO: 190265 - RNA, 22 nt, Human
ucagagaguuacacaaauuguu

SEQ ID NO: 190266 - RNA, 22 nt, Human
gcaggaagaggcucgaagcccc

SEQ ID NO: 190267 - RNA, 19 nt, Human
uccaccccagccagcucug

SEQ ID NO: 190268 - RNA, 22 nt, Human
aggcucugaggcagauuuucgu

SEQ ID NO: 190269 - RNA, 22 nt, Human
agcuccugugugcccaccugcu

SEQ ID NO: 190270 - RNA, 22 nt, Human
cuccagucuaguagagccugcu

SEQ ID NO: 190271 - RNA, 22 nt, Human
ggcagugaaucugagagccugg

SEQ ID NO: 190272 - RNA, 22 nt, Human
cugcaaauaggggugugaauaa

SEQ ID NO: 190273 - RNA, 22 nt, Human
caucaggaggagaugaagaaaa

SEQ ID NO: 190274 - RNA, 22 nt, Human
ucucagucagccuugauguccc

SEQ ID NO: 190275 - RNA, 22 nt, Human
uguuacugauuugauauacagu

SEQ ID NO: 190276 - RNA, 19 nt, Human
acccagagcccuuugcagg

SEQ ID NO: 190277 - RNA, 22 nt, Human
uucuccaacacaagcaugaugu

SEQ ID NO: 190278 - RNA, 20 nt, Human
ucuucagaugcuuuuggagu

SEQ ID NO: 190279 - RNA, 22 nt, Human
agagcuuuuugacaucucucua

SEQ ID NO: 190280 - RNA, 22 nt, Human
uccagcccuccugggaucacag

SEQ ID NO: 190281 - RNA, 22 nt, Human
ggaggccauaguuugggaguca

SEQ ID NO: 190282 - RNA, 22 nt, Human
cucuguaccuuaaaagggcuuu

SEQ ID NO: 190283 - RNA, 22 nt, Human
agugauggugagugagaagcuc

SEQ ID NO: 190284 - RNA, 22 nt, Human
ccagagagaaauggauuugagu

SEQ ID NO: 190285 - RNA, 22 nt, Human
uuuuaauuuuagcccuucuggu

SEQ ID NO: 190286 - RNA, 22 nt, Human
agcuguggcagcacuuuggagu

SEQ ID NO: 190287 - RNA, 22 nt, Human
ccucaggcucugggugccuacc

SEQ ID NO: 190288 - RNA, 22 nt, Human
cugggccuggacgggcagaucu

SEQ ID NO: 190289 - RNA, 22 nt, Human
aaguaacaugggaacaucugaa

SEQ ID NO: 190290 - RNA, 20 nt, Human
gcugggcuaccacuggcccu

SEQ ID NO: 190291 - RNA, 22 nt, Human
ucacaagacugagcuugcuuga

SEQ ID NO: 190292 - RNA, 22 nt, Human
uuagacauguuugcuaaaauga

SEQ ID NO: 190293 - RNA, 22 nt, Human
aggggcaguuccaaguuuugug

SEQ ID NO: 190294 - RNA, 22 nt, Human
ggggaccuucccagagcaguug

SEQ ID NO: 190295 - RNA, 19 nt, Human
aaggcuggagaaggccucu

SEQ ID NO: 190296 - RNA, 22 nt, Human
gcagucaguguugacuacaugc

SEQ ID NO: 190297 - RNA, 22 nt, Human
cuuuggaacauacugcugagcu

SEQ ID NO: 190298 - RNA, 22 nt, Human
uugagucuucaguaaaagggua

SEQ ID NO: 190299 - RNA, 22 nt, Human
gccagaaagaggaggaccuggg

SEQ ID NO: 190300 - RNA, 22 nt, Human
guguucucucuacaggaauuua

SEQ ID NO: 190301 - RNA, 22 nt, Human
uaaggcuuaugaucagaagguu

SEQ ID NO: 190302 - RNA, 22 nt, Human
gauccugugcauggggugaugg

SEQ ID NO: 190303 - RNA, 22 nt, Human
ucauccaguuguggagagggaa

SEQ ID NO: 190304 - RNA, 22 nt, Human
uggucagaaggaagggcuccua

SEQ ID NO: 190305 - RNA, 22 nt, Human
caggugggcugccucuccagcu

SEQ ID NO: 190306 - RNA, 22 nt, Human
gucacaaaggugagggacauga

SEQ ID NO: 190307 - RNA, 22 nt, Human
ucugcccaguuugugcucaggu

SEQ ID NO: 190308 - RNA, 22 nt, Human
acaguuacaucacuuacugaca

SEQ ID NO: 190309 - RNA, 23 nt, Human
gacaccaggcguggcccucgaca

SEQ ID NO: 190310 - RNA, 22 nt, Human
acuuguuucaacuguacucucc

SEQ ID NO: 190311 - RNA, 22 nt, Human
ccaggcuggagugcaguagugu

SEQ ID NO: 190312 - RNA, 22 nt, Human
acagacaaguaguucagacaag

SEQ ID NO: 190313 - RNA, 22 nt, Human
gaaugcagugacggaggcuuac

SEQ ID NO: 190314 - RNA, 22 nt, Human
agacauaagugcuaugacauug

SEQ ID NO: 190315 - RNA, 22 nt, Human
gcuggcucccauugguccuucc

SEQ ID NO: 190316 - RNA, 22 nt, Human
cuauaauuaugcucaaaaugua

SEQ ID NO: 190317 - RNA, 22 nt, Human
gaaggcaucacagaggcugugg

SEQ ID NO: 190318 - RNA, 22 nt, Human
gaugaugagauaaggauaacuu

SEQ ID NO: 190319 - RNA, 22 nt, Human
agagccaaucuucagagcagag

SEQ ID NO: 190320 - RNA, 22 nt, Human
aauuugaaacauagucaccacu

SEQ ID NO: 190321 - RNA, 22 nt, Human
acaucacagagcccagauaaag

SEQ ID NO: 190322 - RNA, 20 nt, Human
ucuuacaaucguuacaucca

SEQ ID NO: 190323 - RNA, 22 nt, Human
ggacccuuggcuucugcagauu

SEQ ID NO: 190324 - RNA, 22 nt, Human
ccugggucuauagacuucaaga

SEQ ID NO: 190325 - RNA, 22 nt, Human
cuggauuaaguaaaauagagga

SEQ ID NO: 190326 - RNA, 22 nt, Human
cugccuuugaaaguucuguuga

SEQ ID NO: 190327 - RNA, 22 nt, Human
cuggcuggucaugucaugagcc

SEQ ID NO: 190328 - RNA, 22 nt, Human
ugcagggccagacuggguugga

SEQ ID NO: 190329 - RNA, 22 nt, Human
acacugcucacuucuucccuug

SEQ ID NO: 190330 - RNA, 22 nt, Human
uagaaacccauguuuauucagu

SEQ ID NO: 190331 - RNA, 22 nt, Human
ugcuggcuuuuugguccuugcu

SEQ ID NO: 190332 - RNA, 18 nt, Human
aguaaagcuuauuacaug

SEQ ID NO: 190333 - RNA, 22 nt, Human
ggguccagcuacaucagggugg

SEQ ID NO: 190334 - RNA, 22 nt, Human
gauugaaacauaggcagucgag

SEQ ID NO: 190335 - RNA, 22 nt, Human
aggacaaaggaccagaucugga

SEQ ID NO: 190336 - RNA, 22 nt, Human
acagugaaaauaauaucuucaa

SEQ ID NO: 190337 - RNA, 22 nt, Human
ucuagaauggcugggcacagcu

SEQ ID NO: 190338 - RNA, 22 nt, Human
ggaagcugaauccagagacagg

SEQ ID NO: 190339 - RNA, 22 nt, Human
cucccaggugucccuucugcca

SEQ ID NO: 190340 - RNA, 22 nt, Human
acauguguacuuuuaaggaugu

SEQ ID NO: 190341 - RNA, 22 nt, Human
ucagcugugauccaucuaucua

SEQ ID NO: 190342 - RNA, 22 nt, Human
agccauccucccaccucagccu

SEQ ID NO: 190343 - RNA, 19 nt, Human
aggagaagacucucucccc

SEQ ID NO: 190344 - RNA, 22 nt, Human
cagcugccccuccagggcuggg

SEQ ID NO: 190345 - RNA, 22 nt, Human
ggugcaggagcggggugcucgg

SEQ ID NO: 190346 - RNA, 22 nt, Human
ggaugucuggucuauuucaagu

SEQ ID NO: 190347 - RNA, 22 nt, Human
caaauagauuguucaauccuga

SEQ ID NO: 190348 - RNA, 22 nt, Human
gaggagggcaguuccucuuuua

SEQ ID NO: 190349 - RNA, 22 nt, Human
auuuccauuaucaugacaaauu

SEQ ID NO: 190350 - RNA, 22 nt, Human
ugcaaauucagaagaacugccc

SEQ ID NO: 190351 - RNA, 22 nt, Human
aguuugaaggaguugaaucacc

SEQ ID NO: 190352 - RNA, 19 nt, Human
ucacuucuguuagcaugga

SEQ ID NO: 190353 - RNA, 22 nt, Human
ggcacagauagaucaagugucu

SEQ ID NO: 190354 - RNA, 22 nt, Human
gccagccacuucagcuauggcu

SEQ ID NO: 190355 - RNA, 22 nt, Human
aucuguuuaauucauuuucaca

SEQ ID NO: 190356 - RNA, 20 nt, Human
ugagggcuaaccagacucug

SEQ ID NO: 190357 - RNA, 19 nt, Human
cugggccagagcuguccuc

SEQ ID NO: 190358 - RNA, 22 nt, Human
aaucagaaucaguugacacagc

SEQ ID NO: 190359 - RNA, 18 nt, Human
cugccacuuaauguggug

SEQ ID NO: 190360 - RNA, 22 nt, Human
uugguuuaccagagggaacgug

SEQ ID NO: 190361 - RNA, 22 nt, Human
caucuucugggacuucucaguu

SEQ ID NO: 190362 - RNA, 22 nt, Human
gaauuuacaaguugaauaacaa

SEQ ID NO: 190363 - RNA, 22 nt, Human
uuagagccccagaaaacagugg

SEQ ID NO: 190364 - RNA, 23 nt, Human
cauggcagcaagagcucauggcc

SEQ ID NO: 190365 - RNA, 22 nt, Human
caaggcagcccgcugaaccaca

SEQ ID NO: 190366 - RNA, 22 nt, Human
acugucuguacuucuugcaagg

SEQ ID NO: 190367 - RNA, 22 nt, Human
guucacaguguuuucuuugcau

SEQ ID NO: 190368 - RNA, 22 nt, Human
uagagucagagaaucauuacag

SEQ ID NO: 190369 - RNA, 22 nt, Human
acccaggcgggagugcaguguc

SEQ ID NO: 190370 - RNA, 22 nt, Human
uccagacccaugacccugggga

SEQ ID NO: 190371 - RNA, 22 nt, Human
uuaaagcugagcccucagaagc

SEQ ID NO: 190372 - RNA, 22 nt, Human
ugagcagauggaggcuucugca

SEQ ID NO: 190373 - RNA, 22 nt, Human
uggcucccaaggagcuccugcc

SEQ ID NO: 190374 - RNA, 22 nt, Human
cauuuacacuucuaaccacaag

SEQ ID NO: 190375 - RNA, 22 nt, Human
ugagauucccugaaugauauau

SEQ ID NO: 190376 - RNA, 22 nt, Human
cucucuggacuugaguaucagc

SEQ ID NO: 190377 - RNA, 22 nt, Human
aagcuguagcuuuucaaaacgu

SEQ ID NO: 190378 - RNA, 17 nt, Human
uuuuggugaguuguuuc

SEQ ID NO: 190379 - RNA, 22 nt, Human
ucagaggaugcuguucuuuaau

SEQ ID NO: 190380 - RNA, 22 nt, Human
acuucagaaaauguugaauguu

SEQ ID NO: 190381 - RNA, 22 nt, Human
gggcacagcugcuacccagugc

SEQ ID NO: 190382 - RNA, 22 nt, Human
gagccgugccagcccugucucg

SEQ ID NO: 190383 - RNA, 22 nt, Human
ugcagugggccggaggccaggg

SEQ ID NO: 190384 - RNA, 22 nt, Human
cccagagggcugaggauaugaa

SEQ ID NO: 190385 - RNA, 21 nt, Human
gggcgaggccugauguggcuc

SEQ ID NO: 190386 - RNA, 22 nt, Human
ugccacauggugcauuuccuag

SEQ ID NO: 190387 - RNA, 22 nt, Human
gggcuucuagaauuucugauau

SEQ ID NO: 190388 - RNA, 22 nt, Human
aauguacaccguggguuuuuua

SEQ ID NO: 190389 - RNA, 22 nt, Human
uggaggcugguuucugcugagg

SEQ ID NO: 190390 - RNA, 22 nt, Human
cugggccuuagggcacucccuu

SEQ ID NO: 190391 - RNA, 22 nt, Human
aaaggcuaugauaguccagugg

SEQ ID NO: 190392 - RNA, 22 nt, Human
aagggaggggauguaagccugg

SEQ ID NO: 190393 - RNA, 22 nt, Human
agagaagcagggagucaucugu

SEQ ID NO: 190394 - RNA, 22 nt, Human
aaaggcuuguuugaggacuggu

SEQ ID NO: 190395 - RNA, 22 nt, Human
ccuggaggagcgcugaccagcu

SEQ ID NO: 190396 - RNA, 22 nt, Human
aggaagcccuugucauuucugu

SEQ ID NO: 190397 - RNA, 22 nt, Human
ggagccagagggaugcaguuga

SEQ ID NO: 190398 - RNA, 22 nt, Human
cccagaggcugaguugggagca

SEQ ID NO: 190399 - RNA, 22 nt, Human
ggacaggugacugcccagagug

SEQ ID NO: 190400 - RNA, 22 nt, Human
aggacagagcccuaguuucaua

SEQ ID NO: 190401 - RNA, 22 nt, Human
acugccuugaaagauuguugag

SEQ ID NO: 190402 - RNA, 22 nt, Human
uucacaucuauaacuuagauaa

SEQ ID NO: 190403 - RNA, 22 nt, Human
uugggggcagagggagcaucug

SEQ ID NO: 190404 - RNA, 22 nt, Human
uaguaacucuacacacgacacu

SEQ ID NO: 190405 - RNA, 22 nt, Human
ucuagaacuccaguuaggcaau

SEQ ID NO: 190406 - RNA, 22 nt, Human
ucuccccuagugcauuaaagug

SEQ ID NO: 190407 - RNA, 21 nt, Human
uuuaugcagauaaugcuauuu

SEQ ID NO: 190408 - RNA, 22 nt, Human
agaagccuguugagagggccgu

SEQ ID NO: 190409 - RNA, 22 nt, Human
cuggaucuguuugugcuugugg

SEQ ID NO: 190410 - RNA, 22 nt, Human
auuuccuaauuuaugcaggagu

SEQ ID NO: 190411 - RNA, 22 nt, Human
agaccuggaaguucaagagaaa

SEQ ID NO: 190412 - RNA, 22 nt, Human
agauguaaacucucaugucauu

SEQ ID NO: 190413 - RNA, 22 nt, Human
cuuaggaauauccacagcaggu

SEQ ID NO: 190414 - RNA, 22 nt, Human
auaaaaguucaagagaguacag

SEQ ID NO: 190415 - RNA, 22 nt, Human
aguguuacugguucaugaaucu

SEQ ID NO: 190416 - RNA, 22 nt, Human
uauaaucugguuuuauuaagag

SEQ ID NO: 190417 - RNA, 22 nt, Human
cagugauuaaaacaugacagcc

SEQ ID NO: 190418 - RNA, 19 nt, Human
aggcuuggauuguggccaa

SEQ ID NO: 190419 - RNA, 22 nt, Human
gcucagagaaucagcagacacc

SEQ ID NO: 190420 - RNA, 21 nt, Human
ucagggcagugggagguuccu

SEQ ID NO: 190421 - RNA, 22 nt, Human
guguguggaaugcucauuuauu

SEQ ID NO: 190422 - RNA, 22 nt, Human
uguuuauucauggcuaaugaaa

SEQ ID NO: 190423 - RNA, 22 nt, Human
uggggcaguuaauaaacauucu

SEQ ID NO: 190424 - RNA, 22 nt, Human
ugccugggaaccaauccuggcu

SEQ ID NO: 190425 - RNA, 22 nt, Human
gggugagagucaggcagagauu

SEQ ID NO: 190426 - RNA, 22 nt, Human
ccugggaggcagagguugcagu

SEQ ID NO: 190427 - RNA, 22 nt, Human
uacaggguauagguacagauga

SEQ ID NO: 190428 - RNA, 22 nt, Human
gagggaugugccugaaggcagg

SEQ ID NO: 190429 - RNA, 20 nt, Human
ugucuccagggcugagugga

SEQ ID NO: 190430 - RNA, 22 nt, Human
ucacaggacagccuuccacccg

SEQ ID NO: 190431 - RNA, 22 nt, Human
uugugcucuuauugugcaggga

SEQ ID NO: 190432 - RNA, 22 nt, Human
cagaaggcuggcagauugagau

SEQ ID NO: 190433 - RNA, 22 nt, Human
agcagggguggaagguagcuuu

SEQ ID NO: 190434 - RNA, 22 nt, Human
uggcucugucgccguuuggaau

SEQ ID NO: 190435 - RNA, 22 nt, Human
uugcugaugguauuaugcuagu

SEQ ID NO: 190436 - RNA, 22 nt, Human
ucucuguagagacagcacugug

SEQ ID NO: 190437 - RNA, 22 nt, Human
uuacuucuuuggccuucagcca

SEQ ID NO: 190438 - RNA, 22 nt, Human
ucuggcagggucagggcccagg

SEQ ID NO: 190439 - RNA, 22 nt, Human
uguaauuaaacugaagacagaa

SEQ ID NO: 190440 - RNA, 22 nt, Human
aauaauuuuagcucagaguugu

SEQ ID NO: 190441 - RNA, 22 nt, Human
ucauucauaaaaauuaguuggc

SEQ ID NO: 190442 - RNA, 22 nt, Human
auuuuccaaaauaauuguuacu

SEQ ID NO: 190443 - RNA, 22 nt, Human
gcucugggugaauggcagauug

SEQ ID NO: 190444 - RNA, 20 nt, Human
ugccccaggccugcaccugc

SEQ ID NO: 190445 - RNA, 22 nt, Human
ucaggcugcuguacugugaaug

SEQ ID NO: 190446 - RNA, 22 nt, Human
augucacuguuuaccagcucca

SEQ ID NO: 190447 - RNA, 22 nt, Human
caaggcuuagucagagggugcu

SEQ ID NO: 190448 - RNA, 22 nt, Human
aucuguucuugugucaguaauu

SEQ ID NO: 190449 - RNA, 21 nt, Human
ucucuucccaucaggacacua

SEQ ID NO: 190450 - RNA, 22 nt, Human
gcagagcugguacuugagccug

SEQ ID NO: 190451 - RNA, 22 nt, Human
gccagauguagauagcaaggua

SEQ ID NO: 190452 - RNA, 22 nt, Human
caggaguggugugagggacucc

SEQ ID NO: 190453 - RNA, 22 nt, Human
cagcaagacaaggaacaaacug

SEQ ID NO: 190454 - RNA, 22 nt, Human
ucuuuagaguuaacaauaauga

SEQ ID NO: 190455 - RNA, 22 nt, Human
ccccugccagcuaucccugaac

SEQ ID NO: 190456 - RNA, 18 nt, Human
cuuagaacaucauuccuu

SEQ ID NO: 190457 - RNA, 21 nt, Human
cggaaacucggcucugguucc

SEQ ID NO: 190458 - RNA, 22 nt, Human
caggaggaaacuggauucacuu

SEQ ID NO: 190459 - RNA, 19 nt, Human
ugcucaggccaaggagccc

SEQ ID NO: 190460 - RNA, 22 nt, Human
auugcuuuuccuuaacacaugc

SEQ ID NO: 190461 - RNA, 22 nt, Human
ugugcugguacaugugaggaug

SEQ ID NO: 190462 - RNA, 22 nt, Human
guuucauucggcagcucauaag

SEQ ID NO: 190463 - RNA, 22 nt, Human
auugcugacucaauaauugaag

SEQ ID NO: 190464 - RNA, 18 nt, Human
guggccagccuggucuug

SEQ ID NO: 190465 - RNA, 22 nt, Human
gacacaggaaucaccuuggaug

SEQ ID NO: 190466 - RNA, 22 nt, Human
caucuuugccauaugauguaau

SEQ ID NO: 190467 - RNA, 22 nt, Human
aagaggaggacgguucccagaa

SEQ ID NO: 190468 - RNA, 22 nt, Human
cugaauuaauacacagaauggc

SEQ ID NO: 190469 - RNA, 22 nt, Human
guuuccuaggcuuauacagcug

SEQ ID NO: 190470 - RNA, 22 nt, Human
augggaagugaagucagggagg

SEQ ID NO: 190471 - RNA, 22 nt, Human
auuacugaggcaaaguaguuuu

SEQ ID NO: 190472 - RNA, 22 nt, Human
aaggcaguacuuuauguccaua

SEQ ID NO: 190473 - RNA, 23 nt, Human
uggucucacuugguaagaugaag

SEQ ID NO: 190474 - RNA, 23 nt, Human
ucuggaaugguacucacuggagu

SEQ ID NO: 190475 - RNA, 22 nt, Human
auaugcuuugggauuagaucau

SEQ ID NO: 190476 - RNA, 22 nt, Human
ggaaagcucagaucuuguugga

SEQ ID NO: 190477 - RNA, 22 nt, Human
uagaacacuugaccacugcucc

SEQ ID NO: 190478 - RNA, 22 nt, Human
uggccucugggaaagcagauuc

SEQ ID NO: 190479 - RNA, 22 nt, Human
ucaggaggcggugcugccuuug

SEQ ID NO: 190480 - RNA, 22 nt, Human
cagauuuaccuaacuccaaguu

SEQ ID NO: 190481 - RNA, 22 nt, Human
uacaaagagguaauugcauaua

SEQ ID NO: 190482 - RNA, 22 nt, Human
cugcacagucauuuccucucaa

SEQ ID NO: 190483 - RNA, 22 nt, Human
gagguccauacagcuauucuac

SEQ ID NO: 190484 - RNA, 22 nt, Human
guaggagcucauggggccagga

SEQ ID NO: 190485 - RNA, 22 nt, Human
gagugucagugccuggcuuguu

SEQ ID NO: 190486 - RNA, 22 nt, Human
uguacuauuaagaggccuaaau

SEQ ID NO: 190487 - RNA, 22 nt, Human
ucuggaggcaacuaaccuaguu

SEQ ID NO: 190488 - RNA, 22 nt, Human
uggcccuuguucaaauauguca

SEQ ID NO: 190489 - RNA, 22 nt, Human
ucaucuuuaccccuugcuucaa

SEQ ID NO: 190490 - RNA, 22 nt, Human
uacacaugacaguggacugaga

SEQ ID NO: 190491 - RNA, 22 nt, Human
gcaugaugaaggaggaggaguc

SEQ ID NO: 190492 - RNA, 22 nt, Human
uugggcagguguggcucuccuu

SEQ ID NO: 190493 - RNA, 18 nt, Human
uaagcaaugacauugcaa

SEQ ID NO: 190494 - RNA, 22 nt, Human
aacuaaaagugugucucuugua

SEQ ID NO: 190495 - RNA, 22 nt, Human
uguggcugccacccugaagccg

SEQ ID NO: 190496 - RNA, 18 nt, Human
caucuacaaaugccagaa

SEQ ID NO: 190497 - RNA, 22 nt, Human
aaauacauuagacggagaguua

SEQ ID NO: 190498 - RNA, 22 nt, Human
ugaguugcuaucuagauccaga

SEQ ID NO: 190499 - RNA, 23 nt, Human
ccccucugguggcucagcuccug

SEQ ID NO: 190500 - RNA, 22 nt, Human
ugacucuuggugauuacugggu

SEQ ID NO: 190501 - RNA, 20 nt, Human
ucuguaauuaugccaucacu

SEQ ID NO: 190502 - RNA, 22 nt, Human
ucccugcccugccuucaugguu

SEQ ID NO: 190503 - RNA, 22 nt, Human
uggcagagaacacggcugaucu

SEQ ID NO: 190504 - RNA, 22 nt, Human
ugcaggagacauaauagggacu

SEQ ID NO: 190505 - RNA, 18 nt, Human
acuggagcauuagcagcu

SEQ ID NO: 190506 - RNA, 22 nt, Human
gcugagagcaaagcaugucuag

SEQ ID NO: 190507 - RNA, 22 nt, Human
cacuguggcaaccugugcccaa

SEQ ID NO: 190508 - RNA, 22 nt, Human
acauguguauagccuguauaga

SEQ ID NO: 190509 - RNA, 22 nt, Human
ccagucuguucucaccucugag

SEQ ID NO: 190510 - RNA, 22 nt, Human
uaggcugagguugaugccaggg

SEQ ID NO: 190511 - RNA, 22 nt, Human
aaagaguugaggcaguuaucca

SEQ ID NO: 190512 - RNA, 22 nt, Human
uucugggcaccaccacagacuu

SEQ ID NO: 190513 - RNA, 22 nt, Human
aguggggaagagcaugggcccu

SEQ ID NO: 190514 - RNA, 22 nt, Human
cuaaauuaucaugagaauuaug

SEQ ID NO: 190515 - RNA, 22 nt, Human
aguguccuagcaagccgguccu

SEQ ID NO: 190516 - RNA, 22 nt, Human
aggaccugacuggcuccugcuu

SEQ ID NO: 190517 - RNA, 22 nt, Human
uaacaagguggucuugguauuu

SEQ ID NO: 190518 - RNA, 22 nt, Human
gggaguggguuuggccuaggcc

SEQ ID NO: 190519 - RNA, 22 nt, Human
cuugggucacaacucugaggug

SEQ ID NO: 190520 - RNA, 22 nt, Human
aauuucaaguggcaucuuugau

SEQ ID NO: 190521 - RNA, 22 nt, Human
cggcuucuuuuaagguugcuga

SEQ ID NO: 190522 - RNA, 22 nt, Human
uauggcuucugcuuucuugacu

SEQ ID NO: 190523 - RNA, 22 nt, Human
cacaugacacuauuuuguucua

SEQ ID NO: 190524 - RNA, 22 nt, Human
cccugaggagagcgcuucccga

SEQ ID NO: 190525 - RNA, 22 nt, Human
uccugccuuagagcaaggaaaa

SEQ ID NO: 190526 - RNA, 22 nt, Human
ggggcagauggaacagagcaca

SEQ ID NO: 190527 - RNA, 22 nt, Human
gacaucauguucugcuaauagu

SEQ ID NO: 190528 - RNA, 20 nt, Human
uccugcaguuccuaggaggg

SEQ ID NO: 190529 - RNA, 22 nt, Human
ucuccagggacugaggcuggag

SEQ ID NO: 190530 - RNA, 16 nt, Human
agugggaggagaaaga

SEQ ID NO: 190531 - RNA, 22 nt, Human
cugaggcagagggcagaccaga

SEQ ID NO: 190532 - RNA, 22 nt, Human
agaggagcugggaggcccucgu

SEQ ID NO: 190533 - RNA, 22 nt, Human
ucccagaguucaaugggaaggu

SEQ ID NO: 190534 - RNA, 22 nt, Human
acaauuacucaacuuugcugcu

SEQ ID NO: 190535 - RNA, 22 nt, Human
aaacauuagacaccauaugcuc

SEQ ID NO: 190536 - RNA, 22 nt, Human
gauugcuggggcaggcuguagc

SEQ ID NO: 190537 - RNA, 17 nt, Human
agauggcaggaggcaga

SEQ ID NO: 190538 - RNA, 22 nt, Human
uccugugucucagcgugaagca

SEQ ID NO: 190539 - RNA, 22 nt, Human
aaaggauucucuugauuucagu

SEQ ID NO: 190540 - RNA, 22 nt, Human
aaaugcucuccaaaaugaaagu

SEQ ID NO: 190541 - RNA, 22 nt, Human
aagggccauaacuugcaguguu

SEQ ID NO: 190542 - RNA, 22 nt, Human
cucuuaaagaauguuccagcug

SEQ ID NO: 190543 - RNA, 19 nt, Human
uuugaaaggauuguuauuu

SEQ ID NO: 190544 - RNA, 22 nt, Human
uucugugaaucuuuuuucccac

SEQ ID NO: 190545 - RNA, 22 nt, Human
caaagugccuguaccacuuugc

SEQ ID NO: 190546 - RNA, 22 nt, Human
aaaccacaguucagugcuuuug

SEQ ID NO: 190547 - RNA, 22 nt, Human
ggagcugggaauuggaucaucu

SEQ ID NO: 190548 - RNA, 23 nt, Human
uauuagggccaggacuggcaaau

SEQ ID NO: 190549 - RNA, 22 nt, Human
ucuggcagaaggcagaaauuca

SEQ ID NO: 190550 - RNA, 22 nt, Human
uucacaauuucccuucaucagg

SEQ ID NO: 190551 - RNA, 22 nt, Human
gcagggcaggauuugaacccag

SEQ ID NO: 190552 - RNA, 22 nt, Human
ccauucugugucucuccacagc

SEQ ID NO: 190553 - RNA, 22 nt, Human
cugagcagcaccuucaagaaac

SEQ ID NO: 190554 - RNA, 22 nt, Human
uuguagcuuaucaaggcuguuu

SEQ ID NO: 190555 - RNA, 22 nt, Human
gacaggcuucaugauggcagga

SEQ ID NO: 190556 - RNA, 22 nt, Human
uuguauauauucuuaaagaugu

SEQ ID NO: 190557 - RNA, 22 nt, Human
cggggcugcucguccuccugug

SEQ ID NO: 190558 - RNA, 22 nt, Human
cugugggagggaaggcgcggcc

SEQ ID NO: 190559 - RNA, 22 nt, Human
uuuguuuaucaaggucuagcau

SEQ ID NO: 190560 - RNA, 22 nt, Human
ugcacaguaaacaugacuggag

SEQ ID NO: 190561 - RNA, 22 nt, Human
agauguggccggcuagggagag

SEQ ID NO: 190562 - RNA, 22 nt, Human
uuuugcaauauguuccugaaua

SEQ ID NO: 190563 - RNA, 22 nt, Human
ggagcugaugguagaagaauga

SEQ ID NO: 190564 - RNA, 22 nt, Human
gugugggcugcagaggcacagc

SEQ ID NO: 190565 - RNA, 17 nt, Human
gccucugcuugugucau

SEQ ID NO: 190566 - RNA, 22 nt, Human
uugcuuuacuuugccauucguu

SEQ ID NO: 190567 - RNA, 23 nt, Human
uucuuuggaauugggcugcaagg

SEQ ID NO: 190568 - RNA, 22 nt, Human
uguguccugguguuaauuuuau

SEQ ID NO: 190569 - RNA, 22 nt, Human
caaaugaauuucccugcaaaug

SEQ ID NO: 190570 - RNA, 22 nt, Human
aacuguaauuuuuacauaguaa

SEQ ID NO: 190571 - RNA, 22 nt, Human
uguccucuuccagugcuccuuc

SEQ ID NO: 190572 - RNA, 22 nt, Human
ccuccuggcccugggccuggaa

SEQ ID NO: 190573 - RNA, 22 nt, Human
aggggagaguuaaugugaaugu

SEQ ID NO: 190574 - RNA, 22 nt, Human
agcugcagagguuugugcaaca

SEQ ID NO: 190575 - RNA, 22 nt, Human
uauucucagcaacacacaugga

SEQ ID NO: 190576 - RNA, 22 nt, Human
agguuccaagaaaucaucagug

SEQ ID NO: 190577 - RNA, 22 nt, Human
acuguccauucacucauauuca

SEQ ID NO: 190578 - RNA, 22 nt, Human
agggcacuuuacccauagcuug

SEQ ID NO: 190579 - RNA, 22 nt, Human
gucccagggaagaaggcagcac

SEQ ID NO: 190580 - RNA, 22 nt, Human
auggucuucucaagcaacacug

SEQ ID NO: 190581 - RNA, 22 nt, Human
ugaaauguuuggguccagaagu

SEQ ID NO: 190582 - RNA, 22 nt, Human
cugucuguuaucucaccagucc

SEQ ID NO: 190583 - RNA, 22 nt, Human
gacauuuaaggcagucacuuaa

SEQ ID NO: 190584 - RNA, 22 nt, Human
uuccaggaagacaucucaggaa

SEQ ID NO: 190585 - RNA, 22 nt, Human
ugaugaauuaguaacaaaugag

SEQ ID NO: 190586 - RNA, 22 nt, Human
ugugggaggaauuagaauggga

SEQ ID NO: 190587 - RNA, 22 nt, Human
uauagacaagcguaacaagaag

SEQ ID NO: 190588 - RNA, 22 nt, Human
ggcagcaguccauggcccaagg

SEQ ID NO: 190589 - RNA, 22 nt, Human
uuuggacaaacagaauagagcu

SEQ ID NO: 190590 - RNA, 22 nt, Human
uuucuaagugaacauucaaguu

SEQ ID NO: 190591 - RNA, 22 nt, Human
gggagcuggggcauuuauaccc

SEQ ID NO: 190592 - RNA, 22 nt, Human
cuggaagagugacuuugcauuu

SEQ ID NO: 190593 - RNA, 22 nt, Human
uccaggacuuucuuaaggcacu

SEQ ID NO: 190594 - RNA, 22 nt, Human
ggcacagaguuggcagagcugc

SEQ ID NO: 190595 - RNA, 22 nt, Human
cugcccuggccacugugcccag

SEQ ID NO: 190596 - RNA, 22 nt, Human
gaggccuggcugggaggaggug

SEQ ID NO: 190597 - RNA, 22 nt, Human
ccauccagaccaguccaugggu

SEQ ID NO: 190598 - RNA, 17 nt, Human
uuugauagaaucagagu

SEQ ID NO: 190599 - RNA, 22 nt, Human
agggauguuaguugugagcuca

SEQ ID NO: 190600 - RNA, 22 nt, Human
aucaucuuaucugacucauuuu

SEQ ID NO: 190601 - RNA, 17 nt, Human
ucuagagcacuuugaga

SEQ ID NO: 190602 - RNA, 22 nt, Human
caguugauguuuagacucugca

SEQ ID NO: 190603 - RNA, 19 nt, Human
aucagcaagguaggaugug

SEQ ID NO: 190604 - RNA, 22 nt, Human
aaauccuaccaagaaauucccu

SEQ ID NO: 190605 - RNA, 22 nt, Human
aaauuccauuaggaaacuucca

SEQ ID NO: 190606 - RNA, 22 nt, Human
augucacaugagagcgcagcac

SEQ ID NO: 190607 - RNA, 22 nt, Human
uagcacagcuucuugaugucac

SEQ ID NO: 190608 - RNA, 21 nt, Human
aggaggagagcuuggccuacc

SEQ ID NO: 190609 - RNA, 22 nt, Human
caggcucccacccuccugcagc

SEQ ID NO: 190610 - RNA, 21 nt, Human
ugaacaaaguucuuaucguga

SEQ ID NO: 190611 - RNA, 22 nt, Human
agguccaggcauuuggguuggg

SEQ ID NO: 190612 - RNA, 21 nt, Human
uuuagagaauacucacuauuu

SEQ ID NO: 190613 - RNA, 22 nt, Human
cagcaccuuccuuaacuccagg

SEQ ID NO: 190614 - RNA, 22 nt, Human
cucagagauauagucccugcuu

SEQ ID NO: 190615 - RNA, 22 nt, Human
uauagcaauucagaauacaugu

SEQ ID NO: 190616 - RNA, 22 nt, Human
uuacaguggcagaguuggguag

SEQ ID NO: 190617 - RNA, 22 nt, Human
ucucagaacacccuucuauggu

SEQ ID NO: 190618 - RNA, 22 nt, Human
ggcugcaguugugugaaggccg

SEQ ID NO: 190619 - RNA, 22 nt, Human
ucuuuucauugagaacacacug

SEQ ID NO: 190620 - RNA, 22 nt, Human
uccaggcugggcugaagggugc

SEQ ID NO: 190621 - RNA, 22 nt, Human
acuucccacugcagugacugag

SEQ ID NO: 190622 - RNA, 22 nt, Human
uggcuucuaguuugaggaaaaa

SEQ ID NO: 190623 - RNA, 22 nt, Human
uccacaggaaagcaccucccau

SEQ ID NO: 190624 - RNA, 18 nt, Human
gcauuuuaaucugaggca

SEQ ID NO: 190625 - RNA, 22 nt, Human
uccuggcauccgugggucugug

SEQ ID NO: 190626 - RNA, 22 nt, Human
aacagaggcucccugcacuugu

SEQ ID NO: 190627 - RNA, 22 nt, Human
aaacugccacaagagggacauc

SEQ ID NO: 190628 - RNA, 22 nt, Human
ccagcaucgacuuccugccuga

SEQ ID NO: 190629 - RNA, 22 nt, Human
uagaacuggaauuuugugguuu

SEQ ID NO: 190630 - RNA, 22 nt, Human
cauaucauaggucuuggauaau

SEQ ID NO: 190631 - RNA, 22 nt, Human
gaccuucuugcuguguccuaac

SEQ ID NO: 190632 - RNA, 22 nt, Human
uuaaugcuugucuagaucuucu

SEQ ID NO: 190633 - RNA, 22 nt, Human
aacaucuacagugagauguuag

SEQ ID NO: 190634 - RNA, 22 nt, Human
auagauuagcccuauaguuuua

SEQ ID NO: 190635 - RNA, 20 nt, Human
ugccaggcacggagugcaug

SEQ ID NO: 190636 - RNA, 22 nt, Human
uuggaauaaaaacaacucacag

SEQ ID NO: 190637 - RNA, 22 nt, Human
auauucuuauccuuuucucugu

SEQ ID NO: 190638 - RNA, 22 nt, Human
agugcagaguacauuuguggca

SEQ ID NO: 190639 - RNA, 22 nt, Human
auuccacacaguaauacucaau

SEQ ID NO: 190640 - RNA, 22 nt, Human
acuuuggacgccaugcuguuug

SEQ ID NO: 190641 - RNA, 22 nt, Human
ugcuuuauuuuaaauaugccau

SEQ ID NO: 190642 - RNA, 22 nt, Human
auuacugagcuuguagcugcau

SEQ ID NO: 190643 - RNA, 22 nt, Human
ggccagagucuauaugcagaca

SEQ ID NO: 190644 - RNA, 22 nt, Human
caacagagggaauggaucucau

SEQ ID NO: 190645 - RNA, 22 nt, Human
uuccuucuauucagcuccaaga

SEQ ID NO: 190646 - RNA, 22 nt, Human
uggcaguggcucagagugcaga

SEQ ID NO: 190647 - RNA, 22 nt, Human
auuagaaugcaggguucauugu

SEQ ID NO: 190648 - RNA, 22 nt, Human
ucucugaguaagugacaguuca

SEQ ID NO: 190649 - RNA, 22 nt, Human
acauuaaacuugcuuggcugua

SEQ ID NO: 190650 - RNA, 22 nt, Human
aaaagcaaguugccuagguuga

SEQ ID NO: 190651 - RNA, 22 nt, Human
acugggccaggugugggugagu

SEQ ID NO: 190652 - RNA, 23 nt, Human
agaaaagcuuggacacauggccu

SEQ ID NO: 190653 - RNA, 22 nt, Human
gccagcuguucagacauucuuu

SEQ ID NO: 190654 - RNA, 22 nt, Human
cacaagucauuuucagcaggcu

SEQ ID NO: 190655 - RNA, 22 nt, Human
cccaggcucacuguccgcuucc

SEQ ID NO: 190656 - RNA, 22 nt, Human
gagugugggucucagcuuuaag

SEQ ID NO: 190657 - RNA, 22 nt, Human
uauauguagucagucagaguaa

SEQ ID NO: 190658 - RNA, 22 nt, Human
uacauguuauuucacuauuggu

SEQ ID NO: 190659 - RNA, 22 nt, Human
ggcuguggucauuaggagguug

SEQ ID NO: 190660 - RNA, 20 nt, Human
uuuauugagcacguacugug

SEQ ID NO: 190661 - RNA, 22 nt, Human
aucuuauuuaacacagcaaaac

SEQ ID NO: 190662 - RNA, 22 nt, Human
uucugaauggcaagcauuaggc

SEQ ID NO: 190663 - RNA, 22 nt, Human
aggauucagaauguaugcagug

SEQ ID NO: 190664 - RNA, 22 nt, Human
ggugggacagguaggaguggcu

SEQ ID NO: 190665 - RNA, 22 nt, Human
ucuggagggggaugccucaucc

SEQ ID NO: 190666 - RNA, 21 nt, Human
ugcacaaacuuucuguggcuu

SEQ ID NO: 190667 - RNA, 22 nt, Human
caagauuaucuucuucuuguua

SEQ ID NO: 190668 - RNA, 22 nt, Human
guacagugugacuuuggaguga

SEQ ID NO: 190669 - RNA, 22 nt, Human
aggcugcuggcaggcguggacg

SEQ ID NO: 190670 - RNA, 22 nt, Human
agaccugggugcccugugcuuu

SEQ ID NO: 190671 - RNA, 22 nt, Human
acuacauuucucaguaccugaa

SEQ ID NO: 190672 - RNA, 22 nt, Human
gccaggcuguuuuuauuacugu

SEQ ID NO: 190673 - RNA, 22 nt, Human
acuguacaugcaucuugucuau

SEQ ID NO: 190674 - RNA, 22 nt, Human
auauacagggagaaacagcuua

SEQ ID NO: 190675 - RNA, 19 nt, Human
gagaaaccccgucuuuagg

SEQ ID NO: 190676 - RNA, 22 nt, Human
uggagcaggugggaugucguga

SEQ ID NO: 190677 - RNA, 22 nt, Human
cagaaagaccugggcucaagag

SEQ ID NO: 190678 - RNA, 22 nt, Human
uucugcuccaccacuuccagca

SEQ ID NO: 190679 - RNA, 22 nt, Human
aagugguuugagcacagugcug

SEQ ID NO: 190680 - RNA, 22 nt, Human
gaaauacagaaagggcugaaug

SEQ ID NO: 190681 - RNA, 22 nt, Human
caacugccauacagcuccaugg

SEQ ID NO: 190682 - RNA, 22 nt, Human
agggucagguuaagggagucau

SEQ ID NO: 190683 - RNA, 22 nt, Human
caggacaagagggaaucgauaa

SEQ ID NO: 190684 - RNA, 22 nt, Human
uagaagauucuaaaguggagag

SEQ ID NO: 190685 - RNA, 22 nt, Human
cuugcuggaaacucucucugcc

SEQ ID NO: 190686 - RNA, 22 nt, Human
gguaauaaaauugugucaaaca

SEQ ID NO: 190687 - RNA, 18 nt, Human
gaggauggaaggagaugc

SEQ ID NO: 190688 - RNA, 22 nt, Human
ugaaugauuugggugcauucag

SEQ ID NO: 190689 - RNA, 22 nt, Human
gcccucucuucugcagccucca

SEQ ID NO: 190690 - RNA, 22 nt, Human
ucucuguaucccagaaccaaaa

SEQ ID NO: 190691 - RNA, 22 nt, Human
acacagcuuuguguugcuccac

SEQ ID NO: 190692 - RNA, 20 nt, Human
ucugagaccuuuccacaccc

SEQ ID NO: 190693 - RNA, 22 nt, Human
uauauguaagcuauguaagagu

SEQ ID NO: 190694 - RNA, 22 nt, Human
augcaaauaaagcaacuauaca

SEQ ID NO: 190695 - RNA, 22 nt, Human
ggcucaggacugcagcguagag

SEQ ID NO: 190696 - RNA, 22 nt, Human
aagcaucuauauuccacuguga

SEQ ID NO: 190697 - RNA, 22 nt, Human
agcaggaacgaguucaugggga

SEQ ID NO: 190698 - RNA, 22 nt, Human
gcucagaggaggccuuuaccua

SEQ ID NO: 190699 - RNA, 22 nt, Human
ugugaaggcagagccagugaaa

SEQ ID NO: 190700 - RNA, 22 nt, Human
auaauauuuggauaggacagua

SEQ ID NO: 190701 - RNA, 22 nt, Human
gaggcucagagacuuuaaguuu

SEQ ID NO: 190702 - RNA, 22 nt, Human
gaauaacagcaaguuugcaggc

SEQ ID NO: 190703 - RNA, 22 nt, Human
auuaagggccaauccuccagcc

SEQ ID NO: 190704 - RNA, 22 nt, Human
gagugcugcuugggauagugag

SEQ ID NO: 190705 - RNA, 22 nt, Human
aacaagcagaugcaaugcacuu

SEQ ID NO: 190706 - RNA, 22 nt, Human
ucuucuggaucgaucacauugu

SEQ ID NO: 190707 - RNA, 22 nt, Human
agugaaaugacugaaucagaua

SEQ ID NO: 190708 - RNA, 23 nt, Human
cuguggcccugcuucaugcagcc

SEQ ID NO: 190709 - RNA, 22 nt, Human
cagguugggcugcgaggaggag

SEQ ID NO: 190710 - RNA, 22 nt, Human
uuuagaauguuagcguuaaagg

SEQ ID NO: 190711 - RNA, 22 nt, Human
acuggacagaggaaauauggag

SEQ ID NO: 190712 - RNA, 19 nt, Human
uagauacugaugaacucca

SEQ ID NO: 190713 - RNA, 22 nt, Human
guaacauaguuugugcuucauc

SEQ ID NO: 190714 - RNA, 21 nt, Human
ugcaggaaagugcugcgaccc

SEQ ID NO: 190715 - RNA, 22 nt, Human
cagcuuuuggcaggaugaccag

SEQ ID NO: 190716 - RNA, 22 nt, Human
aaauguacgggaguagaauuag

SEQ ID NO: 190717 - RNA, 22 nt, Human
guccuggcuagucguccgcgac

SEQ ID NO: 190718 - RNA, 22 nt, Human
aagaugugaacagaaccacagg

SEQ ID NO: 190719 - RNA, 20 nt, Human
aggauggcaagcaagugcau

SEQ ID NO: 190720 - RNA, 22 nt, Human
acacuguaaauugagugcguga

SEQ ID NO: 190721 - RNA, 19 nt, Human
uucuuuccacaucuucucu

SEQ ID NO: 190722 - RNA, 18 nt, Human
gcagcuuuugauucaccc

SEQ ID NO: 190723 - RNA, 22 nt, Human
agcuugauuucucugcagugug

SEQ ID NO: 190724 - RNA, 22 nt, Human
ucugagagcaucacugggguac

SEQ ID NO: 190725 - RNA, 22 nt, Human
ccagcuguuucugaugcuaggc

SEQ ID NO: 190726 - RNA, 22 nt, Human
auauuuuggggugaugugcauc

SEQ ID NO: 190727 - RNA, 22 nt, Human
cagaguccugcaccagcuccag

SEQ ID NO: 190728 - RNA, 22 nt, Human
caggcucccugggcaguggcag

SEQ ID NO: 190729 - RNA, 22 nt, Human
ucaaacugaauuaaacacuugu

SEQ ID NO: 190730 - RNA, 22 nt, Human
ucugcccacugcucugcugccc

SEQ ID NO: 190731 - RNA, 22 nt, Human
ucacauuuuaucuauuuuaagu

SEQ ID NO: 190732 - RNA, 22 nt, Human
gccuggcaauggccucaggaag

SEQ ID NO: 190733 - RNA, 22 nt, Human
cuguacagaccuauuagcccag

SEQ ID NO: 190734 - RNA, 22 nt, Human
aacugcaaaauaaucaaguugu

SEQ ID NO: 190735 - RNA, 22 nt, Human
cauggcccucuucuggagcaau

SEQ ID NO: 190736 - RNA, 22 nt, Human
uccuagaagauggaucagagaa

SEQ ID NO: 190737 - RNA, 22 nt, Human
cauagaaacuugcagcaagcac

SEQ ID NO: 190738 - RNA, 22 nt, Human
cauuuucaugaguuucuguuca

SEQ ID NO: 190739 - RNA, 19 nt, Human
cacuuuauuucuguuuugu

SEQ ID NO: 190740 - RNA, 22 nt, Human
aauagcuuucucaugacuucac

SEQ ID NO: 190741 - RNA, 22 nt, Human
uuuacauggaauauugucuugu

SEQ ID NO: 190742 - RNA, 19 nt, Human
cugggagguguucagagaa

SEQ ID NO: 190743 - RNA, 22 nt, Human
cacaugacucuggcuacccaga

SEQ ID NO: 190744 - RNA, 22 nt, Human
uugcuggggugugaaaucugau

SEQ ID NO: 190745 - RNA, 22 nt, Human
gcaguaagauguuucccagagc

SEQ ID NO: 190746 - RNA, 22 nt, Human
aagaaagauaagguuugcuugg

SEQ ID NO: 190747 - RNA, 22 nt, Human
ccuuccagugacuaaggaggaa

SEQ ID NO: 190748 - RNA, 22 nt, Human
uggcagcuugaaugcagucuuu

SEQ ID NO: 190749 - RNA, 22 nt, Human
ugcauuaugcuugugcuguaua

SEQ ID NO: 190750 - RNA, 22 nt, Human
gagucuggaaacuuugacaaaa

SEQ ID NO: 190751 - RNA, 20 nt, Human
uggcaucucucaauuguagg

SEQ ID NO: 190752 - RNA, 22 nt, Human
ucugcugucuaugcaaguccuu

SEQ ID NO: 190753 - RNA, 22 nt, Human
ugcaggagcugugcggugaggg

SEQ ID NO: 190754 - RNA, 18 nt, Human
ucucaaucgcugcagucu

SEQ ID NO: 190755 - RNA, 22 nt, Human
agggcaguucaacuucauagug

SEQ ID NO: 190756 - RNA, 21 nt, Human
aaugcauuaacauaaagcuga

SEQ ID NO: 190757 - RNA, 22 nt, Human
ucaccugggagggcugugguag

SEQ ID NO: 190758 - RNA, 22 nt, Human
ucagucuuucccucccucaguu

SEQ ID NO: 190759 - RNA, 22 nt, Human
acuuugcagggcuugauaucca

SEQ ID NO: 190760 - RNA, 22 nt, Human
guggaggguuugcaaugugcag

SEQ ID NO: 190761 - RNA, 22 nt, Human
ugcuguuauacuuagcugguua

SEQ ID NO: 190762 - RNA, 22 nt, Human
aaauaagcacuuaacuguauca

SEQ ID NO: 190763 - RNA, 22 nt, Human
gaagcagagccuaaggcagaca

SEQ ID NO: 190764 - RNA, 19 nt, Human
cuggccuguguccugugcu

SEQ ID NO: 190765 - RNA, 22 nt, Human
cuguucacacacuuguacucuc

SEQ ID NO: 190766 - RNA, 22 nt, Human
aagaguuucugggucaaggauu

SEQ ID NO: 190767 - RNA, 22 nt, Human
uggcuucuuuccacuguccugu

SEQ ID NO: 190768 - RNA, 22 nt, Human
caccuguuagcucuaauuuucu

SEQ ID NO: 190769 - RNA, 22 nt, Human
ccagcuccgggaguugcugcug

SEQ ID NO: 190770 - RNA, 22 nt, Human
gguggcugguuuuauaagaggu

SEQ ID NO: 190771 - RNA, 22 nt, Human
cuaguucuagaucccugaggaa

SEQ ID NO: 190772 - RNA, 22 nt, Human
ggguggcacugauaaugagacg

SEQ ID NO: 190773 - RNA, 23 nt, Human
ccugggcauuggcugcagcuucu

SEQ ID NO: 190774 - RNA, 22 nt, Human
gaccccaggcagaucagggggu

SEQ ID NO: 190775 - RNA, 22 nt, Human
cucugcaaggcccuccaguagc

SEQ ID NO: 190776 - RNA, 22 nt, Human
uuacagugugcaaucccagaau

SEQ ID NO: 190777 - RNA, 22 nt, Human
uuucuacagaagauacacugcu

SEQ ID NO: 190778 - RNA, 22 nt, Human
cuugagcuaggaaggcugaggc

SEQ ID NO: 190779 - RNA, 22 nt, Human
acagauuuguucuuuugggcua

SEQ ID NO: 190780 - RNA, 21 nt, Human
uggaaggcugcucugccaggg

SEQ ID NO: 190781 - RNA, 22 nt, Human
ugagaggcagaauggugccugc

SEQ ID NO: 190782 - RNA, 21 nt, Human
cugcaggaugcugaagccagg

SEQ ID NO: 190783 - RNA, 22 nt, Human
gcaggcuucccccacaccuacg

SEQ ID NO: 190784 - RNA, 22 nt, Human
acagccaacgucuuucuuacuu

SEQ ID NO: 190785 - RNA, 22 nt, Human
cacaguuugcauaggaaaaaca

SEQ ID NO: 190786 - RNA, 22 nt, Human
aucuuugaagaggacuugaagu

SEQ ID NO: 190787 - RNA, 17 nt, Human
uggcuucccugggccac

SEQ ID NO: 190788 - RNA, 20 nt, Human
gacacaggcaguccucagag

SEQ ID NO: 190789 - RNA, 22 nt, Human
auguguccauuaucaguucugg

SEQ ID NO: 190790 - RNA, 22 nt, Human
gagcuuggacaagcucugaagg

SEQ ID NO: 190791 - RNA, 22 nt, Human
accuagaaugaagcaaugcugu

SEQ ID NO: 190792 - RNA, 22 nt, Human
agaaucugaaggcaccucuggu

SEQ ID NO: 190793 - RNA, 22 nt, Human
aaaacaguuuaggcaucacagu

SEQ ID NO: 190794 - RNA, 22 nt, Human
auguccuguuuuggcuugcucu

SEQ ID NO: 190795 - RNA, 22 nt, Human
cagcaggcucugaguggcugcc

SEQ ID NO: 190796 - RNA, 22 nt, Human
aaaugacacucauucaguguca

SEQ ID NO: 190797 - RNA, 22 nt, Human
gaaacauauuaauccagugaaa

SEQ ID NO: 190798 - RNA, 22 nt, Human
gaguuagaagacagaauguaaa

SEQ ID NO: 190799 - RNA, 22 nt, Human
uccaugcagaguccaggccuca

SEQ ID NO: 190800 - RNA, 22 nt, Human
ggcucugcuucagaaggcucau

SEQ ID NO: 190801 - RNA, 21 nt, Human
gggugggguuccagccuuuuc

SEQ ID NO: 190802 - RNA, 22 nt, Human
ucuuuauacaaacugggaaaca

SEQ ID NO: 190803 - RNA, 22 nt, Human
cuguuuauagcagagcaagccu

SEQ ID NO: 190804 - RNA, 22 nt, Human
aguccuuugggaaaaaugacua

SEQ ID NO: 190805 - RNA, 21 nt, Human
aagugguuuagguuaccgggg

SEQ ID NO: 190806 - RNA, 22 nt, Human
ggucacugcccucccuuuugca

SEQ ID NO: 190807 - RNA, 22 nt, Human
gaggaggcuuccgggaggcacg

SEQ ID NO: 190808 - RNA, 22 nt, Human
aauaauuuugagagccuggaaa

SEQ ID NO: 190809 - RNA, 22 nt, Human
gaugaaaaucuugagaugucga

SEQ ID NO: 190810 - RNA, 22 nt, Human
auuugcauuuagaaagaucacu

SEQ ID NO: 190811 - RNA, 22 nt, Human
gaaggacccacgaagucacugg

SEQ ID NO: 190812 - RNA, 22 nt, Human
gcugggcuucaccuccagaguu

SEQ ID NO: 190813 - RNA, 22 nt, Human
ucaggaagaaagaagggagugu

SEQ ID NO: 190814 - RNA, 22 nt, Human
uggcagcagacaucugaggucu

SEQ ID NO: 190815 - RNA, 22 nt, Human
agcuggaugaauuuggaacacu

SEQ ID NO: 190816 - RNA, 22 nt, Human
cacccaggcuggagugcauugg

SEQ ID NO: 190817 - RNA, 22 nt, Human
ggaccaggacuggugguaucuc

SEQ ID NO: 190818 - RNA, 22 nt, Human
auacaguaauuuguaacucauc

SEQ ID NO: 190819 - RNA, 22 nt, Human
uucagcacuguuauggauuugc

SEQ ID NO: 190820 - RNA, 17 nt, Human
gcagaaaagucaaggga

SEQ ID NO: 190821 - RNA, 22 nt, Human
uagguuuacugaauuaguggaa

SEQ ID NO: 190822 - RNA, 22 nt, Human
cccagccuuugcuuccugguuc

SEQ ID NO: 190823 - RNA, 22 nt, Human
agcaucugcuuaauggcuuaac

SEQ ID NO: 190824 - RNA, 20 nt, Human
uggaguuguucugcuagguc

SEQ ID NO: 190825 - RNA, 22 nt, Human
aggccaaguagcuagcauugaa

SEQ ID NO: 190826 - RNA, 22 nt, Human
aauuggcuuugagaaguuugag

SEQ ID NO: 190827 - RNA, 22 nt, Human
ugcucugggauucagcagccug

SEQ ID NO: 190828 - RNA, 22 nt, Human
ccaggcaggcgauggugcagug

SEQ ID NO: 190829 - RNA, 22 nt, Human
ucuagaaucacuguuuccaucu

SEQ ID NO: 190830 - RNA, 22 nt, Human
gcccugcugaguccggcucaga

SEQ ID NO: 190831 - RNA, 22 nt, Human
gggcaguggguggcugcagccu

SEQ ID NO: 190832 - RNA, 22 nt, Human
acacaguugauugucacucagg

SEQ ID NO: 190833 - RNA, 22 nt, Human
acaacugucaguaaagaauauu

SEQ ID NO: 190834 - RNA, 22 nt, Human
ucagagacaguucuggggcagg

SEQ ID NO: 190835 - RNA, 22 nt, Human
aggcucaggucucaggucuggc

SEQ ID NO: 190836 - RNA, 22 nt, Human
ugguccagaagauauucaacca

SEQ ID NO: 190837 - RNA, 22 nt, Human
aaaaguuuaagacucauucuag

SEQ ID NO: 190838 - RNA, 22 nt, Human
acuuugaaaagacaguagcucu

SEQ ID NO: 190839 - RNA, 22 nt, Human
gccaggcuggugcaaggauauu

SEQ ID NO: 190840 - RNA, 22 nt, Human
ucagagacaccagagagcugug

SEQ ID NO: 190841 - RNA, 22 nt, Human
uaaggcuaucuuuugagugugu

SEQ ID NO: 190842 - RNA, 22 nt, Human
aggggcucugagugggccagga

SEQ ID NO: 190843 - RNA, 22 nt, Human
uagggaugagccaguggguagu

SEQ ID NO: 190844 - RNA, 22 nt, Human
gaggaagagagcucugccuugu

SEQ ID NO: 190845 - RNA, 22 nt, Human
cacaaaaguaggaggcaggcgg

SEQ ID NO: 190846 - RNA, 22 nt, Human
ugauuacauugguaauguuuau

SEQ ID NO: 190847 - RNA, 22 nt, Human
uguuuacuccagcugauggaac

SEQ ID NO: 190848 - RNA, 22 nt, Human
gagcuggguauauggcuuuaug

SEQ ID NO: 190849 - RNA, 22 nt, Human
gucuggagagcugagcagaguu

SEQ ID NO: 190850 - RNA, 22 nt, Human
ggugcugccuauagucugaaac

SEQ ID NO: 190851 - RNA, 22 nt, Human
uccagggcagugacuacagcgg

SEQ ID NO: 190852 - RNA, 22 nt, Human
uucuguauauuguaaagacuca

SEQ ID NO: 190853 - RNA, 22 nt, Human
auguuuguugaacaucuacugc

SEQ ID NO: 190854 - RNA, 22 nt, Human
aacucuuuguggacauuaaauu

SEQ ID NO: 190855 - RNA, 22 nt, Human
aaaggcuuugagaaguccugca

SEQ ID NO: 190856 - RNA, 22 nt, Human
auuagcaacauggugaauaugu

SEQ ID NO: 190857 - RNA, 22 nt, Human
uaucuagaaacagaguuuuacu

SEQ ID NO: 190858 - RNA, 22 nt, Human
acaggcucacagucauuucauu

SEQ ID NO: 190859 - RNA, 22 nt, Human
cucagcaucaugguaucugggg

SEQ ID NO: 190860 - RNA, 22 nt, Human
acauucaugucccacuucuagc

SEQ ID NO: 190861 - RNA, 22 nt, Human
acugccuugucucuugccuguu

SEQ ID NO: 190862 - RNA, 22 nt, Human
auggucuuuuuguuaugagaga

SEQ ID NO: 190863 - RNA, 22 nt, Human
uguccuuuaugaaaugguguuu

SEQ ID NO: 190864 - RNA, 22 nt, Human
cugcaaaaguaauuggggcuuu

SEQ ID NO: 190865 - RNA, 22 nt, Human
agauguguuucuaguuccugca

SEQ ID NO: 190866 - RNA, 22 nt, Human
cuguucuggagacacugaugaa

SEQ ID NO: 190867 - RNA, 22 nt, Human
agggcagacuaggauggaagug

SEQ ID NO: 190868 - RNA, 16 nt, Human
gcacacagccagccuu

SEQ ID NO: 190869 - RNA, 22 nt, Human
ugaaucaaagcugaaguuuuca

SEQ ID NO: 190870 - RNA, 22 nt, Human
ucagaagucuggacugcuucuc

SEQ ID NO: 190871 - RNA, 22 nt, Human
ucagggcaucaucaugaauaua

SEQ ID NO: 190872 - RNA, 18 nt, Human
uucuuuucaugugaucuc

SEQ ID NO: 190873 - RNA, 20 nt, Human
cuggguggcaagcaaggggg

SEQ ID NO: 190874 - RNA, 21 nt, Human
acccccacaccuccuuaguuc

SEQ ID NO: 190875 - RNA, 22 nt, Human
aguugacauccauaacaggaag

SEQ ID NO: 190876 - RNA, 22 nt, Human
aguaaaugaaagcaauuuuaga

SEQ ID NO: 190877 - RNA, 22 nt, Human
cgcccagcugaaaucuccaggc

SEQ ID NO: 190878 - RNA, 22 nt, Human
acacagccccacggugagcaaa

SEQ ID NO: 190879 - RNA, 22 nt, Human
acagucauagcagccuuuguua

SEQ ID NO: 190880 - RNA, 22 nt, Human
uggcagggccugaaucuuauac

SEQ ID NO: 190881 - RNA, 22 nt, Human
cuuauagauggcgaucuucuug

SEQ ID NO: 190882 - RNA, 22 nt, Human
uccagcccugcccauucucucg

SEQ ID NO: 190883 - RNA, 22 nt, Human
uacaaaguagaaauucaguaaa

SEQ ID NO: 190884 - RNA, 22 nt, Human
augaggcacguguuacuggccu

SEQ ID NO: 190885 - RNA, 22 nt, Human
cuucucugacagucuguuucac

SEQ ID NO: 190886 - RNA, 22 nt, Human
uggauucucaugggaccaguag

SEQ ID NO: 190887 - RNA, 22 nt, Human
ugcccugugugugcaagcacug

SEQ ID NO: 190888 - RNA, 22 nt, Human
acacucaguaaacgacaauggg

SEQ ID NO: 190889 - RNA, 22 nt, Human
uuuaaauucugucugccgcuua

SEQ ID NO: 190890 - RNA, 22 nt, Human
agagggcuaacugggaagcagg

SEQ ID NO: 190891 - RNA, 22 nt, Human
uuugaagacagaucaauauaag

SEQ ID NO: 190892 - RNA, 22 nt, Human
ugaguaaauauuuaugacuaga

SEQ ID NO: 190893 - RNA, 22 nt, Human
gaauaacauuggaacccugaag

SEQ ID NO: 190894 - RNA, 22 nt, Human
auucugggagguagaacugaaa

SEQ ID NO: 190895 - RNA, 22 nt, Human
ucgaaauacuguuuccccuuua

SEQ ID NO: 190896 - RNA, 17 nt, Human
agcugcagaugaaguug

SEQ ID NO: 190897 - RNA, 22 nt, Human
ugaguuaaaugagaacaugaaa

SEQ ID NO: 190898 - RNA, 22 nt, Human
cuuugucauuuugucucucagu

SEQ ID NO: 190899 - RNA, 22 nt, Human
ccaggcuggauuuugcaguuca

SEQ ID NO: 190900 - RNA, 22 nt, Human
ccaggaguuugaggcugcagug

SEQ ID NO: 190901 - RNA, 22 nt, Human
gggcaguuuauucuagaugguu

SEQ ID NO: 190902 - RNA, 22 nt, Human
ucaggcuuggugcuccagugcc

SEQ ID NO: 190903 - RNA, 22 nt, Human
guuucaaaagucaggcuauucu

SEQ ID NO: 190904 - RNA, 22 nt, Human
ucuguugcaaugugcaugguga

SEQ ID NO: 190905 - RNA, 22 nt, Human
uggcaguguuucuaaggggcuc

SEQ ID NO: 190906 - RNA, 22 nt, Human
ugggcugcagagcccggccuuc

SEQ ID NO: 190907 - RNA, 22 nt, Human
acaaguauuuaagguuaguaua

SEQ ID NO: 190908 - RNA, 22 nt, Human
ggacaucuugguugcuuccaag

SEQ ID NO: 190909 - RNA, 22 nt, Human
aacugcaauuacuuuugcacca

SEQ ID NO: 190910 - RNA, 21 nt, Human
ugcacagggcccaggagagcc

SEQ ID NO: 190911 - RNA, 22 nt, Human
ucagcuuucucucgccaucagg

SEQ ID NO: 190912 - RNA, 22 nt, Human
ugugaggguuuuaagggaauga

SEQ ID NO: 190913 - RNA, 22 nt, Human
auguagagcaguguuguccaau

SEQ ID NO: 190914 - RNA, 22 nt, Human
uggauuugcuaccuucugauau

SEQ ID NO: 190915 - RNA, 22 nt, Human
caaaaacugcaauuacuuuuac

SEQ ID NO: 190916 - RNA, 22 nt, Human
aggcggcugguguccugcaggu

SEQ ID NO: 190917 - RNA, 22 nt, Human
uacauucccccaauuaccaaug

SEQ ID NO: 190918 - RNA, 22 nt, Human
uaggggaaagcagaauccugga

SEQ ID NO: 190919 - RNA, 22 nt, Human
cuguuacugaaaugcaccgugc

SEQ ID NO: 190920 - RNA, 22 nt, Human
cugaauuacuuauuagugggga

SEQ ID NO: 190921 - RNA, 21 nt, Human
aggagaccggcuuguuugugc

SEQ ID NO: 190922 - RNA, 22 nt, Human
guccuaaucucuucuuauaagg

SEQ ID NO: 190923 - RNA, 21 nt, Human
agagcucaaggcaaaaauaau

SEQ ID NO: 190924 - RNA, 22 nt, Human
cucagcagugacaagagaguau

SEQ ID NO: 190925 - RNA, 22 nt, Human
auguuuuauauuuugcagcagu

SEQ ID NO: 190926 - RNA, 22 nt, Human
ugcaaaagaauauagauauugu

SEQ ID NO: 190927 - RNA, 22 nt, Human
auaaaaggaaagccuguuguga

SEQ ID NO: 190928 - RNA, 22 nt, Human
caaacauucaaguacaagucuu

SEQ ID NO: 190929 - RNA, 22 nt, Human
agaggcaugaucuuauaauuua

SEQ ID NO: 190930 - RNA, 22 nt, Human
caccucauggauaagauaaacu

SEQ ID NO: 190931 - RNA, 22 nt, Human
ggcugcugggaauaugccagcu

SEQ ID NO: 190932 - RNA, 22 nt, Human
acagguguccaacauuuaccuu

SEQ ID NO: 190933 - RNA, 22 nt, Human
guuugaaugcaguaugcauuuu

SEQ ID NO: 190934 - RNA, 22 nt, Human
ggccaggaggcaggggcucaau

SEQ ID NO: 190935 - RNA, 22 nt, Human
ggcagccauacucagaccuggg

SEQ ID NO: 190936 - RNA, 22 nt, Human
aagagcugugggugguaguccu

SEQ ID NO: 190937 - RNA, 22 nt, Human
uuucagagaaagcccaaagacu

SEQ ID NO: 190938 - RNA, 21 nt, Human
acauuauaauucauauuccac

SEQ ID NO: 190939 - RNA, 21 nt, Human
ugagucuuuugcacaaggaau

SEQ ID NO: 190940 - RNA, 22 nt, Human
uucaacaucaagaaugcaugga

SEQ ID NO: 190941 - RNA, 22 nt, Human
aagggugggcaccgccagguca

SEQ ID NO: 190942 - RNA, 22 nt, Human
aauagcauguucaugauaaaau

SEQ ID NO: 190943 - RNA, 22 nt, Human
agaguuggcccacguguaggcg

SEQ ID NO: 190944 - RNA, 22 nt, Human
cagcauuucaggaggcugaggu

SEQ ID NO: 190945 - RNA, 22 nt, Human
agggcagccucucagccuaggu

SEQ ID NO: 190946 - RNA, 22 nt, Human
aggcacagccucccuucacaug

SEQ ID NO: 190947 - RNA, 20 nt, Human
gcccaggaucucugaggcau

SEQ ID NO: 190948 - RNA, 22 nt, Human
cuuauucagcacuugcucugua

SEQ ID NO: 190949 - RNA, 22 nt, Human
uaggcagcgcuuggcugugcuu

SEQ ID NO: 190950 - RNA, 23 nt, Human
uuuauacaagaaaccgcuggccu

SEQ ID NO: 190951 - RNA, 22 nt, Human
gcuuccagcaccagcagagggg

SEQ ID NO: 190952 - RNA, 22 nt, Human
uagcuguuugaaguauuuuucu

SEQ ID NO: 190953 - RNA, 22 nt, Human
ucuggcaaaggcaaccacaguu

SEQ ID NO: 190954 - RNA, 22 nt, Human
ugaaaucaugaacaagguaggu

SEQ ID NO: 190955 - RNA, 22 nt, Human
guuugcauggaagacagugagu

SEQ ID NO: 190956 - RNA, 22 nt, Human
ucauuguauacuuuauuuauga

SEQ ID NO: 190957 - RNA, 22 nt, Human
ucagagagguuaaauaucuugu

SEQ ID NO: 190958 - RNA, 22 nt, Human
augccaggaacaaacaguggug

SEQ ID NO: 190959 - RNA, 22 nt, Human
ugcugggcuaggguggagcucu

SEQ ID NO: 190960 - RNA, 23 nt, Human
ggguccagccaauuccaaggaaa

SEQ ID NO: 190961 - RNA, 22 nt, Human
uuuccuuugaggguccuacacu

SEQ ID NO: 190962 - RNA, 22 nt, Human
gagagcugggggacuguggaug

SEQ ID NO: 190963 - RNA, 22 nt, Human
ugagacaguuuuucuauuucca

SEQ ID NO: 190964 - RNA, 22 nt, Human
cuggggcccaucgagggcugag

SEQ ID NO: 190965 - RNA, 22 nt, Human
ucagaaaauaacuguuaguuug

SEQ ID NO: 190966 - RNA, 22 nt, Human
uagcccuguccuuggccugugc

SEQ ID NO: 190967 - RNA, 22 nt, Human
gaggaaaaugggacaggcugua

SEQ ID NO: 190968 - RNA, 22 nt, Human
auuucccagcuuugaucaguuu

SEQ ID NO: 190969 - RNA, 22 nt, Human
uacaugcuucuauaugugaagu

SEQ ID NO: 190970 - RNA, 22 nt, Human
agacugaaguaagaaugcagcu

SEQ ID NO: 190971 - RNA, 22 nt, Human
auguuaaauagccauuuguuug

SEQ ID NO: 190972 - RNA, 22 nt, Human
augcauaauguauguauugacu

SEQ ID NO: 190973 - RNA, 22 nt, Human
cagagcaucgcgcagagagccu

SEQ ID NO: 190974 - RNA, 22 nt, Human
aaaugucauauuuaaguaggaa

SEQ ID NO: 190975 - RNA, 22 nt, Human
auaaugucugcagagccacaca

SEQ ID NO: 190976 - RNA, 22 nt, Human
uauucacauguacauaugcuca

SEQ ID NO: 190977 - RNA, 22 nt, Human
ggcuucucuccaguaugcauuc

SEQ ID NO: 190978 - RNA, 22 nt, Human
cauuuaaagguuguggguaaaa

SEQ ID NO: 190979 - RNA, 22 nt, Human
aagauuuuuuuccacagacuca

SEQ ID NO: 190980 - RNA, 20 nt, Human
gucagaggacccuagagcga

SEQ ID NO: 190981 - RNA, 22 nt, Human
caagauaucaaugacauaguau

SEQ ID NO: 190982 - RNA, 22 nt, Human
auccaggcuggguguggcuacu

SEQ ID NO: 190983 - RNA, 22 nt, Human
ugggcccaagagagucuccaac

SEQ ID NO: 190984 - RNA, 22 nt, Human
gaaagcacugugagaucuuguu

SEQ ID NO: 190985 - RNA, 22 nt, Human
aggaaaaauaaggcagcagggc

SEQ ID NO: 190986 - RNA, 20 nt, Human
ugagagcugggcagggauac

SEQ ID NO: 190987 - RNA, 22 nt, Human
agaagaaaugugaaggccacug

SEQ ID NO: 190988 - RNA, 22 nt, Human
acuagaaagcacuaagcuaggc

SEQ ID NO: 190989 - RNA, 22 nt, Human
ugucuguauuagucagcauucu

SEQ ID NO: 190990 - RNA, 22 nt, Human
uggagaaaagguugaauccauc

SEQ ID NO: 190991 - RNA, 22 nt, Human
cauucacauucuucuuacuguu

SEQ ID NO: 190992 - RNA, 23 nt, Human
uggaauguuucuuguacugaaug

SEQ ID NO: 190993 - RNA, 22 nt, Human
uaguaagcacauggacaagugg

SEQ ID NO: 190994 - RNA, 22 nt, Human
auucugggcgccuauggcugca

SEQ ID NO: 190995 - RNA, 22 nt, Human
ugucauacaacaauaaguaccg

SEQ ID NO: 190996 - RNA, 22 nt, Human
uccucccugggagcuucugagu

SEQ ID NO: 190997 - RNA, 22 nt, Human
ucucuugggaggaaagagagaa

SEQ ID NO: 190998 - RNA, 22 nt, Human
gaggcugcuguuagcccugggc

SEQ ID NO: 190999 - RNA, 22 nt, Human
ccuagacauuaagcuuggguuu

SEQ ID NO: 191000 - RNA, 22 nt, Human
uuacaugggcuugugaguccuu

SEQ ID NO: 191001 - RNA, 22 nt, Human
accaugggucagccaccucagc

SEQ ID NO: 191002 - RNA, 22 nt, Human
agaagccauggggucaccagag

SEQ ID NO: 191003 - RNA, 22 nt, Human
uccugggcccuccggaucaggu

SEQ ID NO: 191004 - RNA, 22 nt, Human
gaguuaaaggaaaauaacuuua

SEQ ID NO: 191005 - RNA, 22 nt, Human
ggcaggaauaaauuauggacuu

SEQ ID NO: 191006 - RNA, 22 nt, Human
ggaggagucaguugggcugcuu

SEQ ID NO: 191007 - RNA, 23 nt, Human
agcaccaggaacagugugguccu

SEQ ID NO: 191008 - RNA, 22 nt, Human
agccagaaaaacaccaagagga

SEQ ID NO: 191009 - RNA, 22 nt, Human
ccugccugaaggucagccaccc

SEQ ID NO: 191010 - RNA, 22 nt, Human
accuguuuggaggagguguuag

SEQ ID NO: 191011 - RNA, 22 nt, Human
aaaauuuucagcuugacuugau

SEQ ID NO: 191012 - RNA, 22 nt, Human
uaacagaguuguacaguuacgu

SEQ ID NO: 191013 - RNA, 22 nt, Human
uaaggaaaauggacaucaaaca

SEQ ID NO: 191014 - RNA, 22 nt, Human
gccaccagggggugcaaggucc

SEQ ID NO: 191015 - RNA, 22 nt, Human
uuaaaauuuccccaccauguau

SEQ ID NO: 191016 - RNA, 22 nt, Human
acacgguggccagcaguaggug

SEQ ID NO: 191017 - RNA, 22 nt, Human
uucuuucuuagcaaucuauggu

SEQ ID NO: 191018 - RNA, 22 nt, Human
gccuuagccugcacuuccuguu

SEQ ID NO: 191019 - RNA, 22 nt, Human
auccacagugcagcaagggccc

SEQ ID NO: 191020 - RNA, 22 nt, Human
ucugggaacucugucauuuccc

SEQ ID NO: 191021 - RNA, 22 nt, Human
guguacaggaugacuguacuua

SEQ ID NO: 191022 - RNA, 22 nt, Human
cucugugggccagagaggcccc

SEQ ID NO: 191023 - RNA, 22 nt, Human
gcugagagaucaaggcaggauu

SEQ ID NO: 191024 - RNA, 22 nt, Human
gccagccacguuagacuggccc

SEQ ID NO: 191025 - RNA, 18 nt, Human
uuuguuggguugccuuua

SEQ ID NO: 191026 - RNA, 22 nt, Human
auuuggucacaccaguccacau

SEQ ID NO: 191027 - RNA, 22 nt, Human
gcucuggguagccacugccugg

SEQ ID NO: 191028 - RNA, 18 nt, Human
gagagcccagcagguggu

SEQ ID NO: 191029 - RNA, 22 nt, Human
caggaaaccgcaucccaguggg

SEQ ID NO: 191030 - RNA, 18 nt, Human
ucagagagcagcuuuauu

SEQ ID NO: 191031 - RNA, 19 nt, Human
uccaggagcaaagccaguu

SEQ ID NO: 191032 - RNA, 22 nt, Human
cuccaggggccagaagccuggc

SEQ ID NO: 191033 - RNA, 22 nt, Human
aacacucaauuuacaaacucug

SEQ ID NO: 191034 - RNA, 20 nt, Human
aaacauaguggauaccacag

SEQ ID NO: 191035 - RNA, 22 nt, Human
ccugggagguggagguugcagu

SEQ ID NO: 191036 - RNA, 22 nt, Human
uucucauggugucuuuauacau

SEQ ID NO: 191037 - RNA, 22 nt, Human
cagcaucuuucucuucuggagu

SEQ ID NO: 191038 - RNA, 22 nt, Human
gggcuucuagaccagcagugag

SEQ ID NO: 191039 - RNA, 22 nt, Human
ucugggcugggcuuaggaaccc

SEQ ID NO: 191040 - RNA, 22 nt, Human
ucacagugucguccuugggugu

SEQ ID NO: 191041 - RNA, 22 nt, Human
uaauccaggguauucuaguuuc

SEQ ID NO: 191042 - RNA, 22 nt, Human
agcugcagguucagcauuccac

SEQ ID NO: 191043 - RNA, 22 nt, Human
uggggcagggaugggaaacuau

SEQ ID NO: 191044 - RNA, 22 nt, Human
gcacagccacugagugagaacc

SEQ ID NO: 191045 - RNA, 22 nt, Human
gccuguuuuagaugcauugaug

SEQ ID NO: 191046 - RNA, 22 nt, Human
uccucagauauaaaugagggug

SEQ ID NO: 191047 - RNA, 22 nt, Human
cugggagauugaggccauggug

SEQ ID NO: 191048 - RNA, 22 nt, Human
cuguggagcuuguggcaguggg

SEQ ID NO: 191049 - RNA, 22 nt, Human
agaagccagcuucagcugcccg

SEQ ID NO: 191050 - RNA, 22 nt, Human
gaugguccuccugcugccucuc

SEQ ID NO: 191051 - RNA, 22 nt, Human
uggaaauggaucugaugagucu

SEQ ID NO: 191052 - RNA, 22 nt, Human
auucuucacuguuucagaauga

SEQ ID NO: 191053 - RNA, 22 nt, Human
caggaaaggugugucaugaugg

SEQ ID NO: 191054 - RNA, 22 nt, Human
aacugaaacguauuuuugagau

SEQ ID NO: 191055 - RNA, 22 nt, Human
ucacagaagagauauugacaga

SEQ ID NO: 191056 - RNA, 22 nt, Human
aagcuuuaagugucagucagcc

SEQ ID NO: 191057 - RNA, 23 nt, Human
agcagcaaaaauuuaucuuucug

SEQ ID NO: 191058 - RNA, 22 nt, Human
cauccugguuaccccauaguca

SEQ ID NO: 191059 - RNA, 23 nt, Human
auguagaguacagcacaacagca

SEQ ID NO: 191060 - RNA, 19 nt, Human
ggccuugcucuguggcagc

SEQ ID NO: 191061 - RNA, 22 nt, Human
acaaucuuauuaguaguauaga

SEQ ID NO: 191062 - RNA, 22 nt, Human
uucaguuucuucccugugaaau

SEQ ID NO: 191063 - RNA, 21 nt, Human
aaggcuggagaugcaggucug

SEQ ID NO: 191064 - RNA, 22 nt, Human
auauuauucuagcucuugugug

SEQ ID NO: 191065 - RNA, 22 nt, Human
uacagggaccaauaauaacuau

SEQ ID NO: 191066 - RNA, 22 nt, Human
uggagcagcacaagaaagggga

SEQ ID NO: 191067 - RNA, 22 nt, Human
ccugcagguccccggaugcgca

SEQ ID NO: 191068 - RNA, 23 nt, Human
accaacaagccucuggagagugg

SEQ ID NO: 191069 - RNA, 22 nt, Human
gaagaauauucuugaucuuaga

SEQ ID NO: 191070 - RNA, 22 nt, Human
uguguuauugccacugaagacc

SEQ ID NO: 191071 - RNA, 22 nt, Human
gagucacaaaagaugcccaggg

SEQ ID NO: 191072 - RNA, 22 nt, Human
ccuguccuccaagagcacaucu

SEQ ID NO: 191073 - RNA, 22 nt, Human
acugaaaguccagcaugguaca

SEQ ID NO: 191074 - RNA, 22 nt, Human
aacaacaacggagaaaggguug

SEQ ID NO: 191075 - RNA, 22 nt, Human
gggcuucuacuugcaaaggaua

SEQ ID NO: 191076 - RNA, 22 nt, Human
cccccauccaugucaggagagg

SEQ ID NO: 191077 - RNA, 22 nt, Human
ucagaagguggagguugcagug

SEQ ID NO: 191078 - RNA, 22 nt, Human
uggaaguggcagaaaaugaaca

SEQ ID NO: 191079 - RNA, 22 nt, Human
cugaggagugggugggcaguga

SEQ ID NO: 191080 - RNA, 22 nt, Human
gaagcacauggcuauagcuauu

SEQ ID NO: 191081 - RNA, 19 nt, Human
aaacuaaggggaaauguuu

SEQ ID NO: 191082 - RNA, 19 nt, Human
accaggccucagaggcccu

SEQ ID NO: 191083 - RNA, 22 nt, Human
aagcuggagaguuaggugaaua

SEQ ID NO: 191084 - RNA, 19 nt, Human
uuuagaaguugaaacucug

SEQ ID NO: 191085 - RNA, 22 nt, Human
ugaagcuuuccuguggucagga

SEQ ID NO: 191086 - RNA, 22 nt, Human
ucaggaacauuuaaccacaggg

SEQ ID NO: 191087 - RNA, 22 nt, Human
ccuggguccaauucuggcuugu

SEQ ID NO: 191088 - RNA, 22 nt, Human
cuccagccucaucuccuggcug

SEQ ID NO: 191089 - RNA, 22 nt, Human
agaaauacaaaguacuaagaua

SEQ ID NO: 191090 - RNA, 22 nt, Human
ugcaagagcagaaagaacugag

SEQ ID NO: 191091 - RNA, 22 nt, Human
ucauagcuaagcuccagagugc

SEQ ID NO: 191092 - RNA, 22 nt, Human
cuuguuuaagccgcuguuaagc

SEQ ID NO: 191093 - RNA, 21 nt, Human
cucugcagcccugcuuccagg

SEQ ID NO: 191094 - RNA, 21 nt, Human
ugaggcaaguccuuuuauagc

SEQ ID NO: 191095 - RNA, 23 nt, Human
acagaaaguucugcuggacagag

SEQ ID NO: 191096 - RNA, 22 nt, Human
ucagugcugaguagcgugcacc

SEQ ID NO: 191097 - RNA, 22 nt, Human
cugccccaccccaaccugaggu

SEQ ID NO: 191098 - RNA, 23 nt, Human
ugcuggcuguguuauugccaaca

SEQ ID NO: 191099 - RNA, 22 nt, Human
ggugggagggcugcguuccucu

SEQ ID NO: 191100 - RNA, 22 nt, Human
acagauaauuagcauaaaugcu

SEQ ID NO: 191101 - RNA, 22 nt, Human
aacugagauuacaagagacauu

SEQ ID NO: 191102 - RNA, 22 nt, Human
agacccacacuuugaguagcaa

SEQ ID NO: 191103 - RNA, 20 nt, Human
gcuuggaagccaccuguauu

SEQ ID NO: 191104 - RNA, 22 nt, Human
acugcaccuguguaccaagaug

SEQ ID NO: 191105 - RNA, 22 nt, Human
uggaggcauuucuuuuuggucg

SEQ ID NO: 191106 - RNA, 22 nt, Human
acaacacagcuuuccucaaguu

SEQ ID NO: 191107 - RNA, 22 nt, Human
gcagaaguuaaucgaaggccau

SEQ ID NO: 191108 - RNA, 22 nt, Human
uucucuggaaggcucuacggga

SEQ ID NO: 191109 - RNA, 22 nt, Human
cagccugcaggaggccgucagc

SEQ ID NO: 191110 - RNA, 22 nt, Human
cugaggcacccaucuucuccug

SEQ ID NO: 191111 - RNA, 22 nt, Human
ucaaaggcuugugguucuggga

SEQ ID NO: 191112 - RNA, 22 nt, Human
ugaugaaauguugaggcaguga

SEQ ID NO: 191113 - RNA, 19 nt, Human
uuuacucuccaaggugagu

SEQ ID NO: 191114 - RNA, 22 nt, Human
cugcagagggguugaagggucc

SEQ ID NO: 191115 - RNA, 22 nt, Human
ucagcuuuuuggauugcccaag

SEQ ID NO: 191116 - RNA, 20 nt, Human
ccuucuccagcuuguucuug

SEQ ID NO: 191117 - RNA, 22 nt, Human
gcucuggcacuggcgcgggaug

SEQ ID NO: 191118 - RNA, 22 nt, Human
uuugacucugggugcuuuuucg

SEQ ID NO: 191119 - RNA, 22 nt, Human
uguucaguuugcuaucauaauc

SEQ ID NO: 191120 - RNA, 22 nt, Human
ugguuacagagauuuuuaagau

SEQ ID NO: 191121 - RNA, 22 nt, Human
cccagagcugggugggcagcgg

SEQ ID NO: 191122 - RNA, 22 nt, Human
gaaaggccagcucacagaugag

SEQ ID NO: 191123 - RNA, 22 nt, Human
aaucuguucuacucuauucaga

SEQ ID NO: 191124 - RNA, 22 nt, Human
cuucccacuaguaucacagagc

SEQ ID NO: 191125 - RNA, 22 nt, Human
ugaggcagcaauuguauuguau

SEQ ID NO: 191126 - RNA, 21 nt, Human
cucuagaaaucgaauaaccuu

SEQ ID NO: 191127 - RNA, 22 nt, Human
uaucuauuccaaauaucagcgu

SEQ ID NO: 191128 - RNA, 22 nt, Human
agugggacaguguagagcguca

SEQ ID NO: 191129 - RNA, 22 nt, Human
gcuggcugccuuacuuugugga

SEQ ID NO: 191130 - RNA, 20 nt, Human
ucauggcugcugagagguuc

SEQ ID NO: 191131 - RNA, 22 nt, Human
acaggacugugauccaguaacc

SEQ ID NO: 191132 - RNA, 20 nt, Human
aggaggaagaaagcacacug

SEQ ID NO: 191133 - RNA, 22 nt, Human
cagaacacaggcuaaacugaga

SEQ ID NO: 191134 - RNA, 22 nt, Human
aggcaguggagcuggaauaggc

SEQ ID NO: 191135 - RNA, 22 nt, Human
gauaacccccaagaaggucuuu

SEQ ID NO: 191136 - RNA, 22 nt, Human
agccacagcacauuguaagaaa

SEQ ID NO: 191137 - RNA, 22 nt, Human
cugcaacucucuccagaggcug

SEQ ID NO: 191138 - RNA, 21 nt, Human
agccugggaggcggagguugc

SEQ ID NO: 191139 - RNA, 22 nt, Human
aagauggaguaguguaaugguu

SEQ ID NO: 191140 - RNA, 22 nt, Human
agacaggcagaggcugcagagg

SEQ ID NO: 191141 - RNA, 22 nt, Human
augauauauguguugagcuugc

SEQ ID NO: 191142 - RNA, 22 nt, Human
uugaagagugccuuccagacau

SEQ ID NO: 191143 - RNA, 22 nt, Human
gucugggccaggcgagccgagg

SEQ ID NO: 191144 - RNA, 22 nt, Human
ucccaguggugggugcacauuu

SEQ ID NO: 191145 - RNA, 22 nt, Human
uuucaauguaacauuuccaggc

SEQ ID NO: 191146 - RNA, 22 nt, Human
cucuccaggcgagguccuacug

SEQ ID NO: 191147 - RNA, 16 nt, Human
ucuuuguaaucagcag

SEQ ID NO: 191148 - RNA, 22 nt, Human
ugagacaggcuuccuucuuggg

SEQ ID NO: 191149 - RNA, 22 nt, Human
cuggagugaagcuuauuuuuca

SEQ ID NO: 191150 - RNA, 22 nt, Human
gaguggguaaaggugcuuggcu

SEQ ID NO: 191151 - RNA, 22 nt, Human
uagcuccuggcugcagggccuc

SEQ ID NO: 191152 - RNA, 20 nt, Human
acguggccaccaguggcuua

SEQ ID NO: 191153 - RNA, 22 nt, Human
cuuccucccggcccaugcucug

SEQ ID NO: 191154 - RNA, 22 nt, Human
aucuuccuucacuuucucccac

SEQ ID NO: 191155 - RNA, 22 nt, Human
uggauuuuagcauguaacugug

SEQ ID NO: 191156 - RNA, 22 nt, Human
gaggggccuggcacugagcugg

SEQ ID NO: 191157 - RNA, 22 nt, Human
aacagugucugugguuaaaggu

SEQ ID NO: 191158 - RNA, 22 nt, Human
auggguuucccucugaaauuau

SEQ ID NO: 191159 - RNA, 22 nt, Human
cauggcagggcugugggcaggu

SEQ ID NO: 191160 - RNA, 18 nt, Human
gcucaggcccuagucagu

SEQ ID NO: 191161 - RNA, 22 nt, Human
uggcauuuuguucaguauaugg

SEQ ID NO: 191162 - RNA, 22 nt, Human
cccuaggguuuggccagagccc

SEQ ID NO: 191163 - RNA, 22 nt, Human
gucaggaagcaagguugggcau

SEQ ID NO: 191164 - RNA, 22 nt, Human
uuugacauuggcuuauucuguu

SEQ ID NO: 191165 - RNA, 22 nt, Human
ggccuuagcugucuuuccuuug

SEQ ID NO: 191166 - RNA, 22 nt, Human
ggaaagagcccagcagugcuug

SEQ ID NO: 191167 - RNA, 22 nt, Human
aaccuagaaguuagaguaucau

SEQ ID NO: 191168 - RNA, 22 nt, Human
caggcucgguccaguggcaccc

SEQ ID NO: 191169 - RNA, 23 nt, Human
gccauggcugccccacaggccuc

SEQ ID NO: 191170 - RNA, 22 nt, Human
uacagucaacauugaugaugau

SEQ ID NO: 191171 - RNA, 22 nt, Human
aaacacugaagaccuaucuggu

SEQ ID NO: 191172 - RNA, 21 nt, Human
gguguccagaggaguccccag

SEQ ID NO: 191173 - RNA, 22 nt, Human
gagguccaggguggggccugag

SEQ ID NO: 191174 - RNA, 21 nt, Human
auggcugguggcucagccucc

SEQ ID NO: 191175 - RNA, 22 nt, Human
aucuuuaccaccaaagaaugcu

SEQ ID NO: 191176 - RNA, 22 nt, Human
agcccuagagaaccagccugug

SEQ ID NO: 191177 - RNA, 22 nt, Human
acugcaggccuuggugccagca

SEQ ID NO: 191178 - RNA, 22 nt, Human
ugucaggacacagcuuucugug

SEQ ID NO: 191179 - RNA, 22 nt, Human
uacccagcuccucagaagacca

SEQ ID NO: 191180 - RNA, 22 nt, Human
ggcagugggaaauaagugagaa

SEQ ID NO: 191181 - RNA, 22 nt, Human
uagauaccugcuggaccucauu

SEQ ID NO: 191182 - RNA, 22 nt, Human
ugcugccaaaugcgagcucugu

SEQ ID NO: 191183 - RNA, 22 nt, Human
gaagagcuguagccugcucuuu

SEQ ID NO: 191184 - RNA, 22 nt, Human
gucccaggaguugcugggccuu

SEQ ID NO: 191185 - RNA, 22 nt, Human
acacauuccugcagacaugaug

SEQ ID NO: 191186 - RNA, 22 nt, Human
gagcucuucuaaagauggcaau

SEQ ID NO: 191187 - RNA, 22 nt, Human
auggcagcuuucauuguccaca

SEQ ID NO: 191188 - RNA, 22 nt, Human
uccuuccugcucuaacauucag

SEQ ID NO: 191189 - RNA, 22 nt, Human
caguuugucuugauucagaaca

SEQ ID NO: 191190 - RNA, 19 nt, Human
agguccugaucagcaagga

SEQ ID NO: 191191 - RNA, 22 nt, Human
cugugucccuugucccagagcc

SEQ ID NO: 191192 - RNA, 22 nt, Human
gccaggcuggccagcaccuucu

SEQ ID NO: 191193 - RNA, 22 nt, Human
acaguggaaaugugggagggga

SEQ ID NO: 191194 - RNA, 22 nt, Human
uucacacuguuuuucauagugg

SEQ ID NO: 191195 - RNA, 22 nt, Human
aggaucuugcuguagaggauag

SEQ ID NO: 191196 - RNA, 22 nt, Human
aagaagcaggucacagacaggg

SEQ ID NO: 191197 - RNA, 22 nt, Human
cagcccuggcccaggugccuua

SEQ ID NO: 191198 - RNA, 22 nt, Human
aagcuggaacaucuugaggaag

SEQ ID NO: 191199 - RNA, 22 nt, Human
gcacaggcuguuggccuucaga

SEQ ID NO: 191200 - RNA, 22 nt, Human
gugacuuuaacuucagauuaga

SEQ ID NO: 191201 - RNA, 22 nt, Human
ccuacaggaaauuguaucaaaa

SEQ ID NO: 191202 - RNA, 22 nt, Human
agacuguagcuucugucuugag

SEQ ID NO: 191203 - RNA, 22 nt, Human
gccaggaaagccacuggcauac

SEQ ID NO: 191204 - RNA, 22 nt, Human
uauauuaacacccacuugccuc

SEQ ID NO: 191205 - RNA, 22 nt, Human
uacaaaaguaauuacgguuuuu

SEQ ID NO: 191206 - RNA, 22 nt, Human
caucuuugguuuucuauaugcc

SEQ ID NO: 191207 - RNA, 22 nt, Human
aagccuucccuuuuugagcuca

SEQ ID NO: 191208 - RNA, 22 nt, Human
ucugaaauggcagcgggaauga

SEQ ID NO: 191209 - RNA, 22 nt, Human
guaggaaagggagugaagggaa

SEQ ID NO: 191210 - RNA, 22 nt, Human
agucuagaugauccuaggaaua

SEQ ID NO: 191211 - RNA, 22 nt, Human
gggcagcagagcccugccgagu

SEQ ID NO: 191212 - RNA, 22 nt, Human
uacacuuuauggauccuacuuu

SEQ ID NO: 191213 - RNA, 19 nt, Human
gcucugugaugcugagggg

SEQ ID NO: 191214 - RNA, 22 nt, Human
acguggagagaauagggcacca

SEQ ID NO: 191215 - RNA, 22 nt, Human
aacugcucauuugagaguaugc

SEQ ID NO: 191216 - RNA, 22 nt, Human
agggcugccugacuccagagcc

SEQ ID NO: 191217 - RNA, 22 nt, Human
uccaagagaauacuggagagua

SEQ ID NO: 191218 - RNA, 22 nt, Human
gcucccagaaccaaggcugggg

SEQ ID NO: 191219 - RNA, 22 nt, Human
ugccuagccuucuucaugccau

SEQ ID NO: 191220 - RNA, 22 nt, Human
aagcuggcaugucaccugagaa

SEQ ID NO: 191221 - RNA, 18 nt, Human
aauuuccauaugaauugc

SEQ ID NO: 191222 - RNA, 23 nt, Human
cagcccuuccugcauguuuuugu

SEQ ID NO: 191223 - RNA, 22 nt, Human
uggcaaaggggaccauguugaa

SEQ ID NO: 191224 - RNA, 22 nt, Human
caggucccgccccgggcugacc

SEQ ID NO: 191225 - RNA, 22 nt, Human
uuuuauuaguggcuagaugggg

SEQ ID NO: 191226 - RNA, 22 nt, Human
ggccaggccaagaggguuggaa

SEQ ID NO: 191227 - RNA, 22 nt, Human
uuuacagaucuguugauuuguu

SEQ ID NO: 191228 - RNA, 22 nt, Human
uguacagagguguacauaugau

SEQ ID NO: 191229 - RNA, 22 nt, Human
ucugcucaauacugcucaugaa

SEQ ID NO: 191230 - RNA, 22 nt, Human
ccugccuucuaaagcgcccgcc

SEQ ID NO: 191231 - RNA, 22 nt, Human
uugaauuauuuguuugcaagcu

SEQ ID NO: 191232 - RNA, 22 nt, Human
ccuggccugcucggcucuuaag

SEQ ID NO: 191233 - RNA, 22 nt, Human
aggaggccgggauucuggagau

SEQ ID NO: 191234 - RNA, 22 nt, Human
acccaggcuggaaugcaguggc

SEQ ID NO: 191235 - RNA, 22 nt, Human
acccaggcuggagugcagugac

SEQ ID NO: 191236 - RNA, 23 nt, Human
ccuggcuguggauuugggccugc

SEQ ID NO: 191237 - RNA, 22 nt, Human
ucucuuggacauguggcucugc

SEQ ID NO: 191238 - RNA, 22 nt, Human
cacacagguauauauauguaca

SEQ ID NO: 191239 - RNA, 22 nt, Human
uccucagugcuagccaacugcc

SEQ ID NO: 191240 - RNA, 22 nt, Human
cagcagugcuucagugugagau

SEQ ID NO: 191241 - RNA, 22 nt, Human
aauacauaauaaguuuugucug

SEQ ID NO: 191242 - RNA, 18 nt, Human
cagugaggaugaaggguu

SEQ ID NO: 191243 - RNA, 22 nt, Human
auucauuuagguauucacuuac

SEQ ID NO: 191244 - RNA, 16 nt, Human
ggugggaggugaggug

SEQ ID NO: 191245 - RNA, 22 nt, Human
uguuuccuucugucucuuugga

SEQ ID NO: 191246 - RNA, 19 nt, Human
ugacagguuuuauguguuu

SEQ ID NO: 191247 - RNA, 22 nt, Human
aagccugaggguguugcuagau

SEQ ID NO: 191248 - RNA, 22 nt, Human
gcagcuuuguggagaggcccau

SEQ ID NO: 191249 - RNA, 22 nt, Human
ugguccugcuugcugcuuaaga

SEQ ID NO: 191250 - RNA, 22 nt, Human
uaaauuaaagauuggagaagga

SEQ ID NO: 191251 - RNA, 22 nt, Human
ccagcucuagccccauguggcu

SEQ ID NO: 191252 - RNA, 22 nt, Human
aaaguuuuuaagcaagacccuu

SEQ ID NO: 191253 - RNA, 22 nt, Human
acauauaagggaucagugacag

SEQ ID NO: 191254 - RNA, 22 nt, Human
ugcucccagcuguaggaauguu

SEQ ID NO: 191255 - RNA, 22 nt, Human
ucaguuuucucaucuguaauuu

SEQ ID NO: 191256 - RNA, 22 nt, Human
uucugucauccuuucuagaugu

SEQ ID NO: 191257 - RNA, 22 nt, Human
uucugucaaaugccaguagaga

SEQ ID NO: 191258 - RNA, 22 nt, Human
aauggcuuuaaguagucucaca

SEQ ID NO: 191259 - RNA, 22 nt, Human
cuguccugucugcuuuuaauuu

SEQ ID NO: 191260 - RNA, 19 nt, Human
caguuuaacuaauuuuauc

SEQ ID NO: 191261 - RNA, 22 nt, Human
uaucuauaaguacuaacauggu

SEQ ID NO: 191262 - RNA, 22 nt, Human
ugacauuuuuauaagagucaaa

SEQ ID NO: 191263 - RNA, 22 nt, Human
auuccaaaggcuggccuggagg

SEQ ID NO: 191264 - RNA, 22 nt, Human
auuagagcaguguauuaugaua

SEQ ID NO: 191265 - RNA, 22 nt, Human
uaggugguuauaaauucaaggc

SEQ ID NO: 191266 - RNA, 20 nt, Human
aggcagcugggaaaugaggg

SEQ ID NO: 191267 - RNA, 22 nt, Human
agccuugagcaguucacuuggu

SEQ ID NO: 191268 - RNA, 22 nt, Human
cugggcagcacaucaucguauc

SEQ ID NO: 191269 - RNA, 22 nt, Human
cagagcagggugcaccuugggc

SEQ ID NO: 191270 - RNA, 22 nt, Human
uuacaugcagagggaagggaga

SEQ ID NO: 191271 - RNA, 22 nt, Human
acugucuuguuccaagacuaaa

SEQ ID NO: 191272 - RNA, 22 nt, Human
auuacaaaagaagggagaaggu

SEQ ID NO: 191273 - RNA, 22 nt, Human
gcgaggcugggcccugcaggcg

SEQ ID NO: 191274 - RNA, 22 nt, Human
agcuucucagaagaguccugua

SEQ ID NO: 191275 - RNA, 22 nt, Human
gagaugaugagauuuggaacuu

SEQ ID NO: 191276 - RNA, 22 nt, Human
gccuggagcucaugugggcauu

SEQ ID NO: 191277 - RNA, 22 nt, Human
cucccuccucaaauaucuuugu

SEQ ID NO: 191278 - RNA, 22 nt, Human
uagggcugccuauggcuagaua

SEQ ID NO: 191279 - RNA, 20 nt, Human
cauuugggaucaugagguuu

SEQ ID NO: 191280 - RNA, 22 nt, Human
uccuggcuuccacuccucuguu

SEQ ID NO: 191281 - RNA, 22 nt, Human
agccaguguuaagugacugguu

SEQ ID NO: 191282 - RNA, 20 nt, Human
aauuuuacuguccuauagag

SEQ ID NO: 191283 - RNA, 22 nt, Human
ugaugaggaccuggucucugcu

SEQ ID NO: 191284 - RNA, 18 nt, Human
accuccccauuuucugaa

SEQ ID NO: 191285 - RNA, 22 nt, Human
ucugccuggccuggagggcaca

SEQ ID NO: 191286 - RNA, 22 nt, Human
uuggaaaccaggcuuugagacg

SEQ ID NO: 191287 - RNA, 22 nt, Human
cuggcuguuucaggcagugucc

SEQ ID NO: 191288 - RNA, 22 nt, Human
uucauaaugagguccuagaggc

SEQ ID NO: 191289 - RNA, 22 nt, Human
ugaaggagaauuaauaggcauu

SEQ ID NO: 191290 - RNA, 22 nt, Human
ugagcagaggaggcugccaacu

SEQ ID NO: 191291 - RNA, 22 nt, Human
agaagugagugugacucagcag

SEQ ID NO: 191292 - RNA, 22 nt, Human
ggagggcccugggugcagcucu

SEQ ID NO: 191293 - RNA, 22 nt, Human
aucaaaaugcuccagugauggu

SEQ ID NO: 191294 - RNA, 22 nt, Human
gggcugagacgauggggucuuc

SEQ ID NO: 191295 - RNA, 22 nt, Human
aaguggacuaauacaaggacua

SEQ ID NO: 191296 - RNA, 22 nt, Human
aggaaagcaauggcugagaaca

SEQ ID NO: 191297 - RNA, 22 nt, Human
ccaggugccuccagucacagug

SEQ ID NO: 191298 - RNA, 22 nt, Human
gcugaagauaggcauuucagca

SEQ ID NO: 191299 - RNA, 22 nt, Human
agugugaguuugguugagacuu

SEQ ID NO: 191300 - RNA, 22 nt, Human
aauuacugucuguaaagggaau

SEQ ID NO: 191301 - RNA, 19 nt, Human
uaaaaugucuguggucagu

SEQ ID NO: 191302 - RNA, 22 nt, Human
gaucugaaucaauagaauaacu

SEQ ID NO: 191303 - RNA, 22 nt, Human
ccugggagggcaagugcugaug

SEQ ID NO: 191304 - RNA, 22 nt, Human
uuuguguuuucccauacuauug

SEQ ID NO: 191305 - RNA, 22 nt, Human
uaacacugugucugccauaucc

SEQ ID NO: 191306 - RNA, 22 nt, Human
uacagcuguugguguuuccucu

SEQ ID NO: 191307 - RNA, 22 nt, Human
agauggggcagaauggagccau

SEQ ID NO: 191308 - RNA, 22 nt, Human
gagccuggacaucucaggccca

SEQ ID NO: 191309 - RNA, 22 nt, Human
acagaacugcaggaggaaaagc

SEQ ID NO: 191310 - RNA, 20 nt, Human
ucagaagugcagcugccccu

SEQ ID NO: 191311 - RNA, 22 nt, Human
cagcaugaaaaguguugcuauc

SEQ ID NO: 191312 - RNA, 20 nt, Human
aggaggggauagaaucaaag

SEQ ID NO: 191313 - RNA, 22 nt, Human
aagcaguuacuauuuacuauua

SEQ ID NO: 191314 - RNA, 22 nt, Human
aaauuuucucucuaagacuuaa

SEQ ID NO: 191315 - RNA, 22 nt, Human
agcaaaguaugugcugggagcu

SEQ ID NO: 191316 - RNA, 22 nt, Human
acauguuaaacaucauggaaug

SEQ ID NO: 191317 - RNA, 22 nt, Human
cacacagugggaaaaccugaag

SEQ ID NO: 191318 - RNA, 22 nt, Human
ggaaagaggauaguggguaggu

SEQ ID NO: 191319 - RNA, 22 nt, Human
aggucucucacacucacagggc

SEQ ID NO: 191320 - RNA, 22 nt, Human
aacagguacaguuucccucugg

SEQ ID NO: 191321 - RNA, 22 nt, Human
auaagccugauucacuugucau

SEQ ID NO: 191322 - RNA, 22 nt, Human
acccugcccucuccagcucagg

SEQ ID NO: 191323 - RNA, 22 nt, Human
cccuguuuggauggggacccag

SEQ ID NO: 191324 - RNA, 22 nt, Human
agugcuauaaagguagaccaca

SEQ ID NO: 191325 - RNA, 22 nt, Human
agucuuggcuaugcauagagcu

SEQ ID NO: 191326 - RNA, 22 nt, Human
aagagguggguuggacagauac

SEQ ID NO: 191327 - RNA, 22 nt, Human
uccugagggcauuuuggugacu

SEQ ID NO: 191328 - RNA, 22 nt, Human
uccuggcuaguuuugcugaaau

SEQ ID NO: 191329 - RNA, 22 nt, Human
auauuuacugcuguggugaagg

SEQ ID NO: 191330 - RNA, 22 nt, Human
agauuuccguucucucuucagu

SEQ ID NO: 191331 - RNA, 22 nt, Human
aaagccauugcagagcaggauu

SEQ ID NO: 191332 - RNA, 17 nt, Human
uuaguguaucuguuuug

SEQ ID NO: 191333 - RNA, 21 nt, Human
gcagcgcccucugaccuugau

SEQ ID NO: 191334 - RNA, 19 nt, Human
uggaagaggaagggaaaua

SEQ ID NO: 191335 - RNA, 22 nt, Human
aaugaauucgagugaaggaaag

SEQ ID NO: 191336 - RNA, 22 nt, Human
cgacugucauacacaagacaug

SEQ ID NO: 191337 - RNA, 22 nt, Human
ucuuucuuauuagccauuguuc

SEQ ID NO: 191338 - RNA, 22 nt, Human
cuguuuauacucaaaagauaca

SEQ ID NO: 191339 - RNA, 22 nt, Human
uuacacuucuaaaaaaagcagg

SEQ ID NO: 191340 - RNA, 22 nt, Human
cugaggagaugggcuuuuuagg

SEQ ID NO: 191341 - RNA, 22 nt, Human
ucuuuccauggccacacagucu

SEQ ID NO: 191342 - RNA, 22 nt, Human
gaagaagcaggaguguguagca

SEQ ID NO: 191343 - RNA, 22 nt, Human
aaauaugaaugauaagaguuau

SEQ ID NO: 191344 - RNA, 22 nt, Human
ugaagccacuuuccagaaucac

SEQ ID NO: 191345 - RNA, 22 nt, Human
ugaaugcucacaugccuagguc

SEQ ID NO: 191346 - RNA, 19 nt, Human
ugcagggcugcgccugggg

SEQ ID NO: 191347 - RNA, 22 nt, Human
gugguccugcacccgcuuggcc

SEQ ID NO: 191348 - RNA, 22 nt, Human
gcugggcaugugaccaacagaa

SEQ ID NO: 191349 - RNA, 22 nt, Human
ggcaggcauggccacucccuag

SEQ ID NO: 191350 - RNA, 22 nt, Human
ucuuuaucaggugaagagggac

SEQ ID NO: 191351 - RNA, 22 nt, Human
ugagcuggcuugucaaccaggg

SEQ ID NO: 191352 - RNA, 22 nt, Human
auucuuuggacaauaaguggug

SEQ ID NO: 191353 - RNA, 22 nt, Human
uuccagaaaucuuucagcucaa

SEQ ID NO: 191354 - RNA, 22 nt, Human
agaggucagcugcaugccacau

SEQ ID NO: 191355 - RNA, 22 nt, Human
agguccaguuuucaguucucau

SEQ ID NO: 191356 - RNA, 18 nt, Human
uggcucugcagccagaug

SEQ ID NO: 191357 - RNA, 22 nt, Human
ugucaacagauacuagagagcu

SEQ ID NO: 191358 - RNA, 23 nt, Human
agcagcccagaugccuuccaucc

SEQ ID NO: 191359 - RNA, 22 nt, Human
ugcuuuauucagucucugccau

SEQ ID NO: 191360 - RNA, 23 nt, Human
uuuggcuccauggguggcucauu

SEQ ID NO: 191361 - RNA, 22 nt, Human
cuaauaauagagguggcauuug

SEQ ID NO: 191362 - RNA, 22 nt, Human
ucugggaacugagcuccccuag

SEQ ID NO: 191363 - RNA, 22 nt, Human
cuaguacaauuuuagcaagaug

SEQ ID NO: 191364 - RNA, 22 nt, Human
ucaugcugaggaugcugugaag

SEQ ID NO: 191365 - RNA, 22 nt, Human
auuugggaguugcuagugaguu

SEQ ID NO: 191366 - RNA, 22 nt, Human
gugcaaaaguaacugugguuuu

SEQ ID NO: 191367 - RNA, 22 nt, Human
auagaauagcauagaaaauuga

SEQ ID NO: 191368 - RNA, 22 nt, Human
cagucuucuaaccuagcagccu

SEQ ID NO: 191369 - RNA, 20 nt, Human
agcaggccuuggggagagga

SEQ ID NO: 191370 - RNA, 22 nt, Human
caggccaccagauacaugcccc

SEQ ID NO: 191371 - RNA, 22 nt, Human
cuguccucaacccauccuucuc

SEQ ID NO: 191372 - RNA, 21 nt, Human
agacagacugccugacccacg

SEQ ID NO: 191373 - RNA, 20 nt, Human
agugugcauuuagagucugc

SEQ ID NO: 191374 - RNA, 22 nt, Human
acagggccuuauauccagaagg

SEQ ID NO: 191375 - RNA, 22 nt, Human
agcuuccacaucugucuucagu

SEQ ID NO: 191376 - RNA, 22 nt, Human
cagaacugagucucauggccau

SEQ ID NO: 191377 - RNA, 22 nt, Human
caguccuuaaggaaacauuugu

SEQ ID NO: 191378 - RNA, 22 nt, Human
uggguccaguguccuggcuaug

SEQ ID NO: 191379 - RNA, 22 nt, Human
cacauguaguaagcaggcaaug

SEQ ID NO: 191380 - RNA, 22 nt, Human
ugcaguggaggccgugagacag

SEQ ID NO: 191381 - RNA, 22 nt, Human
ugugugaggugguucugagaag

SEQ ID NO: 191382 - RNA, 22 nt, Human
cugccaggugccuuugugcagu

SEQ ID NO: 191383 - RNA, 22 nt, Human
uaccaugucaagcgagacaugu

SEQ ID NO: 191384 - RNA, 22 nt, Human
uuucuauuguaagucuccuaua

SEQ ID NO: 191385 - RNA, 22 nt, Human
uucuuuggaauaagucaagcug

SEQ ID NO: 191386 - RNA, 22 nt, Human
aaggaaaucuuuguaacaucuu

SEQ ID NO: 191387 - RNA, 22 nt, Human
guuuuucuaaguagcgauauuu

SEQ ID NO: 191388 - RNA, 22 nt, Human
aguguuuuauuagaacacagcc

SEQ ID NO: 191389 - RNA, 21 nt, Human
gggaucugaggcaagucuccu

SEQ ID NO: 191390 - RNA, 22 nt, Human
aguuguaagaggcacaaggaag

SEQ ID NO: 191391 - RNA, 22 nt, Human
aggcuggcauacauuuguucuu

SEQ ID NO: 191392 - RNA, 22 nt, Human
acagagacuaagcuuuucauca

SEQ ID NO: 191393 - RNA, 22 nt, Human
ucucugggaaauggagaauuuu

SEQ ID NO: 191394 - RNA, 22 nt, Human
agguccugucuaucacccucgc

SEQ ID NO: 191395 - RNA, 22 nt, Human
caugcuguugaauaugacauug

SEQ ID NO: 191396 - RNA, 21 nt, Human
acagugugcuucucucccucc

SEQ ID NO: 191397 - RNA, 22 nt, Human
gacuucuauuaauaccucuacu

SEQ ID NO: 191398 - RNA, 22 nt, Human
accaggcccauguggauuacua

SEQ ID NO: 191399 - RNA, 22 nt, Human
gcauucauguccuuccugaacg

SEQ ID NO: 191400 - RNA, 22 nt, Human
uuaauuacuggcauggugguug

SEQ ID NO: 191401 - RNA, 22 nt, Human
uuuauaaacaguaccacggugc

SEQ ID NO: 191402 - RNA, 22 nt, Human
aggcugaggaucguacuuucca

SEQ ID NO: 191403 - RNA, 22 nt, Human
cugagcagcguggggagcuggc

SEQ ID NO: 191404 - RNA, 22 nt, Human
agaagcuaauucaugucuuaug

SEQ ID NO: 191405 - RNA, 18 nt, Human
ucagccuguugucugccu

SEQ ID NO: 191406 - RNA, 23 nt, Human
uaugaacugcauugcuggugugu

SEQ ID NO: 191407 - RNA, 22 nt, Human
cauguaaaaagaagaaucugga

SEQ ID NO: 191408 - RNA, 22 nt, Human
ucucuggccgagagucccuggg

SEQ ID NO: 191409 - RNA, 22 nt, Human
ugauuuaugaccaaguuagaau

SEQ ID NO: 191410 - RNA, 22 nt, Human
ggagacaggguugaaccacgca

SEQ ID NO: 191411 - RNA, 22 nt, Human
aggagcugaagucucugcacuc

SEQ ID NO: 191412 - RNA, 22 nt, Human
uacuuacagagcuuauaaguua

SEQ ID NO: 191413 - RNA, 22 nt, Human
caggcucuuuugguggcaagga

SEQ ID NO: 191414 - RNA, 20 nt, Human
caggcuccgcaggacuaggg

SEQ ID NO: 191415 - RNA, 19 nt, Human
gucagcaccauggacaggg

SEQ ID NO: 191416 - RNA, 22 nt, Human
acugugcaugguauccuugaug

SEQ ID NO: 191417 - RNA, 22 nt, Human
auauucacuccuggugagacua

SEQ ID NO: 191418 - RNA, 22 nt, Human
cccacugcugcucuccauggca

SEQ ID NO: 191419 - RNA, 22 nt, Human
cuguuguucaucaucugucauu

SEQ ID NO: 191420 - RNA, 22 nt, Human
uuuguucaacaggugaaauaga

SEQ ID NO: 191421 - RNA, 22 nt, Human
gagaugguguuccacugccagu

SEQ ID NO: 191422 - RNA, 22 nt, Human
auuugguuacucaguugucuga

SEQ ID NO: 191423 - RNA, 22 nt, Human
uuuggcgucucucaggagcuca

SEQ ID NO: 191424 - RNA, 19 nt, Human
agaggcaaggguggaagua

SEQ ID NO: 191425 - RNA, 22 nt, Human
gagaagcucuagagguguuuuu

SEQ ID NO: 191426 - RNA, 22 nt, Human
cccaguggggagcugagguuca

SEQ ID NO: 191427 - RNA, 22 nt, Human
acagggcaugugcaagagacau

SEQ ID NO: 191428 - RNA, 22 nt, Human
cugcagcugggccagggccacc

SEQ ID NO: 191429 - RNA, 23 nt, Human
ucuugaaaagccuacagcaguuc

SEQ ID NO: 191430 - RNA, 22 nt, Human
ccaguuacaagugauucuuggu

SEQ ID NO: 191431 - RNA, 22 nt, Human
cuuugcaaacgauuaccacaug

SEQ ID NO: 191432 - RNA, 22 nt, Human
uuuuccuucugauacuccauuu

SEQ ID NO: 191433 - RNA, 22 nt, Human
uagugcagguuaauaggacuuc

SEQ ID NO: 191434 - RNA, 22 nt, Human
ugucuucaggaguaaauaucau

SEQ ID NO: 191435 - RNA, 22 nt, Human
ccaauacacuuuauagaagaaa

SEQ ID NO: 191436 - RNA, 22 nt, Human
gucccagggagguucagggcuu

SEQ ID NO: 191437 - RNA, 19 nt, Human
aaggugucccaacugcguu

SEQ ID NO: 191438 - RNA, 22 nt, Human
cugaaggauuuaguucuuugcu

SEQ ID NO: 191439 - RNA, 22 nt, Human
ugcucuggaauaguccuaggca

SEQ ID NO: 191440 - RNA, 18 nt, Human
uuaaggauaagcagacua

SEQ ID NO: 191441 - RNA, 22 nt, Human
uucuagauugccuguaaguaaa

SEQ ID NO: 191442 - RNA, 22 nt, Human
ccucuguacagccucuuuauug

SEQ ID NO: 191443 - RNA, 22 nt, Human
acacaugcacaacaguucuuuc

SEQ ID NO: 191444 - RNA, 22 nt, Human
caguaucugucaguaaucaggu

SEQ ID NO: 191445 - RNA, 22 nt, Human
agugaaaugauucugagcaaga

SEQ ID NO: 191446 - RNA, 22 nt, Human
agagaucugucuacuauuuaag

SEQ ID NO: 191447 - RNA, 22 nt, Human
uauguacacacacaugcaugua

SEQ ID NO: 191448 - RNA, 21 nt, Human
agggccugugcucuccagguc

SEQ ID NO: 191449 - RNA, 22 nt, Human
gcagagguccuagccaggaguc

SEQ ID NO: 191450 - RNA, 22 nt, Human
agauggcuuccuucucacugug

SEQ ID NO: 191451 - RNA, 18 nt, Human
gugcugugggcaguggcc

SEQ ID NO: 191452 - RNA, 21 nt, Human
cccaggcugaauuaaaaauau

SEQ ID NO: 191453 - RNA, 22 nt, Human
ucacaccuugcuggcugagugc

SEQ ID NO: 191454 - RNA, 22 nt, Human
uacagagaauaauaggacaggu

SEQ ID NO: 191455 - RNA, 22 nt, Human
uagauuuaagacccugaauuug

SEQ ID NO: 191456 - RNA, 22 nt, Human
accgggaaguccugcacugggc

SEQ ID NO: 191457 - RNA, 21 nt, Human
aaucaguacauacugcacauc

SEQ ID NO: 191458 - RNA, 22 nt, Human
uuucuuugagucucaguuugcu

SEQ ID NO: 191459 - RNA, 22 nt, Human
uccuucuuucccccuagucauu

SEQ ID NO: 191460 - RNA, 22 nt, Human
aggccaggcaacauucugaagu

SEQ ID NO: 191461 - RNA, 22 nt, Human
guauacaugugguaaaaugcac

SEQ ID NO: 191462 - RNA, 22 nt, Human
aggguggcacugguggcucuau

SEQ ID NO: 191463 - RNA, 22 nt, Human
cagaccucaguccucaguagga

SEQ ID NO: 191464 - RNA, 19 nt, Human
uguuggugcggauguggag

SEQ ID NO: 191465 - RNA, 22 nt, Human
gcucagagaagcgguuucgccu

SEQ ID NO: 191466 - RNA, 22 nt, Human
uauucugugugauauguaaaug

SEQ ID NO: 191467 - RNA, 22 nt, Human
uucaggauucucucccauuuac

SEQ ID NO: 191468 - RNA, 22 nt, Human
uauuccagguauucuucaagag

SEQ ID NO: 191469 - RNA, 22 nt, Human
ugaguccacuuuaaaaugucag

SEQ ID NO: 191470 - RNA, 22 nt, Human
gccuggcuccuaaggacuggcu

SEQ ID NO: 191471 - RNA, 22 nt, Human
uaggacuugguuugaagauuuu

SEQ ID NO: 191472 - RNA, 22 nt, Human
uuggcaguagugguaguacauu

SEQ ID NO: 191473 - RNA, 22 nt, Human
cuauauuucuuggcuuuaaaca

SEQ ID NO: 191474 - RNA, 22 nt, Human
guauuucaucuugaaaaccagu

SEQ ID NO: 191475 - RNA, 23 nt, Human
ccagggaaggccaucuucaacug

SEQ ID NO: 191476 - RNA, 22 nt, Human
gcuuaucuugaaauccaccagc

SEQ ID NO: 191477 - RNA, 22 nt, Human
agacauuuccuagacaucaaug

SEQ ID NO: 191478 - RNA, 22 nt, Human
agaagcuauaacaacaauuaua

SEQ ID NO: 191479 - RNA, 19 nt, Human
gcgaggaagucacuguggc

SEQ ID NO: 191480 - RNA, 22 nt, Human
agcagacaauugccuggaugga

SEQ ID NO: 191481 - RNA, 22 nt, Human
uuccugaagucaaagaucuaaa

SEQ ID NO: 191482 - RNA, 22 nt, Human
ugugugcacgcugggagcugga

SEQ ID NO: 191483 - RNA, 22 nt, Human
uuuucuuccuggauuuuggcau

SEQ ID NO: 191484 - RNA, 22 nt, Human
gcuucaggaggucggucuccuu

SEQ ID NO: 191485 - RNA, 22 nt, Human
aggacaggauugagcugaacug

SEQ ID NO: 191486 - RNA, 22 nt, Human
ucucuguguguuggcuguauau

SEQ ID NO: 191487 - RNA, 22 nt, Human
caguagcaggcacucagcacgu

SEQ ID NO: 191488 - RNA, 22 nt, Human
uuuauucugugcuacaugaaga

SEQ ID NO: 191489 - RNA, 22 nt, Human
cagcagcuccucugcggcuaug

SEQ ID NO: 191490 - RNA, 22 nt, Human
ugcucuggggagcuccucugcg

SEQ ID NO: 191491 - RNA, 22 nt, Human
acgguaacagauaccacagacu

SEQ ID NO: 191492 - RNA, 22 nt, Human
cagaauaaacagaaacguagcu

SEQ ID NO: 191493 - RNA, 22 nt, Human
uuauuuacaacucuucucuucc

SEQ ID NO: 191494 - RNA, 22 nt, Human
ggcaccaggacaugacucccag

SEQ ID NO: 191495 - RNA, 22 nt, Human
agcuaagaacuugagcucugga

SEQ ID NO: 191496 - RNA, 22 nt, Human
gcagggcuguucaggagggugg

SEQ ID NO: 191497 - RNA, 22 nt, Human
acacaugaguucucaucuugug

SEQ ID NO: 191498 - RNA, 22 nt, Human
gcaaaguaaaaauagauucuga

SEQ ID NO: 191499 - RNA, 22 nt, Human
ggguaggcucugcaggcugggu

SEQ ID NO: 191500 - RNA, 22 nt, Human
cugcagcuccuucuggcaugug

SEQ ID NO: 191501 - RNA, 22 nt, Human
uccuggucagugccaaacuggu

SEQ ID NO: 191502 - RNA, 21 nt, Human
ucugaugguagaugagaugug

SEQ ID NO: 191503 - RNA, 20 nt, Human
acaaagacuggaaaagcaag

SEQ ID NO: 191504 - RNA, 22 nt, Human
uauucagaauaaagacuacauu

SEQ ID NO: 191505 - RNA, 19 nt, Human
ccucagagcuagugaacau

SEQ ID NO: 191506 - RNA, 22 nt, Human
caaaauuagaaaugcagcuguu

SEQ ID NO: 191507 - RNA, 22 nt, Human
aaagccagggacagugugcaug

SEQ ID NO: 191508 - RNA, 22 nt, Human
ucugccuuagcaauugucaagg

SEQ ID NO: 191509 - RNA, 22 nt, Human
ucccugagcuucaucaggcuuu

SEQ ID NO: 191510 - RNA, 22 nt, Human
uuacaugggccauuuagacaug

SEQ ID NO: 191511 - RNA, 22 nt, Human
uggucagacaaaggagaauguu

SEQ ID NO: 191512 - RNA, 22 nt, Human
cagaaagaccugauuggcaguu

SEQ ID NO: 191513 - RNA, 22 nt, Human
guccaugacugugacucacaug

SEQ ID NO: 191514 - RNA, 22 nt, Human
acucagaguuugcguuccauac

SEQ ID NO: 191515 - RNA, 22 nt, Human
agcauuagauuaaaaauuuaga

SEQ ID NO: 191516 - RNA, 21 nt, Human
ucuccaguauccuucucugag

SEQ ID NO: 191517 - RNA, 22 nt, Human
uuugcugaacuaaaauucugaa

SEQ ID NO: 191518 - RNA, 22 nt, Human
cauaacuugguguuggaaacug

SEQ ID NO: 191519 - RNA, 22 nt, Human
cuccuggccacguucuugcugg

SEQ ID NO: 191520 - RNA, 22 nt, Human
ucauguuuguuggaaauguggc

SEQ ID NO: 191521 - RNA, 22 nt, Human
uggaaacuuaucugacacgaac

SEQ ID NO: 191522 - RNA, 22 nt, Human
ucccuccuuuaucaaaaagaga

SEQ ID NO: 191523 - RNA, 22 nt, Human
gagcucuuccuuucaggaggcc

SEQ ID NO: 191524 - RNA, 22 nt, Human
aagagacuggaaacuaggguca

SEQ ID NO: 191525 - RNA, 22 nt, Human
uagggaugacgaaaggacagag

SEQ ID NO: 191526 - RNA, 22 nt, Human
gggagggucugagagcugcacc

SEQ ID NO: 191527 - RNA, 22 nt, Human
cccagcuguaacgggucugcac

SEQ ID NO: 191528 - RNA, 22 nt, Human
ugugugugacaaccuaguucag

SEQ ID NO: 191529 - RNA, 22 nt, Human
gaccuggaggauccucuucuug

SEQ ID NO: 191530 - RNA, 22 nt, Human
ccuccccacaggccaaauaggc

SEQ ID NO: 191531 - RNA, 22 nt, Human
cagucuuauccugaaaacaaca

SEQ ID NO: 191532 - RNA, 22 nt, Human
uucaagcagagauauuucaaga

SEQ ID NO: 191533 - RNA, 22 nt, Human
uaguuuuagucccauuuuacag

SEQ ID NO: 191534 - RNA, 22 nt, Human
auguccagaguaaagcacauuc

SEQ ID NO: 191535 - RNA, 22 nt, Human
cuacagugaagacuagcuauag

SEQ ID NO: 191536 - RNA, 19 nt, Human
uaugacaaguacuaguucu

SEQ ID NO: 191537 - RNA, 22 nt, Human
agagcuuuguuugauugucaga

SEQ ID NO: 191538 - RNA, 22 nt, Human
gcaaagcaucaguagaaauguu

SEQ ID NO: 191539 - RNA, 22 nt, Human
cugguaaagaagacaaacaggg

SEQ ID NO: 191540 - RNA, 20 nt, Human
guucaugucucaaauagaaa

SEQ ID NO: 191541 - RNA, 20 nt, Human
cagguauuacuuccuuuaug

SEQ ID NO: 191542 - RNA, 21 nt, Human
uggggaggggaccugauuaug

SEQ ID NO: 191543 - RNA, 21 nt, Human
uccugugaggaccugucagug

SEQ ID NO: 191544 - RNA, 22 nt, Human
acaaggacauaggaaacuacaa

SEQ ID NO: 191545 - RNA, 22 nt, Human
aucuuuuuacuaacacugcuua

SEQ ID NO: 191546 - RNA, 22 nt, Human
uguguacacaaugauugcagag

SEQ ID NO: 191547 - RNA, 22 nt, Human
auuuucaagggagaggccucug

SEQ ID NO: 191548 - RNA, 22 nt, Human
uggcaaagaccgcaauuacuuu

SEQ ID NO: 191549 - RNA, 22 nt, Human
gaacaauagugguaacaaagcc

SEQ ID NO: 191550 - RNA, 22 nt, Human
uauuaggguuuugaagguuugu

SEQ ID NO: 191551 - RNA, 22 nt, Human
uaacacugugguguucuuuguc

SEQ ID NO: 191552 - RNA, 22 nt, Human
ucccagagccucugccacucug

SEQ ID NO: 191553 - RNA, 22 nt, Human
uaaaaugaucucucauguucuu

SEQ ID NO: 191554 - RNA, 22 nt, Human
uuauauguaugcuuauaaacca

SEQ ID NO: 191555 - RNA, 22 nt, Human
uuaaaagggauguuaucuguaa

SEQ ID NO: 191556 - RNA, 22 nt, Human
cuucauuaaccaaaaugcaaua

SEQ ID NO: 191557 - RNA, 22 nt, Human
agguccagaacgugccuacucu

SEQ ID NO: 191558 - RNA, 22 nt, Human
gccuggcugggcaccaggggag

SEQ ID NO: 191559 - RNA, 22 nt, Human
uuugcaaagugacuauuauaug

SEQ ID NO: 191560 - RNA, 22 nt, Human
ucagggcucagcaucuggcauu

SEQ ID NO: 191561 - RNA, 22 nt, Human
gauguguagagggaauuucaaa

SEQ ID NO: 191562 - RNA, 22 nt, Human
guuuggugguagcauuggcuau

SEQ ID NO: 191563 - RNA, 22 nt, Human
auauuaguuuggagacuacaau

SEQ ID NO: 191564 - RNA, 22 nt, Human
ugcgcaggagcucugccaggag

SEQ ID NO: 191565 - RNA, 22 nt, Human
acccacccuacuagcagugucc

SEQ ID NO: 191566 - RNA, 23 nt, Human
caggaaaucaauucuuccagcau

SEQ ID NO: 191567 - RNA, 22 nt, Human
acaaauguggacauggauaaug

SEQ ID NO: 191568 - RNA, 22 nt, Human
ggcagcccuguggagaggccca

SEQ ID NO: 191569 - RNA, 22 nt, Human
agauuuacaaaggauuugcuuu

SEQ ID NO: 191570 - RNA, 22 nt, Human
gcugccuugccaggggcagaaa

SEQ ID NO: 191571 - RNA, 22 nt, Human
ccccuuccuuccucagacagcc

SEQ ID NO: 191572 - RNA, 16 nt, Human
gaggggagcaguaggc

SEQ ID NO: 191573 - RNA, 19 nt, Human
gaaaggcugcugcuaccug

SEQ ID NO: 191574 - RNA, 22 nt, Human
cuagaaccuaggaguacuaaag

SEQ ID NO: 191575 - RNA, 22 nt, Human
ccucugugugugcaugcaugcg

SEQ ID NO: 191576 - RNA, 20 nt, Human
ccagaggguagggccgcccc

SEQ ID NO: 191577 - RNA, 22 nt, Human
cagagugcauggugcuguucau

SEQ ID NO: 191578 - RNA, 22 nt, Human
auacucagcugcuagacagaag

SEQ ID NO: 191579 - RNA, 22 nt, Human
uaacuguaauauaaauaugagu

SEQ ID NO: 191580 - RNA, 22 nt, Human
aggugcugccccgagaaggaug

SEQ ID NO: 191581 - RNA, 22 nt, Human
aaucaguuucuuggcaaguuua

SEQ ID NO: 191582 - RNA, 22 nt, Human
cucugggcuucaagucagauuu

SEQ ID NO: 191583 - RNA, 22 nt, Human
agcgggucugcaagccuucccu

SEQ ID NO: 191584 - RNA, 22 nt, Human
ugggccagcugaagugccgccc

SEQ ID NO: 191585 - RNA, 22 nt, Human
accacaggacccaugagucagu

SEQ ID NO: 191586 - RNA, 22 nt, Human
aaaucaugguggaagaaacaga

SEQ ID NO: 191587 - RNA, 22 nt, Human
auucacaugugcuucuuaucac

SEQ ID NO: 191588 - RNA, 23 nt, Human
aacacaaagcugauuccaguggc

SEQ ID NO: 191589 - RNA, 22 nt, Human
uuucuuucaauucuccuaaugc

SEQ ID NO: 191590 - RNA, 22 nt, Human
gaauuucuggacccuuugagaa

SEQ ID NO: 191591 - RNA, 22 nt, Human
ucaguuuauggucuaguucaug

SEQ ID NO: 191592 - RNA, 22 nt, Human
acuuggccuuauuuccacagaa

SEQ ID NO: 191593 - RNA, 22 nt, Human
aauacuuuugaacugaaaggca

SEQ ID NO: 191594 - RNA, 22 nt, Human
guggcagugccguuugguucag

SEQ ID NO: 191595 - RNA, 22 nt, Human
gccagagcaugcacugccugca

SEQ ID NO: 191596 - RNA, 22 nt, Human
uaaagccacgcuggaaaucagg

SEQ ID NO: 191597 - RNA, 22 nt, Human
gagggccaauggauuucaacug

SEQ ID NO: 191598 - RNA, 22 nt, Human
agcaccaucggguucuugcuuu

SEQ ID NO: 191599 - RNA, 22 nt, Human
agaaaccaucuuuauauaucug

SEQ ID NO: 191600 - RNA, 21 nt, Human
ggcugagauggcagaaucacc

SEQ ID NO: 191601 - RNA, 22 nt, Human
gaugcaggauagcuucacccag

SEQ ID NO: 191602 - RNA, 22 nt, Human
aacauugcugaaagcugggaca

SEQ ID NO: 191603 - RNA, 22 nt, Human
agugacugguuuugacaggaau

SEQ ID NO: 191604 - RNA, 22 nt, Human
ucuuacauauagcaugaguaca

SEQ ID NO: 191605 - RNA, 22 nt, Human
uguuaaaugcucagcucgggga

SEQ ID NO: 191606 - RNA, 22 nt, Human
aagcaggcucacgccaggcagu

SEQ ID NO: 191607 - RNA, 22 nt, Human
uggcacagacagcacagcaaug

SEQ ID NO: 191608 - RNA, 22 nt, Human
ggcagaagauaggacagggaau

SEQ ID NO: 191609 - RNA, 22 nt, Human
aaaccacacuuagcaguuucgu

SEQ ID NO: 191610 - RNA, 22 nt, Human
ggacagggaucauuaucugagc

SEQ ID NO: 191611 - RNA, 22 nt, Human
ggcccugcaugagauuaagguu

SEQ ID NO: 191612 - RNA, 22 nt, Human
aaacaggcacauaguaacauuu

SEQ ID NO: 191613 - RNA, 22 nt, Human
ggucacugucugagguacugga

SEQ ID NO: 191614 - RNA, 22 nt, Human
aucaggauuauuaaaucuggau

SEQ ID NO: 191615 - RNA, 22 nt, Human
aacugacagcaggaaccauucc

SEQ ID NO: 191616 - RNA, 22 nt, Human
cccugggcagucugcacuucag

SEQ ID NO: 191617 - RNA, 23 nt, Human
aucauucuccaaucuggagcagg

SEQ ID NO: 191618 - RNA, 22 nt, Human
aucauaaaccacuuuguaaucu

SEQ ID NO: 191619 - RNA, 22 nt, Human
aagucagaaaucaucuagugua

SEQ ID NO: 191620 - RNA, 22 nt, Human
ugcagagguuuccaggcaaguu

SEQ ID NO: 191621 - RNA, 22 nt, Human
uacaugugcacgugugacuuug

SEQ ID NO: 191622 - RNA, 22 nt, Human
ugguagcaacaucucaguggcu

SEQ ID NO: 191623 - RNA, 22 nt, Human
ucuguuaaaaguggaauaauag

SEQ ID NO: 191624 - RNA, 22 nt, Human
uagaaagacuguccagauuuca

SEQ ID NO: 191625 - RNA, 22 nt, Human
ccacagaaaguugucuagagua

SEQ ID NO: 191626 - RNA, 22 nt, Human
gugaagcauaacugaaggauuu

SEQ ID NO: 191627 - RNA, 22 nt, Human
caguagacacauuaauauggaa

SEQ ID NO: 191628 - RNA, 22 nt, Human
agccugcuugagaguccuggcu

SEQ ID NO: 191629 - RNA, 22 nt, Human
cagcccugcacgcugccuccgc

SEQ ID NO: 191630 - RNA, 22 nt, Human
ccaguguuuccgucaguacacg

SEQ ID NO: 191631 - RNA, 22 nt, Human
auguacauuuuccuaauguuuu

SEQ ID NO: 191632 - RNA, 22 nt, Human
auauuucucucagacauggaag

SEQ ID NO: 191633 - RNA, 22 nt, Human
cugagcugcggcaggcaccugg

SEQ ID NO: 191634 - RNA, 22 nt, Human
uucugcuuucaguucuucuggg

SEQ ID NO: 191635 - RNA, 22 nt, Human
accuugucugugcaccugggcu

SEQ ID NO: 191636 - RNA, 22 nt, Human
uauguuacuucuguaucugcuu

SEQ ID NO: 191637 - RNA, 22 nt, Human
ucuucuccuuugccauguguuu

SEQ ID NO: 191638 - RNA, 22 nt, Human
cggcaggugugcucacucugcc

SEQ ID NO: 191639 - RNA, 22 nt, Human
ggcaggugccaguuggcuuggg

SEQ ID NO: 191640 - RNA, 22 nt, Human
auccauuauugggccaauaaag

SEQ ID NO: 191641 - RNA, 22 nt, Human
ugauuuuuagcuauucugaaga

SEQ ID NO: 191642 - RNA, 21 nt, Human
ucaauacaggugcaugugucu

SEQ ID NO: 191643 - RNA, 22 nt, Human
caggccagugugcuucccaggc

SEQ ID NO: 191644 - RNA, 22 nt, Human
cugaggaaugagugaggagcca

SEQ ID NO: 191645 - RNA, 22 nt, Human
auggaaauguaacuucugauuc

SEQ ID NO: 191646 - RNA, 22 nt, Human
ugcugaggucacggcggccaga

SEQ ID NO: 191647 - RNA, 21 nt, Human
gcccacagugaggaggauccc

SEQ ID NO: 191648 - RNA, 22 nt, Human
ccugaguccccucauucacucu

SEQ ID NO: 191649 - RNA, 22 nt, Human
ggacagaaauucuuguuggaca

SEQ ID NO: 191650 - RNA, 22 nt, Human
gacaagacuauguagaaaguau

SEQ ID NO: 191651 - RNA, 22 nt, Human
ucugggaagcugguccuguucu

SEQ ID NO: 191652 - RNA, 22 nt, Human
uaugauaugcacuuuaucagaa

SEQ ID NO: 191653 - RNA, 19 nt, Human
ucucuggcauagacucaau

SEQ ID NO: 191654 - RNA, 22 nt, Human
aucaagaaaagugcuuucggcu

SEQ ID NO: 191655 - RNA, 22 nt, Human
aauaaaguagcguuuaaggugc

SEQ ID NO: 191656 - RNA, 22 nt, Human
cccugaggaaaggguggagggc

SEQ ID NO: 191657 - RNA, 22 nt, Human
ugcaggagcugcuguccugcuc

SEQ ID NO: 191658 - RNA, 22 nt, Human
acugcaaucuggauccuagaag

SEQ ID NO: 191659 - RNA, 22 nt, Human
caggcacgguggcucaugccug

SEQ ID NO: 191660 - RNA, 22 nt, Human
uccaggcaggguuaaggguccu

SEQ ID NO: 191661 - RNA, 22 nt, Human
agcagggcugcagugugucuuu

SEQ ID NO: 191662 - RNA, 22 nt, Human
gcaggcagagaaggaacauuua

SEQ ID NO: 191663 - RNA, 22 nt, Human
caggguggggcuggcuaucaaa

SEQ ID NO: 191664 - RNA, 22 nt, Human
ucugugcugagcucugagaugu

SEQ ID NO: 191665 - RNA, 22 nt, Human
caauaauuuacauuggauacca

SEQ ID NO: 191666 - RNA, 22 nt, Human
ugguacaagauguucuaacuga

SEQ ID NO: 191667 - RNA, 22 nt, Human
uuccugcuuccuggccucacaa

SEQ ID NO: 191668 - RNA, 22 nt, Human
gaaauccaguucccuacucuua

SEQ ID NO: 191669 - RNA, 22 nt, Human
gggucuggagggcagcccuucu

SEQ ID NO: 191670 - RNA, 22 nt, Human
gagggagggacuagcauucucu

SEQ ID NO: 191671 - RNA, 22 nt, Human
ucaggaaauggugauuugguug

SEQ ID NO: 191672 - RNA, 22 nt, Human
cauucccacguguucuuugcuu

SEQ ID NO: 191673 - RNA, 22 nt, Human
cugggaaauauaauaaaguggu

SEQ ID NO: 191674 - RNA, 22 nt, Human
ugccucaguuucuccauaugaa

SEQ ID NO: 191675 - RNA, 22 nt, Human
acaggcaggcuucggccagagc

SEQ ID NO: 191676 - RNA, 22 nt, Human
ggaggccucaguaccuugcuuu

SEQ ID NO: 191677 - RNA, 22 nt, Human
ugagccagauaagggcucacgc

SEQ ID NO: 191678 - RNA, 22 nt, Human
uaccauuucaguaaaaacuuag

SEQ ID NO: 191679 - RNA, 22 nt, Human
gcuccaaaguccagcuguuucc

SEQ ID NO: 191680 - RNA, 18 nt, Human
ugucucaguucugcuaug

SEQ ID NO: 191681 - RNA, 22 nt, Human
cagcagcaguguucuagaaucu

SEQ ID NO: 191682 - RNA, 22 nt, Human
gguggcauaagaacacuaaaga

SEQ ID NO: 191683 - RNA, 22 nt, Human
guggcagggcaaugcucccucu

SEQ ID NO: 191684 - RNA, 22 nt, Human
gcugugcaguaguagguacagu

SEQ ID NO: 191685 - RNA, 22 nt, Human
ucuguagucugugccauagcug

SEQ ID NO: 191686 - RNA, 22 nt, Human
agaaucuaaguacacagacaga

SEQ ID NO: 191687 - RNA, 22 nt, Human
uguucacaggggagccauuuau

SEQ ID NO: 191688 - RNA, 22 nt, Human
ugaaaucuacccuauucagggu

SEQ ID NO: 191689 - RNA, 22 nt, Human
cuguggcuuugcagggcuuguu

SEQ ID NO: 191690 - RNA, 22 nt, Human
ugcucagcagaucucaggagau

SEQ ID NO: 191691 - RNA, 22 nt, Human
agggucagcuggcugucagggg

SEQ ID NO: 191692 - RNA, 22 nt, Human
uguauacauuuaacuagauaga

SEQ ID NO: 191693 - RNA, 21 nt, Human
aagaguggcugaggaggugau

SEQ ID NO: 191694 - RNA, 23 nt, Human
uuucucaaagaguggcagcuuca

SEQ ID NO: 191695 - RNA, 22 nt, Human
gggucugagcugaggggaaauc

SEQ ID NO: 191696 - RNA, 22 nt, Human
agcugagguuaguauaaaugug

SEQ ID NO: 191697 - RNA, 22 nt, Human
uggaaaacaaagcucucauuau

SEQ ID NO: 191698 - RNA, 22 nt, Human
aagugugggacuagggcuccag

SEQ ID NO: 191699 - RNA, 22 nt, Human
agauugaagacugguggagcug

SEQ ID NO: 191700 - RNA, 22 nt, Human
cagcuccugccugggcagcugu

SEQ ID NO: 191701 - RNA, 19 nt, Human
uggggcuguguuuugaccc

SEQ ID NO: 191702 - RNA, 22 nt, Human
acaguguuuuagaaaagcuuga

SEQ ID NO: 191703 - RNA, 22 nt, Human
ccagaggugccacagaaagagc

SEQ ID NO: 191704 - RNA, 19 nt, Human
ugagcaugcgagcugagaa

SEQ ID NO: 191705 - RNA, 22 nt, Human
aucucagaaaguuuaauuuuuc

SEQ ID NO: 191706 - RNA, 22 nt, Human
aaagagcccuuccaugacucuu

SEQ ID NO: 191707 - RNA, 22 nt, Human
uaguggcaaaagcauuuugggu

SEQ ID NO: 191708 - RNA, 22 nt, Human
ccucuggcagccagccaguugu

SEQ ID NO: 191709 - RNA, 19 nt, Human
aucuaagagaugggggaaa

SEQ ID NO: 191710 - RNA, 22 nt, Human
uuucugcaaguguagauaccca

SEQ ID NO: 191711 - RNA, 22 nt, Human
gaacaaacugggucccaaugau

SEQ ID NO: 191712 - RNA, 22 nt, Human
aauucaaauuacaauaguuguu

SEQ ID NO: 191713 - RNA, 22 nt, Human
cugagcccgggugcucuacccc

SEQ ID NO: 191714 - RNA, 22 nt, Human
gggaggugaaaggucaugugug

SEQ ID NO: 191715 - RNA, 22 nt, Human
uuuguggcaggagcggagaccg

SEQ ID NO: 191716 - RNA, 22 nt, Human
cuuccaaaauuuauauguugaa

SEQ ID NO: 191717 - RNA, 22 nt, Human
cacaggagagguuaaugggggc

SEQ ID NO: 191718 - RNA, 21 nt, Human
uuagcuuucuagaaucuuugu

SEQ ID NO: 191719 - RNA, 22 nt, Human
gcuaucuuucugcaccauaauu

SEQ ID NO: 191720 - RNA, 22 nt, Human
aucauguacuugacaaauaugu

SEQ ID NO: 191721 - RNA, 22 nt, Human
uguccugcaagcccuaaugaau

SEQ ID NO: 191722 - RNA, 22 nt, Human
acacaaaaucaaaguccuaggc

SEQ ID NO: 191723 - RNA, 22 nt, Human
gaauuguaaguaccagcaugcu

SEQ ID NO: 191724 - RNA, 22 nt, Human
ccagaggagcaggcuggcucca

SEQ ID NO: 191725 - RNA, 22 nt, Human
caggaaaugcuaucauagcuga

SEQ ID NO: 191726 - RNA, 22 nt, Human
aggaggcugggcacaguggccu

SEQ ID NO: 191727 - RNA, 22 nt, Human
uacuauuuuugcaacguauaca

SEQ ID NO: 191728 - RNA, 22 nt, Human
aauauuuguuaguguuuuaaug

SEQ ID NO: 191729 - RNA, 22 nt, Human
aaagucaucuaggagcagauuu

SEQ ID NO: 191730 - RNA, 22 nt, Human
ugcaucaaauucugaaauuagc

SEQ ID NO: 191731 - RNA, 22 nt, Human
aaccuguucccugguccuugac

SEQ ID NO: 191732 - RNA, 22 nt, Human
uguccuggggcgacuuggggcc

SEQ ID NO: 191733 - RNA, 22 nt, Human
ugcaagagcccaaacuauauac

SEQ ID NO: 191734 - RNA, 22 nt, Human
gccagcagggaagccuugggcu

SEQ ID NO: 191735 - RNA, 22 nt, Human
aaguguuuacuuaaagucaugg

SEQ ID NO: 191736 - RNA, 22 nt, Human
ccaaaauuauuacauuuguagg

SEQ ID NO: 191737 - RNA, 22 nt, Human
ucauucacuuugaaauaaacga

SEQ ID NO: 191738 - RNA, 22 nt, Human
ucuggcaggucaaucauucuuu

SEQ ID NO: 191739 - RNA, 22 nt, Human
gaaaguauucacaaaguucuug

SEQ ID NO: 191740 - RNA, 20 nt, Human
auguggcuuuuugaccugcu

SEQ ID NO: 191741 - RNA, 22 nt, Human
uccuggccuugcuccugaugcc

SEQ ID NO: 191742 - RNA, 22 nt, Human
guuccacaaaaggucuaguuua

SEQ ID NO: 191743 - RNA, 22 nt, Human
aagcaggcccugggccagggga

SEQ ID NO: 191744 - RNA, 22 nt, Human
uguguccugcagacagacucag

SEQ ID NO: 191745 - RNA, 22 nt, Human
cagggacauaagaggaacaugg

SEQ ID NO: 191746 - RNA, 22 nt, Human
caccuguuguuuauucaucucu

SEQ ID NO: 191747 - RNA, 20 nt, Human
ucauuccaaauaguucagca

SEQ ID NO: 191748 - RNA, 22 nt, Human
uuggcccacaguaccaugcugu

SEQ ID NO: 191749 - RNA, 22 nt, Human
caguggccugagccaggcuucc

SEQ ID NO: 191750 - RNA, 22 nt, Human
uaaauuguuuucuagaaguugu

SEQ ID NO: 191751 - RNA, 20 nt, Human
gauacacagcacagagggcc

SEQ ID NO: 191752 - RNA, 22 nt, Human
cucaucugauaaaucacucuua

SEQ ID NO: 191753 - RNA, 22 nt, Human
ccucaggggucacugugaggag

SEQ ID NO: 191754 - RNA, 22 nt, Human
uuugauucuguaaaauaacagg

SEQ ID NO: 191755 - RNA, 22 nt, Human
uggcaucuccgacagucuugau

SEQ ID NO: 191756 - RNA, 22 nt, Human
ucuguucaguugauguaguuuu

SEQ ID NO: 191757 - RNA, 22 nt, Human
ccucagaguuggccacgagagc

SEQ ID NO: 191758 - RNA, 22 nt, Human
uaagaucaguucaaacaugugu

SEQ ID NO: 191759 - RNA, 22 nt, Human
aaacaugagcauuucuguuuaa

SEQ ID NO: 191760 - RNA, 22 nt, Human
uuucaguuacugcuauaucauu

SEQ ID NO: 191761 - RNA, 22 nt, Human
uagaaacauauguuugagacau

SEQ ID NO: 191762 - RNA, 22 nt, Human
uccuggggaggguucuggcucc

SEQ ID NO: 191763 - RNA, 22 nt, Human
cucuuuggucgcaucauccauu

SEQ ID NO: 191764 - RNA, 23 nt, Human
auaagccuuuucuuucugcccca

SEQ ID NO: 191765 - RNA, 21 nt, Human
uucccagcaccuagcacaggu

SEQ ID NO: 191766 - RNA, 22 nt, Human
agguaguguagcugagugggau

SEQ ID NO: 191767 - RNA, 22 nt, Human
uacaggcugaacucaaugauga

SEQ ID NO: 191768 - RNA, 22 nt, Human
gagggagccgccacagacuggg

SEQ ID NO: 191769 - RNA, 22 nt, Human
gaaugauauuauuucgugcugg

SEQ ID NO: 191770 - RNA, 22 nt, Human
uccaaauucuagggccuugguu

SEQ ID NO: 191771 - RNA, 22 nt, Human
aagacacaaagcuucccuuuuc

SEQ ID NO: 191772 - RNA, 22 nt, Human
gucuggaggcccgucagcccua

SEQ ID NO: 191773 - RNA, 22 nt, Human
guccucuuagccacuuaauuau

SEQ ID NO: 191774 - RNA, 22 nt, Human
uucauagacccagaacucauua

SEQ ID NO: 191775 - RNA, 22 nt, Human
uacagauauagagauuuauaga

SEQ ID NO: 191776 - RNA, 22 nt, Human
ggcagcuguuggcucucuagga

SEQ ID NO: 191777 - RNA, 22 nt, Human
gcugauagacugaauguuggga

SEQ ID NO: 191778 - RNA, 22 nt, Human
ggagagcaggguccugagauac

SEQ ID NO: 191779 - RNA, 22 nt, Human
uauacagauaucuaagauguaa

SEQ ID NO: 191780 - RNA, 22 nt, Human
uacccaggggcugagcagaggu

SEQ ID NO: 191781 - RNA, 22 nt, Human
ucugaagacauaugauauggug

SEQ ID NO: 191782 - RNA, 22 nt, Human
agaucagacacggcuugugacg

SEQ ID NO: 191783 - RNA, 20 nt, Human
aggcaagguagaugucugcu

SEQ ID NO: 191784 - RNA, 22 nt, Human
uaagacacauucauaucugucu

SEQ ID NO: 191785 - RNA, 22 nt, Human
uuuuucuacugguguuggugua

SEQ ID NO: 191786 - RNA, 21 nt, Human
ucagacuugagcucuucuaca

SEQ ID NO: 191787 - RNA, 22 nt, Human
aggagcugggcccaaggaugcu

SEQ ID NO: 191788 - RNA, 22 nt, Human
uacaaggcaaauccaugauguc

SEQ ID NO: 191789 - RNA, 22 nt, Human
agauuugggggcuagggcuggu

SEQ ID NO: 191790 - RNA, 22 nt, Human
aucaaaaccuugacuuuuaaug

SEQ ID NO: 191791 - RNA, 22 nt, Human
ggagaggagauuguggcauuuu

SEQ ID NO: 191792 - RNA, 22 nt, Human
caggccagaggcuguuguugcg

SEQ ID NO: 191793 - RNA, 22 nt, Human
gggcuucuauucaagucuguuu

SEQ ID NO: 191794 - RNA, 22 nt, Human
ggcccagaaaaaggcuuagaau

SEQ ID NO: 191795 - RNA, 22 nt, Human
acacuuggagcaacacuuaugg

SEQ ID NO: 191796 - RNA, 22 nt, Human
aguuugauggcuuaauaguaga

SEQ ID NO: 191797 - RNA, 22 nt, Human
augguacaaugauggauagugg

SEQ ID NO: 191798 - RNA, 22 nt, Human
uuccagugugcuuuuauguuag

SEQ ID NO: 191799 - RNA, 22 nt, Human
caaaugauacuguuuuuagucu

SEQ ID NO: 191800 - RNA, 22 nt, Human
agucacaguucugcugucugag

SEQ ID NO: 191801 - RNA, 22 nt, Human
agagccaguuguuaagcacuua

SEQ ID NO: 191802 - RNA, 23 nt, Human
agcaccugugauuuccuagcucu

SEQ ID NO: 191803 - RNA, 22 nt, Human
cuucuggggauggagcccagaa

SEQ ID NO: 191804 - RNA, 22 nt, Human
gacacuuuaggauuuaaaaguc

SEQ ID NO: 191805 - RNA, 22 nt, Human
gcagcccacaccacucugcuca

SEQ ID NO: 191806 - RNA, 22 nt, Human
uacugccuggagcauuggugcu

SEQ ID NO: 191807 - RNA, 22 nt, Human
uugcauuucacuuucaguaggc

SEQ ID NO: 191808 - RNA, 22 nt, Human
ggcucugggucuguggggagcg

SEQ ID NO: 191809 - RNA, 22 nt, Human
ucuucucccaucuccaggcagg

SEQ ID NO: 191810 - RNA, 22 nt, Human
ucucaggacuccucuggccaua

SEQ ID NO: 191811 - RNA, 22 nt, Human
gggugacauuaggaagauagac

SEQ ID NO: 191812 - RNA, 22 nt, Human
cuccaggcgccgcuuuugcagu

SEQ ID NO: 191813 - RNA, 22 nt, Human
uauuucuguuuauuuguacauc

SEQ ID NO: 191814 - RNA, 16 nt, Human
ccccucaggaaguaca

SEQ ID NO: 191815 - RNA, 22 nt, Human
caggcacaggggaaugucuuuu

SEQ ID NO: 191816 - RNA, 22 nt, Human
acaacaaggcuuuucauucaua

SEQ ID NO: 191817 - RNA, 22 nt, Human
uugggaucuacauagcuaugua

SEQ ID NO: 191818 - RNA, 22 nt, Human
uagggauguccugagacuuggc

SEQ ID NO: 191819 - RNA, 22 nt, Human
uugcauucccagccaaguuagu

SEQ ID NO: 191820 - RNA, 22 nt, Human
gauuucucugcacccacucagg

SEQ ID NO: 191821 - RNA, 22 nt, Human
aggcuggagugugcaguggcgc

SEQ ID NO: 191822 - RNA, 22 nt, Human
ccacugaggggucaugguggga

SEQ ID NO: 191823 - RNA, 22 nt, Human
aggcugagggcuccugagggca

SEQ ID NO: 191824 - RNA, 22 nt, Human
cuucagagcaucacuucagcug

SEQ ID NO: 191825 - RNA, 22 nt, Human
ucuuggaaguagaacacagucu

SEQ ID NO: 191826 - RNA, 22 nt, Human
uggaggcaggggauacagguca

SEQ ID NO: 191827 - RNA, 22 nt, Human
cucagcagcuacaggauucggg

SEQ ID NO: 191828 - RNA, 22 nt, Human
ggcuggugaguucagagaaccc

SEQ ID NO: 191829 - RNA, 22 nt, Human
cugugggcugaaagugcucccg

SEQ ID NO: 191830 - RNA, 21 nt, Human
uccauccaucaguccagccag

SEQ ID NO: 191831 - RNA, 22 nt, Human
ucaggaagugguaaaggauguu

SEQ ID NO: 191832 - RNA, 22 nt, Human
gcugggcugcccaaccucugac

SEQ ID NO: 191833 - RNA, 22 nt, Human
gaggcuguuagggccugaggua

SEQ ID NO: 191834 - RNA, 22 nt, Human
uuuagggaaauugaggguuaag

SEQ ID NO: 191835 - RNA, 22 nt, Human
ccucagagguuuucauucugua

SEQ ID NO: 191836 - RNA, 20 nt, Human
ucugagagucugagugauga

SEQ ID NO: 191837 - RNA, 22 nt, Human
cagaguaaggagcugucaaacg

SEQ ID NO: 191838 - RNA, 22 nt, Human
augaaauguaugagucuggguu

SEQ ID NO: 191839 - RNA, 22 nt, Human
ugcuggagucucuugacccugg

SEQ ID NO: 191840 - RNA, 22 nt, Human
gagagugaggcaucaggggcag

SEQ ID NO: 191841 - RNA, 22 nt, Human
caacuuuaugauugguuuguca

SEQ ID NO: 191842 - RNA, 22 nt, Human
agcacacaggccaccuccacuu

SEQ ID NO: 191843 - RNA, 21 nt, Human
ucugccagcugaagaggugga

SEQ ID NO: 191844 - RNA, 23 nt, Human
acugggcuuaugaggaggcuugu

SEQ ID NO: 191845 - RNA, 22 nt, Human
guaugaaagcaucauuccugcu

SEQ ID NO: 191846 - RNA, 22 nt, Human
aaagacugaggggaaagugaug

SEQ ID NO: 191847 - RNA, 22 nt, Human
cacuggcaaauggagagaaugu

SEQ ID NO: 191848 - RNA, 23 nt, Human
aagaggaggcccugcucccgucc

SEQ ID NO: 191849 - RNA, 22 nt, Human
ugccugccacgcuugcuaccac

SEQ ID NO: 191850 - RNA, 22 nt, Human
ucugcucagggagggucacuac

SEQ ID NO: 191851 - RNA, 20 nt, Human
uggcugugggcaucuguuuc

SEQ ID NO: 191852 - RNA, 22 nt, Human
ucagcuguagguauggaugucc

SEQ ID NO: 191853 - RNA, 22 nt, Human
gaaucagccugaguuugcagcu

SEQ ID NO: 191854 - RNA, 22 nt, Human
aggcuuggcucuccuaugagaa

SEQ ID NO: 191855 - RNA, 19 nt, Human
uucacaagugaugucucuc

SEQ ID NO: 191856 - RNA, 22 nt, Human
ugaagaagccaauugguaggcu

SEQ ID NO: 191857 - RNA, 22 nt, Human
cagggcaggaugcugugauuau

SEQ ID NO: 191858 - RNA, 22 nt, Human
agcuggugccugcuuuugugug

SEQ ID NO: 191859 - RNA, 21 nt, Human
ucuagaauccuguauaagacu

SEQ ID NO: 191860 - RNA, 22 nt, Human
agggcagagggugccucaccug

SEQ ID NO: 191861 - RNA, 22 nt, Human
ucuaacuuagggaauacuuuag

SEQ ID NO: 191862 - RNA, 22 nt, Human
ucccagcccagacuucuccagu

SEQ ID NO: 191863 - RNA, 22 nt, Human
acacagggcagagagcuggcuc

SEQ ID NO: 191864 - RNA, 22 nt, Human
ggcuucccagcagagggcgcac

SEQ ID NO: 191865 - RNA, 22 nt, Human
cuguaacuuagcaugguuacua

SEQ ID NO: 191866 - RNA, 22 nt, Human
ugguacaacuguauuaggcaaa

SEQ ID NO: 191867 - RNA, 22 nt, Human
aaagauacuuaauaguugucug

SEQ ID NO: 191868 - RNA, 22 nt, Human
auacacacaaucagguuuugua

SEQ ID NO: 191869 - RNA, 22 nt, Human
ugaggaggugggcacacagagu

SEQ ID NO: 191870 - RNA, 22 nt, Human
uuaguacagaaucaaaagcaau

SEQ ID NO: 191871 - RNA, 22 nt, Human
uaguuucagcuccuucauccug

SEQ ID NO: 191872 - RNA, 22 nt, Human
uucacauucagaaaaagcccgu

SEQ ID NO: 191873 - RNA, 22 nt, Human
ggaguugauuuuggauauauua

SEQ ID NO: 191874 - RNA, 22 nt, Human
uccugggcaaagaggggcagug

SEQ ID NO: 191875 - RNA, 15 nt, Human
gcaggcagaucaccg

SEQ ID NO: 191876 - RNA, 22 nt, Human
aauauccacacugugucccugc

SEQ ID NO: 191877 - RNA, 22 nt, Human
ucccacaugugaauccucaggu

SEQ ID NO: 191878 - RNA, 22 nt, Human
cagcacaguuucccccaugagc

SEQ ID NO: 191879 - RNA, 22 nt, Human
ucccugccugacagcacccacc

SEQ ID NO: 191880 - RNA, 22 nt, Human
uaaaguguccuagcuaggaggc

SEQ ID NO: 191881 - RNA, 22 nt, Human
uuagaaacucaacucugggaau

SEQ ID NO: 191882 - RNA, 20 nt, Human
auaaaauaacugccacaaga

SEQ ID NO: 191883 - RNA, 22 nt, Human
auuugguagugauugaaauuau

SEQ ID NO: 191884 - RNA, 22 nt, Human
ucugugauaguuuuucagcuau

SEQ ID NO: 191885 - RNA, 22 nt, Human
ggcugcggccgcgggucugugc

SEQ ID NO: 191886 - RNA, 22 nt, Human
uuccuggccaagcagaguggaa

SEQ ID NO: 191887 - RNA, 22 nt, Human
gcugaagauaagugaagaggcu

SEQ ID NO: 191888 - RNA, 22 nt, Human
cucuccacuguccuuugcuggu

SEQ ID NO: 191889 - RNA, 19 nt, Human
uuagaaacuguugacacug

SEQ ID NO: 191890 - RNA, 22 nt, Human
uuuuguguugccauguuaagca

SEQ ID NO: 191891 - RNA, 22 nt, Human
ucugggcuugccugguugugca

SEQ ID NO: 191892 - RNA, 19 nt, Human
agaaauagccuuccuuguc

SEQ ID NO: 191893 - RNA, 22 nt, Human
uguacauagaucuugaaaauua

SEQ ID NO: 191894 - RNA, 22 nt, Human
aagcauggcuguucuagcuaua

SEQ ID NO: 191895 - RNA, 22 nt, Human
ugaugaaaguguuuacucaccu

SEQ ID NO: 191896 - RNA, 22 nt, Human
cuccuuccugccccagugauaa

SEQ ID NO: 191897 - RNA, 22 nt, Human
ggacaugauauuucaggaagac

SEQ ID NO: 191898 - RNA, 22 nt, Human
ucacucugaaugguacugagga

SEQ ID NO: 191899 - RNA, 22 nt, Human
gcugggcaaggcugaagcuacc

SEQ ID NO: 191900 - RNA, 22 nt, Human
aaagccuucaaguagauguaag

SEQ ID NO: 191901 - RNA, 20 nt, Human
cugggcucaagugagccucc

SEQ ID NO: 191902 - RNA, 22 nt, Human
auaaagcauacuuuguaugacu

SEQ ID NO: 191903 - RNA, 22 nt, Human
caguggagugggacuggucuga

SEQ ID NO: 191904 - RNA, 22 nt, Human
gaacagcagcucguucucgaug

SEQ ID NO: 191905 - RNA, 22 nt, Human
agucaauuaucucuaggucauc

SEQ ID NO: 191906 - RNA, 22 nt, Human
ggggccaguaggagugauguac

SEQ ID NO: 191907 - RNA, 19 nt, Human
ucauaaacugggcacagug

SEQ ID NO: 191908 - RNA, 20 nt, Human
aacuaugaauagaagagauu

SEQ ID NO: 191909 - RNA, 22 nt, Human
uagcaucaugaucagaacuguu

SEQ ID NO: 191910 - RNA, 22 nt, Human
guggccuggcgagcuggcgcgg

SEQ ID NO: 191911 - RNA, 20 nt, Human
gcaggcuccgggcuugggag

SEQ ID NO: 191912 - RNA, 22 nt, Human
cuggcugugucuuggaggagcu

SEQ ID NO: 191913 - RNA, 22 nt, Human
acagauuuauugaagcugcugc

SEQ ID NO: 191914 - RNA, 22 nt, Human
cagagcuuugugucagggcugu

SEQ ID NO: 191915 - RNA, 22 nt, Human
ucaggacuucauuaccucaggu

SEQ ID NO: 191916 - RNA, 21 nt, Human
ucaggcugaugucgauguuag

SEQ ID NO: 191917 - RNA, 19 nt, Human
uggagaggaaaugcugcuc

SEQ ID NO: 191918 - RNA, 22 nt, Human
uucaaggagauuggagucuacu

SEQ ID NO: 191919 - RNA, 22 nt, Human
aggcucugcuuuucuggauaua

SEQ ID NO: 191920 - RNA, 22 nt, Human
gccaccuggacucagagccagg

SEQ ID NO: 191921 - RNA, 22 nt, Human
ccaggagauuuuuccauagcac

SEQ ID NO: 191922 - RNA, 22 nt, Human
ggcaggugugagaucgaggcca

SEQ ID NO: 191923 - RNA, 23 nt, Human
ugguaauagggagcagaagguag

SEQ ID NO: 191924 - RNA, 22 nt, Human
ugaaaccccagauuaccacaaa

SEQ ID NO: 191925 - RNA, 22 nt, Human
acugccuuauaugcugugugug

SEQ ID NO: 191926 - RNA, 20 nt, Human
ucucugagcuucucuugggg

SEQ ID NO: 191927 - RNA, 22 nt, Human
gauuuuacaaacugcaggaccc

SEQ ID NO: 191928 - RNA, 18 nt, Human
cugcccagagcacuugug

SEQ ID NO: 191929 - RNA, 22 nt, Human
uccaggccuaggccaagugauu

SEQ ID NO: 191930 - RNA, 22 nt, Human
aggcucugguucaucaugaugg

SEQ ID NO: 191931 - RNA, 22 nt, Human
aggcccaguagugcugccuuua

SEQ ID NO: 191932 - RNA, 22 nt, Human
ggagcuguucaggacugcuuca

SEQ ID NO: 191933 - RNA, 22 nt, Human
cucaggcuccagacuuccgucc

SEQ ID NO: 191934 - RNA, 22 nt, Human
cccagcccacgguccugggugg

SEQ ID NO: 191935 - RNA, 22 nt, Human
agcuuugggauucaggcaggaa

SEQ ID NO: 191936 - RNA, 22 nt, Human
cuugaagaaaguauguugggau

SEQ ID NO: 191937 - RNA, 22 nt, Human
ucacaucucuguuuucuaaauc

SEQ ID NO: 191938 - RNA, 22 nt, Human
gcugcagcaagcccuccagggg

SEQ ID NO: 191939 - RNA, 22 nt, Human
ugauggaagagcuaacaauauc

SEQ ID NO: 191940 - RNA, 23 nt, Human
cagaagcaccuguugacugcugc

SEQ ID NO: 191941 - RNA, 19 nt, Human
uucauucuuucuacuuacc

SEQ ID NO: 191942 - RNA, 22 nt, Human
caaaaguaauugcgguuuuugc

SEQ ID NO: 191943 - RNA, 22 nt, Human
ugccaaggagcuggaucagggc

SEQ ID NO: 191944 - RNA, 22 nt, Human
cagggcuccccagagagccucu

SEQ ID NO: 191945 - RNA, 22 nt, Human
ugcccugaggcacuccauccau

SEQ ID NO: 191946 - RNA, 22 nt, Human
aggagaccuuuugagugugaga

SEQ ID NO: 191947 - RNA, 22 nt, Human
cccagggaaugacucuggccuu

SEQ ID NO: 191948 - RNA, 22 nt, Human
ggauccugauauguguuucuca

SEQ ID NO: 191949 - RNA, 22 nt, Human
agcagguuuaaacucuaaugca

SEQ ID NO: 191950 - RNA, 22 nt, Human
uguuaacagccagauuugguga

SEQ ID NO: 191951 - RNA, 19 nt, Human
auguuuacacucaggggcu

SEQ ID NO: 191952 - RNA, 22 nt, Human
ccuggaccugcagcaucagcau

SEQ ID NO: 191953 - RNA, 22 nt, Human
gggucagaguaagcaaggacaa

SEQ ID NO: 191954 - RNA, 22 nt, Human
uugaaagugccaaguccuagug

SEQ ID NO: 191955 - RNA, 22 nt, Human
caggccuccuaugagcacuagc

SEQ ID NO: 191956 - RNA, 22 nt, Human
ucucugaugcugccagggaaaa

SEQ ID NO: 191957 - RNA, 22 nt, Human
ugguuccacuaaccugagagcc

SEQ ID NO: 191958 - RNA, 19 nt, Human
agcaguuauaugcauggga

SEQ ID NO: 191959 - RNA, 22 nt, Human
agucuccagaaauauagcagug

SEQ ID NO: 191960 - RNA, 22 nt, Human
acuucccacacccuguuuucuc

SEQ ID NO: 191961 - RNA, 22 nt, Human
uugcagggcuggaacauggaau

SEQ ID NO: 191962 - RNA, 20 nt, Human
gcagcagacagacaggggac

SEQ ID NO: 191963 - RNA, 23 nt, Human
gggaaaggauaugauccuagggg

SEQ ID NO: 191964 - RNA, 22 nt, Human
ucuccagguggcuugggcuucu

SEQ ID NO: 191965 - RNA, 22 nt, Human
uaggagggcccugaaaauggca

SEQ ID NO: 191966 - RNA, 22 nt, Human
cacugucugagcuggugauuag

SEQ ID NO: 191967 - RNA, 22 nt, Human
accagagcuggcucugagcacc

SEQ ID NO: 191968 - RNA, 22 nt, Human
uuaauaaacaggugcagcugaa

SEQ ID NO: 191969 - RNA, 22 nt, Human
cacaggaaugaacagggaaaga

SEQ ID NO: 191970 - RNA, 22 nt, Human
augcagagacagauguggcaug

SEQ ID NO: 191971 - RNA, 22 nt, Human
uuuuuggcagcucagaaacuuc

SEQ ID NO: 191972 - RNA, 22 nt, Human
uuggagagauuuaggucucagu

SEQ ID NO: 191973 - RNA, 22 nt, Human
ggagagaauuccauggacaugu

SEQ ID NO: 191974 - RNA, 22 nt, Human
cuggcccuucucuugcuuccug

SEQ ID NO: 191975 - RNA, 22 nt, Human
ugggcugaguggcagccagagu

SEQ ID NO: 191976 - RNA, 22 nt, Human
aaaucuguuguaauguuuuuua

SEQ ID NO: 191977 - RNA, 22 nt, Human
cccagugucaccaacaggacac

SEQ ID NO: 191978 - RNA, 22 nt, Human
aagucagugcuagcuaauggcu

SEQ ID NO: 191979 - RNA, 22 nt, Human
cugccuucaucucugagcuggg

SEQ ID NO: 191980 - RNA, 22 nt, Human
agcugacagugcauggagggac

SEQ ID NO: 191981 - RNA, 22 nt, Human
ggcuucuccagguacugagcau

SEQ ID NO: 191982 - RNA, 22 nt, Human
ggcuucuuccugugaacauguu

SEQ ID NO: 191983 - RNA, 22 nt, Human
uuacaagacacagugcugaagg

SEQ ID NO: 191984 - RNA, 22 nt, Human
cccugcagggaggauucugaag

SEQ ID NO: 191985 - RNA, 22 nt, Human
ccuccuguugucaccaggcgug

SEQ ID NO: 191986 - RNA, 22 nt, Human
aagucagauaggugaguccaaa

SEQ ID NO: 191987 - RNA, 22 nt, Human
uacaagcuuuuguguauaaaug

SEQ ID NO: 191988 - RNA, 22 nt, Human
gaauauauuauucagcuuuuca

SEQ ID NO: 191989 - RNA, 22 nt, Human
agccagggugagagggcuuugu

SEQ ID NO: 191990 - RNA, 22 nt, Human
uaaaugacauucuuaagucuug

SEQ ID NO: 191991 - RNA, 22 nt, Human
cugaaaauguuacacaggaaga

SEQ ID NO: 191992 - RNA, 22 nt, Human
uccucagcauuagcacagacau

SEQ ID NO: 191993 - RNA, 22 nt, Human
agaaucuucagaugauuuguca

SEQ ID NO: 191994 - RNA, 22 nt, Human
gaaggggacuggcagcugcaga

SEQ ID NO: 191995 - RNA, 20 nt, Human
uugaggcaugucuagaagua

SEQ ID NO: 191996 - RNA, 21 nt, Human
ugagcccuugccucagagccc

SEQ ID NO: 191997 - RNA, 22 nt, Human
cuauuuggauguuagccucagu

SEQ ID NO: 191998 - RNA, 22 nt, Human
gcacucaguaccaggucacugc

SEQ ID NO: 191999 - RNA, 22 nt, Human
ugccuuuuccaguuucuagggg

SEQ ID NO: 192000 - RNA, 18 nt, Human
gcucugcaggugcucggu

SEQ ID NO: 192001 - RNA, 22 nt, Human
auggcagcaaagaggccuucuu

SEQ ID NO: 192002 - RNA, 22 nt, Human
gaguguuuuacucaaagaaaga

SEQ ID NO: 192003 - RNA, 22 nt, Human
uucucugggaucuggcaaaagg

SEQ ID NO: 192004 - RNA, 22 nt, Human
ccaggggaaacagggagcacuc

SEQ ID NO: 192005 - RNA, 22 nt, Human
ucacacagcuccuuuccuuagu

SEQ ID NO: 192006 - RNA, 20 nt, Human
ucacauccucucccaacaug

SEQ ID NO: 192007 - RNA, 22 nt, Human
ugauucuguaagucauauuguu

SEQ ID NO: 192008 - RNA, 22 nt, Human
gcacacacuguuuuccucacau

SEQ ID NO: 192009 - RNA, 19 nt, Human
ugaauacagagauacagaa

SEQ ID NO: 192010 - RNA, 22 nt, Human
aagaggaccaguagauaaauuu

SEQ ID NO: 192011 - RNA, 22 nt, Human
auuuauugaagcuuauuacguu

SEQ ID NO: 192012 - RNA, 22 nt, Human
aacaaugugauugaagcuagaa

SEQ ID NO: 192013 - RNA, 20 nt, Human
aagcuggcaggucauagcuu

SEQ ID NO: 192014 - RNA, 22 nt, Human
uucucauucugacucaguguag

SEQ ID NO: 192015 - RNA, 22 nt, Human
ucaagagcauguaucucccuaa

SEQ ID NO: 192016 - RNA, 19 nt, Human
caacaguugcaacacuguc

SEQ ID NO: 192017 - RNA, 22 nt, Human
aaggccagacaggaccacaucu

SEQ ID NO: 192018 - RNA, 22 nt, Human
uagaaagcagaaaccaucagag

SEQ ID NO: 192019 - RNA, 22 nt, Human
cuuuggcucaugguuuuaucca

SEQ ID NO: 192020 - RNA, 18 nt, Human
agacuuugaguuagaggg

SEQ ID NO: 192021 - RNA, 22 nt, Human
acucuguguuuugguggcagca

SEQ ID NO: 192022 - RNA, 22 nt, Human
gagcaagauccuguuuuucuau

SEQ ID NO: 192023 - RNA, 22 nt, Human
caaauguauaaauguacuuucu

SEQ ID NO: 192024 - RNA, 23 nt, Human
uggagcuccugcccauccuggcu

SEQ ID NO: 192025 - RNA, 22 nt, Human
uuauucagcauuuagaggaagg

SEQ ID NO: 192026 - RNA, 22 nt, Human
caggaugauguuaauugaaguu

SEQ ID NO: 192027 - RNA, 22 nt, Human
cauuggaaugaucguuuugcug

SEQ ID NO: 192028 - RNA, 22 nt, Human
ugaggaaacuuacaaggcagaa

SEQ ID NO: 192029 - RNA, 22 nt, Human
cagaacugggcucgcucugguu

SEQ ID NO: 192030 - RNA, 17 nt, Human
ugagcaguagaagaugc

SEQ ID NO: 192031 - RNA, 22 nt, Human
cugugggcauuugagugugggu

SEQ ID NO: 192032 - RNA, 22 nt, Human
caccagcuacagacuacugugu

SEQ ID NO: 192033 - RNA, 22 nt, Human
cugugucccacacgagguguau

SEQ ID NO: 192034 - RNA, 22 nt, Human
gugcugugcgcuuuuucuguau

SEQ ID NO: 192035 - RNA, 22 nt, Human
gcagggcagaaggugcugagga

SEQ ID NO: 192036 - RNA, 22 nt, Human
guacaaauugauacagguuuuc

SEQ ID NO: 192037 - RNA, 18 nt, Human
ucaggcugcccugugucu

SEQ ID NO: 192038 - RNA, 22 nt, Human
gguggggcccuggcacugguau

SEQ ID NO: 192039 - RNA, 22 nt, Human
aaggagugauauaugggugcua

SEQ ID NO: 192040 - RNA, 22 nt, Human
uccaggucuuccuauuccaggu

SEQ ID NO: 192041 - RNA, 22 nt, Human
uggcaggaaaaacauuggagau

SEQ ID NO: 192042 - RNA, 22 nt, Human
aggaaacugagguuacgggacu

SEQ ID NO: 192043 - RNA, 22 nt, Human
gcagagucagguccaaggacug

SEQ ID NO: 192044 - RNA, 20 nt, Human
uguggcaggaugagggcgga

SEQ ID NO: 192045 - RNA, 22 nt, Human
gcuucucuggccugcagggcau

SEQ ID NO: 192046 - RNA, 22 nt, Human
uuugacucaagccuuucuuuag

SEQ ID NO: 192047 - RNA, 20 nt, Human
aggcugagggugauuguguc

SEQ ID NO: 192048 - RNA, 22 nt, Human
ucaugauuuccugguuaaggac

SEQ ID NO: 192049 - RNA, 22 nt, Human
agggucuguauuucuggcaagc

SEQ ID NO: 192050 - RNA, 22 nt, Human
agggcacuucagucagacugag

SEQ ID NO: 192051 - RNA, 23 nt, Human
uggcuccaggagaagccagaagc

SEQ ID NO: 192052 - RNA, 22 nt, Human
aaguccagugcuuuagauucca

SEQ ID NO: 192053 - RNA, 22 nt, Human
uggcagaguucgcuccuauuca

SEQ ID NO: 192054 - RNA, 22 nt, Human
gccccaccugcuaccuuccagc

SEQ ID NO: 192055 - RNA, 22 nt, Human
ccuuuggucuugaugaacuguu

SEQ ID NO: 192056 - RNA, 22 nt, Human
uacauucagagaaaguuuccau

SEQ ID NO: 192057 - RNA, 22 nt, Human
cuggcagcgugagcagcaucca

SEQ ID NO: 192058 - RNA, 22 nt, Human
gcaccuuucuauauucaguggc

SEQ ID NO: 192059 - RNA, 22 nt, Human
auucucaaaacauaacuucacu

SEQ ID NO: 192060 - RNA, 22 nt, Human
aguuucuagcaaggauuguuga

SEQ ID NO: 192061 - RNA, 22 nt, Human
gccagugccugcugcucagggc

SEQ ID NO: 192062 - RNA, 22 nt, Human
augaugaagaguaacaggcuga

SEQ ID NO: 192063 - RNA, 23 nt, Human
uuaggcacuuaguagggccagag

SEQ ID NO: 192064 - RNA, 22 nt, Human
auggcagggacuguggcccuug

SEQ ID NO: 192065 - RNA, 22 nt, Human
agggcccugaguugcagcccug

SEQ ID NO: 192066 - RNA, 22 nt, Human
caggcccucugcacccucgucu

SEQ ID NO: 192067 - RNA, 22 nt, Human
cagcagugacaagacuaagaag

SEQ ID NO: 192068 - RNA, 22 nt, Human
gcacaaaagguacuucauguag

SEQ ID NO: 192069 - RNA, 20 nt, Human
caaagacaugcuaggggugg

SEQ ID NO: 192070 - RNA, 23 nt, Human
ucucugggugggcugugucuaua

SEQ ID NO: 192071 - RNA, 22 nt, Human
acuggcagccacaacuggcagg

SEQ ID NO: 192072 - RNA, 22 nt, Human
augagugcaacagaucagcaug

SEQ ID NO: 192073 - RNA, 22 nt, Human
augaaauguauucagauaugua

SEQ ID NO: 192074 - RNA, 22 nt, Human
ucaugaggauuuacuagacuag

SEQ ID NO: 192075 - RNA, 22 nt, Human
gcaaagcacacuggagaugucg

SEQ ID NO: 192076 - RNA, 22 nt, Human
ugggccucaugcccagccaccc

SEQ ID NO: 192077 - RNA, 19 nt, Human
augaauguguucuuaccuc

SEQ ID NO: 192078 - RNA, 23 nt, Human
ccaggcucuuucaccugcuauuc

SEQ ID NO: 192079 - RNA, 22 nt, Human
uugucaagauugagagaugacu

SEQ ID NO: 192080 - RNA, 22 nt, Human
uuuuccagauuggacuuagucc

SEQ ID NO: 192081 - RNA, 22 nt, Human
uugcucugcaguccagacagua

SEQ ID NO: 192082 - RNA, 22 nt, Human
acagggagauaucuucaauauc

SEQ ID NO: 192083 - RNA, 17 nt, Human
ccuggcugggaaucuga

SEQ ID NO: 192084 - RNA, 22 nt, Human
acagauuuuugguaaauaauuu

SEQ ID NO: 192085 - RNA, 22 nt, Human
gugcugagugcagagugcagag

SEQ ID NO: 192086 - RNA, 22 nt, Human
auaguuuuaaaaccucaggaag

SEQ ID NO: 192087 - RNA, 22 nt, Human
ucugucuuggccagccaucugg

SEQ ID NO: 192088 - RNA, 22 nt, Human
uucaaguaugagaaaggggacu

SEQ ID NO: 192089 - RNA, 22 nt, Human
aacauucuaugugcauucagaa

SEQ ID NO: 192090 - RNA, 22 nt, Human
gagguccucuguguccgcgggc

SEQ ID NO: 192091 - RNA, 22 nt, Human
aggguauguuuuaggcugaguu

SEQ ID NO: 192092 - RNA, 22 nt, Human
uuacuuuggauggucaagaaag

SEQ ID NO: 192093 - RNA, 20 nt, Human
gcuaggcuguguccugccca

SEQ ID NO: 192094 - RNA, 22 nt, Human
uccucagucacgguagcacauu

SEQ ID NO: 192095 - RNA, 18 nt, Human
uggaggaaaaaucucaug

SEQ ID NO: 192096 - RNA, 22 nt, Human
uagcagcuggggcuauucauca

SEQ ID NO: 192097 - RNA, 22 nt, Human
cacagcuguuuucuccaggcag

SEQ ID NO: 192098 - RNA, 21 nt, Human
uucuccagggggagcucucuc

SEQ ID NO: 192099 - RNA, 20 nt, Human
uaugaauucuggucccuggg

SEQ ID NO: 192100 - RNA, 22 nt, Human
uucucuguuuuccccucgaugu

SEQ ID NO: 192101 - RNA, 22 nt, Human
caucaguggauauagauuagcg

SEQ ID NO: 192102 - RNA, 22 nt, Human
agggagcuaggauccugaaggu

SEQ ID NO: 192103 - RNA, 20 nt, Human
uuugagaccagucugcccaa

SEQ ID NO: 192104 - RNA, 22 nt, Human
auuacaacuacauaaucucaga

SEQ ID NO: 192105 - RNA, 22 nt, Human
ugugaccauaauuuguaaauaa

SEQ ID NO: 192106 - RNA, 22 nt, Human
ucuagaaucuaaacuauaguuu

SEQ ID NO: 192107 - RNA, 22 nt, Human
ggcucugcucacagcccgcagc

SEQ ID NO: 192108 - RNA, 22 nt, Human
gucuuuggagaggugccauuuc

SEQ ID NO: 192109 - RNA, 21 nt, Human
agcacagcauauccaauguca

SEQ ID NO: 192110 - RNA, 22 nt, Human
ggagaucuugcuugaaggcaug

SEQ ID NO: 192111 - RNA, 22 nt, Human
aauaugcaaagcguguuaucug

SEQ ID NO: 192112 - RNA, 22 nt, Human
uaaucucuuuuaggacagagcc

SEQ ID NO: 192113 - RNA, 22 nt, Human
augagacuaccuguaauguggc

SEQ ID NO: 192114 - RNA, 22 nt, Human
aguugaagguuggcugauccau

SEQ ID NO: 192115 - RNA, 22 nt, Human
auuuagaaauuccaaaaguauu

SEQ ID NO: 192116 - RNA, 22 nt, Human
aaagcgcuauauaaauguuaac

SEQ ID NO: 192117 - RNA, 22 nt, Human
uccauguguuuuccuguccaca

SEQ ID NO: 192118 - RNA, 22 nt, Human
cccaggcacauccacucuguga

SEQ ID NO: 192119 - RNA, 22 nt, Human
uucauguaggcugcaaugcaca

SEQ ID NO: 192120 - RNA, 22 nt, Human
auugauuuagcucaagacacau

SEQ ID NO: 192121 - RNA, 20 nt, Human
ugaaagcaugugguauuugg

SEQ ID NO: 192122 - RNA, 22 nt, Human
cuccaggccaagauuaaguaau

SEQ ID NO: 192123 - RNA, 22 nt, Human
acauuacauaagauuguaaccu

SEQ ID NO: 192124 - RNA, 22 nt, Human
agacaacuagaaaacuagacag

SEQ ID NO: 192125 - RNA, 23 nt, Human
acugggcugaaauuuuucauggc

SEQ ID NO: 192126 - RNA, 22 nt, Human
ugggagcaggaagcaggaagua

SEQ ID NO: 192127 - RNA, 22 nt, Human
cucuccagggcaugaguuccac

SEQ ID NO: 192128 - RNA, 22 nt, Human
aacuuugucuuuuaugcuuaca

SEQ ID NO: 192129 - RNA, 22 nt, Human
aaagagcugggacuuaaagugc

SEQ ID NO: 192130 - RNA, 21 nt, Human
cacaugugaauuacugaacug

SEQ ID NO: 192131 - RNA, 22 nt, Human
gagucugagaacugggcucagu

SEQ ID NO: 192132 - RNA, 22 nt, Human
ugcagugauuuguacaauuaga

SEQ ID NO: 192133 - RNA, 22 nt, Human
ggaagaggcugguagugcccgu

SEQ ID NO: 192134 - RNA, 22 nt, Human
agagaugguagaacagucauaa

SEQ ID NO: 192135 - RNA, 20 nt, Human
ugugaaagcaguagaaugac

SEQ ID NO: 192136 - RNA, 22 nt, Human
guccacugcugugugcuucacc

SEQ ID NO: 192137 - RNA, 22 nt, Human
ccagcagccagagaaggaccuc

SEQ ID NO: 192138 - RNA, 23 nt, Human
ugucugguucaugcuuauuuugg

SEQ ID NO: 192139 - RNA, 22 nt, Human
uagaguccauuaaugcaaguuu

SEQ ID NO: 192140 - RNA, 22 nt, Human
aggcagcugaggucuggcgccc

SEQ ID NO: 192141 - RNA, 22 nt, Human
aaucuuuuucacaagaaagcac

SEQ ID NO: 192142 - RNA, 22 nt, Human
aggaagccaagccugacacuca

SEQ ID NO: 192143 - RNA, 22 nt, Human
gggcugagugggccucuuacuu

SEQ ID NO: 192144 - RNA, 22 nt, Human
cuggcagcgguuugcagccugg

SEQ ID NO: 192145 - RNA, 22 nt, Human
uccaccccugggaaugucaaua

SEQ ID NO: 192146 - RNA, 20 nt, Human
gcccucugccucccucagcg

SEQ ID NO: 192147 - RNA, 22 nt, Human
cuggccaggcucucacgugguc

SEQ ID NO: 192148 - RNA, 18 nt, Human
agcaggugugcagaaugu

SEQ ID NO: 192149 - RNA, 23 nt, Human
agacaaacuuccuucacugcacc

SEQ ID NO: 192150 - RNA, 22 nt, Human
ugucuuuagaaagaagcagaca

SEQ ID NO: 192151 - RNA, 22 nt, Human
cagcacagggacaauagcagau

SEQ ID NO: 192152 - RNA, 22 nt, Human
uccaguccuagaaacuggagag

SEQ ID NO: 192153 - RNA, 22 nt, Human
uuauagaauccaguuguuguau

SEQ ID NO: 192154 - RNA, 22 nt, Human
gaaauacaaagccagccauuuu

SEQ ID NO: 192155 - RNA, 22 nt, Human
uccaggcauguugggaagauga

SEQ ID NO: 192156 - RNA, 22 nt, Human
cagguggguguaugaaugcaaa

SEQ ID NO: 192157 - RNA, 22 nt, Human
ccaggcagggcucaaggaaccu

SEQ ID NO: 192158 - RNA, 22 nt, Human
gugucugcuugcugagcauuua

SEQ ID NO: 192159 - RNA, 22 nt, Human
caggcuuuugcauagcacuggg

SEQ ID NO: 192160 - RNA, 22 nt, Human
uccugagcccuguaggacccug

SEQ ID NO: 192161 - RNA, 22 nt, Human
cagccaggagcucccccugcuc

SEQ ID NO: 192162 - RNA, 21 nt, Human
auaauguacaaaaacugucuu

SEQ ID NO: 192163 - RNA, 22 nt, Human
guucuuaaagauucaucaagca

SEQ ID NO: 192164 - RNA, 22 nt, Human
agggcugagugggagagaguug

SEQ ID NO: 192165 - RNA, 21 nt, Human
ccugucuuggacugaggcacc

SEQ ID NO: 192166 - RNA, 22 nt, Human
ucucuggcagacaccucccuga

SEQ ID NO: 192167 - RNA, 22 nt, Human
cuggggcucacuccagcccugg

SEQ ID NO: 192168 - RNA, 22 nt, Human
acaguaaugauaaccagcauuu

SEQ ID NO: 192169 - RNA, 22 nt, Human
aagucuggugcuguccucaccc

SEQ ID NO: 192170 - RNA, 23 nt, Human
aguuaggucaaguuaggucaauu

SEQ ID NO: 192171 - RNA, 22 nt, Human
auuauuaggugcucucugacaa

SEQ ID NO: 192172 - RNA, 19 nt, Human
gccaggucuuggguccagg

SEQ ID NO: 192173 - RNA, 22 nt, Human
uuuaauugauucacagucugua

SEQ ID NO: 192174 - RNA, 22 nt, Human
gcuuuucuucagcagccugaug

SEQ ID NO: 192175 - RNA, 22 nt, Human
agcccagcugccugccugcugu

SEQ ID NO: 192176 - RNA, 22 nt, Human
uccaggcugcagucuugcccuc

SEQ ID NO: 192177 - RNA, 22 nt, Human
aagaacaguugggaggugagcc

SEQ ID NO: 192178 - RNA, 17 nt, Human
ucugagaacuugaagca

SEQ ID NO: 192179 - RNA, 22 nt, Human
uuaggauuugaaaaggggcaga

SEQ ID NO: 192180 - RNA, 22 nt, Human
ucccagauucuucugugugggc

SEQ ID NO: 192181 - RNA, 22 nt, Human
acucaggaauggggcugggacu

SEQ ID NO: 192182 - RNA, 22 nt, Human
ugcaaauagccugaugaaagaa

SEQ ID NO: 192183 - RNA, 22 nt, Human
gaagugucuccguuuuuaaagg

SEQ ID NO: 192184 - RNA, 22 nt, Human
gcugagugagguccagagcuug

SEQ ID NO: 192185 - RNA, 22 nt, Human
cugucuccagggcaggugcagg

SEQ ID NO: 192186 - RNA, 22 nt, Human
ggugaggcagagggaguaaccu

SEQ ID NO: 192187 - RNA, 22 nt, Human
aacuuauuccauaggcucacug

SEQ ID NO: 192188 - RNA, 22 nt, Human
ugucaacacaccuaucucaauu

SEQ ID NO: 192189 - RNA, 22 nt, Human
uagcacccaccucgugggguuu

SEQ ID NO: 192190 - RNA, 22 nt, Human
agaagccagccuugccuccuuu

SEQ ID NO: 192191 - RNA, 21 nt, Human
ccagccucagaucagggagcu

SEQ ID NO: 192192 - RNA, 22 nt, Human
uugcauuccaguccccacugug

SEQ ID NO: 192193 - RNA, 20 nt, Human
gcugaggucauuaugccuca

SEQ ID NO: 192194 - RNA, 22 nt, Human
acugaauuacagucugcauuuu

SEQ ID NO: 192195 - RNA, 22 nt, Human
cccagagagcacaggugguggg

SEQ ID NO: 192196 - RNA, 22 nt, Human
agcuuguucucauccauucuuc

SEQ ID NO: 192197 - RNA, 22 nt, Human
uucauuccuucuguaccuugcc

SEQ ID NO: 192198 - RNA, 22 nt, Human
agucuagaggauggguccagau

SEQ ID NO: 192199 - RNA, 22 nt, Human
guaaauuauuucaagaucaucu

SEQ ID NO: 192200 - RNA, 22 nt, Human
caacaguuccuccauccucucu

SEQ ID NO: 192201 - RNA, 22 nt, Human
ugcaggagggaggguuacaguu

SEQ ID NO: 192202 - RNA, 22 nt, Human
gaugucuuugccaugcaugugu

SEQ ID NO: 192203 - RNA, 21 nt, Human
aagucugguugauuccuuugc

SEQ ID NO: 192204 - RNA, 22 nt, Human
ccugagagcccuagccaggcgc

SEQ ID NO: 192205 - RNA, 22 nt, Human
cuucauuacuugcucguagcac

SEQ ID NO: 192206 - RNA, 22 nt, Human
gucaggauuggggucaugaguc

SEQ ID NO: 192207 - RNA, 20 nt, Human
agcccuguuuccuggagaga

SEQ ID NO: 192208 - RNA, 22 nt, Human
gcaggugguggggcuaugaucu

SEQ ID NO: 192209 - RNA, 22 nt, Human
auauuugucaauucacuguuca

SEQ ID NO: 192210 - RNA, 22 nt, Human
caucuccuggcagcuguuagga

SEQ ID NO: 192211 - RNA, 22 nt, Human
gaaaacugugauuagaaugccu

SEQ ID NO: 192212 - RNA, 18 nt, Human
ccuucagcucugccagua

SEQ ID NO: 192213 - RNA, 22 nt, Human
aggaaaggccucagcagaaacc

SEQ ID NO: 192214 - RNA, 22 nt, Human
ucucuggaauuggcugaggcaa

SEQ ID NO: 192215 - RNA, 22 nt, Human
caggaggcauauuuaaauccaa

SEQ ID NO: 192216 - RNA, 23 nt, Human
cauggcugauuucaagcuaccac

SEQ ID NO: 192217 - RNA, 22 nt, Human
gggcacuggaggccaaggagcu

SEQ ID NO: 192218 - RNA, 22 nt, Human
uuccuggccucucucugagcag

SEQ ID NO: 192219 - RNA, 22 nt, Human
caugggggucuggacaacaggc

SEQ ID NO: 192220 - RNA, 23 nt, Human
ucugguacuauugcuguugagca

SEQ ID NO: 192221 - RNA, 22 nt, Human
ucugcuuucaaauucacuuagu

SEQ ID NO: 192222 - RNA, 22 nt, Human
gagccaggguuugaaacuagac

SEQ ID NO: 192223 - RNA, 22 nt, Human
aaaggccaccaacaugaagcau

SEQ ID NO: 192224 - RNA, 22 nt, Human
uggcugugccucuuuccaggcc

SEQ ID NO: 192225 - RNA, 22 nt, Human
cagacugaguggauuaaacaau

SEQ ID NO: 192226 - RNA, 21 nt, Human
cagcuucugaagguguaggaa

SEQ ID NO: 192227 - RNA, 22 nt, Human
uuuguuaaggaguauugcuucu

SEQ ID NO: 192228 - RNA, 22 nt, Human
aaauucuaaggucacaauguug

SEQ ID NO: 192229 - RNA, 22 nt, Human
uccuggcuggaauuucucacuc

SEQ ID NO: 192230 - RNA, 22 nt, Human
guugucuuagucagaaauaugc

SEQ ID NO: 192231 - RNA, 22 nt, Human
uuuuguuuguguccacugcagu

SEQ ID NO: 192232 - RNA, 22 nt, Human
acagauguacacucauauauaa

SEQ ID NO: 192233 - RNA, 22 nt, Human
cacaucauucaauggugauauu

SEQ ID NO: 192234 - RNA, 22 nt, Human
ugcuuugacagggaugacauga

SEQ ID NO: 192235 - RNA, 22 nt, Human
aggcuggggaauugaauuugcu

SEQ ID NO: 192236 - RNA, 22 nt, Human
gucuucuguucugugaggcuuc

SEQ ID NO: 192237 - RNA, 22 nt, Human
uggcccaggccaaagcccugga

SEQ ID NO: 192238 - RNA, 22 nt, Human
uaugagaaaauaaauaucuguu

SEQ ID NO: 192239 - RNA, 22 nt, Human
ucucagagugacaaugagaauu

SEQ ID NO: 192240 - RNA, 22 nt, Human
uugugaaaucguguuuggaagc

SEQ ID NO: 192241 - RNA, 18 nt, Human
ggcagccuacccacuugu

SEQ ID NO: 192242 - RNA, 22 nt, Human
acuaccuuauacaaaauguagg

SEQ ID NO: 192243 - RNA, 23 nt, Human
aguguucagcauguaguaaauac

SEQ ID NO: 192244 - RNA, 22 nt, Human
aaugcauucucgguuugugugu

SEQ ID NO: 192245 - RNA, 22 nt, Human
uggagcuggcagcggaaaaggg

SEQ ID NO: 192246 - RNA, 22 nt, Human
uuugcuugacccuugugcugaa

SEQ ID NO: 192247 - RNA, 22 nt, Human
gcagcauccugggccacagucc

SEQ ID NO: 192248 - RNA, 22 nt, Human
aaagcaauggcacaugauggua

SEQ ID NO: 192249 - RNA, 22 nt, Human
auucuucacaccuguuccuguu

SEQ ID NO: 192250 - RNA, 19 nt, Human
aggcuugguugcagcaagc

SEQ ID NO: 192251 - RNA, 22 nt, Human
gcucaggaccgaggggugggaa

SEQ ID NO: 192252 - RNA, 22 nt, Human
ucugaggacagugcugugccug

SEQ ID NO: 192253 - RNA, 22 nt, Human
ucauggcacaugcccuccaggg

SEQ ID NO: 192254 - RNA, 23 nt, Human
ucacagagcauacugcauuuugc

SEQ ID NO: 192255 - RNA, 22 nt, Human
gcuuucugggcuauagaacggg

SEQ ID NO: 192256 - RNA, 22 nt, Human
aaauuacagccuuggguagcuu

SEQ ID NO: 192257 - RNA, 22 nt, Human
agggcuggagccacagcuggga

SEQ ID NO: 192258 - RNA, 22 nt, Human
agaauuuaggaugcaugugaau

SEQ ID NO: 192259 - RNA, 22 nt, Human
uuuauugaauuguaacccuauu

SEQ ID NO: 192260 - RNA, 22 nt, Human
cugggggucuugaaagggagag

SEQ ID NO: 192261 - RNA, 22 nt, Human
ugccauuugccccagcacuguc

SEQ ID NO: 192262 - RNA, 22 nt, Human
ugcuuugccugcuuugacucau

SEQ ID NO: 192263 - RNA, 22 nt, Human
gcacccagaggucagcagugcu

SEQ ID NO: 192264 - RNA, 22 nt, Human
ccagaaagguaaacacuggauu

SEQ ID NO: 192265 - RNA, 22 nt, Human
agcugguauuucugaaggaaag

SEQ ID NO: 192266 - RNA, 22 nt, Human
uggagggaacccaggcugcucu

SEQ ID NO: 192267 - RNA, 22 nt, Human
ugucacauaauuuaucuguagg

SEQ ID NO: 192268 - RNA, 22 nt, Human
uuccaggccgggcaggaaacac

SEQ ID NO: 192269 - RNA, 22 nt, Human
ggguauuaaaaugaaggagaaa

SEQ ID NO: 192270 - RNA, 22 nt, Human
gugugagagaagcugccaugga

SEQ ID NO: 192271 - RNA, 22 nt, Human
agcuggcagcucucagggguac

SEQ ID NO: 192272 - RNA, 22 nt, Human
uuuauacuccacucugcaagcg

SEQ ID NO: 192273 - RNA, 22 nt, Human
ucccagugggaagcagcacgcu

SEQ ID NO: 192274 - RNA, 22 nt, Human
ggucagugacuuuuuucugugg

SEQ ID NO: 192275 - RNA, 22 nt, Human
aagaggucauaccagauaaggg

SEQ ID NO: 192276 - RNA, 22 nt, Human
uagauucuuugcuagaucauug

SEQ ID NO: 192277 - RNA, 22 nt, Human
uaggaaacaaagcuuagcagga

SEQ ID NO: 192278 - RNA, 22 nt, Human
auugcaaaauuguccuguggaa

SEQ ID NO: 192279 - RNA, 22 nt, Human
gagaaucucuuugacaagcaga

SEQ ID NO: 192280 - RNA, 20 nt, Human
cgggacacucaagcucuggg

SEQ ID NO: 192281 - RNA, 22 nt, Human
caugaaaaugucaaguucugcu

SEQ ID NO: 192282 - RNA, 22 nt, Human
augucucugccccagagagcuu

SEQ ID NO: 192283 - RNA, 22 nt, Human
uaguuacaggaguuucugaaau

SEQ ID NO: 192284 - RNA, 18 nt, Human
caguauaaccagcaacuc

SEQ ID NO: 192285 - RNA, 22 nt, Human
uagccauugacuuaaagcuuau

SEQ ID NO: 192286 - RNA, 22 nt, Human
aauaucaguauauuguaucagu

SEQ ID NO: 192287 - RNA, 22 nt, Human
ugaaagcauuagucuaagguag

SEQ ID NO: 192288 - RNA, 22 nt, Human
ggcucugggguuggcccaucuc

SEQ ID NO: 192289 - RNA, 22 nt, Human
uggcuguggacucagauggcuc

SEQ ID NO: 192290 - RNA, 19 nt, Human
auuuccaagaauuggagag

SEQ ID NO: 192291 - RNA, 22 nt, Human
aagaaugauuacaaagcaacga

SEQ ID NO: 192292 - RNA, 22 nt, Human
aggacccugagcgggcaugccg

SEQ ID NO: 192293 - RNA, 22 nt, Human
cuguggcugcagccuugguccu

SEQ ID NO: 192294 - RNA, 22 nt, Human
ucugcaucauuuuucagagccg

SEQ ID NO: 192295 - RNA, 20 nt, Human
caugccaugucuacugaggc

SEQ ID NO: 192296 - RNA, 19 nt, Human
cugcugaauuagcucugga

SEQ ID NO: 192297 - RNA, 22 nt, Human
augggcaggcaagguggcgagu

SEQ ID NO: 192298 - RNA, 20 nt, Human
uuucuggguacucucccucu

SEQ ID NO: 192299 - RNA, 22 nt, Human
ugcaggugacaccacucuuccu

SEQ ID NO: 192300 - RNA, 22 nt, Human
agugggcauaugaagucucaag

SEQ ID NO: 192301 - RNA, 22 nt, Human
agcacagauaacauggagugga

SEQ ID NO: 192302 - RNA, 22 nt, Human
ucaaauuuuaacaugcauuaga

SEQ ID NO: 192303 - RNA, 22 nt, Human
caaaugauagagccgauuauca

SEQ ID NO: 192304 - RNA, 20 nt, Human
agggucaguagcacagagcu

SEQ ID NO: 192305 - RNA, 22 nt, Human
ggaaucuucagccaugccaaga

SEQ ID NO: 192306 - RNA, 17 nt, Human
uuuauaauuggccucuu

SEQ ID NO: 192307 - RNA, 22 nt, Human
cagugaugaucauuguaacauc

SEQ ID NO: 192308 - RNA, 22 nt, Human
aaauccaugguaaucuguuaca

SEQ ID NO: 192309 - RNA, 22 nt, Human
gagguuggugaggggacacggu

SEQ ID NO: 192310 - RNA, 22 nt, Human
ccugggugaaaucucuccugca

SEQ ID NO: 192311 - RNA, 20 nt, Human
aagcuggguaggagaggagc

SEQ ID NO: 192312 - RNA, 22 nt, Human
uguccuggagacacaagguggu

SEQ ID NO: 192313 - RNA, 22 nt, Human
agggaccugucaaugacaguua

SEQ ID NO: 192314 - RNA, 22 nt, Human
cagcugcaggcugugcaggaag

SEQ ID NO: 192315 - RNA, 19 nt, Human
agagaccacagagcugccu

SEQ ID NO: 192316 - RNA, 22 nt, Human
aagaguuuccaguuguggcuca

SEQ ID NO: 192317 - RNA, 19 nt, Human
uccauacaaacuguugaaa

SEQ ID NO: 192318 - RNA, 22 nt, Human
uuuguguuuguacaaugcacua

SEQ ID NO: 192319 - RNA, 22 nt, Human
cuguggaacuuagugggagaca

SEQ ID NO: 192320 - RNA, 22 nt, Human
cuacauuuuaauaagcugcuua

SEQ ID NO: 192321 - RNA, 22 nt, Human
cacuuuaugggaagcaaaaauu

SEQ ID NO: 192322 - RNA, 22 nt, Human
ucacuagcauuguugaaggacu

SEQ ID NO: 192323 - RNA, 22 nt, Human
aaauggaagaagugcaauacug

SEQ ID NO: 192324 - RNA, 22 nt, Human
ucagggcuccggaaguggccuc

SEQ ID NO: 192325 - RNA, 22 nt, Human
aaggacuaaugaauagaugaau

SEQ ID NO: 192326 - RNA, 22 nt, Human
accuacauguuccacauaguug

SEQ ID NO: 192327 - RNA, 22 nt, Human
accuccaggaagcucuugguac

SEQ ID NO: 192328 - RNA, 22 nt, Human
acccagaggcggagguugcagu

SEQ ID NO: 192329 - RNA, 22 nt, Human
cagcaagucauccaggaugaug

SEQ ID NO: 192330 - RNA, 22 nt, Human
gcuuugcugggugcuucaugua

SEQ ID NO: 192331 - RNA, 22 nt, Human
accacuguacagcagauauagu

SEQ ID NO: 192332 - RNA, 22 nt, Human
augucugguggucgaugcuaca

SEQ ID NO: 192333 - RNA, 22 nt, Human
ccaggccugugcaaggagggag

SEQ ID NO: 192334 - RNA, 22 nt, Human
uuccugagucgccgagucuaug

SEQ ID NO: 192335 - RNA, 21 nt, Human
ggcaauuaggcuucugaguau

SEQ ID NO: 192336 - RNA, 22 nt, Human
ucuggcucaaaauacguacucu

SEQ ID NO: 192337 - RNA, 22 nt, Human
aguggcacaauuuugacucccc

SEQ ID NO: 192338 - RNA, 22 nt, Human
aagggggcggcagccaguggaa

SEQ ID NO: 192339 - RNA, 22 nt, Human
ucagacauauuuuuaacaaagu

SEQ ID NO: 192340 - RNA, 22 nt, Human
gagagugaggccugggaaucua

SEQ ID NO: 192341 - RNA, 22 nt, Human
ucccagccuuccuuguggugaa

SEQ ID NO: 192342 - RNA, 22 nt, Human
ggcagcugggucacaccgaucu

SEQ ID NO: 192343 - RNA, 22 nt, Human
agucucuuuaaucacagugucu

SEQ ID NO: 192344 - RNA, 22 nt, Human
uuuggaaaaagccugaacauag

SEQ ID NO: 192345 - RNA, 22 nt, Human
aagcccuccguacgugcuagcu

SEQ ID NO: 192346 - RNA, 22 nt, Human
uuacaguuaaugugacuaacca

SEQ ID NO: 192347 - RNA, 22 nt, Human
caaagcugauacucagcaagua

SEQ ID NO: 192348 - RNA, 22 nt, Human
aaaggcuuagacacagaacugu

SEQ ID NO: 192349 - RNA, 22 nt, Human
ugggacaguuguccuccacucu

SEQ ID NO: 192350 - RNA, 22 nt, Human
guaacuuaccauuguagcauca

SEQ ID NO: 192351 - RNA, 22 nt, Human
uuguuacagcacuuaaccuuuu

SEQ ID NO: 192352 - RNA, 22 nt, Human
uuaaaacagcgugaaucuggca

SEQ ID NO: 192353 - RNA, 22 nt, Human
ugaacagaucaauagaacugac

SEQ ID NO: 192354 - RNA, 20 nt, Human
cugaacacagaauaagcaca

SEQ ID NO: 192355 - RNA, 18 nt, Human
ccauguguuccuuuuggg

SEQ ID NO: 192356 - RNA, 22 nt, Human
ccuggcagguggagguugcagu

SEQ ID NO: 192357 - RNA, 17 nt, Human
aagucccagcuaacaca

SEQ ID NO: 192358 - RNA, 22 nt, Human
caggcuugaagcuucagaguau

SEQ ID NO: 192359 - RNA, 22 nt, Human
aagaacaugguaggauaacaaa

SEQ ID NO: 192360 - RNA, 21 nt, Human
ugggccaguagaaaggaaggc

SEQ ID NO: 192361 - RNA, 22 nt, Human
aggacagaccuaggacuggagc

SEQ ID NO: 192362 - RNA, 22 nt, Human
cuggcagcaguuaugaaacaau

SEQ ID NO: 192363 - RNA, 22 nt, Human
gggcugagaaguugaucccaag

SEQ ID NO: 192364 - RNA, 22 nt, Human
caauaguauuuauugaacaccu

SEQ ID NO: 192365 - RNA, 22 nt, Human
aggaguggaauuacuggguucu

SEQ ID NO: 192366 - RNA, 22 nt, Human
ggaaggguuuaagcaggagagu

SEQ ID NO: 192367 - RNA, 22 nt, Human
uauacacuguuguugggagucu

SEQ ID NO: 192368 - RNA, 22 nt, Human
aaaagcaagaggcuggauuaaa

SEQ ID NO: 192369 - RNA, 22 nt, Human
uugaaacucccuuuugucuagu

SEQ ID NO: 192370 - RNA, 22 nt, Human
agcugccuggccggagccacug

SEQ ID NO: 192371 - RNA, 19 nt, Human
uggcuuccaucucucucau

SEQ ID NO: 192372 - RNA, 22 nt, Human
ucuuuauuuaagucuguuguaa

SEQ ID NO: 192373 - RNA, 22 nt, Human
acuuuaaagcagaauggcuaug

SEQ ID NO: 192374 - RNA, 22 nt, Human
ugggaagauggagugacaggca

SEQ ID NO: 192375 - RNA, 22 nt, Human
agaaacucauccuggagaugac

SEQ ID NO: 192376 - RNA, 22 nt, Human
ugaauaauuccuuuuugucaag

SEQ ID NO: 192377 - RNA, 22 nt, Human
uguccaggaguaaaaagaccug

SEQ ID NO: 192378 - RNA, 22 nt, Human
ccauggcaauggucagucuauu

SEQ ID NO: 192379 - RNA, 22 nt, Human
agaugguggacuaucugacuug

SEQ ID NO: 192380 - RNA, 22 nt, Human
uccaggacagcggcaggcagau

SEQ ID NO: 192381 - RNA, 22 nt, Human
acagaauuugcuugggcaaugg

SEQ ID NO: 192382 - RNA, 19 nt, Human
agcugcagaccagaagugc

SEQ ID NO: 192383 - RNA, 22 nt, Human
aucugggccagccccaagagac

SEQ ID NO: 192384 - RNA, 20 nt, Human
agcuggucuuaaguaacuga

SEQ ID NO: 192385 - RNA, 22 nt, Human
caggcucaaggcugacuuccau

SEQ ID NO: 192386 - RNA, 22 nt, Human
ccuggaucccgauggcugugag

SEQ ID NO: 192387 - RNA, 22 nt, Human
cccucagcuccacccucagcag

SEQ ID NO: 192388 - RNA, 22 nt, Human
aaugcacauauauguguauaca

SEQ ID NO: 192389 - RNA, 21 nt, Human
ucagcuuugcaacugcacauc

SEQ ID NO: 192390 - RNA, 22 nt, Human
gcaccaggcuuagagccccagg

SEQ ID NO: 192391 - RNA, 22 nt, Human
agcugcaacuguccuugccuug

SEQ ID NO: 192392 - RNA, 22 nt, Human
auugagaauauugugacagugu

SEQ ID NO: 192393 - RNA, 21 nt, Human
agaaccuuggaugccauugca

SEQ ID NO: 192394 - RNA, 22 nt, Human
uggcacugacagggugcucaag

SEQ ID NO: 192395 - RNA, 22 nt, Human
auuguuuaaagauacaucccug

SEQ ID NO: 192396 - RNA, 22 nt, Human
ugaggcaguugagcuuccugag

SEQ ID NO: 192397 - RNA, 22 nt, Human
caccaggugcuggaggacauca

SEQ ID NO: 192398 - RNA, 22 nt, Human
aaaauuauggaguaucccaaag

SEQ ID NO: 192399 - RNA, 22 nt, Human
uucaguuucguuaucuaugaga

SEQ ID NO: 192400 - RNA, 22 nt, Human
caggaagaggacaggcuucccc

SEQ ID NO: 192401 - RNA, 22 nt, Human
auuggucucuagagucuauugu

SEQ ID NO: 192402 - RNA, 22 nt, Human
agcugcugccgguggccacccu

SEQ ID NO: 192403 - RNA, 22 nt, Human
guggcugguuuccugcaugcaa

SEQ ID NO: 192404 - RNA, 22 nt, Human
ccuggcacugaccaggcacuga

SEQ ID NO: 192405 - RNA, 22 nt, Human
ugguuaaguccagaaaggaagc

SEQ ID NO: 192406 - RNA, 22 nt, Human
cucugggccaccgcugguguau

SEQ ID NO: 192407 - RNA, 22 nt, Human
gcaggaguuaggcgucguggau

SEQ ID NO: 192408 - RNA, 22 nt, Human
cugggucucuuuagggugccgu

SEQ ID NO: 192409 - RNA, 22 nt, Human
acagugcugugcagucugcccu

SEQ ID NO: 192410 - RNA, 22 nt, Human
ugggagcaccuugagggcagaa

SEQ ID NO: 192411 - RNA, 22 nt, Human
auguucuguuuuguaauucaua

SEQ ID NO: 192412 - RNA, 22 nt, Human
uagaagcacagguuaaaggcau

SEQ ID NO: 192413 - RNA, 22 nt, Human
uuugucaaucccuugaaaaccu

SEQ ID NO: 192414 - RNA, 22 nt, Human
uucagaaacagagugagugagu

SEQ ID NO: 192415 - RNA, 22 nt, Human
cagcccuguccagcagagggug

SEQ ID NO: 192416 - RNA, 22 nt, Human
uuucucagcucagcaucugggu

SEQ ID NO: 192417 - RNA, 22 nt, Human
ggcaggcaaugaggaugggaag

SEQ ID NO: 192418 - RNA, 22 nt, Human
cauuuauuggcauguaguaggu

SEQ ID NO: 192419 - RNA, 22 nt, Human
gaaaguuuucucacacaguaau

SEQ ID NO: 192420 - RNA, 22 nt, Human
cuuuagaaaucuggauguauuu

SEQ ID NO: 192421 - RNA, 22 nt, Human
aguguaugcagguuuucaaugu

SEQ ID NO: 192422 - RNA, 19 nt, Human
uccagacuguccaggcuau

SEQ ID NO: 192423 - RNA, 22 nt, Human
aggaagccacgaguggcacggg

SEQ ID NO: 192424 - RNA, 22 nt, Human
agccuaggggguccugggccac

SEQ ID NO: 192425 - RNA, 22 nt, Human
gcccacaguuaaugggggcucu

SEQ ID NO: 192426 - RNA, 22 nt, Human
ucuggguguagggccuggcaac

SEQ ID NO: 192427 - RNA, 22 nt, Human
ccacagcuucuuauaucacugg

SEQ ID NO: 192428 - RNA, 22 nt, Human
ucugggaagauguuucaaaggu

SEQ ID NO: 192429 - RNA, 22 nt, Human
cuuggaauggggcagaaaaugg

SEQ ID NO: 192430 - RNA, 22 nt, Human
gggaucugggacaacagguggu

SEQ ID NO: 192431 - RNA, 22 nt, Human
uuuggcaaagaucaacauguua

SEQ ID NO: 192432 - RNA, 22 nt, Human
uauuucuaagagauaucuguac

SEQ ID NO: 192433 - RNA, 22 nt, Human
gggaaugugucugauggaaaga

SEQ ID NO: 192434 - RNA, 22 nt, Human
ggcaucaggagcuucuucaggu

SEQ ID NO: 192435 - RNA, 22 nt, Human
augggagaaacaucaugaggca

SEQ ID NO: 192436 - RNA, 22 nt, Human
uuaagacauucagauauuucua

SEQ ID NO: 192437 - RNA, 20 nt, Human
uucuagaaguuugcuaccca

SEQ ID NO: 192438 - RNA, 22 nt, Human
uuccugagggacuuuugagauu

SEQ ID NO: 192439 - RNA, 22 nt, Human
agcaacagcagguuugcacucc

SEQ ID NO: 192440 - RNA, 22 nt, Human
caagaaggcuauaugggccagg

SEQ ID NO: 192441 - RNA, 22 nt, Human
ugggaaccacaggacucggcac

SEQ ID NO: 192442 - RNA, 22 nt, Human
cucuguagccauggguauauuc

SEQ ID NO: 192443 - RNA, 22 nt, Human
uggcaauaugcuuucaguggcc

SEQ ID NO: 192444 - RNA, 22 nt, Human
cuggauggucccaugagcagcu

SEQ ID NO: 192445 - RNA, 22 nt, Human
ucagggcauacucuucaagguc

SEQ ID NO: 192446 - RNA, 22 nt, Human
caggugaggcugaacagaugaa

SEQ ID NO: 192447 - RNA, 22 nt, Human
gagaaggcuuccaaauucugug

SEQ ID NO: 192448 - RNA, 22 nt, Human
ugcaauaaguuguguuaucacu

SEQ ID NO: 192449 - RNA, 22 nt, Human
aguauaaagugguuuucagcac

SEQ ID NO: 192450 - RNA, 22 nt, Human
uaauuacagagguuugccaguu

SEQ ID NO: 192451 - RNA, 22 nt, Human
agcaccagcucaaggugcaccu

SEQ ID NO: 192452 - RNA, 22 nt, Human
gggccaagggugcguggcagga

SEQ ID NO: 192453 - RNA, 22 nt, Human
uuuccaggagaaagagagccuu

SEQ ID NO: 192454 - RNA, 22 nt, Human
acuaaaaacuacugccaauagc

SEQ ID NO: 192455 - RNA, 22 nt, Human
ugcaaucagaaaguucagcggu

SEQ ID NO: 192456 - RNA, 22 nt, Human
caggcauagguaggauguuucu

SEQ ID NO: 192457 - RNA, 22 nt, Human
gagaggcugaaaucacaggagc

SEQ ID NO: 192458 - RNA, 21 nt, Human
gcauuaaaagcaguuguuggu

SEQ ID NO: 192459 - RNA, 22 nt, Human
aguuugaauugaaaugcagaug

SEQ ID NO: 192460 - RNA, 22 nt, Human
caaauucucaagguuuauccca

SEQ ID NO: 192461 - RNA, 22 nt, Human
auguucuacagauggaaagggg

SEQ ID NO: 192462 - RNA, 22 nt, Human
aguguccuggggcccuaaggcc

SEQ ID NO: 192463 - RNA, 23 nt, Human
agaggcacuaauuauucagagau

SEQ ID NO: 192464 - RNA, 22 nt, Human
gcugugugcugggcauggcacu

SEQ ID NO: 192465 - RNA, 22 nt, Human
auauucuauaagcaguuggaag

SEQ ID NO: 192466 - RNA, 22 nt, Human
aagucacagaacccauuguaac

SEQ ID NO: 192467 - RNA, 22 nt, Human
ucuggagaaaguugaguuugug

SEQ ID NO: 192468 - RNA, 17 nt, Human
ggcugcaguccaggagg

SEQ ID NO: 192469 - RNA, 22 nt, Human
uuucaaguacuguaaacaugcu

SEQ ID NO: 192470 - RNA, 22 nt, Human
acaugacauaguagaaaagccc

SEQ ID NO: 192471 - RNA, 22 nt, Human
cuggccaagcuucucuaagcag

SEQ ID NO: 192472 - RNA, 21 nt, Human
gggggaagaggaguugcuagu

SEQ ID NO: 192473 - RNA, 22 nt, Human
gcccagcacuccucucugacau

SEQ ID NO: 192474 - RNA, 22 nt, Human
uuuccuugcacauugguuucca

SEQ ID NO: 192475 - RNA, 22 nt, Human
gucuguagucacacaggugaca

SEQ ID NO: 192476 - RNA, 20 nt, Human
agugccagggcaggugagag

SEQ ID NO: 192477 - RNA, 22 nt, Human
cagagugauggcaccugcuggg

SEQ ID NO: 192478 - RNA, 22 nt, Human
ccugugacuuggcaaaccucca

SEQ ID NO: 192479 - RNA, 22 nt, Human
uucuucaacaaggacacuguua

SEQ ID NO: 192480 - RNA, 22 nt, Human
cagagccaaaugcugugguuau

SEQ ID NO: 192481 - RNA, 19 nt, Human
agggaauccggcugaggga

SEQ ID NO: 192482 - RNA, 22 nt, Human
guuuacauguacucauuauacu

SEQ ID NO: 192483 - RNA, 22 nt, Human
caccagcuacucggguuuccug

SEQ ID NO: 192484 - RNA, 22 nt, Human
caauagaaaacucaauacuuaa

SEQ ID NO: 192485 - RNA, 22 nt, Human
aggugucugugaugggagcgau

SEQ ID NO: 192486 - RNA, 22 nt, Human
agaggccucccucccagcuggu

SEQ ID NO: 192487 - RNA, 22 nt, Human
ugcagcaaacaggccuucaggg

SEQ ID NO: 192488 - RNA, 22 nt, Human
ucugcuguucauucuuuuagcu

SEQ ID NO: 192489 - RNA, 22 nt, Human
gcuggccugaccugaggcuggg

SEQ ID NO: 192490 - RNA, 22 nt, Human
ucaagagacaggacguguuuca

SEQ ID NO: 192491 - RNA, 22 nt, Human
aagcucagaguagcucagcguc

SEQ ID NO: 192492 - RNA, 22 nt, Human
agugucuguuacgcuugcagaa

SEQ ID NO: 192493 - RNA, 22 nt, Human
gagcugaauuacggugagucau

SEQ ID NO: 192494 - RNA, 22 nt, Human
uuauuacacugaaagaauugcg

SEQ ID NO: 192495 - RNA, 22 nt, Human
aaaccuagaaggaagggucucu

SEQ ID NO: 192496 - RNA, 22 nt, Human
ucagacagugugaucagucucu

SEQ ID NO: 192497 - RNA, 22 nt, Human
gaugaggaaaccaaggcucagg

SEQ ID NO: 192498 - RNA, 22 nt, Human
agugggguccucaguaugguuc

SEQ ID NO: 192499 - RNA, 22 nt, Human
ccaggacaauucgucacuuucu

SEQ ID NO: 192500 - RNA, 22 nt, Human
auuagguaaucuuuagauacac

SEQ ID NO: 192501 - RNA, 22 nt, Human
ugacacagauuagagacauacc

SEQ ID NO: 192502 - RNA, 22 nt, Human
uuuaggaauauuuucuuucagg

SEQ ID NO: 192503 - RNA, 22 nt, Human
ucagaggaacuggacuaaagcc

SEQ ID NO: 192504 - RNA, 18 nt, Human
gcacagcuaggagggucc

SEQ ID NO: 192505 - RNA, 22 nt, Human
ucuguggauuuuaguguucaug

SEQ ID NO: 192506 - RNA, 22 nt, Human
gugaagaucugagcccucaggu

SEQ ID NO: 192507 - RNA, 22 nt, Human
uuuauuuaccuuauguccucca

SEQ ID NO: 192508 - RNA, 22 nt, Human
ucucuguaucagcaccugcugg

SEQ ID NO: 192509 - RNA, 22 nt, Human
ucaggaguaaagacagaguucc

SEQ ID NO: 192510 - RNA, 22 nt, Human
aaguuucuguaugcucuucugu

SEQ ID NO: 192511 - RNA, 22 nt, Human
uguacuuaugagauccuagucg

SEQ ID NO: 192512 - RNA, 22 nt, Human
aucuguaauuuugaaugcaaau

SEQ ID NO: 192513 - RNA, 19 nt, Human
agugcaugggcgaggugca

SEQ ID NO: 192514 - RNA, 22 nt, Human
agcugcaaaccaggccggcgcg

SEQ ID NO: 192515 - RNA, 22 nt, Human
gggcagcagcaggaggucucug

SEQ ID NO: 192516 - RNA, 23 nt, Human
ucagaggaucaucaaacguuuuc

SEQ ID NO: 192517 - RNA, 22 nt, Human
ucacacagggucggaaagagug

SEQ ID NO: 192518 - RNA, 22 nt, Human
aggcagcugaccacaguaugau

SEQ ID NO: 192519 - RNA, 22 nt, Human
aauuccaaaucaacuagucuag

SEQ ID NO: 192520 - RNA, 22 nt, Human
aauaauacaugagauuaauguu

SEQ ID NO: 192521 - RNA, 22 nt, Human
aaauaagugugggccagucaaa

SEQ ID NO: 192522 - RNA, 22 nt, Human
ucugccaucuuaauucucuuuu

SEQ ID NO: 192523 - RNA, 22 nt, Human
ugggcagugagaaaggucaggu

SEQ ID NO: 192524 - RNA, 22 nt, Human
ucucaaauggcaaauguggguc

SEQ ID NO: 192525 - RNA, 22 nt, Human
uuaaaugaugcauaucauuuag

SEQ ID NO: 192526 - RNA, 19 nt, Human
ugaggggcucacagucuca

SEQ ID NO: 192527 - RNA, 18 nt, Human
gucuuuggaguggaggua

SEQ ID NO: 192528 - RNA, 22 nt, Human
caguuucccugcuugaaaacgu

SEQ ID NO: 192529 - RNA, 22 nt, Human
uggggucccaacucugauugau

SEQ ID NO: 192530 - RNA, 22 nt, Human
aucagcaaucucguguauuagg

SEQ ID NO: 192531 - RNA, 22 nt, Human
cuccugugaggcuuaagcccag

SEQ ID NO: 192532 - RNA, 22 nt, Human
aucuuuggacggucccaacuga

SEQ ID NO: 192533 - RNA, 22 nt, Human
caucucaucagugagagucagc

SEQ ID NO: 192534 - RNA, 22 nt, Human
uguguucaucaugauaucaggu

SEQ ID NO: 192535 - RNA, 22 nt, Human
auguggauguuuauaugaagaa

SEQ ID NO: 192536 - RNA, 22 nt, Human
uguaaugggcuacuaggaagag

SEQ ID NO: 192537 - RNA, 22 nt, Human
acaagauuuaaugcaacccaag

SEQ ID NO: 192538 - RNA, 21 nt, Human
caguuacagccaggacaaggc

SEQ ID NO: 192539 - RNA, 22 nt, Human
uucuguauuuaguuugaggaca

SEQ ID NO: 192540 - RNA, 22 nt, Human
aaugucuucaguguauacaugg

SEQ ID NO: 192541 - RNA, 22 nt, Human
uccaaggacgcuggaccccugc

SEQ ID NO: 192542 - RNA, 22 nt, Human
agccaagaggagccuaaagcga

SEQ ID NO: 192543 - RNA, 22 nt, Human
uccucagcaaacacuucacucu

SEQ ID NO: 192544 - RNA, 22 nt, Human
gcucuucuaaagaauguacagg

SEQ ID NO: 192545 - RNA, 22 nt, Human
uuacagagauaaacuguaagug

SEQ ID NO: 192546 - RNA, 22 nt, Human
cauuuauauaaaauguccagaa

SEQ ID NO: 192547 - RNA, 22 nt, Human
ccaggagcaggagcugcagcug

SEQ ID NO: 192548 - RNA, 22 nt, Human
cacacaggaugaagcagcagaa

SEQ ID NO: 192549 - RNA, 22 nt, Human
ggggccuuggaucugugccccg

SEQ ID NO: 192550 - RNA, 22 nt, Human
cccagcuugcgggcggcaggag

SEQ ID NO: 192551 - RNA, 22 nt, Human
ucagaacagaagcuggcuauaa

SEQ ID NO: 192552 - RNA, 22 nt, Human
gggucugggcaggcgcuuccuc

SEQ ID NO: 192553 - RNA, 22 nt, Human
cugccugcuucugagccagagg

SEQ ID NO: 192554 - RNA, 23 nt, Human
acugaaaggauccuagcagagac

SEQ ID NO: 192555 - RNA, 22 nt, Human
gcagggcagugugucugugggg

SEQ ID NO: 192556 - RNA, 22 nt, Human
ucuuccuugccuugcuucauca

SEQ ID NO: 192557 - RNA, 22 nt, Human
cuuuccuccacucccuaggcuu

SEQ ID NO: 192558 - RNA, 22 nt, Human
gagugcugaaugcgagaacaga

SEQ ID NO: 192559 - RNA, 22 nt, Human
ugaucaaauucaggagucugga

SEQ ID NO: 192560 - RNA, 17 nt, Human
gcccacccuuaggagcu

SEQ ID NO: 192561 - RNA, 22 nt, Human
ucugaauucaguauggucuuuc

SEQ ID NO: 192562 - RNA, 21 nt, Human
aggcaggauucaaacacagag

SEQ ID NO: 192563 - RNA, 22 nt, Human
ccuccagggccccucucacugg

SEQ ID NO: 192564 - RNA, 22 nt, Human
ccucaggcuuacgggcaaugga

SEQ ID NO: 192565 - RNA, 22 nt, Human
agcagcagauucagcaggaaug

SEQ ID NO: 192566 - RNA, 22 nt, Human
uccugggaguaaaagcugcccu

SEQ ID NO: 192567 - RNA, 22 nt, Human
gacagacaccugggggguugcu

SEQ ID NO: 192568 - RNA, 22 nt, Human
cagacagaccugcaagggcaca

SEQ ID NO: 192569 - RNA, 22 nt, Human
uucauugauuuccuuggaauaa

SEQ ID NO: 192570 - RNA, 22 nt, Human
gcucaggcuggauugcaguggc

SEQ ID NO: 192571 - RNA, 22 nt, Human
cuucacauguuggaguccuuug

SEQ ID NO: 192572 - RNA, 22 nt, Human
agugucaacugucuacagggag

SEQ ID NO: 192573 - RNA, 22 nt, Human
ugcaaaauaaugaacgauuuuu

SEQ ID NO: 192574 - RNA, 22 nt, Human
caggcagccugcggucugcaca

SEQ ID NO: 192575 - RNA, 22 nt, Human
gucaggauuaaugggaguaugc

SEQ ID NO: 192576 - RNA, 22 nt, Human
uugcaggguugaccaauaggcu

SEQ ID NO: 192577 - RNA, 22 nt, Human
ugaggccuuaguaacccugcac

SEQ ID NO: 192578 - RNA, 22 nt, Human
ugcugauuuugccuacugaucc

SEQ ID NO: 192579 - RNA, 22 nt, Human
augagcagaugcuccugccucu

SEQ ID NO: 192580 - RNA, 22 nt, Human
gacaagauuaaccauaguuaag

SEQ ID NO: 192581 - RNA, 22 nt, Human
uuaggaaugagauuucuaguga

SEQ ID NO: 192582 - RNA, 22 nt, Human
ucaagacaggguuuaagguuga

SEQ ID NO: 192583 - RNA, 20 nt, Human
ucacacauaagugaacgcac

SEQ ID NO: 192584 - RNA, 22 nt, Human
ugcaggcccaguguagaggcuc

SEQ ID NO: 192585 - RNA, 22 nt, Human
agggcugcugaggaagccuugc

SEQ ID NO: 192586 - RNA, 22 nt, Human
auagcacaauauuaccuuuaug

SEQ ID NO: 192587 - RNA, 22 nt, Human
auauauuggugucagaaagagu

SEQ ID NO: 192588 - RNA, 22 nt, Human
ucagagcuaaggggagagcaaa

SEQ ID NO: 192589 - RNA, 22 nt, Human
gcugguccagggccucuguggg

SEQ ID NO: 192590 - RNA, 22 nt, Human
uacaagaaggauggagcccacu

SEQ ID NO: 192591 - RNA, 23 nt, Human
agugcucagggcauuaggcuaga

SEQ ID NO: 192592 - RNA, 22 nt, Human
aaaggcuugagcauuuguugaa

SEQ ID NO: 192593 - RNA, 22 nt, Human
cacauuuaaagguugaagcuga

SEQ ID NO: 192594 - RNA, 22 nt, Human
cagcugaagagaggugcugagu

SEQ ID NO: 192595 - RNA, 20 nt, Human
ccuggcuuugcagcaugaga

SEQ ID NO: 192596 - RNA, 22 nt, Human
ucugccuguggauacaugcucu

SEQ ID NO: 192597 - RNA, 22 nt, Human
uuugacaugaaguagcuuauaa

SEQ ID NO: 192598 - RNA, 22 nt, Human
uuggaaagucucacccaguuga

SEQ ID NO: 192599 - RNA, 22 nt, Human
uagaaaguagccacuuacagag

SEQ ID NO: 192600 - RNA, 21 nt, Human
agagaucugaagaaccauuag

SEQ ID NO: 192601 - RNA, 22 nt, Human
caggaaaugcguaguugaacuu

SEQ ID NO: 192602 - RNA, 22 nt, Human
ugacagacacaccuuaggaaag

SEQ ID NO: 192603 - RNA, 22 nt, Human
ugcagaggagcuggaaggcugg

SEQ ID NO: 192604 - RNA, 22 nt, Human
ggaggccaccauggagucacuu

SEQ ID NO: 192605 - RNA, 22 nt, Human
uggcaggugccuguaaucucag

SEQ ID NO: 192606 - RNA, 22 nt, Human
uagaauacaguuuaagaacuac

SEQ ID NO: 192607 - RNA, 22 nt, Human
gacagacacagggccaugauug

SEQ ID NO: 192608 - RNA, 22 nt, Human
ugcuuccuugagcucuccaauc

SEQ ID NO: 192609 - RNA, 22 nt, Human
cagucuuuuguauauuagcaga

SEQ ID NO: 192610 - RNA, 22 nt, Human
agguuccagguucgaaucccau

SEQ ID NO: 192611 - RNA, 22 nt, Human
gcuuuacaaguggugcagauua

SEQ ID NO: 192612 - RNA, 22 nt, Human
uucccagacuccacacugaggc

SEQ ID NO: 192613 - RNA, 22 nt, Human
cccaggucugugccagcucuga

SEQ ID NO: 192614 - RNA, 22 nt, Human
cacagcaggcacuauacagggc

SEQ ID NO: 192615 - RNA, 22 nt, Human
acaaaggcagagaauucaacau

SEQ ID NO: 192616 - RNA, 22 nt, Human
ccagcuuuaucaagucugagcu

SEQ ID NO: 192617 - RNA, 22 nt, Human
agugcugaagacuggcuaggga

SEQ ID NO: 192618 - RNA, 22 nt, Human
cgcagggccgcgagcgggacca

SEQ ID NO: 192619 - RNA, 22 nt, Human
ggugaaauuccuuguggaaagu

SEQ ID NO: 192620 - RNA, 22 nt, Human
aaugucaaaauggaaugagacu

SEQ ID NO: 192621 - RNA, 22 nt, Human
agaaagacaaaaugcaguggcu

SEQ ID NO: 192622 - RNA, 22 nt, Human
gugcaguaucucugggaguggg

SEQ ID NO: 192623 - RNA, 22 nt, Human
cccaggucccggggccagcugc

SEQ ID NO: 192624 - RNA, 22 nt, Human
guaagccugagaaacaccaccu

SEQ ID NO: 192625 - RNA, 22 nt, Human
uuugguuuagggucauuuaaca

SEQ ID NO: 192626 - RNA, 22 nt, Human
cguggcuggggcgacuccacgg

SEQ ID NO: 192627 - RNA, 22 nt, Human
augguuuuucaaguauucagaa

SEQ ID NO: 192628 - RNA, 22 nt, Human
cacugugucuggagugagcugg

SEQ ID NO: 192629 - RNA, 22 nt, Human
ucaaaguauaauugcuuuuuug

SEQ ID NO: 192630 - RNA, 22 nt, Human
gagccaagcucuucuccaugag

SEQ ID NO: 192631 - RNA, 22 nt, Human
auggagggaaaaguggagagcc

SEQ ID NO: 192632 - RNA, 22 nt, Human
guggccagaaccaggagaauga

SEQ ID NO: 192633 - RNA, 22 nt, Human
gcuuugugaauuauuacucaca

SEQ ID NO: 192634 - RNA, 22 nt, Human
uuacaguagauuuugaaugugg

SEQ ID NO: 192635 - RNA, 22 nt, Human
aagcaaacaggagaagagcugu

SEQ ID NO: 192636 - RNA, 22 nt, Human
auccuggcgggggaacugccca

SEQ ID NO: 192637 - RNA, 22 nt, Human
agaugaaagauuuuuauagaga

SEQ ID NO: 192638 - RNA, 22 nt, Human
cccagggagguagcaggagaaa

SEQ ID NO: 192639 - RNA, 22 nt, Human
acauuucaguaaguguuaauuu

SEQ ID NO: 192640 - RNA, 22 nt, Human
uccuggaguuuguggugauaug

SEQ ID NO: 192641 - RNA, 22 nt, Human
aaauugcugacacuugaccauu

SEQ ID NO: 192642 - RNA, 22 nt, Human
cuccugaguaguagcauuguca

SEQ ID NO: 192643 - RNA, 22 nt, Human
caggcacaaugagcgccaucuu

SEQ ID NO: 192644 - RNA, 22 nt, Human
auuuauuccugauuccuggcuu

SEQ ID NO: 192645 - RNA, 22 nt, Human
ggugugggcccugaugucagca

SEQ ID NO: 192646 - RNA, 21 nt, Human
ggcugccugggaagaagaaga

SEQ ID NO: 192647 - RNA, 22 nt, Human
gcuuaggaguuucaggcucuca

SEQ ID NO: 192648 - RNA, 22 nt, Human
uccucuggauauaagccucacc

SEQ ID NO: 192649 - RNA, 22 nt, Human
cugccugugugugccugcagaa

SEQ ID NO: 192650 - RNA, 22 nt, Human
ggccagaguugauggcaucuug

SEQ ID NO: 192651 - RNA, 22 nt, Human
uguaaaacaaaauuuguggaga

SEQ ID NO: 192652 - RNA, 22 nt, Human
agcuuuauauuuaaugaauucu

SEQ ID NO: 192653 - RNA, 22 nt, Human
aauuuugugugggaucaaagga

SEQ ID NO: 192654 - RNA, 22 nt, Human
uuacaauaguuccuucuuuugu

SEQ ID NO: 192655 - RNA, 22 nt, Human
auuagcugugacgaggcauugu

SEQ ID NO: 192656 - RNA, 22 nt, Human
aaugucuacauucugaauucgu

SEQ ID NO: 192657 - RNA, 22 nt, Human
gccuuccaccuaggccucugcu

SEQ ID NO: 192658 - RNA, 22 nt, Human
cuucugugcuaaaugcaaaacc

SEQ ID NO: 192659 - RNA, 20 nt, Human
uuucugugcccaggucuguu

SEQ ID NO: 192660 - RNA, 22 nt, Human
aguggcugaagcaucaaaggca

SEQ ID NO: 192661 - RNA, 19 nt, Human
ugcagagagaggcaaagaa

SEQ ID NO: 192662 - RNA, 22 nt, Human
cuguggcuaugguguacauacu

SEQ ID NO: 192663 - RNA, 22 nt, Human
acaggucuacuggcaagcagug

SEQ ID NO: 192664 - RNA, 22 nt, Human
ccugaaauccauaguuuacacu

SEQ ID NO: 192665 - RNA, 22 nt, Human
gcccugagccuaugagccucuc

SEQ ID NO: 192666 - RNA, 22 nt, Human
ggccacugcccuggcuacaccg

SEQ ID NO: 192667 - RNA, 22 nt, Human
ggcaauuaaaguacugugaaug

SEQ ID NO: 192668 - RNA, 22 nt, Human
acagucuuuaauuucuuugugg

SEQ ID NO: 192669 - RNA, 22 nt, Human
ccagcaggggaauauuuuuagg

SEQ ID NO: 192670 - RNA, 19 nt, Human
uccuggcacaguggaacca

SEQ ID NO: 192671 - RNA, 22 nt, Human
ggcucugccugcccagcagcac

SEQ ID NO: 192672 - RNA, 20 nt, Human
aucuucuuggccagcuugcu

SEQ ID NO: 192673 - RNA, 22 nt, Human
cuggaaagucaggucagaaacu

SEQ ID NO: 192674 - RNA, 22 nt, Human
auggcugcaguccgugcccugg

SEQ ID NO: 192675 - RNA, 23 nt, Human
uccaggcacgcauuucuucuagc

SEQ ID NO: 192676 - RNA, 22 nt, Human
ucacagaaguguagugaggaaa

SEQ ID NO: 192677 - RNA, 22 nt, Human
gccccuggcuggccagcuccuc

SEQ ID NO: 192678 - RNA, 22 nt, Human
ucuccaggugacucugauguau

SEQ ID NO: 192679 - RNA, 22 nt, Human
acaggcuggugguccuggccau

SEQ ID NO: 192680 - RNA, 22 nt, Human
agagggcuuugauucucaguuc

SEQ ID NO: 192681 - RNA, 22 nt, Human
uccaggaacucuugauggugau

SEQ ID NO: 192682 - RNA, 22 nt, Human
ucccagggcucuagagugcugg

SEQ ID NO: 192683 - RNA, 22 nt, Human
cuacaggucaagcaguagcucu

SEQ ID NO: 192684 - RNA, 22 nt, Human
uaggguaguaccaugcugccag

SEQ ID NO: 192685 - RNA, 22 nt, Human
augacaggaggcagcugggcag

SEQ ID NO: 192686 - RNA, 22 nt, Human
ccugccagugccucccacuggu

SEQ ID NO: 192687 - RNA, 22 nt, Human
cuucaguuaguuucaugugagc

SEQ ID NO: 192688 - RNA, 22 nt, Human
gcagagccaggagagacccuug

SEQ ID NO: 192689 - RNA, 22 nt, Human
gcucaggcaaauuucuggugaa

SEQ ID NO: 192690 - RNA, 22 nt, Human
gcccuccaccuggucucucugg

SEQ ID NO: 192691 - RNA, 23 nt, Human
uccuuccuuugagaggcuccauc

SEQ ID NO: 192692 - RNA, 22 nt, Human
uguuuacuuaaauguuuucaua

SEQ ID NO: 192693 - RNA, 22 nt, Human
caugcucacuuuuauacuguaa

SEQ ID NO: 192694 - RNA, 19 nt, Human
agaaaaacugguacugcug

SEQ ID NO: 192695 - RNA, 22 nt, Human
gccagcucagugccaggccccu

SEQ ID NO: 192696 - RNA, 22 nt, Human
ucacaucugauuagugacugau

SEQ ID NO: 192697 - RNA, 22 nt, Human
gagagaggccuccauguacuga

SEQ ID NO: 192698 - RNA, 22 nt, Human
uaaaaaacauuacucuguccug

SEQ ID NO: 192699 - RNA, 22 nt, Human
gggcuggcaggaccugggcuga

SEQ ID NO: 192700 - RNA, 22 nt, Human
acaaaugacuauuugguacagg

SEQ ID NO: 192701 - RNA, 22 nt, Human
uuggaacaugccgggguccagg

SEQ ID NO: 192702 - RNA, 22 nt, Human
cgcugcagacgcgcuggcgaaa

SEQ ID NO: 192703 - RNA, 22 nt, Human
uugucuggucaaaucacuugua

SEQ ID NO: 192704 - RNA, 22 nt, Human
aggaaccuaagagccugcaguc

SEQ ID NO: 192705 - RNA, 22 nt, Human
aauccauuuacucuuuacaaga

SEQ ID NO: 192706 - RNA, 22 nt, Human
ccucuguaagccucaguuucuu

SEQ ID NO: 192707 - RNA, 22 nt, Human
cacacaccaaucaaaugucaga

SEQ ID NO: 192708 - RNA, 22 nt, Human
gaagauuucaguuaaguaucua

SEQ ID NO: 192709 - RNA, 22 nt, Human
caucugcugacuugacaaguac

SEQ ID NO: 192710 - RNA, 22 nt, Human
aacuauuuuuggagcuaacucu

SEQ ID NO: 192711 - RNA, 22 nt, Human
ucagaacugguauuuaucaagg

SEQ ID NO: 192712 - RNA, 22 nt, Human
cuaaagaauuuugcuugaccag

SEQ ID NO: 192713 - RNA, 22 nt, Human
uccucuggcucuuucccuagga

SEQ ID NO: 192714 - RNA, 22 nt, Human
auauacacauuugcuuaugugu

SEQ ID NO: 192715 - RNA, 22 nt, Human
aggaagaaaacuaauuagaugg

SEQ ID NO: 192716 - RNA, 20 nt, Human
aguggcugauggaaagaagc

SEQ ID NO: 192717 - RNA, 22 nt, Human
auuuccuaacagaggcaacagu

SEQ ID NO: 192718 - RNA, 22 nt, Human
ucuacugcacuggugucucauc

SEQ ID NO: 192719 - RNA, 22 nt, Human
ugagcagagcaguaacaggagc

SEQ ID NO: 192720 - RNA, 22 nt, Human
auuuucuauucugcugguuuag

SEQ ID NO: 192721 - RNA, 22 nt, Human
uuuacacaaaagauagcacacc

SEQ ID NO: 192722 - RNA, 22 nt, Human
agcaccugcuaugugucaggga

SEQ ID NO: 192723 - RNA, 22 nt, Human
aaaguauauuuacuuacuguga

SEQ ID NO: 192724 - RNA, 22 nt, Human
accaauuuuagagcaccaagaa

SEQ ID NO: 192725 - RNA, 22 nt, Human
ucuuuaaaguuggagcuugcaa

SEQ ID NO: 192726 - RNA, 22 nt, Human
augagggagggguggugccgca

SEQ ID NO: 192727 - RNA, 19 nt, Human
auuccucaaggacagaaau

SEQ ID NO: 192728 - RNA, 22 nt, Human
cuccucagucaggucuaggguc

SEQ ID NO: 192729 - RNA, 22 nt, Human
gagcccucgggcgagcccgcgc

SEQ ID NO: 192730 - RNA, 22 nt, Human
gaaaggagggaaacagagcggu

SEQ ID NO: 192731 - RNA, 22 nt, Human
uggcaguuauauugccuuaggg

SEQ ID NO: 192732 - RNA, 22 nt, Human
caauucauuacauugcaaagac

SEQ ID NO: 192733 - RNA, 22 nt, Human
gggcuggaccgcgaccccugag

SEQ ID NO: 192734 - RNA, 22 nt, Human
uucuuugguguuacccagcuca

SEQ ID NO: 192735 - RNA, 22 nt, Human
ugcagaagugagucaugaggaa

SEQ ID NO: 192736 - RNA, 22 nt, Human
ggcuggcgcucucccagcgcug

SEQ ID NO: 192737 - RNA, 22 nt, Human
uccaggagggggagccgugccg

SEQ ID NO: 192738 - RNA, 22 nt, Human
cagggagcuggaguuggaguac

SEQ ID NO: 192739 - RNA, 22 nt, Human
gcaccuggcugcccagguggag

SEQ ID NO: 192740 - RNA, 22 nt, Human
aauggcuggguuucauuuugua

SEQ ID NO: 192741 - RNA, 22 nt, Human
agcagcagaagguuugcaccca

SEQ ID NO: 192742 - RNA, 22 nt, Human
aggaagggcuguuucuccaaga

SEQ ID NO: 192743 - RNA, 22 nt, Human
agcaccuccuuagcuaugacca

SEQ ID NO: 192744 - RNA, 22 nt, Human
ugaugcaauguuuacaucuuga

SEQ ID NO: 192745 - RNA, 22 nt, Human
gucugcccuuccucuccacgau

SEQ ID NO: 192746 - RNA, 22 nt, Human
cugggcuccacuacuugcuaac

SEQ ID NO: 192747 - RNA, 22 nt, Human
gcugaagggagugcugagucug

SEQ ID NO: 192748 - RNA, 22 nt, Human
agucacugucaaagccacacac

SEQ ID NO: 192749 - RNA, 21 nt, Human
uccagaggaggacagacucag

SEQ ID NO: 192750 - RNA, 22 nt, Human
aucuagaaaguguugaagauca

SEQ ID NO: 192751 - RNA, 22 nt, Human
ucugucccugagagcucaggag

SEQ ID NO: 192752 - RNA, 18 nt, Human
ucccugggauauaauuac

SEQ ID NO: 192753 - RNA, 22 nt, Human
uacacauccuucugaacaaccu

SEQ ID NO: 192754 - RNA, 19 nt, Human
agacagagcucaguggguu

SEQ ID NO: 192755 - RNA, 22 nt, Human
aaucuacauagagaucaaauga

SEQ ID NO: 192756 - RNA, 22 nt, Human
auguuuaagaaagucuuccaua

SEQ ID NO: 192757 - RNA, 22 nt, Human
cccacagaaugccaaugagacc

SEQ ID NO: 192758 - RNA, 22 nt, Human
cagguccuggcaucaggcaggu

SEQ ID NO: 192759 - RNA, 23 nt, Human
aggaccagguucccaaaagucaa

SEQ ID NO: 192760 - RNA, 22 nt, Human
uucaggaauauaggcauugaca

SEQ ID NO: 192761 - RNA, 22 nt, Human
gaacuuugcaaaugucagaagc

SEQ ID NO: 192762 - RNA, 22 nt, Human
aucaggauagucuguaaauugu

SEQ ID NO: 192763 - RNA, 22 nt, Human
cucuuuggugcaccuugcaguc

SEQ ID NO: 192764 - RNA, 22 nt, Human
ccugcucugccaaguccucuuu

SEQ ID NO: 192765 - RNA, 22 nt, Human
cucagccaugucaugccuaccu

SEQ ID NO: 192766 - RNA, 22 nt, Human
uccagcuuuggcucuagcuaca

SEQ ID NO: 192767 - RNA, 22 nt, Human
ucugacccucagaucaugucca

SEQ ID NO: 192768 - RNA, 22 nt, Human
ggagcagcacugccacacagag

SEQ ID NO: 192769 - RNA, 22 nt, Human
ggcaucuucaaaauugccaaau

SEQ ID NO: 192770 - RNA, 22 nt, Human
uuccuguggccuuacaucugug

SEQ ID NO: 192771 - RNA, 22 nt, Human
uucuuaacuggaaaaugucaga

SEQ ID NO: 192772 - RNA, 22 nt, Human
acacugcagaugaaagcauaag

SEQ ID NO: 192773 - RNA, 22 nt, Human
uuucugcagcagacucagugug

SEQ ID NO: 192774 - RNA, 22 nt, Human
gaggccuggguuaccuacucgu

SEQ ID NO: 192775 - RNA, 22 nt, Human
ccagcuuggaauaugccauugu

SEQ ID NO: 192776 - RNA, 22 nt, Human
ucuggcucuuugggugauugua

SEQ ID NO: 192777 - RNA, 23 nt, Human
aggcccugccugucccucuuuuu

SEQ ID NO: 192778 - RNA, 22 nt, Human
augaaacaugcuuuguggauga

SEQ ID NO: 192779 - RNA, 22 nt, Human
uuucucucuuaaggaguuuaaa

SEQ ID NO: 192780 - RNA, 22 nt, Human
agucauuucccauucuucauau

SEQ ID NO: 192781 - RNA, 21 nt, Human
ugcuucucuagaucaacuacu

SEQ ID NO: 192782 - RNA, 22 nt, Human
agaaacucuaggucaauugagg

SEQ ID NO: 192783 - RNA, 22 nt, Human
ccuguaggaacgccuucauuug

SEQ ID NO: 192784 - RNA, 22 nt, Human
ucuggcagcagcaucaguggcu

SEQ ID NO: 192785 - RNA, 22 nt, Human
uuccuuccugucuuccuuacug

SEQ ID NO: 192786 - RNA, 22 nt, Human
uggcagaguuauggguauuuau

SEQ ID NO: 192787 - RNA, 22 nt, Human
cacaggcuuuucugacauaggc

SEQ ID NO: 192788 - RNA, 22 nt, Human
aucagagauggcuccagugcuc

SEQ ID NO: 192789 - RNA, 22 nt, Human
ucccagagauuuccucuccuuc

SEQ ID NO: 192790 - RNA, 20 nt, Human
ccucaggccaguuuuaaagu

SEQ ID NO: 192791 - RNA, 22 nt, Human
auggauuggauuuuuauggacc

SEQ ID NO: 192792 - RNA, 20 nt, Human
cuucuucagccuaugcuuca

SEQ ID NO: 192793 - RNA, 22 nt, Human
acaguuuacuggccuugccguu

SEQ ID NO: 192794 - RNA, 22 nt, Human
ugaggauggggagauggugucu

SEQ ID NO: 192795 - RNA, 22 nt, Human
uucucuguggauugggugagag

SEQ ID NO: 192796 - RNA, 22 nt, Human
gacuuuauccugccugaccacg

SEQ ID NO: 192797 - RNA, 22 nt, Human
cugggaggcaccgcgucgugcu

SEQ ID NO: 192798 - RNA, 22 nt, Human
ucuccacaccagaaggagcuga

SEQ ID NO: 192799 - RNA, 22 nt, Human
ugggaagggucugaaucugaga

SEQ ID NO: 192800 - RNA, 22 nt, Human
uagggacaaagagcugaggccu

SEQ ID NO: 192801 - RNA, 22 nt, Human
uggcucugcgucuguucguggg

SEQ ID NO: 192802 - RNA, 22 nt, Human
aaauagcaaugugaaaagagga

SEQ ID NO: 192803 - RNA, 22 nt, Human
gcauucuuuuugacuccugguu

SEQ ID NO: 192804 - RNA, 21 nt, Human
ggguccugggaugggauccag

SEQ ID NO: 192805 - RNA, 22 nt, Human
cagagacaacaaguuuaacuau

SEQ ID NO: 192806 - RNA, 22 nt, Human
ugaguccaucgcagggaagugg

SEQ ID NO: 192807 - RNA, 22 nt, Human
cauagaaaguauuauggaauuu

SEQ ID NO: 192808 - RNA, 22 nt, Human
acaggauuucaccauguuggcc

SEQ ID NO: 192809 - RNA, 22 nt, Human
auugcuggcaucagugacaaua

SEQ ID NO: 192810 - RNA, 22 nt, Human
auauauuguaucuuucaugggg

SEQ ID NO: 192811 - RNA, 22 nt, Human
ccuggcucgcugaccucagggg

SEQ ID NO: 192812 - RNA, 22 nt, Human
gagggcugcaaugagacagaga

SEQ ID NO: 192813 - RNA, 23 nt, Human
gggugggccaaauuagguagccu

SEQ ID NO: 192814 - RNA, 20 nt, Human
auagaaguauuauguaaugu

SEQ ID NO: 192815 - RNA, 22 nt, Human
ucuugcauacacuauauguaca

SEQ ID NO: 192816 - RNA, 18 nt, Human
uccucucuuuccccaggg

SEQ ID NO: 192817 - RNA, 23 nt, Human
uucuuuauaaaucaaugggaugu

SEQ ID NO: 192818 - RNA, 22 nt, Human
gacuggccuggagaugcagcug

SEQ ID NO: 192819 - RNA, 19 nt, Human
cgguggcuugcagggaggu

SEQ ID NO: 192820 - RNA, 22 nt, Human
uguuuuaagagcgcacuuuaua

SEQ ID NO: 192821 - RNA, 22 nt, Human
uuuccaagagcuuauuucugaa

SEQ ID NO: 192822 - RNA, 22 nt, Human
aggaggagguaagaaaagcaua

SEQ ID NO: 192823 - RNA, 20 nt, Human
uugaaugaaugucuggcuca

SEQ ID NO: 192824 - RNA, 22 nt, Human
ucuccuggccuuuagguuaagg

SEQ ID NO: 192825 - RNA, 22 nt, Human
gcccuggggaaggugucuccaa

SEQ ID NO: 192826 - RNA, 21 nt, Human
ucauuuauugagaaaugacug

SEQ ID NO: 192827 - RNA, 22 nt, Human
ugacaccaaggaaguaucauuu

SEQ ID NO: 192828 - RNA, 22 nt, Human
ucucagcugccugcccugcucc

SEQ ID NO: 192829 - RNA, 22 nt, Human
uuuuuugucccagagagccugg

SEQ ID NO: 192830 - RNA, 17 nt, Human
uagcauuuaucuuccuu

SEQ ID NO: 192831 - RNA, 22 nt, Human
guccucuccaggaggcucugau

SEQ ID NO: 192832 - RNA, 22 nt, Human
augaacaucggaaaugagacug

SEQ ID NO: 192833 - RNA, 16 nt, Human
uggcagguuuuuaucu

SEQ ID NO: 192834 - RNA, 22 nt, Human
agauggucuaguugaaccauau

SEQ ID NO: 192835 - RNA, 22 nt, Human
ugggaagccuagcagacagcug

SEQ ID NO: 192836 - RNA, 22 nt, Human
uuuaauguauucuuuggaacca

SEQ ID NO: 192837 - RNA, 22 nt, Human
gggaaagaccuuccuggggugu

SEQ ID NO: 192838 - RNA, 20 nt, Human
augagucuacacacuggcuu

SEQ ID NO: 192839 - RNA, 22 nt, Human
ccagggaagauuagaagccacu

SEQ ID NO: 192840 - RNA, 22 nt, Human
ugggaaaguguugaggugucuu

SEQ ID NO: 192841 - RNA, 22 nt, Human
cauaauuagucauguuaugcau

SEQ ID NO: 192842 - RNA, 22 nt, Human
cgcaauuaauucgggccacagu

SEQ ID NO: 192843 - RNA, 22 nt, Human
uuugacuccugccuucuccugu

SEQ ID NO: 192844 - RNA, 22 nt, Human
aggugagguuugggagguguca

SEQ ID NO: 192845 - RNA, 22 nt, Human
auucaguguuugcagcaacuuu

SEQ ID NO: 192846 - RNA, 22 nt, Human
augaggcaggaaaggcguaucu

SEQ ID NO: 192847 - RNA, 22 nt, Human
ggccugagcagacagcaugaug

SEQ ID NO: 192848 - RNA, 22 nt, Human
uuucuucucgacaccuuauccc

SEQ ID NO: 192849 - RNA, 21 nt, Human
aggaagaaagguuggagguug

SEQ ID NO: 192850 - RNA, 19 nt, Human
ggccaucucugccccagca

SEQ ID NO: 192851 - RNA, 22 nt, Human
gcacacaugcguguauaugggu

SEQ ID NO: 192852 - RNA, 22 nt, Human
ccuguucauuuuuugacucugc

SEQ ID NO: 192853 - RNA, 22 nt, Human
ggcaaggggucaggcugagaca

SEQ ID NO: 192854 - RNA, 22 nt, Human
uugagucugcaauacauaacac

SEQ ID NO: 192855 - RNA, 22 nt, Human
ucuguggaguuagacugguauc

SEQ ID NO: 192856 - RNA, 22 nt, Human
uguugccugacuuuaaaaugug

SEQ ID NO: 192857 - RNA, 22 nt, Human
cugaggccucucccacuccagc

SEQ ID NO: 192858 - RNA, 22 nt, Human
acaguacauagaucucuacccu

SEQ ID NO: 192859 - RNA, 22 nt, Human
ccugagugaccugaggucuagu

SEQ ID NO: 192860 - RNA, 22 nt, Human
uauuuuagguaauauccauugu

SEQ ID NO: 192861 - RNA, 22 nt, Human
aguaaugauuauguacagaaug

SEQ ID NO: 192862 - RNA, 22 nt, Human
ucaaugcaugugacaaagagua

SEQ ID NO: 192863 - RNA, 22 nt, Human
ggcccucccugagccagguggg

SEQ ID NO: 192864 - RNA, 22 nt, Human
ggguuccaaacauagucuuccu

SEQ ID NO: 192865 - RNA, 22 nt, Human
acugagcauaaauaugugucca

SEQ ID NO: 192866 - RNA, 22 nt, Human
uggacacacauguaugucagag

SEQ ID NO: 192867 - RNA, 22 nt, Human
guggcugcucgggcuccggccc

SEQ ID NO: 192868 - RNA, 22 nt, Human
uaauuuuuccacguacacuggg

SEQ ID NO: 192869 - RNA, 22 nt, Human
guccagcccucugccuccaggu

SEQ ID NO: 192870 - RNA, 22 nt, Human
gacagcaguuuuucucuagggu

SEQ ID NO: 192871 - RNA, 21 nt, Human
gcuggcugucccagggaagca

SEQ ID NO: 192872 - RNA, 22 nt, Human
cuucuuuagggaucucuugcug

SEQ ID NO: 192873 - RNA, 22 nt, Human
auauuuuccgaacuugagguag

SEQ ID NO: 192874 - RNA, 18 nt, Human
ccuggagcuccacagcaa

SEQ ID NO: 192875 - RNA, 22 nt, Human
cugucccacaagcagugugcac

SEQ ID NO: 192876 - RNA, 22 nt, Human
uggcuaugcaaaccugaggcug

SEQ ID NO: 192877 - RNA, 22 nt, Human
uagguucacacaucuuccagau

SEQ ID NO: 192878 - RNA, 22 nt, Human
cagugcagucaaggaagaacca

SEQ ID NO: 192879 - RNA, 22 nt, Human
uggcauuuccucagugcucaga

SEQ ID NO: 192880 - RNA, 22 nt, Human
ggcugcaggaacgacggagggg

SEQ ID NO: 192881 - RNA, 22 nt, Human
guuagacaugagugugcuuaca

SEQ ID NO: 192882 - RNA, 22 nt, Human
ggcugugggugugacaggccuc

SEQ ID NO: 192883 - RNA, 17 nt, Human
gcucccugaggacagcu

SEQ ID NO: 192884 - RNA, 22 nt, Human
uuuccucacuucaugagaguuu

SEQ ID NO: 192885 - RNA, 22 nt, Human
cauagaauggauugacaagauu

SEQ ID NO: 192886 - RNA, 22 nt, Human
aggagcucagccugcagggagc

SEQ ID NO: 192887 - RNA, 22 nt, Human
cagcagagcugugugggaaggg

SEQ ID NO: 192888 - RNA, 22 nt, Human
ucagggaacaucguuaaacuag

SEQ ID NO: 192889 - RNA, 22 nt, Human
cuucuucuuuuaauaaaugucu

SEQ ID NO: 192890 - RNA, 22 nt, Human
aauuagggaaguauuuaguagu

SEQ ID NO: 192891 - RNA, 22 nt, Human
ggagggagguuagauucaagcu

SEQ ID NO: 192892 - RNA, 23 nt, Human
cuucaucaaaaguuaacacuagu

SEQ ID NO: 192893 - RNA, 22 nt, Human
caguuuuagcuagagcaaacca

SEQ ID NO: 192894 - RNA, 22 nt, Human
agagccaaggccucagucucaa

SEQ ID NO: 192895 - RNA, 22 nt, Human
acauuuuacaccaagacuucuu

SEQ ID NO: 192896 - RNA, 22 nt, Human
aggcuggcgucaggggcuguac

SEQ ID NO: 192897 - RNA, 22 nt, Human
uugguuuaguaccugccagcgu

SEQ ID NO: 192898 - RNA, 22 nt, Human
uuugcaaaaugaggugaagagu

SEQ ID NO: 192899 - RNA, 22 nt, Human
gacagcuguacacuccugguua

SEQ ID NO: 192900 - RNA, 22 nt, Human
ggcaguuuggcaggauggaggg

SEQ ID NO: 192901 - RNA, 22 nt, Human
gaggcccaguccugcaagcacg

SEQ ID NO: 192902 - RNA, 22 nt, Human
cuguccagcugaccagagcagc

SEQ ID NO: 192903 - RNA, 22 nt, Human
ucccuggguccugcuugcucuc

SEQ ID NO: 192904 - RNA, 22 nt, Human
uguucuuucaguuagacacagu

SEQ ID NO: 192905 - RNA, 16 nt, Human
cagaggcaccuggcuc

SEQ ID NO: 192906 - RNA, 22 nt, Human
gaacagugccagcacacaauaa

SEQ ID NO: 192907 - RNA, 22 nt, Human
gcugccucuguagcuuuggacc

SEQ ID NO: 192908 - RNA, 22 nt, Human
cuuuucuuacucccgcaaggca

SEQ ID NO: 192909 - RNA, 22 nt, Human
uccaaagccccaugcacuuucu

SEQ ID NO: 192910 - RNA, 22 nt, Human
gaugaggucauguuuuacauau

SEQ ID NO: 192911 - RNA, 22 nt, Human
uugaaauuggguguggcuguca

SEQ ID NO: 192912 - RNA, 22 nt, Human
cccugugccucaguuuccucau

SEQ ID NO: 192913 - RNA, 22 nt, Human
ugugccugagucucggcccacc

SEQ ID NO: 192914 - RNA, 22 nt, Human
agcugcaguuagccccagauga

SEQ ID NO: 192915 - RNA, 21 nt, Human
uggaaacuucuagcuuacgua

SEQ ID NO: 192916 - RNA, 22 nt, Human
agcugcaggauuauggaaugga

SEQ ID NO: 192917 - RNA, 22 nt, Human
uccaggacuuagugaccuaaaa

SEQ ID NO: 192918 - RNA, 22 nt, Human
ugggggaguauagucuggccuc

SEQ ID NO: 192919 - RNA, 22 nt, Human
gggcccagcgugguuccaucug

SEQ ID NO: 192920 - RNA, 22 nt, Human
gcuguccagguuguggagcaac

SEQ ID NO: 192921 - RNA, 22 nt, Human
uuuccucugcugccauugcccc

SEQ ID NO: 192922 - RNA, 22 nt, Human
auggccaguguuucccucaguu

SEQ ID NO: 192923 - RNA, 22 nt, Human
gacagacacuguguccucacuu

SEQ ID NO: 192924 - RNA, 22 nt, Human
ggaggccaaggcagguggauca

SEQ ID NO: 192925 - RNA, 22 nt, Human
uccuggagggcucacaggcggc

SEQ ID NO: 192926 - RNA, 20 nt, Human
aaauuacugccacacauuuc

SEQ ID NO: 192927 - RNA, 22 nt, Human
ccuuccuugagaagcaauuccu

SEQ ID NO: 192928 - RNA, 22 nt, Human
cuguauaucaugguuuugcagu

SEQ ID NO: 192929 - RNA, 22 nt, Human
aucucuggccuuccuuuuccaa

SEQ ID NO: 192930 - RNA, 22 nt, Human
uaagaaucgauguuuauuuaga

SEQ ID NO: 192931 - RNA, 22 nt, Human
ucuggcuucaacuuuacugaaa

SEQ ID NO: 192932 - RNA, 22 nt, Human
aaaagcagagacucuggagcua

SEQ ID NO: 192933 - RNA, 22 nt, Human
ucagguguaucauggaguugaa

SEQ ID NO: 192934 - RNA, 22 nt, Human
caggcacacugucuacacugag

SEQ ID NO: 192935 - RNA, 22 nt, Human
uccaugagagguaacuuuacaa

SEQ ID NO: 192936 - RNA, 22 nt, Human
ucuccuggucaccucagaaguc

SEQ ID NO: 192937 - RNA, 20 nt, Human
guccagaguaaugugcugac

SEQ ID NO: 192938 - RNA, 22 nt, Human
gacagaaggcaucuagggcacg

SEQ ID NO: 192939 - RNA, 22 nt, Human
caugaaggaccauuucacgguc

SEQ ID NO: 192940 - RNA, 22 nt, Human
auaaagcuuugaaauggagaua

SEQ ID NO: 192941 - RNA, 22 nt, Human
aaaggcuucuuugcuccauguc

SEQ ID NO: 192942 - RNA, 22 nt, Human
auguguccacaggugugagaga

SEQ ID NO: 192943 - RNA, 22 nt, Human
caguuuaaggcaggacauggga

SEQ ID NO: 192944 - RNA, 18 nt, Human
gccagccaggcguugcuc

SEQ ID NO: 192945 - RNA, 19 nt, Human
ccuaggcauuguccaaggg

SEQ ID NO: 192946 - RNA, 22 nt, Human
gacaagaugagcagcucagugu

SEQ ID NO: 192947 - RNA, 22 nt, Human
acugagguaauugugaggauua

SEQ ID NO: 192948 - RNA, 22 nt, Human
gacuuucuugcagaaauauucc

SEQ ID NO: 192949 - RNA, 22 nt, Human
agggucugaccaccaguaggga

SEQ ID NO: 192950 - RNA, 22 nt, Human
ugagccagucucucagaacccu

SEQ ID NO: 192951 - RNA, 22 nt, Human
cagggcucugccuugagggaug

SEQ ID NO: 192952 - RNA, 22 nt, Human
uggaggaaucagggcuuaggcu

SEQ ID NO: 192953 - RNA, 22 nt, Human
uuuccucuaaacgcauuugcuu

SEQ ID NO: 192954 - RNA, 22 nt, Human
uccagggagcaagucaggccgg

SEQ ID NO: 192955 - RNA, 22 nt, Human
ccuccaggauaagucagggccu

SEQ ID NO: 192956 - RNA, 22 nt, Human
ggcaccaggaucagucugucau

SEQ ID NO: 192957 - RNA, 22 nt, Human
accccagaggcggaggcugcag

SEQ ID NO: 192958 - RNA, 22 nt, Human
aaaaccuucuagacuuuauauu

SEQ ID NO: 192959 - RNA, 22 nt, Human
guugaaugaaucauucuaugua

SEQ ID NO: 192960 - RNA, 22 nt, Human
uucauucuuauuugugaucugg

SEQ ID NO: 192961 - RNA, 22 nt, Human
uuccugugugcucucauuuagu

SEQ ID NO: 192962 - RNA, 22 nt, Human
gcccugugagucaugcggcaga

SEQ ID NO: 192963 - RNA, 22 nt, Human
agauuugaaacuugcuucauaa

SEQ ID NO: 192964 - RNA, 22 nt, Human
uagcuacacugaggcugcuuaa

SEQ ID NO: 192965 - RNA, 22 nt, Human
aggcuggagggcaauggcaaga

SEQ ID NO: 192966 - RNA, 22 nt, Human
aaaaggcauggagguugauagu

SEQ ID NO: 192967 - RNA, 22 nt, Human
cuauuaaauacucuucaaauug

SEQ ID NO: 192968 - RNA, 22 nt, Human
cugcccucgggcccucccauag

SEQ ID NO: 192969 - RNA, 22 nt, Human
aacagcauaccaauguacauau

SEQ ID NO: 192970 - RNA, 22 nt, Human
acucagagaacuggauuagagg

SEQ ID NO: 192971 - RNA, 22 nt, Human
uccagccacuugcacaguuaaa

SEQ ID NO: 192972 - RNA, 22 nt, Human
gcuggcuggaaugggagaagaa

SEQ ID NO: 192973 - RNA, 19 nt, Human
agacacaucacauuucucc

SEQ ID NO: 192974 - RNA, 22 nt, Human
gucuccagaagccuagacagcc

SEQ ID NO: 192975 - RNA, 19 nt, Human
ccugaggaaaagaugauug

SEQ ID NO: 192976 - RNA, 17 nt, Human
gacuuuggaguuucaua

SEQ ID NO: 192977 - RNA, 22 nt, Human
caccuagcaugaaauucagcag

SEQ ID NO: 192978 - RNA, 22 nt, Human
gacaugugagcaagcgugcggc

SEQ ID NO: 192979 - RNA, 22 nt, Human
agaagaaagauugaagguuccu

SEQ ID NO: 192980 - RNA, 22 nt, Human
ggguggggcccaggaaaucuau

SEQ ID NO: 192981 - RNA, 22 nt, Human
ucugugcuuucccugccuucuu

SEQ ID NO: 192982 - RNA, 22 nt, Human
ucaggccugcagugccaaccca

SEQ ID NO: 192983 - RNA, 22 nt, Human
cagugcaguuucccagaugcug

SEQ ID NO: 192984 - RNA, 22 nt, Human
cacauuccuggugcucagcagc

SEQ ID NO: 192985 - RNA, 22 nt, Human
ugaucccaaucuuuccugcucc

SEQ ID NO: 192986 - RNA, 22 nt, Human
uacaucaugaaagcauacauca

SEQ ID NO: 192987 - RNA, 22 nt, Human
uacagcaaagaaacccucaguc

SEQ ID NO: 192988 - RNA, 22 nt, Human
cugagcagugguucuugagcgc

SEQ ID NO: 192989 - RNA, 22 nt, Human
ucacagugggacuuuuaucgcu

SEQ ID NO: 192990 - RNA, 22 nt, Human
ucugcccacagccuccugucca

SEQ ID NO: 192991 - RNA, 22 nt, Human
agugcagcucccucaccugcuu

SEQ ID NO: 192992 - RNA, 20 nt, Human
gcuggugggggcuugacaug

SEQ ID NO: 192993 - RNA, 22 nt, Human
guuuguuagaagagcagaaucu

SEQ ID NO: 192994 - RNA, 23 nt, Human
caggaaauguucuugaagccuga

SEQ ID NO: 192995 - RNA, 22 nt, Human
gcccuguggacagugagaagug

SEQ ID NO: 192996 - RNA, 22 nt, Human
ucugaaauccuuuaucuuggcu

SEQ ID NO: 192997 - RNA, 22 nt, Human
ccucccagugccuccagagcag

SEQ ID NO: 192998 - RNA, 22 nt, Human
aucuucccaggcuggggagagg

SEQ ID NO: 192999 - RNA, 22 nt, Human
uggcagguggcucuggcauucu

SEQ ID NO: 193000 - RNA, 22 nt, Human
ccuggaggcagaaauaggacuu

SEQ ID NO: 193001 - RNA, 22 nt, Human
uacaccagcuugccugggcucu

SEQ ID NO: 193002 - RNA, 22 nt, Human
uuuccuugccuccuguccuucu

SEQ ID NO: 193003 - RNA, 22 nt, Human
ugcaaauguguuuuaaaccaaa

SEQ ID NO: 193004 - RNA, 22 nt, Human
aaccagcuaacauguggaauga

SEQ ID NO: 193005 - RNA, 22 nt, Human
agcagccaguucucugugguag

SEQ ID NO: 193006 - RNA, 22 nt, Human
aaucaagaguuguguaauauuu

SEQ ID NO: 193007 - RNA, 22 nt, Human
agguuacagugauuauagguuu

SEQ ID NO: 193008 - RNA, 22 nt, Human
cuggaaagacagagggcauggg

SEQ ID NO: 193009 - RNA, 22 nt, Human
accugagaccuaaucugacugu

SEQ ID NO: 193010 - RNA, 22 nt, Human
agcugcuuagagucucuucuua

SEQ ID NO: 193011 - RNA, 22 nt, Human
gugcuggcuggggcaucaggca

SEQ ID NO: 193012 - RNA, 22 nt, Human
gaguccaggcuguugcucaucu

SEQ ID NO: 193013 - RNA, 22 nt, Human
cugggcagcuaccaccacugcu

SEQ ID NO: 193014 - RNA, 22 nt, Human
cuuggagcaacacaugacaucu

SEQ ID NO: 193015 - RNA, 22 nt, Human
ucaugcuaguuaagaacacaau

SEQ ID NO: 193016 - RNA, 22 nt, Human
gaucuuuucagguuucucuagu

SEQ ID NO: 193017 - RNA, 22 nt, Human
uucauguaccguguaccaggca

SEQ ID NO: 193018 - RNA, 22 nt, Human
uccagugguacauggagacacu

SEQ ID NO: 193019 - RNA, 19 nt, Human
aggcuuggaacagccuuau

SEQ ID NO: 193020 - RNA, 22 nt, Human
uugcaacacaaaguuugauucc

SEQ ID NO: 193021 - RNA, 22 nt, Human
ucacuucacacccacuaucaug

SEQ ID NO: 193022 - RNA, 22 nt, Human
caucccugacuucuaggugaca

SEQ ID NO: 193023 - RNA, 22 nt, Human
gcugcccagacauugaaucagg

SEQ ID NO: 193024 - RNA, 22 nt, Human
acagagcuaauguugcauaggc

SEQ ID NO: 193025 - RNA, 22 nt, Human
ucauggcauuguuaaggguuuu

SEQ ID NO: 193026 - RNA, 22 nt, Human
ccaggagcgcgugaacaggcug

SEQ ID NO: 193027 - RNA, 22 nt, Human
aggcugccucgugagcucgcug

SEQ ID NO: 193028 - RNA, 19 nt, Human
cacaauuaugagacacuua

SEQ ID NO: 193029 - RNA, 22 nt, Human
acaaauauuuacugaauccacu

SEQ ID NO: 193030 - RNA, 22 nt, Human
agacacagauuuuggaaaagau

SEQ ID NO: 193031 - RNA, 22 nt, Human
uacagaauuagauuauuagaga

SEQ ID NO: 193032 - RNA, 18 nt, Human
agauuuugagaaauacaa

SEQ ID NO: 193033 - RNA, 22 nt, Human
aggacagcauuuucagcaucuc

SEQ ID NO: 193034 - RNA, 22 nt, Human
cucugggugugacagcaccugg

SEQ ID NO: 193035 - RNA, 22 nt, Human
gguggcugcaauggcuaacuuc

SEQ ID NO: 193036 - RNA, 22 nt, Human
aaagaagggacagacugccucu

SEQ ID NO: 193037 - RNA, 22 nt, Human
cucagcacugacccaggagaug

SEQ ID NO: 193038 - RNA, 22 nt, Human
ucucauugguauauacaugugu

SEQ ID NO: 193039 - RNA, 19 nt, Human
gacaggacgaagggaaguu

SEQ ID NO: 193040 - RNA, 22 nt, Human
agguaacacuacuuaguauacu

SEQ ID NO: 193041 - RNA, 19 nt, Human
acuccagggaugacagaag

SEQ ID NO: 193042 - RNA, 22 nt, Human
ggcaggcagaaaaauagaauau

SEQ ID NO: 193043 - RNA, 18 nt, Human
ucuagaaacccagacucu

SEQ ID NO: 193044 - RNA, 22 nt, Human
caugccugccuggugggcgugg

SEQ ID NO: 193045 - RNA, 22 nt, Human
gcgagaaacuaagugcccuuug

SEQ ID NO: 193046 - RNA, 23 nt, Human
cugcuccaggacagcauggaggu

SEQ ID NO: 193047 - RNA, 22 nt, Human
uucuguggucucccaugucugu

SEQ ID NO: 193048 - RNA, 22 nt, Human
gaaguuacucucguuaaauaug

SEQ ID NO: 193049 - RNA, 22 nt, Human
ugaggcucaagaauagacagua

SEQ ID NO: 193050 - RNA, 22 nt, Human
uauggaaaaauguaucuuguca

SEQ ID NO: 193051 - RNA, 22 nt, Human
ccagugcaggugagcaccaggu

SEQ ID NO: 193052 - RNA, 22 nt, Human
auagaguccaaaguaugaauau

SEQ ID NO: 193053 - RNA, 22 nt, Human
ucagagaagguaagugaccugc

SEQ ID NO: 193054 - RNA, 22 nt, Human
uuaugaaguuccuguuacagug

SEQ ID NO: 193055 - RNA, 22 nt, Human
uaauaauuggcuaacccuggga

SEQ ID NO: 193056 - RNA, 22 nt, Human
aaggcacagccacuugaucauc

SEQ ID NO: 193057 - RNA, 22 nt, Human
cucugggaaguagauuuggccu

SEQ ID NO: 193058 - RNA, 22 nt, Human
gagcugcauagcugggauccuc

SEQ ID NO: 193059 - RNA, 22 nt, Human
cuucccagcaccucagucuggc

SEQ ID NO: 193060 - RNA, 22 nt, Human
agcagguguuuguaucauaagg

SEQ ID NO: 193061 - RNA, 19 nt, Human
ccaggccugcgggcguugg

SEQ ID NO: 193062 - RNA, 21 nt, Human
aauuagggugccucuuauaau

SEQ ID NO: 193063 - RNA, 21 nt, Human
ccagagagagggaaguggguu

SEQ ID NO: 193064 - RNA, 22 nt, Human
agaaaucauuuuaggcuugaug

SEQ ID NO: 193065 - RNA, 22 nt, Human
guguggcuguuuagugacuuuc

SEQ ID NO: 193066 - RNA, 22 nt, Human
uuccaggcuauucccuuuggag

SEQ ID NO: 193067 - RNA, 22 nt, Human
uggagcugucacucagaaccaa

SEQ ID NO: 193068 - RNA, 22 nt, Human
cuccugagggaugcuuaggcuu

SEQ ID NO: 193069 - RNA, 22 nt, Human
cuucucagaggccagaagcuau

SEQ ID NO: 193070 - RNA, 20 nt, Human
cuagaacugagaaauuuaaa

SEQ ID NO: 193071 - RNA, 22 nt, Human
gauaacauuuugaagugcuagu

SEQ ID NO: 193072 - RNA, 22 nt, Human
uguaaagagaaugguauaugga

SEQ ID NO: 193073 - RNA, 22 nt, Human
gcaggaagaugagcucagguaa

SEQ ID NO: 193074 - RNA, 22 nt, Human
ggugagcagcugucuguaugga

SEQ ID NO: 193075 - RNA, 22 nt, Human
uuuuauucuaaguaugauggga

SEQ ID NO: 193076 - RNA, 21 nt, Human
ugauaggguuugggcaauuau

SEQ ID NO: 193077 - RNA, 22 nt, Human
ugcuccagcuggagaugggggc

SEQ ID NO: 193078 - RNA, 22 nt, Human
uugagaaugaugagauucuucc

SEQ ID NO: 193079 - RNA, 22 nt, Human
aaguuugaugaguuucuggagg

SEQ ID NO: 193080 - RNA, 22 nt, Human
auggcucugcugggcaaagcaa

SEQ ID NO: 193081 - RNA, 22 nt, Human
cugguagcagugaagcuguuga

SEQ ID NO: 193082 - RNA, 22 nt, Human
ucaggcugaggucaucugcauc

SEQ ID NO: 193083 - RNA, 22 nt, Human
gcaguaggagaagaggaugcuu

SEQ ID NO: 193084 - RNA, 22 nt, Human
ccauucauacaauuuuguucua

SEQ ID NO: 193085 - RNA, 22 nt, Human
cacuucucugauaaucucaguu

SEQ ID NO: 193086 - RNA, 22 nt, Human
ucuagagcuuuuuccucuugua

SEQ ID NO: 193087 - RNA, 22 nt, Human
aggacagcaguuggugagguuc

SEQ ID NO: 193088 - RNA, 22 nt, Human
acauauguguuguacaugcaug

SEQ ID NO: 193089 - RNA, 22 nt, Human
ccucagagccaugccugaguuc

SEQ ID NO: 193090 - RNA, 22 nt, Human
auaagaggaauuacagaagagg

SEQ ID NO: 193091 - RNA, 22 nt, Human
ugugccugauggucacguggcc

SEQ ID NO: 193092 - RNA, 22 nt, Human
agagggggugucagcacugcag

SEQ ID NO: 193093 - RNA, 17 nt, Human
cuccuggcagccucagg

SEQ ID NO: 193094 - RNA, 22 nt, Human
ucucaguggcuuccucacuuuu

SEQ ID NO: 193095 - RNA, 22 nt, Human
aagccauggcaugccaggauca

SEQ ID NO: 193096 - RNA, 23 nt, Human
ugaggaccucucaggggccaggc

SEQ ID NO: 193097 - RNA, 22 nt, Human
ugcauuggaaaacuauggcuca

SEQ ID NO: 193098 - RNA, 22 nt, Human
gaagcaguuucuguaaugaaau

SEQ ID NO: 193099 - RNA, 22 nt, Human
uggagcagcauucauccagcag

SEQ ID NO: 193100 - RNA, 22 nt, Human
cacagcuuguuuagugacucac

SEQ ID NO: 193101 - RNA, 22 nt, Human
cauacuuuugcccugacauucu

SEQ ID NO: 193102 - RNA, 22 nt, Human
cauuaaacaaccuugaaucaau

SEQ ID NO: 193103 - RNA, 22 nt, Human
caugauuauguguuagaguuug

SEQ ID NO: 193104 - RNA, 22 nt, Human
ucagguguuucuggagaaguaa

SEQ ID NO: 193105 - RNA, 22 nt, Human
acaauguuuuuguucaaagagu

SEQ ID NO: 193106 - RNA, 22 nt, Human
uauucacagcugccgcacucag

SEQ ID NO: 193107 - RNA, 22 nt, Human
gauccacaguuugaugaucaua

SEQ ID NO: 193108 - RNA, 22 nt, Human
caaagagcuguucagugucgcu

SEQ ID NO: 193109 - RNA, 22 nt, Human
ggugccacugcacucuggccug

SEQ ID NO: 193110 - RNA, 22 nt, Human
agcgagggaggucugaggacag

SEQ ID NO: 193111 - RNA, 20 nt, Human
uuguuuuaaauccuggauga

SEQ ID NO: 193112 - RNA, 22 nt, Human
aggugggguucagucucagccg

SEQ ID NO: 193113 - RNA, 22 nt, Human
cagcugaggucaaagaagcagg

SEQ ID NO: 193114 - RNA, 22 nt, Human
augggcucuaugucuaggagau

SEQ ID NO: 193115 - RNA, 22 nt, Human
uugcaaauguuauacugccagu

SEQ ID NO: 193116 - RNA, 22 nt, Human
uagacauuucugguuauugaca

SEQ ID NO: 193117 - RNA, 21 nt, Human
uuucaauguguucuuuguagu

SEQ ID NO: 193118 - RNA, 22 nt, Human
uuuaguguagccuaagcagaau

SEQ ID NO: 193119 - RNA, 22 nt, Human
cuguggcuucugggucaguuca

SEQ ID NO: 193120 - RNA, 22 nt, Human
ucccugggucauucucuggcac

SEQ ID NO: 193121 - RNA, 22 nt, Human
uucugggcuguccagaggguga

SEQ ID NO: 193122 - RNA, 22 nt, Human
ugcugccaggucuugcugucca

SEQ ID NO: 193123 - RNA, 22 nt, Human
ccaaggaggccccaggucagcu

SEQ ID NO: 193124 - RNA, 22 nt, Human
aggaagcuuuaugaccagcuaa

SEQ ID NO: 193125 - RNA, 22 nt, Human
ucacagaauagcacuguaagcg

SEQ ID NO: 193126 - RNA, 22 nt, Human
acugcccuuguccuggcacacc

SEQ ID NO: 193127 - RNA, 19 nt, Human
cguccaggugcuggaagau

SEQ ID NO: 193128 - RNA, 19 nt, Human
aguggcagaucuggaagua

SEQ ID NO: 193129 - RNA, 22 nt, Human
cauuaauaaacauuucagaaga

SEQ ID NO: 193130 - RNA, 22 nt, Human
gaggcugccccuuccucagcug

SEQ ID NO: 193131 - RNA, 22 nt, Human
aagaguuucuuuauuaaccuuu

SEQ ID NO: 193132 - RNA, 22 nt, Human
aaauuucaguuaccuuuacguu

SEQ ID NO: 193133 - RNA, 22 nt, Human
agggaguuagaaauccaggaua

SEQ ID NO: 193134 - RNA, 22 nt, Human
guuguauucuucaauaucagag

SEQ ID NO: 193135 - RNA, 20 nt, Human
gaacauggcagguggagggg

SEQ ID NO: 193136 - RNA, 22 nt, Human
uaguccagguuaaucccugccu

SEQ ID NO: 193137 - RNA, 22 nt, Human
uuauguguguguauacauacaa

SEQ ID NO: 193138 - RNA, 22 nt, Human
uuuauaucuuaugucauuucaa

SEQ ID NO: 193139 - RNA, 22 nt, Human
ucucaacuuugagaaacauugu

SEQ ID NO: 193140 - RNA, 22 nt, Human
ccagaauagaaggcagcuguca

SEQ ID NO: 193141 - RNA, 22 nt, Human
cucugcaggccuugaguguggu

SEQ ID NO: 193142 - RNA, 22 nt, Human
agcugugggagaaucucugggu

SEQ ID NO: 193143 - RNA, 22 nt, Human
uuuagaagacagaugcacagcc

SEQ ID NO: 193144 - RNA, 22 nt, Human
agagcugagcaccaagcauggu

SEQ ID NO: 193145 - RNA, 22 nt, Human
ucacaggcucuagggauuaaga

SEQ ID NO: 193146 - RNA, 22 nt, Human
caggcacacagcacauggccug

SEQ ID NO: 193147 - RNA, 22 nt, Human
caagagcuggguggcaagcuag

SEQ ID NO: 193148 - RNA, 21 nt, Human
uguuuaauacauauuugugga

SEQ ID NO: 193149 - RNA, 22 nt, Human
uagcaagauccuucccuggcgu

SEQ ID NO: 193150 - RNA, 22 nt, Human
cccuagaacacgcagacacuga

SEQ ID NO: 193151 - RNA, 22 nt, Human
cacuggcauuagucacgaggca

SEQ ID NO: 193152 - RNA, 22 nt, Human
ugaaguuagaacuaugaggaua

SEQ ID NO: 193153 - RNA, 22 nt, Human
uuacauguuuacggauacacuu

SEQ ID NO: 193154 - RNA, 22 nt, Human
gcaugucuguaauuacagagcc

SEQ ID NO: 193155 - RNA, 22 nt, Human
auagacauuauaacacagagcu

SEQ ID NO: 193156 - RNA, 22 nt, Human
agucacagaaugauggcuccag

SEQ ID NO: 193157 - RNA, 22 nt, Human
uucuucaaccaucuacauaaac

SEQ ID NO: 193158 - RNA, 22 nt, Human
cacuggcccagccaggccuguu

SEQ ID NO: 193159 - RNA, 22 nt, Human
ggaguauuguagcuuccaguuc

SEQ ID NO: 193160 - RNA, 22 nt, Human
agggcacaggcuccggguccag

SEQ ID NO: 193161 - RNA, 22 nt, Human
cugggugagcuggccagagggu

SEQ ID NO: 193162 - RNA, 22 nt, Human
cugggagaucuguugggacugg

SEQ ID NO: 193163 - RNA, 21 nt, Human
uccagcuccugccacuccuua

SEQ ID NO: 193164 - RNA, 22 nt, Human
gcagggcagaccuccagccuau

SEQ ID NO: 193165 - RNA, 22 nt, Human
guggcagguuauaagcaucuca

SEQ ID NO: 193166 - RNA, 22 nt, Human
uuacauguacaaacaauucuua

SEQ ID NO: 193167 - RNA, 22 nt, Human
gcagagugagccgaggcugcuc

SEQ ID NO: 193168 - RNA, 22 nt, Human
uguuuacuuuuaauuaccuguc

SEQ ID NO: 193169 - RNA, 22 nt, Human
caaacuuuuccuggaaaagauu

SEQ ID NO: 193170 - RNA, 22 nt, Human
cagugugcugcagagaacauuu

SEQ ID NO: 193171 - RNA, 22 nt, Human
uguguccugcaggugcugccug

SEQ ID NO: 193172 - RNA, 22 nt, Human
augcugugucaccuuaggauuu

SEQ ID NO: 193173 - RNA, 22 nt, Human
ucccguugaugacggugcaucc

SEQ ID NO: 193174 - RNA, 22 nt, Human
agcuggaauccuacuucuaaca

SEQ ID NO: 193175 - RNA, 22 nt, Human
caggaaaugggucguuuuauaa

SEQ ID NO: 193176 - RNA, 22 nt, Human
uacagaggaggugguugggagu

SEQ ID NO: 193177 - RNA, 22 nt, Human
cugguuuaagcuuauauaguug

SEQ ID NO: 193178 - RNA, 22 nt, Human
ccaucccuucaccacagcagua

SEQ ID NO: 193179 - RNA, 23 nt, Human
ugccucaguggaaugugagggug

SEQ ID NO: 193180 - RNA, 22 nt, Human
gcugucugccgcaggcugccac

SEQ ID NO: 193181 - RNA, 22 nt, Human
auaucauucugauguauaucuu

SEQ ID NO: 193182 - RNA, 22 nt, Human
uuauuaggaacucaggauuuuu

SEQ ID NO: 193183 - RNA, 22 nt, Human
agggccagccgacuuccagccu

SEQ ID NO: 193184 - RNA, 18 nt, Human
ccucagaggcaaauuguu

SEQ ID NO: 193185 - RNA, 22 nt, Human
gaagcuccguacuaugacuuuu

SEQ ID NO: 193186 - RNA, 22 nt, Human
aggccaguuguucagugggccg

SEQ ID NO: 193187 - RNA, 22 nt, Human
caagaucaagguaucagcagau

SEQ ID NO: 193188 - RNA, 22 nt, Human
caagaucaaggugucagcaggu

SEQ ID NO: 193189 - RNA, 22 nt, Human
uucucagaaaauguagagaaaa

SEQ ID NO: 193190 - RNA, 22 nt, Human
auucuggguucaugagugagcu

SEQ ID NO: 193191 - RNA, 22 nt, Human
aggagggcaggcuggcugccua

SEQ ID NO: 193192 - RNA, 22 nt, Human
ccagcaugagacgaugaugaag

SEQ ID NO: 193193 - RNA, 23 nt, Human
aguaacaugcaaauaacagucug

SEQ ID NO: 193194 - RNA, 22 nt, Human
ucugugcacugugucauuaggu

SEQ ID NO: 193195 - RNA, 22 nt, Human
auucagugauucauuuguacaa

SEQ ID NO: 193196 - RNA, 22 nt, Human
gaugucuuuagggcaaaauauu

SEQ ID NO: 193197 - RNA, 22 nt, Human
aauguugauguuuucagugagc

SEQ ID NO: 193198 - RNA, 22 nt, Human
agggaagggcagggucuaugca

SEQ ID NO: 193199 - RNA, 22 nt, Human
aaagaguucuaugaucuuucca

SEQ ID NO: 193200 - RNA, 21 nt, Human
uggagagcccuugccugaguc

SEQ ID NO: 193201 - RNA, 22 nt, Human
acugggaggcaucuggagcuga

SEQ ID NO: 193202 - RNA, 22 nt, Human
gcuguggcugaccaccaggggg

SEQ ID NO: 193203 - RNA, 22 nt, Human
aggggacauuuagcaaugacua

SEQ ID NO: 193204 - RNA, 22 nt, Human
gacaccaguaaauauucaaaag

SEQ ID NO: 193205 - RNA, 22 nt, Human
ccaggcagagggauccccaucc

SEQ ID NO: 193206 - RNA, 22 nt, Human
uugcacuccagcccgagcaaca

SEQ ID NO: 193207 - RNA, 22 nt, Human
cauuucacgcacacucauuacu

SEQ ID NO: 193208 - RNA, 22 nt, Human
agacuacagaauggcauuguuu

SEQ ID NO: 193209 - RNA, 22 nt, Human
uucugcauuucuaauaaguucc

SEQ ID NO: 193210 - RNA, 22 nt, Human
acaaugcuugguuuuucuagaa

SEQ ID NO: 193211 - RNA, 22 nt, Human
cacaguccagacuccuggaguu

SEQ ID NO: 193212 - RNA, 22 nt, Human
gccacccugagcugggccaggg

SEQ ID NO: 193213 - RNA, 22 nt, Human
aagcuguucucuaaguuucaug

SEQ ID NO: 193214 - RNA, 22 nt, Human
auccuggguuugugaguuuaug

SEQ ID NO: 193215 - RNA, 23 nt, Human
ugggcagcuucugcaugcccacc

SEQ ID NO: 193216 - RNA, 22 nt, Human
acagaauuaacauuugaugaau

SEQ ID NO: 193217 - RNA, 22 nt, Human
auaggugugugguucauggccc

SEQ ID NO: 193218 - RNA, 22 nt, Human
cuuuaguuugugauacgaagau

SEQ ID NO: 193219 - RNA, 22 nt, Human
auucugagaaaugcauugucag

SEQ ID NO: 193220 - RNA, 23 nt, Human
uuucaaggugucuguaccacuga

SEQ ID NO: 193221 - RNA, 22 nt, Human
caguuacucaauaauucuugcg

SEQ ID NO: 193222 - RNA, 19 nt, Human
cuccacagggauugugauu

SEQ ID NO: 193223 - RNA, 22 nt, Human
ugcccuggaaaugagaggugug

SEQ ID NO: 193224 - RNA, 23 nt, Human
accccaggcaucgcauuccucuu

SEQ ID NO: 193225 - RNA, 22 nt, Human
gagggagcuaugaauagaagaa

SEQ ID NO: 193226 - RNA, 21 nt, Human
uuccuuuuuauggcuuagugg

SEQ ID NO: 193227 - RNA, 22 nt, Human
gcugcagcccugcggaucacuu

SEQ ID NO: 193228 - RNA, 22 nt, Human
cagcuccugaggacugcuggga

SEQ ID NO: 193229 - RNA, 18 nt, Human
caguuacaccuucauuca

SEQ ID NO: 193230 - RNA, 22 nt, Human
cugagcagccccaccagccauu

SEQ ID NO: 193231 - RNA, 17 nt, Human
agaacuguaguagcucc

SEQ ID NO: 193232 - RNA, 22 nt, Human
aaguggagagcccuggaggucu

SEQ ID NO: 193233 - RNA, 22 nt, Human
caaggccauauugccuguaugu

SEQ ID NO: 193234 - RNA, 21 nt, Human
guuauuuuaagugagcuuugc

SEQ ID NO: 193235 - RNA, 20 nt, Human
agucucuguagugccugaga

SEQ ID NO: 193236 - RNA, 22 nt, Human
aaugucuucccuggcaggccaa

SEQ ID NO: 193237 - RNA, 22 nt, Human
agauggggcucaguguggaggc

SEQ ID NO: 193238 - RNA, 17 nt, Human
uuacagagguaauuaag

SEQ ID NO: 193239 - RNA, 22 nt, Human
cuccagucuuucagaugucccu

SEQ ID NO: 193240 - RNA, 22 nt, Human
acccagcccagaaucuggggcc

SEQ ID NO: 193241 - RNA, 22 nt, Human
auguuacagaaagcaaagauga

SEQ ID NO: 193242 - RNA, 22 nt, Human
uucuuggaaauacauucaauaa

SEQ ID NO: 193243 - RNA, 22 nt, Human
auaaauggcuuucauuccuagg

SEQ ID NO: 193244 - RNA, 22 nt, Human
agcuaagcucucagauacuaag

SEQ ID NO: 193245 - RNA, 22 nt, Human
ggaaagagcuaaaagggugaga

SEQ ID NO: 193246 - RNA, 22 nt, Human
ccuggcucccccaucauagcug

SEQ ID NO: 193247 - RNA, 22 nt, Human
aaggcauuuguuggauuucuca

SEQ ID NO: 193248 - RNA, 22 nt, Human
uccagcaugaaggggcuuuuau

SEQ ID NO: 193249 - RNA, 22 nt, Human
cagcagcuucuguugaucagaa

SEQ ID NO: 193250 - RNA, 22 nt, Human
cugcuuccaugcaauggcaguc

SEQ ID NO: 193251 - RNA, 22 nt, Human
ggcuggcuuucucuccgcaccu

SEQ ID NO: 193252 - RNA, 22 nt, Human
ucagaaggaaacgaugccagcu

SEQ ID NO: 193253 - RNA, 22 nt, Human
uuacagggguguggaggcaauc

SEQ ID NO: 193254 - RNA, 22 nt, Human
cccuccaugagugugcugcugg

SEQ ID NO: 193255 - RNA, 22 nt, Human
auccuucuccaaaacuggcucc

SEQ ID NO: 193256 - RNA, 23 nt, Human
agaaguggaauggccgugggguc

SEQ ID NO: 193257 - RNA, 22 nt, Human
caggcaugaucauaggaguuua

SEQ ID NO: 193258 - RNA, 22 nt, Human
agugugagccuacaggccaaag

SEQ ID NO: 193259 - RNA, 19 nt, Human
ccuggaggugaagguucuc

SEQ ID NO: 193260 - RNA, 22 nt, Human
ucacaucugccuccauagcacc

SEQ ID NO: 193261 - RNA, 22 nt, Human
gacugagcuucugcaacacugg

SEQ ID NO: 193262 - RNA, 22 nt, Human
gcagcuuuagaaacaagggcug

SEQ ID NO: 193263 - RNA, 22 nt, Human
agaaccuugaucuuggacuucu

SEQ ID NO: 193264 - RNA, 22 nt, Human
agcucagggccaggcgcguuuc

SEQ ID NO: 193265 - RNA, 19 nt, Human
uccuucagucagaucuggg

SEQ ID NO: 193266 - RNA, 21 nt, Human
aacucccagugccuucccagc

SEQ ID NO: 193267 - RNA, 22 nt, Human
ugagaagcaguuucaguaagaa

SEQ ID NO: 193268 - RNA, 22 nt, Human
ugucccaguuuaucugggacug

SEQ ID NO: 193269 - RNA, 22 nt, Human
ggaggagguggguuaaguugua

SEQ ID NO: 193270 - RNA, 22 nt, Human
aucugacaaggccacauauucu

SEQ ID NO: 193271 - RNA, 22 nt, Human
uucugaaggucagcagcuuggu

SEQ ID NO: 193272 - RNA, 22 nt, Human
cuccaaguccgagggcucucaa

SEQ ID NO: 193273 - RNA, 22 nt, Human
ugcugaaagaccguauuuaucu

SEQ ID NO: 193274 - RNA, 22 nt, Human
ccuggcccacauggcuucuccc

SEQ ID NO: 193275 - RNA, 22 nt, Human
cccuggagugugacgaggcauu

SEQ ID NO: 193276 - RNA, 22 nt, Human
ggacuucuaagugccagacacu

SEQ ID NO: 193277 - RNA, 22 nt, Human
augaagcagaauuucccacucu

SEQ ID NO: 193278 - RNA, 22 nt, Human
aacuuucuugugacauuugggg

SEQ ID NO: 193279 - RNA, 22 nt, Human
cagagcucagagcagggcacuc

SEQ ID NO: 193280 - RNA, 22 nt, Human
uuugauaucuugguauacagau

SEQ ID NO: 193281 - RNA, 22 nt, Human
gccaggagaaugcuagcagagg

SEQ ID NO: 193282 - RNA, 22 nt, Human
accacaggaggauggcugcugg

SEQ ID NO: 193283 - RNA, 22 nt, Human
caaagauaugacauggaaaaug

SEQ ID NO: 193284 - RNA, 22 nt, Human
ggcagugagcuggagggaagga

SEQ ID NO: 193285 - RNA, 18 nt, Human
cccuuagccuuuccucuc

SEQ ID NO: 193286 - RNA, 22 nt, Human
agagccaggccaggccggggca

SEQ ID NO: 193287 - RNA, 23 nt, Human
auaaauuacuaucucccuagagc

SEQ ID NO: 193288 - RNA, 22 nt, Human
aaaccuuugugugucugugccu

SEQ ID NO: 193289 - RNA, 22 nt, Human
ucugcugucacucauuugcuuc

SEQ ID NO: 193290 - RNA, 22 nt, Human
agacagugugaguucagggugg

SEQ ID NO: 193291 - RNA, 22 nt, Human
gugggaagucucucggaggaag

SEQ ID NO: 193292 - RNA, 22 nt, Human
agcuucucucuuugcacucaca

SEQ ID NO: 193293 - RNA, 22 nt, Human
aggucugguguugaugaauucc

SEQ ID NO: 193294 - RNA, 22 nt, Human
auggcauuugaaucugucuuuu

SEQ ID NO: 193295 - RNA, 22 nt, Human
uuagagccaguuacaaggucaa

SEQ ID NO: 193296 - RNA, 22 nt, Human
uucaaugucuauguacauuuua

SEQ ID NO: 193297 - RNA, 19 nt, Human
ggcaccuuggucuuggacu

SEQ ID NO: 193298 - RNA, 22 nt, Human
ugucuccucaacucaugcucga

SEQ ID NO: 193299 - RNA, 22 nt, Human
aguacaauuauauuuagauggu

SEQ ID NO: 193300 - RNA, 22 nt, Human
guuccuaaccagcagagaaaca

SEQ ID NO: 193301 - RNA, 22 nt, Human
acuggcagaauugaauaguugu

SEQ ID NO: 193302 - RNA, 22 nt, Human
uagaaaggauauugagaugaau

SEQ ID NO: 193303 - RNA, 22 nt, Human
ucaaggaaugacuauaugagga

SEQ ID NO: 193304 - RNA, 22 nt, Human
guagcuacuuagagccguucuu

SEQ ID NO: 193305 - RNA, 22 nt, Human
cagagcugugauaaauagauau

SEQ ID NO: 193306 - RNA, 22 nt, Human
gcugggagcaaguacucaucuu

SEQ ID NO: 193307 - RNA, 22 nt, Human
cagcccuggaacagcugacuca

SEQ ID NO: 193308 - RNA, 22 nt, Human
gaggacaaagcccaggugcugg

SEQ ID NO: 193309 - RNA, 22 nt, Human
gugcucagaaacuugcucauuu

SEQ ID NO: 193310 - RNA, 22 nt, Human
aaguaaugguuaaauaauucua

SEQ ID NO: 193311 - RNA, 22 nt, Human
ucucuguggcaagcaugcugcu

SEQ ID NO: 193312 - RNA, 22 nt, Human
ugcucaggaaauaaugucugug

SEQ ID NO: 193313 - RNA, 22 nt, Human
auuuauugagacuuaacaaccc

SEQ ID NO: 193314 - RNA, 22 nt, Human
ugccaggccaauucuauuugac

SEQ ID NO: 193315 - RNA, 22 nt, Human
ugucacauucugaugugaggug

SEQ ID NO: 193316 - RNA, 22 nt, Human
cuagggaacaagaugcccaggg

SEQ ID NO: 193317 - RNA, 22 nt, Human
cagaggaguucaguacacagcc

SEQ ID NO: 193318 - RNA, 22 nt, Human
cuacugaugauguugguugugg

SEQ ID NO: 193319 - RNA, 22 nt, Human
auggugcuccugcaggaagcag

SEQ ID NO: 193320 - RNA, 22 nt, Human
gcacacaguagggauucaauga

SEQ ID NO: 193321 - RNA, 22 nt, Human
ucaaggagcccacagucuaaug

SEQ ID NO: 193322 - RNA, 22 nt, Human
uagaagucucucaagaaacaua

SEQ ID NO: 193323 - RNA, 22 nt, Human
uacagucucuuugagugauugu

SEQ ID NO: 193324 - RNA, 22 nt, Human
gaaauauacauugcaggaagag

SEQ ID NO: 193325 - RNA, 22 nt, Human
cugagagaucaagccacaggau

SEQ ID NO: 193326 - RNA, 22 nt, Human
cccagaggugaaggagguggga

SEQ ID NO: 193327 - RNA, 22 nt, Human
ucaugcaguuucuuaucugcca

SEQ ID NO: 193328 - RNA, 22 nt, Human
cuggcccaggagagcaggcauu

SEQ ID NO: 193329 - RNA, 22 nt, Human
ggcugggagcuggacaggccgg

SEQ ID NO: 193330 - RNA, 22 nt, Human
agggcagaaaccaccuugaugg

SEQ ID NO: 193331 - RNA, 22 nt, Human
cagggagcuggugccagccgac

SEQ ID NO: 193332 - RNA, 22 nt, Human
ucugaggggcuggaagggcugc

SEQ ID NO: 193333 - RNA, 22 nt, Human
uucucuggccauagcuggcuag

SEQ ID NO: 193334 - RNA, 22 nt, Human
gcggguugaagggcgcaucgaa

SEQ ID NO: 193335 - RNA, 22 nt, Human
ucucagacucuuuagugaaggu

SEQ ID NO: 193336 - RNA, 20 nt, Human
ucuguacacucaucuucugc

SEQ ID NO: 193337 - RNA, 22 nt, Human
uaagccaucaucauggcuuugg

SEQ ID NO: 193338 - RNA, 22 nt, Human
gccugcuuccuagccuuccaag

SEQ ID NO: 193339 - RNA, 22 nt, Human
gugcaaaaaucuaucaccagca

SEQ ID NO: 193340 - RNA, 22 nt, Human
uuucuucucaucccugaaauca

SEQ ID NO: 193341 - RNA, 22 nt, Human
uuguacaaaugcauauuccugg

SEQ ID NO: 193342 - RNA, 22 nt, Human
agucugguaaacugaaaaauau

SEQ ID NO: 193343 - RNA, 22 nt, Human
cugcagggagguuccuuguucu

SEQ ID NO: 193344 - RNA, 22 nt, Human
cuggcucuuucagccgcuggag

SEQ ID NO: 193345 - RNA, 22 nt, Human
gcuucuggaggagcugggcuga

SEQ ID NO: 193346 - RNA, 22 nt, Human
aggcagguuggugagaagacug

SEQ ID NO: 193347 - RNA, 22 nt, Human
ggcuguguuccaagugucagga

SEQ ID NO: 193348 - RNA, 20 nt, Human
cauuuguuagcuuucuacug

SEQ ID NO: 193349 - RNA, 22 nt, Human
ccugggucccagccaggcuuug

SEQ ID NO: 193350 - RNA, 22 nt, Human
gaggacaagcugugaguggggu

SEQ ID NO: 193351 - RNA, 22 nt, Human
uuuguucuugcaacaguuauua

SEQ ID NO: 193352 - RNA, 22 nt, Human
ugagcuucaaaguuggaucuga

SEQ ID NO: 193353 - RNA, 22 nt, Human
ugcugugguucccagaguggau

SEQ ID NO: 193354 - RNA, 22 nt, Human
accauuuaaggaaaauguauca

SEQ ID NO: 193355 - RNA, 22 nt, Human
gcagcuguggugcugagauagg

SEQ ID NO: 193356 - RNA, 22 nt, Human
uuugggaagaggaaucucugga

SEQ ID NO: 193357 - RNA, 22 nt, Human
gacugucucugugaaugguagg

SEQ ID NO: 193358 - RNA, 23 nt, Human
cagaggcaucggauucaacauca

SEQ ID NO: 193359 - RNA, 22 nt, Human
ugaaauaggaaacagauguuuc

SEQ ID NO: 193360 - RNA, 22 nt, Human
gucuucuaaguaucaaagcaga

SEQ ID NO: 193361 - RNA, 22 nt, Human
uaggcuucacuuccaguuauuc

SEQ ID NO: 193362 - RNA, 22 nt, Human
cuggagagagaaaaagccuuaa

SEQ ID NO: 193363 - RNA, 22 nt, Human
ugcuauuuggcacuuuugaccu

SEQ ID NO: 193364 - RNA, 22 nt, Human
aaacuggguuguggucaguggu

SEQ ID NO: 193365 - RNA, 22 nt, Human
aaagcacaugaguaguguagua

SEQ ID NO: 193366 - RNA, 22 nt, Human
gccacuguuccaccaucuugau

SEQ ID NO: 193367 - RNA, 22 nt, Human
agagggaaauccaggagugcuu

SEQ ID NO: 193368 - RNA, 18 nt, Human
caauuuuacccagucccu

SEQ ID NO: 193369 - RNA, 22 nt, Human
acagccugcugccugcuucuug

SEQ ID NO: 193370 - RNA, 22 nt, Human
gcucaggggaaugggcugccgu

SEQ ID NO: 193371 - RNA, 23 nt, Human
aggaaagcauucauuuuuaccau

SEQ ID NO: 193372 - RNA, 22 nt, Human
cagcaagaaaauucacaugcuc

SEQ ID NO: 193373 - RNA, 22 nt, Human
cagacaggaauucuggcguggu

SEQ ID NO: 193374 - RNA, 22 nt, Human
gucucugucauuucaccuuccc

SEQ ID NO: 193375 - RNA, 22 nt, Human
aacuggaauagcacaggaaaag

SEQ ID NO: 193376 - RNA, 19 nt, Human
uuucaauggcuuagagaaa

SEQ ID NO: 193377 - RNA, 22 nt, Human
ccaggcucaccuggagccccug

SEQ ID NO: 193378 - RNA, 22 nt, Human
agcuccugcagacuccugcuca

SEQ ID NO: 193379 - RNA, 19 nt, Human
aggagccuugagcagugag

SEQ ID NO: 193380 - RNA, 22 nt, Human
cuguauuucccacauucucuau

SEQ ID NO: 193381 - RNA, 22 nt, Human
gucuccuggaaauaugcccaua

SEQ ID NO: 193382 - RNA, 22 nt, Human
gugucccaaagauuagaaauca

SEQ ID NO: 193383 - RNA, 22 nt, Human
uuccuggagaguuuucccaaag

SEQ ID NO: 193384 - RNA, 22 nt, Human
agucugaguuaguggaaaugua

SEQ ID NO: 193385 - RNA, 22 nt, Human
uccaggaccaaagacacaugua

SEQ ID NO: 193386 - RNA, 22 nt, Human
gaggagcuggcugucgggaggc

SEQ ID NO: 193387 - RNA, 22 nt, Human
aggcaggccccugagaauagac

SEQ ID NO: 193388 - RNA, 23 nt, Human
caccccacccugaggaggaggga

SEQ ID NO: 193389 - RNA, 22 nt, Human
uuuacuuugugucaagucaaga

SEQ ID NO: 193390 - RNA, 20 nt, Human
uguaggaaggacccugucug

SEQ ID NO: 193391 - RNA, 22 nt, Human
aguuggguuugugucaguugca

SEQ ID NO: 193392 - RNA, 22 nt, Human
aauugcuuuucaaggguacagc

SEQ ID NO: 193393 - RNA, 22 nt, Human
uugaccugggcacagugagcau

SEQ ID NO: 193394 - RNA, 22 nt, Human
acagagguuuccauugagguuu

SEQ ID NO: 193395 - RNA, 22 nt, Human
ggaagccaggcugggggaucug

SEQ ID NO: 193396 - RNA, 22 nt, Human
cucuccagagcccuuccggccc

SEQ ID NO: 193397 - RNA, 22 nt, Human
ugcauuauuacaagguaagacu

SEQ ID NO: 193398 - RNA, 22 nt, Human
cacagagcugaaccugggucau

SEQ ID NO: 193399 - RNA, 22 nt, Human
uuacauauuauccaaaacugcu

SEQ ID NO: 193400 - RNA, 22 nt, Human
uagaguaacacaaacgaauugg

SEQ ID NO: 193401 - RNA, 22 nt, Human
cuuauagaauguuuuuauaugu

SEQ ID NO: 193402 - RNA, 22 nt, Human
gcacagcuggacucugccuggc

SEQ ID NO: 193403 - RNA, 22 nt, Human
guguuuuggccauuagugugau

SEQ ID NO: 193404 - RNA, 18 nt, Human
ccugaagccugugucuuu

SEQ ID NO: 193405 - RNA, 22 nt, Human
gggcacagcccagugggguccc

SEQ ID NO: 193406 - RNA, 22 nt, Human
uggccugucuuguugugcuaga

SEQ ID NO: 193407 - RNA, 22 nt, Human
gcaagauguuaacauagggaga

SEQ ID NO: 193408 - RNA, 22 nt, Human
aagaaucuccauuccuguuuua

SEQ ID NO: 193409 - RNA, 22 nt, Human
aguaaacacuaaaaugacugcg

SEQ ID NO: 193410 - RNA, 18 nt, Human
gggugcuggggccccuug

SEQ ID NO: 193411 - RNA, 22 nt, Human
gcagcccagagcgcaggacccc

SEQ ID NO: 193412 - RNA, 23 nt, Human
augcaggacuuauaagguaaggu

SEQ ID NO: 193413 - RNA, 22 nt, Human
gcagcuggcucagagagguggg

SEQ ID NO: 193414 - RNA, 21 nt, Human
ucuuccugcuccacacucccc

SEQ ID NO: 193415 - RNA, 22 nt, Human
cuuucacacacauacauuugga

SEQ ID NO: 193416 - RNA, 22 nt, Human
ugcugucuuuucccaauccugg

SEQ ID NO: 193417 - RNA, 22 nt, Human
ugcaggggcuugucugggccug

SEQ ID NO: 193418 - RNA, 22 nt, Human
agagaucaguuaaaaucuuuuu

SEQ ID NO: 193419 - RNA, 22 nt, Human
gaaugauagagcugccuucgga

SEQ ID NO: 193420 - RNA, 22 nt, Human
cacugcaguuccccagugcgca

SEQ ID NO: 193421 - RNA, 22 nt, Human
caaauguaaauucuuuugaagc

SEQ ID NO: 193422 - RNA, 22 nt, Human
agaccugugaucacauggaaug

SEQ ID NO: 193423 - RNA, 22 nt, Human
aacuucugccaaacagcuguua

SEQ ID NO: 193424 - RNA, 22 nt, Human
ugguggacauucuggaugugcu

SEQ ID NO: 193425 - RNA, 22 nt, Human
gacugguaagguauuggaauuc

SEQ ID NO: 193426 - RNA, 22 nt, Human
ugcuucucuuuauuuguagguu

SEQ ID NO: 193427 - RNA, 22 nt, Human
ucucugagcccagugucccccu

SEQ ID NO: 193428 - RNA, 22 nt, Human
uauuucccagggagcaacaagc

SEQ ID NO: 193429 - RNA, 21 nt, Human
caaauagacauggcuagagga

SEQ ID NO: 193430 - RNA, 20 nt, Human
gaaauucucguauuaguuua

SEQ ID NO: 193431 - RNA, 17 nt, Human
uccaugagacaugaaga

SEQ ID NO: 193432 - RNA, 22 nt, Human
acagcagcaauagcagugacau

SEQ ID NO: 193433 - RNA, 19 nt, Human
auucagcauucugcacuuc

SEQ ID NO: 193434 - RNA, 22 nt, Human
uaucaugaucagcaacuaauca

SEQ ID NO: 193435 - RNA, 22 nt, Human
gucaaauaauuuucucaauagu

SEQ ID NO: 193436 - RNA, 22 nt, Human
acauuuaaguuaaaaccucagu

SEQ ID NO: 193437 - RNA, 22 nt, Human
ucagggagagugacccauccac

SEQ ID NO: 193438 - RNA, 22 nt, Human
gggacaggccccucgcuagcuu

SEQ ID NO: 193439 - RNA, 22 nt, Human
cuucucagcaugguuacuguga

SEQ ID NO: 193440 - RNA, 22 nt, Human
aggcaacuugcaucucggcaag

SEQ ID NO: 193441 - RNA, 22 nt, Human
agcagguguagggcucuuugua

SEQ ID NO: 193442 - RNA, 22 nt, Human
agaagccauucccuguaggcuc

SEQ ID NO: 193443 - RNA, 22 nt, Human
acauuucuuugcuagacagcag

SEQ ID NO: 193444 - RNA, 22 nt, Human
ucucagagggaggauuacugcc

SEQ ID NO: 193445 - RNA, 22 nt, Human
gucuagaauaucuagaaagauc

SEQ ID NO: 193446 - RNA, 22 nt, Human
uauguacagggauagaacuuga

SEQ ID NO: 193447 - RNA, 22 nt, Human
uacaccaguaucuuaagcauga

SEQ ID NO: 193448 - RNA, 22 nt, Human
uuugaagaccuuaucucuaaau

SEQ ID NO: 193449 - RNA, 22 nt, Human
uggcuucauucagcaugacagu

SEQ ID NO: 193450 - RNA, 22 nt, Human
uauaucagaguuaaaagaaugu

SEQ ID NO: 193451 - RNA, 22 nt, Human
auacacuuuagaaaaacgcugc

SEQ ID NO: 193452 - RNA, 17 nt, Human
ugauucaacuagaaacu

SEQ ID NO: 193453 - RNA, 22 nt, Human
acccaggccugagagacaggag

SEQ ID NO: 193454 - RNA, 19 nt, Human
acauguuuugcagaacagc

SEQ ID NO: 193455 - RNA, 22 nt, Human
aacagcugucugccuaucucug

SEQ ID NO: 193456 - RNA, 22 nt, Human
ggcagcuucucccaggcuguuu

SEQ ID NO: 193457 - RNA, 22 nt, Human
cagagcauuaaaaccagcucug

SEQ ID NO: 193458 - RNA, 22 nt, Human
aaagaggauggaguagucagcu

SEQ ID NO: 193459 - RNA, 22 nt, Human
cagcuacacuucuggguguguc

SEQ ID NO: 193460 - RNA, 22 nt, Human
uccuucuggaggcuguaaagga

SEQ ID NO: 193461 - RNA, 22 nt, Human
ucacuggcaacuugugcucccu

SEQ ID NO: 193462 - RNA, 22 nt, Human
ugauuagacaaaggaaucaugc

SEQ ID NO: 193463 - RNA, 22 nt, Human
aggagccagaauccagacucgg

SEQ ID NO: 193464 - RNA, 22 nt, Human
cccugggauaccagacaccaga

SEQ ID NO: 193465 - RNA, 22 nt, Human
aaccagcuccagccuccauuca

SEQ ID NO: 193466 - RNA, 19 nt, Human
ucucagagcccuagaggcc

SEQ ID NO: 193467 - RNA, 22 nt, Human
gccaggaaaaacguggugggag

SEQ ID NO: 193468 - RNA, 22 nt, Human
uccuccagugguacuggccaau

SEQ ID NO: 193469 - RNA, 22 nt, Human
ugcccuggugaagugcucuccu

SEQ ID NO: 193470 - RNA, 18 nt, Human
uacaaacuccuugaaggc

SEQ ID NO: 193471 - RNA, 22 nt, Human
ucccagagcagaugugcuaaag

SEQ ID NO: 193472 - RNA, 22 nt, Human
ucagugugaguaccaugcucag

SEQ ID NO: 193473 - RNA, 22 nt, Human
acccuggggguggccagugcca

SEQ ID NO: 193474 - RNA, 22 nt, Human
acaugaaguggucagaucaaac

SEQ ID NO: 193475 - RNA, 22 nt, Human
acccugggacuuccgaguugag

SEQ ID NO: 193476 - RNA, 22 nt, Human
gcuuugcugaggucugaggauu

SEQ ID NO: 193477 - RNA, 22 nt, Human
caaaccuuguuccagucaacuc

SEQ ID NO: 193478 - RNA, 22 nt, Human
agggccugagcuggcugaccuc

SEQ ID NO: 193479 - RNA, 22 nt, Human
augacagaggagugcaggugau

SEQ ID NO: 193480 - RNA, 21 nt, Human
aagagcuggaucaaggauaag

SEQ ID NO: 193481 - RNA, 22 nt, Human
cuaauacacccuauugcuuguu

SEQ ID NO: 193482 - RNA, 23 nt, Human
augggcuuagaaagcaaguggga

SEQ ID NO: 193483 - RNA, 22 nt, Human
uucacacugucccggguggaaa

SEQ ID NO: 193484 - RNA, 22 nt, Human
cagccuucaaggcuuagcucag

SEQ ID NO: 193485 - RNA, 19 nt, Human
uccagcccuguucccuuuu

SEQ ID NO: 193486 - RNA, 23 nt, Human
gagaccagggccagcugugucau

SEQ ID NO: 193487 - RNA, 22 nt, Human
aguggcugucuuccaaaaucug

SEQ ID NO: 193488 - RNA, 22 nt, Human
ggaguggccucuccugugcagg

SEQ ID NO: 193489 - RNA, 22 nt, Human
uaggaaauuuuacuggucuggg

SEQ ID NO: 193490 - RNA, 22 nt, Human
cacauacauacguauguauaca

SEQ ID NO: 193491 - RNA, 22 nt, Human
agauguuaucauucagaguagc

SEQ ID NO: 193492 - RNA, 22 nt, Human
auuaaauuagcaaacugugaaa

SEQ ID NO: 193493 - RNA, 22 nt, Human
ugauguguggcaguuaaacugu

SEQ ID NO: 193494 - RNA, 22 nt, Human
gcuggaggauggacuggaagaa

SEQ ID NO: 193495 - RNA, 23 nt, Human
ucuguucaaggcuuucuccuuga

SEQ ID NO: 193496 - RNA, 22 nt, Human
cagcucaggcacuggcgcggga

SEQ ID NO: 193497 - RNA, 22 nt, Human
cugggggccuuacggaacucca

SEQ ID NO: 193498 - RNA, 22 nt, Human
cagcugcugauggccugacaga

SEQ ID NO: 193499 - RNA, 22 nt, Human
cacagugcgaaagaaacccagc

SEQ ID NO: 193500 - RNA, 22 nt, Human
ggcagccagagggcagcuggau

SEQ ID NO: 193501 - RNA, 22 nt, Human
ugggggcauggaccagccuggc

SEQ ID NO: 193502 - RNA, 23 nt, Human
aggcagugggggccacuuugcuu

SEQ ID NO: 193503 - RNA, 22 nt, Human
aaauuuaaggaggugcucacuu

SEQ ID NO: 193504 - RNA, 22 nt, Human
aacuuugcuugggucaaacuca

SEQ ID NO: 193505 - RNA, 22 nt, Human
ggcugagccaugggcacugcag

SEQ ID NO: 193506 - RNA, 22 nt, Human
uuuaggaaauacuguccuauga

SEQ ID NO: 193507 - RNA, 22 nt, Human
accagaaaggaugccuccuucc

SEQ ID NO: 193508 - RNA, 22 nt, Human
cuguuauuucugccaggugagu

SEQ ID NO: 193509 - RNA, 22 nt, Human
guuuacuguuuucugauaagug

SEQ ID NO: 193510 - RNA, 22 nt, Human
acccuggguucccgcagcacca

SEQ ID NO: 193511 - RNA, 22 nt, Human
cuucuuucaagaauggauuagg

SEQ ID NO: 193512 - RNA, 22 nt, Human
uucagauaucauuaauuuagua

SEQ ID NO: 193513 - RNA, 22 nt, Human
ucugcaccccgcagggucaggu

SEQ ID NO: 193514 - RNA, 22 nt, Human
uuucauuucauagaauuguguu

SEQ ID NO: 193515 - RNA, 22 nt, Human
agcuuuggagcugggugaaaga

SEQ ID NO: 193516 - RNA, 22 nt, Human
aaacucuauaggcagaagcaau

SEQ ID NO: 193517 - RNA, 22 nt, Human
uggcugagugaacauguccauu

SEQ ID NO: 193518 - RNA, 22 nt, Human
ccacugcuccugaccaagguca

SEQ ID NO: 193519 - RNA, 22 nt, Human
ugcuuuauuuauaaaauagcaa

SEQ ID NO: 193520 - RNA, 21 nt, Human
ucauccagguccugcuucuuc

SEQ ID NO: 193521 - RNA, 22 nt, Human
uagaggagcggcgagcugagcu

SEQ ID NO: 193522 - RNA, 22 nt, Human
gcacagagcuggcccuccaggc

SEQ ID NO: 193523 - RNA, 22 nt, Human
aaagguuuucaucacagcaaga

SEQ ID NO: 193524 - RNA, 22 nt, Human
uggagagcgugcuuagcacucu

SEQ ID NO: 193525 - RNA, 22 nt, Human
uguaggccuauguccagcaauu

SEQ ID NO: 193526 - RNA, 22 nt, Human
uagaagcacugacagaguuuga

SEQ ID NO: 193527 - RNA, 18 nt, Human
uggcucagauggcuuuaa

SEQ ID NO: 193528 - RNA, 22 nt, Human
guuuuccuguugaguaguauuc

SEQ ID NO: 193529 - RNA, 19 nt, Human
gggcucucgagcaaccaac

SEQ ID NO: 193530 - RNA, 18 nt, Human
gccuuugcacaagcagcu

SEQ ID NO: 193531 - RNA, 22 nt, Human
uccuguggggaaaagccuaucu

SEQ ID NO: 193532 - RNA, 22 nt, Human
ggagggggaauucagccccagc

SEQ ID NO: 193533 - RNA, 22 nt, Human
agguuccucuuccucuggccug

SEQ ID NO: 193534 - RNA, 22 nt, Human
guuuccugacccuggcccagca

SEQ ID NO: 193535 - RNA, 22 nt, Human
ugcaggagauaauggugcuuag

SEQ ID NO: 193536 - RNA, 22 nt, Human
cugggccucauccagccacaac

SEQ ID NO: 193537 - RNA, 22 nt, Human
ucugcagcccaaagucucuuag

SEQ ID NO: 193538 - RNA, 22 nt, Human
ucugugcaaguauuugacauuu

SEQ ID NO: 193539 - RNA, 22 nt, Human
acagaauagucagcuguaggcc

SEQ ID NO: 193540 - RNA, 22 nt, Human
ugcuggcuuggaaggaaagcgc

SEQ ID NO: 193541 - RNA, 22 nt, Human
gcagcaggucugucaaugucau

SEQ ID NO: 193542 - RNA, 22 nt, Human
ggagagcugguauaugaagaca

SEQ ID NO: 193543 - RNA, 22 nt, Human
uacugucuauacacuugauuac

SEQ ID NO: 193544 - RNA, 22 nt, Human
uagcaucagccacaccuuguac

SEQ ID NO: 193545 - RNA, 22 nt, Human
uugagcucccgcuucuucuuug

SEQ ID NO: 193546 - RNA, 22 nt, Human
accagcuccaggccccugcugg

SEQ ID NO: 193547 - RNA, 22 nt, Human
cccagccugucuuucccaauga

SEQ ID NO: 193548 - RNA, 22 nt, Human
uccuccaggauaaaauguguug

SEQ ID NO: 193549 - RNA, 19 nt, Human
aaggugguuugucucugua

SEQ ID NO: 193550 - RNA, 22 nt, Human
gucucaguuuuccaaacuguca

SEQ ID NO: 193551 - RNA, 22 nt, Human
aggaccugcuaaugugccaagu

SEQ ID NO: 193552 - RNA, 21 nt, Human
acauuuucuguuuuaggaagu

SEQ ID NO: 193553 - RNA, 22 nt, Human
uccagcauauauagagaaugag

SEQ ID NO: 193554 - RNA, 22 nt, Human
uccaggcugauccaugaagaau

SEQ ID NO: 193555 - RNA, 19 nt, Human
ugagacugggugcaguacu

SEQ ID NO: 193556 - RNA, 22 nt, Human
gguggcagagaggagguaguuu

SEQ ID NO: 193557 - RNA, 22 nt, Human
cugcaucuguuagauuaucacc

SEQ ID NO: 193558 - RNA, 22 nt, Human
gagcugaacgggaauuccccga

SEQ ID NO: 193559 - RNA, 22 nt, Human
gagaggcuggguuggagaucga

SEQ ID NO: 193560 - RNA, 22 nt, Human
accagaaggaccagaggcaagg

SEQ ID NO: 193561 - RNA, 22 nt, Human
uuguauucuuccuuagcaguac

SEQ ID NO: 193562 - RNA, 22 nt, Human
uacaaagcuuguacugugugac

SEQ ID NO: 193563 - RNA, 22 nt, Human
acagaaagaagguguauuugag

SEQ ID NO: 193564 - RNA, 22 nt, Human
gggcccaggccuccuuccuucc

SEQ ID NO: 193565 - RNA, 22 nt, Human
aauuaaaagauaacccaugagu

SEQ ID NO: 193566 - RNA, 22 nt, Human
uuugcaaugguaguuguugcuc

SEQ ID NO: 193567 - RNA, 22 nt, Human
gaucuucuauguaaugaagugu

SEQ ID NO: 193568 - RNA, 22 nt, Human
cagaucaagcuguauggucaga

SEQ ID NO: 193569 - RNA, 22 nt, Human
aggaagaauguuuacauaucaa

SEQ ID NO: 193570 - RNA, 22 nt, Human
gcugggucuggcugugagccgg

SEQ ID NO: 193571 - RNA, 22 nt, Human
acaguuugaauaauuuagauag

SEQ ID NO: 193572 - RNA, 22 nt, Human
agggccaaguccaggaccucgg

SEQ ID NO: 193573 - RNA, 22 nt, Human
agcuggccauugugaguggccu

SEQ ID NO: 193574 - RNA, 22 nt, Human
aggcgugggaggaucugaggcc

SEQ ID NO: 193575 - RNA, 22 nt, Human
cccugcagagagugcuuuugug

SEQ ID NO: 193576 - RNA, 22 nt, Human
ucacuuauugcucaucucaugc

SEQ ID NO: 193577 - RNA, 22 nt, Human
acauugaugugaugcagaagug

SEQ ID NO: 193578 - RNA, 22 nt, Human
agagccagcauuugacacuggc

SEQ ID NO: 193579 - RNA, 22 nt, Human
aggcuggcuggcaggggacaca

SEQ ID NO: 193580 - RNA, 19 nt, Human
aauggacaggcaauagucu

SEQ ID NO: 193581 - RNA, 22 nt, Human
ucugugucugcagaaguucagc

SEQ ID NO: 193582 - RNA, 22 nt, Human
agaaagagcucgggauuaacag

SEQ ID NO: 193583 - RNA, 20 nt, Human
agcccuguaaauccccugga

SEQ ID NO: 193584 - RNA, 19 nt, Human
agcagguggguaagaaaau

SEQ ID NO: 193585 - RNA, 22 nt, Human
aucuagaggcaaugaaggaggu

SEQ ID NO: 193586 - RNA, 22 nt, Human
aggcugugcauuuuggagggcc

SEQ ID NO: 193587 - RNA, 22 nt, Human
aauugcuuguuuucggucauaa

SEQ ID NO: 193588 - RNA, 22 nt, Human
caggugguacuuaaagucagaa

SEQ ID NO: 193589 - RNA, 22 nt, Human
gggcccaguacccucugccaag

SEQ ID NO: 193590 - RNA, 22 nt, Human
agagacuucugccuuagcaaga

SEQ ID NO: 193591 - RNA, 22 nt, Human
uaggugucuggacaacuuugua

SEQ ID NO: 193592 - RNA, 22 nt, Human
gcugcucugaaaaugacuguug

SEQ ID NO: 193593 - RNA, 22 nt, Human
uccucagaagaaccccuagauu

SEQ ID NO: 193594 - RNA, 22 nt, Human
cuagggucaggggccugcgucg

SEQ ID NO: 193595 - RNA, 22 nt, Human
aucuccagcuggcugugauaaa

SEQ ID NO: 193596 - RNA, 22 nt, Human
ugacuuccagcaacuuccucca

SEQ ID NO: 193597 - RNA, 22 nt, Human
caaugacauggauaaucauauu

SEQ ID NO: 193598 - RNA, 22 nt, Human
uagcuaucuguguccagaucca

SEQ ID NO: 193599 - RNA, 20 nt, Human
gggagaagggcugaugagag

SEQ ID NO: 193600 - RNA, 22 nt, Human
ccucugggaagccaguccugcu

SEQ ID NO: 193601 - RNA, 22 nt, Human
aacuggaaccuuuuauucaguc

SEQ ID NO: 193602 - RNA, 22 nt, Human
gccagaggggcucgaaggcgcg

SEQ ID NO: 193603 - RNA, 22 nt, Human
gcuccugugcaggucucgguug

SEQ ID NO: 193604 - RNA, 22 nt, Human
uggagcagcuaagccucugaga

SEQ ID NO: 193605 - RNA, 22 nt, Human
ugggccugggagggcagacgcu

SEQ ID NO: 193606 - RNA, 22 nt, Human
ucucaggagccacagcgggagu

SEQ ID NO: 193607 - RNA, 22 nt, Human
auucgcacauuaacacucauau

SEQ ID NO: 193608 - RNA, 22 nt, Human
ggcccagaauacuuuguaaaau

SEQ ID NO: 193609 - RNA, 22 nt, Human
aagugcaaauuuaagaaggcau

SEQ ID NO: 193610 - RNA, 22 nt, Human
cccugggagcugccuggcugac

SEQ ID NO: 193611 - RNA, 22 nt, Human
uuauguuuuaaguguguaucuu

SEQ ID NO: 193612 - RNA, 22 nt, Human
gccacugugguccucccaugau

SEQ ID NO: 193613 - RNA, 22 nt, Human
auucauguaaaauuggauagac

SEQ ID NO: 193614 - RNA, 22 nt, Human
auuugcuuuuacuauguuaaaa

SEQ ID NO: 193615 - RNA, 22 nt, Human
ucugguaauaggcaauagcuug

SEQ ID NO: 193616 - RNA, 22 nt, Human
gcccuggauguacaggcauguu

SEQ ID NO: 193617 - RNA, 22 nt, Human
agcugcaagucuguguggggag

SEQ ID NO: 193618 - RNA, 22 nt, Human
ucuggcaguugccgcuucaguc

SEQ ID NO: 193619 - RNA, 22 nt, Human
ggacccagaggggagucuggca

SEQ ID NO: 193620 - RNA, 22 nt, Human
aggagcagaacuguuguggagg

SEQ ID NO: 193621 - RNA, 22 nt, Human
ugcugugcuccauugucuucac

SEQ ID NO: 193622 - RNA, 20 nt, Human
uguugauuggugucaucuca

SEQ ID NO: 193623 - RNA, 22 nt, Human
agucacugcuuugucccugugu

SEQ ID NO: 193624 - RNA, 22 nt, Human
aaggugguucgcugguacccag

SEQ ID NO: 193625 - RNA, 22 nt, Human
uguuuacuaugauguaaccuau

SEQ ID NO: 193626 - RNA, 22 nt, Human
gcuggccagggcugcucgcgga

SEQ ID NO: 193627 - RNA, 22 nt, Human
ugggagcaggcugaugauaggu

SEQ ID NO: 193628 - RNA, 22 nt, Human
agagccuuuggagcugcuauua

SEQ ID NO: 193629 - RNA, 22 nt, Human
caggcuggagugcaauggugcu

SEQ ID NO: 193630 - RNA, 22 nt, Human
ugagggcuaaauuguggcaggu

SEQ ID NO: 193631 - RNA, 22 nt, Human
uacacauuacauaauacuaucu

SEQ ID NO: 193632 - RNA, 22 nt, Human
gaggcuguuaggagggacucug

SEQ ID NO: 193633 - RNA, 21 nt, Human
agcugggccucagccugcagu

SEQ ID NO: 193634 - RNA, 22 nt, Human
uucaaaguccugucagguagcc

SEQ ID NO: 193635 - RNA, 22 nt, Human
aaagacacaaauguagaccaaa

SEQ ID NO: 193636 - RNA, 22 nt, Human
uaaaaaguagugagaauggcgc

SEQ ID NO: 193637 - RNA, 22 nt, Human
aacaucagaauauccauguugg

SEQ ID NO: 193638 - RNA, 22 nt, Human
gaaaggaaauauucuaagcacu

SEQ ID NO: 193639 - RNA, 17 nt, Human
aauugcuuguacuccca

SEQ ID NO: 193640 - RNA, 22 nt, Human
uuauaagcucugaaaucuccua

SEQ ID NO: 193641 - RNA, 22 nt, Human
uacagauauuguacaguuauag

SEQ ID NO: 193642 - RNA, 22 nt, Human
agccucuuauucuccaggacuu

SEQ ID NO: 193643 - RNA, 22 nt, Human
gaggcucagggaguauaugaau

SEQ ID NO: 193644 - RNA, 22 nt, Human
uuuguguuuucacuagcagugu

SEQ ID NO: 193645 - RNA, 22 nt, Human
ucuggcuguguaagguagcacc

SEQ ID NO: 193646 - RNA, 22 nt, Human
gggucucucagaaggcugcaau

SEQ ID NO: 193647 - RNA, 22 nt, Human
ugaaauacugagugaaagaauu

SEQ ID NO: 193648 - RNA, 22 nt, Human
guccuggcaccucacuggcuac

SEQ ID NO: 193649 - RNA, 22 nt, Human
caggacugaagggcacagggaa

SEQ ID NO: 193650 - RNA, 22 nt, Human
uccuccagcuacuaggcaaaua

SEQ ID NO: 193651 - RNA, 20 nt, Human
caugguggaggagcagggcc

SEQ ID NO: 193652 - RNA, 20 nt, Human
uuugacauauacaguucagg

SEQ ID NO: 193653 - RNA, 22 nt, Human
aaugcuuuaauugcauguagug

SEQ ID NO: 193654 - RNA, 22 nt, Human
uagaacuaagaguuaucauuua

SEQ ID NO: 193655 - RNA, 22 nt, Human
gggcuuggcucauaaguggaug

SEQ ID NO: 193656 - RNA, 22 nt, Human
uuagaaucuuguaucagaaguu

SEQ ID NO: 193657 - RNA, 22 nt, Human
uuccaggagacuuccagaaaua

SEQ ID NO: 193658 - RNA, 22 nt, Human
cuucaagagaaugcagggaugu

SEQ ID NO: 193659 - RNA, 22 nt, Human
gaggcucuucaauaggucaaug

SEQ ID NO: 193660 - RNA, 22 nt, Human
cuccccgagagagguuguccgc

SEQ ID NO: 193661 - RNA, 22 nt, Human
cacacagaugguaagggaggga

SEQ ID NO: 193662 - RNA, 22 nt, Human
cucucagaaguagcacgugggc

SEQ ID NO: 193663 - RNA, 22 nt, Human
uucaacaauuaaguaucagccu

SEQ ID NO: 193664 - RNA, 22 nt, Human
auagaaauguauuuuggacuag

SEQ ID NO: 193665 - RNA, 22 nt, Human
cugaaauucugccucugcacaa

SEQ ID NO: 193666 - RNA, 22 nt, Human
ucaugcaucugggcuggcuggu

SEQ ID NO: 193667 - RNA, 22 nt, Human
aaacaugaauagauauuaaaca

SEQ ID NO: 193668 - RNA, 22 nt, Human
uacugaaacucuuguaaauauc

SEQ ID NO: 193669 - RNA, 22 nt, Human
ucuuccugcuuuggugaggcuu

SEQ ID NO: 193670 - RNA, 22 nt, Human
agaggccaagccagacugugca

SEQ ID NO: 193671 - RNA, 22 nt, Human
uauguuacaaaguuuuucuaaa

SEQ ID NO: 193672 - RNA, 22 nt, Human
auacauauaugguacuuccugg

SEQ ID NO: 193673 - RNA, 22 nt, Human
uucaauaucucuaagaaugagg

SEQ ID NO: 193674 - RNA, 22 nt, Human
cugugagggucacagccaugcc

SEQ ID NO: 193675 - RNA, 22 nt, Human
cucacagguuaguuguguggau

SEQ ID NO: 193676 - RNA, 22 nt, Human
ugacauguauaucuuacgcuau

SEQ ID NO: 193677 - RNA, 22 nt, Human
aucuuuagugugaauuuauuga

SEQ ID NO: 193678 - RNA, 22 nt, Human
ucuuagaaguuuauggcacgga

SEQ ID NO: 193679 - RNA, 22 nt, Human
cuggacaggcuggggacugcaa

SEQ ID NO: 193680 - RNA, 22 nt, Human
agcagugugggcugcacgcugg

SEQ ID NO: 193681 - RNA, 20 nt, Human
uuugcuguggguguaagaau

SEQ ID NO: 193682 - RNA, 22 nt, Human
cugggucaaggaaugcuggugg

SEQ ID NO: 193683 - RNA, 22 nt, Human
cugcccagaagccagaugggca

SEQ ID NO: 193684 - RNA, 22 nt, Human
ugucugggucaccccuccuggc

SEQ ID NO: 193685 - RNA, 22 nt, Human
cagggagggacaauugucaccu

SEQ ID NO: 193686 - RNA, 22 nt, Human
uggugagauaacuuucggcaag

SEQ ID NO: 193687 - RNA, 22 nt, Human
gugcccaguccugccuugacag

SEQ ID NO: 193688 - RNA, 22 nt, Human
agaaaucacuuagaggaaguga

SEQ ID NO: 193689 - RNA, 22 nt, Human
ugagucuucugccuaaagaagu

SEQ ID NO: 193690 - RNA, 22 nt, Human
gcuuccaaaucuguucaaaaug

SEQ ID NO: 193691 - RNA, 22 nt, Human
auacaucuagagucauaaaaac

SEQ ID NO: 193692 - RNA, 22 nt, Human
gcaaaggcuagagacacaggga

SEQ ID NO: 193693 - RNA, 22 nt, Human
uggauugauaaaaugggauguu

SEQ ID NO: 193694 - RNA, 22 nt, Human
uccuggguuaauuaugauucac

SEQ ID NO: 193695 - RNA, 22 nt, Human
gggagccacaguagcagcuacu

SEQ ID NO: 193696 - RNA, 22 nt, Human
gccauugagauugaaguaagca

SEQ ID NO: 193697 - RNA, 22 nt, Human
agaauaaaugcuaccuaucaca

SEQ ID NO: 193698 - RNA, 22 nt, Human
gccaaaggauucuauggagaua

SEQ ID NO: 193699 - RNA, 22 nt, Human
uuccuaaucacgaacauuauuu

SEQ ID NO: 193700 - RNA, 22 nt, Human
ucuucaaauacagucauauuga

SEQ ID NO: 193701 - RNA, 22 nt, Human
aaaugcuguagaucagugaguu

SEQ ID NO: 193702 - RNA, 22 nt, Human
agacauauauugcaauucacug

SEQ ID NO: 193703 - RNA, 22 nt, Human
uacuguuagagccagaaaccua

SEQ ID NO: 193704 - RNA, 18 nt, Human
agcagguucucacagcca

SEQ ID NO: 193705 - RNA, 21 nt, Human
ugaaugaugccccagaguugu

SEQ ID NO: 193706 - RNA, 22 nt, Human
uguuauugagguuacuuauaag

SEQ ID NO: 193707 - RNA, 18 nt, Human
cuccccagcugcccccag

SEQ ID NO: 193708 - RNA, 22 nt, Human
ugaguagagaauucagcuaagg

SEQ ID NO: 193709 - RNA, 22 nt, Human
aacagcugcaaaagguugccug

SEQ ID NO: 193710 - RNA, 22 nt, Human
ucccagugagaugaaacaggua

SEQ ID NO: 193711 - RNA, 22 nt, Human
cugaggagagaucacguggugu

SEQ ID NO: 193712 - RNA, 22 nt, Human
acaguaaaacauuuuuauuagg

SEQ ID NO: 193713 - RNA, 22 nt, Human
cagucccuaguggagcucacag

SEQ ID NO: 193714 - RNA, 22 nt, Human
cuggcucaguucuugguuuuca

SEQ ID NO: 193715 - RNA, 22 nt, Human
uucacagugagcuaugucuugu

SEQ ID NO: 193716 - RNA, 22 nt, Human
gugcagagugucuguggacuga

SEQ ID NO: 193717 - RNA, 22 nt, Human
ugggcugcggauaggccucgga

SEQ ID NO: 193718 - RNA, 22 nt, Human
cagugggacaugggcacugggc

SEQ ID NO: 193719 - RNA, 22 nt, Human
uaguacuacguuuucuacuauc

SEQ ID NO: 193720 - RNA, 22 nt, Human
uaaggagguugguggguuggau

SEQ ID NO: 193721 - RNA, 22 nt, Human
agucagaguuuugaggugugac

SEQ ID NO: 193722 - RNA, 22 nt, Human
cugaggcuuugugugcaugccu

SEQ ID NO: 193723 - RNA, 22 nt, Human
ugaaaucuuauacuuugguagu

SEQ ID NO: 193724 - RNA, 22 nt, Human
acaggauuaauaaaaaauugua

SEQ ID NO: 193725 - RNA, 22 nt, Human
ugacagagcauguagugacagc

SEQ ID NO: 193726 - RNA, 22 nt, Human
gggcugcuacgagaacugaaua

SEQ ID NO: 193727 - RNA, 22 nt, Human
ugcaggaguccaaucaggagac

SEQ ID NO: 193728 - RNA, 22 nt, Human
gccugggacccuuagcucuugg

SEQ ID NO: 193729 - RNA, 22 nt, Human
ccagaggucuccugcacgggau

SEQ ID NO: 193730 - RNA, 20 nt, Human
uccaggcccacucagcugaa

SEQ ID NO: 193731 - RNA, 21 nt, Human
gucuuucuaccucuauguggc

SEQ ID NO: 193732 - RNA, 22 nt, Human
uaggaagaucaaguuuaucuca

SEQ ID NO: 193733 - RNA, 22 nt, Human
gacaagacugguuuauuuaagg

SEQ ID NO: 193734 - RNA, 22 nt, Human
ugaaagauaaguuauuauguac

SEQ ID NO: 193735 - RNA, 22 nt, Human
uuccuucuagcccaaguauugg

SEQ ID NO: 193736 - RNA, 22 nt, Human
aggcacugacaauucuggacug

SEQ ID NO: 193737 - RNA, 22 nt, Human
agggacaguauccaucucacag

SEQ ID NO: 193738 - RNA, 22 nt, Human
gcaggaguaugcagcuaugguu

SEQ ID NO: 193739 - RNA, 22 nt, Human
aagaacagauucagccugaacu

SEQ ID NO: 193740 - RNA, 22 nt, Human
gugcagcuuccuggucucagcc

SEQ ID NO: 193741 - RNA, 22 nt, Human
ggcugccuccugcugggcugga

SEQ ID NO: 193742 - RNA, 22 nt, Human
gacauaaaauggaauucuguug

SEQ ID NO: 193743 - RNA, 17 nt, Human
uuaucuacugcuacugu

SEQ ID NO: 193744 - RNA, 22 nt, Human
ggcuguggucucaucuagccuu

SEQ ID NO: 193745 - RNA, 22 nt, Human
uuaucagaguccccaaaagaaa

SEQ ID NO: 193746 - RNA, 22 nt, Human
cugggcucugcggugucgcucu

SEQ ID NO: 193747 - RNA, 22 nt, Human
cuggaggagaacuugaggaagg

SEQ ID NO: 193748 - RNA, 22 nt, Human
aauucacugaacuucucugaga

SEQ ID NO: 193749 - RNA, 22 nt, Human
agcuaaaugugaaaugucaacc

SEQ ID NO: 193750 - RNA, 22 nt, Human
ggagcagccacgucucagggca

SEQ ID NO: 193751 - RNA, 22 nt, Human
uuuaaagugcugcuccuauccu

SEQ ID NO: 193752 - RNA, 22 nt, Human
aucaaaucauugcauuaauguu

SEQ ID NO: 193753 - RNA, 22 nt, Human
gauacagcucuggccagaugug

SEQ ID NO: 193754 - RNA, 22 nt, Human
caggcucagcaggagccugacc

SEQ ID NO: 193755 - RNA, 22 nt, Human
cucugggucucccugaggcuaa

SEQ ID NO: 193756 - RNA, 22 nt, Human
uucugcauguguuucaaauacu

SEQ ID NO: 193757 - RNA, 22 nt, Human
cuuuggaggaaaauugagguca

SEQ ID NO: 193758 - RNA, 22 nt, Human
ggccucugcuuaugcugaugac

SEQ ID NO: 193759 - RNA, 22 nt, Human
cuccaggaccagggcuccugga

SEQ ID NO: 193760 - RNA, 22 nt, Human
agcacaguuucuuuuccuuguc

SEQ ID NO: 193761 - RNA, 22 nt, Human
accaggcagagcugggccuuaa

SEQ ID NO: 193762 - RNA, 22 nt, Human
auucaagguuuauucaguuuag

SEQ ID NO: 193763 - RNA, 22 nt, Human
agaggcugcacuugcucaugau

SEQ ID NO: 193764 - RNA, 22 nt, Human
gaggagggcuuuguugauguua

SEQ ID NO: 193765 - RNA, 23 nt, Human
uccuccugacacagccugaguga

SEQ ID NO: 193766 - RNA, 22 nt, Human
aggcagugagugugacuucaca

SEQ ID NO: 193767 - RNA, 22 nt, Human
gucucuaucauagcugaacccu

SEQ ID NO: 193768 - RNA, 22 nt, Human
cuucucuuggguguggugucuu

SEQ ID NO: 193769 - RNA, 22 nt, Human
uuccuucuuguaaugaucugcc

SEQ ID NO: 193770 - RNA, 22 nt, Human
ccaggccuggccaggggaugcc

SEQ ID NO: 193771 - RNA, 22 nt, Human
uauuauugcaaguauauaaagu

SEQ ID NO: 193772 - RNA, 22 nt, Human
agggaaaggcugaugcuguggg

SEQ ID NO: 193773 - RNA, 22 nt, Human
auagcaagguaugacuggagcc

SEQ ID NO: 193774 - RNA, 19 nt, Human
agcaauuaagacugugggc

SEQ ID NO: 193775 - RNA, 22 nt, Human
cccugcagugugaccucaccua

SEQ ID NO: 193776 - RNA, 22 nt, Human
uuccuucucuguggggaaggca

SEQ ID NO: 193777 - RNA, 22 nt, Human
agcagcagugugguuuggggaa

SEQ ID NO: 193778 - RNA, 22 nt, Human
gguggccuccagggcauaggug

SEQ ID NO: 193779 - RNA, 22 nt, Human
agaagggcuacacgggcucucc

SEQ ID NO: 193780 - RNA, 22 nt, Human
ucugggagagggaaagaagacu

SEQ ID NO: 193781 - RNA, 19 nt, Human
uguacauauagagcucagu

SEQ ID NO: 193782 - RNA, 22 nt, Human
gaaagaaucaacuaugucucug

SEQ ID NO: 193783 - RNA, 22 nt, Human
augcuucugguauaagaaaaau

SEQ ID NO: 193784 - RNA, 21 nt, Human
agcaacucugacuagaugagg

SEQ ID NO: 193785 - RNA, 22 nt, Human
auuauaaaccuuugaggguggg

SEQ ID NO: 193786 - RNA, 18 nt, Human
gcuucucauuucuaagca

SEQ ID NO: 193787 - RNA, 22 nt, Human
ugucucugaaauauguggcucc

SEQ ID NO: 193788 - RNA, 22 nt, Human
cugaggcauguuacaggacaua

SEQ ID NO: 193789 - RNA, 22 nt, Human
cucaggagaugacagaagguau

SEQ ID NO: 193790 - RNA, 22 nt, Human
ucaaaggaaacacaagcuucug

SEQ ID NO: 193791 - RNA, 22 nt, Human
ccacugucuuuuccaggcugaa

SEQ ID NO: 193792 - RNA, 22 nt, Human
uuccuaaaagaauacacuggau

SEQ ID NO: 193793 - RNA, 22 nt, Human
uucugagguccaugcaguacug

SEQ ID NO: 193794 - RNA, 22 nt, Human
cagcccuuccuucuguuuauac

SEQ ID NO: 193795 - RNA, 22 nt, Human
cugccucugguuuuggucccug

SEQ ID NO: 193796 - RNA, 21 nt, Human
uagaggcaggagggacugcag

SEQ ID NO: 193797 - RNA, 22 nt, Human
uggagcuccacuggaaaaaugu

SEQ ID NO: 193798 - RNA, 22 nt, Human
uuuugcuuuuguaacacagugu

SEQ ID NO: 193799 - RNA, 22 nt, Human
ggcccagcuguauauuacaguu

SEQ ID NO: 193800 - RNA, 22 nt, Human
agucuucugaauaagaaucacu

SEQ ID NO: 193801 - RNA, 22 nt, Human
ugcagggccuugggaugugucc

SEQ ID NO: 193802 - RNA, 21 nt, Human
uggcucccuugaauugucugu

SEQ ID NO: 193803 - RNA, 22 nt, Human
aauagcuuuggucaccaucugg

SEQ ID NO: 193804 - RNA, 22 nt, Human
ugcuucucuguucuaacccuug

SEQ ID NO: 193805 - RNA, 22 nt, Human
aacauguugaguugaaaguagc

SEQ ID NO: 193806 - RNA, 22 nt, Human
gccccaggauaaauuuguaaga

SEQ ID NO: 193807 - RNA, 22 nt, Human
guuuuucuagacugggaguuug

SEQ ID NO: 193808 - RNA, 22 nt, Human
gggcaauuaaggucccguuucc

SEQ ID NO: 193809 - RNA, 23 nt, Human
aggcaguggugguaacaugucaa

SEQ ID NO: 193810 - RNA, 19 nt, Human
agguggucuaggcuggaga

SEQ ID NO: 193811 - RNA, 19 nt, Human
cugcucagagcagcuccag

SEQ ID NO: 193812 - RNA, 22 nt, Human
cucagggcggcgggcagcccag

SEQ ID NO: 193813 - RNA, 22 nt, Human
ccugccuugacguaacgcauga

SEQ ID NO: 193814 - RNA, 22 nt, Human
guggaugagauaacuguagaag

SEQ ID NO: 193815 - RNA, 22 nt, Human
cacauaaauggugccauguuuu

SEQ ID NO: 193816 - RNA, 20 nt, Human
ugggcucugcuuccuggagu

SEQ ID NO: 193817 - RNA, 22 nt, Human
ugacaagaaagcgucuucuuuu

SEQ ID NO: 193818 - RNA, 22 nt, Human
gcagcugucggaaagcuaagug

SEQ ID NO: 193819 - RNA, 22 nt, Human
ucuuuccacagcauguccaugc

SEQ ID NO: 193820 - RNA, 23 nt, Human
caugucugcuuucaugcuacaac

SEQ ID NO: 193821 - RNA, 22 nt, Human
uccaggaaucugugccuagccc

SEQ ID NO: 193822 - RNA, 22 nt, Human
gaggccauaagaaguucuuggg

SEQ ID NO: 193823 - RNA, 21 nt, Human
uuacauucagaggaguggaag

SEQ ID NO: 193824 - RNA, 22 nt, Human
aacagcagguccuggcaugggu

SEQ ID NO: 193825 - RNA, 20 nt, Human
ugucagcaauuaggagaaaa

SEQ ID NO: 193826 - RNA, 22 nt, Human
aggcucagcaucugauucauau

SEQ ID NO: 193827 - RNA, 22 nt, Human
gguucaguggaauguguugacc

SEQ ID NO: 193828 - RNA, 22 nt, Human
agggacccugaugacugaggag

SEQ ID NO: 193829 - RNA, 22 nt, Human
aucauaacuguaauucaucuac

SEQ ID NO: 193830 - RNA, 19 nt, Human
agcuggcacuagaauccag

SEQ ID NO: 193831 - RNA, 22 nt, Human
aggccaaguagccgcuguccua

SEQ ID NO: 193832 - RNA, 22 nt, Human
guuuccuauguccauugaggga

SEQ ID NO: 193833 - RNA, 19 nt, Human
ucuccaggcaggugagcga

SEQ ID NO: 193834 - RNA, 22 nt, Human
uucauguuucauuuguuacuau

SEQ ID NO: 193835 - RNA, 22 nt, Human
aagcacuuuaugucaauguccu

SEQ ID NO: 193836 - RNA, 22 nt, Human
gccaccauguagcccauuagag

SEQ ID NO: 193837 - RNA, 22 nt, Human
gacaauuagguuaagagcaaga

SEQ ID NO: 193838 - RNA, 18 nt, Human
acacugcagcagucugcu

SEQ ID NO: 193839 - RNA, 22 nt, Human
aaagccaaaugaaagaugguuc

SEQ ID NO: 193840 - RNA, 22 nt, Human
acaguaccugcucucaagcaaa

SEQ ID NO: 193841 - RNA, 22 nt, Human
agcccaaaccugcgagcagagc

SEQ ID NO: 193842 - RNA, 22 nt, Human
ugaggccagugacauauauuaa

SEQ ID NO: 193843 - RNA, 22 nt, Human
aggagacucagagaccuggccg

SEQ ID NO: 193844 - RNA, 22 nt, Human
uggcccugacagguccugggca

SEQ ID NO: 193845 - RNA, 22 nt, Human
guggucagagaugacagugggu

SEQ ID NO: 193846 - RNA, 22 nt, Human
uucuaguuuccauuuuaagaca

SEQ ID NO: 193847 - RNA, 22 nt, Human
aaacauuguuaugauaaauuac

SEQ ID NO: 193848 - RNA, 22 nt, Human
uggggcuagaauccugcaggaa

SEQ ID NO: 193849 - RNA, 22 nt, Human
auuuacugagcagcuaccaugu

SEQ ID NO: 193850 - RNA, 22 nt, Human
agagggcauaaaauagagcacg

SEQ ID NO: 193851 - RNA, 20 nt, Human
cucucuccaucucaguggcc

SEQ ID NO: 193852 - RNA, 22 nt, Human
uauccauuauguuggcuagucu

SEQ ID NO: 193853 - RNA, 19 nt, Human
accaggaacuucccuaggc

SEQ ID NO: 193854 - RNA, 22 nt, Human
ugggcaggauaauaucucaugu

SEQ ID NO: 193855 - RNA, 22 nt, Human
aacaugauggggaagaacaaga

SEQ ID NO: 193856 - RNA, 22 nt, Human
cgccugggaguccacaccugcu

SEQ ID NO: 193857 - RNA, 22 nt, Human
ugggcucauggcccagcacugg

SEQ ID NO: 193858 - RNA, 22 nt, Human
auagauauuagcaaaauuuuau

SEQ ID NO: 193859 - RNA, 22 nt, Human
guuuauaaauucugcuuuuguu

SEQ ID NO: 193860 - RNA, 22 nt, Human
aggcacagagaaugcccuccau

SEQ ID NO: 193861 - RNA, 22 nt, Human
ccugacaguuaauuguccugua

SEQ ID NO: 193862 - RNA, 22 nt, Human
ugagaagcccacacucuuuccu

SEQ ID NO: 193863 - RNA, 22 nt, Human
acaugccagcacugcuuuucag

SEQ ID NO: 193864 - RNA, 22 nt, Human
guauuaguuaucuacugcugug

SEQ ID NO: 193865 - RNA, 22 nt, Human
cugcccugcuucugagggaagc

SEQ ID NO: 193866 - RNA, 22 nt, Human
uaggcugaaaggagaggugaag

SEQ ID NO: 193867 - RNA, 22 nt, Human
gcuuucuugguucugcaggggc

SEQ ID NO: 193868 - RNA, 19 nt, Human
ugggugugaccaucucugc

SEQ ID NO: 193869 - RNA, 22 nt, Human
cucaggcugcccugacagcccc

SEQ ID NO: 193870 - RNA, 22 nt, Human
ggcuuugcuuuggcuguuucag

SEQ ID NO: 193871 - RNA, 22 nt, Human
aaacaugaguuaaaaguaacug

SEQ ID NO: 193872 - RNA, 22 nt, Human
ggcagcugagcauggcuaccuu

SEQ ID NO: 193873 - RNA, 22 nt, Human
aggcaucuauacauuauguuca

SEQ ID NO: 193874 - RNA, 22 nt, Human
gagaggaacucccagugccugg

SEQ ID NO: 193875 - RNA, 22 nt, Human
aauagaucugugugcacauuug

SEQ ID NO: 193876 - RNA, 22 nt, Human
gacaagacaccucucuccaucc

SEQ ID NO: 193877 - RNA, 18 nt, Human
agucuuuaaagauguuac

SEQ ID NO: 193878 - RNA, 22 nt, Human
gcugagcugaggcagggcuggg

SEQ ID NO: 193879 - RNA, 22 nt, Human
aaccagcucugcaaaaugucau

SEQ ID NO: 193880 - RNA, 22 nt, Human
augacuucguuuucucucugca

SEQ ID NO: 193881 - RNA, 22 nt, Human
accugccagaauccaagccaca

SEQ ID NO: 193882 - RNA, 22 nt, Human
ucacaugcccuaccuaaucuua

SEQ ID NO: 193883 - RNA, 22 nt, Human
gcuguggucccucuguccucau

SEQ ID NO: 193884 - RNA, 22 nt, Human
ucugaggguaagguuaagguag

SEQ ID NO: 193885 - RNA, 17 nt, Human
uucugggucccagggcc

SEQ ID NO: 193886 - RNA, 23 nt, Human
uguauuacagaugcaucagugau

SEQ ID NO: 193887 - RNA, 22 nt, Human
agcuccuccugagugucuggga

SEQ ID NO: 193888 - RNA, 22 nt, Human
aauucccacuauaugccaagca

SEQ ID NO: 193889 - RNA, 22 nt, Human
ucuggcucauacaagccugcaa

SEQ ID NO: 193890 - RNA, 22 nt, Human
uaugcauacaaugagauauucc

SEQ ID NO: 193891 - RNA, 22 nt, Human
agaaguaucaggaagauucuca

SEQ ID NO: 193892 - RNA, 22 nt, Human
ugacauuuuuaaaaccacuagu

SEQ ID NO: 193893 - RNA, 22 nt, Human
agggcugccccaguccagccgg

SEQ ID NO: 193894 - RNA, 22 nt, Human
uccugggccuguacuccauccg

SEQ ID NO: 193895 - RNA, 22 nt, Human
gagggcucacugagaaagcagu

SEQ ID NO: 193896 - RNA, 22 nt, Human
ucugccuuucccaggcuacugu

SEQ ID NO: 193897 - RNA, 22 nt, Human
gcagccaggaagccuuucccuc

SEQ ID NO: 193898 - RNA, 22 nt, Human
ccucagcuugauuucugcagag

SEQ ID NO: 193899 - RNA, 22 nt, Human
cuugggaaugcuaacagaugac

SEQ ID NO: 193900 - RNA, 22 nt, Human
aggcccagagagccaguuagug

SEQ ID NO: 193901 - RNA, 22 nt, Human
acacaguuuuucagacagagau

SEQ ID NO: 193902 - RNA, 22 nt, Human
uggcagggagccaccggucaug

SEQ ID NO: 193903 - RNA, 22 nt, Human
uggggcuaaacacgccuggccu

SEQ ID NO: 193904 - RNA, 22 nt, Human
aagugaauaaaauuguguucuu

SEQ ID NO: 193905 - RNA, 22 nt, Human
gcagagcacccugcagugguau

SEQ ID NO: 193906 - RNA, 23 nt, Human
uguguucucacacagaugcagua

SEQ ID NO: 193907 - RNA, 22 nt, Human
agggagcucuaaguagagggac

SEQ ID NO: 193908 - RNA, 22 nt, Human
aauuaggaauaaaugaguacuu

SEQ ID NO: 193909 - RNA, 22 nt, Human
auaacagagagcuacugaacug

SEQ ID NO: 193910 - RNA, 22 nt, Human
gcucagguguuaccuccucuag

SEQ ID NO: 193911 - RNA, 22 nt, Human
caagaacaguuugccaaauugg

SEQ ID NO: 193912 - RNA, 22 nt, Human
acacacaugguauuguucagaa

SEQ ID NO: 193913 - RNA, 22 nt, Human
agucagcugcagcagcuuuggu

SEQ ID NO: 193914 - RNA, 22 nt, Human
acagacugucccaccacaugga

SEQ ID NO: 193915 - RNA, 22 nt, Human
acccaggggcagccuugcugug

SEQ ID NO: 193916 - RNA, 22 nt, Human
auucuucauguugaagcuguca

SEQ ID NO: 193917 - RNA, 22 nt, Human
ucagguggcuuggagggggacg

SEQ ID NO: 193918 - RNA, 22 nt, Human
cagcagcagagauacugguuuc

SEQ ID NO: 193919 - RNA, 22 nt, Human
uccugagcuacaguaguaugau

SEQ ID NO: 193920 - RNA, 22 nt, Human
uuucagugaaagcuacuguuag

SEQ ID NO: 193921 - RNA, 22 nt, Human
auaguguuguauguacagucug

SEQ ID NO: 193922 - RNA, 22 nt, Human
gcaggcaccgcggcggcagguu

SEQ ID NO: 193923 - RNA, 22 nt, Human
ccaggguaccccaagggcaggu

SEQ ID NO: 193924 - RNA, 22 nt, Human
cugugggagcagcaccaaggac

SEQ ID NO: 193925 - RNA, 22 nt, Human
ucugaaauaacugaugccagau

SEQ ID NO: 193926 - RNA, 22 nt, Human
cugggcagugguggcccuuccc

SEQ ID NO: 193927 - RNA, 22 nt, Human
uggggcuccuccuggcaggagg

SEQ ID NO: 193928 - RNA, 22 nt, Human
aucugggccuguucccucaccu

SEQ ID NO: 193929 - RNA, 22 nt, Human
ggcaugggccgaggugccuccu

SEQ ID NO: 193930 - RNA, 22 nt, Human
cucaggauagauuguccucuca

SEQ ID NO: 193931 - RNA, 22 nt, Human
agugcaacuucacguagaguac

SEQ ID NO: 193932 - RNA, 22 nt, Human
cccaggcugugcaaacuucaaa

SEQ ID NO: 193933 - RNA, 22 nt, Human
caaggccagagccagcgauaag

SEQ ID NO: 193934 - RNA, 17 nt, Human
uuauugcuauaagcuga

SEQ ID NO: 193935 - RNA, 22 nt, Human
ggcugagaaggagugggugagg

SEQ ID NO: 193936 - RNA, 22 nt, Human
uuaauagauaugccucuagagu

SEQ ID NO: 193937 - RNA, 22 nt, Human
uaugaaaugguaguaggaaggg

SEQ ID NO: 193938 - RNA, 22 nt, Human
ugggggagccuucacaguagcu

SEQ ID NO: 193939 - RNA, 22 nt, Human
uugcuuauagagaguuucauac

SEQ ID NO: 193940 - RNA, 22 nt, Human
gaggucuugucugauagggaaa

SEQ ID NO: 193941 - RNA, 18 nt, Human
ucuuuguuuccuucuugc

SEQ ID NO: 193942 - RNA, 22 nt, Human
gagucuggaaugaugaagaccu

SEQ ID NO: 193943 - RNA, 22 nt, Human
acuucaugcagaagagagcugu

SEQ ID NO: 193944 - RNA, 22 nt, Human
gcuggggcugggcugaggaaga

SEQ ID NO: 193945 - RNA, 22 nt, Human
uaucuagaguccugcugagaac

SEQ ID NO: 193946 - RNA, 22 nt, Human
uagggcuggcgugcucagggaa

SEQ ID NO: 193947 - RNA, 22 nt, Human
ugggccuggcccuguggaggag

SEQ ID NO: 193948 - RNA, 22 nt, Human
acuucuaugcacagagcuugga

SEQ ID NO: 193949 - RNA, 22 nt, Human
aucuguaacaucaguagcagaa

SEQ ID NO: 193950 - RNA, 22 nt, Human
ccucccucuguuagagcugucu

SEQ ID NO: 193951 - RNA, 22 nt, Human
uggcccuguccucauuucaucu

SEQ ID NO: 193952 - RNA, 19 nt, Human
uugcuggagaaaaaggaga

SEQ ID NO: 193953 - RNA, 22 nt, Human
gggaacagagugccagacugac

SEQ ID NO: 193954 - RNA, 22 nt, Human
uuaaagcaugcugcuuuuccau

SEQ ID NO: 193955 - RNA, 22 nt, Human
aggcagguagaaggaucuuuau

SEQ ID NO: 193956 - RNA, 22 nt, Human
ucaggacaguucccugcaaauu

SEQ ID NO: 193957 - RNA, 23 nt, Human
uuucucugagaagcaguucucua

SEQ ID NO: 193958 - RNA, 22 nt, Human
gaacaaauucucaucaacuugu

SEQ ID NO: 193959 - RNA, 22 nt, Human
gauagaguguugccucucaauu

SEQ ID NO: 193960 - RNA, 22 nt, Human
caccugggcuaaacuaugcagg

SEQ ID NO: 193961 - RNA, 22 nt, Human
uuagcaucugcuguaagcuuau

SEQ ID NO: 193962 - RNA, 22 nt, Human
agacacuuucagaaguguuugc

SEQ ID NO: 193963 - RNA, 19 nt, Human
ucucuggggacacuuucac

SEQ ID NO: 193964 - RNA, 22 nt, Human
gggggaagaaagaacauggcau

SEQ ID NO: 193965 - RNA, 22 nt, Human
aaauuguaggaucacaugaccu

SEQ ID NO: 193966 - RNA, 22 nt, Human
gaggcugaguagcuuugugcuc

SEQ ID NO: 193967 - RNA, 22 nt, Human
gcagcucuggggcaggccugag

SEQ ID NO: 193968 - RNA, 22 nt, Human
cagagcugggaucccaugggcg

SEQ ID NO: 193969 - RNA, 22 nt, Human
gccaacuggcugaucucaaagc

SEQ ID NO: 193970 - RNA, 22 nt, Human
aggccagugccuuuccagggcu

SEQ ID NO: 193971 - RNA, 22 nt, Human
gggcuggcucccagguguugaa

SEQ ID NO: 193972 - RNA, 22 nt, Human
uacaugaagaugaauguauggc

SEQ ID NO: 193973 - RNA, 22 nt, Human
uuccuacauuugccucacuccc

SEQ ID NO: 193974 - RNA, 22 nt, Human
aguccagggagcccaggcuuug

SEQ ID NO: 193975 - RNA, 22 nt, Human
cagcuagcggugcuggcggcuc

SEQ ID NO: 193976 - RNA, 22 nt, Human
gagcagugaagacagaaguaca

SEQ ID NO: 193977 - RNA, 22 nt, Human
uugaaagauauguuaaucuuuc

SEQ ID NO: 193978 - RNA, 22 nt, Human
uugguuuugggauguacaaagg

SEQ ID NO: 193979 - RNA, 21 nt, Human
ugggugggcagagucucuuca

SEQ ID NO: 193980 - RNA, 22 nt, Human
ggaggagcacuugacggggucu

SEQ ID NO: 193981 - RNA, 22 nt, Human
auggcuucugucuuggaaauuu

SEQ ID NO: 193982 - RNA, 22 nt, Human
gggcugagauuggugcccuguc

SEQ ID NO: 193983 - RNA, 22 nt, Human
ucucuuucuauaugugagucuu

SEQ ID NO: 193984 - RNA, 22 nt, Human
ugacacaguugucgacucuaca

SEQ ID NO: 193985 - RNA, 22 nt, Human
acaugccaucacuuucauuccu

SEQ ID NO: 193986 - RNA, 22 nt, Human
agugcccugcuggggcaggaga

SEQ ID NO: 193987 - RNA, 22 nt, Human
ucucuaaauacagaugucaugg

SEQ ID NO: 193988 - RNA, 22 nt, Human
gcauguguucuugaaaggccac

SEQ ID NO: 193989 - RNA, 19 nt, Human
gaagcccugcauucuccgc

SEQ ID NO: 193990 - RNA, 22 nt, Human
caugccuguauuucugaucuau

SEQ ID NO: 193991 - RNA, 22 nt, Human
ccuucaaguuccuggucccugg

SEQ ID NO: 193992 - RNA, 22 nt, Human
caguuacagagccaguuagaga

SEQ ID NO: 193993 - RNA, 22 nt, Human
ugcaaagugcuagcccacacca

SEQ ID NO: 193994 - RNA, 22 nt, Human
ucuuggagacucuuguauauuu

SEQ ID NO: 193995 - RNA, 22 nt, Human
acucagagcuuggcuccuugcu

SEQ ID NO: 193996 - RNA, 22 nt, Human
uuagaucauuuugaacuaauuu

SEQ ID NO: 193997 - RNA, 22 nt, Human
agaggggcucaagcaguggucu

SEQ ID NO: 193998 - RNA, 22 nt, Human
cacugauuaagucugcuagagg

SEQ ID NO: 193999 - RNA, 22 nt, Human
uuuacacauaccucuuuaaagu

SEQ ID NO: 194000 - RNA, 22 nt, Human
agcagccacagucugggacagg

SEQ ID NO: 194001 - RNA, 22 nt, Human
acaggacauggcuucugugacg

SEQ ID NO: 194002 - RNA, 22 nt, Human
auugauuugaacaaagauauua

SEQ ID NO: 194003 - RNA, 22 nt, Human
uggcccgaccucugcucaugca

SEQ ID NO: 194004 - RNA, 22 nt, Human
uggcucagcugacucggcuucu

SEQ ID NO: 194005 - RNA, 22 nt, Human
ccugugacauuagaauuucauu

SEQ ID NO: 194006 - RNA, 22 nt, Human
aaagacuuggcuuaugauuugc

SEQ ID NO: 194007 - RNA, 22 nt, Human
gccaggcagcugggagggugcc

SEQ ID NO: 194008 - RNA, 22 nt, Human
cuuagaugaagucacagaaccc

SEQ ID NO: 194009 - RNA, 22 nt, Human
ucaagucuggagaucuggaacu

SEQ ID NO: 194010 - RNA, 20 nt, Human
auuugggacgauuggccacc

SEQ ID NO: 194011 - RNA, 22 nt, Human
augaggcaaggaucagguaagg

SEQ ID NO: 194012 - RNA, 22 nt, Human
cuacagaaacacuggacaugug

SEQ ID NO: 194013 - RNA, 22 nt, Human
cagagccugcucacgucucugu

SEQ ID NO: 194014 - RNA, 22 nt, Human
aggguccaucaaggacugcaca

SEQ ID NO: 194015 - RNA, 22 nt, Human
ugcugugagguugagaaggaag

SEQ ID NO: 194016 - RNA, 22 nt, Human
ugggugggagcgcccugucugg

SEQ ID NO: 194017 - RNA, 22 nt, Human
aaguggcaguucaggaagcaga

SEQ ID NO: 194018 - RNA, 22 nt, Human
ugaaagaaacagguauauuggg

SEQ ID NO: 194019 - RNA, 22 nt, Human
gucccaggcagagucaggaggg

SEQ ID NO: 194020 - RNA, 22 nt, Human
aaagcucacaguaauacaaggc

SEQ ID NO: 194021 - RNA, 22 nt, Human
auguagaggaguuucuggucug

SEQ ID NO: 194022 - RNA, 22 nt, Human
ucucaacaccacuugcugaaga

SEQ ID NO: 194023 - RNA, 22 nt, Human
uacaauguuaaggaaagagaga

SEQ ID NO: 194024 - RNA, 22 nt, Human
ugagucugggcauguucacuuu

SEQ ID NO: 194025 - RNA, 22 nt, Human
aaguaucucaaaaacaguaauc

SEQ ID NO: 194026 - RNA, 22 nt, Human
gcuuuuaauuaguugcuuccau

SEQ ID NO: 194027 - RNA, 22 nt, Human
cuucugugguaaacuuuguugu

SEQ ID NO: 194028 - RNA, 22 nt, Human
ugcaguuuugccaggcaaugga

SEQ ID NO: 194029 - RNA, 22 nt, Human
cagcuuuuaggacugugagaaa

SEQ ID NO: 194030 - RNA, 22 nt, Human
agaggucagagcaggaaaggca

SEQ ID NO: 194031 - RNA, 22 nt, Human
aaaacuuagcuaggcaaguuuu

SEQ ID NO: 194032 - RNA, 22 nt, Human
uuccugguuggauucugauuaa

SEQ ID NO: 194033 - RNA, 22 nt, Human
cagcuguugucaccucacaucc

SEQ ID NO: 194034 - RNA, 22 nt, Human
ucuggagaacuugcaagaggau

SEQ ID NO: 194035 - RNA, 22 nt, Human
uauugucaagaaguuuauagug

SEQ ID NO: 194036 - RNA, 19 nt, Human
uggugcuggccucccaugg

SEQ ID NO: 194037 - RNA, 22 nt, Human
aaagcacuuugagacugacagg

SEQ ID NO: 194038 - RNA, 22 nt, Human
uuuaguauccuaucucauuuaa

SEQ ID NO: 194039 - RNA, 22 nt, Human
ggccuuagugagguccugaugc

SEQ ID NO: 194040 - RNA, 20 nt, Human
gcugggggugugcugaguga

SEQ ID NO: 194041 - RNA, 22 nt, Human
ccuuucugauggccucccagcc

SEQ ID NO: 194042 - RNA, 22 nt, Human
uaagaaucaguagauauagauu

SEQ ID NO: 194043 - RNA, 22 nt, Human
ugcaaggcccagacaagagcuc

SEQ ID NO: 194044 - RNA, 22 nt, Human
gcauaucagcaucaaaacacag

SEQ ID NO: 194045 - RNA, 22 nt, Human
uccaaggagucuuaaguuacau

SEQ ID NO: 194046 - RNA, 22 nt, Human
cagaaacauguauaaaguugua

SEQ ID NO: 194047 - RNA, 22 nt, Human
ggaggaagcacacggcuuguau

SEQ ID NO: 194048 - RNA, 22 nt, Human
aguccaaagcagaugagggcca

SEQ ID NO: 194049 - RNA, 22 nt, Human
ucagugucugugggcaggaugg

SEQ ID NO: 194050 - RNA, 22 nt, Human
aagacauuuauuugaaucaauu

SEQ ID NO: 194051 - RNA, 22 nt, Human
caggugguugagagcuguaggc

SEQ ID NO: 194052 - RNA, 18 nt, Human
aggucugaggaagagccu

SEQ ID NO: 194053 - RNA, 22 nt, Human
guuuuauaggcuguugcuauau

SEQ ID NO: 194054 - RNA, 22 nt, Human
auguuacauaguccuuauuugu

SEQ ID NO: 194055 - RNA, 22 nt, Human
ugccaggcucagccccuaucuu

SEQ ID NO: 194056 - RNA, 22 nt, Human
aaauaaacugaagcacagagag

SEQ ID NO: 194057 - RNA, 19 nt, Human
gggcuuggggcugaagccu

SEQ ID NO: 194058 - RNA, 22 nt, Human
cugcaccacagccugaggcagc

SEQ ID NO: 194059 - RNA, 21 nt, Human
cagcccagcuucuuccccagu

SEQ ID NO: 194060 - RNA, 22 nt, Human
guggaaauuuuaggaucaucuu

SEQ ID NO: 194061 - RNA, 22 nt, Human
cuugaauccaaaugggagauga

SEQ ID NO: 194062 - RNA, 22 nt, Human
ucccacacuacacgguuguugg

SEQ ID NO: 194063 - RNA, 22 nt, Human
uggucauuaauucuuaccuuua

SEQ ID NO: 194064 - RNA, 22 nt, Human
agcaggagagcagugcgugguc

SEQ ID NO: 194065 - RNA, 23 nt, Human
gagcucagguagggcucgcccgc

SEQ ID NO: 194066 - RNA, 19 nt, Human
uacaugcagcaggcacgca

SEQ ID NO: 194067 - RNA, 22 nt, Human
gaagagcugacagugucauccu

SEQ ID NO: 194068 - RNA, 22 nt, Human
cagagggacaguaugaugaaag

SEQ ID NO: 194069 - RNA, 22 nt, Human
agacuggcuugcuuuacaagga

SEQ ID NO: 194070 - RNA, 18 nt, Human
caggaauggaugggauuu

SEQ ID NO: 194071 - RNA, 22 nt, Human
gugagucuuuggagacaguuca

SEQ ID NO: 194072 - RNA, 22 nt, Human
ccagcugugccuaggagcaggg

SEQ ID NO: 194073 - RNA, 22 nt, Human
uuuagagaauuagaacaguacu

SEQ ID NO: 194074 - RNA, 19 nt, Human
agaggcaagggcucaugac

SEQ ID NO: 194075 - RNA, 22 nt, Human
gcuuacagauaaugaggagacu

SEQ ID NO: 194076 - RNA, 23 nt, Human
uuccuuaacuguuaagauugucu

SEQ ID NO: 194077 - RNA, 22 nt, Human
uuccuguuagccauuauuagcu

SEQ ID NO: 194078 - RNA, 22 nt, Human
ugcuuagaaucuggacuuguug

SEQ ID NO: 194079 - RNA, 22 nt, Human
ugucugagucaugcagagauau

SEQ ID NO: 194080 - RNA, 22 nt, Human
uggcugagaccuucccaaauuc

SEQ ID NO: 194081 - RNA, 22 nt, Human
uuacacaacagugcaucagcag

SEQ ID NO: 194082 - RNA, 22 nt, Human
aauacauauggaauuccauguu

SEQ ID NO: 194083 - RNA, 22 nt, Human
agaaccuucagcuugcaacaag

SEQ ID NO: 194084 - RNA, 22 nt, Human
auuguuaaacugaagcauuacu

SEQ ID NO: 194085 - RNA, 22 nt, Human
agaaaagaggcuuucuaagcau

SEQ ID NO: 194086 - RNA, 22 nt, Human
aauguuaauuuacugucuucau

SEQ ID NO: 194087 - RNA, 22 nt, Human
ucuguggaguugaggaagguug

SEQ ID NO: 194088 - RNA, 23 nt, Human
ggagugcaauggcgccaucucgg

SEQ ID NO: 194089 - RNA, 22 nt, Human
agccuggguuuuuauuaaggag

SEQ ID NO: 194090 - RNA, 22 nt, Human
aggaggguacaauggguggaaa

SEQ ID NO: 194091 - RNA, 19 nt, Human
ugcccugcccgcagccuug

SEQ ID NO: 194092 - RNA, 22 nt, Human
uggcccaggugcacccagaggc

SEQ ID NO: 194093 - RNA, 22 nt, Human
cugggucuucagcagcaggcgg

SEQ ID NO: 194094 - RNA, 22 nt, Human
ggagaggagcuauugggggcuc

SEQ ID NO: 194095 - RNA, 22 nt, Human
uugaggaggccuuucagggcuu

SEQ ID NO: 194096 - RNA, 22 nt, Human
ccuggggccccgagccagaagc

SEQ ID NO: 194097 - RNA, 22 nt, Human
uguuuaauaauucuaugauagu

SEQ ID NO: 194098 - RNA, 22 nt, Human
gcacccagagggcagggucucc

SEQ ID NO: 194099 - RNA, 22 nt, Human
uugggggguugaggaguagaua

SEQ ID NO: 194100 - RNA, 22 nt, Human
aggacacaugcacacccugcgu

SEQ ID NO: 194101 - RNA, 22 nt, Human
ucaggaaguugaggcguagaga

SEQ ID NO: 194102 - RNA, 22 nt, Human
gaauaucccgcuaugcaaagua

SEQ ID NO: 194103 - RNA, 22 nt, Human
uagggaggaggguuuucaaauc

SEQ ID NO: 194104 - RNA, 22 nt, Human
uagccaugagcagaucacuaua

SEQ ID NO: 194105 - RNA, 22 nt, Human
cucuccacucagcgucaugucc

SEQ ID NO: 194106 - RNA, 22 nt, Human
guagggacuguucucaccugag

SEQ ID NO: 194107 - RNA, 22 nt, Human
ugaaaugcuguagagacuguau

SEQ ID NO: 194108 - RNA, 22 nt, Human
ugaggcagguggauuacaaggu

SEQ ID NO: 194109 - RNA, 22 nt, Human
gaggguccccaugcagagcuca

SEQ ID NO: 194110 - RNA, 22 nt, Human
ccucagagaaaugucuauucaa

SEQ ID NO: 194111 - RNA, 21 nt, Human
ucacaggcucagggagagagu

SEQ ID NO: 194112 - RNA, 22 nt, Human
uucuccugcgcaggcccaggga

SEQ ID NO: 194113 - RNA, 22 nt, Human
cucuagaggcuugaaugggcga

SEQ ID NO: 194114 - RNA, 23 nt, Human
cagaccuuucuguaucaguuauc

SEQ ID NO: 194115 - RNA, 22 nt, Human
gcugcgguggcuggcgauggga

SEQ ID NO: 194116 - RNA, 22 nt, Human
ugaugguuuuauuaauaggacc

SEQ ID NO: 194117 - RNA, 22 nt, Human
uuugaaaggagcuuuauccaga

SEQ ID NO: 194118 - RNA, 22 nt, Human
gaagugaagguuacucuagauu

SEQ ID NO: 194119 - RNA, 22 nt, Human
uuuagagcugugcugccacaug

SEQ ID NO: 194120 - RNA, 22 nt, Human
ugcuucuggaaacaguggcugu

SEQ ID NO: 194121 - RNA, 22 nt, Human
gggccaccuggauuccaugugu

SEQ ID NO: 194122 - RNA, 22 nt, Human
aaccccaaaaccucugaagugg

SEQ ID NO: 194123 - RNA, 17 nt, Human
agugucagaagacaguu

SEQ ID NO: 194124 - RNA, 22 nt, Human
cugcugucgccacggucgccgc

SEQ ID NO: 194125 - RNA, 22 nt, Human
aggcauggguagaagagaagcc

SEQ ID NO: 194126 - RNA, 22 nt, Human
uagcaucuaacaucuuaggacu

SEQ ID NO: 194127 - RNA, 20 nt, Human
uggguccugcacauucucca

SEQ ID NO: 194128 - RNA, 22 nt, Human
ucagguguggucaccacagggu

SEQ ID NO: 194129 - RNA, 19 nt, Human
uguagcaguuuaaaacaac

SEQ ID NO: 194130 - RNA, 22 nt, Human
acucugugugaguagagccugu

SEQ ID NO: 194131 - RNA, 22 nt, Human
cccaggcagcggggucuccuug

SEQ ID NO: 194132 - RNA, 22 nt, Human
uuuauacuucauaaugucuauu

SEQ ID NO: 194133 - RNA, 22 nt, Human
aagggcaggcagagaucauaua

SEQ ID NO: 194134 - RNA, 22 nt, Human
uguggcagucucacuggagggc

SEQ ID NO: 194135 - RNA, 20 nt, Human
uaccaacagcaggaagcaua

SEQ ID NO: 194136 - RNA, 22 nt, Human
agcuggcaucugaagucagggc

SEQ ID NO: 194137 - RNA, 22 nt, Human
cacauguguauaugugaggggg

SEQ ID NO: 194138 - RNA, 22 nt, Human
auuuccuauagauauggugagu

SEQ ID NO: 194139 - RNA, 22 nt, Human
uagcugaaugccuuggauuuuu

SEQ ID NO: 194140 - RNA, 22 nt, Human
ugacagaaagaauaugucaauc

SEQ ID NO: 194141 - RNA, 22 nt, Human
acacugucugggacucaggagu

SEQ ID NO: 194142 - RNA, 18 nt, Human
cuggauuaagacagugcu

SEQ ID NO: 194143 - RNA, 22 nt, Human
uuugcagaguaccugaagagga

SEQ ID NO: 194144 - RNA, 22 nt, Human
gcuggagucuggaggugugcca

SEQ ID NO: 194145 - RNA, 20 nt, Human
gucuccacuggggguuaacc

SEQ ID NO: 194146 - RNA, 22 nt, Human
aaaagggaaagcagaaugacuu

SEQ ID NO: 194147 - RNA, 18 nt, Human
gcuagggcaugcauggug

SEQ ID NO: 194148 - RNA, 22 nt, Human
uaaaugcaguuaguacuugcca

SEQ ID NO: 194149 - RNA, 22 nt, Human
gggcccagcccucugcucacug

SEQ ID NO: 194150 - RNA, 22 nt, Human
acuguccuuuuaaugcagccgu

SEQ ID NO: 194151 - RNA, 22 nt, Human
cagggaugguugagaauuggua

SEQ ID NO: 194152 - RNA, 22 nt, Human
uauuauuaugcauagcaugaaa

SEQ ID NO: 194153 - RNA, 22 nt, Human
cucucuggaccucaacuauuuu

SEQ ID NO: 194154 - RNA, 22 nt, Human
gcugccaggcccuggggcuaug

SEQ ID NO: 194155 - RNA, 22 nt, Human
uccaggcuggacaugaggcggg

SEQ ID NO: 194156 - RNA, 22 nt, Human
gagguuggagggcuggccugca

SEQ ID NO: 194157 - RNA, 22 nt, Human
agagauuaagucacuuggucag

SEQ ID NO: 194158 - RNA, 22 nt, Human
uguggcuggauugauuuuaccu

SEQ ID NO: 194159 - RNA, 22 nt, Human
ucuuguuaucaggaaaacagua

SEQ ID NO: 194160 - RNA, 22 nt, Human
ggcugcagauagccagccacca

SEQ ID NO: 194161 - RNA, 22 nt, Human
uagggcucuggugggcucuguu

SEQ ID NO: 194162 - RNA, 22 nt, Human
gggcugacgaaggccaugugug

SEQ ID NO: 194163 - RNA, 22 nt, Human
gcagaggaggacccaggaauua

SEQ ID NO: 194164 - RNA, 22 nt, Human
uucuuuuccuguggcucaucca

SEQ ID NO: 194165 - RNA, 22 nt, Human
agauguggccuuugggagauua

SEQ ID NO: 194166 - RNA, 22 nt, Human
acaggucugcaguaacugggaa

SEQ ID NO: 194167 - RNA, 22 nt, Human
aacaguagguguaaccaaacaa

SEQ ID NO: 194168 - RNA, 22 nt, Human
cagaaucucugggaguggauca

SEQ ID NO: 194169 - RNA, 22 nt, Human
uccaugcagagaacugaaguac

SEQ ID NO: 194170 - RNA, 22 nt, Human
uuuccagguaucaagcuucagg

SEQ ID NO: 194171 - RNA, 22 nt, Human
ggccagcccagugguccucucu

SEQ ID NO: 194172 - RNA, 22 nt, Human
uggcugagcugcagcguggcuu

SEQ ID NO: 194173 - RNA, 22 nt, Human
ucaaagcaauuucaccagugcc

SEQ ID NO: 194174 - RNA, 22 nt, Human
ucaggauggcuucugcaucaaa

SEQ ID NO: 194175 - RNA, 22 nt, Human
ugggccagagaguaagaaaggu

SEQ ID NO: 194176 - RNA, 22 nt, Human
auacagguaggggacauacauc

SEQ ID NO: 194177 - RNA, 22 nt, Human
agagaggcauucggugauccca

SEQ ID NO: 194178 - RNA, 22 nt, Human
ugccaggccaaugaaggcaggg

SEQ ID NO: 194179 - RNA, 22 nt, Human
gaaccacaaugugaagaaggag

SEQ ID NO: 194180 - RNA, 22 nt, Human
aagcugaagccggaucaaaaag

SEQ ID NO: 194181 - RNA, 22 nt, Human
auuucuagaggcagcuucuagg

SEQ ID NO: 194182 - RNA, 22 nt, Human
uuucauuauucaugcuaguuau

SEQ ID NO: 194183 - RNA, 22 nt, Human
gagcaagauuuuauaaguugug

SEQ ID NO: 194184 - RNA, 22 nt, Human
caggauggagagugagggguca

SEQ ID NO: 194185 - RNA, 22 nt, Human
aagaugugcugucuugccacuc

SEQ ID NO: 194186 - RNA, 22 nt, Human
ugauaucugaaguguauaaaca

SEQ ID NO: 194187 - RNA, 19 nt, Human
aacaucauggcucuuucca

SEQ ID NO: 194188 - RNA, 18 nt, Human
aggcuucuuggcucaguc

SEQ ID NO: 194189 - RNA, 22 nt, Human
gauucagugagggugagaagaa

SEQ ID NO: 194190 - RNA, 22 nt, Human
aaaguggucaccuucucauuuc

SEQ ID NO: 194191 - RNA, 18 nt, Human
uuuuacucauagcaggcc

SEQ ID NO: 194192 - RNA, 20 nt, Human
cucucccagcacagcuuccu

SEQ ID NO: 194193 - RNA, 22 nt, Human
gugugccaccagucaaggugaa

SEQ ID NO: 194194 - RNA, 22 nt, Human
cuguccuggugcuggggauccc

SEQ ID NO: 194195 - RNA, 22 nt, Human
cacagaaaggcucaaaucccaa

SEQ ID NO: 194196 - RNA, 22 nt, Human
gagacagaugcugcuggagcau

SEQ ID NO: 194197 - RNA, 22 nt, Human
ccaggcacuuguuugccaggca

SEQ ID NO: 194198 - RNA, 22 nt, Human
gacuacaacucccagaagacuu

SEQ ID NO: 194199 - RNA, 22 nt, Human
augcaacacauuugaugagcga

SEQ ID NO: 194200 - RNA, 22 nt, Human
gcaggcuucaagcacagcuuuu

SEQ ID NO: 194201 - RNA, 22 nt, Human
cuucauaggguuguaaggauua

SEQ ID NO: 194202 - RNA, 22 nt, Human
cagugguauuugagagaaugga

SEQ ID NO: 194203 - RNA, 22 nt, Human
uugcagagagguuaggaacuca

SEQ ID NO: 194204 - RNA, 22 nt, Human
caaguuuuagcaaguggaaagg

SEQ ID NO: 194205 - RNA, 21 nt, Human
cugccaggauagcaugcaggc

SEQ ID NO: 194206 - RNA, 22 nt, Human
auaauuuaauuuucacaguggu

SEQ ID NO: 194207 - RNA, 22 nt, Human
acuguaacacaaugguaucugu

SEQ ID NO: 194208 - RNA, 22 nt, Human
guucauguggaaauuuaaaaca

SEQ ID NO: 194209 - RNA, 22 nt, Human
ggcugcagggcagcuggugugg

SEQ ID NO: 194210 - RNA, 22 nt, Human
augcaaaugcuagagaauguug

SEQ ID NO: 194211 - RNA, 22 nt, Human
cggccgcagcagugucggccca

SEQ ID NO: 194212 - RNA, 22 nt, Human
cacuguacccauuuaaauaaau

SEQ ID NO: 194213 - RNA, 22 nt, Human
gucugugguagacaggaaggca

SEQ ID NO: 194214 - RNA, 22 nt, Human
gucaaauauaugcaaaacuauu

SEQ ID NO: 194215 - RNA, 22 nt, Human
gcccuguguauccccugugcuu

SEQ ID NO: 194216 - RNA, 22 nt, Human
acccaggaugauaauguucaca

SEQ ID NO: 194217 - RNA, 22 nt, Human
cuggugccauucuguggccuag

SEQ ID NO: 194218 - RNA, 22 nt, Human
gaaggaaaucugugauuuaugc

SEQ ID NO: 194219 - RNA, 22 nt, Human
auguuucaaauauauagaguug

SEQ ID NO: 194220 - RNA, 18 nt, Human
acacaguggaugccuggu

SEQ ID NO: 194221 - RNA, 22 nt, Human
aggcaguuguugcugagcagcu

SEQ ID NO: 194222 - RNA, 22 nt, Human
aaagccagagcaagcugucaca

SEQ ID NO: 194223 - RNA, 20 nt, Human
guuaaaagaguaauuugagg

SEQ ID NO: 194224 - RNA, 22 nt, Human
acuaaaguccuguuguagcaua

SEQ ID NO: 194225 - RNA, 22 nt, Human
ucucccaggcugcccuguggac

SEQ ID NO: 194226 - RNA, 22 nt, Human
gagauggggaauaggagcaagc

SEQ ID NO: 194227 - RNA, 22 nt, Human
ucaagacagauggguaacuugg

SEQ ID NO: 194228 - RNA, 20 nt, Human
uccacaucuuuugagaugug

SEQ ID NO: 194229 - RNA, 22 nt, Human
uucauucaucacaugcagcugg

SEQ ID NO: 194230 - RNA, 22 nt, Human
cagcagcucccauccgcugagc

SEQ ID NO: 194231 - RNA, 22 nt, Human
uuugcuuucuugauucagauua

SEQ ID NO: 194232 - RNA, 22 nt, Human
ucagcaggcaccggaaguguuu

SEQ ID NO: 194233 - RNA, 22 nt, Human
caggcauugccauuccuccaga

SEQ ID NO: 194234 - RNA, 22 nt, Human
cucuagaaugaauuagcgcagg

SEQ ID NO: 194235 - RNA, 22 nt, Human
gucauuuaucaucagaagucau

SEQ ID NO: 194236 - RNA, 22 nt, Human
agagucagaaccaagaugaggc

SEQ ID NO: 194237 - RNA, 22 nt, Human
aggggccaccuguggcacccug

SEQ ID NO: 194238 - RNA, 22 nt, Human
gcugcccauuccacuggauggu

SEQ ID NO: 194239 - RNA, 22 nt, Human
ccuuccagaguucagucugccc

SEQ ID NO: 194240 - RNA, 22 nt, Human
caaaacauucucugcagcaggg

SEQ ID NO: 194241 - RNA, 22 nt, Human
gccacaggcacuuaagggcugg

SEQ ID NO: 194242 - RNA, 22 nt, Human
cuuguauuaggaagaaugcuuu

SEQ ID NO: 194243 - RNA, 22 nt, Human
gugggagaaauuagcucuaguu

SEQ ID NO: 194244 - RNA, 22 nt, Human
cuggguaccucaccgcugcugc

SEQ ID NO: 194245 - RNA, 22 nt, Human
guguucugggaugauuguagug

SEQ ID NO: 194246 - RNA, 22 nt, Human
cagcagguucuacgggugagau

SEQ ID NO: 194247 - RNA, 22 nt, Human
cagaagcaagagccggagcuag

SEQ ID NO: 194248 - RNA, 22 nt, Human
cacccugggcugggccuguuaa

SEQ ID NO: 194249 - RNA, 22 nt, Human
gcccuccauggugauccaggcc

SEQ ID NO: 194250 - RNA, 19 nt, Human
agucuggaguaaaaggaau

SEQ ID NO: 194251 - RNA, 22 nt, Human
ccaaggcuguggggcugugcag

SEQ ID NO: 194252 - RNA, 22 nt, Human
gcaggcugugguauguugggca

SEQ ID NO: 194253 - RNA, 22 nt, Human
uuccccaggcggcuuuuucagc

SEQ ID NO: 194254 - RNA, 22 nt, Human
caggaagcuagauuuuguugcu

SEQ ID NO: 194255 - RNA, 22 nt, Human
cuguccugaaguuuucaugaga

SEQ ID NO: 194256 - RNA, 22 nt, Human
auccauuuuaacuguuagugca

SEQ ID NO: 194257 - RNA, 22 nt, Human
uugcuuuagggcaaauauuuca

SEQ ID NO: 194258 - RNA, 22 nt, Human
ugucauauagauauuagacagg

SEQ ID NO: 194259 - RNA, 22 nt, Human
gaaggcuucaaaagguguaauu

SEQ ID NO: 194260 - RNA, 21 nt, Human
agagggagaguggcccuucca

SEQ ID NO: 194261 - RNA, 20 nt, Human
cucugaggcugagaagggag

SEQ ID NO: 194262 - RNA, 22 nt, Human
uacuuuauauuguggcuggcca

SEQ ID NO: 194263 - RNA, 22 nt, Human
caucuuugggcugcauggaagg

SEQ ID NO: 194264 - RNA, 22 nt, Human
gcucuggggcccagggaucaca

SEQ ID NO: 194265 - RNA, 22 nt, Human
ugauuucuucuaauuuccauca

SEQ ID NO: 194266 - RNA, 22 nt, Human
uaagaugaccuuauaaagagca

SEQ ID NO: 194267 - RNA, 22 nt, Human
cuugaaagaagggucuuuuaau

SEQ ID NO: 194268 - RNA, 22 nt, Human
uggcuucugagcauugaaacgu

SEQ ID NO: 194269 - RNA, 22 nt, Human
cagauuuacucccugcugcugc

SEQ ID NO: 194270 - RNA, 22 nt, Human
agugacucacacaaacaugugu

SEQ ID NO: 194271 - RNA, 22 nt, Human
gguguccugucagcuagaguga

SEQ ID NO: 194272 - RNA, 22 nt, Human
gaaguuuucugaggcuguagcu

SEQ ID NO: 194273 - RNA, 22 nt, Human
cuccucgaagcaaccugcaggc

SEQ ID NO: 194274 - RNA, 22 nt, Human
gaggcaagagaagccagcuuuc

SEQ ID NO: 194275 - RNA, 22 nt, Human
aaaggccaugguuggaguguuu

SEQ ID NO: 194276 - RNA, 22 nt, Human
cuccuggacauggagcggagga

SEQ ID NO: 194277 - RNA, 22 nt, Human
gcagcuggagccagccagacac

SEQ ID NO: 194278 - RNA, 22 nt, Human
aaaaagacagaggaugaggcag

SEQ ID NO: 194279 - RNA, 22 nt, Human
agguugaaauagguuaucuaag

SEQ ID NO: 194280 - RNA, 22 nt, Human
ucaggugucuugugggauuuua

SEQ ID NO: 194281 - RNA, 21 nt, Human
aggagcuguguuagcuggucg

SEQ ID NO: 194282 - RNA, 22 nt, Human
ggcagccagcggguggacgcgc

SEQ ID NO: 194283 - RNA, 22 nt, Human
cauggcugcgagaagagugggu

SEQ ID NO: 194284 - RNA, 22 nt, Human
uggcccugcacccagagcaguu

SEQ ID NO: 194285 - RNA, 22 nt, Human
uugagggagaaaguuggaguag

SEQ ID NO: 194286 - RNA, 22 nt, Human
cuucuggcaaaacaggcagaaa

SEQ ID NO: 194287 - RNA, 22 nt, Human
uuguuucuucaggcuuuuagga

SEQ ID NO: 194288 - RNA, 22 nt, Human
uguuaacauaguggcgcaucug

SEQ ID NO: 194289 - RNA, 22 nt, Human
gaaagauauuuauuggcaacag

SEQ ID NO: 194290 - RNA, 22 nt, Human
acaaauggagaaacugaggccc

SEQ ID NO: 194291 - RNA, 22 nt, Human
acaugccaucuuugucaggagu

SEQ ID NO: 194292 - RNA, 22 nt, Human
aaagguuauuauuacuauuguc

SEQ ID NO: 194293 - RNA, 22 nt, Human
agaaggaaggaagcauucuguu

SEQ ID NO: 194294 - RNA, 22 nt, Human
ucuguguauuugugaccuguau

SEQ ID NO: 194295 - RNA, 19 nt, Human
acugcagggaggaggugug

SEQ ID NO: 194296 - RNA, 22 nt, Human
ucuccaagaaaagaucucagcu

SEQ ID NO: 194297 - RNA, 22 nt, Human
auagauguuuuaguaauacugu

SEQ ID NO: 194298 - RNA, 22 nt, Human
acaauagucaaugcacgucauu

SEQ ID NO: 194299 - RNA, 22 nt, Human
guacacauacuauucaaagaga

SEQ ID NO: 194300 - RNA, 22 nt, Human
ucuguacaacaaagggaugaga

SEQ ID NO: 194301 - RNA, 22 nt, Human
agagggugggcacgugauggau

SEQ ID NO: 194302 - RNA, 22 nt, Human
acuccugguucccaguugagau

SEQ ID NO: 194303 - RNA, 22 nt, Human
ucuguucagguuucagagaacu

SEQ ID NO: 194304 - RNA, 22 nt, Human
cugucccucaguucugggcaaa

SEQ ID NO: 194305 - RNA, 22 nt, Human
gcuggcagugugaaugacaagc

SEQ ID NO: 194306 - RNA, 22 nt, Human
auguguguguuuaauccucaaa

SEQ ID NO: 194307 - RNA, 22 nt, Human
uuucugcauauguauguaugga

SEQ ID NO: 194308 - RNA, 22 nt, Human
agggaaauuaaugugagcaaug

SEQ ID NO: 194309 - RNA, 23 nt, Human
cagguauugauuuuucuucuagg

SEQ ID NO: 194310 - RNA, 22 nt, Human
acagcuguggucuccuuagugu

SEQ ID NO: 194311 - RNA, 22 nt, Human
cagugcccuuccaggacugcag

SEQ ID NO: 194312 - RNA, 22 nt, Human
acauucucuccaugucuucuuu

SEQ ID NO: 194313 - RNA, 22 nt, Human
aucagcaggugcugguggagac

SEQ ID NO: 194314 - RNA, 22 nt, Human
gcugccaucuccugaggacagg

SEQ ID NO: 194315 - RNA, 22 nt, Human
uagcugugaaacagcagaagag

SEQ ID NO: 194316 - RNA, 22 nt, Human
acacugcuucucuggcagagcc

SEQ ID NO: 194317 - RNA, 18 nt, Human
uggcuucuugagcuaaca

SEQ ID NO: 194318 - RNA, 22 nt, Human
uacuuucuuguuccuuucauaa

SEQ ID NO: 194319 - RNA, 22 nt, Human
auuugaaccacucagaacucau

SEQ ID NO: 194320 - RNA, 22 nt, Human
cuggcuuugcgucuuugccaca

SEQ ID NO: 194321 - RNA, 19 nt, Human
gcacaggacaucugaugga

SEQ ID NO: 194322 - RNA, 22 nt, Human
uccaggccccccacgcuaaugg

SEQ ID NO: 194323 - RNA, 22 nt, Human
agucugggagaaggugagauua

SEQ ID NO: 194324 - RNA, 22 nt, Human
gccuuccuuuuaccaccagcca

SEQ ID NO: 194325 - RNA, 22 nt, Human
agggcugaccuaagcuccacuu

SEQ ID NO: 194326 - RNA, 22 nt, Human
ugguccuggggaucugcaguga

SEQ ID NO: 194327 - RNA, 22 nt, Human
uggcuucuggccaggcacagga

SEQ ID NO: 194328 - RNA, 22 nt, Human
cugguuuaugagggaagggaug

SEQ ID NO: 194329 - RNA, 22 nt, Human
gagggagggccaggucccaacc

SEQ ID NO: 194330 - RNA, 22 nt, Human
gagcucagauucuggugucaga

SEQ ID NO: 194331 - RNA, 20 nt, Human
ucuaaaguacaguuugugug

SEQ ID NO: 194332 - RNA, 22 nt, Human
agagugcaugacaugaucuugg

SEQ ID NO: 194333 - RNA, 22 nt, Human
aagugcuuaaaaggguggucua

SEQ ID NO: 194334 - RNA, 22 nt, Human
gcaguguuguuaaaagauuaga

SEQ ID NO: 194335 - RNA, 22 nt, Human
agcccagcacugggggcccagc

SEQ ID NO: 194336 - RNA, 22 nt, Human
ucugucaauauaugugcugcag

SEQ ID NO: 194337 - RNA, 18 nt, Human
aguuuuuaggaagaaaug

SEQ ID NO: 194338 - RNA, 17 nt, Human
gaacaguguaagacacu

SEQ ID NO: 194339 - RNA, 22 nt, Human
cauaaauuguacccauuccaac

SEQ ID NO: 194340 - RNA, 17 nt, Human
ucugugauaguguagau

SEQ ID NO: 194341 - RNA, 22 nt, Human
ccugggcagguguggcuucccc

SEQ ID NO: 194342 - RNA, 20 nt, Human
uccagggcuagggagcucau

SEQ ID NO: 194343 - RNA, 22 nt, Human
uucagaaaugaauauugguauu

SEQ ID NO: 194344 - RNA, 19 nt, Human
ggcuccuguggcugcagcc

SEQ ID NO: 194345 - RNA, 22 nt, Human
uucaugaagggugaauauaguc

SEQ ID NO: 194346 - RNA, 22 nt, Human
acuguucuuguaacacuuaaau

SEQ ID NO: 194347 - RNA, 22 nt, Human
cucagauguguuggauggaaaa

SEQ ID NO: 194348 - RNA, 22 nt, Human
caagggcagaggcagggccccg

SEQ ID NO: 194349 - RNA, 22 nt, Human
agcagggcuccauuucacugcc

SEQ ID NO: 194350 - RNA, 22 nt, Human
gcagacagacugcagugauuuu

SEQ ID NO: 194351 - RNA, 22 nt, Human
auccugggcaguuuugagugcu

SEQ ID NO: 194352 - RNA, 22 nt, Human
acagggcaaccucugggagacu

SEQ ID NO: 194353 - RNA, 22 nt, Human
agccauguuaaauggacuugau

SEQ ID NO: 194354 - RNA, 22 nt, Human
gauggcuuugccugcugugagg

SEQ ID NO: 194355 - RNA, 22 nt, Human
uguggaagugccaaugacaaau

SEQ ID NO: 194356 - RNA, 20 nt, Human
gccaggcacuguucucaaua

SEQ ID NO: 194357 - RNA, 22 nt, Human
aauagcuuauugacagugaauu

SEQ ID NO: 194358 - RNA, 22 nt, Human
cgcgguggcggccuccagcgcc

SEQ ID NO: 194359 - RNA, 22 nt, Human
acuggaaaguauucuuucacug

SEQ ID NO: 194360 - RNA, 22 nt, Human
gcuggcugccaauuucagagcu

SEQ ID NO: 194361 - RNA, 22 nt, Human
ugagaacauuugcagggagagu

SEQ ID NO: 194362 - RNA, 22 nt, Human
ucccagagacaucauuucuccg

SEQ ID NO: 194363 - RNA, 22 nt, Human
aaagccugucuggucauagcua

SEQ ID NO: 194364 - RNA, 19 nt, Human
acaaagugcgugcucuuuu

SEQ ID NO: 194365 - RNA, 22 nt, Human
uugguuuaggaacuggcuugga

SEQ ID NO: 194366 - RNA, 22 nt, Human
acacauaugguugcugcaguga

SEQ ID NO: 194367 - RNA, 22 nt, Human
uugagaagaaauaguuugcaau

SEQ ID NO: 194368 - RNA, 22 nt, Human
agacagugcaagaagagcaggc

SEQ ID NO: 194369 - RNA, 22 nt, Human
agcccugcgaucgugauuucuu

SEQ ID NO: 194370 - RNA, 22 nt, Human
agcugaggguucgguguccaca

SEQ ID NO: 194371 - RNA, 22 nt, Human
augacucuaagaauucuagaug

SEQ ID NO: 194372 - RNA, 22 nt, Human
uuugacuccacuccuaacuccu

SEQ ID NO: 194373 - RNA, 22 nt, Human
aggaggggcaaugauagucugg

SEQ ID NO: 194374 - RNA, 22 nt, Human
uagggggcuuugcugcuugaca

SEQ ID NO: 194375 - RNA, 22 nt, Human
ucaucagagcucccccaaacgu

SEQ ID NO: 194376 - RNA, 22 nt, Human
uaguguauguucagcuuauaug

SEQ ID NO: 194377 - RNA, 22 nt, Human
aguuuaaaucauguuuuguaac

SEQ ID NO: 194378 - RNA, 22 nt, Human
gaguauuuauauguaaguaccu

SEQ ID NO: 194379 - RNA, 22 nt, Human
uggagcugccuggcaccuacag

SEQ ID NO: 194380 - RNA, 22 nt, Human
gccugggagauuaauuaggaag

SEQ ID NO: 194381 - RNA, 22 nt, Human
aaaguuuaggcuuugaaaccag

SEQ ID NO: 194382 - RNA, 21 nt, Human
cacucaggguaugugccaggc

SEQ ID NO: 194383 - RNA, 22 nt, Human
caguguggugugcacagcuuag

SEQ ID NO: 194384 - RNA, 22 nt, Human
agaguccaugaagacagcugag

SEQ ID NO: 194385 - RNA, 22 nt, Human
uguuuauagauggccacaauga

SEQ ID NO: 194386 - RNA, 17 nt, Human
uaggugguugcuggucu

SEQ ID NO: 194387 - RNA, 22 nt, Human
auguguuuguccugcagaaaua

SEQ ID NO: 194388 - RNA, 19 nt, Human
gcagacagguccagagagg

SEQ ID NO: 194389 - RNA, 22 nt, Human
acacagccaggguaguaaggcu

SEQ ID NO: 194390 - RNA, 22 nt, Human
cuggccuggcaggggaccucua

SEQ ID NO: 194391 - RNA, 22 nt, Human
cugcggcucugcgggcagcugg

SEQ ID NO: 194392 - RNA, 22 nt, Human
cagcccugcuuccccgcuaguu

SEQ ID NO: 194393 - RNA, 22 nt, Human
uauuucacagcagcucauuuaa

SEQ ID NO: 194394 - RNA, 22 nt, Human
ugguaacacaggcauuaaaguu

SEQ ID NO: 194395 - RNA, 21 nt, Human
ccauucuuagucaagugucuc

SEQ ID NO: 194396 - RNA, 22 nt, Human
gauuucuaguaagucaugaagg

SEQ ID NO: 194397 - RNA, 22 nt, Human
uuagagcuucccaauuaaaacg

SEQ ID NO: 194398 - RNA, 22 nt, Human
ucaggucugggcacaugguaca

SEQ ID NO: 194399 - RNA, 22 nt, Human
uagagcaguguuguccaucaga

SEQ ID NO: 194400 - RNA, 19 nt, Human
uucucagagcuugcagcac

SEQ ID NO: 194401 - RNA, 22 nt, Human
gaguuacauuuggugacacuuc

SEQ ID NO: 194402 - RNA, 22 nt, Human
uguuaacacaauucuggagaga

SEQ ID NO: 194403 - RNA, 17 nt, Human
ucuguucaugcauaccu

SEQ ID NO: 194404 - RNA, 22 nt, Human
auggagugggccaauuuuagug

SEQ ID NO: 194405 - RNA, 22 nt, Human
aaggcuggggugcagacggccu

SEQ ID NO: 194406 - RNA, 22 nt, Human
cugccucuauucacugaggcag

SEQ ID NO: 194407 - RNA, 22 nt, Human
acagucuuugcaggagaaagga

SEQ ID NO: 194408 - RNA, 20 nt, Human
agaagucagcucagaaguga

SEQ ID NO: 194409 - RNA, 22 nt, Human
acagcuugcaugcagaggcacu

SEQ ID NO: 194410 - RNA, 22 nt, Human
aggccagggcacugcucuuuag

SEQ ID NO: 194411 - RNA, 22 nt, Human
gucuguggcaggggagaaguuu

SEQ ID NO: 194412 - RNA, 22 nt, Human
guuuaaauaauuaggggccugu

SEQ ID NO: 194413 - RNA, 22 nt, Human
uaaagaauaauacccauggagc

SEQ ID NO: 194414 - RNA, 22 nt, Human
acaagcuuugugauaguagaga

SEQ ID NO: 194415 - RNA, 22 nt, Human
aggguguguucuccuaugagaa

SEQ ID NO: 194416 - RNA, 22 nt, Human
acaguuaauaaguaguaaguca

SEQ ID NO: 194417 - RNA, 22 nt, Human
ucugucauaaacacacacaagc

SEQ ID NO: 194418 - RNA, 22 nt, Human
agacccagagggcugcugggag

SEQ ID NO: 194419 - RNA, 22 nt, Human
aaggcuggguaaccuguccacu

SEQ ID NO: 194420 - RNA, 22 nt, Human
uucucuuauucuggauaugcag

SEQ ID NO: 194421 - RNA, 22 nt, Human
agcuugaagccuuggcgagauu

SEQ ID NO: 194422 - RNA, 22 nt, Human
cagcauggcuugaguguuuccu

SEQ ID NO: 194423 - RNA, 22 nt, Human
cacagaauuaagggagaaauau

SEQ ID NO: 194424 - RNA, 23 nt, Human
uugguuuacaggaauaagcaggg

SEQ ID NO: 194425 - RNA, 20 nt, Human
ucuugagaacaauuucuggc

SEQ ID NO: 194426 - RNA, 21 nt, Human
uuccuggggaaggagcugccu

SEQ ID NO: 194427 - RNA, 22 nt, Human
aagaaacugaaaguggcuucau

SEQ ID NO: 194428 - RNA, 22 nt, Human
ccagcuggaagagugcagaacu

SEQ ID NO: 194429 - RNA, 22 nt, Human
ccagggugagaaaaggcuggau

SEQ ID NO: 194430 - RNA, 22 nt, Human
aggcugugcgaggucucagagu

SEQ ID NO: 194431 - RNA, 22 nt, Human
gggcagguggccucuuguacua

SEQ ID NO: 194432 - RNA, 20 nt, Human
ccaguccaccugagacaugu

SEQ ID NO: 194433 - RNA, 22 nt, Human
agagugggacacgggcgcuguc

SEQ ID NO: 194434 - RNA, 22 nt, Human
gagugugucggucagcguggcg

SEQ ID NO: 194435 - RNA, 22 nt, Human
ucugacagguguucuuccaggc

SEQ ID NO: 194436 - RNA, 22 nt, Human
gcucagagcccgaggcuugcau

SEQ ID NO: 194437 - RNA, 22 nt, Human
cuccuggcagcaacauuuauau

SEQ ID NO: 194438 - RNA, 22 nt, Human
auacagauugcuauacuuacaa

SEQ ID NO: 194439 - RNA, 22 nt, Human
acugugcacacaaaaauagauu

SEQ ID NO: 194440 - RNA, 22 nt, Human
ucuggaauagguccugaguauu

SEQ ID NO: 194441 - RNA, 22 nt, Human
uuguauuucuuccggucucauu

SEQ ID NO: 194442 - RNA, 22 nt, Human
aaagggaaguugcacauguucc

SEQ ID NO: 194443 - RNA, 22 nt, Human
cccaggcuucccaaucagaagg

SEQ ID NO: 194444 - RNA, 19 nt, Human
cuccaggauggcugggcga

SEQ ID NO: 194445 - RNA, 22 nt, Human
cagcaggugggcuuugcggaug

SEQ ID NO: 194446 - RNA, 22 nt, Human
cugaaggacuuggugauaguug

SEQ ID NO: 194447 - RNA, 21 nt, Human
ccucaaagaugaugggguuuc

SEQ ID NO: 194448 - RNA, 22 nt, Human
aauuagagaucgcaauaacggg

SEQ ID NO: 194449 - RNA, 22 nt, Human
agucuucacucuucacuacuau

SEQ ID NO: 194450 - RNA, 22 nt, Human
gcagggcucugcuguaguccua

SEQ ID NO: 194451 - RNA, 22 nt, Human
uguuccugguuccugcaugaug

SEQ ID NO: 194452 - RNA, 22 nt, Human
ggugggagagcucugucuccag

SEQ ID NO: 194453 - RNA, 21 nt, Human
aggguggcucugggucagaac

SEQ ID NO: 194454 - RNA, 22 nt, Human
aggccagugcagcuggaacaga

SEQ ID NO: 194455 - RNA, 22 nt, Human
ugcauacacuucaaaugagcau

SEQ ID NO: 194456 - RNA, 22 nt, Human
gggggucccaagcugggcugcu

SEQ ID NO: 194457 - RNA, 22 nt, Human
gccucagccggcggacgccagg

SEQ ID NO: 194458 - RNA, 22 nt, Human
ccugcagguuucccccggacgg

SEQ ID NO: 194459 - RNA, 22 nt, Human
uggggagagguaucauugagau

SEQ ID NO: 194460 - RNA, 22 nt, Human
ucuucacauggaacaugaagcu

SEQ ID NO: 194461 - RNA, 22 nt, Human
uuugaaucugauauggcagcau

SEQ ID NO: 194462 - RNA, 22 nt, Human
acauuaaaauggagaauuuuga

SEQ ID NO: 194463 - RNA, 18 nt, Human
agucaguugauggggacc

SEQ ID NO: 194464 - RNA, 22 nt, Human
agggggugaucaaggugcggcg

SEQ ID NO: 194465 - RNA, 22 nt, Human
auuuccugcaggggcugguggg

SEQ ID NO: 194466 - RNA, 16 nt, Human
gagggcagaggcggaa

SEQ ID NO: 194467 - RNA, 20 nt, Human
gccugccucagcuagcugag

SEQ ID NO: 194468 - RNA, 22 nt, Human
gagcugaaguuuccauuuguac

SEQ ID NO: 194469 - RNA, 22 nt, Human
cugcugugagugguucuugccu

SEQ ID NO: 194470 - RNA, 22 nt, Human
aaugaaauguagcuuauccaua

SEQ ID NO: 194471 - RNA, 22 nt, Human
uccugagacaucucugcugguc

SEQ ID NO: 194472 - RNA, 22 nt, Human
ucagaggaccuuacugagaacc

SEQ ID NO: 194473 - RNA, 19 nt, Human
uccaguguagcuggucauu

SEQ ID NO: 194474 - RNA, 22 nt, Human
augggacaauuugaacacagug

SEQ ID NO: 194475 - RNA, 22 nt, Human
gacagcuggcaguggaaaggug

SEQ ID NO: 194476 - RNA, 22 nt, Human
gaggcucagggaaacagcgcag

SEQ ID NO: 194477 - RNA, 22 nt, Human
aggguggcaccacauaucauag

SEQ ID NO: 194478 - RNA, 22 nt, Human
ggacuuggggaaggcacaguua

SEQ ID NO: 194479 - RNA, 22 nt, Human
gcucuguaguauuuaguaaaua

SEQ ID NO: 194480 - RNA, 19 nt, Human
cuggccacaccugcugguu

SEQ ID NO: 194481 - RNA, 22 nt, Human
cugcguguuugcacccugucug

SEQ ID NO: 194482 - RNA, 22 nt, Human
gggagccaugcuggucuucuuu

SEQ ID NO: 194483 - RNA, 22 nt, Human
ugcuuugcucucacuguaaggu

SEQ ID NO: 194484 - RNA, 22 nt, Human
gcuuccugaguacacccucauc

SEQ ID NO: 194485 - RNA, 22 nt, Human
uccuguuuaggcuguggucugg

SEQ ID NO: 194486 - RNA, 22 nt, Human
uaaucuacuguuuauaugaaau

SEQ ID NO: 194487 - RNA, 22 nt, Human
uucaaagcagagggucaauaca

SEQ ID NO: 194488 - RNA, 22 nt, Human
ugccugcauuuuguggcuggcu

SEQ ID NO: 194489 - RNA, 22 nt, Human
cagggacccuacuagcucacac

SEQ ID NO: 194490 - RNA, 22 nt, Human
auguuuacaaaaaggaggcuug

SEQ ID NO: 194491 - RNA, 22 nt, Human
gagcuguguaugcaucauucug

SEQ ID NO: 194492 - RNA, 22 nt, Human
ggguucccugccuggccacucu

SEQ ID NO: 194493 - RNA, 22 nt, Human
agcauuuaggagaauuugagaa

SEQ ID NO: 194494 - RNA, 22 nt, Human
acagccacucaaagggccgaag

SEQ ID NO: 194495 - RNA, 22 nt, Human
uaacaacuugcuuuuaucuuag

SEQ ID NO: 194496 - RNA, 22 nt, Human
auuuaucaccaguuagcugacu

SEQ ID NO: 194497 - RNA, 22 nt, Human
aauggccagcaacaggagugaa

SEQ ID NO: 194498 - RNA, 22 nt, Human
acagcagguuauuguuauggca

SEQ ID NO: 194499 - RNA, 22 nt, Human
auucaagguuggcucaggaauu

SEQ ID NO: 194500 - RNA, 18 nt, Human
aggcaggcggaucacaag

SEQ ID NO: 194501 - RNA, 22 nt, Human
agcuugaaccuaaaacaauaau

SEQ ID NO: 194502 - RNA, 22 nt, Human
aaucucuugggaggaaugaauu

SEQ ID NO: 194503 - RNA, 22 nt, Human
uuccugguccuauuauauacac

SEQ ID NO: 194504 - RNA, 22 nt, Human
accuacaucaagggagugguag

SEQ ID NO: 194505 - RNA, 22 nt, Human
uaaguguugaucugagugcuaa

SEQ ID NO: 194506 - RNA, 22 nt, Human
gaaucagauacugauuucaguc

SEQ ID NO: 194507 - RNA, 22 nt, Human
cuuuuucugauguuccaugauu

SEQ ID NO: 194508 - RNA, 22 nt, Human
uuucauguuggauacuguuuca

SEQ ID NO: 194509 - RNA, 22 nt, Human
gggcucaggccuggccucucac

SEQ ID NO: 194510 - RNA, 19 nt, Human
augcaacaaaaguguaaga

SEQ ID NO: 194511 - RNA, 22 nt, Human
ucugaaagcccuaguuuguaau

SEQ ID NO: 194512 - RNA, 20 nt, Human
ugccagggccagcagaggcu

SEQ ID NO: 194513 - RNA, 23 nt, Human
ucagaguagcaauuuuucucucc

SEQ ID NO: 194514 - RNA, 22 nt, Human
ccugggaggcggagguugcagu

SEQ ID NO: 194515 - RNA, 22 nt, Human
ccucuuuguucaggcugcuggc

SEQ ID NO: 194516 - RNA, 22 nt, Human
cuggcugcuggccugaggaugc

SEQ ID NO: 194517 - RNA, 22 nt, Human
gcuuuagauacucccaaugucc

SEQ ID NO: 194518 - RNA, 22 nt, Human
agaagcuugaaggagcagugac

SEQ ID NO: 194519 - RNA, 22 nt, Human
aaagacaucagaaccagcugag

SEQ ID NO: 194520 - RNA, 22 nt, Human
caaaaguaauugcaguuuuugc

SEQ ID NO: 194521 - RNA, 22 nt, Human
cugggaaauugacacugauaaa

SEQ ID NO: 194522 - RNA, 22 nt, Human
cacauuccuuacauucauagag

SEQ ID NO: 194523 - RNA, 22 nt, Human
uuaggagaugguccucuaggga

SEQ ID NO: 194524 - RNA, 22 nt, Human
agaggcaagggaccuuucuggg

SEQ ID NO: 194525 - RNA, 22 nt, Human
cuggcagucugguggaaggccu

SEQ ID NO: 194526 - RNA, 21 nt, Human
aaguaaugugucucuucuacc

SEQ ID NO: 194527 - RNA, 22 nt, Human
aguuagaagugugucaucugug

SEQ ID NO: 194528 - RNA, 22 nt, Human
ggcaucagagguguguucugcu

SEQ ID NO: 194529 - RNA, 22 nt, Human
acuugcaagguugcaguuagaa

SEQ ID NO: 194530 - RNA, 22 nt, Human
agaagucauuuauguuagauga

SEQ ID NO: 194531 - RNA, 22 nt, Human
agaggaauaaauuucuguagug

SEQ ID NO: 194532 - RNA, 22 nt, Human
cugcuguuuggugagugagaaa

SEQ ID NO: 194533 - RNA, 22 nt, Human
uguuauuuauuucaccuccaga

SEQ ID NO: 194534 - RNA, 20 nt, Human
caaggcagaccagagugagu

SEQ ID NO: 194535 - RNA, 22 nt, Human
uagagaauggccuugaaguagu

SEQ ID NO: 194536 - RNA, 22 nt, Human
acaaaguuauucuuucagagga

SEQ ID NO: 194537 - RNA, 17 nt, Human
gaaaguuucucucucuu

SEQ ID NO: 194538 - RNA, 20 nt, Human
gcuguugccaguacagaugg

SEQ ID NO: 194539 - RNA, 22 nt, Human
uggcucugggaaucuguugcuu

SEQ ID NO: 194540 - RNA, 22 nt, Human
uuuagucuaauaaaaguggagu

SEQ ID NO: 194541 - RNA, 22 nt, Human
auucuuuuaaauggcaguagua

SEQ ID NO: 194542 - RNA, 22 nt, Human
gcaugcaggagagaaagacggc

SEQ ID NO: 194543 - RNA, 22 nt, Human
aacugaggaauaacugaguugc

SEQ ID NO: 194544 - RNA, 22 nt, Human
auauggcagaccaauuagaagc

SEQ ID NO: 194545 - RNA, 22 nt, Human
agcauggcuuuggaggauagca

SEQ ID NO: 194546 - RNA, 22 nt, Human
agagcccagucuuugugugaag

SEQ ID NO: 194547 - RNA, 22 nt, Human
acccagcuaacccuacccugga

SEQ ID NO: 194548 - RNA, 22 nt, Human
auugaaaguccuaucuaaggga

SEQ ID NO: 194549 - RNA, 22 nt, Human
gagggaggugauacugaacgua

SEQ ID NO: 194550 - RNA, 22 nt, Human
uaaucuagucccacauggaauu

SEQ ID NO: 194551 - RNA, 22 nt, Human
gcccaaggucccauggcagcac

SEQ ID NO: 194552 - RNA, 22 nt, Human
aauuuuguuuaagugaucugcu

SEQ ID NO: 194553 - RNA, 22 nt, Human
acugcaggaugugcuccuauug

SEQ ID NO: 194554 - RNA, 22 nt, Human
uggaacugcuccaaaaccucca

SEQ ID NO: 194555 - RNA, 21 nt, Human
cuuugcauacagaugccaauu

SEQ ID NO: 194556 - RNA, 22 nt, Human
ucuuuuucugcacacguguccc

SEQ ID NO: 194557 - RNA, 22 nt, Human
cagcagaggaaagcaaaucuaa

SEQ ID NO: 194558 - RNA, 23 nt, Human
uuucuguuccucuagcuuugcau

SEQ ID NO: 194559 - RNA, 22 nt, Human
agcuucugaaagucuguuuucc

SEQ ID NO: 194560 - RNA, 22 nt, Human
gaggacacggccuuuuggaaaa

SEQ ID NO: 194561 - RNA, 22 nt, Human
auuacagaagauaugcucaaca

SEQ ID NO: 194562 - RNA, 22 nt, Human
augaugaaacuaggaacuagag

SEQ ID NO: 194563 - RNA, 22 nt, Human
agcacaggaccaaggaagcugu

SEQ ID NO: 194564 - RNA, 22 nt, Human
cuuaauuacccaaugugguagg

SEQ ID NO: 194565 - RNA, 22 nt, Human
uggccugccccgagauccuggc

SEQ ID NO: 194566 - RNA, 22 nt, Human
gcucuggcucaaaccaccggcu

SEQ ID NO: 194567 - RNA, 22 nt, Human
uccuggguucauguccuggugc

SEQ ID NO: 194568 - RNA, 22 nt, Human
gagcugcuggcuccucagguua

SEQ ID NO: 194569 - RNA, 23 nt, Human
aagugguuuugaacccggacccu

SEQ ID NO: 194570 - RNA, 22 nt, Human
uugcaaaaccauccuaaguaaa

SEQ ID NO: 194571 - RNA, 22 nt, Human
cagagcugagucuucaagguug

SEQ ID NO: 194572 - RNA, 22 nt, Human
ucaggaggccaccaggaccugu

SEQ ID NO: 194573 - RNA, 22 nt, Human
uucucaacucucaagagaagcu

SEQ ID NO: 194574 - RNA, 22 nt, Human
ggcuccuggaaagcccucgcuc

SEQ ID NO: 194575 - RNA, 20 nt, Human
uauugaguaccuacuguaua

SEQ ID NO: 194576 - RNA, 22 nt, Human
cugggagggguagccaauccua

SEQ ID NO: 194577 - RNA, 22 nt, Human
gaggcacaucacuuggugcauu

SEQ ID NO: 194578 - RNA, 22 nt, Human
ugcaagagacagacaugacuca

SEQ ID NO: 194579 - RNA, 22 nt, Human
cugggccucaaucucagaguuu

SEQ ID NO: 194580 - RNA, 22 nt, Human
gccagccagggaagggagagac

SEQ ID NO: 194581 - RNA, 22 nt, Human
uuggaauucagcuugcuuauaa

SEQ ID NO: 194582 - RNA, 22 nt, Human
guagcuuauuagggauaauagu

SEQ ID NO: 194583 - RNA, 22 nt, Human
gggcugagucaucuggggccuc

SEQ ID NO: 194584 - RNA, 22 nt, Human
agacaacaucacuaaagcugag

SEQ ID NO: 194585 - RNA, 20 nt, Human
aaguuuucuccaaauacagu

SEQ ID NO: 194586 - RNA, 22 nt, Human
ugccaaaauggccaaaagcuag

SEQ ID NO: 194587 - RNA, 22 nt, Human
ucccagggacuggaugaugcag

SEQ ID NO: 194588 - RNA, 22 nt, Human
agucuugaaagcacauuagagu

SEQ ID NO: 194589 - RNA, 22 nt, Human
gggacagaggcaaacuagcaga

SEQ ID NO: 194590 - RNA, 22 nt, Human
ggccagcuuauuagcucagagg

SEQ ID NO: 194591 - RNA, 22 nt, Human
ccagagaguaucauggagagua

SEQ ID NO: 194592 - RNA, 22 nt, Human
ugagauggggagggcugcagaa

SEQ ID NO: 194593 - RNA, 22 nt, Human
uccaggaguggggcagaggucu

SEQ ID NO: 194594 - RNA, 23 nt, Human
gccagcuuuggucugucuccuag

SEQ ID NO: 194595 - RNA, 22 nt, Human
ggcuuccuuucacuacccucag

SEQ ID NO: 194596 - RNA, 19 nt, Human
ugggaugaugcagaaggua

SEQ ID NO: 194597 - RNA, 22 nt, Human
caaaugcaugagaaauaagagg

SEQ ID NO: 194598 - RNA, 22 nt, Human
gaauauauuucucuuaccuuua

SEQ ID NO: 194599 - RNA, 22 nt, Human
ggcucucuggaggagcucaccc

SEQ ID NO: 194600 - RNA, 22 nt, Human
gaacauaacuauugugaauagu

SEQ ID NO: 194601 - RNA, 23 nt, Human
cagggcugggcuugguguuaggc

SEQ ID NO: 194602 - RNA, 22 nt, Human
ucagaauaaguuaugaaaugaa

SEQ ID NO: 194603 - RNA, 22 nt, Human
aauuaggaaaugagaguauuug

SEQ ID NO: 194604 - RNA, 22 nt, Human
acaagucuguuaugcaccugga

SEQ ID NO: 194605 - RNA, 22 nt, Human
uagcugcccaucuuuccuuuag

SEQ ID NO: 194606 - RNA, 22 nt, Human
gggcagcucuggcugugggaag

SEQ ID NO: 194607 - RNA, 22 nt, Human
uauauguagauuguaccaaugu

SEQ ID NO: 194608 - RNA, 22 nt, Human
agucaguuuucuuaaagggaag

SEQ ID NO: 194609 - RNA, 22 nt, Human
ccagcaucuaugugcuguugau

SEQ ID NO: 194610 - RNA, 22 nt, Human
cagcuccagcucugggcgccuc

SEQ ID NO: 194611 - RNA, 22 nt, Human
uauucaugacauugcauaugca

SEQ ID NO: 194612 - RNA, 22 nt, Human
gagaggagguggcuaugacagc

SEQ ID NO: 194613 - RNA, 20 nt, Human
uucuaauuugauggaguagc

SEQ ID NO: 194614 - RNA, 22 nt, Human
uugguuuauuucuuccuaugag

SEQ ID NO: 194615 - RNA, 22 nt, Human
cuuuuucauuggcuuuaggaca

SEQ ID NO: 194616 - RNA, 22 nt, Human
cucagagcaaugaacaugcaaa

SEQ ID NO: 194617 - RNA, 22 nt, Human
cacuucaacaguuauuucuuag

SEQ ID NO: 194618 - RNA, 22 nt, Human
aguguuuuucaggagcagaaca

SEQ ID NO: 194619 - RNA, 21 nt, Human
cccgcaucuuccucuccagca

SEQ ID NO: 194620 - RNA, 22 nt, Human
uuucuaggucuuccauacugcc

SEQ ID NO: 194621 - RNA, 22 nt, Human
ucagcucugcacuccacugugg

SEQ ID NO: 194622 - RNA, 22 nt, Human
aucagguagauuuaauauucug

SEQ ID NO: 194623 - RNA, 22 nt, Human
ugggacaggaggccucuggaga

SEQ ID NO: 194624 - RNA, 22 nt, Human
uguccagcugacauucccuucc

SEQ ID NO: 194625 - RNA, 23 nt, Human
gugacccaaggaccuuccagaau

SEQ ID NO: 194626 - RNA, 21 nt, Human
aucagaaguuuuggucaguag

SEQ ID NO: 194627 - RNA, 22 nt, Human
uaauaauuuuaaagaaggcuag

SEQ ID NO: 194628 - RNA, 22 nt, Human
uggcuggggagccccgacuccc

SEQ ID NO: 194629 - RNA, 22 nt, Human
ggcauuugagccauuggccugu

SEQ ID NO: 194630 - RNA, 20 nt, Human
aggguucccuuguucagcag

SEQ ID NO: 194631 - RNA, 22 nt, Human
cuggagcucuccagagccccgu

SEQ ID NO: 194632 - RNA, 22 nt, Human
ucaggccuuguccugaccuccu

SEQ ID NO: 194633 - RNA, 22 nt, Human
gccucagggauaggaugagcau

SEQ ID NO: 194634 - RNA, 22 nt, Human
uuguauuuuguuaugcuacugc

SEQ ID NO: 194635 - RNA, 22 nt, Human
caggggcuuaagugacagaagg

SEQ ID NO: 194636 - RNA, 22 nt, Human
ucucagugguguuuugagucca

SEQ ID NO: 194637 - RNA, 22 nt, Human
cugaggucagaguuuagucugg

SEQ ID NO: 194638 - RNA, 22 nt, Human
aaucagaaauucuacaucacaa

SEQ ID NO: 194639 - RNA, 22 nt, Human
aaggcaguuaccgcaauggagg

SEQ ID NO: 194640 - RNA, 22 nt, Human
agcaagauuuaaacccagguca

SEQ ID NO: 194641 - RNA, 22 nt, Human
aagaucagaacuuuauacagga

SEQ ID NO: 194642 - RNA, 22 nt, Human
gcuugggagaggguccccagga

SEQ ID NO: 194643 - RNA, 17 nt, Human
aggcaggagauuggaga

SEQ ID NO: 194644 - RNA, 22 nt, Human
uuauuauuuuguguacagcaaa

SEQ ID NO: 194645 - RNA, 16 nt, Human
gcagagcucagggacu

SEQ ID NO: 194646 - RNA, 22 nt, Human
uccaggcaaggauaauaaacau

SEQ ID NO: 194647 - RNA, 22 nt, Human
cccaggcagccugcagggaagg

SEQ ID NO: 194648 - RNA, 22 nt, Human
agagcagcugacagccugccau

SEQ ID NO: 194649 - RNA, 22 nt, Human
acuggcaauagcaaaugcuugg

SEQ ID NO: 194650 - RNA, 22 nt, Human
uaaguucauaagcuuauucuua

SEQ ID NO: 194651 - RNA, 22 nt, Human
ucuuuggucagaaagauuacac

SEQ ID NO: 194652 - RNA, 22 nt, Human
gagacagcuuaauuggugguca

SEQ ID NO: 194653 - RNA, 22 nt, Human
ucaggcuggagugcaguggcgc

SEQ ID NO: 194654 - RNA, 22 nt, Human
ugccuugcacauaauauacauu

SEQ ID NO: 194655 - RNA, 22 nt, Human
auuuuccuccaugugagcaguu

SEQ ID NO: 194656 - RNA, 22 nt, Human
agcccaggugacucauacaccc

SEQ ID NO: 194657 - RNA, 22 nt, Human
uuuggagauagggccuagcaau

SEQ ID NO: 194658 - RNA, 22 nt, Human
augucaaacacaacaccagugg

SEQ ID NO: 194659 - RNA, 22 nt, Human
uugcaaagaauuuuacauucua

SEQ ID NO: 194660 - RNA, 22 nt, Human
aaaagcucuuucugcuguagau

SEQ ID NO: 194661 - RNA, 22 nt, Human
acaacaaaaugaggaagugguc

SEQ ID NO: 194662 - RNA, 22 nt, Human
ugcccagcuucuuacuuuuaaa

SEQ ID NO: 194663 - RNA, 22 nt, Human
aaagcaugauuagauagaugau

SEQ ID NO: 194664 - RNA, 22 nt, Human
ucuuagauggcagcuagagcuc

SEQ ID NO: 194665 - RNA, 22 nt, Human
cugguuuacucugcacugcuca

SEQ ID NO: 194666 - RNA, 22 nt, Human
cugggccuccacgggccaucac

SEQ ID NO: 194667 - RNA, 22 nt, Human
gcagacagaagcuaaguagaca

SEQ ID NO: 194668 - RNA, 22 nt, Human
ucuggguccgggggugaauuga

SEQ ID NO: 194669 - RNA, 22 nt, Human
ugugugaguaaggcugagagag

SEQ ID NO: 194670 - RNA, 22 nt, Human
uacagggaaugggacauaaauc

SEQ ID NO: 194671 - RNA, 22 nt, Human
ugaaacaauuagaauguaauga

SEQ ID NO: 194672 - RNA, 22 nt, Human
cuucuggguugcaggucuuggc

SEQ ID NO: 194673 - RNA, 22 nt, Human
acaguaaaaagccuuagaauuu

SEQ ID NO: 194674 - RNA, 22 nt, Human
ugcagauacaguauguggaagc

SEQ ID NO: 194675 - RNA, 22 nt, Human
ugguccaguagcagggauacca

SEQ ID NO: 194676 - RNA, 22 nt, Human
gccugaagaacagcugugagga

SEQ ID NO: 194677 - RNA, 22 nt, Human
uccugggaggaacauuuaccua

SEQ ID NO: 194678 - RNA, 22 nt, Human
guggcugcaucggggugaccag

SEQ ID NO: 194679 - RNA, 22 nt, Human
ucaggagcagggucuguuacca

SEQ ID NO: 194680 - RNA, 22 nt, Human
gagcuggaggcagugcugaggu

SEQ ID NO: 194681 - RNA, 22 nt, Human
accauuuuggguauuuucagag

SEQ ID NO: 194682 - RNA, 22 nt, Human
aagucucuuuggguacuuuauu

SEQ ID NO: 194683 - RNA, 22 nt, Human
uucauucagugcauuugggaga

SEQ ID NO: 194684 - RNA, 22 nt, Human
aaaagugaugggauggcacuuc

SEQ ID NO: 194685 - RNA, 22 nt, Human
ugacagaaauaguucuuaauuu

SEQ ID NO: 194686 - RNA, 22 nt, Human
ucuccaggcuuaaucucagcuu

SEQ ID NO: 194687 - RNA, 22 nt, Human
acucucacugcuuggcuccugc

SEQ ID NO: 194688 - RNA, 22 nt, Human
auuccaguuggguucuaauaca

SEQ ID NO: 194689 - RNA, 22 nt, Human
guuguuuauaaaaauaucuagc

SEQ ID NO: 194690 - RNA, 22 nt, Human
ccauuacuuuccaauauaucag

SEQ ID NO: 194691 - RNA, 22 nt, Human
aacaugaaacccaaacagaaua

SEQ ID NO: 194692 - RNA, 22 nt, Human
gcauucuucgaaguaaguagug

SEQ ID NO: 194693 - RNA, 20 nt, Human
agguggcuccugcugggggu

SEQ ID NO: 194694 - RNA, 22 nt, Human
aucuuguucucccuuguucuua

SEQ ID NO: 194695 - RNA, 22 nt, Human
augucacuguuguuauuguuau

SEQ ID NO: 194696 - RNA, 22 nt, Human
uuccaggcuccugcaguuucua

SEQ ID NO: 194697 - RNA, 22 nt, Human
auguaguuagaagauucaaaca

SEQ ID NO: 194698 - RNA, 20 nt, Human
acaggagaucugaggaaagg

SEQ ID NO: 194699 - RNA, 22 nt, Human
augccacauaaccaguucacuu

SEQ ID NO: 194700 - RNA, 22 nt, Human
cagagacagggcagggagugug

SEQ ID NO: 194701 - RNA, 22 nt, Human
acaccagccucgcccguguguu

SEQ ID NO: 194702 - RNA, 22 nt, Human
ggaacugagaagcagcuaugcc

SEQ ID NO: 194703 - RNA, 21 nt, Human
aucuggaaauucugccagaga

SEQ ID NO: 194704 - RNA, 22 nt, Human
ugggagcagcauugccaugugc

SEQ ID NO: 194705 - RNA, 22 nt, Human
ggcugaaaggugggaggauggc

SEQ ID NO: 194706 - RNA, 22 nt, Human
cuugccugcuggagcagggcuc

SEQ ID NO: 194707 - RNA, 22 nt, Human
ccuguuuauugugaagaaccca

SEQ ID NO: 194708 - RNA, 22 nt, Human
cugcccagaagcuuagagcuua

SEQ ID NO: 194709 - RNA, 22 nt, Human
accuuuauagcugauuaugaca

SEQ ID NO: 194710 - RNA, 22 nt, Human
uuucacaacguuguggugagag

SEQ ID NO: 194711 - RNA, 22 nt, Human
uuuagacagcggcucugaacca

SEQ ID NO: 194712 - RNA, 22 nt, Human
ucuaaauguaucacaucuggau

SEQ ID NO: 194713 - RNA, 22 nt, Human
guuagaaaugcagaaacuugac

SEQ ID NO: 194714 - RNA, 22 nt, Human
aagguugcuguuuugcuucaaa

SEQ ID NO: 194715 - RNA, 22 nt, Human
cugggacauuauaagaaacauu

SEQ ID NO: 194716 - RNA, 22 nt, Human
uaugcacaguuacaagaauauc

SEQ ID NO: 194717 - RNA, 22 nt, Human
uccagcagcccgaaggcccauc

SEQ ID NO: 194718 - RNA, 22 nt, Human
agcugcaguaugaggcuggugg

SEQ ID NO: 194719 - RNA, 22 nt, Human
uaaauacugaguuggaguuggc

SEQ ID NO: 194720 - RNA, 19 nt, Human
cagagcagugguuccugaa

SEQ ID NO: 194721 - RNA, 22 nt, Human
cugucuaguuaggaugccagca

SEQ ID NO: 194722 - RNA, 22 nt, Human
uggcagaaguucacuaguagcu

SEQ ID NO: 194723 - RNA, 22 nt, Human
uccagcuugacaaaugauuuua

SEQ ID NO: 194724 - RNA, 23 nt, Human
aaauucaguccuucaacucugag

SEQ ID NO: 194725 - RNA, 22 nt, Human
uccugaggaaaguucaugaaug

SEQ ID NO: 194726 - RNA, 17 nt, Human
ugggguccccgauggug

SEQ ID NO: 194727 - RNA, 22 nt, Human
ggggcugguggugguuucucca

SEQ ID NO: 194728 - RNA, 22 nt, Human
aggacuuuucaucagcuauccu

SEQ ID NO: 194729 - RNA, 21 nt, Human
ggccucagccaccuggcucug

SEQ ID NO: 194730 - RNA, 22 nt, Human
augagguuuugauuggcacagg

SEQ ID NO: 194731 - RNA, 22 nt, Human
agacacaucuuagguugucagg

SEQ ID NO: 194732 - RNA, 22 nt, Human
uuaauacaagcauaugcacaca

SEQ ID NO: 194733 - RNA, 22 nt, Human
gcugccugcucggcuccuggga

SEQ ID NO: 194734 - RNA, 22 nt, Human
uuacauucuuggaaucuuguuu

SEQ ID NO: 194735 - RNA, 22 nt, Human
aaaaacacaacugucuuucucu

SEQ ID NO: 194736 - RNA, 22 nt, Human
uaaaacuuaacuauccagauua

SEQ ID NO: 194737 - RNA, 22 nt, Human
uccagcccuguggcuuccaccc

SEQ ID NO: 194738 - RNA, 22 nt, Human
uguaaacaguaggacuaaagag

SEQ ID NO: 194739 - RNA, 22 nt, Human
cauggcaggaggcugcuggcag

SEQ ID NO: 194740 - RNA, 22 nt, Human
caggaaauaaaaaguaucuucu

SEQ ID NO: 194741 - RNA, 22 nt, Human
aagugauuguuccguugagugu

SEQ ID NO: 194742 - RNA, 22 nt, Human
aguuaacaaguuggcaaucaac

SEQ ID NO: 194743 - RNA, 22 nt, Human
cccuguuuaagaaaccuguaaa

SEQ ID NO: 194744 - RNA, 20 nt, Human
ucugcucagcccucaguggc

SEQ ID NO: 194745 - RNA, 22 nt, Human
uaagcaaauagcuagaucagag

SEQ ID NO: 194746 - RNA, 22 nt, Human
auauuaaauggauuuugggagc

SEQ ID NO: 194747 - RNA, 22 nt, Human
uuccaggaccaggaagagggga

SEQ ID NO: 194748 - RNA, 22 nt, Human
uucuuguauguaugcaaaauca

SEQ ID NO: 194749 - RNA, 22 nt, Human
ucuguaaacacccguaagcuuu

SEQ ID NO: 194750 - RNA, 22 nt, Human
ccucaggccucugccucauugg

SEQ ID NO: 194751 - RNA, 22 nt, Human
acuuucaagaacuucuuuaaug

SEQ ID NO: 194752 - RNA, 22 nt, Human
uauauucaacaggcuaauguca

SEQ ID NO: 194753 - RNA, 22 nt, Human
aacacagacauagugauuacag

SEQ ID NO: 194754 - RNA, 22 nt, Human
uccaucaccauuucugcgagcu

SEQ ID NO: 194755 - RNA, 22 nt, Human
cacccagcauuggcuaagagag

SEQ ID NO: 194756 - RNA, 18 nt, Human
uccaccagucaaucuguc

SEQ ID NO: 194757 - RNA, 22 nt, Human
ucuguguuuuacuccaauuaua

SEQ ID NO: 194758 - RNA, 22 nt, Human
gcaaaaguacagccggauuucu

SEQ ID NO: 194759 - RNA, 22 nt, Human
aggaauuaacaauauauuuagg

SEQ ID NO: 194760 - RNA, 22 nt, Human
cugcacccugcagguaccccug

SEQ ID NO: 194761 - RNA, 21 nt, Human
cagcccagcccauugacagug

SEQ ID NO: 194762 - RNA, 19 nt, Human
ugggcagcucccucugucc

SEQ ID NO: 194763 - RNA, 18 nt, Human
aggcuucccaggcaggcc

SEQ ID NO: 194764 - RNA, 22 nt, Human
uggcugaggcuuuucuuaaaga

SEQ ID NO: 194765 - RNA, 22 nt, Human
cuugggcccuccccuugugaau

SEQ ID NO: 194766 - RNA, 22 nt, Human
agacaaauuuccugcaaugaag

SEQ ID NO: 194767 - RNA, 22 nt, Human
uuauacauguguuuugagauga

SEQ ID NO: 194768 - RNA, 22 nt, Human
acuuuugguucuguaacuguga

SEQ ID NO: 194769 - RNA, 20 nt, Human
gagcccucugcacuagcgcc

SEQ ID NO: 194770 - RNA, 22 nt, Human
aagaacaugaacacaauguuua

SEQ ID NO: 194771 - RNA, 21 nt, Human
ugaaacauuugaucaaagcac

SEQ ID NO: 194772 - RNA, 22 nt, Human
acuuuggaaauugucuauaaga

SEQ ID NO: 194773 - RNA, 22 nt, Human
aacugauuguuggaugauagug

SEQ ID NO: 194774 - RNA, 22 nt, Human
gauguagacacuuggaggcuua

SEQ ID NO: 194775 - RNA, 22 nt, Human
aguuuggaaaaugagacaagga

SEQ ID NO: 194776 - RNA, 22 nt, Human
uccagagcugggucugugcuca

SEQ ID NO: 194777 - RNA, 22 nt, Human
gcuguguguucaauaaugugau

SEQ ID NO: 194778 - RNA, 22 nt, Human
ugcucccuugccagaggggaag

SEQ ID NO: 194779 - RNA, 22 nt, Human
ucugggaguuagaauacauggg

SEQ ID NO: 194780 - RNA, 22 nt, Human
cauaauuaaauucugggcaaga

SEQ ID NO: 194781 - RNA, 22 nt, Human
ugugggaaugacgaggaagagg

SEQ ID NO: 194782 - RNA, 22 nt, Human
augguggauuugugauucagcu

SEQ ID NO: 194783 - RNA, 22 nt, Human
uaguuuagcacuaagaaaaaca

SEQ ID NO: 194784 - RNA, 22 nt, Human
acacuggaggguccagggaugu

SEQ ID NO: 194785 - RNA, 22 nt, Human
aagguauuuucuaauguauacu

SEQ ID NO: 194786 - RNA, 22 nt, Human
gcaggcuugcccggccuccuuc

SEQ ID NO: 194787 - RNA, 22 nt, Human
gcuggcucuacauuugagguca

SEQ ID NO: 194788 - RNA, 19 nt, Human
gcugcagaggugaagaaga

SEQ ID NO: 194789 - RNA, 22 nt, Human
uguggaaaagaauaagggagau

SEQ ID NO: 194790 - RNA, 22 nt, Human
acacuguagacuguugaaguac

SEQ ID NO: 194791 - RNA, 19 nt, Human
ccucugugggagucaguga

SEQ ID NO: 194792 - RNA, 22 nt, Human
gagucagacagggucacccaga

SEQ ID NO: 194793 - RNA, 22 nt, Human
ugcuagugugugagauguucaa

SEQ ID NO: 194794 - RNA, 22 nt, Human
uuuauuguguugaaacugaauu

SEQ ID NO: 194795 - RNA, 22 nt, Human
ucauuauaaacauaugcuaaag

SEQ ID NO: 194796 - RNA, 22 nt, Human
ucccagccuccugacaguuuug

SEQ ID NO: 194797 - RNA, 20 nt, Human
agcaaacaggcuccaccaga

SEQ ID NO: 194798 - RNA, 22 nt, Human
ucuccagggcccccgagcguug

SEQ ID NO: 194799 - RNA, 20 nt, Human
ggucucugacagcugguugc

SEQ ID NO: 194800 - RNA, 22 nt, Human
agguggcaugccugagacauaa

SEQ ID NO: 194801 - RNA, 22 nt, Human
acccaggcuagggugcaguggc

SEQ ID NO: 194802 - RNA, 22 nt, Human
uacugcaugguggaguggagcu

SEQ ID NO: 194803 - RNA, 18 nt, Human
gguggcuggggacggaca

SEQ ID NO: 194804 - RNA, 22 nt, Human
ggcagcucaccucugguccagg

SEQ ID NO: 194805 - RNA, 22 nt, Human
cggcagugggcgccaggucucc

SEQ ID NO: 194806 - RNA, 22 nt, Human
caaggcaggucugaggagguug

SEQ ID NO: 194807 - RNA, 22 nt, Human
uuaguuuucccaucuuuauggu

SEQ ID NO: 194808 - RNA, 21 nt, Human
agcucagcaagauggaggcuc

SEQ ID NO: 194809 - RNA, 22 nt, Human
ggaacauuuccuggcagagagg

SEQ ID NO: 194810 - RNA, 22 nt, Human
ugcagccugguggucacuggag

SEQ ID NO: 194811 - RNA, 22 nt, Human
cagggggcucaaaggagagugc

SEQ ID NO: 194812 - RNA, 22 nt, Human
ugaacaugcuguugauggccug

SEQ ID NO: 194813 - RNA, 22 nt, Human
uaugaagacaaugauagcauga

SEQ ID NO: 194814 - RNA, 19 nt, Human
caaggccaccauuucuccg

SEQ ID NO: 194815 - RNA, 18 nt, Human
ggcugugcguggaggcug

SEQ ID NO: 194816 - RNA, 22 nt, Human
cucuaggcugcccaggagcuga

SEQ ID NO: 194817 - RNA, 22 nt, Human
uuguaaaguucuuaggaagcuc

SEQ ID NO: 194818 - RNA, 22 nt, Human
uggagggcucuuucaccuggua

SEQ ID NO: 194819 - RNA, 22 nt, Human
acaaaguuaacaguuggauagu

SEQ ID NO: 194820 - RNA, 22 nt, Human
ccagugccuuuuguggguuugu

SEQ ID NO: 194821 - RNA, 22 nt, Human
ugagauuucaggccaaggagug

SEQ ID NO: 194822 - RNA, 22 nt, Human
gguaaaaugcagauucuuagcc

SEQ ID NO: 194823 - RNA, 22 nt, Human
agugaguugaacauugauaaug

SEQ ID NO: 194824 - RNA, 22 nt, Human
acagguuuuggacuccagauuu

SEQ ID NO: 194825 - RNA, 22 nt, Human
uucauaguguuuccuuccagug

SEQ ID NO: 194826 - RNA, 22 nt, Human
ucacuggugugagaggagcaaa

SEQ ID NO: 194827 - RNA, 22 nt, Human
uguguccuuccaguuuuuccug

SEQ ID NO: 194828 - RNA, 18 nt, Human
gcagugccagccucuccu

SEQ ID NO: 194829 - RNA, 22 nt, Human
ccccaucuucccugagggauuu

SEQ ID NO: 194830 - RNA, 22 nt, Human
cacaagucuguggucuccaaca

SEQ ID NO: 194831 - RNA, 23 nt, Human
caaaccuguucuccccacaugca

SEQ ID NO: 194832 - RNA, 22 nt, Human
uuacaagcagcuacauaucaca

SEQ ID NO: 194833 - RNA, 22 nt, Human
ccacagagacucugcaggacug

SEQ ID NO: 194834 - RNA, 22 nt, Human
gggguccucggagccugggucu

SEQ ID NO: 194835 - RNA, 22 nt, Human
cccaggcagugcugaucccuca

SEQ ID NO: 194836 - RNA, 22 nt, Human
ucaacacaacagagaaaugcug

SEQ ID NO: 194837 - RNA, 22 nt, Human
ccuccuggaaaaauucccuggc

SEQ ID NO: 194838 - RNA, 22 nt, Human
ucccuuggaaaguagccucaca

SEQ ID NO: 194839 - RNA, 20 nt, Human
agagugagacuccaucucag

SEQ ID NO: 194840 - RNA, 22 nt, Human
ugguaccagcuguguguucacu

SEQ ID NO: 194841 - RNA, 22 nt, Human
agugugaguaauugagucuguc

SEQ ID NO: 194842 - RNA, 22 nt, Human
ggugagcaaagcuucaucugua

SEQ ID NO: 194843 - RNA, 22 nt, Human
agagaccuuuguuauucuagga

SEQ ID NO: 194844 - RNA, 22 nt, Human
uggaccugagccuggcccugcc

SEQ ID NO: 194845 - RNA, 23 nt, Human
ucuaaugcaauuagaaauuaggg

SEQ ID NO: 194846 - RNA, 22 nt, Human
uugcaaaucuuugccagaaggc

SEQ ID NO: 194847 - RNA, 20 nt, Human
uuugucuguuaaguguuucu

SEQ ID NO: 194848 - RNA, 19 nt, Human
agucucaguguacagaggc

SEQ ID NO: 194849 - RNA, 22 nt, Human
gacacagcuugaugagggcuuu

SEQ ID NO: 194850 - RNA, 22 nt, Human
ucaguguccaaaaagaggcaag

SEQ ID NO: 194851 - RNA, 22 nt, Human
ggaaggggugucgcccauggau

SEQ ID NO: 194852 - RNA, 23 nt, Human
gugagcagcccacuaggaaugcc

SEQ ID NO: 194853 - RNA, 17 nt, Human
uguuuucauucauugcu

SEQ ID NO: 194854 - RNA, 19 nt, Human
acucaggcuuccucugagg

SEQ ID NO: 194855 - RNA, 22 nt, Human
cugaggucuauuuugaaacugc

SEQ ID NO: 194856 - RNA, 22 nt, Human
cucuuuuaugugacguguguga

SEQ ID NO: 194857 - RNA, 22 nt, Human
uccaucuggguggggagaagga

SEQ ID NO: 194858 - RNA, 18 nt, Human
agacagcugaaaggaaaa

SEQ ID NO: 194859 - RNA, 22 nt, Human
cuuggaaucaaguuuuuggaga

SEQ ID NO: 194860 - RNA, 22 nt, Human
aggaauguuaaagauuaagagc

SEQ ID NO: 194861 - RNA, 22 nt, Human
ugggcucuggguggccugagca

SEQ ID NO: 194862 - RNA, 22 nt, Human
cuuucagucuuuacaagguugc

SEQ ID NO: 194863 - RNA, 22 nt, Human
gguccuggaugagacagguagu

SEQ ID NO: 194864 - RNA, 22 nt, Human
accccaagacaguagaagagaa

SEQ ID NO: 194865 - RNA, 22 nt, Human
gcugcccuguccggcucuccug

SEQ ID NO: 194866 - RNA, 22 nt, Human
uaauuuugucacagugacaugc

SEQ ID NO: 194867 - RNA, 22 nt, Human
uucuguuagaauuuugaaaaua

SEQ ID NO: 194868 - RNA, 22 nt, Human
acagaauagguacagucaguca

SEQ ID NO: 194869 - RNA, 22 nt, Human
auuuccauacacccauuucuga

SEQ ID NO: 194870 - RNA, 22 nt, Human
caugcacacugcaacaaggacu

SEQ ID NO: 194871 - RNA, 22 nt, Human
ggcuucugccacgagagggaag

SEQ ID NO: 194872 - RNA, 22 nt, Human
ccaggcugcuguugguguccgc

SEQ ID NO: 194873 - RNA, 22 nt, Human
ugcugaaggcaggggagguggc

SEQ ID NO: 194874 - RNA, 22 nt, Human
gaagaaggaagaucaugcuuga

SEQ ID NO: 194875 - RNA, 22 nt, Human
ucccucacugguucugcauccc

SEQ ID NO: 194876 - RNA, 22 nt, Human
caggaaugaggucguaaguguc

SEQ ID NO: 194877 - RNA, 22 nt, Human
caguggaauacgagcagauguc

SEQ ID NO: 194878 - RNA, 22 nt, Human
uuucugcauuguccucuugguu

SEQ ID NO: 194879 - RNA, 22 nt, Human
cucugccaguuucuggccucag

SEQ ID NO: 194880 - RNA, 22 nt, Human
ugggugggagcacccugucugg

SEQ ID NO: 194881 - RNA, 22 nt, Human
aagcaggcauuccagagacaau

SEQ ID NO: 194882 - RNA, 22 nt, Human
uuccuugguagagagaauauuu

SEQ ID NO: 194883 - RNA, 22 nt, Human
guauuaggagguggagccuuug

SEQ ID NO: 194884 - RNA, 22 nt, Human
agugcagagagcaauacucuac

SEQ ID NO: 194885 - RNA, 22 nt, Human
cccacacacauuuaugauagga

SEQ ID NO: 194886 - RNA, 22 nt, Human
cagcuccaaagccccacugucc

SEQ ID NO: 194887 - RNA, 22 nt, Human
gugcacagauucagagguuuug

SEQ ID NO: 194888 - RNA, 22 nt, Human
ggcacacagauggagcacuagc

SEQ ID NO: 194889 - RNA, 22 nt, Human
uuccuucuaauauucugccugu

SEQ ID NO: 194890 - RNA, 22 nt, Human
cugccagcucaaagcgcagcua

SEQ ID NO: 194891 - RNA, 22 nt, Human
uaaaaggagguugaagcuguca

SEQ ID NO: 194892 - RNA, 22 nt, Human
agcuaugugauuuaaacaaggu

SEQ ID NO: 194893 - RNA, 21 nt, Human
gcugcccaacccugcaucucc

SEQ ID NO: 194894 - RNA, 23 nt, Human
aaacaugcagcacaugaaugcua

SEQ ID NO: 194895 - RNA, 22 nt, Human
ugccaggcugcccuccagucug

SEQ ID NO: 194896 - RNA, 22 nt, Human
cuguggaguggggaguacuggu

SEQ ID NO: 194897 - RNA, 22 nt, Human
ggcuucaccugugcacucuacc

SEQ ID NO: 194898 - RNA, 22 nt, Human
agcagcucaagacuuaaauuug

SEQ ID NO: 194899 - RNA, 22 nt, Human
gugcaggagcuucuggccugac

SEQ ID NO: 194900 - RNA, 22 nt, Human
ggccagaggaccucucauagcc

SEQ ID NO: 194901 - RNA, 22 nt, Human
acuugggagggugugggcagcu

SEQ ID NO: 194902 - RNA, 22 nt, Human
uagaacuggcggcuagaccacu

SEQ ID NO: 194903 - RNA, 22 nt, Human
acagguggcacugcuguuacuc

SEQ ID NO: 194904 - RNA, 22 nt, Human
uucaaaaagguauguucaaguc

SEQ ID NO: 194905 - RNA, 22 nt, Human
gcuguucacagacucugcucug

SEQ ID NO: 194906 - RNA, 22 nt, Human
uuuuguguccuucacaucaugu

SEQ ID NO: 194907 - RNA, 22 nt, Human
ccugccagccagaucacucgcc

SEQ ID NO: 194908 - RNA, 22 nt, Human
gagcuccagggaacagcagcua

SEQ ID NO: 194909 - RNA, 19 nt, Human
uuugacuccucauuuuuau

SEQ ID NO: 194910 - RNA, 22 nt, Human
cugagcugggaguagagacucu

SEQ ID NO: 194911 - RNA, 22 nt, Human
cucucuggcacuucauugcugu

SEQ ID NO: 194912 - RNA, 21 nt, Human
cauuuacaugacagauugguu

SEQ ID NO: 194913 - RNA, 22 nt, Human
uuucuaaguaagauuaacuucu

SEQ ID NO: 194914 - RNA, 22 nt, Human
acaaggagaagaaauuggucau

SEQ ID NO: 194915 - RNA, 22 nt, Human
ugcuggcucaguuugcagacuc

SEQ ID NO: 194916 - RNA, 22 nt, Human
gucucucugcuaggccuccagu

SEQ ID NO: 194917 - RNA, 22 nt, Human
aaaguguuuuugagcuguaguu

SEQ ID NO: 194918 - RNA, 22 nt, Human
uauuucaccuaaaagugucaaa

SEQ ID NO: 194919 - RNA, 22 nt, Human
accaaggagacaaagguguauu

SEQ ID NO: 194920 - RNA, 22 nt, Human
ggagggaaccuuggcuggauug

SEQ ID NO: 194921 - RNA, 22 nt, Human
acucccuccaaaucugcacagu

SEQ ID NO: 194922 - RNA, 22 nt, Human
uccugcagagucccacugauuu

SEQ ID NO: 194923 - RNA, 22 nt, Human
cuucaagauauuucuagaauca

SEQ ID NO: 194924 - RNA, 22 nt, Human
aaguaaaagcuuuaccaugcgc

SEQ ID NO: 194925 - RNA, 22 nt, Human
auaauacaugguugaucuuuuc

SEQ ID NO: 194926 - RNA, 22 nt, Human
uacauagugaacauuuacagag

SEQ ID NO: 194927 - RNA, 22 nt, Human
ccugcccuguguuuggggacua

SEQ ID NO: 194928 - RNA, 19 nt, Human
gucuagaccaggcuccuua

SEQ ID NO: 194929 - RNA, 22 nt, Human
ccauuugugcuucuucaaagca

SEQ ID NO: 194930 - RNA, 22 nt, Human
gucaucuugcuguuuuagaucu

SEQ ID NO: 194931 - RNA, 22 nt, Human
ccugcagggaaucgaggcagaa

SEQ ID NO: 194932 - RNA, 22 nt, Human
cucuagacaacuugcugugggu

SEQ ID NO: 194933 - RNA, 22 nt, Human
uucaguguuaaauucaaagagu

SEQ ID NO: 194934 - RNA, 22 nt, Human
ugagcuggcaggggcucaggga

SEQ ID NO: 194935 - RNA, 22 nt, Human
guccaggcaccucccuugugcu

SEQ ID NO: 194936 - RNA, 22 nt, Human
agaguuuggagagggugaggca

SEQ ID NO: 194937 - RNA, 22 nt, Human
agcagacauaucucaugucaca

SEQ ID NO: 194938 - RNA, 22 nt, Human
aucuuugaugacuaaugcuuug

SEQ ID NO: 194939 - RNA, 21 nt, Human
agcugagcccagaagacuggu

SEQ ID NO: 194940 - RNA, 22 nt, Human
agaaaauauucauugagaggcu

SEQ ID NO: 194941 - RNA, 22 nt, Human
ggcagguguggugaccagagau

SEQ ID NO: 194942 - RNA, 22 nt, Human
agaucuuuaaaaguuauuauua

SEQ ID NO: 194943 - RNA, 22 nt, Human
uucugcuuauucuguagccuuu

SEQ ID NO: 194944 - RNA, 22 nt, Human
ugauugaauucaaaugcaaucu

SEQ ID NO: 194945 - RNA, 22 nt, Human
auuugaaguaaguaaugaguau

SEQ ID NO: 194946 - RNA, 20 nt, Human
aaaaucucccagaaacuuau

SEQ ID NO: 194947 - RNA, 22 nt, Human
agcagggcuggauuuggcaaga

SEQ ID NO: 194948 - RNA, 22 nt, Human
cuguggcccugugaucuggcac

SEQ ID NO: 194949 - RNA, 22 nt, Human
uuacucagucucccauacauug

SEQ ID NO: 194950 - RNA, 22 nt, Human
uccuggacuggcucagcacccu

SEQ ID NO: 194951 - RNA, 22 nt, Human
gaguccagagauuaagcaccuc

SEQ ID NO: 194952 - RNA, 22 nt, Human
gaucugguuucaucauggacuu

SEQ ID NO: 194953 - RNA, 20 nt, Human
ggaagccagggugcagggga

SEQ ID NO: 194954 - RNA, 22 nt, Human
auaguauuuccagaaauagucu

SEQ ID NO: 194955 - RNA, 22 nt, Human
gcugcucucauagauggcuuca

SEQ ID NO: 194956 - RNA, 22 nt, Human
uuauguguguacaugcauaugu

SEQ ID NO: 194957 - RNA, 22 nt, Human
agccagagacugugucuguaau

SEQ ID NO: 194958 - RNA, 22 nt, Human
gaaacccugagagguggucugg

SEQ ID NO: 194959 - RNA, 22 nt, Human
cagagcugcgcuuuuuccuggu

SEQ ID NO: 194960 - RNA, 22 nt, Human
ggaaggcugugcaguguuugca

SEQ ID NO: 194961 - RNA, 22 nt, Human
uaaaucaagaauaucagcuugu

SEQ ID NO: 194962 - RNA, 22 nt, Human
ucccucagauuggcaauuagau

SEQ ID NO: 194963 - RNA, 22 nt, Human
ucagcccuugauguuugggggu

SEQ ID NO: 194964 - RNA, 22 nt, Human
gguuccagaguauuucauuuca

SEQ ID NO: 194965 - RNA, 22 nt, Human
uguaauggaaaaacauuagcau

SEQ ID NO: 194966 - RNA, 22 nt, Human
uuucacauucuucugaaucuac

SEQ ID NO: 194967 - RNA, 22 nt, Human
uacaaaggcuuaaagagauuuc

SEQ ID NO: 194968 - RNA, 22 nt, Human
aauauauuugaaucaggaacaa

SEQ ID NO: 194969 - RNA, 20 nt, Human
uuacagugggaccuuccuga

SEQ ID NO: 194970 - RNA, 22 nt, Human
uaggaggcauuugcucccaggg

SEQ ID NO: 194971 - RNA, 22 nt, Human
gauguuuauaucuaacuuaagu

SEQ ID NO: 194972 - RNA, 23 nt, Human
gcuggcuggcaguaaagguuguu

SEQ ID NO: 194973 - RNA, 22 nt, Human
uuucuuuguaguagcauaauca

SEQ ID NO: 194974 - RNA, 22 nt, Human
ccucuggcaacuucacagccca

SEQ ID NO: 194975 - RNA, 21 nt, Human
uuaugucucuuuggugacugg

SEQ ID NO: 194976 - RNA, 22 nt, Human
cagagcugcacauucuaugaug

SEQ ID NO: 194977 - RNA, 22 nt, Human
uaaaagauaucuuagggauuug

SEQ ID NO: 194978 - RNA, 22 nt, Human
cagacaucuguacccagccugu

SEQ ID NO: 194979 - RNA, 22 nt, Human
cuccccacacacuaggccugau

SEQ ID NO: 194980 - RNA, 22 nt, Human
uaacauuauacagagaggacag

SEQ ID NO: 194981 - RNA, 22 nt, Human
gaauacaaagcagaacucauac

SEQ ID NO: 194982 - RNA, 20 nt, Human
acugccuuuagguauccuug

SEQ ID NO: 194983 - RNA, 21 nt, Human
gaguccuuccaauguccucag

SEQ ID NO: 194984 - RNA, 22 nt, Human
ggcugugcgggcagccguggga

SEQ ID NO: 194985 - RNA, 22 nt, Human
uccaggcucucaggugucagca

SEQ ID NO: 194986 - RNA, 22 nt, Human
guuaggaauuuguuacugugua

SEQ ID NO: 194987 - RNA, 22 nt, Human
uguggcugcaaaggaaggcugc

SEQ ID NO: 194988 - RNA, 22 nt, Human
uuccuugaaaguuugaacugac

SEQ ID NO: 194989 - RNA, 22 nt, Human
agcaguguuuaggcauucagua

SEQ ID NO: 194990 - RNA, 22 nt, Human
aucuguguguucaggaaguccu

SEQ ID NO: 194991 - RNA, 22 nt, Human
uuucuacuuuggaaugcacuga

SEQ ID NO: 194992 - RNA, 22 nt, Human
aggaccugccaggugcaaagca

SEQ ID NO: 194993 - RNA, 22 nt, Human
ccaggcagcaaauuuucugaau

SEQ ID NO: 194994 - RNA, 22 nt, Human
acauggcuaaauuagcuuuacu

SEQ ID NO: 194995 - RNA, 22 nt, Human
auucaagagcccauguuuccug

SEQ ID NO: 194996 - RNA, 22 nt, Human
aguuuuucugcuggucucacua

SEQ ID NO: 194997 - RNA, 22 nt, Human
gcucaggaaauaguuuaguguu

SEQ ID NO: 194998 - RNA, 22 nt, Human
uagcugcuucucacaugggcaa

SEQ ID NO: 194999 - RNA, 22 nt, Human
uuguguacuguugguugauauu

SEQ ID NO: 195000 - RNA, 22 nt, Human
uagcaacauaagaaacauuuug

SEQ ID NO: 195001 - RNA, 22 nt, Human
cugagaggugcugguggcugca

SEQ ID NO: 195002 - RNA, 18 nt, Human
ggcuucucacugaccuca

SEQ ID NO: 195003 - RNA, 22 nt, Human
ugccccagaccuacugaauggg

SEQ ID NO: 195004 - RNA, 22 nt, Human
gccuggcugaggccucugcuaa

SEQ ID NO: 195005 - RNA, 22 nt, Human
cuacagcagagcuacacuaacu

SEQ ID NO: 195006 - RNA, 22 nt, Human
ucucuaguugaggacugagcag

SEQ ID NO: 195007 - RNA, 23 nt, Human
agaguccacaagauuuuccagug

SEQ ID NO: 195008 - RNA, 22 nt, Human
augcaggguuauuucaaaaaua

SEQ ID NO: 195009 - RNA, 22 nt, Human
agaaaaguuuucugagacugac

SEQ ID NO: 195010 - RNA, 22 nt, Human
cuugcaggauuuugcugcugua

SEQ ID NO: 195011 - RNA, 22 nt, Human
cuggauccuucucuguguauuu

SEQ ID NO: 195012 - RNA, 22 nt, Human
auuaaauuggacgcugggggaa

SEQ ID NO: 195013 - RNA, 19 nt, Human
cucgugcacccaucaccug

SEQ ID NO: 195014 - RNA, 22 nt, Human
aguguccucaggcuuuguuccu

SEQ ID NO: 195015 - RNA, 17 nt, Human
ucaggauguagcaguag

SEQ ID NO: 195016 - RNA, 22 nt, Human
ucagugcuaaaagagcuggugu

SEQ ID NO: 195017 - RNA, 23 nt, Human
auucuucauuaucuucuagaaaa

SEQ ID NO: 195018 - RNA, 22 nt, Human
uuuaauuuucugggcccagcag

SEQ ID NO: 195019 - RNA, 19 nt, Human
gcagagucaagagcugcug

SEQ ID NO: 195020 - RNA, 22 nt, Human
uuccuggcugucaugcccuagu

SEQ ID NO: 195021 - RNA, 22 nt, Human
acaguggcagucguguucucua

SEQ ID NO: 195022 - RNA, 22 nt, Human
auggaacaugaauuaauauggu

SEQ ID NO: 195023 - RNA, 22 nt, Human
aguguuaagagaaaauucugcu

SEQ ID NO: 195024 - RNA, 22 nt, Human
uuugaaguaccugguucugacu

SEQ ID NO: 195025 - RNA, 22 nt, Human
acagaagaaguucaaggugaag

SEQ ID NO: 195026 - RNA, 22 nt, Human
ggagcuggccgccuaugugcag

SEQ ID NO: 195027 - RNA, 20 nt, Human
cuguccugaucuuuucagaa

SEQ ID NO: 195028 - RNA, 22 nt, Human
guucccauugcccuagcuugua

SEQ ID NO: 195029 - RNA, 22 nt, Human
acaagguucuuguggaggaauu

SEQ ID NO: 195030 - RNA, 22 nt, Human
uuccuggccagcuguggugagu

SEQ ID NO: 195031 - RNA, 22 nt, Human
uucaguaaaacacugcaauguc

SEQ ID NO: 195032 - RNA, 22 nt, Human
caggcccugcugcugagaccuu

SEQ ID NO: 195033 - RNA, 22 nt, Human
acugguuuuggaaaucaguaca

SEQ ID NO: 195034 - RNA, 22 nt, Human
ugcuggggucucuccggugccc

SEQ ID NO: 195035 - RNA, 22 nt, Human
agugccccaugggugccugggg

SEQ ID NO: 195036 - RNA, 22 nt, Human
caccagggacaaugcuaggggu

SEQ ID NO: 195037 - RNA, 22 nt, Human
auaugauuccacuauuguaugg

SEQ ID NO: 195038 - RNA, 22 nt, Human
ugaggggguuaauuaggagagu

SEQ ID NO: 195039 - RNA, 22 nt, Human
acuggcagagggaaaaccauuc

SEQ ID NO: 195040 - RNA, 22 nt, Human
ccuggcagacugugagggcagg

SEQ ID NO: 195041 - RNA, 22 nt, Human
ucuuuggcaucagggccagcua

SEQ ID NO: 195042 - RNA, 20 nt, Human
gcugucugacaguucccaga

SEQ ID NO: 195043 - RNA, 22 nt, Human
uuuuuguagucauuagaagagg

SEQ ID NO: 195044 - RNA, 22 nt, Human
ugccaggcccagcagggcggcc

SEQ ID NO: 195045 - RNA, 22 nt, Human
cccagugugaugagguugcuaa

SEQ ID NO: 195046 - RNA, 22 nt, Human
caggcuagcagggcccagggca

SEQ ID NO: 195047 - RNA, 22 nt, Human
gcuggccaguguggugaccacc

SEQ ID NO: 195048 - RNA, 22 nt, Human
ucagagcuuaucucuugcugga

SEQ ID NO: 195049 - RNA, 22 nt, Human
gcugucuugaugauuggaugcu

SEQ ID NO: 195050 - RNA, 22 nt, Human
uauucuuguauacuacaaucuu

SEQ ID NO: 195051 - RNA, 22 nt, Human
ucuauauaaccuccacuucuac

SEQ ID NO: 195052 - RNA, 22 nt, Human
uucuccugaguucccaggucua

SEQ ID NO: 195053 - RNA, 21 nt, Human
ugaggcucaucuuauguggcu

SEQ ID NO: 195054 - RNA, 22 nt, Human
gccggggcuggggagagacaug

SEQ ID NO: 195055 - RNA, 22 nt, Human
aagaguuuucuauaaucuuggc

SEQ ID NO: 195056 - RNA, 20 nt, Human
agucacauugagcuuuugga

SEQ ID NO: 195057 - RNA, 22 nt, Human
cucagcucaaaauucaccuuug

SEQ ID NO: 195058 - RNA, 22 nt, Human
uuauucaucagugcauuaauuu

SEQ ID NO: 195059 - RNA, 22 nt, Human
uugguggagucauuggcauaug

SEQ ID NO: 195060 - RNA, 22 nt, Human
cacagcaaagacacucucaacu

SEQ ID NO: 195061 - RNA, 20 nt, Human
guauuaggagguaaauguaa

SEQ ID NO: 195062 - RNA, 22 nt, Human
ggcuccaggguaccccuggaug

SEQ ID NO: 195063 - RNA, 22 nt, Human
auaauuacauuauacuguuaga

SEQ ID NO: 195064 - RNA, 20 nt, Human
ucucugaguuuccuaauuug

SEQ ID NO: 195065 - RNA, 22 nt, Human
ggccaggcgaugaccccuccac

SEQ ID NO: 195066 - RNA, 22 nt, Human
gagcccaggcugggguucagag

SEQ ID NO: 195067 - RNA, 22 nt, Human
gcauguguuauuuuauguauga

SEQ ID NO: 195068 - RNA, 22 nt, Human
aaagugaugccaggagucuggu

SEQ ID NO: 195069 - RNA, 22 nt, Human
ucauuucaaguucugacagcua

SEQ ID NO: 195070 - RNA, 22 nt, Human
aggggagaaaaaugccuucugu

SEQ ID NO: 195071 - RNA, 22 nt, Human
augacacuuggugauacuuugu

SEQ ID NO: 195072 - RNA, 22 nt, Human
ugauucuuugaccaaaaaauug

SEQ ID NO: 195073 - RNA, 22 nt, Human
uuucuaaguguguuucauagga

SEQ ID NO: 195074 - RNA, 22 nt, Human
gacagcagggacauguaggaag

SEQ ID NO: 195075 - RNA, 22 nt, Human
aucuugggaauuuuccaggagu

SEQ ID NO: 195076 - RNA, 22 nt, Human
ccauguguaaauuagauaacuc

SEQ ID NO: 195077 - RNA, 22 nt, Human
caaagcaguuuuaaucaaguag

SEQ ID NO: 195078 - RNA, 22 nt, Human
cagggagaaaucuccaggaggu

SEQ ID NO: 195079 - RNA, 22 nt, Human
auuaaugucuaccaguugugug

SEQ ID NO: 195080 - RNA, 22 nt, Human
uugaaaggugaacaugaugcac

SEQ ID NO: 195081 - RNA, 22 nt, Human
ucugaauucuuagaauuaaagg

SEQ ID NO: 195082 - RNA, 22 nt, Human
gucagagagggcacgugcacac

SEQ ID NO: 195083 - RNA, 17 nt, Human
ucagagggaugagcagg

SEQ ID NO: 195084 - RNA, 22 nt, Human
cuggagcuuauugggagcagaa

SEQ ID NO: 195085 - RNA, 17 nt, Human
ugcaaacaaucacauau

SEQ ID NO: 195086 - RNA, 22 nt, Human
cacugucuauuaauauaacuua

SEQ ID NO: 195087 - RNA, 22 nt, Human
ugcuggaggggaugccuucacu

SEQ ID NO: 195088 - RNA, 20 nt, Human
ucuuccagguacagucugca

SEQ ID NO: 195089 - RNA, 22 nt, Human
uuacagaguagggaauugaagu

SEQ ID NO: 195090 - RNA, 22 nt, Human
uggcagggaguucguucacaac

SEQ ID NO: 195091 - RNA, 22 nt, Human
aagugguuugauucaguuuaug

SEQ ID NO: 195092 - RNA, 22 nt, Human
agagguaugguauauuggaaga

SEQ ID NO: 195093 - RNA, 22 nt, Human
ucaugccaaacugaacacaguu

SEQ ID NO: 195094 - RNA, 23 nt, Human
ugcuggguaaauagcugaguaac

SEQ ID NO: 195095 - RNA, 22 nt, Human
uaaaggcucguauuguugugug

SEQ ID NO: 195096 - RNA, 22 nt, Human
auugucauuccagucauuguua

SEQ ID NO: 195097 - RNA, 20 nt, Human
agcauuugaaauaugacuau

SEQ ID NO: 195098 - RNA, 22 nt, Human
aguaagugagucacugugcugg

SEQ ID NO: 195099 - RNA, 22 nt, Human
gcucuguacgcaggaugagggg

SEQ ID NO: 195100 - RNA, 22 nt, Human
aggcccagggcugcucucugaa

SEQ ID NO: 195101 - RNA, 22 nt, Human
cagugcaguugguggcaggggu

SEQ ID NO: 195102 - RNA, 19 nt, Human
cuccggccagcaacugcau

SEQ ID NO: 195103 - RNA, 22 nt, Human
auucuucauuuacuguuacuug

SEQ ID NO: 195104 - RNA, 22 nt, Human
cucuguagaaacagggcagaag

SEQ ID NO: 195105 - RNA, 22 nt, Human
ugcagaagaaaacagcugugug

SEQ ID NO: 195106 - RNA, 22 nt, Human
ggcagggguggccuuccuuugg

SEQ ID NO: 195107 - RNA, 22 nt, Human
aggccaagauuuuggaucagcu

SEQ ID NO: 195108 - RNA, 22 nt, Human
uuguccuguuuagggauaagga

SEQ ID NO: 195109 - RNA, 22 nt, Human
gacauuuagcuguuuugcauuu

SEQ ID NO: 195110 - RNA, 22 nt, Human
aaaggccacacugcucuuucuc

SEQ ID NO: 195111 - RNA, 22 nt, Human
cauucauucagcaacuguuauu

SEQ ID NO: 195112 - RNA, 23 nt, Human
ccagucucacguauacaggauuu

SEQ ID NO: 195113 - RNA, 22 nt, Human
agggcgcugucuggccagcggu

SEQ ID NO: 195114 - RNA, 22 nt, Human
acagugaucaguuacugucugu

SEQ ID NO: 195115 - RNA, 22 nt, Human
uuccaaaguuauucaagcagua

SEQ ID NO: 195116 - RNA, 22 nt, Human
uacagaaagggaugauugaucu

SEQ ID NO: 195117 - RNA, 22 nt, Human
cuggaaugccucccugucagag

SEQ ID NO: 195118 - RNA, 22 nt, Human
uuccugaauugagcuuuagaaa

SEQ ID NO: 195119 - RNA, 18 nt, Human
cugaaggauccaggugua

SEQ ID NO: 195120 - RNA, 22 nt, Human
cuacaucagaacauuuacccua

SEQ ID NO: 195121 - RNA, 19 nt, Human
gcuacugaggcccaggacc

SEQ ID NO: 195122 - RNA, 22 nt, Human
gggucgagggucucgcccuucc

SEQ ID NO: 195123 - RNA, 22 nt, Human
gggaaguuugugggaggaauau

SEQ ID NO: 195124 - RNA, 22 nt, Human
gaggagagggcugcgggcccac

SEQ ID NO: 195125 - RNA, 22 nt, Human
augacaaccugugagcugguau

SEQ ID NO: 195126 - RNA, 23 nt, Human
uuuguacugcauuaugagacaca

SEQ ID NO: 195127 - RNA, 22 nt, Human
ucuggccccuggcaguccugga

SEQ ID NO: 195128 - RNA, 22 nt, Human
aggccagacagcuagaaacagg

SEQ ID NO: 195129 - RNA, 22 nt, Human
ucuguaaagucuguguaaaguc

SEQ ID NO: 195130 - RNA, 22 nt, Human
cugacagaugcugcuggcagua

SEQ ID NO: 195131 - RNA, 22 nt, Human
uuggaaaugcaaauauauugaa

SEQ ID NO: 195132 - RNA, 22 nt, Human
gugcaaaaguaauugcaguuuu

SEQ ID NO: 195133 - RNA, 22 nt, Human
aucaucaugcccacuugagacu

SEQ ID NO: 195134 - RNA, 22 nt, Human
ucagagaaauaauugcugaguu

SEQ ID NO: 195135 - RNA, 22 nt, Human
ugcaagaggauuguaucaauaa

SEQ ID NO: 195136 - RNA, 22 nt, Human
ucugggcugguugugcuugcuu

SEQ ID NO: 195137 - RNA, 22 nt, Human
ccaaaugugccuguuucaacaa

SEQ ID NO: 195138 - RNA, 22 nt, Human
uuuggaaugaaacagcagagcc

SEQ ID NO: 195139 - RNA, 20 nt, Human
ccccuucaucuacagccuga

SEQ ID NO: 195140 - RNA, 20 nt, Human
agggcugagaagggacuagc

SEQ ID NO: 195141 - RNA, 22 nt, Human
cacgcauguggaucagaugaag

SEQ ID NO: 195142 - RNA, 22 nt, Human
gaaauacugcacacccuguaag

SEQ ID NO: 195143 - RNA, 22 nt, Human
cugucccagauguucucagcac

SEQ ID NO: 195144 - RNA, 22 nt, Human
uuucugaagauacagcuuugcu

SEQ ID NO: 195145 - RNA, 22 nt, Human
ugcugugcaucauaguguuugg

SEQ ID NO: 195146 - RNA, 22 nt, Human
uugcugugucauuuguuuaauc

SEQ ID NO: 195147 - RNA, 22 nt, Human
auguuuuaugcuucagaugagg

SEQ ID NO: 195148 - RNA, 20 nt, Human
gcucagagccugaacuucau

SEQ ID NO: 195149 - RNA, 22 nt, Human
uuguacauucugaaucuguccu

SEQ ID NO: 195150 - RNA, 22 nt, Human
uucuccugcccuuggacuucca

SEQ ID NO: 195151 - RNA, 22 nt, Human
uggagcuggaauuugagcugga

SEQ ID NO: 195152 - RNA, 22 nt, Human
uuuccagauuaagauaccacuu

SEQ ID NO: 195153 - RNA, 22 nt, Human
caggcuagauuggggccaguag

SEQ ID NO: 195154 - RNA, 22 nt, Human
ggcugccacgucgaggguccaa

SEQ ID NO: 195155 - RNA, 22 nt, Human
uuuccuuccagguuccuaaggc

SEQ ID NO: 195156 - RNA, 22 nt, Human
aacuguacgauaauaaauuugu

SEQ ID NO: 195157 - RNA, 22 nt, Human
aggcagggcugggauuagacuc

SEQ ID NO: 195158 - RNA, 22 nt, Human
gcuagaauauuggguaggcaag

SEQ ID NO: 195159 - RNA, 22 nt, Human
agugcucaccugucaggucaag

SEQ ID NO: 195160 - RNA, 22 nt, Human
ccugagagugcgugccuccuua

SEQ ID NO: 195161 - RNA, 17 nt, Human
uccuccccgcaguugca

SEQ ID NO: 195162 - RNA, 22 nt, Human
uugcuuuacauguucugguaaa

SEQ ID NO: 195163 - RNA, 22 nt, Human
ucuugagagauauacuacugaa

SEQ ID NO: 195164 - RNA, 22 nt, Human
uuugcaaagaaauuauugcugu

SEQ ID NO: 195165 - RNA, 22 nt, Human
uaaggcuuuccuugucaucuuu

SEQ ID NO: 195166 - RNA, 22 nt, Human
uuacagucagugaauggaaggg

SEQ ID NO: 195167 - RNA, 22 nt, Human
uaugaauucuguucauugauga

SEQ ID NO: 195168 - RNA, 22 nt, Human
uauguugagcauucagugaucu

SEQ ID NO: 195169 - RNA, 21 nt, Human
gcaggcuggucaaaccucagu

SEQ ID NO: 195170 - RNA, 22 nt, Human
uuuuuuaguuaggucagaaugu

SEQ ID NO: 195171 - RNA, 22 nt, Human
uguuacuuugauugguauucua

SEQ ID NO: 195172 - RNA, 22 nt, Human
augcuguguccuagugaaagaa

SEQ ID NO: 195173 - RNA, 21 nt, Human
uccaggacuugagaauuccag

SEQ ID NO: 195174 - RNA, 22 nt, Human
guuuccugucugcuuuacuaua

SEQ ID NO: 195175 - RNA, 22 nt, Human
aguugggaguuauagacucuau

SEQ ID NO: 195176 - RNA, 22 nt, Human
cuccaggaaaauagggaaugag

SEQ ID NO: 195177 - RNA, 22 nt, Human
uagguucucuauugcccccaaa

SEQ ID NO: 195178 - RNA, 22 nt, Human
gaggguggcuccucccugggcc

SEQ ID NO: 195179 - RNA, 22 nt, Human
ccaggaaggaagcagggguuuc

SEQ ID NO: 195180 - RNA, 22 nt, Human
acacuguaugaaaacaggaaau

SEQ ID NO: 195181 - RNA, 22 nt, Human
augaaugagaaagcugaaaucu

SEQ ID NO: 195182 - RNA, 22 nt, Human
uucuuuucuuggcaggaguaga

SEQ ID NO: 195183 - RNA, 22 nt, Human
gucucaagggggaacucacugu

SEQ ID NO: 195184 - RNA, 22 nt, Human
cacacauuaauaucaaaggcuc

SEQ ID NO: 195185 - RNA, 19 nt, Human
uuugcugguucaggaaaga

SEQ ID NO: 195186 - RNA, 21 nt, Human
aggcucucauccagggaccca

SEQ ID NO: 195187 - RNA, 22 nt, Human
uagaaagagcauaguauuauaa

SEQ ID NO: 195188 - RNA, 22 nt, Human
ccaucuccacugucccugucaa

SEQ ID NO: 195189 - RNA, 19 nt, Human
uggcccagaugguccuggg

SEQ ID NO: 195190 - RNA, 22 nt, Human
gggcugagucugcugccuguca

SEQ ID NO: 195191 - RNA, 22 nt, Human
uggagggauacaaagaugaaaa

SEQ ID NO: 195192 - RNA, 22 nt, Human
aaagcagcaaauacuuuugcac

SEQ ID NO: 195193 - RNA, 22 nt, Human
aucaucuugaaagucuauguuu

SEQ ID NO: 195194 - RNA, 22 nt, Human
auuagcauugcuacucucaaga

SEQ ID NO: 195195 - RNA, 22 nt, Human
acaaagcuagagaagagaauug

SEQ ID NO: 195196 - RNA, 21 nt, Human
caggucuggugaacacucuca

SEQ ID NO: 195197 - RNA, 22 nt, Human
ccaacucugaaaauccagauau

SEQ ID NO: 195198 - RNA, 22 nt, Human
uucccucccuggcugccauuuc

SEQ ID NO: 195199 - RNA, 22 nt, Human
gcuuucccugcccucagaagga

SEQ ID NO: 195200 - RNA, 22 nt, Human
auggagcuguagggagcagugg

SEQ ID NO: 195201 - RNA, 22 nt, Human
uaaacagcuacugugucaaagg

SEQ ID NO: 195202 - RNA, 22 nt, Human
uggcugccaugacgccugggga

SEQ ID NO: 195203 - RNA, 22 nt, Human
cccaggcugguccugaacuccu

SEQ ID NO: 195204 - RNA, 22 nt, Human
acuagaaagcaaaagccauuuc

SEQ ID NO: 195205 - RNA, 22 nt, Human
ugaaugaauccuaacaaagaca

SEQ ID NO: 195206 - RNA, 22 nt, Human
cacuugaacuguuugaaugaga

SEQ ID NO: 195207 - RNA, 22 nt, Human
cuagaauugcauucuaugaaua

SEQ ID NO: 195208 - RNA, 22 nt, Human
gcccugcuguuuagagagcuac

SEQ ID NO: 195209 - RNA, 22 nt, Human
cuucuucaaccugaaaguuuca

SEQ ID NO: 195210 - RNA, 22 nt, Human
caucucuccacggcagcucucg

SEQ ID NO: 195211 - RNA, 22 nt, Human
ccaggagcagggcuggcugcac

SEQ ID NO: 195212 - RNA, 22 nt, Human
gucuagaaaucauguacuguga

SEQ ID NO: 195213 - RNA, 22 nt, Human
cuaaaucaucauuuauguuugu

SEQ ID NO: 195214 - RNA, 22 nt, Human
uucacuuauagggauguuauug

SEQ ID NO: 195215 - RNA, 20 nt, Human
guggccucucacauucugag

SEQ ID NO: 195216 - RNA, 22 nt, Human
agcccagcaaagggagguucag

SEQ ID NO: 195217 - RNA, 22 nt, Human
gcaggccacaguggagucucug

SEQ ID NO: 195218 - RNA, 22 nt, Human
ggaaggcuuuguagaagugcca

SEQ ID NO: 195219 - RNA, 22 nt, Human
auggcuggauaguugaagcucu

SEQ ID NO: 195220 - RNA, 21 nt, Human
uggcccuggccacggcugcca

SEQ ID NO: 195221 - RNA, 23 nt, Human
agguggucuuguggaugcugcaa

SEQ ID NO: 195222 - RNA, 22 nt, Human
ucuggcucggauuugucuagca

SEQ ID NO: 195223 - RNA, 22 nt, Human
cauaauuagagaauucauguua

SEQ ID NO: 195224 - RNA, 22 nt, Human
agucuuuacauguguuauauau

SEQ ID NO: 195225 - RNA, 22 nt, Human
auuugccuuggugauuuguaaa

SEQ ID NO: 195226 - RNA, 22 nt, Human
ucucuuggggaaagagaagaau

SEQ ID NO: 195227 - RNA, 22 nt, Human
acagccagggucucaggaggcg

SEQ ID NO: 195228 - RNA, 22 nt, Human
ccaaggcugucauucaguagcu

SEQ ID NO: 195229 - RNA, 22 nt, Human
acaggaagcuggagacccuuga

SEQ ID NO: 195230 - RNA, 22 nt, Human
agagucuguuacuuguccccua

SEQ ID NO: 195231 - RNA, 22 nt, Human
guuagcaccagugcucauaaca

SEQ ID NO: 195232 - RNA, 22 nt, Human
cugggccucaagcucagauuuc

SEQ ID NO: 195233 - RNA, 22 nt, Human
uucuuguuuugcccaaguugua

SEQ ID NO: 195234 - RNA, 22 nt, Human
ccuggcugagggaccucgggua

SEQ ID NO: 195235 - RNA, 22 nt, Human
aguggaaggucaggggacagug

SEQ ID NO: 195236 - RNA, 22 nt, Human
cuuagagccuuacucuucuugu

SEQ ID NO: 195237 - RNA, 22 nt, Human
ggaagaaagcacacaaacuuga

SEQ ID NO: 195238 - RNA, 21 nt, Human
agaguaauuccugcuggaaag

SEQ ID NO: 195239 - RNA, 22 nt, Human
uuagcuuuucacuugcauuauc

SEQ ID NO: 195240 - RNA, 22 nt, Human
cuacaaaaguaauugugguuuu

SEQ ID NO: 195241 - RNA, 22 nt, Human
gucugggcagcagcauuucuua

SEQ ID NO: 195242 - RNA, 22 nt, Human
guguuuauaggagugaaugcug

SEQ ID NO: 195243 - RNA, 19 nt, Human
ggcagaagguguaggggga

SEQ ID NO: 195244 - RNA, 22 nt, Human
cagaggccccauuggcugugcg

SEQ ID NO: 195245 - RNA, 22 nt, Human
gcucccaggaugaggagccagg

SEQ ID NO: 195246 - RNA, 19 nt, Human
uggaggagaggaaaaguca

SEQ ID NO: 195247 - RNA, 22 nt, Human
uguuuuucaaauauugcucugu

SEQ ID NO: 195248 - RNA, 22 nt, Human
ugggccucggggaagcccgugu

SEQ ID NO: 195249 - RNA, 22 nt, Human
ugacacaggggaaggagucugg

SEQ ID NO: 195250 - RNA, 22 nt, Human
aggcaguguguagcuggaagag

SEQ ID NO: 195251 - RNA, 22 nt, Human
uggcauuucuggccauuugugu

SEQ ID NO: 195252 - RNA, 22 nt, Human
ucucccauucagcuugcaguca

SEQ ID NO: 195253 - RNA, 22 nt, Human
auuugucacugagagaguuaga

SEQ ID NO: 195254 - RNA, 22 nt, Human
gacaaaugaaugaugaacacca

SEQ ID NO: 195255 - RNA, 22 nt, Human
ggcaggcagccuccauccacag

SEQ ID NO: 195256 - RNA, 22 nt, Human
uggccaugggauagugcagggg

SEQ ID NO: 195257 - RNA, 22 nt, Human
ucugcagguguuggaaggguca

SEQ ID NO: 195258 - RNA, 22 nt, Human
ucccuuucacuuaacuagccca

SEQ ID NO: 195259 - RNA, 22 nt, Human
aaacaugaugucauauaugcca

SEQ ID NO: 195260 - RNA, 22 nt, Human
acccagcuggaugcauggaggc

SEQ ID NO: 195261 - RNA, 22 nt, Human
ggcugccuccucgagacaggau

SEQ ID NO: 195262 - RNA, 22 nt, Human
auuaauuuuaccuuuguaaaca

SEQ ID NO: 195263 - RNA, 22 nt, Human
aguccuuccggcagauuucacu

SEQ ID NO: 195264 - RNA, 22 nt, Human
cuuuauguucaguacaaugcuu

SEQ ID NO: 195265 - RNA, 22 nt, Human
ggugacugguuuaucuggcagu

SEQ ID NO: 195266 - RNA, 22 nt, Human
uggcuucuggcuggugagaaau

SEQ ID NO: 195267 - RNA, 22 nt, Human
uaagacauagccaagagcaucc

SEQ ID NO: 195268 - RNA, 20 nt, Human
ucccucagcacuucuaccuc

SEQ ID NO: 195269 - RNA, 19 nt, Human
gaaaacaugggugaggguc

SEQ ID NO: 195270 - RNA, 22 nt, Human
ugaggccagcuucagcagugga

SEQ ID NO: 195271 - RNA, 22 nt, Human
cugggcuccuaaccauccaggu

SEQ ID NO: 195272 - RNA, 22 nt, Human
ugcagaagcagagccgguggcc

SEQ ID NO: 195273 - RNA, 22 nt, Human
uuuguacaauuagcagaggcua

SEQ ID NO: 195274 - RNA, 22 nt, Human
acuguuugcugauagauauuua

SEQ ID NO: 195275 - RNA, 23 nt, Human
ucacaucugccguaguguauucu

SEQ ID NO: 195276 - RNA, 22 nt, Human
agcccuuaguacauuucucaag

SEQ ID NO: 195277 - RNA, 18 nt, Human
gccuucagacugcaugcu

SEQ ID NO: 195278 - RNA, 18 nt, Human
ggagagugacagagucgu

SEQ ID NO: 195279 - RNA, 22 nt, Human
accugggaaagccguggaaagg

SEQ ID NO: 195280 - RNA, 22 nt, Human
uugaggaguugugacagauacu

SEQ ID NO: 195281 - RNA, 22 nt, Human
auacuuaugauaaauaauugcu

SEQ ID NO: 195282 - RNA, 22 nt, Human
ucucuucugaaaccugucuuua

SEQ ID NO: 195283 - RNA, 23 nt, Human
ggagacaagguaccacguuaaca

SEQ ID NO: 195284 - RNA, 22 nt, Human
cugcucuguuucuuagcugggu

SEQ ID NO: 195285 - RNA, 22 nt, Human
uguccagcugaaggcagccuca

SEQ ID NO: 195286 - RNA, 22 nt, Human
gcuggagaaacaggaggaggaa

SEQ ID NO: 195287 - RNA, 22 nt, Human
aggaaacuuucuuuugcuucau

SEQ ID NO: 195288 - RNA, 22 nt, Human
cucuccagggguagaugccuuc

SEQ ID NO: 195289 - RNA, 22 nt, Human
ucagauuuuauuuuccuguuac

SEQ ID NO: 195290 - RNA, 22 nt, Human
gaaaguuauaucaugauuuuag

SEQ ID NO: 195291 - RNA, 22 nt, Human
agcaggcaagguccgugccucg

SEQ ID NO: 195292 - RNA, 22 nt, Human
uuaaauagucaaaucaguggca

SEQ ID NO: 195293 - RNA, 22 nt, Human
agguggggugagcugcagacua

SEQ ID NO: 195294 - RNA, 19 nt, Human
gucaggcacgugagagcau

SEQ ID NO: 195295 - RNA, 22 nt, Human
auugagaaugcaaucuacuaug

SEQ ID NO: 195296 - RNA, 22 nt, Human
acaugauuugcaugauuuguaa

SEQ ID NO: 195297 - RNA, 22 nt, Human
uggcaugaagucagcagcuggg

SEQ ID NO: 195298 - RNA, 22 nt, Human
uaaacucucaacagagaaccac

SEQ ID NO: 195299 - RNA, 22 nt, Human
acauaugugucugcacaugccc

SEQ ID NO: 195300 - RNA, 23 nt, Human
uuuauauuccuaaugucuugagc

SEQ ID NO: 195301 - RNA, 22 nt, Human
gugcagagaggaccuuggggag

SEQ ID NO: 195302 - RNA, 22 nt, Human
ggagugacucacagcugggaca

SEQ ID NO: 195303 - RNA, 22 nt, Human
uuaauaauaaugagcccauuuu

SEQ ID NO: 195304 - RNA, 22 nt, Human
gacaagacauugguaaagauau

SEQ ID NO: 195305 - RNA, 22 nt, Human
aaacuuuuccugcucuuguccu

SEQ ID NO: 195306 - RNA, 22 nt, Human
cagaggaagggugcugcgaaag

SEQ ID NO: 195307 - RNA, 22 nt, Human
gagggaccuuuacacagacauu

SEQ ID NO: 195308 - RNA, 19 nt, Human
ucaucucacagggccuggc

SEQ ID NO: 195309 - RNA, 22 nt, Human
gucuggaggcacuuucucauga

SEQ ID NO: 195310 - RNA, 22 nt, Human
agguuuaugccuuggagcuggg

SEQ ID NO: 195311 - RNA, 22 nt, Human
cauuugcauaugaagaaguaag

SEQ ID NO: 195312 - RNA, 22 nt, Human
gggaucugaugcacugcugaaa

SEQ ID NO: 195313 - RNA, 22 nt, Human
aggcuaggcugaugccucuucc

SEQ ID NO: 195314 - RNA, 20 nt, Human
cugaagaguggccugaucug

SEQ ID NO: 195315 - RNA, 22 nt, Human
uauuagguuggugcaaaauuaa

SEQ ID NO: 195316 - RNA, 22 nt, Human
cauaaguuggguaauauaauga

SEQ ID NO: 195317 - RNA, 22 nt, Human
ugccaggcacgugagaguggcc

SEQ ID NO: 195318 - RNA, 22 nt, Human
gaugaucugagguacaugaaac

SEQ ID NO: 195319 - RNA, 22 nt, Human
caguuucuccaaacgcaggcug

SEQ ID NO: 195320 - RNA, 22 nt, Human
ugaggcucugcuucuguggcuc

SEQ ID NO: 195321 - RNA, 22 nt, Human
gcugcagggaauguauggauuu

SEQ ID NO: 195322 - RNA, 22 nt, Human
agaaacuaagucauaacucuuu

SEQ ID NO: 195323 - RNA, 22 nt, Human
cacauuguagagauuagaaaga

SEQ ID NO: 195324 - RNA, 22 nt, Human
gaggagcuguucccucaccucu

SEQ ID NO: 195325 - RNA, 22 nt, Human
gacaccagaagacauaagcaga

SEQ ID NO: 195326 - RNA, 22 nt, Human
uggcgaggccaggccagggccu

SEQ ID NO: 195327 - RNA, 19 nt, Human
cugcucuccuugacuugga

SEQ ID NO: 195328 - RNA, 22 nt, Human
ggcuugaucacauaggucuccc

SEQ ID NO: 195329 - RNA, 22 nt, Human
acugguuugucuauugucauuc

SEQ ID NO: 195330 - RNA, 22 nt, Human
ucacagcaggguaacaggaaga

SEQ ID NO: 195331 - RNA, 22 nt, Human
uuucucagcuguggagccuauc

SEQ ID NO: 195332 - RNA, 22 nt, Human
acacugucucauaugaggggac

SEQ ID NO: 195333 - RNA, 19 nt, Human
uggcuucuucgguguuccc

SEQ ID NO: 195334 - RNA, 21 nt, Human
ucauauuucucuugcuauugu

SEQ ID NO: 195335 - RNA, 22 nt, Human
ucuuggaauaccccgaagguca

SEQ ID NO: 195336 - RNA, 22 nt, Human
ggcugccuucccugagccccgg

SEQ ID NO: 195337 - RNA, 18 nt, Human
agggucagugucacuggc

SEQ ID NO: 195338 - RNA, 22 nt, Human
accugggaggcagagguugcag

SEQ ID NO: 195339 - RNA, 22 nt, Human
ucaggcagaaaaaucacuaauu

SEQ ID NO: 195340 - RNA, 22 nt, Human
cagcucuggcagagcccaaccc

SEQ ID NO: 195341 - RNA, 22 nt, Human
uucaaucauuagaaucucaggc

SEQ ID NO: 195342 - RNA, 22 nt, Human
acacauuuuggcuagguggaga

SEQ ID NO: 195343 - RNA, 22 nt, Human
gaggccuggaccagccacagag

SEQ ID NO: 195344 - RNA, 17 nt, Human
aguggcaggcagauggg

SEQ ID NO: 195345 - RNA, 22 nt, Human
aaggugcucguuauggccagug

SEQ ID NO: 195346 - RNA, 22 nt, Human
ccagucagggcaggagccuggu

SEQ ID NO: 195347 - RNA, 22 nt, Human
cagaggccuuucuacagugaua

SEQ ID NO: 195348 - RNA, 22 nt, Human
caggcagaggaagucugggucu

SEQ ID NO: 195349 - RNA, 22 nt, Human
cuuggagucaauaagaucuaga

SEQ ID NO: 195350 - RNA, 22 nt, Human
accaggcuguugggcccagugu

SEQ ID NO: 195351 - RNA, 22 nt, Human
aauuuccaaauuucugucacac

SEQ ID NO: 195352 - RNA, 22 nt, Human
ggcaggcacugugcuaggcgcu

SEQ ID NO: 195353 - RNA, 22 nt, Human
caugugucacagccuuuuauug

SEQ ID NO: 195354 - RNA, 22 nt, Human
cagccagguaugggcgugcggg

SEQ ID NO: 195355 - RNA, 22 nt, Human
cagcuucugagcaagccagggg

SEQ ID NO: 195356 - RNA, 22 nt, Human
gcaggugguggcgcgcgcccug

SEQ ID NO: 195357 - RNA, 22 nt, Human
agguccagcuguugcagccucc

SEQ ID NO: 195358 - RNA, 22 nt, Human
uacacugugacaaucaugacag

SEQ ID NO: 195359 - RNA, 22 nt, Human
gcucuagcaaggcuggccuggg

SEQ ID NO: 195360 - RNA, 21 nt, Human
ucucugggaggacuugugaga

SEQ ID NO: 195361 - RNA, 22 nt, Human
uugagggauuuuaaaugaacaa

SEQ ID NO: 195362 - RNA, 22 nt, Human
uggcuggaguauaggaguagga

SEQ ID NO: 195363 - RNA, 22 nt, Human
agucuuaggcuccauuaguaga

SEQ ID NO: 195364 - RNA, 22 nt, Human
aguuugaagcacaugaauggca

SEQ ID NO: 195365 - RNA, 22 nt, Human
aaggcagugguuggguggagga

SEQ ID NO: 195366 - RNA, 22 nt, Human
uucuaguucccacauaguugcc

SEQ ID NO: 195367 - RNA, 22 nt, Human
ggccaggagcugcacagggcuc

SEQ ID NO: 195368 - RNA, 22 nt, Human
aacagguagggacucuaacuug

SEQ ID NO: 195369 - RNA, 22 nt, Human
gauauauuuuccauggucugca

SEQ ID NO: 195370 - RNA, 20 nt, Human
agaaacauuucuugagaacu

SEQ ID NO: 195371 - RNA, 22 nt, Human
gggucuccauguuaacaucacu

SEQ ID NO: 195372 - RNA, 23 nt, Human
acuacagauacuccugcuguuug

SEQ ID NO: 195373 - RNA, 22 nt, Human
aagggggcccagcacuaaguug

SEQ ID NO: 195374 - RNA, 22 nt, Human
agcaaauacuugaauaaaaaga

SEQ ID NO: 195375 - RNA, 22 nt, Human
cugguuuaaccauguauccugg

SEQ ID NO: 195376 - RNA, 22 nt, Human
uggcagccaucagagcaggggu

SEQ ID NO: 195377 - RNA, 22 nt, Human
acaguagcuaauauugcauuau

SEQ ID NO: 195378 - RNA, 19 nt, Human
auagaaaggguuaaagaca

SEQ ID NO: 195379 - RNA, 22 nt, Human
ucaguccauaggugggccugag

SEQ ID NO: 195380 - RNA, 22 nt, Human
cagaugcacauucucaucagca

SEQ ID NO: 195381 - RNA, 22 nt, Human
ugaggcucauucugcaugccaa

SEQ ID NO: 195382 - RNA, 22 nt, Human
gagcaggcaaagaugaaaggag

SEQ ID NO: 195383 - RNA, 22 nt, Human
agcaggcagccauuuggaaggc

SEQ ID NO: 195384 - RNA, 22 nt, Human
uuuauuaugauggacaccuucg

SEQ ID NO: 195385 - RNA, 22 nt, Human
aagauacacguuguauugaaua

SEQ ID NO: 195386 - RNA, 22 nt, Human
ugccuggcugggcugcucaugg

SEQ ID NO: 195387 - RNA, 20 nt, Human
gggaggccagccucagagaa

SEQ ID NO: 195388 - RNA, 22 nt, Human
gucauuccuauccauuugauac

SEQ ID NO: 195389 - RNA, 22 nt, Human
gaguuugauagagaggaaccgg

SEQ ID NO: 195390 - RNA, 22 nt, Human
uguguggauucaucucaaagag

SEQ ID NO: 195391 - RNA, 21 nt, Human
caucuuagguuguacauauau

SEQ ID NO: 195392 - RNA, 22 nt, Human
cuugcugagauaaaugcugucu

SEQ ID NO: 195393 - RNA, 22 nt, Human
caccaggaugggcagguagguc

SEQ ID NO: 195394 - RNA, 22 nt, Human
uuugcaaauacagaggucuugc

SEQ ID NO: 195395 - RNA, 22 nt, Human
agcugcagagaaaagaggcugg

SEQ ID NO: 195396 - RNA, 22 nt, Human
agccuccacagaugcaaagggc

SEQ ID NO: 195397 - RNA, 22 nt, Human
gugccccagacacgcauguggg

SEQ ID NO: 195398 - RNA, 22 nt, Human
ggaagagggaaccacgacugua

SEQ ID NO: 195399 - RNA, 19 nt, Human
ucaaaggcaaggaggaacu

SEQ ID NO: 195400 - RNA, 17 nt, Human
ccugucuuguuucugcc

SEQ ID NO: 195401 - RNA, 22 nt, Human
uccaggcugcaaggccacaggg

SEQ ID NO: 195402 - RNA, 22 nt, Human
aauaaaaugaacugguagaguu

SEQ ID NO: 195403 - RNA, 22 nt, Human
uggcuccagguugaacuuuggg

SEQ ID NO: 195404 - RNA, 22 nt, Human
uacccucucccgguccagcuuu

SEQ ID NO: 195405 - RNA, 22 nt, Human
ccaggcucaggccugcucguug

SEQ ID NO: 195406 - RNA, 22 nt, Human
cugcuguguuggcauuggauag

SEQ ID NO: 195407 - RNA, 22 nt, Human
agggggcccuugcaggugagcg

SEQ ID NO: 195408 - RNA, 22 nt, Human
augcaacauccaauuccuuuug

SEQ ID NO: 195409 - RNA, 22 nt, Human
uugcuguuacaauuauuuaccc

SEQ ID NO: 195410 - RNA, 22 nt, Human
acugcaccuugcgguccugugg

SEQ ID NO: 195411 - RNA, 22 nt, Human
uuucacaaacugaggagacaau

SEQ ID NO: 195412 - RNA, 22 nt, Human
ucuaaauuacuuugggcaguau

SEQ ID NO: 195413 - RNA, 19 nt, Human
gagcccucuccauggccac

SEQ ID NO: 195414 - RNA, 22 nt, Human
ugggaggagcccucugggaagg

SEQ ID NO: 195415 - RNA, 18 nt, Human
gggcccuggcguccgccc

SEQ ID NO: 195416 - RNA, 22 nt, Human
uggaagaaggcagagaggcauu

SEQ ID NO: 195417 - RNA, 23 nt, Human
agcugaggcagaggggcauucuc

SEQ ID NO: 195418 - RNA, 22 nt, Human
agcaguuaucgaagaaucaggu

SEQ ID NO: 195419 - RNA, 22 nt, Human
auuuacauuuauuugagaaggu

SEQ ID NO: 195420 - RNA, 21 nt, Human
uuuuauugaugaauggccacu

SEQ ID NO: 195421 - RNA, 22 nt, Human
cugcucuguucccccaucaucu

SEQ ID NO: 195422 - RNA, 22 nt, Human
cagccugucggcuccuucauuc

SEQ ID NO: 195423 - RNA, 22 nt, Human
cucuuuuacaccaaaaggccua

SEQ ID NO: 195424 - RNA, 22 nt, Human
uuacaguuuauccaggaagagc

SEQ ID NO: 195425 - RNA, 22 nt, Human
acauuaaaauugggugggguaa

SEQ ID NO: 195426 - RNA, 22 nt, Human
caauucuuucagcugcauuugu

SEQ ID NO: 195427 - RNA, 22 nt, Human
ccugcuggacguggaggagggg

SEQ ID NO: 195428 - RNA, 22 nt, Human
aucuuggggaauccucugugua

SEQ ID NO: 195429 - RNA, 22 nt, Human
gaaggccuagggaugcucugcg

SEQ ID NO: 195430 - RNA, 22 nt, Human
cuccuccacagaccuacugaau

SEQ ID NO: 195431 - RNA, 22 nt, Human
cuggaaagugcauguaaugagg

SEQ ID NO: 195432 - RNA, 22 nt, Human
gagggaagaaagaauugaugcg

SEQ ID NO: 195433 - RNA, 22 nt, Human
gcucugaggcugugaggugcug

SEQ ID NO: 195434 - RNA, 22 nt, Human
cucuggaccucagcuacagacu

SEQ ID NO: 195435 - RNA, 22 nt, Human
aaggaggguucccagguccugg

SEQ ID NO: 195436 - RNA, 22 nt, Human
gcugcccuccaguucccacagu

SEQ ID NO: 195437 - RNA, 22 nt, Human
aaggccagaguugaacugcucc

SEQ ID NO: 195438 - RNA, 22 nt, Human
uggccaccuucccacuucugcc

SEQ ID NO: 195439 - RNA, 22 nt, Human
gacugccucaguuucccugcag

SEQ ID NO: 195440 - RNA, 22 nt, Human
agggccagggaaacgaucagca

SEQ ID NO: 195441 - RNA, 22 nt, Human
cacaggggcaaacuguagggga

SEQ ID NO: 195442 - RNA, 22 nt, Human
aggcugugcacagggcaccugc

SEQ ID NO: 195443 - RNA, 22 nt, Human
gcaucucuacaacgaagacagu

SEQ ID NO: 195444 - RNA, 22 nt, Human
uauuucugucagccagauaugg

SEQ ID NO: 195445 - RNA, 22 nt, Human
accaggaacucacccgcagagg

SEQ ID NO: 195446 - RNA, 22 nt, Human
ugcccugcccuugcuauuucua

SEQ ID NO: 195447 - RNA, 22 nt, Human
uuguagaauuuggaucucggca

SEQ ID NO: 195448 - RNA, 22 nt, Human
gacaacugccccauuuuaaaug

SEQ ID NO: 195449 - RNA, 22 nt, Human
gcuguaggaagacagaaugcag

SEQ ID NO: 195450 - RNA, 22 nt, Human
uggcucugcugaaccuagugca

SEQ ID NO: 195451 - RNA, 22 nt, Human
gcacaggcacagagggccacug

SEQ ID NO: 195452 - RNA, 22 nt, Human
uuguaagucacaccagggcagg

SEQ ID NO: 195453 - RNA, 22 nt, Human
auuguacaaugcugagguuugg

SEQ ID NO: 195454 - RNA, 22 nt, Human
agugcugggauugcaggcauga

SEQ ID NO: 195455 - RNA, 22 nt, Human
agggagcaaagguuucaggguu

SEQ ID NO: 195456 - RNA, 22 nt, Human
agugcugggauuacaggcauaa

SEQ ID NO: 195457 - RNA, 22 nt, Human
gagcuuuacuucugacuggugc

SEQ ID NO: 195458 - RNA, 20 nt, Human
auuccucagccccagccuca

SEQ ID NO: 195459 - RNA, 22 nt, Human
ucugucaucuguaacaggaggg

SEQ ID NO: 195460 - RNA, 22 nt, Human
augcuucuguguauguuucagg

SEQ ID NO: 195461 - RNA, 22 nt, Human
ucagaggaagccuuggugggag

SEQ ID NO: 195462 - RNA, 17 nt, Human
gcuccuucuaacuucca

SEQ ID NO: 195463 - RNA, 20 nt, Human
ugcagaagaacguucugguu

SEQ ID NO: 195464 - RNA, 22 nt, Human
cauaaacucucuguaccaauau

SEQ ID NO: 195465 - RNA, 22 nt, Human
aauuucagauauuaaagaauga

SEQ ID NO: 195466 - RNA, 22 nt, Human
ucccaagcaaugagucagggcc

SEQ ID NO: 195467 - RNA, 21 nt, Human
gcccagagggagccaagccca

SEQ ID NO: 195468 - RNA, 22 nt, Human
gcuguucaagacuaggaaauuu

SEQ ID NO: 195469 - RNA, 22 nt, Human
uucuucuugucugcccucacau

SEQ ID NO: 195470 - RNA, 22 nt, Human
aaggaggcacucgcucucaggg

SEQ ID NO: 195471 - RNA, 22 nt, Human
cugaccagaccccaggaggcug

SEQ ID NO: 195472 - RNA, 22 nt, Human
cugcugugggcaggguagcugg

SEQ ID NO: 195473 - RNA, 22 nt, Human
gggcucuggauggagccugcag

SEQ ID NO: 195474 - RNA, 22 nt, Human
aaauaaucaauuuuuguagaua

SEQ ID NO: 195475 - RNA, 22 nt, Human
agcaagauuuuucagguuagua

SEQ ID NO: 195476 - RNA, 22 nt, Human
cccaggccccagggcuugucag

SEQ ID NO: 195477 - RNA, 18 nt, Human
acaaaggucugcaagacc

SEQ ID NO: 195478 - RNA, 22 nt, Human
agagucuuuugucaguaauguu

SEQ ID NO: 195479 - RNA, 22 nt, Human
aagccaggccauucucugguuc

SEQ ID NO: 195480 - RNA, 22 nt, Human
guuuccugacuguggaauuaua

SEQ ID NO: 195481 - RNA, 20 nt, Human
cccaggagcugugccccauc

SEQ ID NO: 195482 - RNA, 22 nt, Human
cuuuggaagccaggcaguucac

SEQ ID NO: 195483 - RNA, 22 nt, Human
gaaaaggcucucacucccuccg

SEQ ID NO: 195484 - RNA, 22 nt, Human
cccaggagaccugugaaaggac

SEQ ID NO: 195485 - RNA, 19 nt, Human
cauuuucucauugugcccc

SEQ ID NO: 195486 - RNA, 20 nt, Human
uccaggcagacagcuauggg

SEQ ID NO: 195487 - RNA, 22 nt, Human
gggaggaaggcuugggugagua

SEQ ID NO: 195488 - RNA, 22 nt, Human
uggcauuuuccaaugauauguu

SEQ ID NO: 195489 - RNA, 22 nt, Human
uuggaauuccuguuguuucguc

SEQ ID NO: 195490 - RNA, 22 nt, Human
agugaaauugcuguaagaggaa

SEQ ID NO: 195491 - RNA, 22 nt, Human
uguggggccucgugcuagcugg

SEQ ID NO: 195492 - RNA, 22 nt, Human
caucucaugggcaugccaagcu

SEQ ID NO: 195493 - RNA, 23 nt, Human
auaaacugucaaaagccagcccu

SEQ ID NO: 195494 - RNA, 22 nt, Human
ggcaucaguauggccauagggu

SEQ ID NO: 195495 - RNA, 22 nt, Human
aaaugcagguaguauuuauuuu

SEQ ID NO: 195496 - RNA, 22 nt, Human
cuguugucuucauugucauauc

SEQ ID NO: 195497 - RNA, 22 nt, Human
uugacuucagccuguacuugua

SEQ ID NO: 195498 - RNA, 22 nt, Human
cuccacagcucaggcucagagu

SEQ ID NO: 195499 - RNA, 22 nt, Human
aggccucagcucagugugacag

SEQ ID NO: 195500 - RNA, 22 nt, Human
gaaaggagaggguuaaggagcu

SEQ ID NO: 195501 - RNA, 19 nt, Human
ccagucccauacaggagau

SEQ ID NO: 195502 - RNA, 22 nt, Human
uucucuguaguugccuggugga

SEQ ID NO: 195503 - RNA, 22 nt, Human
uuccaaaguuaguuauuagaaa

SEQ ID NO: 195504 - RNA, 22 nt, Human
cuacagucuggcaggaauguua

SEQ ID NO: 195505 - RNA, 22 nt, Human
cauaauccuguccuggauucuu

SEQ ID NO: 195506 - RNA, 22 nt, Human
ugcaaauguguggugaggcauu

SEQ ID NO: 195507 - RNA, 22 nt, Human
ugggaggaucgcuugagcccag

SEQ ID NO: 195508 - RNA, 22 nt, Human
gguaagcacuucauguacauga

SEQ ID NO: 195509 - RNA, 22 nt, Human
agucugugugaaugugggcuuu

SEQ ID NO: 195510 - RNA, 22 nt, Human
cuuguucaguugccucuccugc

SEQ ID NO: 195511 - RNA, 22 nt, Human
agccucuguagaaagcagugug

SEQ ID NO: 195512 - RNA, 22 nt, Human
aauuagaguggcgagugauuua

SEQ ID NO: 195513 - RNA, 22 nt, Human
uucacaaacuucaugauggcac

SEQ ID NO: 195514 - RNA, 21 nt, Human
auucaacuagaugauuauuuc

SEQ ID NO: 195515 - RNA, 22 nt, Human
cugccuguuuccucuugcuccc

SEQ ID NO: 195516 - RNA, 22 nt, Human
ggcugccucagauuugcugacu

SEQ ID NO: 195517 - RNA, 22 nt, Human
ucuucuuccucauuuauacaua

SEQ ID NO: 195518 - RNA, 22 nt, Human
uggaggaaguggcuggccagaa

SEQ ID NO: 195519 - RNA, 22 nt, Human
gaaggcugagcagacaggccaa

SEQ ID NO: 195520 - RNA, 22 nt, Human
guccugaggcaggauggguuuc

SEQ ID NO: 195521 - RNA, 22 nt, Human
cauauucuuuaagcaaugcucu

SEQ ID NO: 195522 - RNA, 22 nt, Human
acccagaggugucuagcaagcu

SEQ ID NO: 195523 - RNA, 22 nt, Human
aacaggcagcagacugaaucug

SEQ ID NO: 195524 - RNA, 22 nt, Human
gggaaacucacaggugcagggg

SEQ ID NO: 195525 - RNA, 22 nt, Human
ggugagcacugcccugggucuc

SEQ ID NO: 195526 - RNA, 22 nt, Human
gcccaugggccugaggcccuag

SEQ ID NO: 195527 - RNA, 23 nt, Human
ugggucucuaguacaggcaggca

SEQ ID NO: 195528 - RNA, 22 nt, Human
ccuuggagaccugggucugugc

SEQ ID NO: 195529 - RNA, 22 nt, Human
gcccaguaguucaagguugcag

SEQ ID NO: 195530 - RNA, 22 nt, Human
acaggccuggguucaaauuugg

SEQ ID NO: 195531 - RNA, 22 nt, Human
gaguccuuuguuccuugccaca

SEQ ID NO: 195532 - RNA, 22 nt, Human
uguucucucuccuuuugaagug

SEQ ID NO: 195533 - RNA, 20 nt, Human
ggggcagguuuuuauggcua

SEQ ID NO: 195534 - RNA, 22 nt, Human
uucuuacagauuuggugaauga

SEQ ID NO: 195535 - RNA, 22 nt, Human
ucaguuaagacugcacuggacu

SEQ ID NO: 195536 - RNA, 22 nt, Human
gggcucugagcucugggaauua

SEQ ID NO: 195537 - RNA, 22 nt, Human
agacaauggagggaaauacuuc

SEQ ID NO: 195538 - RNA, 22 nt, Human
aauaagaacuugucucuggcag

SEQ ID NO: 195539 - RNA, 19 nt, Human
aguguucugaguacuccuc

SEQ ID NO: 195540 - RNA, 20 nt, Human
agcaggaaaagugccagucu

SEQ ID NO: 195541 - RNA, 22 nt, Human
uuuacuguuacaccuaccuucu

SEQ ID NO: 195542 - RNA, 22 nt, Human
aaaccauugcaucuuucuuaau

SEQ ID NO: 195543 - RNA, 22 nt, Human
caggcugcggccgugugagcau

SEQ ID NO: 195544 - RNA, 23 nt, Human
ugaaacauuuaggguagaauuuc

SEQ ID NO: 195545 - RNA, 22 nt, Human
aucaacaugaauuucucugaag

SEQ ID NO: 195546 - RNA, 22 nt, Human
auugcaaagcauugugagcgca

SEQ ID NO: 195547 - RNA, 22 nt, Human
ugaggaagggugugacggcacc

SEQ ID NO: 195548 - RNA, 22 nt, Human
cuggugagacucagggaugcuu

SEQ ID NO: 195549 - RNA, 22 nt, Human
aggcugugcaauuaggguaaga

SEQ ID NO: 195550 - RNA, 22 nt, Human
cucaggccauucuuccagcugc

SEQ ID NO: 195551 - RNA, 22 nt, Human
aguuacaucuguuauguguguu

SEQ ID NO: 195552 - RNA, 22 nt, Human
ggguggaagccagagaggucau

SEQ ID NO: 195553 - RNA, 22 nt, Human
cucaugucaggggugucaaugu

SEQ ID NO: 195554 - RNA, 22 nt, Human
uucaagaaagaguggcuauucc

SEQ ID NO: 195555 - RNA, 22 nt, Human
auacacauuacuuucugucuga

SEQ ID NO: 195556 - RNA, 23 nt, Human
uuuuaauuuggacauaagaagau

SEQ ID NO: 195557 - RNA, 22 nt, Human
cgggcuccgggucuuugcaguc

SEQ ID NO: 195558 - RNA, 22 nt, Human
gcaaauacauguugagcaccua

SEQ ID NO: 195559 - RNA, 22 nt, Human
ucauuuucaaguuugaacagga

SEQ ID NO: 195560 - RNA, 22 nt, Human
uggcuacauuuauacucucauu

SEQ ID NO: 195561 - RNA, 22 nt, Human
aguguguucucaaugaaaagaa

SEQ ID NO: 195562 - RNA, 22 nt, Human
gcagacaauuuauuagcagauu

SEQ ID NO: 195563 - RNA, 22 nt, Human
aauuucaaacuaauaggaacca

SEQ ID NO: 195564 - RNA, 22 nt, Human
ggacccugggcucugggccuau

SEQ ID NO: 195565 - RNA, 22 nt, Human
uuugcaguagacaucuuauuuu

SEQ ID NO: 195566 - RNA, 22 nt, Human
uacuacauacagaauuuagaga

SEQ ID NO: 195567 - RNA, 22 nt, Human
cucccagagaccaagcugagaa

SEQ ID NO: 195568 - RNA, 22 nt, Human
aaugguuucaaacacacuaagu

SEQ ID NO: 195569 - RNA, 22 nt, Human
caggaaacaaagccuugcucau

SEQ ID NO: 195570 - RNA, 22 nt, Human
cuuuggaaguaaagucagcagg

SEQ ID NO: 195571 - RNA, 22 nt, Human
gcucuggaagcaucugagagga

SEQ ID NO: 195572 - RNA, 19 nt, Human
ccaacaguacugaagcacu

SEQ ID NO: 195573 - RNA, 17 nt, Human
aggccagaugaggcaag

SEQ ID NO: 195574 - RNA, 22 nt, Human
caagauggagaagcagcaaggg

SEQ ID NO: 195575 - RNA, 22 nt, Human
cacuugauguugucacuauugc

SEQ ID NO: 195576 - RNA, 22 nt, Human
aggcucagggacucccucccuc

SEQ ID NO: 195577 - RNA, 20 nt, Human
agauuauuccuaagauuucu

SEQ ID NO: 195578 - RNA, 18 nt, Human
gggaagaggaucuggccc

SEQ ID NO: 195579 - RNA, 20 nt, Human
uugcugggaccuuuuucaac

SEQ ID NO: 195580 - RNA, 22 nt, Human
acaagacugugcucuaagagug

SEQ ID NO: 195581 - RNA, 22 nt, Human
gacuuuauuauaguggcaauag

SEQ ID NO: 195582 - RNA, 22 nt, Human
ugcugagggagcaucaaagaaa

SEQ ID NO: 195583 - RNA, 22 nt, Human
uugccuggagggacauggagac

SEQ ID NO: 195584 - RNA, 22 nt, Human
uucuaagucacucagauuuugg

SEQ ID NO: 195585 - RNA, 22 nt, Human
agggcagccugagugcuggccc

SEQ ID NO: 195586 - RNA, 22 nt, Human
gcucaaaucccagcgggcuccu

SEQ ID NO: 195587 - RNA, 22 nt, Human
ccugcuggccaguggagggcug

SEQ ID NO: 195588 - RNA, 20 nt, Human
agggccuggaguacagcagg

SEQ ID NO: 195589 - RNA, 22 nt, Human
uccccagguccugucggcuccu

SEQ ID NO: 195590 - RNA, 22 nt, Human
uagggcugccauuugcuuuucu

SEQ ID NO: 195591 - RNA, 22 nt, Human
gucucagauucagacaucuaca

SEQ ID NO: 195592 - RNA, 22 nt, Human
gccugagccgccugagcggcgg

SEQ ID NO: 195593 - RNA, 22 nt, Human
cagucccagaagagccugggag

SEQ ID NO: 195594 - RNA, 22 nt, Human
uuucaugccucuugagaaagau

SEQ ID NO: 195595 - RNA, 22 nt, Human
ggcuccaggagaugcugggcag

SEQ ID NO: 195596 - RNA, 22 nt, Human
cugacuuugcucauaggucaaa

SEQ ID NO: 195597 - RNA, 22 nt, Human
cucuguggcuugccuuucuguc

SEQ ID NO: 195598 - RNA, 22 nt, Human
agggucagugaugagggagccc

SEQ ID NO: 195599 - RNA, 22 nt, Human
auggagauuuuuagaauuacag

SEQ ID NO: 195600 - RNA, 22 nt, Human
caugcaggugaccagguguggg

SEQ ID NO: 195601 - RNA, 23 nt, Human
acaguuauagcugugaauaacau

SEQ ID NO: 195602 - RNA, 22 nt, Human
uuucauguggcgaugucucugg

SEQ ID NO: 195603 - RNA, 22 nt, Human
ucaggcuuccaggcucugcuga

SEQ ID NO: 195604 - RNA, 22 nt, Human
agacgagggcccccaggacagc

SEQ ID NO: 195605 - RNA, 22 nt, Human
ugcuucucaaaaggagguaggu

SEQ ID NO: 195606 - RNA, 22 nt, Human
cagcuguggagggaggaaaugc

SEQ ID NO: 195607 - RNA, 22 nt, Human
uuugaaaggaaguuaauacuuu

SEQ ID NO: 195608 - RNA, 22 nt, Human
aacacagggcagcugcugggaa

SEQ ID NO: 195609 - RNA, 22 nt, Human
uugucugugaaauggaaauagu

SEQ ID NO: 195610 - RNA, 18 nt, Human
uggacaggguggagaaaa

SEQ ID NO: 195611 - RNA, 22 nt, Human
acauucaaaaagcaucugucac

SEQ ID NO: 195612 - RNA, 22 nt, Human
ccaggguggcguagaugcuggg

SEQ ID NO: 195613 - RNA, 22 nt, Human
ucucaguguuaucuaucugccu

SEQ ID NO: 195614 - RNA, 20 nt, Human
cuccaguguucaggggagug

SEQ ID NO: 195615 - RNA, 22 nt, Human
acucaucagccucuaggaaaga

SEQ ID NO: 195616 - RNA, 18 nt, Human
uccuaacuuagauacucc

SEQ ID NO: 195617 - RNA, 22 nt, Human
acaggugucuaaggcagacagc

SEQ ID NO: 195618 - RNA, 22 nt, Human
cccaggaccgcgcggcugagcg

SEQ ID NO: 195619 - RNA, 22 nt, Human
uccaagucuuccuucccaaacc

SEQ ID NO: 195620 - RNA, 22 nt, Human
aggcagggucuugcuauguugc

SEQ ID NO: 195621 - RNA, 22 nt, Human
aguuuccaaagcauguucacac

SEQ ID NO: 195622 - RNA, 22 nt, Human
guuuagaauggcaaaauuaagu

SEQ ID NO: 195623 - RNA, 22 nt, Human
uuuacagaugaggauacugagg

SEQ ID NO: 195624 - RNA, 22 nt, Human
cacauuuagagguuagcauggu

SEQ ID NO: 195625 - RNA, 22 nt, Human
acagaaaugauguuuggcaaua

SEQ ID NO: 195626 - RNA, 22 nt, Human
agaggcggagcuugcagugagc

SEQ ID NO: 195627 - RNA, 22 nt, Human
cagaaguuugacauguuuagcu

SEQ ID NO: 195628 - RNA, 22 nt, Human
auauucacaguaaguguagcag

SEQ ID NO: 195629 - RNA, 22 nt, Human
cuccccuucuugccagauccuu

SEQ ID NO: 195630 - RNA, 22 nt, Human
cagcuuuaguaacccacugcuc

SEQ ID NO: 195631 - RNA, 22 nt, Human
caggaagucgcagagcuggggg

SEQ ID NO: 195632 - RNA, 22 nt, Human
auauuuaaacaggguaccaaua

SEQ ID NO: 195633 - RNA, 22 nt, Human
uuguuucucuggucuugaguga

SEQ ID NO: 195634 - RNA, 22 nt, Human
gcuuuuccugacuuuccauuag

SEQ ID NO: 195635 - RNA, 22 nt, Human
uguauguaugcaucuuuuaugu

SEQ ID NO: 195636 - RNA, 22 nt, Human
uacauaguauucacauuguuuu

SEQ ID NO: 195637 - RNA, 21 nt, Human
agcacagcuuuaagccaugug

SEQ ID NO: 195638 - RNA, 22 nt, Human
gcugcagagacagcugccgaug

SEQ ID NO: 195639 - RNA, 22 nt, Human
agcaggcugccuuccaaagccu

SEQ ID NO: 195640 - RNA, 22 nt, Human
caauacugaguuuacauucauc

SEQ ID NO: 195641 - RNA, 18 nt, Human
agcugguggggagacagc

SEQ ID NO: 195642 - RNA, 22 nt, Human
uugcaaaggggaauaaagcaau

SEQ ID NO: 195643 - RNA, 22 nt, Human
acacauuugcauaauaccucau

SEQ ID NO: 195644 - RNA, 22 nt, Human
gcccuccagcuguugcgcgucg

SEQ ID NO: 195645 - RNA, 22 nt, Human
gaagcaguauccugacagcacc

SEQ ID NO: 195646 - RNA, 22 nt, Human
aaggaggaauguagccagcucc

SEQ ID NO: 195647 - RNA, 22 nt, Human
uagauaaaagggcaaagggcau

SEQ ID NO: 195648 - RNA, 22 nt, Human
uaugucacauuguaacagugug

SEQ ID NO: 195649 - RNA, 22 nt, Human
agaaauguggaucguuuuaaaa

SEQ ID NO: 195650 - RNA, 22 nt, Human
gcacacauucggauucuuaacc

SEQ ID NO: 195651 - RNA, 22 nt, Human
cuuggcccaguugccaaggaaa

SEQ ID NO: 195652 - RNA, 22 nt, Human
ggcccugcgauuagguggcagg

SEQ ID NO: 195653 - RNA, 22 nt, Human
agggcagcagcugucccugaga

SEQ ID NO: 195654 - RNA, 22 nt, Human
cuuucagagguuacucaggaaa

SEQ ID NO: 195655 - RNA, 22 nt, Human
cagcuuugugcaaugcagucuc

SEQ ID NO: 195656 - RNA, 22 nt, Human
aaagacagagcuguaggggaaa

SEQ ID NO: 195657 - RNA, 22 nt, Human
ccucagucuauuuccagcaggu

SEQ ID NO: 195658 - RNA, 22 nt, Human
caguguuucugaguuccagcuc

SEQ ID NO: 195659 - RNA, 22 nt, Human
aagucuguuugagugucacacu

SEQ ID NO: 195660 - RNA, 22 nt, Human
aagucguggcaggcuugcacga

SEQ ID NO: 195661 - RNA, 22 nt, Human
ucuucauguauacucaugguac

SEQ ID NO: 195662 - RNA, 23 nt, Human
acacauauauucagauacagaug

SEQ ID NO: 195663 - RNA, 22 nt, Human
aggccuggcuuugguuugcuga

SEQ ID NO: 195664 - RNA, 22 nt, Human
gggcuucuguaccuaccuggaa

SEQ ID NO: 195665 - RNA, 22 nt, Human
auuggaauggcuuugcaugucc

SEQ ID NO: 195666 - RNA, 19 nt, Human
ugggcuuccccagggcaga

SEQ ID NO: 195667 - RNA, 22 nt, Human
gaugagcugugauuaauaagua

SEQ ID NO: 195668 - RNA, 22 nt, Human
ugccugucucugacugccauua

SEQ ID NO: 195669 - RNA, 22 nt, Human
ggcucccuggcccuggggacac

SEQ ID NO: 195670 - RNA, 22 nt, Human
acacagcucagugccuccaaga

SEQ ID NO: 195671 - RNA, 22 nt, Human
ggcuucugaaaucucugugcgu

SEQ ID NO: 195672 - RNA, 22 nt, Human
aaugcaaugcagcaccuccuug

SEQ ID NO: 195673 - RNA, 22 nt, Human
aaagugccuucuauuuuaguga

SEQ ID NO: 195674 - RNA, 22 nt, Human
auucucagcuuucaaauagaca

SEQ ID NO: 195675 - RNA, 22 nt, Human
aaagacauuagcuuagauguca

SEQ ID NO: 195676 - RNA, 22 nt, Human
cuuuuucuaaucauaauugucu

SEQ ID NO: 195677 - RNA, 22 nt, Human
accaggccaaaaucauauuuac

SEQ ID NO: 195678 - RNA, 22 nt, Human
ugcggaaggcagcgcagggugg

SEQ ID NO: 195679 - RNA, 22 nt, Human
cacccacauuccucuaguaugu

SEQ ID NO: 195680 - RNA, 22 nt, Human
cucucagaagcuuccaguaugg

SEQ ID NO: 195681 - RNA, 22 nt, Human
gcugauuuugagaagcacaguc

SEQ ID NO: 195682 - RNA, 22 nt, Human
aaagccaugggucuuuggcaua

SEQ ID NO: 195683 - RNA, 22 nt, Human
ugucccugauccacuggacccc

SEQ ID NO: 195684 - RNA, 22 nt, Human
ucugucugccuugugagggcac

SEQ ID NO: 195685 - RNA, 22 nt, Human
gcccugagccaccaaugccauu

SEQ ID NO: 195686 - RNA, 23 nt, Human
agccuucaggcaaugucaguaga

SEQ ID NO: 195687 - RNA, 22 nt, Human
cucagagagggcaccagggcca

SEQ ID NO: 195688 - RNA, 22 nt, Human
ucaggaaauuaaacacuugaaa

SEQ ID NO: 195689 - RNA, 22 nt, Human
gaccauuuuuacagagcauuca

SEQ ID NO: 195690 - RNA, 22 nt, Human
guuuauaugugugccacucuua

SEQ ID NO: 195691 - RNA, 22 nt, Human
gaauaauauugacuuugcaggc

SEQ ID NO: 195692 - RNA, 22 nt, Human
ugcuuugugacagauuaguuuu

SEQ ID NO: 195693 - RNA, 22 nt, Human
uucaguuucuaaaugcuccucu

SEQ ID NO: 195694 - RNA, 22 nt, Human
gagaugguugcaauaguuuaaa

SEQ ID NO: 195695 - RNA, 22 nt, Human
ggcucugccucugacccucugg

SEQ ID NO: 195696 - RNA, 22 nt, Human
uggcucagcuuuccccaucugg

SEQ ID NO: 195697 - RNA, 22 nt, Human
ggugaaggcacaagagggcaag

SEQ ID NO: 195698 - RNA, 22 nt, Human
uugcagaacuuaaagacagagu

SEQ ID NO: 195699 - RNA, 22 nt, Human
ugcucaguauagaaaaugauau

SEQ ID NO: 195700 - RNA, 22 nt, Human
cccuguacagucucuguggcac

SEQ ID NO: 195701 - RNA, 22 nt, Human
aaguuacauaaauguccucuag

SEQ ID NO: 195702 - RNA, 22 nt, Human
cccuagggcuaagcaggacugc

SEQ ID NO: 195703 - RNA, 22 nt, Human
ucuguggcuugggccugccugu

SEQ ID NO: 195704 - RNA, 22 nt, Human
aggaccagaccgaacuagcuaa

SEQ ID NO: 195705 - RNA, 22 nt, Human
aaacaagcugcagacaagccau

SEQ ID NO: 195706 - RNA, 22 nt, Human
uuucagaagucacaguugacug

SEQ ID NO: 195707 - RNA, 22 nt, Human
acauuucuuucuauucaguagc

SEQ ID NO: 195708 - RNA, 22 nt, Human
uucucacaauucuuguauuugc

SEQ ID NO: 195709 - RNA, 22 nt, Human
ucuggcagugaagucaugaggu

SEQ ID NO: 195710 - RNA, 22 nt, Human
ucugggcucugucagcaccucu

SEQ ID NO: 195711 - RNA, 22 nt, Human
uggcccagacucugcucuuauc

SEQ ID NO: 195712 - RNA, 22 nt, Human
ccagagcccgggaccuggacuu

SEQ ID NO: 195713 - RNA, 22 nt, Human
ccagguguagcacugcucacag

SEQ ID NO: 195714 - RNA, 22 nt, Human
uagcaaccuauggauagagaag

SEQ ID NO: 195715 - RNA, 19 nt, Human
uuguacagcaaccaacccu

SEQ ID NO: 195716 - RNA, 23 nt, Human
agcucaaggcaguccacauuucc

SEQ ID NO: 195717 - RNA, 22 nt, Human
gguaccaccaauucagcugcca

SEQ ID NO: 195718 - RNA, 22 nt, Human
agcuaacaugacuagaagcuuc

SEQ ID NO: 195719 - RNA, 22 nt, Human
ccucuccccucccaaggcggga

SEQ ID NO: 195720 - RNA, 16 nt, Human
gucuuuauucacuuag

SEQ ID NO: 195721 - RNA, 22 nt, Human
guucuuaagaccacaauaaaaa

SEQ ID NO: 195722 - RNA, 22 nt, Human
caggacuggcucgcagugggug

SEQ ID NO: 195723 - RNA, 22 nt, Human
uacaaauuaaugggcauguuua

SEQ ID NO: 195724 - RNA, 22 nt, Human
uucuaagucugcugucuucauc

SEQ ID NO: 195725 - RNA, 22 nt, Human
cagugggauugggauuggaacc

SEQ ID NO: 195726 - RNA, 22 nt, Human
gaaugcuauuauuucugugugu

SEQ ID NO: 195727 - RNA, 22 nt, Human
cauuucaaugccuucaacauag

SEQ ID NO: 195728 - RNA, 22 nt, Human
gaaccucuuuagugcauccuuc

SEQ ID NO: 195729 - RNA, 22 nt, Human
uguggggcuuacaaaggcagau

SEQ ID NO: 195730 - RNA, 22 nt, Human
gggcaggugaccucuuguccug

SEQ ID NO: 195731 - RNA, 22 nt, Human
gugcugagcugcagaugcgcuc

SEQ ID NO: 195732 - RNA, 22 nt, Human
ugucaauaacauuuacuucuau

SEQ ID NO: 195733 - RNA, 22 nt, Human
uguccagcggccuggcugcuga

SEQ ID NO: 195734 - RNA, 22 nt, Human
ucaguccaggggcugugauguc

SEQ ID NO: 195735 - RNA, 22 nt, Human
aagggcucugcugucucucccc

SEQ ID NO: 195736 - RNA, 22 nt, Human
ggcuccuggcaucuggugggua

SEQ ID NO: 195737 - RNA, 22 nt, Human
cagaugcuucgugggugagcac

SEQ ID NO: 195738 - RNA, 22 nt, Human
uccaugagacagauacuguaag

SEQ ID NO: 195739 - RNA, 22 nt, Human
ugguggggcuuuccuucugcuu

SEQ ID NO: 195740 - RNA, 22 nt, Human
ccaggaggugcuggaagaaagc

SEQ ID NO: 195741 - RNA, 22 nt, Human
aaauaucauucuggugcacaga

SEQ ID NO: 195742 - RNA, 22 nt, Human
acuucccauuucucugcuuuag

SEQ ID NO: 195743 - RNA, 22 nt, Human
acuuccuugucaggugcaucau

SEQ ID NO: 195744 - RNA, 22 nt, Human
ucuggccacuaauaggucucac

SEQ ID NO: 195745 - RNA, 22 nt, Human
acuggcagugucguuuacauga

SEQ ID NO: 195746 - RNA, 22 nt, Human
ugaaaucuccucuuuauauauc

SEQ ID NO: 195747 - RNA, 22 nt, Human
ugaggggcagagagguguccag

SEQ ID NO: 195748 - RNA, 22 nt, Human
cuccuccacagaguccuugcca

SEQ ID NO: 195749 - RNA, 22 nt, Human
uaacaguugguguaauuucuug

SEQ ID NO: 195750 - RNA, 22 nt, Human
uugagauggagucucacucugu

SEQ ID NO: 195751 - RNA, 22 nt, Human
ucugucugacuaccaugaggca

SEQ ID NO: 195752 - RNA, 22 nt, Human
gcuccaggcagcauaguggaug

SEQ ID NO: 195753 - RNA, 22 nt, Human
ugagaugaauaacuccugcuaa

SEQ ID NO: 195754 - RNA, 19 nt, Human
aggguccaggcccugugga

SEQ ID NO: 195755 - RNA, 22 nt, Human
auggacauuugaguuauuucca

SEQ ID NO: 195756 - RNA, 22 nt, Human
ugaagggcaaccccaggcccag

SEQ ID NO: 195757 - RNA, 22 nt, Human
ugucuucagcaaaugccuuucu

SEQ ID NO: 195758 - RNA, 22 nt, Human
acacaggcauagccauacaugu

SEQ ID NO: 195759 - RNA, 22 nt, Human
aagagacaugaauacucgaagg

SEQ ID NO: 195760 - RNA, 22 nt, Human
acuucaugaacauguggccugu

SEQ ID NO: 195761 - RNA, 22 nt, Human
auuugcuucugcuaaacaacuu

SEQ ID NO: 195762 - RNA, 22 nt, Human
uagcuguccagugagucccuuu

SEQ ID NO: 195763 - RNA, 17 nt, Human
gccugcaggcccgcaga

SEQ ID NO: 195764 - RNA, 22 nt, Human
aaagccaguuugucucuuuaaa

SEQ ID NO: 195765 - RNA, 22 nt, Human
agcacuguggggaacucacaga

SEQ ID NO: 195766 - RNA, 22 nt, Human
acacauauauuauuuguggcuc

SEQ ID NO: 195767 - RNA, 22 nt, Human
ugaacuuucacaagaauaugcu

SEQ ID NO: 195768 - RNA, 22 nt, Human
uggagggcgcuuagauggaggg

SEQ ID NO: 195769 - RNA, 22 nt, Human
gcaggaguucaauugcccauga

SEQ ID NO: 195770 - RNA, 22 nt, Human
aauguuaauguguuugcuuaug

SEQ ID NO: 195771 - RNA, 22 nt, Human
agcuggcuuugagcugggaggu

SEQ ID NO: 195772 - RNA, 22 nt, Human
gggacuucauagcuaggcacuu

SEQ ID NO: 195773 - RNA, 22 nt, Human
aagcaagaggaaauguggaccu

SEQ ID NO: 195774 - RNA, 22 nt, Human
cacuugaaugagaauuuccugg

SEQ ID NO: 195775 - RNA, 23 nt, Human
aggcagcagguuguccaggguga

SEQ ID NO: 195776 - RNA, 22 nt, Human
aagugauuucugccugcauguu

SEQ ID NO: 195777 - RNA, 19 nt, Human
agugagcauccagagaggu

SEQ ID NO: 195778 - RNA, 22 nt, Human
ccucugcucugguccaugugcu

SEQ ID NO: 195779 - RNA, 22 nt, Human
uccugcagaccucagucagguc

SEQ ID NO: 195780 - RNA, 22 nt, Human
auuuuagagcuccaaguacagc

SEQ ID NO: 195781 - RNA, 22 nt, Human
gaauuucagaucagagaccauu

SEQ ID NO: 195782 - RNA, 22 nt, Human
caggaaguagaguuggccagcc

SEQ ID NO: 195783 - RNA, 22 nt, Human
uccuggaggagauccaaucuga

SEQ ID NO: 195784 - RNA, 21 nt, Human
ugaaacagauggaaguauuug

SEQ ID NO: 195785 - RNA, 22 nt, Human
acacauuuucuaacagggauca

SEQ ID NO: 195786 - RNA, 22 nt, Human
uacuguuagagcgauuuguccu

SEQ ID NO: 195787 - RNA, 22 nt, Human
uugcuuuauuccuagcccuugu

SEQ ID NO: 195788 - RNA, 22 nt, Human
aggagcccagccugggcucgga

SEQ ID NO: 195789 - RNA, 22 nt, Human
gccaccuccuuauuccaccugu

SEQ ID NO: 195790 - RNA, 22 nt, Human
accuaaaucuaccucauguuuu

SEQ ID NO: 195791 - RNA, 22 nt, Human
cagagucaguauugaauugaaa

SEQ ID NO: 195792 - RNA, 22 nt, Human
aucuccagaugccuggaaauga

SEQ ID NO: 195793 - RNA, 22 nt, Human
uugcuuuaggauuuaaguggca

SEQ ID NO: 195794 - RNA, 22 nt, Human
aauuauauguuaaucuucaauu

SEQ ID NO: 195795 - RNA, 22 nt, Human
caguccagccaguagggugugg

SEQ ID NO: 195796 - RNA, 22 nt, Human
gagacaggcagcuaguggguca

SEQ ID NO: 195797 - RNA, 22 nt, Human
uugaauaauuaauuacacucag

SEQ ID NO: 195798 - RNA, 22 nt, Human
aggcaggugcuuaugacuugcu

SEQ ID NO: 195799 - RNA, 22 nt, Human
aaguuacaguuacagaauggag

SEQ ID NO: 195800 - RNA, 22 nt, Human
uccaggauugcaggugcacaac

SEQ ID NO: 195801 - RNA, 22 nt, Human
uggcuccaggggacacgcagua

SEQ ID NO: 195802 - RNA, 22 nt, Human
cuguuuauuacguaauuaauau

SEQ ID NO: 195803 - RNA, 18 nt, Human
caugucugcgccacaagg

SEQ ID NO: 195804 - RNA, 22 nt, Human
uagcauaauuuguagaaaauca

SEQ ID NO: 195805 - RNA, 22 nt, Human
aaggaacuuggugcccgugccc

SEQ ID NO: 195806 - RNA, 22 nt, Human
aauuucagagguagagauucua

SEQ ID NO: 195807 - RNA, 22 nt, Human
acagggcagagggcaguuggua

SEQ ID NO: 195808 - RNA, 22 nt, Human
agggccagaugaagccacaagc

SEQ ID NO: 195809 - RNA, 22 nt, Human
gcagggugacguugcccaccuc

SEQ ID NO: 195810 - RNA, 22 nt, Human
ccacagcugaccgcaggugagc

SEQ ID NO: 195811 - RNA, 22 nt, Human
aucagaaaucuaggauucagaa

SEQ ID NO: 195812 - RNA, 22 nt, Human
uuccuagggcagagccgcuggg

SEQ ID NO: 195813 - RNA, 22 nt, Human
ccagagaaagcucacaggcagu

SEQ ID NO: 195814 - RNA, 22 nt, Human
cugggcucuucccagauccaga

SEQ ID NO: 195815 - RNA, 22 nt, Human
gaaagcugaaccaggaaccaug

SEQ ID NO: 195816 - RNA, 22 nt, Human
uacaguaaccuuauuugucauu

SEQ ID NO: 195817 - RNA, 22 nt, Human
cuucaggauuuaggaagaugaa

SEQ ID NO: 195818 - RNA, 23 nt, Human
uggucucagccugugagagcuga

SEQ ID NO: 195819 - RNA, 22 nt, Human
gcuggcucugccccaccuguuc

SEQ ID NO: 195820 - RNA, 22 nt, Human
ggagagagaugccgccuugcuc

SEQ ID NO: 195821 - RNA, 22 nt, Human
ucucuggccccauggcugagcu

SEQ ID NO: 195822 - RNA, 22 nt, Human
ucagugauuucuggggugaggg

SEQ ID NO: 195823 - RNA, 22 nt, Human
cccuuagaauuuuguaguuauu

SEQ ID NO: 195824 - RNA, 22 nt, Human
auggcuggugauacuggaguga

SEQ ID NO: 195825 - RNA, 22 nt, Human
aucauucagccuaagcaaguac

SEQ ID NO: 195826 - RNA, 22 nt, Human
ucuuccucaugaauucucguau

SEQ ID NO: 195827 - RNA, 22 nt, Human
ugugcucuucuguuacuuguag

SEQ ID NO: 195828 - RNA, 22 nt, Human
agguaaaauagauaguauuucu

SEQ ID NO: 195829 - RNA, 22 nt, Human
cugggaaauggcuucgagcuca

SEQ ID NO: 195830 - RNA, 21 nt, Human
ugguccuucuuuacugccucc

SEQ ID NO: 195831 - RNA, 22 nt, Human
aaagaguucacggaggccaaag

SEQ ID NO: 195832 - RNA, 20 nt, Human
auguaaaagacagggaguag

SEQ ID NO: 195833 - RNA, 22 nt, Human
aauaauacuucguaaaguuguu

SEQ ID NO: 195834 - RNA, 22 nt, Human
cugcugugcagacagacucucu

SEQ ID NO: 195835 - RNA, 22 nt, Human
cuugacuuugccuuuuaaaugu

SEQ ID NO: 195836 - RNA, 22 nt, Human
ugcuggggcagaagagccaaga

SEQ ID NO: 195837 - RNA, 22 nt, Human
ucagcaaaggaccagcacaggc

SEQ ID NO: 195838 - RNA, 22 nt, Human
cugccugcaggacaccucgcua

SEQ ID NO: 195839 - RNA, 22 nt, Human
cauagaaaucaggugagaaucu

SEQ ID NO: 195840 - RNA, 22 nt, Human
gucuagaaaaugccgagggaug

SEQ ID NO: 195841 - RNA, 22 nt, Human
uggcugaggucuggggcuucug

SEQ ID NO: 195842 - RNA, 22 nt, Human
ggcccagcaucuugugaaguuu

SEQ ID NO: 195843 - RNA, 22 nt, Human
agaacacugcuaguauaaucac

SEQ ID NO: 195844 - RNA, 22 nt, Human
gcuccuggagagauugagaaag

SEQ ID NO: 195845 - RNA, 22 nt, Human
ucuauauuuugaaagguauuua

SEQ ID NO: 195846 - RNA, 22 nt, Human
ucuuaaagagcgcaauuugagg

SEQ ID NO: 195847 - RNA, 22 nt, Human
agcccugcacaguucgggagga

SEQ ID NO: 195848 - RNA, 22 nt, Human
gcaaggagccuggaggugagug

SEQ ID NO: 195849 - RNA, 22 nt, Human
gccacagcccgagcaccaugag

SEQ ID NO: 195850 - RNA, 20 nt, Human
uacaagaauccccaguuguc

SEQ ID NO: 195851 - RNA, 22 nt, Human
gugcaguguguaauccaggaac

SEQ ID NO: 195852 - RNA, 22 nt, Human
uaggauuuuuuggauucuggau

SEQ ID NO: 195853 - RNA, 22 nt, Human
uugugaauagugccgcuauaaa

SEQ ID NO: 195854 - RNA, 22 nt, Human
agcagcugguucccgagggcgu

SEQ ID NO: 195855 - RNA, 22 nt, Human
uuuagccaacuauaugacuagu

SEQ ID NO: 195856 - RNA, 22 nt, Human
uugaaauggcagcagcugaccu

SEQ ID NO: 195857 - RNA, 22 nt, Human
ggcucagguuaccagucccucc

SEQ ID NO: 195858 - RNA, 22 nt, Human
accuugggcaaguuggaaacug

SEQ ID NO: 195859 - RNA, 22 nt, Human
cugcuguguaucauuuuagaug

SEQ ID NO: 195860 - RNA, 22 nt, Human
auacacuacuaagcacagauug

SEQ ID NO: 195861 - RNA, 22 nt, Human
uauccaaagagauucauguucu

SEQ ID NO: 195862 - RNA, 22 nt, Human
uagcaauccguugaucccuugc

SEQ ID NO: 195863 - RNA, 22 nt, Human
aggagggcuaggaaaaccagga

SEQ ID NO: 195864 - RNA, 22 nt, Human
aguaaucugauuuuauagcuau

SEQ ID NO: 195865 - RNA, 22 nt, Human
uggcugagcucccuguguguug

SEQ ID NO: 195866 - RNA, 22 nt, Human
ccagcagagcuggaagugugcu

SEQ ID NO: 195867 - RNA, 22 nt, Human
uuuccucuccggggccuccagg

SEQ ID NO: 195868 - RNA, 22 nt, Human
uuucuauuggcgucacuguugu

SEQ ID NO: 195869 - RNA, 22 nt, Human
aggcagcagucaugaggaaaga

SEQ ID NO: 195870 - RNA, 22 nt, Human
uacagagggauuaucuaagggu

SEQ ID NO: 195871 - RNA, 22 nt, Human
cacaggaagagguauacaauuc

SEQ ID NO: 195872 - RNA, 22 nt, Human
ccugagucuuggcuucuuggcu

SEQ ID NO: 195873 - RNA, 22 nt, Human
uucuauugacauucacuguaac

SEQ ID NO: 195874 - RNA, 22 nt, Human
cagagcuucugacagcugcugc

SEQ ID NO: 195875 - RNA, 22 nt, Human
aaauaaguuagcagauuccagu

SEQ ID NO: 195876 - RNA, 22 nt, Human
ucuguucaugucuuuuuaagug

SEQ ID NO: 195877 - RNA, 22 nt, Human
ccucugcagcagagagccagag

SEQ ID NO: 195878 - RNA, 22 nt, Human
ugguuccucaagcgcuggcggc

SEQ ID NO: 195879 - RNA, 22 nt, Human
gugacagucaaagacaugacuu

SEQ ID NO: 195880 - RNA, 22 nt, Human
cacccccaggagcuccagggac

SEQ ID NO: 195881 - RNA, 22 nt, Human
cagaggcuguguaggcagacug

SEQ ID NO: 195882 - RNA, 22 nt, Human
caaaggcuuugcuaugaugcau

SEQ ID NO: 195883 - RNA, 23 nt, Human
uaggugucuaguguccacuaugu

SEQ ID NO: 195884 - RNA, 22 nt, Human
uccuggagaaacucagagaucu

SEQ ID NO: 195885 - RNA, 22 nt, Human
cagcaacuccuguagcuuaugc

SEQ ID NO: 195886 - RNA, 20 nt, Human
aaugagaugacuuagaggaa

SEQ ID NO: 195887 - RNA, 22 nt, Human
cugcccacaguucucugccaug

SEQ ID NO: 195888 - RNA, 22 nt, Human
uuucacauggaagcucucgaga

SEQ ID NO: 195889 - RNA, 22 nt, Human
auggcagccugagcagaggaau

SEQ ID NO: 195890 - RNA, 22 nt, Human
acauggugagcggcaggccuau

SEQ ID NO: 195891 - RNA, 22 nt, Human
agcugcaggcgccggggccgau

SEQ ID NO: 195892 - RNA, 22 nt, Human
agagccuguuuugugggagaug

SEQ ID NO: 195893 - RNA, 22 nt, Human
agaggccagggacacugcucaa

SEQ ID NO: 195894 - RNA, 22 nt, Human
uguucucuaagaaaagaagcau

SEQ ID NO: 195895 - RNA, 21 nt, Human
agcugcagccauguacauggc

SEQ ID NO: 195896 - RNA, 22 nt, Human
agcgcugugggcgugcgaggag

SEQ ID NO: 195897 - RNA, 22 nt, Human
uaguucuagccagugaaaugua

SEQ ID NO: 195898 - RNA, 22 nt, Human
gagccacagcaaccucaaagga

SEQ ID NO: 195899 - RNA, 22 nt, Human
augcuccaccuuuugcaggaac

SEQ ID NO: 195900 - RNA, 18 nt, Human
ugaacuuuggugucucuc

SEQ ID NO: 195901 - RNA, 22 nt, Human
cugcagggguguccuguauugg

SEQ ID NO: 195902 - RNA, 22 nt, Human
aaagaagagcuggaaggagucu

SEQ ID NO: 195903 - RNA, 22 nt, Human
gggcuccuggcagucaugcuca

SEQ ID NO: 195904 - RNA, 22 nt, Human
aucaggauggguuuggcuuagg

SEQ ID NO: 195905 - RNA, 21 nt, Human
agauccagugccauaaggccc

SEQ ID NO: 195906 - RNA, 22 nt, Human
ccuuacacugccuggggccacg

SEQ ID NO: 195907 - RNA, 22 nt, Human
guucuacuuucugugucuuuga

SEQ ID NO: 195908 - RNA, 22 nt, Human
aaagcagagguugcagugagcu

SEQ ID NO: 195909 - RNA, 22 nt, Human
uccucuuucucaacauuaguua

SEQ ID NO: 195910 - RNA, 22 nt, Human
ucaguguuggcauucagaaaug

SEQ ID NO: 195911 - RNA, 22 nt, Human
caacauuucaaggucuuuagga

SEQ ID NO: 195912 - RNA, 22 nt, Human
agacauguccacaaagcauuca

SEQ ID NO: 195913 - RNA, 22 nt, Human
uucaacaaacuguucacgaaug

SEQ ID NO: 195914 - RNA, 22 nt, Human
ugagaugguucacagagaaggc

SEQ ID NO: 195915 - RNA, 22 nt, Human
ugccucagagaccugacaguac

SEQ ID NO: 195916 - RNA, 22 nt, Human
ucugucugagggagugacauuu

SEQ ID NO: 195917 - RNA, 22 nt, Human
ugucagugucugagguuuuaua

SEQ ID NO: 195918 - RNA, 22 nt, Human
ugccauccuugaggaagggcaa

SEQ ID NO: 195919 - RNA, 22 nt, Human
agaagcaggccucacagaucug

SEQ ID NO: 195920 - RNA, 20 nt, Human
gucuuuauguuuuaugaccu

SEQ ID NO: 195921 - RNA, 22 nt, Human
caggcuuuacuuucucucugaa

SEQ ID NO: 195922 - RNA, 22 nt, Human
agcccagagccccggccauguu

SEQ ID NO: 195923 - RNA, 22 nt, Human
uggcucugugucucccagcagc

SEQ ID NO: 195924 - RNA, 22 nt, Human
gagaaaugcaugcaugucauca

SEQ ID NO: 195925 - RNA, 22 nt, Human
uucacagucacccuucuccaug

SEQ ID NO: 195926 - RNA, 22 nt, Human
gucagagcacugaguugugggc

SEQ ID NO: 195927 - RNA, 22 nt, Human
uugucaaggcuuuuaauauucu

SEQ ID NO: 195928 - RNA, 22 nt, Human
cugcuuuaacagaugauggugu

SEQ ID NO: 195929 - RNA, 22 nt, Human
cagcuggguggcucuucugcuc

SEQ ID NO: 195930 - RNA, 22 nt, Human
gcacacguagaagaacuugacu

SEQ ID NO: 195931 - RNA, 22 nt, Human
aacuguaagagaauaaaugugu

SEQ ID NO: 195932 - RNA, 22 nt, Human
agggcagcggugcuuguguuau

SEQ ID NO: 195933 - RNA, 22 nt, Human
augcauaucuccuaucuccuca

SEQ ID NO: 195934 - RNA, 22 nt, Human
ucuucagugcaccugaugucuu

SEQ ID NO: 195935 - RNA, 22 nt, Human
uuccagccacuuuauacugcua

SEQ ID NO: 195936 - RNA, 22 nt, Human
agccccacacucucucugagaa

SEQ ID NO: 195937 - RNA, 22 nt, Human
auuggcuuucuuuugugaaaau

SEQ ID NO: 195938 - RNA, 22 nt, Human
ucugcucuaguugcuuccugcc

SEQ ID NO: 195939 - RNA, 22 nt, Human
agggcagaaguacagacacuua

SEQ ID NO: 195940 - RNA, 22 nt, Human
ggcaguuucucaggcaggggua

SEQ ID NO: 195941 - RNA, 23 nt, Human
acaugggagggacauggaggcug

SEQ ID NO: 195942 - RNA, 22 nt, Human
cugggacaugauagaaacagau

SEQ ID NO: 195943 - RNA, 22 nt, Human
uggaggcauaggccugggcccu

SEQ ID NO: 195944 - RNA, 22 nt, Human
uuuauugggccuggaggaucua

SEQ ID NO: 195945 - RNA, 22 nt, Human
gcagaggcauuucugacgcugc

SEQ ID NO: 195946 - RNA, 22 nt, Human
agcugugccuauucguggcaag

SEQ ID NO: 195947 - RNA, 16 nt, Human
aggaauguggcggaac

SEQ ID NO: 195948 - RNA, 22 nt, Human
agucagcagccuggccaggaga

SEQ ID NO: 195949 - RNA, 22 nt, Human
cuuauuuaugucugucucuaau

SEQ ID NO: 195950 - RNA, 22 nt, Human
uccuuggaucuuuccuaugauu

SEQ ID NO: 195951 - RNA, 22 nt, Human
ucuggaugcucugagcccaagg

SEQ ID NO: 195952 - RNA, 22 nt, Human
auaaggaaaugaaacucuaaua

SEQ ID NO: 195953 - RNA, 22 nt, Human
gcacacacaugugaguacaugc

SEQ ID NO: 195954 - RNA, 22 nt, Human
ucugagcugggucuugacagcu

SEQ ID NO: 195955 - RNA, 22 nt, Human
caugaaacuuccaaagcugacc

SEQ ID NO: 195956 - RNA, 22 nt, Human
aggucagguaucagcagguauu

SEQ ID NO: 195957 - RNA, 17 nt, Human
ugagauggaagaagacu

SEQ ID NO: 195958 - RNA, 22 nt, Human
aucaggaucacugggagucuug

SEQ ID NO: 195959 - RNA, 22 nt, Human
gcuuccagaccccagucccuca

SEQ ID NO: 195960 - RNA, 22 nt, Human
agauucuacucuagauccaugg

SEQ ID NO: 195961 - RNA, 22 nt, Human
ccuuccaggagucucugcaggu

SEQ ID NO: 195962 - RNA, 22 nt, Human
acacauaagccuaaucaucucc

SEQ ID NO: 195963 - RNA, 22 nt, Human
uaggguccucaucuguaaauga

SEQ ID NO: 195964 - RNA, 19 nt, Human
uggcagccuccacuuuugc

SEQ ID NO: 195965 - RNA, 22 nt, Human
agccacagagagggagcugcaa

SEQ ID NO: 195966 - RNA, 22 nt, Human
agcuuuaugaggagaccuuagu

SEQ ID NO: 195967 - RNA, 22 nt, Human
ggucucuggccuuggagauuga

SEQ ID NO: 195968 - RNA, 22 nt, Human
ugugacagaauuggucuguucu

SEQ ID NO: 195969 - RNA, 23 nt, Human
auguuacuuaaccucucugugcc

SEQ ID NO: 195970 - RNA, 22 nt, Human
guucagcccacagagggggccg

SEQ ID NO: 195971 - RNA, 17 nt, Human
uucauuaauaaaagcaa

SEQ ID NO: 195972 - RNA, 22 nt, Human
uucagagagaccaaguggcgug

SEQ ID NO: 195973 - RNA, 22 nt, Human
uuucaguugcagugguugucua

SEQ ID NO: 195974 - RNA, 22 nt, Human
ccuggcucaaggcgaggacucc

SEQ ID NO: 195975 - RNA, 22 nt, Human
gcccagccagagcugugugaug

SEQ ID NO: 195976 - RNA, 22 nt, Human
ugcaucuguucagagcugucga

SEQ ID NO: 195977 - RNA, 22 nt, Human
uggcuccacaggccagggugug

SEQ ID NO: 195978 - RNA, 22 nt, Human
uggagcccagggugagaaggag

SEQ ID NO: 195979 - RNA, 22 nt, Human
gcuggaguuaggugggcuugaa

SEQ ID NO: 195980 - RNA, 22 nt, Human
uauuauugacauuuacuuggug

SEQ ID NO: 195981 - RNA, 22 nt, Human
uuucuuucucguaaacuuaguu

SEQ ID NO: 195982 - RNA, 22 nt, Human
acaggggcuccgaaggugaggg

SEQ ID NO: 195983 - RNA, 22 nt, Human
auauaacucuuguucuuauagu

SEQ ID NO: 195984 - RNA, 22 nt, Human
acugaaaugaaaucuaucaucu

SEQ ID NO: 195985 - RNA, 22 nt, Human
acauagaacuucgaugucuuuu

SEQ ID NO: 195986 - RNA, 22 nt, Human
acaugacuauaauuacuuaaau

SEQ ID NO: 195987 - RNA, 22 nt, Human
cagggccuucguaaguguccgg

SEQ ID NO: 195988 - RNA, 22 nt, Human
guguccugccacccugggcuuu

SEQ ID NO: 195989 - RNA, 22 nt, Human
aaaugcuacacaggaauucuca

SEQ ID NO: 195990 - RNA, 22 nt, Human
gccuggcacauugcaguggauu

SEQ ID NO: 195991 - RNA, 22 nt, Human
gcugucuuggguagaaagaggu

SEQ ID NO: 195992 - RNA, 22 nt, Human
augaacagaggaauagaauucu

SEQ ID NO: 195993 - RNA, 22 nt, Human
aagaccuaaaauucccucagau

SEQ ID NO: 195994 - RNA, 22 nt, Human
gucuuucuaugaugaacuguug

SEQ ID NO: 195995 - RNA, 22 nt, Human
gccuagugcacuggcagggcuc

SEQ ID NO: 195996 - RNA, 22 nt, Human
uuuuauacuuaagacagaguuu

SEQ ID NO: 195997 - RNA, 22 nt, Human
ugaggcaauuggaaauuuuaac

SEQ ID NO: 195998 - RNA, 22 nt, Human
uacaauguaauucugauuaugu

SEQ ID NO: 195999 - RNA, 22 nt, Human
cuauagaaaauuguaucacacg

SEQ ID NO: 196000 - RNA, 22 nt, Human
uuuauauuguaaaaaugguucu

SEQ ID NO: 196001 - RNA, 22 nt, Human
uguacaggagaacaaugagaaa

SEQ ID NO: 196002 - RNA, 22 nt, Human
ugggccuccuccgacagccggg

SEQ ID NO: 196003 - RNA, 22 nt, Human
uucagcaaauggacuguucagg

SEQ ID NO: 196004 - RNA, 22 nt, Human
acugggcuguuuuuugagugga

SEQ ID NO: 196005 - RNA, 22 nt, Human
gacuuucugauguaaacauuua

SEQ ID NO: 196006 - RNA, 22 nt, Human
gacagcugugcaggagaagggg

SEQ ID NO: 196007 - RNA, 17 nt, Human
uccuguuuaucauugau

SEQ ID NO: 196008 - RNA, 22 nt, Human
ggccagcuuugagcugcaggaa

SEQ ID NO: 196009 - RNA, 22 nt, Human
ugagguggguggcuucuguuau

SEQ ID NO: 196010 - RNA, 22 nt, Human
caauucaucuggguagguagcc

SEQ ID NO: 196011 - RNA, 22 nt, Human
ucauuguuauguuuugcugucu

SEQ ID NO: 196012 - RNA, 22 nt, Human
acuuucugccuuacaggagucc

SEQ ID NO: 196013 - RNA, 22 nt, Human
uucauucaagggguuccugauu

SEQ ID NO: 196014 - RNA, 22 nt, Human
cagauggcacagauuuagagug

SEQ ID NO: 196015 - RNA, 21 nt, Human
cacaagacacauaggguguuu

SEQ ID NO: 196016 - RNA, 22 nt, Human
ggcuggcuuggugagcugucac

SEQ ID NO: 196017 - RNA, 21 nt, Human
uccuggcccacucuaucccca

SEQ ID NO: 196018 - RNA, 17 nt, Human
uucugugcuuccuggcu

SEQ ID NO: 196019 - RNA, 22 nt, Human
gccaggcuguggggaacuugaa

SEQ ID NO: 196020 - RNA, 22 nt, Human
uacauucagaauugggaggcaa

SEQ ID NO: 196021 - RNA, 22 nt, Human
uagauuuuacuucugucauuac

SEQ ID NO: 196022 - RNA, 22 nt, Human
aucugucuggaggccuggcaug

SEQ ID NO: 196023 - RNA, 22 nt, Human
ugugucuuuggcgaugucugga

SEQ ID NO: 196024 - RNA, 22 nt, Human
cagucuuugaugcauccuagcc

SEQ ID NO: 196025 - RNA, 22 nt, Human
ggcaccuguguaagaucuggaa

SEQ ID NO: 196026 - RNA, 20 nt, Human
aggcagcuggccaggcaggu

SEQ ID NO: 196027 - RNA, 21 nt, Human
guccuucagcaaguuaguggc

SEQ ID NO: 196028 - RNA, 22 nt, Human
gaaggccaguuuugagauaggu

SEQ ID NO: 196029 - RNA, 22 nt, Human
ucaggcugugggcacuggccau

SEQ ID NO: 196030 - RNA, 18 nt, Human
aggcaggugcuaauauuu

SEQ ID NO: 196031 - RNA, 22 nt, Human
cagguccuggcagcugacucag

SEQ ID NO: 196032 - RNA, 22 nt, Human
ccugaguagcuggaauuaaagg

SEQ ID NO: 196033 - RNA, 20 nt, Human
ggcauccuuuuggucacagc

SEQ ID NO: 196034 - RNA, 22 nt, Human
uggcuucugggauguguugaca

SEQ ID NO: 196035 - RNA, 22 nt, Human
ucaguuaaucaauguggucuaa

SEQ ID NO: 196036 - RNA, 22 nt, Human
uuucacauuuaggcgugaauug

SEQ ID NO: 196037 - RNA, 22 nt, Human
cuacauuauguuuauugggacu

SEQ ID NO: 196038 - RNA, 22 nt, Human
ggcugcuggggacgugggagag

SEQ ID NO: 196039 - RNA, 22 nt, Human
acauaauaggugccugaauauu

SEQ ID NO: 196040 - RNA, 22 nt, Human
gaaggcuagaaacgaugcuuau

SEQ ID NO: 196041 - RNA, 22 nt, Human
gcucuguaugagggugagagau

SEQ ID NO: 196042 - RNA, 22 nt, Human
auagcaaagaugucaauucccc

SEQ ID NO: 196043 - RNA, 18 nt, Human
guucaaggucaagagaga

SEQ ID NO: 196044 - RNA, 22 nt, Human
acuguggcacuaggcaccuuac

SEQ ID NO: 196045 - RNA, 23 nt, Human
ugucucagacugagggguuuccc

SEQ ID NO: 196046 - RNA, 22 nt, Human
ugcuugggaauguggagucaga

SEQ ID NO: 196047 - RNA, 22 nt, Human
aauguauucugggaaaauguua

SEQ ID NO: 196048 - RNA, 22 nt, Human
ucagcuggcagguucugggaag

SEQ ID NO: 196049 - RNA, 22 nt, Human
augcaugagucacucagugcag

SEQ ID NO: 196050 - RNA, 22 nt, Human
ucaguucuuuauuucacaguga

SEQ ID NO: 196051 - RNA, 22 nt, Human
gagaggcucagggacuugcuga

SEQ ID NO: 196052 - RNA, 22 nt, Human
aggagguggcaacugucgacag

SEQ ID NO: 196053 - RNA, 20 nt, Human
cucugcugcgcaucccacuu

SEQ ID NO: 196054 - RNA, 22 nt, Human
cugggaaagcaagguuguggau

SEQ ID NO: 196055 - RNA, 22 nt, Human
uuucaagacucauugaguauug

SEQ ID NO: 196056 - RNA, 22 nt, Human
agacauuauggcuuucacuggg

SEQ ID NO: 196057 - RNA, 22 nt, Human
ccucuggcucacagcaccaacu

SEQ ID NO: 196058 - RNA, 22 nt, Human
gggcuccaccuagggacacugg

SEQ ID NO: 196059 - RNA, 22 nt, Human
aguguccugugucccagacugu

SEQ ID NO: 196060 - RNA, 22 nt, Human
uccuggagaagaggggcuugga

SEQ ID NO: 196061 - RNA, 22 nt, Human
ucaggacagacuagacuagcgu

SEQ ID NO: 196062 - RNA, 22 nt, Human
acugggcugguuaguuuuacua

SEQ ID NO: 196063 - RNA, 18 nt, Human
gguggcaggucagaugcc

SEQ ID NO: 196064 - RNA, 22 nt, Human
caaggccagggaauuuuucugg

SEQ ID NO: 196065 - RNA, 22 nt, Human
cuuagaaauuguuacucauuca

SEQ ID NO: 196066 - RNA, 22 nt, Human
agagcagucaggcuaggacacu

SEQ ID NO: 196067 - RNA, 22 nt, Human
uuucagauuaucucaacuuugg

SEQ ID NO: 196068 - RNA, 22 nt, Human
uuccugccccugagagcuccca

SEQ ID NO: 196069 - RNA, 22 nt, Human
uuuucauuguuacuaugagcua

SEQ ID NO: 196070 - RNA, 22 nt, Human
uuaaagaugcagcuuuagagaa

SEQ ID NO: 196071 - RNA, 22 nt, Human
agagcuguucaacguagcaaug

SEQ ID NO: 196072 - RNA, 22 nt, Human
gguuucucaccuucagcacuac

SEQ ID NO: 196073 - RNA, 22 nt, Human
accugggagucacaccugagaa

SEQ ID NO: 196074 - RNA, 22 nt, Human
auaugugugaugcauggacuaa

SEQ ID NO: 196075 - RNA, 22 nt, Human
uauuuauaaucugccaaagaga

SEQ ID NO: 196076 - RNA, 22 nt, Human
uuguagaaucauuauuucuagu

SEQ ID NO: 196077 - RNA, 22 nt, Human
cccaggcagggacgugcucugg

SEQ ID NO: 196078 - RNA, 22 nt, Human
aauccauugcugugcugccagg

SEQ ID NO: 196079 - RNA, 22 nt, Human
uagagcuauacacugaguaaaa

SEQ ID NO: 196080 - RNA, 22 nt, Human
gcagagccagaauggccaggac

SEQ ID NO: 196081 - RNA, 22 nt, Human
aaaguucucuaugguguaaaaa

SEQ ID NO: 196082 - RNA, 22 nt, Human
ugcuuucauugugauaggaagc

SEQ ID NO: 196083 - RNA, 22 nt, Human
cagaugaggcaaccucauugcu

SEQ ID NO: 196084 - RNA, 22 nt, Human
cauggcuggccagugggagugg

SEQ ID NO: 196085 - RNA, 22 nt, Human
auggcuugcuuuuagagagauc

SEQ ID NO: 196086 - RNA, 22 nt, Human
cugggucccggcuucuauccac

SEQ ID NO: 196087 - RNA, 22 nt, Human
augggcagacagggagcucacg

SEQ ID NO: 196088 - RNA, 22 nt, Human
acagcagauuucccugggcucc

SEQ ID NO: 196089 - RNA, 22 nt, Human
ugcuggagagcuaguucugcag

SEQ ID NO: 196090 - RNA, 22 nt, Human
aucaaguuuucuuaguugacug

SEQ ID NO: 196091 - RNA, 22 nt, Human
ucugguaaccuuuaucccuccu

SEQ ID NO: 196092 - RNA, 22 nt, Human
guguggcccugcguccugaguc

SEQ ID NO: 196093 - RNA, 22 nt, Human
cuggccugugggcugucuccgg

SEQ ID NO: 196094 - RNA, 22 nt, Human
agaaagcaucuccauuguaggu

SEQ ID NO: 196095 - RNA, 19 nt, Human
uggcagugugggguaugaa

SEQ ID NO: 196096 - RNA, 22 nt, Human
uuggaacacagcagcugauuuu

SEQ ID NO: 196097 - RNA, 22 nt, Human
ucccuggccuggaaggauauca

SEQ ID NO: 196098 - RNA, 22 nt, Human
acuuuggaggguguuguagaug

SEQ ID NO: 196099 - RNA, 22 nt, Human
agauuuacucagcuccuggaaa

SEQ ID NO: 196100 - RNA, 22 nt, Human
cugcuacaccggaauagugaca

SEQ ID NO: 196101 - RNA, 20 nt, Human
gagugcuuuggcuugcucuc

SEQ ID NO: 196102 - RNA, 22 nt, Human
ucucugcacuugcacauaagcu

SEQ ID NO: 196103 - RNA, 18 nt, Human
agcugcuugcaggccuuc

SEQ ID NO: 196104 - RNA, 22 nt, Human
ugcuagaauuugcagaagcaua

SEQ ID NO: 196105 - RNA, 22 nt, Human
ugagggaauccucacaucaauc

SEQ ID NO: 196106 - RNA, 22 nt, Human
auauagaaggugcuauuuacau

SEQ ID NO: 196107 - RNA, 22 nt, Human
gcccaagcagcuucccgagcuu

SEQ ID NO: 196108 - RNA, 22 nt, Human
cuuccucugccucccgugcuca

SEQ ID NO: 196109 - RNA, 22 nt, Human
uucuuguaauuuggagaaauga

SEQ ID NO: 196110 - RNA, 22 nt, Human
cugugggccuagucuggccuag

SEQ ID NO: 196111 - RNA, 22 nt, Human
uguuaaaaccacaggugaggac

SEQ ID NO: 196112 - RNA, 22 nt, Human
ccaggaugacccccacuuuccu

SEQ ID NO: 196113 - RNA, 22 nt, Human
ucaggaaggagcuggccugcca

SEQ ID NO: 196114 - RNA, 22 nt, Human
ucccugagcugagcucaacagc

SEQ ID NO: 196115 - RNA, 22 nt, Human
agagacuggagaugggcagugu

SEQ ID NO: 196116 - RNA, 22 nt, Human
ucucagaaaaaggagaaacugg

SEQ ID NO: 196117 - RNA, 22 nt, Human
agaggucagaacaggaaagugu

SEQ ID NO: 196118 - RNA, 22 nt, Human
gcugccuucaguucugauucau

SEQ ID NO: 196119 - RNA, 19 nt, Human
uuccaggugcuguggggag

SEQ ID NO: 196120 - RNA, 22 nt, Human
cucccuucaggagaggcucaca

SEQ ID NO: 196121 - RNA, 22 nt, Human
ggagcccaagucugcacucggc

SEQ ID NO: 196122 - RNA, 22 nt, Human
ggagagguguauucaguggguc

SEQ ID NO: 196123 - RNA, 22 nt, Human
ugucagcagaucuccugcagcc

SEQ ID NO: 196124 - RNA, 23 nt, Human
uggcauuucuauacuggcaagug

SEQ ID NO: 196125 - RNA, 22 nt, Human
augacaaauucagaccauagca

SEQ ID NO: 196126 - RNA, 20 nt, Human
ggcaggugcucgcuuggucu

SEQ ID NO: 196127 - RNA, 22 nt, Human
aaguaagucuuacauucacauu

SEQ ID NO: 196128 - RNA, 22 nt, Human
auagauacuggguauggagaug

SEQ ID NO: 196129 - RNA, 22 nt, Human
cccuguuuuaaguugauauuga

SEQ ID NO: 196130 - RNA, 18 nt, Human
ucuggcucaggacugaac

SEQ ID NO: 196131 - RNA, 22 nt, Human
gcuguagggugucauaugaagc

SEQ ID NO: 196132 - RNA, 22 nt, Human
uggcauggcauuuagagaauua

SEQ ID NO: 196133 - RNA, 22 nt, Human
cuugggucuguccugcugugca

SEQ ID NO: 196134 - RNA, 22 nt, Human
gcagacagccagacugcacugg

SEQ ID NO: 196135 - RNA, 22 nt, Human
cccugugcacacacuucacucu

SEQ ID NO: 196136 - RNA, 22 nt, Human
uucugggcuaccuucccggcag

SEQ ID NO: 196137 - RNA, 22 nt, Human
ugcccagcugucaaaguagaua

SEQ ID NO: 196138 - RNA, 22 nt, Human
ucaggagaaucagggcuguccu

SEQ ID NO: 196139 - RNA, 20 nt, Human
uccuccagaagggcagggug

SEQ ID NO: 196140 - RNA, 22 nt, Human
agggcugccauuucuggcccaa

SEQ ID NO: 196141 - RNA, 22 nt, Human
cuguagaggaacaagagcucuu

SEQ ID NO: 196142 - RNA, 17 nt, Human
ucugaggccucuaggag

SEQ ID NO: 196143 - RNA, 22 nt, Human
ccugggaagaccggcagugggg

SEQ ID NO: 196144 - RNA, 22 nt, Human
ucugccuugauggcauugagaa

SEQ ID NO: 196145 - RNA, 22 nt, Human
gcacuggauuuugaucugcaag

SEQ ID NO: 196146 - RNA, 22 nt, Human
acacacaugcaugcuugccauu

SEQ ID NO: 196147 - RNA, 22 nt, Human
aaaauccuuagccgagugaggu

SEQ ID NO: 196148 - RNA, 17 nt, Human
caggcagacauguaagc

SEQ ID NO: 196149 - RNA, 23 nt, Human
uccuuugucuuugcauagauggu

SEQ ID NO: 196150 - RNA, 22 nt, Human
aaguggagucccuacaaccagc

SEQ ID NO: 196151 - RNA, 22 nt, Human
uggccugaguugucugcaggcc

SEQ ID NO: 196152 - RNA, 22 nt, Human
acugcccuggcaccacacaugc

SEQ ID NO: 196153 - RNA, 22 nt, Human
uaucuuuugaguucucaagaug

SEQ ID NO: 196154 - RNA, 22 nt, Human
ucccagccugacagugcaucaa

SEQ ID NO: 196155 - RNA, 22 nt, Human
aaauucuuuggccuacuuugaa

SEQ ID NO: 196156 - RNA, 16 nt, Human
ucccaggccaggugga

SEQ ID NO: 196157 - RNA, 22 nt, Human
ucuccacaagcugaugcuagga

SEQ ID NO: 196158 - RNA, 23 nt, Human
cuugaaugggauggaauucacug

SEQ ID NO: 196159 - RNA, 22 nt, Human
aagaaagcugaauauucugugu

SEQ ID NO: 196160 - RNA, 20 nt, Human
ucuccuggucugguccgugc

SEQ ID NO: 196161 - RNA, 18 nt, Human
ugagacagcuaccacuug

SEQ ID NO: 196162 - RNA, 22 nt, Human
gcaggccacugucuccucuggg

SEQ ID NO: 196163 - RNA, 22 nt, Human
uuggagguuugaaaauaugugu

SEQ ID NO: 196164 - RNA, 22 nt, Human
augcaaucauauggcauacagc

SEQ ID NO: 196165 - RNA, 22 nt, Human
ggcccagauuagaagcugaaug

SEQ ID NO: 196166 - RNA, 22 nt, Human
gaugggggccagggccugcuuu

SEQ ID NO: 196167 - RNA, 22 nt, Human
aaacuuuggauugugauugugc

SEQ ID NO: 196168 - RNA, 22 nt, Human
uacaucauaauaauacuuagaa

SEQ ID NO: 196169 - RNA, 22 nt, Human
cuuugcuuuacucccacugugu

SEQ ID NO: 196170 - RNA, 22 nt, Human
aggaaugucaaguagaugugcg

SEQ ID NO: 196171 - RNA, 22 nt, Human
cucagugucacguuuugccuua

SEQ ID NO: 196172 - RNA, 17 nt, Human
ucaggcugggugcagug

SEQ ID NO: 196173 - RNA, 17 nt, Human
gugaagagucauugaau

SEQ ID NO: 196174 - RNA, 22 nt, Human
uaaaggaagaauucucugugau

SEQ ID NO: 196175 - RNA, 22 nt, Human
uccuggcuuuucuuggcucauc

SEQ ID NO: 196176 - RNA, 22 nt, Human
aggcucagauccuuguguccug

SEQ ID NO: 196177 - RNA, 22 nt, Human
ucagaggacuaccuucuccagu

SEQ ID NO: 196178 - RNA, 22 nt, Human
ugggccuggaguuuguccagag

SEQ ID NO: 196179 - RNA, 22 nt, Human
auguggaaugaacaaaggaggc

SEQ ID NO: 196180 - RNA, 22 nt, Human
ucucugagcuggauuuguucuu

SEQ ID NO: 196181 - RNA, 21 nt, Human
gaaggagaaagcaagugcugc

SEQ ID NO: 196182 - RNA, 22 nt, Human
uauuccaaaaucccaaacugcc

SEQ ID NO: 196183 - RNA, 22 nt, Human
gcuggcuuccuucugcagcuag

SEQ ID NO: 196184 - RNA, 22 nt, Human
caucaugaagaugagaaagcau

SEQ ID NO: 196185 - RNA, 22 nt, Human
acaucuucccacacuugcaaaa

SEQ ID NO: 196186 - RNA, 22 nt, Human
ucaguuacucaacagaggugga

SEQ ID NO: 196187 - RNA, 22 nt, Human
ucaucucuuuuguauugggguu

SEQ ID NO: 196188 - RNA, 22 nt, Human
gucugggcucccagggucggcg

SEQ ID NO: 196189 - RNA, 22 nt, Human
gcagaggguccugugccagcag

SEQ ID NO: 196190 - RNA, 22 nt, Human
ucccagccuggacccugccagu

SEQ ID NO: 196191 - RNA, 22 nt, Human
cugagcccucuguuuucccucu

SEQ ID NO: 196192 - RNA, 22 nt, Human
gccugugguuugauuaagcauu

SEQ ID NO: 196193 - RNA, 22 nt, Human
uccaugggaagauuuugagugg

SEQ ID NO: 196194 - RNA, 22 nt, Human
aggcugugacuacgcagggaag

SEQ ID NO: 196195 - RNA, 23 nt, Human
auauuagggagauuagcccucua

SEQ ID NO: 196196 - RNA, 22 nt, Human
uagcauauggaggguaagaggg

SEQ ID NO: 196197 - RNA, 22 nt, Human
cagcuuggauuuuggcacgugu

SEQ ID NO: 196198 - RNA, 22 nt, Human
gaggcagcauucgcauagacag

SEQ ID NO: 196199 - RNA, 23 nt, Human
ugagucuugagcuuuggauucug

SEQ ID NO: 196200 - RNA, 22 nt, Human
uucucugggcuuuucggauccg

SEQ ID NO: 196201 - RNA, 22 nt, Human
uccugccaccugcacagcuccc

SEQ ID NO: 196202 - RNA, 22 nt, Human
uuccuggcacccuggacccggc

SEQ ID NO: 196203 - RNA, 22 nt, Human
acaugugugacaacagagguga

SEQ ID NO: 196204 - RNA, 22 nt, Human
uggcaggaaccaggaggcucuc

SEQ ID NO: 196205 - RNA, 22 nt, Human
cacccaggcagguggcugagaa

SEQ ID NO: 196206 - RNA, 22 nt, Human
ucccugaaacauaauagaugcc

SEQ ID NO: 196207 - RNA, 22 nt, Human
ugaaggccacuuccugugagcu

SEQ ID NO: 196208 - RNA, 22 nt, Human
uauguacauggagagcaauuga

SEQ ID NO: 196209 - RNA, 22 nt, Human
uggcccugggcagaggcaacau

SEQ ID NO: 196210 - RNA, 22 nt, Human
uuugauccguugcuggugagga

SEQ ID NO: 196211 - RNA, 22 nt, Human
acaagguuugguccuauauuuu

SEQ ID NO: 196212 - RNA, 21 nt, Human
ucuccccauucuuauucccau

SEQ ID NO: 196213 - RNA, 22 nt, Human
auggccaugccaguuuacagcc

SEQ ID NO: 196214 - RNA, 22 nt, Human
uagauuaagaugccaguuuuga

SEQ ID NO: 196215 - RNA, 22 nt, Human
ucaaaaauaagauauucuggac

SEQ ID NO: 196216 - RNA, 22 nt, Human
ccacauuucuucacuuguccca

SEQ ID NO: 196217 - RNA, 22 nt, Human
guuuucuuccugcaauuggcau

SEQ ID NO: 196218 - RNA, 22 nt, Human
ucaggcugguggucagauggcu

SEQ ID NO: 196219 - RNA, 22 nt, Human
accacaggggaggaaugaugcc

SEQ ID NO: 196220 - RNA, 22 nt, Human
cacugcagcaccaugcagggcu

SEQ ID NO: 196221 - RNA, 22 nt, Human
uaacuguaguuauaaagcuauc

SEQ ID NO: 196222 - RNA, 22 nt, Human
ccugagagugagugccuccuua

SEQ ID NO: 196223 - RNA, 20 nt, Human
aaacaagguugcucugagga

SEQ ID NO: 196224 - RNA, 22 nt, Human
cagggccauuggaacaaagagg

SEQ ID NO: 196225 - RNA, 22 nt, Human
ggcuccuggggaggugagcuug

SEQ ID NO: 196226 - RNA, 22 nt, Human
ugagaaagccuuuagucccagg

SEQ ID NO: 196227 - RNA, 22 nt, Human
aguuuauguaaaauuaguaaug

SEQ ID NO: 196228 - RNA, 22 nt, Human
agugucuggucucugaacuaaa

SEQ ID NO: 196229 - RNA, 22 nt, Human
gugcccuggcucacagugucuc

SEQ ID NO: 196230 - RNA, 22 nt, Human
aaagcucuuauagcagagugug

SEQ ID NO: 196231 - RNA, 22 nt, Human
caucagugaaagugaauguucu

SEQ ID NO: 196232 - RNA, 22 nt, Human
uuggccuuguacaucauauuaa

SEQ ID NO: 196233 - RNA, 19 nt, Human
ugaaauggcaguugcuaaa

SEQ ID NO: 196234 - RNA, 22 nt, Human
ugccucucuaacccaugcccaa

SEQ ID NO: 196235 - RNA, 22 nt, Human
cggcugagacggccauagacac

SEQ ID NO: 196236 - RNA, 22 nt, Human
aagggagaaaacuuguggcuua

SEQ ID NO: 196237 - RNA, 22 nt, Human
cagguacauucguagacccauu

SEQ ID NO: 196238 - RNA, 22 nt, Human
uggaaccaucaaagagauccug

SEQ ID NO: 196239 - RNA, 22 nt, Human
gaaggcacugaacuccuucugg

SEQ ID NO: 196240 - RNA, 22 nt, Human
cuucauguacaguuauuggaga

SEQ ID NO: 196241 - RNA, 22 nt, Human
gaggaagaaucaggguggugag

SEQ ID NO: 196242 - RNA, 22 nt, Human
uagaagauaagacaagugcugc

SEQ ID NO: 196243 - RNA, 22 nt, Human
gagaggaguagacacuuugguu

SEQ ID NO: 196244 - RNA, 22 nt, Human
ugcagaauguggacaguggguu

SEQ ID NO: 196245 - RNA, 19 nt, Human
aagagcagggaaagaauug

SEQ ID NO: 196246 - RNA, 22 nt, Human
cuggugcaggaaggagcuggca

SEQ ID NO: 196247 - RNA, 22 nt, Human
cagcuccuagaucggcgaagug

SEQ ID NO: 196248 - RNA, 22 nt, Human
gcugcccucucuggccccacac

SEQ ID NO: 196249 - RNA, 22 nt, Human
uggccacacugcccccacuggg

SEQ ID NO: 196250 - RNA, 18 nt, Human
aggugcagccucugaggc

SEQ ID NO: 196251 - RNA, 22 nt, Human
ucugggcagcagcagcuaguag

SEQ ID NO: 196252 - RNA, 19 nt, Human
agcagcuggagguggagug

SEQ ID NO: 196253 - RNA, 22 nt, Human
uacaguguauguauuuguaggu

SEQ ID NO: 196254 - RNA, 22 nt, Human
uaggaaaagucuagauugauga

SEQ ID NO: 196255 - RNA, 22 nt, Human
caugugcagacggugggcugga

SEQ ID NO: 196256 - RNA, 22 nt, Human
cucugggaccauggcaagugcg

SEQ ID NO: 196257 - RNA, 22 nt, Human
ugcuuaaacauacuauuuauau

SEQ ID NO: 196258 - RNA, 22 nt, Human
cacagcugccaugcagucagug

SEQ ID NO: 196259 - RNA, 22 nt, Human
cucuccagggaagcaguguacu

SEQ ID NO: 196260 - RNA, 22 nt, Human
agucuuuauacagaaauauaug

SEQ ID NO: 196261 - RNA, 21 nt, Human
ucugugguauggccaucuucc

SEQ ID NO: 196262 - RNA, 22 nt, Human
aacacaggcauacuggcuccag

SEQ ID NO: 196263 - RNA, 22 nt, Human
cauucccuuggggaguucaugc

SEQ ID NO: 196264 - RNA, 22 nt, Human
uucuuuaucaguuacucauagg

SEQ ID NO: 196265 - RNA, 22 nt, Human
agcaggugagcacagccaggcu

SEQ ID NO: 196266 - RNA, 22 nt, Human
guucuacaguuccuauuacuua

SEQ ID NO: 196267 - RNA, 22 nt, Human
ugagucuuuucauuguguggau

SEQ ID NO: 196268 - RNA, 22 nt, Human
agaguuuacagaaauaagcugu

SEQ ID NO: 196269 - RNA, 22 nt, Human
gcaggugggagccgcugccuga

SEQ ID NO: 196270 - RNA, 22 nt, Human
cacaaggcacauuccuugucca

SEQ ID NO: 196271 - RNA, 20 nt, Human
acaaaauagguacuggguag

SEQ ID NO: 196272 - RNA, 19 nt, Human
ccagguggaacugagguag

SEQ ID NO: 196273 - RNA, 22 nt, Human
cagggcucaggaaaucagacgu

SEQ ID NO: 196274 - RNA, 22 nt, Human
acaguauaccauugugacuuug

SEQ ID NO: 196275 - RNA, 22 nt, Human
uggccugggccugccggugcaa

SEQ ID NO: 196276 - RNA, 22 nt, Human
aauucccauuugcagaaaauca

SEQ ID NO: 196277 - RNA, 22 nt, Human
uugucuaaugagcuccacuuca

SEQ ID NO: 196278 - RNA, 21 nt, Human
uccacccucucugcucccagu

SEQ ID NO: 196279 - RNA, 18 nt, Human
caggccuuugagacagaa

SEQ ID NO: 196280 - RNA, 19 nt, Human
uuuauucaccuuuaccuug

SEQ ID NO: 196281 - RNA, 22 nt, Human
uuuaugcaucucuaggaagggc

SEQ ID NO: 196282 - RNA, 22 nt, Human
uagaauaugugguguauacuuu

SEQ ID NO: 196283 - RNA, 22 nt, Human
ccuggggcuuucuuuguaucau

SEQ ID NO: 196284 - RNA, 21 nt, Human
acagauuuuauaucucugcug

SEQ ID NO: 196285 - RNA, 22 nt, Human
cacaaaugugcagaaaugugag

SEQ ID NO: 196286 - RNA, 22 nt, Human
gcugccaggggcagcugucuca

SEQ ID NO: 196287 - RNA, 22 nt, Human
uauugcugacugucuucugagu

SEQ ID NO: 196288 - RNA, 22 nt, Human
cugcuugaccuguuguucucac

SEQ ID NO: 196289 - RNA, 22 nt, Human
uguuuaaucuauaaaauggaga

SEQ ID NO: 196290 - RNA, 22 nt, Human
ugaugaggacccaucaccuggu

SEQ ID NO: 196291 - RNA, 22 nt, Human
uaaugaauaaacuugagaguca

SEQ ID NO: 196292 - RNA, 22 nt, Human
cucugagcccgcugcagcccca

SEQ ID NO: 196293 - RNA, 22 nt, Human
cacccacauuccaucacucugc

SEQ ID NO: 196294 - RNA, 22 nt, Human
ucucaguggacgugucugucuu

SEQ ID NO: 196295 - RNA, 22 nt, Human
gaaaugaacugauuaucauugc

SEQ ID NO: 196296 - RNA, 22 nt, Human
aaugccaacuuggauauacauu

SEQ ID NO: 196297 - RNA, 22 nt, Human
aagcaggagagccugggcgagc

SEQ ID NO: 196298 - RNA, 22 nt, Human
gccugcagccucaagggcugag

SEQ ID NO: 196299 - RNA, 22 nt, Human
gcagagugguuucagaguugag

SEQ ID NO: 196300 - RNA, 22 nt, Human
auaaacucaugcugaaaaccca

SEQ ID NO: 196301 - RNA, 22 nt, Human
uuccugugaagccgguggucuc

SEQ ID NO: 196302 - RNA, 20 nt, Human
cuccagggaacagacuggag

SEQ ID NO: 196303 - RNA, 22 nt, Human
aacaauguucuuuuagcuugaa

SEQ ID NO: 196304 - RNA, 22 nt, Human
ucugccagaagccagggucugg

SEQ ID NO: 196305 - RNA, 22 nt, Human
aaggauuaguagguacaguuca

SEQ ID NO: 196306 - RNA, 22 nt, Human
aaauccuaagcagaggaauuua

SEQ ID NO: 196307 - RNA, 22 nt, Human
aaugaggucauuaaugguggga

SEQ ID NO: 196308 - RNA, 22 nt, Human
ggcucaggccagaccacgacuc

SEQ ID NO: 196309 - RNA, 21 nt, Human
aaagcaguucuuccugccucu

SEQ ID NO: 196310 - RNA, 22 nt, Human
ugccauuuauaaccaguggccu

SEQ ID NO: 196311 - RNA, 22 nt, Human
gguggcaccuugaucuuggacu

SEQ ID NO: 196312 - RNA, 22 nt, Human
ugaggcaaaaacacugauuagg

SEQ ID NO: 196313 - RNA, 22 nt, Human
gccacugucaucuugugaagca

SEQ ID NO: 196314 - RNA, 22 nt, Human
caggcucuuccauccugcugag

SEQ ID NO: 196315 - RNA, 22 nt, Human
caggucugagucacauguucau

SEQ ID NO: 196316 - RNA, 22 nt, Human
aggcccuuggguccucuccaca

SEQ ID NO: 196317 - RNA, 22 nt, Human
uuauuugugaaucauuuaucua

SEQ ID NO: 196318 - RNA, 22 nt, Human
guucauauucuaaguaacuggc

SEQ ID NO: 196319 - RNA, 22 nt, Human
agugucugagccagaauuagaa

SEQ ID NO: 196320 - RNA, 20 nt, Human
ucagagaaggagcuuuccug

SEQ ID NO: 196321 - RNA, 22 nt, Human
agcugcaguaaagcucuccagg

SEQ ID NO: 196322 - RNA, 22 nt, Human
cuccaggacacuaacccaggcu

SEQ ID NO: 196323 - RNA, 22 nt, Human
uucacaauuaacuuuauacuua

SEQ ID NO: 196324 - RNA, 22 nt, Human
ggcucugccgugugcucacaug

SEQ ID NO: 196325 - RNA, 22 nt, Human
cccugccugugggcaucaacau

SEQ ID NO: 196326 - RNA, 22 nt, Human
gaaaguauuagccuagaaguca

SEQ ID NO: 196327 - RNA, 22 nt, Human
acaguguagaauccuguacuua

SEQ ID NO: 196328 - RNA, 17 nt, Human
uggggaagcucagauuu

SEQ ID NO: 196329 - RNA, 22 nt, Human
acauacaugggauuaaaaaauu

SEQ ID NO: 196330 - RNA, 22 nt, Human
aacuccugaggaaauggucuca

SEQ ID NO: 196331 - RNA, 22 nt, Human
uagccgggugugguggaacucc

SEQ ID NO: 196332 - RNA, 22 nt, Human
uucuggauaugggagagggagc

SEQ ID NO: 196333 - RNA, 22 nt, Human
cccagcugcaccucuauggccu

SEQ ID NO: 196334 - RNA, 22 nt, Human
aggaauguauuauuccuucugg

SEQ ID NO: 196335 - RNA, 22 nt, Human
ucuuuuauagugaauuuucuug

SEQ ID NO: 196336 - RNA, 22 nt, Human
ggcagugcccggugccuccucu

SEQ ID NO: 196337 - RNA, 22 nt, Human
cauaauuugauaugcuugaugg

SEQ ID NO: 196338 - RNA, 22 nt, Human
augcugaagagugcacaggcua

SEQ ID NO: 196339 - RNA, 22 nt, Human
agacagacuugaaaauguucuu

SEQ ID NO: 196340 - RNA, 22 nt, Human
uguuaaauguuccuuuacugga

SEQ ID NO: 196341 - RNA, 22 nt, Human
gcugaggcucaagucauggguc

SEQ ID NO: 196342 - RNA, 22 nt, Human
gcugcaggcggccgugguggcg

SEQ ID NO: 196343 - RNA, 22 nt, Human
gccugcagacguguuuuccuca

SEQ ID NO: 196344 - RNA, 22 nt, Human
ggagaugcuucuuguguuuauu

SEQ ID NO: 196345 - RNA, 22 nt, Human
uuagcaccuugaacagacccug

SEQ ID NO: 196346 - RNA, 22 nt, Human
agcuccugcgcacggugcacac

SEQ ID NO: 196347 - RNA, 22 nt, Human
acaguuuauugcacagguaacc

SEQ ID NO: 196348 - RNA, 22 nt, Human
uuugucaaguuugcaaauacgu

SEQ ID NO: 196349 - RNA, 22 nt, Human
ccagggaugccaagcuuuacca

SEQ ID NO: 196350 - RNA, 22 nt, Human
gaagcagcuagcccacuaguca

SEQ ID NO: 196351 - RNA, 22 nt, Human
ccugggugacagagugagaccu

SEQ ID NO: 196352 - RNA, 21 nt, Human
gaaaagcaagggaguagaaca

SEQ ID NO: 196353 - RNA, 22 nt, Human
caaggcugaucauuuucccaua

SEQ ID NO: 196354 - RNA, 22 nt, Human
caauguaucaagaagcaucagu

SEQ ID NO: 196355 - RNA, 21 nt, Human
ucuugaaaauuguagcaguuu

SEQ ID NO: 196356 - RNA, 22 nt, Human
ccuuuagaugaucucuuggaca

SEQ ID NO: 196357 - RNA, 22 nt, Human
agaguacacuguacacacaauu

SEQ ID NO: 196358 - RNA, 22 nt, Human
cucuucuuuccaucccuagcca

SEQ ID NO: 196359 - RNA, 19 nt, Human
acacaugaggagggacccc

SEQ ID NO: 196360 - RNA, 22 nt, Human
gcucaaagguugauagcugugc

SEQ ID NO: 196361 - RNA, 23 nt, Human
uggaaucuucgauauugauucag

SEQ ID NO: 196362 - RNA, 22 nt, Human
aaagcaaacagaaccccaagcu

SEQ ID NO: 196363 - RNA, 22 nt, Human
uuugauuuacuggauauucuca

SEQ ID NO: 196364 - RNA, 22 nt, Human
caggaguccaucuggccuggug

SEQ ID NO: 196365 - RNA, 18 nt, Human
uggacacauggccugggu

SEQ ID NO: 196366 - RNA, 22 nt, Human
agcugcugagccauguccugcu

SEQ ID NO: 196367 - RNA, 22 nt, Human
ccuuaggggugacagaaauacc

SEQ ID NO: 196368 - RNA, 22 nt, Human
acuuuacuccccaacauaaaug

SEQ ID NO: 196369 - RNA, 22 nt, Human
ucagugucacaggaugcuaugc

SEQ ID NO: 196370 - RNA, 22 nt, Human
ccugggugaaauaguccucaag

SEQ ID NO: 196371 - RNA, 22 nt, Human
ucauugaaugagaugcaauaga

SEQ ID NO: 196372 - RNA, 22 nt, Human
auucuucaccauggauaauuug

SEQ ID NO: 196373 - RNA, 22 nt, Human
agacagacuuugaucuggaugu

SEQ ID NO: 196374 - RNA, 22 nt, Human
aaggcauauauucuaaacagga

SEQ ID NO: 196375 - RNA, 22 nt, Human
ccagcuuuggaguguuguugcu

SEQ ID NO: 196376 - RNA, 22 nt, Human
auuuuccagccuuucuagaacu

SEQ ID NO: 196377 - RNA, 22 nt, Human
uggcacaugguuaaucauaauu

SEQ ID NO: 196378 - RNA, 22 nt, Human
auucucuguucaaggaugguga

SEQ ID NO: 196379 - RNA, 22 nt, Human
uuugcuuccuaguuggguaaua

SEQ ID NO: 196380 - RNA, 22 nt, Human
ggaacuggagaaugcccucuuu

SEQ ID NO: 196381 - RNA, 18 nt, Human
ggcuuugcugggguuucu

SEQ ID NO: 196382 - RNA, 22 nt, Human
aaucuuaaagaauauucuacca

SEQ ID NO: 196383 - RNA, 22 nt, Human
accugcuuuguaguguuugcug

SEQ ID NO: 196384 - RNA, 22 nt, Human
cucaggacagauuccagagaaa

SEQ ID NO: 196385 - RNA, 22 nt, Human
ugaguggagaacagaggcucuc

SEQ ID NO: 196386 - RNA, 22 nt, Human
aaagccaggcuggccugggguu

SEQ ID NO: 196387 - RNA, 21 nt, Human
agcuccaggcuccugggguuc

SEQ ID NO: 196388 - RNA, 22 nt, Human
ggcacaggaaucugugaagugc

SEQ ID NO: 196389 - RNA, 21 nt, Human
auuauuauaaagaccacaggg

SEQ ID NO: 196390 - RNA, 22 nt, Human
agaaugcucuucaaaaucuagc

SEQ ID NO: 196391 - RNA, 22 nt, Human
uuacuugaaugcugugaucuca

SEQ ID NO: 196392 - RNA, 22 nt, Human
ucagguggcuucggggaguggc

SEQ ID NO: 196393 - RNA, 22 nt, Human
aaagcaauuacaaaagggauaa

SEQ ID NO: 196394 - RNA, 22 nt, Human
uggcucugugaacagacgacug

SEQ ID NO: 196395 - RNA, 22 nt, Human
uugggcugaaguagagggcaga

SEQ ID NO: 196396 - RNA, 22 nt, Human
agccagcaggaacgucuagguu

SEQ ID NO: 196397 - RNA, 20 nt, Human
agcuguuuacauggauuucu

SEQ ID NO: 196398 - RNA, 22 nt, Human
agagggagcccagucauagcug

SEQ ID NO: 196399 - RNA, 22 nt, Human
cuccccuuccgccagcucuuga

SEQ ID NO: 196400 - RNA, 22 nt, Human
uggugcugccaccuccucugcu

SEQ ID NO: 196401 - RNA, 23 nt, Human
agcuucauugaccuccgcagggg

SEQ ID NO: 196402 - RNA, 22 nt, Human
ugccuggcuaauuuuuguaucc

SEQ ID NO: 196403 - RNA, 22 nt, Human
aaguguuuggggaucauuuuaa

SEQ ID NO: 196404 - RNA, 22 nt, Human
uucugauaacaaacaccaauuu

SEQ ID NO: 196405 - RNA, 22 nt, Human
acagauuugacugguaccuggc

SEQ ID NO: 196406 - RNA, 22 nt, Human
cagagagcaugggaggcccgag

SEQ ID NO: 196407 - RNA, 22 nt, Human
ccagcccaaacaagccgccuuc

SEQ ID NO: 196408 - RNA, 22 nt, Human
gugagacacgugugugaccugg

SEQ ID NO: 196409 - RNA, 21 nt, Human
auuuucauuaauucagugugg

SEQ ID NO: 196410 - RNA, 18 nt, Human
cagggcuguggggucacu

SEQ ID NO: 196411 - RNA, 22 nt, Human
aagagcaucuauuucacagugg

SEQ ID NO: 196412 - RNA, 22 nt, Human
auugaaagagaauguagcucuu

SEQ ID NO: 196413 - RNA, 22 nt, Human
ucucagcaacgauccggaguaa

SEQ ID NO: 196414 - RNA, 22 nt, Human
accagcuccaggccccugcuga

SEQ ID NO: 196415 - RNA, 22 nt, Human
ucucaagaucucaagauggccc

SEQ ID NO: 196416 - RNA, 22 nt, Human
uuauugagagcuguuuuauggc

SEQ ID NO: 196417 - RNA, 22 nt, Human
ucaguagcagaaagcaaugagu

SEQ ID NO: 196418 - RNA, 22 nt, Human
uuggcugcucuguguuuaguau

SEQ ID NO: 196419 - RNA, 22 nt, Human
uucuuagaugauuaaugauggg

SEQ ID NO: 196420 - RNA, 22 nt, Human
gcacacaugcaugugugcaucc

SEQ ID NO: 196421 - RNA, 22 nt, Human
agcccagaugguagcccuagaa

SEQ ID NO: 196422 - RNA, 22 nt, Human
aagaacugguuauguuaucuug

SEQ ID NO: 196423 - RNA, 17 nt, Human
ggcuggagcagcucccc

SEQ ID NO: 196424 - RNA, 22 nt, Human
cacaguauucacugggcagauu

SEQ ID NO: 196425 - RNA, 22 nt, Human
acuuagauaacaaaccuguggu

SEQ ID NO: 196426 - RNA, 20 nt, Human
ucacagcuggcuaugacagg

SEQ ID NO: 196427 - RNA, 22 nt, Human
cuguccacauggagaaccuggu

SEQ ID NO: 196428 - RNA, 22 nt, Human
uggcuucuugaucuuggacuug

SEQ ID NO: 196429 - RNA, 22 nt, Human
gaaaggaacuugugagugggag

SEQ ID NO: 196430 - RNA, 22 nt, Human
caaaggcaguuacugaaugaag

SEQ ID NO: 196431 - RNA, 22 nt, Human
aggacacaccagguccagcugu

SEQ ID NO: 196432 - RNA, 22 nt, Human
uuuguugguugcacuggugggu

SEQ ID NO: 196433 - RNA, 22 nt, Human
ucugcgccaccuugugcuugug

SEQ ID NO: 196434 - RNA, 22 nt, Human
agccagcaggugagugcagccu

SEQ ID NO: 196435 - RNA, 22 nt, Human
cuggcaggaucuaaccagggaa

SEQ ID NO: 196436 - RNA, 22 nt, Human
augcaaaaguaauugcaauuuu

SEQ ID NO: 196437 - RNA, 22 nt, Human
uuggcagacugacaaucuguuu

SEQ ID NO: 196438 - RNA, 22 nt, Human
uucuguacaaguuguggcugcu

SEQ ID NO: 196439 - RNA, 22 nt, Human
caggagacaguguuauuuuauu

SEQ ID NO: 196440 - RNA, 22 nt, Human
agucucugucguagaucagcgu

SEQ ID NO: 196441 - RNA, 22 nt, Human
ucaggauguccaaaauccagcc

SEQ ID NO: 196442 - RNA, 22 nt, Human
aaggcauaccugaauguuugug

SEQ ID NO: 196443 - RNA, 22 nt, Human
aucuggcuauugacauguuaua

SEQ ID NO: 196444 - RNA, 22 nt, Human
ccagcauccucagcucacuucu

SEQ ID NO: 196445 - RNA, 22 nt, Human
ccugugugucugucacugcaca

SEQ ID NO: 196446 - RNA, 22 nt, Human
ccagauguuccccuggaggccu

SEQ ID NO: 196447 - RNA, 22 nt, Human
acaauaugggauauacauuuua

SEQ ID NO: 196448 - RNA, 22 nt, Human
gucucuguggcuggcuccuucc

SEQ ID NO: 196449 - RNA, 22 nt, Human
uacagacaaagugcuauagggu

SEQ ID NO: 196450 - RNA, 22 nt, Human
gccaggugcauggcugagucuc

SEQ ID NO: 196451 - RNA, 22 nt, Human
uuucacagcuagugagcuucua

SEQ ID NO: 196452 - RNA, 22 nt, Human
agagcuggcagcagcuucuccu

SEQ ID NO: 196453 - RNA, 22 nt, Human
ccucccuucaguagagcccaau

SEQ ID NO: 196454 - RNA, 22 nt, Human
cuggcaggcagacuucugcaag

SEQ ID NO: 196455 - RNA, 22 nt, Human
ucaggucugaugccucauccau

SEQ ID NO: 196456 - RNA, 22 nt, Human
ucaagacagugugauacuggcc

SEQ ID NO: 196457 - RNA, 22 nt, Human
uucauuugccaucaguguaaug

SEQ ID NO: 196458 - RNA, 22 nt, Human
cagcuuuccagagaccugcccc

SEQ ID NO: 196459 - RNA, 19 nt, Human
ugucucugaaagaugagcu

SEQ ID NO: 196460 - RNA, 22 nt, Human
aguaacaugcuaauuugauuau

SEQ ID NO: 196461 - RNA, 22 nt, Human
auaggcguguuuaggaggacgu

SEQ ID NO: 196462 - RNA, 22 nt, Human
ugcaugaaauauuuucuguagg

SEQ ID NO: 196463 - RNA, 22 nt, Human
aacaugcccgcuguaugccauu

SEQ ID NO: 196464 - RNA, 22 nt, Human
cuuggcccggagccccaugaag

SEQ ID NO: 196465 - RNA, 22 nt, Human
ggcaagugugagaagggacugg

SEQ ID NO: 196466 - RNA, 23 nt, Human
ccuccucauaucuuugacuagug

SEQ ID NO: 196467 - RNA, 22 nt, Human
uaggugucugcucuuauuuaac

SEQ ID NO: 196468 - RNA, 22 nt, Human
auaauaaugaaagccacugugu

SEQ ID NO: 196469 - RNA, 22 nt, Human
uccagcccaucccuagccuggg

SEQ ID NO: 196470 - RNA, 22 nt, Human
caggcccauucuaggcuugcua

SEQ ID NO: 196471 - RNA, 22 nt, Human
acaaauuauagaaaauugagcu

SEQ ID NO: 196472 - RNA, 22 nt, Human
cagcagaaauggauuuugagau

SEQ ID NO: 196473 - RNA, 22 nt, Human
agccuauuccaggaugagcuca

SEQ ID NO: 196474 - RNA, 22 nt, Human
agauggcuuugcuuuuagaagc

SEQ ID NO: 196475 - RNA, 22 nt, Human
guggaaggaauuaacagacuag

SEQ ID NO: 196476 - RNA, 22 nt, Human
uggaaagaggaagugcccagca

SEQ ID NO: 196477 - RNA, 22 nt, Human
acaagguacaaaacagagcaca

SEQ ID NO: 196478 - RNA, 22 nt, Human
ggcuccagaggccuuaccugca

SEQ ID NO: 196479 - RNA, 22 nt, Human
gugugcagcagagacaggacuc

SEQ ID NO: 196480 - RNA, 22 nt, Human
ccagcuuucucagaggcuucua

SEQ ID NO: 196481 - RNA, 22 nt, Human
gcuuggcuggaaauagguugag

SEQ ID NO: 196482 - RNA, 22 nt, Human
acacugugagcugaagggcugc

SEQ ID NO: 196483 - RNA, 22 nt, Human
cugagggaggagaauugcuuga

SEQ ID NO: 196484 - RNA, 23 nt, Human
agugagcagcuguagggcaagga

SEQ ID NO: 196485 - RNA, 22 nt, Human
gugcccugcaugccccggguau

SEQ ID NO: 196486 - RNA, 22 nt, Human
uguauuuaagcuuuaccuaaaa

SEQ ID NO: 196487 - RNA, 22 nt, Human
cuguggaccugcucuuagagac

SEQ ID NO: 196488 - RNA, 22 nt, Human
uacaaguagcucagguuuucug

SEQ ID NO: 196489 - RNA, 21 nt, Human
gcaggugugguaucagcuucc

SEQ ID NO: 196490 - RNA, 22 nt, Human
agccugagagccaagcugugca

SEQ ID NO: 196491 - RNA, 18 nt, Human
gggagcugggaagcuggu

SEQ ID NO: 196492 - RNA, 19 nt, Human
cuggaaggagggacuguuc

SEQ ID NO: 196493 - RNA, 17 nt, Human
cucagcagggcucacuu

SEQ ID NO: 196494 - RNA, 22 nt, Human
aggacacacugcaagagccugg

SEQ ID NO: 196495 - RNA, 22 nt, Human
aggcuugguuaauucuguguga

SEQ ID NO: 196496 - RNA, 22 nt, Human
gcuggucuccgccgcucccuga

SEQ ID NO: 196497 - RNA, 22 nt, Human
gaacaaggauucccaaagaaga

SEQ ID NO: 196498 - RNA, 22 nt, Human
ucugggcucugcgaagcccuuc

SEQ ID NO: 196499 - RNA, 22 nt, Human
cugagagguaagcagcgcagug

SEQ ID NO: 196500 - RNA, 22 nt, Human
uuucagaaccgcuaaaauaaau

SEQ ID NO: 196501 - RNA, 22 nt, Human
agccaggacaucucuagcugcu

SEQ ID NO: 196502 - RNA, 22 nt, Human
caggaaggggcucacucuggcc

SEQ ID NO: 196503 - RNA, 22 nt, Human
auauaaagagcuuaguauagug

SEQ ID NO: 196504 - RNA, 22 nt, Human
acauuuguauauaugcagcaua

SEQ ID NO: 196505 - RNA, 22 nt, Human
acugagguuuacuugaaggaga

SEQ ID NO: 196506 - RNA, 23 nt, Human
ggucccugacagcgggcaaguug

SEQ ID NO: 196507 - RNA, 22 nt, Human
uuuccagugauugcugcucuca

SEQ ID NO: 196508 - RNA, 17 nt, Human
cugaagauaauggcaac

SEQ ID NO: 196509 - RNA, 22 nt, Human
cagcauucuacuuugugaacug

SEQ ID NO: 196510 - RNA, 22 nt, Human
gcuuuagaaauguaggagauac

SEQ ID NO: 196511 - RNA, 22 nt, Human
ucuuaaugaaagugaaauauca

SEQ ID NO: 196512 - RNA, 21 nt, Human
cagcagguggagccucuuguc

SEQ ID NO: 196513 - RNA, 22 nt, Human
ggccucucuggcauggcugccc

SEQ ID NO: 196514 - RNA, 22 nt, Human
uuguguguagacucagccauug

SEQ ID NO: 196515 - RNA, 22 nt, Human
ucuggggagucaaagagaccug

SEQ ID NO: 196516 - RNA, 22 nt, Human
auguuuaugaccuccauaagga

SEQ ID NO: 196517 - RNA, 22 nt, Human
aacuucaccuuuuugccacacu

SEQ ID NO: 196518 - RNA, 22 nt, Human
aucagcagaugcucaaugaaca

SEQ ID NO: 196519 - RNA, 22 nt, Human
uagagcaguuggcagcuguauu

SEQ ID NO: 196520 - RNA, 22 nt, Human
aauggcaagcugaacucagaag

SEQ ID NO: 196521 - RNA, 22 nt, Human
cagaggcaaaagagguggaggu

SEQ ID NO: 196522 - RNA, 22 nt, Human
uuuccuaguucuaagaaaugua

SEQ ID NO: 196523 - RNA, 22 nt, Human
agucucuuuugguuccaaaaau

SEQ ID NO: 196524 - RNA, 22 nt, Human
gagcuccugcugcauccugccu

SEQ ID NO: 196525 - RNA, 22 nt, Human
cugugaauugaauaugacuaug

SEQ ID NO: 196526 - RNA, 22 nt, Human
auauuuucacugaaccaaagua

SEQ ID NO: 196527 - RNA, 22 nt, Human
caggugucagcagcacuguacu

SEQ ID NO: 196528 - RNA, 22 nt, Human
uuacagcagcagggacagacua

SEQ ID NO: 196529 - RNA, 22 nt, Human
gagugucaaggcucucuuuggc

SEQ ID NO: 196530 - RNA, 22 nt, Human
caugugucaaaugauguagcug

SEQ ID NO: 196531 - RNA, 22 nt, Human
uuucauugaugggugauagaaa

SEQ ID NO: 196532 - RNA, 22 nt, Human
ggaggccagggacccagucagc

SEQ ID NO: 196533 - RNA, 22 nt, Human
uuaguuaauaggucuucagcuu

SEQ ID NO: 196534 - RNA, 22 nt, Human
ucacacacauaaucuaagauua

SEQ ID NO: 196535 - RNA, 22 nt, Human
auggcagccuguggacagucaa

SEQ ID NO: 196536 - RNA, 22 nt, Human
aauauucauuugcagaagaagu

SEQ ID NO: 196537 - RNA, 22 nt, Human
aacuagaacgucuaguugcugg

SEQ ID NO: 196538 - RNA, 22 nt, Human
gcuggagguagggagguccugu

SEQ ID NO: 196539 - RNA, 22 nt, Human
cucuguggguauuuauauguau

SEQ ID NO: 196540 - RNA, 22 nt, Human
uugaggagugugaggucuccca

SEQ ID NO: 196541 - RNA, 22 nt, Human
cuccagggagcuguggagguuu

SEQ ID NO: 196542 - RNA, 22 nt, Human
uuggaugaagucuagcuuuagu

SEQ ID NO: 196543 - RNA, 22 nt, Human
gcuugucauaguuguuacaaau

SEQ ID NO: 196544 - RNA, 23 nt, Human
uccaguagggagucugcuuacuu

SEQ ID NO: 196545 - RNA, 22 nt, Human
ugccucagcugaggccgcucca

SEQ ID NO: 196546 - RNA, 22 nt, Human
caguauuuauggcuugaguauu

SEQ ID NO: 196547 - RNA, 22 nt, Human
aagcagacaucccauacuuuug

SEQ ID NO: 196548 - RNA, 18 nt, Human
aaaaagugcucaggccua

SEQ ID NO: 196549 - RNA, 22 nt, Human
acugggcucccaggcuugucau

SEQ ID NO: 196550 - RNA, 22 nt, Human
ugccagccagguucugaggcua

SEQ ID NO: 196551 - RNA, 22 nt, Human
agggcugaagggaggugcucau

SEQ ID NO: 196552 - RNA, 22 nt, Human
gagcuggcaaugacuuguguau

SEQ ID NO: 196553 - RNA, 22 nt, Human
cugcucuugagggacugcgguc

SEQ ID NO: 196554 - RNA, 22 nt, Human
gacucuuucaaacagaaagcca

SEQ ID NO: 196555 - RNA, 22 nt, Human
acuuccaaauaccaucacauug

SEQ ID NO: 196556 - RNA, 22 nt, Human
augaggcaggauauuaacuuuu

SEQ ID NO: 196557 - RNA, 22 nt, Human
guccaggcugaccccuagagga

SEQ ID NO: 196558 - RNA, 22 nt, Human
cucuggaauuaaggaagccugu

SEQ ID NO: 196559 - RNA, 22 nt, Human
gagauauguuggcagcugguau

SEQ ID NO: 196560 - RNA, 22 nt, Human
ccuccuggccugugcagagccc

SEQ ID NO: 196561 - RNA, 22 nt, Human
ggaagugguagagccaugagug

SEQ ID NO: 196562 - RNA, 22 nt, Human
aaauacuagaauucagaguuga

SEQ ID NO: 196563 - RNA, 22 nt, Human
uaugcuaaugacacucuagaaa

SEQ ID NO: 196564 - RNA, 22 nt, Human
uuccuucuggaggcuccagggg

SEQ ID NO: 196565 - RNA, 22 nt, Human
ugucucaucucuuaaccccacu

SEQ ID NO: 196566 - RNA, 22 nt, Human
uauacaagugagaagaagaguu

SEQ ID NO: 196567 - RNA, 22 nt, Human
uucugggugccaccuaagacau

SEQ ID NO: 196568 - RNA, 22 nt, Human
uguacaguggaaaauggauucg

SEQ ID NO: 196569 - RNA, 22 nt, Human
agucaggaagcuggagcugggg

SEQ ID NO: 196570 - RNA, 22 nt, Human
acugggcugcuugagugccuuc

SEQ ID NO: 196571 - RNA, 22 nt, Human
uacaugcucaguaacuuucagu

SEQ ID NO: 196572 - RNA, 22 nt, Human
ucugggcuggugcucaugaauu

SEQ ID NO: 196573 - RNA, 22 nt, Human
acagacugugagucucauuuuc

SEQ ID NO: 196574 - RNA, 17 nt, Human
uuugaaaggaugucagu

SEQ ID NO: 196575 - RNA, 22 nt, Human
acagcagggggagcuguuggac

SEQ ID NO: 196576 - RNA, 22 nt, Human
gcccaggagaggccagggcuga

SEQ ID NO: 196577 - RNA, 22 nt, Human
cagcugaguguuggcauguuca

SEQ ID NO: 196578 - RNA, 22 nt, Human
agccagucucucucccuggaga

SEQ ID NO: 196579 - RNA, 22 nt, Human
aagucugggccuccuucccaga

SEQ ID NO: 196580 - RNA, 22 nt, Human
gcugcucucagagcucaugcug

SEQ ID NO: 196581 - RNA, 22 nt, Human
agugcaacagaagcaggcuggc

SEQ ID NO: 196582 - RNA, 22 nt, Human
ucugugucccuucuaauuucag

SEQ ID NO: 196583 - RNA, 22 nt, Human
ugagcugauggcaucccuguuu

SEQ ID NO: 196584 - RNA, 18 nt, Human
caugcagagggaucugug

SEQ ID NO: 196585 - RNA, 22 nt, Human
gcuuccagaucccaugcucuua

SEQ ID NO: 196586 - RNA, 22 nt, Human
gacccugccaugagugacaggg

SEQ ID NO: 196587 - RNA, 20 nt, Human
uccaugaguuagagacuaua

SEQ ID NO: 196588 - RNA, 22 nt, Human
ugcaggguagaugcaggcugug

SEQ ID NO: 196589 - RNA, 22 nt, Human
aggucaggguauucacgucugu

SEQ ID NO: 196590 - RNA, 21 nt, Human
ccaagagcaaugcuaaggaga

SEQ ID NO: 196591 - RNA, 20 nt, Human
aguguuuagaauacuauuau

SEQ ID NO: 196592 - RNA, 22 nt, Human
gucuguggaguugcuugcugga

SEQ ID NO: 196593 - RNA, 22 nt, Human
uguguucaaucaccaaagguau

SEQ ID NO: 196594 - RNA, 22 nt, Human
ucuccaggaaagacacuggacu

SEQ ID NO: 196595 - RNA, 22 nt, Human
gcagccagggcuaagcugggga

SEQ ID NO: 196596 - RNA, 22 nt, Human
caggaagcuggucagauccugu

SEQ ID NO: 196597 - RNA, 22 nt, Human
cagccugcucucagauguugag

SEQ ID NO: 196598 - RNA, 18 nt, Human
ugccagccgacuggccug

SEQ ID NO: 196599 - RNA, 22 nt, Human
uggaaacuagccuuuuagguug

SEQ ID NO: 196600 - RNA, 22 nt, Human
uucaaaguugcaugacagcuua

SEQ ID NO: 196601 - RNA, 23 nt, Human
ucagggacaugaugugucauauc

SEQ ID NO: 196602 - RNA, 22 nt, Human
gugugccacugccugaggaccc

SEQ ID NO: 196603 - RNA, 22 nt, Human
gcucagagcagaugguacucag

SEQ ID NO: 196604 - RNA, 22 nt, Human
ucugagcuguggccauucuucc

SEQ ID NO: 196605 - RNA, 19 nt, Human
ccagagguuugcugggccu

SEQ ID NO: 196606 - RNA, 22 nt, Human
gucauuccuuauguugauucag

SEQ ID NO: 196607 - RNA, 22 nt, Human
acaauaguaagguauauuguca

SEQ ID NO: 196608 - RNA, 22 nt, Human
uugcauguacguacagagagag

SEQ ID NO: 196609 - RNA, 20 nt, Human
uccccagggcaucaggagca

SEQ ID NO: 196610 - RNA, 22 nt, Human
gagcucagcaaaggucugugug

SEQ ID NO: 196611 - RNA, 22 nt, Human
ggaugaggaaaccacagugucc

SEQ ID NO: 196612 - RNA, 22 nt, Human
cugagguguggucugggaguau

SEQ ID NO: 196613 - RNA, 19 nt, Human
cucugggcaagucacuuaa

SEQ ID NO: 196614 - RNA, 22 nt, Human
gaagccuugaacugcaaacccc

SEQ ID NO: 196615 - RNA, 22 nt, Human
aguauuugaucagaugauagua

SEQ ID NO: 196616 - RNA, 22 nt, Human
gacuuucuguccagugauuucu

SEQ ID NO: 196617 - RNA, 22 nt, Human
uccuggcagagggcggccucga

SEQ ID NO: 196618 - RNA, 22 nt, Human
uccuuggggacgcugacaucgu

SEQ ID NO: 196619 - RNA, 19 nt, Human
uauugguaugugugaggca

SEQ ID NO: 196620 - RNA, 22 nt, Human
cuccuacaguguuugaguccag

SEQ ID NO: 196621 - RNA, 19 nt, Human
ccucugccagcccgccucu

SEQ ID NO: 196622 - RNA, 22 nt, Human
uuuacaagucagggacuguucu

SEQ ID NO: 196623 - RNA, 20 nt, Human
ucugaauugagugaaugucu

SEQ ID NO: 196624 - RNA, 22 nt, Human
gaagucuggcugacgagaguua

SEQ ID NO: 196625 - RNA, 22 nt, Human
ugacauuuaaucccuaaauauu

SEQ ID NO: 196626 - RNA, 22 nt, Human
aaacacauuagcccuguggaaa

SEQ ID NO: 196627 - RNA, 22 nt, Human
gaccugagauuuugaggcucau

SEQ ID NO: 196628 - RNA, 22 nt, Human
ccagggcaggagaaagacucac

SEQ ID NO: 196629 - RNA, 22 nt, Human
uuacuuuugcaccaaacuaaua

SEQ ID NO: 196630 - RNA, 22 nt, Human
accuucaaacuagauagaaguu

SEQ ID NO: 196631 - RNA, 22 nt, Human
agcacaaugugaaaagagcucu

SEQ ID NO: 196632 - RNA, 22 nt, Human
aauaacuucaucuucaggauag

SEQ ID NO: 196633 - RNA, 21 nt, Human
cucugggacauuucuuagcag

SEQ ID NO: 196634 - RNA, 23 nt, Human
cagcucagcacauaggagguacu

SEQ ID NO: 196635 - RNA, 22 nt, Human
cacagggccuugugugacugca

SEQ ID NO: 196636 - RNA, 22 nt, Human
ggcucaccauuuucacucucug

SEQ ID NO: 196637 - RNA, 22 nt, Human
ugaaucaauugucuuaagacau

SEQ ID NO: 196638 - RNA, 19 nt, Human
aggcuugguguugaauggg

SEQ ID NO: 196639 - RNA, 19 nt, Human
gaggcgaggcgugcaggag

SEQ ID NO: 196640 - RNA, 22 nt, Human
gcaguggcagagacagcaccaa

SEQ ID NO: 196641 - RNA, 22 nt, Human
uuuugaauaauucagaaacagc

SEQ ID NO: 196642 - RNA, 22 nt, Human
ugguaauauaugccagauaaaa

SEQ ID NO: 196643 - RNA, 17 nt, Human
ggcaggugacagacacc

SEQ ID NO: 196644 - RNA, 22 nt, Human
ucagggagauuuggggacucaa

SEQ ID NO: 196645 - RNA, 22 nt, Human
cugcccugggugcuggggaucc

SEQ ID NO: 196646 - RNA, 22 nt, Human
aguguguuuggagcgagggagg

SEQ ID NO: 196647 - RNA, 22 nt, Human
cuuucagaagccggaagggcag

SEQ ID NO: 196648 - RNA, 22 nt, Human
ccuguucaaugcccuggcuuca

SEQ ID NO: 196649 - RNA, 22 nt, Human
ccaguguuuccccagaagagag

SEQ ID NO: 196650 - RNA, 22 nt, Human
ccagucugcagccccuggggac

SEQ ID NO: 196651 - RNA, 22 nt, Human
aguauacauagugcuuccucuu

SEQ ID NO: 196652 - RNA, 22 nt, Human
uuuuguuuucuuagaaaccugg

SEQ ID NO: 196653 - RNA, 22 nt, Human
aggagauggagcucagugggca

SEQ ID NO: 196654 - RNA, 22 nt, Human
acaguauaaacuccuaaaagcc

SEQ ID NO: 196655 - RNA, 22 nt, Human
uuuauaguagcaugauuuauaa

SEQ ID NO: 196656 - RNA, 18 nt, Human
ggcagugcagucucaggg

SEQ ID NO: 196657 - RNA, 22 nt, Human
ggcuugcuucaccuacccccag

SEQ ID NO: 196658 - RNA, 21 nt, Human
agcagcagcaguggggcuucu

SEQ ID NO: 196659 - RNA, 22 nt, Human
ugucuggggaacugugcaucca

SEQ ID NO: 196660 - RNA, 22 nt, Human
cuggcacaugcucccugagugg

SEQ ID NO: 196661 - RNA, 22 nt, Human
gucauggaggauugugaguggu

SEQ ID NO: 196662 - RNA, 22 nt, Human
cugcuguaaugagucagcaucu

SEQ ID NO: 196663 - RNA, 22 nt, Human
acacuuuagauauucccuucug

SEQ ID NO: 196664 - RNA, 22 nt, Human
gaguccaggauuugagcucugu

SEQ ID NO: 196665 - RNA, 22 nt, Human
cuugugaaaugccagauaaucu

SEQ ID NO: 196666 - RNA, 22 nt, Human
agugucuguugaguuucaaaag

SEQ ID NO: 196667 - RNA, 22 nt, Human
ggaccugcauuuuaacaagauc

SEQ ID NO: 196668 - RNA, 20 nt, Human
ggcuuucugugauccucagu

SEQ ID NO: 196669 - RNA, 18 nt, Human
aagcugcccucaggcagg

SEQ ID NO: 196670 - RNA, 22 nt, Human
agugucugccagcugccaggug

SEQ ID NO: 196671 - RNA, 22 nt, Human
auucuucagaauaucuggcacu

SEQ ID NO: 196672 - RNA, 22 nt, Human
ccguggcuucccaggcggaugu

SEQ ID NO: 196673 - RNA, 22 nt, Human
acacugugacaagaaagagcug

SEQ ID NO: 196674 - RNA, 23 nt, Human
aggcagugucucuuauccugucc

SEQ ID NO: 196675 - RNA, 22 nt, Human
uaagacauguccaggcugugag

SEQ ID NO: 196676 - RNA, 22 nt, Human
aaaggcuuaauguuguuguaau

SEQ ID NO: 196677 - RNA, 22 nt, Human
gugcaaaaguaauugcuguuuu

SEQ ID NO: 196678 - RNA, 22 nt, Human
ccaguguucugguguucauuuc

SEQ ID NO: 196679 - RNA, 19 nt, Human
acauuugucaagagaaggu

SEQ ID NO: 196680 - RNA, 22 nt, Human
aggccaggguagggcccauugu

SEQ ID NO: 196681 - RNA, 22 nt, Human
acuugguugaugucauaagguu

SEQ ID NO: 196682 - RNA, 22 nt, Human
ccacagagacaggguccuugcu

SEQ ID NO: 196683 - RNA, 22 nt, Human
cagcccuugaugauaauuuauc

SEQ ID NO: 196684 - RNA, 22 nt, Human
gaaccacaagauucaaaggggu

SEQ ID NO: 196685 - RNA, 20 nt, Human
agcugcagaacccacuggac

SEQ ID NO: 196686 - RNA, 17 nt, Human
acauuuccuaacugaag

SEQ ID NO: 196687 - RNA, 22 nt, Human
ucuggagcuugaagcuuugguu

SEQ ID NO: 196688 - RNA, 22 nt, Human
gcuguguccucacacagccuuu

SEQ ID NO: 196689 - RNA, 22 nt, Human
ugcaaggauauuuagucuagug

SEQ ID NO: 196690 - RNA, 22 nt, Human
aaagcaauugugguuuuuguca

SEQ ID NO: 196691 - RNA, 22 nt, Human
ucauuuucacacauaaauagca

SEQ ID NO: 196692 - RNA, 22 nt, Human
uguggggcagcuagccggccug

SEQ ID NO: 196693 - RNA, 22 nt, Human
gguggcagggagugucccuggg

SEQ ID NO: 196694 - RNA, 22 nt, Human
cauccaaagcaaauaucuuaaa

SEQ ID NO: 196695 - RNA, 22 nt, Human
agcaugcaggaaccacauggca

SEQ ID NO: 196696 - RNA, 22 nt, Human
gcuggcagcauuagacccuggg

SEQ ID NO: 196697 - RNA, 22 nt, Human
aaggaaagacauauaaaugacu

SEQ ID NO: 196698 - RNA, 22 nt, Human
aauguuuucucugugaacacau

SEQ ID NO: 196699 - RNA, 22 nt, Human
accaggcaacugugaaugggcu

SEQ ID NO: 196700 - RNA, 22 nt, Human
acugucuuguguuaaagaacca

SEQ ID NO: 196701 - RNA, 22 nt, Human
uguguccucaugagguuugcag

SEQ ID NO: 196702 - RNA, 22 nt, Human
agccuucuaggaugucaucugc

SEQ ID NO: 196703 - RNA, 18 nt, Human
auguucauauuuuuaggg

SEQ ID NO: 196704 - RNA, 22 nt, Human
ggcaagucaggaaguugacauu

SEQ ID NO: 196705 - RNA, 22 nt, Human
uuggcugcugaaauauguucug

SEQ ID NO: 196706 - RNA, 22 nt, Human
aacaguacuggacaaggaguca

SEQ ID NO: 196707 - RNA, 22 nt, Human
ugaguaggugguuaagcaugga

SEQ ID NO: 196708 - RNA, 22 nt, Human
augguggaagagcaucagaaag

SEQ ID NO: 196709 - RNA, 22 nt, Human
caaggcuagaaguccaacauca

SEQ ID NO: 196710 - RNA, 22 nt, Human
cuccccaaagauaacggcuucu

SEQ ID NO: 196711 - RNA, 22 nt, Human
ggacaguagucacuaaacuaga

SEQ ID NO: 196712 - RNA, 22 nt, Human
ugaagccauuacuguguuaggg

SEQ ID NO: 196713 - RNA, 22 nt, Human
uaggacaguggagauaaccaga

SEQ ID NO: 196714 - RNA, 22 nt, Human
auacauuagaaucugguacuca

SEQ ID NO: 196715 - RNA, 22 nt, Human
uuuuccuuucaucaggacaaag

SEQ ID NO: 196716 - RNA, 22 nt, Human
uaucagugauugcuguauacaa

SEQ ID NO: 196717 - RNA, 22 nt, Human
gggagguucuguucgcacuuga

SEQ ID NO: 196718 - RNA, 22 nt, Human
guuaaugucuuccuauucuaca

SEQ ID NO: 196719 - RNA, 22 nt, Human
uuaucuguuguuuuaguacaau

SEQ ID NO: 196720 - RNA, 22 nt, Human
cagccacugaacuccuggcuau

SEQ ID NO: 196721 - RNA, 18 nt, Human
ucuguggagagggcaguu

SEQ ID NO: 196722 - RNA, 22 nt, Human
ugacaagaggcagaaucagcug

SEQ ID NO: 196723 - RNA, 22 nt, Human
agaauauugaaaguucuugaca

SEQ ID NO: 196724 - RNA, 22 nt, Human
cccugaggggaguggugaggug

SEQ ID NO: 196725 - RNA, 22 nt, Human
agcucagggcaaagacucaaau

SEQ ID NO: 196726 - RNA, 20 nt, Human
ggcugucccgcggcugccgg

SEQ ID NO: 196727 - RNA, 22 nt, Human
aaagcagucuguuuuaaccuga

SEQ ID NO: 196728 - RNA, 22 nt, Human
gcucagagauguucaguagcuu

SEQ ID NO: 196729 - RNA, 21 nt, Human
gcucaaagggcuugccaugcu

SEQ ID NO: 196730 - RNA, 22 nt, Human
caggcuccucacucaugcuccc

SEQ ID NO: 196731 - RNA, 22 nt, Human
gccagccaagauugagaaggua

SEQ ID NO: 196732 - RNA, 22 nt, Human
ccaggagccugggccaggcugg

SEQ ID NO: 196733 - RNA, 22 nt, Human
gagaaggcuucuuuuccucuga

SEQ ID NO: 196734 - RNA, 22 nt, Human
ucacaggcuaaauuuaugcagg

SEQ ID NO: 196735 - RNA, 19 nt, Human
uuugucucugaauaauauu

SEQ ID NO: 196736 - RNA, 22 nt, Human
aucuagaaaaggugacuaaaau

SEQ ID NO: 196737 - RNA, 22 nt, Human
guccagucacugucaauguucc

SEQ ID NO: 196738 - RNA, 22 nt, Human
ucugggcuauauggucucugcu

SEQ ID NO: 196739 - RNA, 22 nt, Human
accaggaguuuugaccaggggc

SEQ ID NO: 196740 - RNA, 22 nt, Human
caaauggucauuucucuuuugu

SEQ ID NO: 196741 - RNA, 22 nt, Human
gggcacugacagggucccaacu

SEQ ID NO: 196742 - RNA, 22 nt, Human
aggggagagaacauaaggaagu

SEQ ID NO: 196743 - RNA, 22 nt, Human
uccuuaccucaagcuugugguc

SEQ ID NO: 196744 - RNA, 22 nt, Human
uacauguuugguaaaugauggc

SEQ ID NO: 196745 - RNA, 22 nt, Human
acuaaagcucacagaguugaac

SEQ ID NO: 196746 - RNA, 22 nt, Human
ugaauaaucuuggguauuaaua

SEQ ID NO: 196747 - RNA, 22 nt, Human
augcaugaugaacuugcuuuca

SEQ ID NO: 196748 - RNA, 23 nt, Human
ggcagauuugguuuguuuuaaua

SEQ ID NO: 196749 - RNA, 22 nt, Human
caggaaaugggguuuaguuauu

SEQ ID NO: 196750 - RNA, 22 nt, Human
cagaaucugagucgugauugua

SEQ ID NO: 196751 - RNA, 22 nt, Human
gccaccagccccaugcgcugug

SEQ ID NO: 196752 - RNA, 23 nt, Human
agcugcagaugcucagcgggcag

SEQ ID NO: 196753 - RNA, 22 nt, Human
caggcucagucagaaaauguau

SEQ ID NO: 196754 - RNA, 22 nt, Human
uccuuuguuaaggagguuuguu

SEQ ID NO: 196755 - RNA, 22 nt, Human
ugucugaagcagccagugcugu

SEQ ID NO: 196756 - RNA, 22 nt, Human
cuggucaccuccuucccagcua

SEQ ID NO: 196757 - RNA, 17 nt, Human
cugcuuugugcaacgcu

SEQ ID NO: 196758 - RNA, 22 nt, Human
ucagugucuugggcuugaaugc

SEQ ID NO: 196759 - RNA, 22 nt, Human
ugauuuugucauguuucugaua

SEQ ID NO: 196760 - RNA, 22 nt, Human
uacuucuguuagcucugagagu

SEQ ID NO: 196761 - RNA, 22 nt, Human
aacuuucuccagugccaacuau

SEQ ID NO: 196762 - RNA, 22 nt, Human
auggacagcaacuggaagcuuc

SEQ ID NO: 196763 - RNA, 22 nt, Human
agccuugaucuugguaacagga

SEQ ID NO: 196764 - RNA, 22 nt, Human
ccuggucagguaacugggcuga

SEQ ID NO: 196765 - RNA, 22 nt, Human
uuauaacuuuggauaugacaag

SEQ ID NO: 196766 - RNA, 22 nt, Human
ggagcucaccuuggagucucug

SEQ ID NO: 196767 - RNA, 20 nt, Human
uuauuucaguugcuagauug

SEQ ID NO: 196768 - RNA, 22 nt, Human
uuuccagguauuaauacuguau

SEQ ID NO: 196769 - RNA, 22 nt, Human
cucugugagggucuguacagaa

SEQ ID NO: 196770 - RNA, 22 nt, Human
uuugcagugauucuugcaguga

SEQ ID NO: 196771 - RNA, 19 nt, Human
ggucagagagauccaggcu

SEQ ID NO: 196772 - RNA, 22 nt, Human
acagggaaggauuuagugggaa

SEQ ID NO: 196773 - RNA, 22 nt, Human
uuguuuccauugcagacugugu

SEQ ID NO: 196774 - RNA, 22 nt, Human
aggagcugggagaaggacuaaa

SEQ ID NO: 196775 - RNA, 22 nt, Human
gacccuuagaaugugaucuuau

SEQ ID NO: 196776 - RNA, 22 nt, Human
aggagcucacaucuuuauuucu

SEQ ID NO: 196777 - RNA, 22 nt, Human
agcuacagucggaaggacagac

SEQ ID NO: 196778 - RNA, 23 nt, Human
uugcugccugagccuuccucugg

SEQ ID NO: 196779 - RNA, 22 nt, Human
gggcacugcuggaggcucccug

SEQ ID NO: 196780 - RNA, 22 nt, Human
uagacuagaggaucagcaaggg

SEQ ID NO: 196781 - RNA, 22 nt, Human
gcugggugauucauuuccauaa

SEQ ID NO: 196782 - RNA, 22 nt, Human
gggaucugacuugcuggugggu

SEQ ID NO: 196783 - RNA, 22 nt, Human
uacccagggcuuuucugaugca

SEQ ID NO: 196784 - RNA, 22 nt, Human
uguguauguuuugagguugcua

SEQ ID NO: 196785 - RNA, 22 nt, Human
ccagcugguguuccuuaggacc

SEQ ID NO: 196786 - RNA, 22 nt, Human
caaaggcaaucuuguucucugg

SEQ ID NO: 196787 - RNA, 22 nt, Human
ugucuccauuuucaaguagcag

SEQ ID NO: 196788 - RNA, 22 nt, Human
aauaaacugcucaauugcauca

SEQ ID NO: 196789 - RNA, 22 nt, Human
ucugugcaccuucuaaugagua

SEQ ID NO: 196790 - RNA, 22 nt, Human
ugggcagaggacagggaagauc

SEQ ID NO: 196791 - RNA, 22 nt, Human
uggggcuggcuauugucucccu

SEQ ID NO: 196792 - RNA, 22 nt, Human
uggccuuuucuuucacaggcaa

SEQ ID NO: 196793 - RNA, 21 nt, Human
uggccagcuggagucuccaca

SEQ ID NO: 196794 - RNA, 22 nt, Human
cuccugagaggaucucuguugu

SEQ ID NO: 196795 - RNA, 22 nt, Human
guaucuggugaggguuccccug

SEQ ID NO: 196796 - RNA, 20 nt, Human
ggggcugcaugcagagaaga

SEQ ID NO: 196797 - RNA, 21 nt, Human
gcugccaccgcgugcuccagg

SEQ ID NO: 196798 - RNA, 22 nt, Human
aaagagucguguuccagguuug

SEQ ID NO: 196799 - RNA, 22 nt, Human
augaagucugccaaggaaaggc

SEQ ID NO: 196800 - RNA, 22 nt, Human
uuccaauuuguggugaguuaau

SEQ ID NO: 196801 - RNA, 22 nt, Human
cccagcuggccagguggcuuug

SEQ ID NO: 196802 - RNA, 22 nt, Human
uggcccagcucagggugggcgg

SEQ ID NO: 196803 - RNA, 19 nt, Human
ccaggccaucccaguuccc

SEQ ID NO: 196804 - RNA, 22 nt, Human
guaaaacaagcuuuaugguucc

SEQ ID NO: 196805 - RNA, 22 nt, Human
caugugucuaaucuacuaauau

SEQ ID NO: 196806 - RNA, 22 nt, Human
ggaauguucuggaacaccgcuu

SEQ ID NO: 196807 - RNA, 22 nt, Human
uugguuuacucuggggauaucu

SEQ ID NO: 196808 - RNA, 22 nt, Human
gucaaaaaguagucauuucugu

SEQ ID NO: 196809 - RNA, 22 nt, Human
gcuccucugucaaaugagagug

SEQ ID NO: 196810 - RNA, 22 nt, Human
acauggaucaaccuauuuucuu

SEQ ID NO: 196811 - RNA, 19 nt, Human
uccuggcaucuuccucccu

SEQ ID NO: 196812 - RNA, 22 nt, Human
cacauguccuggcgcugagccc

SEQ ID NO: 196813 - RNA, 22 nt, Human
uucuuuuaauguucugaaguuu

SEQ ID NO: 196814 - RNA, 22 nt, Human
uacaaagucccauugccaugga

SEQ ID NO: 196815 - RNA, 18 nt, Human
ggguccugugggagacag

SEQ ID NO: 196816 - RNA, 22 nt, Human
ucauuuguucucauucucuacu

SEQ ID NO: 196817 - RNA, 22 nt, Human
augugucugguuauugacaugc

SEQ ID NO: 196818 - RNA, 22 nt, Human
cugagcugcucccgcugcagcg

SEQ ID NO: 196819 - RNA, 22 nt, Human
cuggcugccacuucagggucuu

SEQ ID NO: 196820 - RNA, 22 nt, Human
guuaggaacacuggagccuaaa

SEQ ID NO: 196821 - RNA, 22 nt, Human
agcuggcugccuucuccuuagg

SEQ ID NO: 196822 - RNA, 20 nt, Human
acauggcauucccacguggu

SEQ ID NO: 196823 - RNA, 22 nt, Human
cucucuggucccagauuccaga

SEQ ID NO: 196824 - RNA, 17 nt, Human
ugaaggccaugaccacg

SEQ ID NO: 196825 - RNA, 22 nt, Human
guaauagaacacucagcaugga

SEQ ID NO: 196826 - RNA, 22 nt, Human
ugugaaaucacaggcuauuuag

SEQ ID NO: 196827 - RNA, 22 nt, Human
cauuugauuacuaaagauaauu

SEQ ID NO: 196828 - RNA, 19 nt, Human
aaauacagcagcuguuucc

SEQ ID NO: 196829 - RNA, 22 nt, Human
caagcuuuccauuacacacauu

SEQ ID NO: 196830 - RNA, 22 nt, Human
aaaguauuugugauuuuuacca

SEQ ID NO: 196831 - RNA, 22 nt, Human
auguggcuagugcaacugagaa

SEQ ID NO: 196832 - RNA, 22 nt, Human
gggcaagaagcuggaagcauuc

SEQ ID NO: 196833 - RNA, 22 nt, Human
acugccauuuugaauaauuacu

SEQ ID NO: 196834 - RNA, 22 nt, Human
gggucagagccguaacaggacu

SEQ ID NO: 196835 - RNA, 22 nt, Human
uuuaucaucuuguuuuuaaagc

SEQ ID NO: 196836 - RNA, 22 nt, Human
cccuggacuguucagggccuga

SEQ ID NO: 196837 - RNA, 22 nt, Human
ugaugugugauucauucucaaa

SEQ ID NO: 196838 - RNA, 22 nt, Human
ugugcaggugcaggaagggggc

SEQ ID NO: 196839 - RNA, 22 nt, Human
gaacauuuggauuuguaaauuu

SEQ ID NO: 196840 - RNA, 22 nt, Human
acagcugugagggucacuugua

SEQ ID NO: 196841 - RNA, 22 nt, Human
gccuccuguuaugccaugugcc

SEQ ID NO: 196842 - RNA, 22 nt, Human
ucaggccuggagaaaggaauga

SEQ ID NO: 196843 - RNA, 22 nt, Human
auacacuuguacauuuuuuaau

SEQ ID NO: 196844 - RNA, 22 nt, Human
uucuugccugcccugugucgua

SEQ ID NO: 196845 - RNA, 22 nt, Human
gggcuggcgggaaaggcaauuc

SEQ ID NO: 196846 - RNA, 22 nt, Human
guacacuugacucauaggaaau

SEQ ID NO: 196847 - RNA, 22 nt, Human
aacauuuaugguagucauugca

SEQ ID NO: 196848 - RNA, 22 nt, Human
aauucauugccagaaucuauga

SEQ ID NO: 196849 - RNA, 22 nt, Human
ucugcccagccagacccaaggu

SEQ ID NO: 196850 - RNA, 22 nt, Human
agaucacaguggcaacucccuu

SEQ ID NO: 196851 - RNA, 22 nt, Human
uuucagaaggggagaaagguca

SEQ ID NO: 196852 - RNA, 22 nt, Human
auuuacagguagaauuuuaagu

SEQ ID NO: 196853 - RNA, 18 nt, Human
agacagacagguuugugc

SEQ ID NO: 196854 - RNA, 22 nt, Human
aauucuauaggcaagcuauuuu

SEQ ID NO: 196855 - RNA, 22 nt, Human
uaaaguguuguacaaauguaug

SEQ ID NO: 196856 - RNA, 22 nt, Human
ccuuucugguauuuaaccaaag

SEQ ID NO: 196857 - RNA, 22 nt, Human
gccuguuuguuugcaaaggagc

SEQ ID NO: 196858 - RNA, 22 nt, Human
accaggacauuuuagucaucuu

SEQ ID NO: 196859 - RNA, 22 nt, Human
aguaaacauuucagauuuauuu

SEQ ID NO: 196860 - RNA, 22 nt, Human
agugcucauaaaaaugugaaac

SEQ ID NO: 196861 - RNA, 22 nt, Human
uuucacuggaauuuuaacauuu

SEQ ID NO: 196862 - RNA, 22 nt, Human
uguggccaggccccugauggug

SEQ ID NO: 196863 - RNA, 22 nt, Human
gccucagagggcccuagggaca

SEQ ID NO: 196864 - RNA, 22 nt, Human
uucccuccgaaccucagugcug

SEQ ID NO: 196865 - RNA, 22 nt, Human
cuaauagauaccacauuggaca

SEQ ID NO: 196866 - RNA, 22 nt, Human
uaucacaucaauguuuuaaaau

SEQ ID NO: 196867 - RNA, 22 nt, Human
gcucaggaaaacagucuaguaa

SEQ ID NO: 196868 - RNA, 22 nt, Human
cugcucagaggaaggaaugucu

SEQ ID NO: 196869 - RNA, 22 nt, Human
uucacugcuacauccaggugcc

SEQ ID NO: 196870 - RNA, 22 nt, Human
cagccugacuauggcugcaggu

SEQ ID NO: 196871 - RNA, 22 nt, Human
aaacaccaagagcuagcuauua

SEQ ID NO: 196872 - RNA, 22 nt, Human
uugcaaaugugguuagggcuuu

SEQ ID NO: 196873 - RNA, 22 nt, Human
cauuuguauagugcuuagacca

SEQ ID NO: 196874 - RNA, 22 nt, Human
ucucuaggggagccccguuugu

SEQ ID NO: 196875 - RNA, 18 nt, Human
aggaaagaaaggcaggug

SEQ ID NO: 196876 - RNA, 22 nt, Human
uagcaaaaaaacuggcaucucc

SEQ ID NO: 196877 - RNA, 22 nt, Human
uaaacuguguaauaugaugucu

SEQ ID NO: 196878 - RNA, 22 nt, Human
gggcaggugauuuuggcuccau

SEQ ID NO: 196879 - RNA, 22 nt, Human
caggaagcucuuagcagucacc

SEQ ID NO: 196880 - RNA, 22 nt, Human
ccagccuggacugggucuugug

SEQ ID NO: 196881 - RNA, 22 nt, Human
uccacagugguugaacuaguuu

SEQ ID NO: 196882 - RNA, 22 nt, Human
ggcaagaaggcuucagguagcu

SEQ ID NO: 196883 - RNA, 22 nt, Human
aggacagugguguucuggagug

SEQ ID NO: 196884 - RNA, 21 nt, Human
gccagccuguuuaccuguggu

SEQ ID NO: 196885 - RNA, 22 nt, Human
gcuccuccaauauggacuccuc

SEQ ID NO: 196886 - RNA, 22 nt, Human
acaugcauucucuaaaagcaaa

SEQ ID NO: 196887 - RNA, 19 nt, Human
cuuccccuguuaccucacu

SEQ ID NO: 196888 - RNA, 22 nt, Human
ucugggucuaucccaugccuuu

SEQ ID NO: 196889 - RNA, 22 nt, Human
ccuuucccgcuuugagggcaag

SEQ ID NO: 196890 - RNA, 22 nt, Human
ccuagaaugugcagacuuaggg

SEQ ID NO: 196891 - RNA, 22 nt, Human
uacaguuuuuauucaugacaag

SEQ ID NO: 196892 - RNA, 22 nt, Human
gggaaacuggggacugaaucug

SEQ ID NO: 196893 - RNA, 22 nt, Human
uuugauuuucagcaauaguggc

SEQ ID NO: 196894 - RNA, 19 nt, Human
agcuggggcgguguguguu

SEQ ID NO: 196895 - RNA, 22 nt, Human
cagggccucgaagccucugggc

SEQ ID NO: 196896 - RNA, 22 nt, Human
gggacccugggaggcuggcgca

SEQ ID NO: 196897 - RNA, 22 nt, Human
ugaaacauuugaugaucuuugg

SEQ ID NO: 196898 - RNA, 22 nt, Human
gcagcccaaaaaagagguagau

SEQ ID NO: 196899 - RNA, 22 nt, Human
agaacacucuccugaaaauuaa

SEQ ID NO: 196900 - RNA, 22 nt, Human
cacaggugugugccuuaucaaa

SEQ ID NO: 196901 - RNA, 22 nt, Human
aguuaagagugugaaaauguua

SEQ ID NO: 196902 - RNA, 20 nt, Human
uguaaaacaaggugaauccu

SEQ ID NO: 196903 - RNA, 22 nt, Human
gggcaugcaggacuguggcaga

SEQ ID NO: 196904 - RNA, 22 nt, Human
uccaggcuacuuggauuccugg

SEQ ID NO: 196905 - RNA, 22 nt, Human
agcuggcugggugccagucucc

SEQ ID NO: 196906 - RNA, 22 nt, Human
uaaaugauuuauguaugugaaa

SEQ ID NO: 196907 - RNA, 22 nt, Human
agcuccagggaaagaguggauc

SEQ ID NO: 196908 - RNA, 22 nt, Human
uaccaggcagcugcacagaggc

SEQ ID NO: 196909 - RNA, 22 nt, Human
uuccuggcuggcgguuuuggug

SEQ ID NO: 196910 - RNA, 22 nt, Human
uuuauugcccuguaguacagga

SEQ ID NO: 196911 - RNA, 22 nt, Human
cacauccuucauacucagcucu

SEQ ID NO: 196912 - RNA, 22 nt, Human
gaggcuucccgcccaugcugga

SEQ ID NO: 196913 - RNA, 22 nt, Human
acaagugcauggaaucagcugu

SEQ ID NO: 196914 - RNA, 22 nt, Human
ggggaacaccgggcagaggcgc

SEQ ID NO: 196915 - RNA, 22 nt, Human
uaacaguauagccuaacauuuc

SEQ ID NO: 196916 - RNA, 22 nt, Human
uacaugcacaugaacaugugug

SEQ ID NO: 196917 - RNA, 22 nt, Human
uuccuggaaauuaugcucaccu

SEQ ID NO: 196918 - RNA, 22 nt, Human
agccagagauccaucccuagga

SEQ ID NO: 196919 - RNA, 19 nt, Human
uccuggggauguggucacc

SEQ ID NO: 196920 - RNA, 22 nt, Human
uacagcuggacugguagcugug

SEQ ID NO: 196921 - RNA, 22 nt, Human
aaguauucuggcagucauucag

SEQ ID NO: 196922 - RNA, 18 nt, Human
uuaugcaaaacuguuuuc

SEQ ID NO: 196923 - RNA, 22 nt, Human
aaggccagcuuguagggcuggu

SEQ ID NO: 196924 - RNA, 23 nt, Human
ugcagagggacugaagccagcuu

SEQ ID NO: 196925 - RNA, 22 nt, Human
uagaaggcuuugagagauacuu

SEQ ID NO: 196926 - RNA, 22 nt, Human
ggcuuuauaggguagaggauca

SEQ ID NO: 196927 - RNA, 22 nt, Human
agcagaaagcuuauuuugacug

SEQ ID NO: 196928 - RNA, 22 nt, Human
ugcuggcuuuagugauuggggu

SEQ ID NO: 196929 - RNA, 23 nt, Human
guguguggaaagugcaugggccu

SEQ ID NO: 196930 - RNA, 22 nt, Human
cucucuggcuuggcacggagau

SEQ ID NO: 196931 - RNA, 22 nt, Human
ggcugccaggagaagcucagug

SEQ ID NO: 196932 - RNA, 22 nt, Human
cacaugagguggagaugaauga

SEQ ID NO: 196933 - RNA, 22 nt, Human
ggggagaauuaccaaaagcgcu

SEQ ID NO: 196934 - RNA, 22 nt, Human
aguaucauguuggaauuaauca

SEQ ID NO: 196935 - RNA, 22 nt, Human
ccaggacaaguguggccauggc

SEQ ID NO: 196936 - RNA, 22 nt, Human
uaaacauguugacaucuuaccu

SEQ ID NO: 196937 - RNA, 22 nt, Human
ggccaggcugcccugggagcag

SEQ ID NO: 196938 - RNA, 22 nt, Human
ucaggagcuugguagugugauu

SEQ ID NO: 196939 - RNA, 22 nt, Human
agcuggaagugcauuucucacu

SEQ ID NO: 196940 - RNA, 22 nt, Human
caaauucucuuacuguuugaca

SEQ ID NO: 196941 - RNA, 22 nt, Human
cguggggcggguggacacuugc

SEQ ID NO: 196942 - RNA, 22 nt, Human
ugaaagcagcaccaauaccauu

SEQ ID NO: 196943 - RNA, 22 nt, Human
uugaggcugcacaguacaggcu

SEQ ID NO: 196944 - RNA, 22 nt, Human
uacauauucaacguucaguauu

SEQ ID NO: 196945 - RNA, 20 nt, Human
augcacccucagggucccug

SEQ ID NO: 196946 - RNA, 22 nt, Human
gacagacacuauugguaugccu

SEQ ID NO: 196947 - RNA, 22 nt, Human
auggcagcaaaugucuggcugg

SEQ ID NO: 196948 - RNA, 22 nt, Human
ggucacagggaagggcucucaa

SEQ ID NO: 196949 - RNA, 22 nt, Human
ccuguggcugccacuuggguga

SEQ ID NO: 196950 - RNA, 22 nt, Human
uaauuuugucccccugcacaua

SEQ ID NO: 196951 - RNA, 22 nt, Human
uucaaucauugcaaaguaaugg

SEQ ID NO: 196952 - RNA, 22 nt, Human
ucugagcuucugcauuuccaac

SEQ ID NO: 196953 - RNA, 20 nt, Human
uccagggcccuggcuccucu

SEQ ID NO: 196954 - RNA, 22 nt, Human
caucagagugguggccuggugu

SEQ ID NO: 196955 - RNA, 22 nt, Human
cuuccucacggugcaacaggaa

SEQ ID NO: 196956 - RNA, 22 nt, Human
agcugcagccgcagcuguggcc

SEQ ID NO: 196957 - RNA, 22 nt, Human
ucacacguccuugcuacuccuc

SEQ ID NO: 196958 - RNA, 22 nt, Human
gcucagggccuggcugcggacu

SEQ ID NO: 196959 - RNA, 22 nt, Human
gcccuucacgaugguaucuuag

SEQ ID NO: 196960 - RNA, 22 nt, Human
cugggccugucccugauugagg

SEQ ID NO: 196961 - RNA, 22 nt, Human
ucuggguggcugccaaucugcc

SEQ ID NO: 196962 - RNA, 22 nt, Human
auaaaaccaaagcagcaguguu

SEQ ID NO: 196963 - RNA, 22 nt, Human
agacacagugcugggugcugag

SEQ ID NO: 196964 - RNA, 22 nt, Human
cuugcaugcauuugaagaucau

SEQ ID NO: 196965 - RNA, 22 nt, Human
gcuggugguaaggaggaaaaag

SEQ ID NO: 196966 - RNA, 22 nt, Human
cccugcugcagagagcuuucca

SEQ ID NO: 196967 - RNA, 22 nt, Human
ucucuuggagguucuuccuguu

SEQ ID NO: 196968 - RNA, 22 nt, Human
ucucugagcccaauguagcaau

SEQ ID NO: 196969 - RNA, 22 nt, Human
cugauacaaugcuaauaaauuu

SEQ ID NO: 196970 - RNA, 22 nt, Human
ggugcugauaguaacaauaaua

SEQ ID NO: 196971 - RNA, 22 nt, Human
gcaggcuuauggggagacagag

SEQ ID NO: 196972 - RNA, 22 nt, Human
gauacauuucaaggaggacugg

SEQ ID NO: 196973 - RNA, 22 nt, Human
cauuuacacacagaggugugcu

SEQ ID NO: 196974 - RNA, 22 nt, Human
uuuucuguauuauugugcuuca

SEQ ID NO: 196975 - RNA, 22 nt, Human
aagcaauuugacaguacauauc

SEQ ID NO: 196976 - RNA, 22 nt, Human
acugcugagagcaaucccaaac

SEQ ID NO: 196977 - RNA, 22 nt, Human
aaaguguuuugauuuaguggua

SEQ ID NO: 196978 - RNA, 22 nt, Human
agaaaguuguuuuagccaaacc

SEQ ID NO: 196979 - RNA, 22 nt, Human
aucuaaaaggagcucuuuaucu

SEQ ID NO: 196980 - RNA, 22 nt, Human
cagccaaaugagucauaaaugu

SEQ ID NO: 196981 - RNA, 22 nt, Human
agggauguugucaaggaugugg

SEQ ID NO: 196982 - RNA, 22 nt, Human
ggcaagagggcagauggagugc

SEQ ID NO: 196983 - RNA, 22 nt, Human
ugugcaugacagcauacaaacg

SEQ ID NO: 196984 - RNA, 22 nt, Human
uauauuguaggugcuauuugaa

SEQ ID NO: 196985 - RNA, 19 nt, Human
uggagacugagagugagca

SEQ ID NO: 196986 - RNA, 22 nt, Human
ugugacugagcugcagaguguc

SEQ ID NO: 196987 - RNA, 22 nt, Human
uuggaaaggagauucuauugug

SEQ ID NO: 196988 - RNA, 22 nt, Human
uuuccccagguagauagauaau

SEQ ID NO: 196989 - RNA, 22 nt, Human
ucccagcacagggcagauguga

SEQ ID NO: 196990 - RNA, 22 nt, Human
ccuggagguggagguugcagug

SEQ ID NO: 196991 - RNA, 22 nt, Human
ucaaagcaucagucaauuuagg

SEQ ID NO: 196992 - RNA, 22 nt, Human
ugaaaucaauugcaauguuuau

SEQ ID NO: 196993 - RNA, 22 nt, Human
aaagaggcucaaggugggccag

SEQ ID NO: 196994 - RNA, 22 nt, Human
ugagcccuaccugcucaucucc

SEQ ID NO: 196995 - RNA, 22 nt, Human
uagcuuuagugaaaaauaucag

SEQ ID NO: 196996 - RNA, 22 nt, Human
cagaguggcgacccccucagcu

SEQ ID NO: 196997 - RNA, 22 nt, Human
aggaaaauggaccagaguuguu

SEQ ID NO: 196998 - RNA, 22 nt, Human
gagccaugagauaguugguucg

SEQ ID NO: 196999 - RNA, 22 nt, Human
acaaaaaccguggauucagcau

SEQ ID NO: 197000 - RNA, 17 nt, Human
uccaggagaggcaaugg

SEQ ID NO: 197001 - RNA, 22 nt, Human
auucucugaagucuuucagggc

SEQ ID NO: 197002 - RNA, 22 nt, Human
uggccaguagagcucagauagu

SEQ ID NO: 197003 - RNA, 22 nt, Human
auuuccauagagcgucucacag

SEQ ID NO: 197004 - RNA, 22 nt, Human
uagucaguaugaaauugcucaa

SEQ ID NO: 197005 - RNA, 21 nt, Human
agcucccuguuuccucacucu

SEQ ID NO: 197006 - RNA, 21 nt, Human
aaacugaagagacaggaacuu

SEQ ID NO: 197007 - RNA, 22 nt, Human
agaaucaaggugaagcccacag

SEQ ID NO: 197008 - RNA, 22 nt, Human
uugcugaaaucuaugacauccu

SEQ ID NO: 197009 - RNA, 22 nt, Human
uuguuuauguaauuggcacacu

SEQ ID NO: 197010 - RNA, 22 nt, Human
gcccucagaguuccccacagug

SEQ ID NO: 197011 - RNA, 22 nt, Human
gaauucaguuaucuaauucaag

SEQ ID NO: 197012 - RNA, 22 nt, Human
uaggaaacaaaguggaugaaau

SEQ ID NO: 197013 - RNA, 22 nt, Human
uucuguuugccauauauaguag

SEQ ID NO: 197014 - RNA, 22 nt, Human
ucccugcaggugggguggccag

SEQ ID NO: 197015 - RNA, 22 nt, Human
uccaggccuugacaggucaguu

SEQ ID NO: 197016 - RNA, 22 nt, Human
ugaaaaaacaaguuggcccauu

SEQ ID NO: 197017 - RNA, 22 nt, Human
guggggugcagcaguacugugu

SEQ ID NO: 197018 - RNA, 22 nt, Human
uuacacacaauuagcauaguaa

SEQ ID NO: 197019 - RNA, 21 nt, Human
uucuagaaaaguaugggacug

SEQ ID NO: 197020 - RNA, 22 nt, Human
uucucuggggacuugguuggag

SEQ ID NO: 197021 - RNA, 22 nt, Human
ucugucaucuguucagugcuca

SEQ ID NO: 197022 - RNA, 22 nt, Human
gccuucaggaaaucaguccuug

SEQ ID NO: 197023 - RNA, 22 nt, Human
gaauggcugaaugucuuaaauu

SEQ ID NO: 197024 - RNA, 22 nt, Human
uacuguauuugauaagugaagu

SEQ ID NO: 197025 - RNA, 22 nt, Human
uuacaaagcaggucagcugaaa

SEQ ID NO: 197026 - RNA, 22 nt, Human
ugucccuggagcuucugucccc

SEQ ID NO: 197027 - RNA, 22 nt, Human
aacaugugucuugcauuucuug

SEQ ID NO: 197028 - RNA, 22 nt, Human
agacaucucuaugcaggaucuc

SEQ ID NO: 197029 - RNA, 22 nt, Human
agucucugccagcuuguccucu

SEQ ID NO: 197030 - RNA, 19 nt, Human
ucagugucccuguuaauau

SEQ ID NO: 197031 - RNA, 22 nt, Human
ccaguggccaugcacgagcagc

SEQ ID NO: 197032 - RNA, 20 nt, Human
cagauggcacgucagggcau

SEQ ID NO: 197033 - RNA, 22 nt, Human
aaacaguuaauugcuuucaguu

SEQ ID NO: 197034 - RNA, 20 nt, Human
aaguuucugguuuauaucuu

SEQ ID NO: 197035 - RNA, 22 nt, Human
cagucccagcugcucagaaggc

SEQ ID NO: 197036 - RNA, 22 nt, Human
uguaaaagacauuucuaagcaa

SEQ ID NO: 197037 - RNA, 22 nt, Human
ugggcuucuggaguggggcaga

SEQ ID NO: 197038 - RNA, 22 nt, Human
ugcucgagguccccaccggcuc

SEQ ID NO: 197039 - RNA, 22 nt, Human
uagcagcaagaaugggaugugu

SEQ ID NO: 197040 - RNA, 22 nt, Human
ccuggcucccggaacagggucu

SEQ ID NO: 197041 - RNA, 22 nt, Human
ugaggcaaaaguuaugugguag

SEQ ID NO: 197042 - RNA, 22 nt, Human
caaaugaauagggagugugaug

SEQ ID NO: 197043 - RNA, 22 nt, Human
uuacaauggguauacuuccauu

SEQ ID NO: 197044 - RNA, 22 nt, Human
uugggacaucuggcauacaguu

SEQ ID NO: 197045 - RNA, 22 nt, Human
ugcaagagauucaaaccauaaa

SEQ ID NO: 197046 - RNA, 22 nt, Human
uucacagauguauuggaacucc

SEQ ID NO: 197047 - RNA, 22 nt, Human
aaauggcaguagaaaagaaucc

SEQ ID NO: 197048 - RNA, 22 nt, Human
ucccuggggcaguggcucggag

SEQ ID NO: 197049 - RNA, 22 nt, Human
uccugguggcuuucccugccuu

SEQ ID NO: 197050 - RNA, 22 nt, Human
ggacacaguggaagacagcuug

SEQ ID NO: 197051 - RNA, 22 nt, Human
cacaugcauuggcaaaagugua

SEQ ID NO: 197052 - RNA, 22 nt, Human
uaguuaaagauucuguuaagag

SEQ ID NO: 197053 - RNA, 22 nt, Human
uuuuguuuaaaauccuggaugg

SEQ ID NO: 197054 - RNA, 22 nt, Human
gaggacacaaaguggcugagau

SEQ ID NO: 197055 - RNA, 17 nt, Human
agcagaagucagaggga

SEQ ID NO: 197056 - RNA, 19 nt, Human
gagcaacauauguaaacuc

SEQ ID NO: 197057 - RNA, 22 nt, Human
aagaggccuuggucugaccuga

SEQ ID NO: 197058 - RNA, 22 nt, Human
gcaggcucuucuuucugcccag

SEQ ID NO: 197059 - RNA, 22 nt, Human
gccucuggucccucaugcugug

SEQ ID NO: 197060 - RNA, 22 nt, Human
cucucugucuuggcauuugguc

SEQ ID NO: 197061 - RNA, 17 nt, Human
acucaggaucugggagu

SEQ ID NO: 197062 - RNA, 22 nt, Human
uuguuuuggaagaacuuacucu

SEQ ID NO: 197063 - RNA, 22 nt, Human
uucauguuggauucacugugag

SEQ ID NO: 197064 - RNA, 22 nt, Human
agaccuuuauuucaugauagga

SEQ ID NO: 197065 - RNA, 22 nt, Human
acauaucuguuagacacagcag

SEQ ID NO: 197066 - RNA, 22 nt, Human
cuggaggcugaguugggucucc

SEQ ID NO: 197067 - RNA, 22 nt, Human
aaguuacagucugcuugcugac

SEQ ID NO: 197068 - RNA, 22 nt, Human
ugaaggcugguaguuugggcug

SEQ ID NO: 197069 - RNA, 22 nt, Human
uccaguuucauagcuaaggaac

SEQ ID NO: 197070 - RNA, 22 nt, Human
gccucaggacuggcauacucau

SEQ ID NO: 197071 - RNA, 22 nt, Human
uccuguggucuggaaggaaugg

SEQ ID NO: 197072 - RNA, 22 nt, Human
uccauguuucagcaucuacauc

SEQ ID NO: 197073 - RNA, 22 nt, Human
auugaaaggcaaaguaggaagc

SEQ ID NO: 197074 - RNA, 22 nt, Human
gcuggggacuccccaccauagc

SEQ ID NO: 197075 - RNA, 22 nt, Human
aaacugguuucugagauggaac

SEQ ID NO: 197076 - RNA, 22 nt, Human
auuucagaguagaucguuauuu

SEQ ID NO: 197077 - RNA, 22 nt, Human
augaucaagaauuuuguauucc

SEQ ID NO: 197078 - RNA, 22 nt, Human
agcagcagggcucugcccgugc

SEQ ID NO: 197079 - RNA, 22 nt, Human
cuggugacauuuccggcugcca

SEQ ID NO: 197080 - RNA, 22 nt, Human
ugguaucugugaaugugacauu

SEQ ID NO: 197081 - RNA, 21 nt, Human
ggcuggucgcgugcaugucuc

SEQ ID NO: 197082 - RNA, 22 nt, Human
guggauggauuuugaggaaugg

SEQ ID NO: 197083 - RNA, 22 nt, Human
uguguucuccaacuguagauuu

SEQ ID NO: 197084 - RNA, 22 nt, Human
agcuaggggaccaagguggccc

SEQ ID NO: 197085 - RNA, 22 nt, Human
uagacagagugaagacaagugg

SEQ ID NO: 197086 - RNA, 22 nt, Human
cccuauuagugaccacaucaua

SEQ ID NO: 197087 - RNA, 22 nt, Human
cagcuucaccagggccaugguu

SEQ ID NO: 197088 - RNA, 22 nt, Human
aggccccaucaggaaggaggcc

SEQ ID NO: 197089 - RNA, 22 nt, Human
gccucagaaucauuuaucaucu

SEQ ID NO: 197090 - RNA, 22 nt, Human
uggaaggggagcuggaaagggg

SEQ ID NO: 197091 - RNA, 22 nt, Human
gcuggcuggaacuagcaguugg

SEQ ID NO: 197092 - RNA, 22 nt, Human
guccucugcuucaugcccugau

SEQ ID NO: 197093 - RNA, 22 nt, Human
uuacagauacuuuguaggcaag

SEQ ID NO: 197094 - RNA, 22 nt, Human
uggcuccagaucugucuccugu

SEQ ID NO: 197095 - RNA, 22 nt, Human
cuggugaccggaccucaguuuu

SEQ ID NO: 197096 - RNA, 22 nt, Human
aagaauguggcauuuauuuaua

SEQ ID NO: 197097 - RNA, 22 nt, Human
uuuggcucgauggacuuugaau

SEQ ID NO: 197098 - RNA, 22 nt, Human
gccuguguggaugcgccggugc

SEQ ID NO: 197099 - RNA, 23 nt, Human
gagcaccagggcuuuugagacau

SEQ ID NO: 197100 - RNA, 22 nt, Human
gcuuagaaguuccuauaaaaug

SEQ ID NO: 197101 - RNA, 22 nt, Human
uaagccacugagauuugggguu

SEQ ID NO: 197102 - RNA, 22 nt, Human
cuuucauaagggguuuuauaau

SEQ ID NO: 197103 - RNA, 22 nt, Human
agacagacauucuagagccacc

SEQ ID NO: 197104 - RNA, 22 nt, Human
agguggucuuaaacugcucugg

SEQ ID NO: 197105 - RNA, 22 nt, Human
agaggcuccuucacucuggcac

SEQ ID NO: 197106 - RNA, 22 nt, Human
agacauuuauguuucucuagga

SEQ ID NO: 197107 - RNA, 22 nt, Human
ccugccuggcuuccagaagaga

SEQ ID NO: 197108 - RNA, 22 nt, Human
ucucuuccucagccuggggccu

SEQ ID NO: 197109 - RNA, 22 nt, Human
aagucacuugauuguugacaga

SEQ ID NO: 197110 - RNA, 22 nt, Human
accccaaaagaguaauagaauu

SEQ ID NO: 197111 - RNA, 22 nt, Human
ggcaggcaagucugcucuguga

SEQ ID NO: 197112 - RNA, 22 nt, Human
ugaguucaaguccaaguugcug

SEQ ID NO: 197113 - RNA, 22 nt, Human
ugugugcaagugacauuagaaa

SEQ ID NO: 197114 - RNA, 19 nt, Human
uaguggagugacaaguucu

SEQ ID NO: 197115 - RNA, 22 nt, Human
gaggugccuggcgaugucucug

SEQ ID NO: 197116 - RNA, 22 nt, Human
gugcugggcccugagaccaggg

SEQ ID NO: 197117 - RNA, 22 nt, Human
caguuucugagcccugucauuu

SEQ ID NO: 197118 - RNA, 20 nt, Human
acaguguuuuugaguagagc

SEQ ID NO: 197119 - RNA, 22 nt, Human
uaaugucuaugggccagauaau

SEQ ID NO: 197120 - RNA, 22 nt, Human
ucugaggaagcagcaggaagug

SEQ ID NO: 197121 - RNA, 21 nt, Human
cacuuuaaaaauaucuuuaua

SEQ ID NO: 197122 - RNA, 22 nt, Human
ucuuccagcuucugguggcugc

SEQ ID NO: 197123 - RNA, 22 nt, Human
aauuggaagaauugauuugcuu

SEQ ID NO: 197124 - RNA, 22 nt, Human
gcuaaaaggagcacuagagauu

SEQ ID NO: 197125 - RNA, 22 nt, Human
ugccaauucgcagugaguauuu

SEQ ID NO: 197126 - RNA, 22 nt, Human
guuuauaugaacuucauaccca

SEQ ID NO: 197127 - RNA, 19 nt, Human
uguggggagucagggggcu

SEQ ID NO: 197128 - RNA, 22 nt, Human
augacaauacuucaauaagcug

SEQ ID NO: 197129 - RNA, 22 nt, Human
cccagcccccgagugucuggaa

SEQ ID NO: 197130 - RNA, 22 nt, Human
uguguuucagaaccuucuuuca

SEQ ID NO: 197131 - RNA, 23 nt, Human
agaugagccaacaccuccaugcc

SEQ ID NO: 197132 - RNA, 22 nt, Human
cuuaggaaugcguuuccugggu

SEQ ID NO: 197133 - RNA, 22 nt, Human
ccauguggugggaaggagaaug

SEQ ID NO: 197134 - RNA, 22 nt, Human
uguacacaguaugaggcaucuu

SEQ ID NO: 197135 - RNA, 22 nt, Human
ucccacauuacccugacugaca

SEQ ID NO: 197136 - RNA, 22 nt, Human
uugguaaauaacaaucacagug

SEQ ID NO: 197137 - RNA, 22 nt, Human
auuucccaugugaaucaauugg

SEQ ID NO: 197138 - RNA, 19 nt, Human
ugggccucacaaugcuccc

SEQ ID NO: 197139 - RNA, 22 nt, Human
caggcagagugagaagcccuug

SEQ ID NO: 197140 - RNA, 22 nt, Human
augcccugcaucaagugacacu

SEQ ID NO: 197141 - RNA, 22 nt, Human
gccagaggaacgcugcgcgccc

SEQ ID NO: 197142 - RNA, 22 nt, Human
aaugucaaaggcuauacauuca

SEQ ID NO: 197143 - RNA, 22 nt, Human
uggugcagauagugguguagua

SEQ ID NO: 197144 - RNA, 21 nt, Human
agaggcccucggacugggcgu

SEQ ID NO: 197145 - RNA, 22 nt, Human
gcaggagagccagcaggcuucc

SEQ ID NO: 197146 - RNA, 22 nt, Human
ccuugcaguuguuacuguagcc

SEQ ID NO: 197147 - RNA, 22 nt, Human
ggcacugacacuagcauggcac

SEQ ID NO: 197148 - RNA, 22 nt, Human
agaggacaaaaugagaagugcu

SEQ ID NO: 197149 - RNA, 22 nt, Human
ucuuuguggcgggcuuaaauac

SEQ ID NO: 197150 - RNA, 22 nt, Human
uugggaaggcguggaagcagaa

SEQ ID NO: 197151 - RNA, 22 nt, Human
acuuauauuugcuuuaugcuuc

SEQ ID NO: 197152 - RNA, 22 nt, Human
uuuugccugcacuguauauaua

SEQ ID NO: 197153 - RNA, 22 nt, Human
ucugugcuggacugauuucaua

SEQ ID NO: 197154 - RNA, 22 nt, Human
aaauagcagcuuugacagcaca

SEQ ID NO: 197155 - RNA, 23 nt, Human
ugucuuugaaugggcuguagaca

SEQ ID NO: 197156 - RNA, 22 nt, Human
ucugggugccacugucuguaca

SEQ ID NO: 197157 - RNA, 22 nt, Human
caggagcuggaucuccuugcgg

SEQ ID NO: 197158 - RNA, 22 nt, Human
guccuuccugcagggauggaug

SEQ ID NO: 197159 - RNA, 20 nt, Human
uaucuaaaugcuuacauuac

SEQ ID NO: 197160 - RNA, 22 nt, Human
cagugauguuucugcaucagag

SEQ ID NO: 197161 - RNA, 22 nt, Human
aggcugaggcagguggaucauu

SEQ ID NO: 197162 - RNA, 20 nt, Human
acaggggcagcacaauaaug

SEQ ID NO: 197163 - RNA, 23 nt, Human
ugcuguagucucuacagcugguc

SEQ ID NO: 197164 - RNA, 22 nt, Human
uccagccaugcaugacaaucac

SEQ ID NO: 197165 - RNA, 22 nt, Human
uuuuugcuccacaacuuugaag

SEQ ID NO: 197166 - RNA, 18 nt, Human
ccuggcagccaugcgcgc

SEQ ID NO: 197167 - RNA, 22 nt, Human
aaucugcuuuugucauuuauga

SEQ ID NO: 197168 - RNA, 22 nt, Human
acaggucugugugcacagugcu

SEQ ID NO: 197169 - RNA, 22 nt, Human
caggucccugcgccccggccuc

SEQ ID NO: 197170 - RNA, 22 nt, Human
auucauuagccacuaacuagca

SEQ ID NO: 197171 - RNA, 22 nt, Human
aggcagcagugauaagauagga

SEQ ID NO: 197172 - RNA, 22 nt, Human
aacaucuagguucucaucgaua

SEQ ID NO: 197173 - RNA, 22 nt, Human
uggcccugcagaacuagccugg

SEQ ID NO: 197174 - RNA, 22 nt, Human
ucccauggucuauauagaggca

SEQ ID NO: 197175 - RNA, 22 nt, Human
gaagccacuauagauauucuaa

SEQ ID NO: 197176 - RNA, 20 nt, Human
auucucugacaccgcccccg

SEQ ID NO: 197177 - RNA, 22 nt, Human
gccagggagucugggccacaga

SEQ ID NO: 197178 - RNA, 22 nt, Human
aagcacaauuuaggacugaaau

SEQ ID NO: 197179 - RNA, 22 nt, Human
gauuuuucaguauaaaauauau

SEQ ID NO: 197180 - RNA, 22 nt, Human
aaaguaucugaccgauuauaaa

SEQ ID NO: 197181 - RNA, 22 nt, Human
gcaggcauggucgcugccaggu

SEQ ID NO: 197182 - RNA, 22 nt, Human
ccaggcaggcagcguucucagg

SEQ ID NO: 197183 - RNA, 22 nt, Human
uacaguaggauuuucagggucu

SEQ ID NO: 197184 - RNA, 22 nt, Human
ggcagugucaaaauaggcagaa

SEQ ID NO: 197185 - RNA, 22 nt, Human
cuuccucaggcauuagcuggac

SEQ ID NO: 197186 - RNA, 23 nt, Human
gccagccagaauuucuccacugu

SEQ ID NO: 197187 - RNA, 22 nt, Human
ccuagaugggauggcggccggg

SEQ ID NO: 197188 - RNA, 22 nt, Human
cugcugccauuagggcacagac

SEQ ID NO: 197189 - RNA, 22 nt, Human
gggaaauagagcuggaaccuug

SEQ ID NO: 197190 - RNA, 22 nt, Human
cugagcaggacagugggagacc

SEQ ID NO: 197191 - RNA, 22 nt, Human
ucauguguccuaguucauauaa

SEQ ID NO: 197192 - RNA, 22 nt, Human
gaaaguuucucacacaugcaga

SEQ ID NO: 197193 - RNA, 22 nt, Human
gaguuacagagaggauuauggu

SEQ ID NO: 197194 - RNA, 22 nt, Human
agccuuccacccagauccccuu

SEQ ID NO: 197195 - RNA, 22 nt, Human
aggcuguguggucaugguggcu

SEQ ID NO: 197196 - RNA, 22 nt, Human
gaauucuaggguaaauauccua

SEQ ID NO: 197197 - RNA, 22 nt, Human
acuuugcacuucaauauaacuu

SEQ ID NO: 197198 - RNA, 22 nt, Human
ccaaggaguagagcaggaagcu

SEQ ID NO: 197199 - RNA, 22 nt, Human
acagccagugacuggacaagcu

SEQ ID NO: 197200 - RNA, 22 nt, Human
guggucagaauggagcccagga

SEQ ID NO: 197201 - RNA, 20 nt, Human
ucaaaggcaaaggugggugu

SEQ ID NO: 197202 - RNA, 22 nt, Human
cugcaggaaucugugcuaggug

SEQ ID NO: 197203 - RNA, 22 nt, Human
uuccugguuuauggaaagcaug

SEQ ID NO: 197204 - RNA, 22 nt, Human
uugcuuuuaauuaaucauugcu

SEQ ID NO: 197205 - RNA, 22 nt, Human
uaucuugugcagaugaaagaau

SEQ ID NO: 197206 - RNA, 22 nt, Human
uuaacacugauuguagagacac

SEQ ID NO: 197207 - RNA, 22 nt, Human
uucuacagguacugaaguacau

SEQ ID NO: 197208 - RNA, 22 nt, Human
cugcccaggaaggagaggaugg

SEQ ID NO: 197209 - RNA, 22 nt, Human
guccucugacucagccuuggga

SEQ ID NO: 197210 - RNA, 22 nt, Human
aaacacagguacugcagaagug

SEQ ID NO: 197211 - RNA, 22 nt, Human
ugaggccuggagggaggaguuu

SEQ ID NO: 197212 - RNA, 22 nt, Human
ucuuugggagaaggggucccag

SEQ ID NO: 197213 - RNA, 22 nt, Human
auucagaaauagaaaauuugau

SEQ ID NO: 197214 - RNA, 15 nt, Human
uacauucauuuccac

SEQ ID NO: 197215 - RNA, 22 nt, Human
gcucaggagcugacagccucaa

SEQ ID NO: 197216 - RNA, 22 nt, Human
acuguacaacugcugagcagaa

SEQ ID NO: 197217 - RNA, 20 nt, Human
uauagaucacaucuucuagc

SEQ ID NO: 197218 - RNA, 22 nt, Human
caucucuguguccccacaccca

SEQ ID NO: 197219 - RNA, 22 nt, Human
uucagagacagcaaccaggaca

SEQ ID NO: 197220 - RNA, 23 nt, Human
aaggccagagagaggcuaguguc

SEQ ID NO: 197221 - RNA, 22 nt, Human
gcagccacuaguuuuccuguuu

SEQ ID NO: 197222 - RNA, 22 nt, Human
aauuauacaauugucaaguucu

SEQ ID NO: 197223 - RNA, 22 nt, Human
cagcacauuuacucagcccuca

SEQ ID NO: 197224 - RNA, 22 nt, Human
ugcccugggaggcuuuccuguu

SEQ ID NO: 197225 - RNA, 22 nt, Human
aggccaugggauuuccaauugg

SEQ ID NO: 197226 - RNA, 19 nt, Human
ugaauuagaauuauccucu

SEQ ID NO: 197227 - RNA, 22 nt, Human
cugcaggaaggggacggagugg

SEQ ID NO: 197228 - RNA, 22 nt, Human
agaggcaggaagagcugauuuu

SEQ ID NO: 197229 - RNA, 18 nt, Human
ucagagagaauaguaauu

SEQ ID NO: 197230 - RNA, 22 nt, Human
ucacaucugaaaaaauauugag

SEQ ID NO: 197231 - RNA, 22 nt, Human
ccaggcuguaagagugauguug

SEQ ID NO: 197232 - RNA, 22 nt, Human
uguguuaaguauuugauacacu

SEQ ID NO: 197233 - RNA, 22 nt, Human
uaaggccaaguucauauacaac

SEQ ID NO: 197234 - RNA, 22 nt, Human
uagagaaacagaaccaacaggg

SEQ ID NO: 197235 - RNA, 21 nt, Human
ggaguuuuucuggaagggacu

SEQ ID NO: 197236 - RNA, 22 nt, Human
gcucucacuuuagguuggaccg

SEQ ID NO: 197237 - RNA, 22 nt, Human
ucucuguauucuucguaaugcc

SEQ ID NO: 197238 - RNA, 23 nt, Human
acugggcugaaauuaaagguguc

SEQ ID NO: 197239 - RNA, 22 nt, Human
cugggccuuugggaguucggug

SEQ ID NO: 197240 - RNA, 22 nt, Human
ucugggcagccucaggccaggg

SEQ ID NO: 197241 - RNA, 16 nt, Human
acccucagaaacugcu

SEQ ID NO: 197242 - RNA, 22 nt, Human
agggccagagucuguguagaua

SEQ ID NO: 197243 - RNA, 22 nt, Human
cacucacuuauuucuaacagaa

SEQ ID NO: 197244 - RNA, 22 nt, Human
gcuucugcaggguccucgcugu

SEQ ID NO: 197245 - RNA, 22 nt, Human
uucacauuaucaggauuguuuc

SEQ ID NO: 197246 - RNA, 21 nt, Human
auuucagagcacacaaguaaa

SEQ ID NO: 197247 - RNA, 22 nt, Human
guccugagcccucagcacagca

SEQ ID NO: 197248 - RNA, 22 nt, Human
ugccuucucccuuggacccuga

SEQ ID NO: 197249 - RNA, 22 nt, Human
cauuuguugggacaaugaaaag

SEQ ID NO: 197250 - RNA, 22 nt, Human
acccagggaccccgcugacgcc

SEQ ID NO: 197251 - RNA, 22 nt, Human
cagaaauggagcccaggaaucu

SEQ ID NO: 197252 - RNA, 22 nt, Human
uucuggaagccccagagucaga

SEQ ID NO: 197253 - RNA, 22 nt, Human
aggauagaagccccauguucuu

SEQ ID NO: 197254 - RNA, 22 nt, Human
ugcuggaggccagaagucugag

SEQ ID NO: 197255 - RNA, 22 nt, Human
uaagugaugagcacaguaauua

SEQ ID NO: 197256 - RNA, 22 nt, Human
aaauggaaaaugcuguuuuggu

SEQ ID NO: 197257 - RNA, 17 nt, Human
ggagccaggagcccacc

SEQ ID NO: 197258 - RNA, 22 nt, Human
ucugggucaugacucagcguga

SEQ ID NO: 197259 - RNA, 22 nt, Human
ggcuguauauacuguauacagu

SEQ ID NO: 197260 - RNA, 22 nt, Human
ccaggcaaagcccaugcaagag

SEQ ID NO: 197261 - RNA, 17 nt, Human
cucugggcagccugggg

SEQ ID NO: 197262 - RNA, 17 nt, Human
ugccagccugucccagg

SEQ ID NO: 197263 - RNA, 20 nt, Human
ggugucagggccaugccugg

SEQ ID NO: 197264 - RNA, 22 nt, Human
ucuuuuagaaaaguugaaugua

SEQ ID NO: 197265 - RNA, 22 nt, Human
uagggauguggugagaacugag

SEQ ID NO: 197266 - RNA, 22 nt, Human
ccauuuaguaaggaagaacagc

SEQ ID NO: 197267 - RNA, 22 nt, Human
caauguacuacaaagauuguca

SEQ ID NO: 197268 - RNA, 22 nt, Human
cuuccccaaccccgacugugug

SEQ ID NO: 197269 - RNA, 22 nt, Human
ugagcugaguggcaggucucag

SEQ ID NO: 197270 - RNA, 22 nt, Human
aagccagugggcauagcaguug

SEQ ID NO: 197271 - RNA, 22 nt, Human
aaagucaagguuuagacuagag

SEQ ID NO: 197272 - RNA, 22 nt, Human
cucuccucagaacaggcccucu

SEQ ID NO: 197273 - RNA, 23 nt, Human
aucuagaaaccugaugacucugu

SEQ ID NO: 197274 - RNA, 22 nt, Human
gauuuugucaaauuccaaaugu

SEQ ID NO: 197275 - RNA, 22 nt, Human
uucaauuuagugauguuguugg

SEQ ID NO: 197276 - RNA, 22 nt, Human
guacauuucucccaacacuaaa

SEQ ID NO: 197277 - RNA, 19 nt, Human
uagaagcacuaggcaaacu

SEQ ID NO: 197278 - RNA, 22 nt, Human
caggucugcagacagggccaug

SEQ ID NO: 197279 - RNA, 22 nt, Human
ugacuuccugcacucaggugau

SEQ ID NO: 197280 - RNA, 22 nt, Human
ucccugggaauuaauauuugga

SEQ ID NO: 197281 - RNA, 22 nt, Human
cucagaaaggugccauuuaugu

SEQ ID NO: 197282 - RNA, 22 nt, Human
aaauuagauaugugugagacuc

SEQ ID NO: 197283 - RNA, 22 nt, Human
ucccugggaccggcagcucaca

SEQ ID NO: 197284 - RNA, 22 nt, Human
ccuggagggacccuggcccugu

SEQ ID NO: 197285 - RNA, 22 nt, Human
ucccacccauccugcaucucuu

SEQ ID NO: 197286 - RNA, 22 nt, Human
uaccauuucauucuuuccucau

SEQ ID NO: 197287 - RNA, 22 nt, Human
ggccugugagcccuugcaugua

SEQ ID NO: 197288 - RNA, 22 nt, Human
cauaaacucuugagauucuugu

SEQ ID NO: 197289 - RNA, 22 nt, Human
agacacaguuugggauggguug

SEQ ID NO: 197290 - RNA, 22 nt, Human
ccaggaccacacgacaggagag

SEQ ID NO: 197291 - RNA, 22 nt, Human
acuaaagugcaccccuuugaga

SEQ ID NO: 197292 - RNA, 22 nt, Human
aguggcagacacaaugugggca

SEQ ID NO: 197293 - RNA, 22 nt, Human
acuuagaaauucaguuuuguca

SEQ ID NO: 197294 - RNA, 22 nt, Human
aaacuucagacuccccacuucu

SEQ ID NO: 197295 - RNA, 22 nt, Human
agguccagacuguguacccuag

SEQ ID NO: 197296 - RNA, 22 nt, Human
cuggccaggcggccccugcaug

SEQ ID NO: 197297 - RNA, 22 nt, Human
agcagcugauggggaaggaguu

SEQ ID NO: 197298 - RNA, 22 nt, Human
uagcaggcuugugaauggagcc

SEQ ID NO: 197299 - RNA, 20 nt, Human
gugcugagggcugggcaaug

SEQ ID NO: 197300 - RNA, 22 nt, Human
uuaggaauuuaucacagacugg

SEQ ID NO: 197301 - RNA, 22 nt, Human
cauuaaauuccuuguucucaaa

SEQ ID NO: 197302 - RNA, 22 nt, Human
uuggaacuggauuucauguagc

SEQ ID NO: 197303 - RNA, 18 nt, Human
uggagcugagugcugugc

SEQ ID NO: 197304 - RNA, 22 nt, Human
gggaagaguaacuagcccaugu

SEQ ID NO: 197305 - RNA, 22 nt, Human
caggcuucaugaauuaugcacc

SEQ ID NO: 197306 - RNA, 22 nt, Human
uccugaggaugguugaagugca

SEQ ID NO: 197307 - RNA, 20 nt, Human
augccuuugauagucaggcu

SEQ ID NO: 197308 - RNA, 22 nt, Human
uccaugguuucagucuggcugg

SEQ ID NO: 197309 - RNA, 22 nt, Human
gauaaacacaaggugauuucau

SEQ ID NO: 197310 - RNA, 23 nt, Human
aaagacucuccagagggaaguag

SEQ ID NO: 197311 - RNA, 22 nt, Human
gaggcucagagagguccacaua

SEQ ID NO: 197312 - RNA, 22 nt, Human
cuuggcugucuauaggaaagag

SEQ ID NO: 197313 - RNA, 22 nt, Human
gggggcucugacucccucagcu

SEQ ID NO: 197314 - RNA, 22 nt, Human
ggcagccaugucccagggcuuc

SEQ ID NO: 197315 - RNA, 22 nt, Human
ucaauguucaaguaugacaaug

SEQ ID NO: 197316 - RNA, 22 nt, Human
auuuuguggcagaugcagaacc

SEQ ID NO: 197317 - RNA, 22 nt, Human
uccugguguuacuaaauugaaa

SEQ ID NO: 197318 - RNA, 17 nt, Human
gcucugccaggaaagag

SEQ ID NO: 197319 - RNA, 22 nt, Human
cagggcagggagcuuagaauga

SEQ ID NO: 197320 - RNA, 22 nt, Human
uccaugagcuagcuuuccaaag

SEQ ID NO: 197321 - RNA, 22 nt, Human
uugucuuuggaaauuuaauguu

SEQ ID NO: 197322 - RNA, 22 nt, Human
ugugauauuugaguauugucaa

SEQ ID NO: 197323 - RNA, 22 nt, Human
cagcagcuagaggaagggcaga

SEQ ID NO: 197324 - RNA, 22 nt, Human
caagagcuuuagaaaugcucau

SEQ ID NO: 197325 - RNA, 22 nt, Human
ccaggcuuuuagcugcauggca

SEQ ID NO: 197326 - RNA, 22 nt, Human
aaggaagugauuuucaugucaa

SEQ ID NO: 197327 - RNA, 22 nt, Human
aggugauuuucuccuuacgauu

SEQ ID NO: 197328 - RNA, 22 nt, Human
ccccuggggaucagcuggaauu

SEQ ID NO: 197329 - RNA, 22 nt, Human
aaagauuuaugaaguucaauua

SEQ ID NO: 197330 - RNA, 19 nt, Human
acagcacagaaauauuuca

SEQ ID NO: 197331 - RNA, 22 nt, Human
caggucagcuggugccccaggu

SEQ ID NO: 197332 - RNA, 22 nt, Human
gcucagcugagcgaaggacaug

SEQ ID NO: 197333 - RNA, 22 nt, Human
caggagccccaggcugacaaua

SEQ ID NO: 197334 - RNA, 22 nt, Human
uugauucaaaggggacaagugg

SEQ ID NO: 197335 - RNA, 21 nt, Human
aaaggccauaaucacggagca

SEQ ID NO: 197336 - RNA, 22 nt, Human
uagggaugaagaugguauuucu

SEQ ID NO: 197337 - RNA, 22 nt, Human
cacugaaacagguauugcuggu

SEQ ID NO: 197338 - RNA, 21 nt, Human
uuacuggcagcagaaaccuga

SEQ ID NO: 197339 - RNA, 22 nt, Human
ugagugcuaagaauaaucugca

SEQ ID NO: 197340 - RNA, 22 nt, Human
uccagccccgaggccggcgacg

SEQ ID NO: 197341 - RNA, 22 nt, Human
uacuuaaauaauugcugcuauu

SEQ ID NO: 197342 - RNA, 22 nt, Human
ugaggccuuuucugucuggcua

SEQ ID NO: 197343 - RNA, 22 nt, Human
aauugcuuuaguuaccauagug

SEQ ID NO: 197344 - RNA, 22 nt, Human
uucuggaaaagaaaguuaagau

SEQ ID NO: 197345 - RNA, 22 nt, Human
ucuucccagcugcugcgaugcc

SEQ ID NO: 197346 - RNA, 22 nt, Human
ugcuuucagauaucuguuucaa

SEQ ID NO: 197347 - RNA, 22 nt, Human
uugccauuuauacugcaaguca

SEQ ID NO: 197348 - RNA, 22 nt, Human
guuugcuaauuuaaagcuauuu

SEQ ID NO: 197349 - RNA, 22 nt, Human
cuugccuucagugucccuuugc

SEQ ID NO: 197350 - RNA, 22 nt, Human
ugagcaggauucgccucuugca

SEQ ID NO: 197351 - RNA, 22 nt, Human
uagucagagucuucucuguugu

SEQ ID NO: 197352 - RNA, 22 nt, Human
cucacagcagccagucugccuu

SEQ ID NO: 197353 - RNA, 18 nt, Human
acaggcuauugcaggaga

SEQ ID NO: 197354 - RNA, 22 nt, Human
cuaggaaaugaauacaguacac

SEQ ID NO: 197355 - RNA, 20 nt, Human
cccugagacgacugagcucc

SEQ ID NO: 197356 - RNA, 22 nt, Human
gcaaacaugcugagaaauaaga

SEQ ID NO: 197357 - RNA, 20 nt, Human
gcaauauaugagugcaauaa

SEQ ID NO: 197358 - RNA, 22 nt, Human
cuccagguuuuacaaggucuau

SEQ ID NO: 197359 - RNA, 22 nt, Human
gucuucuuuucagucugcuugu

SEQ ID NO: 197360 - RNA, 22 nt, Human
aagauuuaccacuuuauucaag

SEQ ID NO: 197361 - RNA, 22 nt, Human
ugcauucaauacaguaagaaua

SEQ ID NO: 197362 - RNA, 22 nt, Human
gauguuaagaaggaauugaagu

SEQ ID NO: 197363 - RNA, 22 nt, Human
gagugcugcuaaugcaagggug

SEQ ID NO: 197364 - RNA, 22 nt, Human
uuccauacgacugaggucucgg

SEQ ID NO: 197365 - RNA, 22 nt, Human
uaguacaguuccaucaaagcag

SEQ ID NO: 197366 - RNA, 22 nt, Human
uccaggcuugagaccaggcucu

SEQ ID NO: 197367 - RNA, 22 nt, Human
ucaggcuguagggccccuggag

SEQ ID NO: 197368 - RNA, 22 nt, Human
cuguggcuuucucugccuccuu

SEQ ID NO: 197369 - RNA, 22 nt, Human
agcauugucuccaagcaggucu

SEQ ID NO: 197370 - RNA, 22 nt, Human
ugaugagguggauucaaagcag

SEQ ID NO: 197371 - RNA, 22 nt, Human
ucccagagguugagucacuuau

SEQ ID NO: 197372 - RNA, 22 nt, Human
cagaauucgaaugagcagaauc

SEQ ID NO: 197373 - RNA, 22 nt, Human
gaagcagcuuucuggugaggag

SEQ ID NO: 197374 - RNA, 22 nt, Human
ugcccagcacugugccagucac

SEQ ID NO: 197375 - RNA, 20 nt, Human
aggggucuagcagcagugcu

SEQ ID NO: 197376 - RNA, 22 nt, Human
augguuuacuucauccaaucua

SEQ ID NO: 197377 - RNA, 22 nt, Human
cucccagggucuaggcugcugg

SEQ ID NO: 197378 - RNA, 22 nt, Human
acugaggagaaauuugagugaa

SEQ ID NO: 197379 - RNA, 22 nt, Human
caggcccaugagggcagccaca

SEQ ID NO: 197380 - RNA, 22 nt, Human
aaauuucaagcaaaguagcuau

SEQ ID NO: 197381 - RNA, 22 nt, Human
aauuuguuacacagcaauauaa

SEQ ID NO: 197382 - RNA, 22 nt, Human
aagcauuuuguuuuaagaauga

SEQ ID NO: 197383 - RNA, 22 nt, Human
ccaggcugggcggggaaccugg

SEQ ID NO: 197384 - RNA, 22 nt, Human
uccaggacuagcauuucugaua

SEQ ID NO: 197385 - RNA, 22 nt, Human
guguugacacagccaucuuguc

SEQ ID NO: 197386 - RNA, 22 nt, Human
cugggcaggagggcucuaugga

SEQ ID NO: 197387 - RNA, 21 nt, Human
accaucuuccaugcauuauau

SEQ ID NO: 197388 - RNA, 22 nt, Human
uucauucuuugaaucugaggua

SEQ ID NO: 197389 - RNA, 22 nt, Human
agggggaggcugugcugcgucu

SEQ ID NO: 197390 - RNA, 21 nt, Human
uucucuggcuucuguagcugg

SEQ ID NO: 197391 - RNA, 22 nt, Human
gcccuguuuugaaacuugcaua

SEQ ID NO: 197392 - RNA, 21 nt, Human
uucauucauggcauaauauag

SEQ ID NO: 197393 - RNA, 23 nt, Human
ucccugggcccgugccagcggug

SEQ ID NO: 197394 - RNA, 22 nt, Human
ucaggcuuuucuucccucagug

SEQ ID NO: 197395 - RNA, 22 nt, Human
uccagggaagagcagaggcuac

SEQ ID NO: 197396 - RNA, 22 nt, Human
auucacuagguugcaaaacugu

SEQ ID NO: 197397 - RNA, 22 nt, Human
ucacuugacuuuccagucuugg

SEQ ID NO: 197398 - RNA, 22 nt, Human
uucauauauaugcacuacguac

SEQ ID NO: 197399 - RNA, 22 nt, Human
guucucucagcgauagugaugg

SEQ ID NO: 197400 - RNA, 22 nt, Human
aaguacuguaucacuuacuccu

SEQ ID NO: 197401 - RNA, 22 nt, Human
ucagccucucugaguccagacc

SEQ ID NO: 197402 - RNA, 22 nt, Human
gcaggcagagucaauuugaucc

SEQ ID NO: 197403 - RNA, 22 nt, Human
cuucaguuagccaauucagguc

SEQ ID NO: 197404 - RNA, 22 nt, Human
ucuguggcaugaggaaauaggc

SEQ ID NO: 197405 - RNA, 22 nt, Human
ucaaaacaacacucagguguaa

SEQ ID NO: 197406 - RNA, 22 nt, Human
cagcuucucgggagcgcaugug

SEQ ID NO: 197407 - RNA, 22 nt, Human
acauauauuacuaguaaagaca

SEQ ID NO: 197408 - RNA, 22 nt, Human
uaagaaacauuuuuaugacagu

SEQ ID NO: 197409 - RNA, 22 nt, Human
ugggcuggcguggagaguuuag

SEQ ID NO: 197410 - RNA, 22 nt, Human
ggaggccaggugggagucaucu

SEQ ID NO: 197411 - RNA, 22 nt, Human
acugccuguagcccugagaugu

SEQ ID NO: 197412 - RNA, 22 nt, Human
ucaaucaaugugucaguuccca

SEQ ID NO: 197413 - RNA, 22 nt, Human
gggagugguugauggugaaaau

SEQ ID NO: 197414 - RNA, 22 nt, Human
cugaggaguuggugaauaagcc

SEQ ID NO: 197415 - RNA, 22 nt, Human
gaggcuggaauauuagaaaugu

SEQ ID NO: 197416 - RNA, 22 nt, Human
uauuuagcuggagucagugcuu

SEQ ID NO: 197417 - RNA, 23 nt, Human
gcugacugugaaauucuggagcu

SEQ ID NO: 197418 - RNA, 22 nt, Human
caggcccagugaucagggcucu

SEQ ID NO: 197419 - RNA, 22 nt, Human
gaggccuggugcuguguccaca

SEQ ID NO: 197420 - RNA, 22 nt, Human
caaggcuacccuuucaccaaaa

SEQ ID NO: 197421 - RNA, 22 nt, Human
acacugaauguuuaagaacuug

SEQ ID NO: 197422 - RNA, 22 nt, Human
cccugccccaggcggcuucacu

SEQ ID NO: 197423 - RNA, 21 nt, Human
gcagugucaugguuucaaguu

SEQ ID NO: 197424 - RNA, 22 nt, Human
ggacaaaaaucagccaucucua

SEQ ID NO: 197425 - RNA, 22 nt, Human
gaggcugauucggggaacagca

SEQ ID NO: 197426 - RNA, 19 nt, Human
ugccuuggcugccaggaaa

SEQ ID NO: 197427 - RNA, 22 nt, Human
agggaugacucuuggcugauuc

SEQ ID NO: 197428 - RNA, 22 nt, Human
acacaguguccuucuacuugcc

SEQ ID NO: 197429 - RNA, 21 nt, Human
ugggaccuagcuuugcacagg

SEQ ID NO: 197430 - RNA, 22 nt, Human
gcauacaaagguuuacaacuga

SEQ ID NO: 197431 - RNA, 22 nt, Human
ggacagcauucuacuguaggca

SEQ ID NO: 197432 - RNA, 22 nt, Human
uaggaacuagacucaugacuca

SEQ ID NO: 197433 - RNA, 22 nt, Human
ugcagggauuagaggccgggga

SEQ ID NO: 197434 - RNA, 22 nt, Human
uacacaucuggugugacugcca

SEQ ID NO: 197435 - RNA, 22 nt, Human
ccagagggccuuuggaguuauc

SEQ ID NO: 197436 - RNA, 22 nt, Human
aagcagccaccucaucuccacu

SEQ ID NO: 197437 - RNA, 22 nt, Human
gacacagagcucacagucuccu

SEQ ID NO: 197438 - RNA, 22 nt, Human
gaggccuguagucauggaugua

SEQ ID NO: 197439 - RNA, 22 nt, Human
ccuagagcucugcuuuaucuaa

SEQ ID NO: 197440 - RNA, 22 nt, Human
agcaggagcccuuaucaccagg

SEQ ID NO: 197441 - RNA, 22 nt, Human
aauucagauggaagauucuggc

SEQ ID NO: 197442 - RNA, 22 nt, Human
auauuucacguagguuguuuuc

SEQ ID NO: 197443 - RNA, 22 nt, Human
cugcuuuaaaacugauacauga

SEQ ID NO: 197444 - RNA, 22 nt, Human
caguuggaggaaugaggcugua

SEQ ID NO: 197445 - RNA, 22 nt, Human
gauggugcaggugaagugcugg

SEQ ID NO: 197446 - RNA, 22 nt, Human
uauuagguaaaggacuugcagg

SEQ ID NO: 197447 - RNA, 22 nt, Human
guccaggcucaaaagguuguua

SEQ ID NO: 197448 - RNA, 22 nt, Human
uccaaggaaguuugcacuauug

SEQ ID NO: 197449 - RNA, 22 nt, Human
uguuagaaauuauuaguaauau

SEQ ID NO: 197450 - RNA, 22 nt, Human
ugcuuggcuagcuuggcagcuc

SEQ ID NO: 197451 - RNA, 22 nt, Human
cagcaggucaugaaagaaaacc

SEQ ID NO: 197452 - RNA, 22 nt, Human
auaguacaaucaguuaauuagu

SEQ ID NO: 197453 - RNA, 22 nt, Human
uugaggagguaguacagaguau

SEQ ID NO: 197454 - RNA, 22 nt, Human
agccagugaugaagacucugga

SEQ ID NO: 197455 - RNA, 22 nt, Human
gaauagcuguaggcuagugucu

SEQ ID NO: 197456 - RNA, 22 nt, Human
ccagagcagggcagcagggcuc

SEQ ID NO: 197457 - RNA, 22 nt, Human
aauaguuugaauuuaucagaug

SEQ ID NO: 197458 - RNA, 22 nt, Human
agucacauaguguuuuggaauc

SEQ ID NO: 197459 - RNA, 22 nt, Human
auccugggcugcacccucagcc

SEQ ID NO: 197460 - RNA, 22 nt, Human
ucacagacauggugagguaaca

SEQ ID NO: 197461 - RNA, 22 nt, Human
guaggcagguggaggagugaag

SEQ ID NO: 197462 - RNA, 19 nt, Human
aggugugggggcugcagac

SEQ ID NO: 197463 - RNA, 22 nt, Human
uuuguucugaaaacucaagucc

SEQ ID NO: 197464 - RNA, 22 nt, Human
ucagagcuccuaagggcugauu

SEQ ID NO: 197465 - RNA, 22 nt, Human
cagucucugugccagauccugg

SEQ ID NO: 197466 - RNA, 22 nt, Human
gcagggugaaggucacauagaa

SEQ ID NO: 197467 - RNA, 22 nt, Human
ugcagggcauaggguccaguuu

SEQ ID NO: 197468 - RNA, 22 nt, Human
ccugaggcuuaaucugucccaa

SEQ ID NO: 197469 - RNA, 18 nt, Human
uguuuccuccuggaggcu

SEQ ID NO: 197470 - RNA, 22 nt, Human
agaguggagagaaacaacucug

SEQ ID NO: 197471 - RNA, 23 nt, Human
auagucauguaaaauauuugaag

SEQ ID NO: 197472 - RNA, 22 nt, Human
gagcaguuauuuuuagacauga

SEQ ID NO: 197473 - RNA, 22 nt, Human
ccuggcagaauauuaaagugca

SEQ ID NO: 197474 - RNA, 22 nt, Human
gagcuggucaguuucagggcca

SEQ ID NO: 197475 - RNA, 22 nt, Human
aguuccagcugugaccagaaaa

SEQ ID NO: 197476 - RNA, 22 nt, Human
gcugggcuggaaggccaaggca

SEQ ID NO: 197477 - RNA, 22 nt, Human
ccuguggcacaugcagggauuc

SEQ ID NO: 197478 - RNA, 22 nt, Human
gaauacaaacuuaaggcuuuac

SEQ ID NO: 197479 - RNA, 22 nt, Human
acugucuucaaaugaauauauu

SEQ ID NO: 197480 - RNA, 22 nt, Human
aguucuuugugaguaauacaga

SEQ ID NO: 197481 - RNA, 22 nt, Human
cagaggccaggcugccugacug

SEQ ID NO: 197482 - RNA, 22 nt, Human
guacuucuuuagucaauaugua

SEQ ID NO: 197483 - RNA, 22 nt, Human
aaacagagggccacugaggcuc

SEQ ID NO: 197484 - RNA, 22 nt, Human
aggagcugguagucucauuggg

SEQ ID NO: 197485 - RNA, 20 nt, Human
cuguuuauuagaaguggauu

SEQ ID NO: 197486 - RNA, 19 nt, Human
ccagaggacuguuaaugaa

SEQ ID NO: 197487 - RNA, 22 nt, Human
auguaacacccacuuuuauagc

SEQ ID NO: 197488 - RNA, 22 nt, Human
aggaccagaggccagagucagc

SEQ ID NO: 197489 - RNA, 22 nt, Human
cuauugcuaucauucugguggu

SEQ ID NO: 197490 - RNA, 19 nt, Human
ccagcccugucacuucuug

SEQ ID NO: 197491 - RNA, 22 nt, Human
uggcuccaucauccaugcaaga

SEQ ID NO: 197492 - RNA, 22 nt, Human
cagcugugagcagccaguugcc

SEQ ID NO: 197493 - RNA, 22 nt, Human
gugcuggggagauaggaagaga

SEQ ID NO: 197494 - RNA, 22 nt, Human
gccagggcucgcggucccucgu

SEQ ID NO: 197495 - RNA, 22 nt, Human
cugcccaggaaccagaggggca

SEQ ID NO: 197496 - RNA, 22 nt, Human
aaaaaggcuaagcaucuugugc

SEQ ID NO: 197497 - RNA, 22 nt, Human
uauuaacauuuuaugaaaauaa

SEQ ID NO: 197498 - RNA, 22 nt, Human
gagaaaccuguaaggaaggaag

SEQ ID NO: 197499 - RNA, 22 nt, Human
uugaagauuauucuauuaaaag

SEQ ID NO: 197500 - RNA, 22 nt, Human
cagccacuguggaauagccccc

SEQ ID NO: 197501 - RNA, 22 nt, Human
gaggaaugucagcacaggccuc

SEQ ID NO: 197502 - RNA, 22 nt, Human
aaggcuucuuuaguguccuaau

SEQ ID NO: 197503 - RNA, 22 nt, Human
acaggcagguccugucccagcu

SEQ ID NO: 197504 - RNA, 22 nt, Human
ggcugaggcucaugccaucuug

SEQ ID NO: 197505 - RNA, 22 nt, Human
uuuuuuggauaauaaacgaucu

SEQ ID NO: 197506 - RNA, 22 nt, Human
agcaggaaggcuuuggggguuc

SEQ ID NO: 197507 - RNA, 22 nt, Human
uggagggcaugcuguccauggg

SEQ ID NO: 197508 - RNA, 23 nt, Human
augaaacucaagccagauccaag

SEQ ID NO: 197509 - RNA, 22 nt, Human
agaauccuugacucaggcugag

SEQ ID NO: 197510 - RNA, 20 nt, Human
ugaagaggaagaggacggcc

SEQ ID NO: 197511 - RNA, 20 nt, Human
auguucuucauuuaauguuc

SEQ ID NO: 197512 - RNA, 22 nt, Human
caggaggacauacuggcucaca

SEQ ID NO: 197513 - RNA, 22 nt, Human
caaggcuuaucagccaggagcc

SEQ ID NO: 197514 - RNA, 22 nt, Human
augcaacagaaaauugccuggg

SEQ ID NO: 197515 - RNA, 22 nt, Human
uacuuuggggacaauauggaau

SEQ ID NO: 197516 - RNA, 22 nt, Human
uacagacauuuacuccacuccu

SEQ ID NO: 197517 - RNA, 22 nt, Human
ucaugaacaucucaaauaacca

SEQ ID NO: 197518 - RNA, 22 nt, Human
gcccaagguauaucagagacag

SEQ ID NO: 197519 - RNA, 22 nt, Human
auacagguaauuugaauaauag

SEQ ID NO: 197520 - RNA, 22 nt, Human
ccuuggcuaggcagcggcuguc

SEQ ID NO: 197521 - RNA, 22 nt, Human
cuuuagaauuugauauaaucaa

SEQ ID NO: 197522 - RNA, 22 nt, Human
caaagggcggcugucggagggu

SEQ ID NO: 197523 - RNA, 21 nt, Human
ugggauagaaauauggcugcu

SEQ ID NO: 197524 - RNA, 22 nt, Human
gagcugagccuggguggaccgc

SEQ ID NO: 197525 - RNA, 22 nt, Human
gccucugcaugcucagcaccca

SEQ ID NO: 197526 - RNA, 22 nt, Human
uggcagguggagacagcagagc

SEQ ID NO: 197527 - RNA, 20 nt, Human
uccuggccuucucgggcagu

SEQ ID NO: 197528 - RNA, 22 nt, Human
gcucagagaaauuauaggaauu

SEQ ID NO: 197529 - RNA, 22 nt, Human
uuaacaauagaguuucuucagg

SEQ ID NO: 197530 - RNA, 22 nt, Human
uagauucuuaguuucauagaau

SEQ ID NO: 197531 - RNA, 22 nt, Human
gccaagccuguagacacaagcu

SEQ ID NO: 197532 - RNA, 22 nt, Human
augguggagguguauucuggau

SEQ ID NO: 197533 - RNA, 22 nt, Human
cagauucuccaggggcugcaga

SEQ ID NO: 197534 - RNA, 22 nt, Human
agugucuuuagcaaguuuaguc

SEQ ID NO: 197535 - RNA, 22 nt, Human
cagaguguggcaucuuccaacu

SEQ ID NO: 197536 - RNA, 22 nt, Human
uaccagccugacccugucugac

SEQ ID NO: 197537 - RNA, 22 nt, Human
gggcagaggggcgcuucccucu

SEQ ID NO: 197538 - RNA, 22 nt, Human
ucugaagagucuugcaagaaag

SEQ ID NO: 197539 - RNA, 22 nt, Human
uagaaagugguugagaguuuag

SEQ ID NO: 197540 - RNA, 22 nt, Human
uggcagcuggcucugcgcaggc

SEQ ID NO: 197541 - RNA, 22 nt, Human
aagggcuggaauaucucuuaga

SEQ ID NO: 197542 - RNA, 22 nt, Human
gugauacaaauaaacauaugcu

SEQ ID NO: 197543 - RNA, 22 nt, Human
gagucugaugucccccaggcca

SEQ ID NO: 197544 - RNA, 22 nt, Human
aguguccuuaguuagcuuuggg

SEQ ID NO: 197545 - RNA, 22 nt, Human
ccuggcuccgugucacgugccc

SEQ ID NO: 197546 - RNA, 22 nt, Human
gagcagcucgagaaggaagcag

SEQ ID NO: 197547 - RNA, 22 nt, Human
agggcucccgcgguguccggga

SEQ ID NO: 197548 - RNA, 22 nt, Human
uugcagggaccugcagaaagcu

SEQ ID NO: 197549 - RNA, 22 nt, Human
uuuguacaccuaccuaauacag

SEQ ID NO: 197550 - RNA, 20 nt, Human
uucaaagacccucaggucca

SEQ ID NO: 197551 - RNA, 22 nt, Human
gacuguggucuguucuccaggu

SEQ ID NO: 197552 - RNA, 22 nt, Human
gggcacuguguucagagugcag

SEQ ID NO: 197553 - RNA, 19 nt, Human
aguguccuagucauuugcc

SEQ ID NO: 197554 - RNA, 22 nt, Human
guccucuguuagaaaugugcuu

SEQ ID NO: 197555 - RNA, 23 nt, Human
ccaaaagcgagucuguuguuccc

SEQ ID NO: 197556 - RNA, 22 nt, Human
cauccauaugaggcacauuggu

SEQ ID NO: 197557 - RNA, 22 nt, Human
uggcuuccaaauuaucccuaga

SEQ ID NO: 197558 - RNA, 22 nt, Human
ccaggguggggcaggcccacug

SEQ ID NO: 197559 - RNA, 22 nt, Human
ucccugcccucagugcacccgg

SEQ ID NO: 197560 - RNA, 22 nt, Human
ugagcucucagggacagacuau

SEQ ID NO: 197561 - RNA, 22 nt, Human
caggaaauuuauguucuacuua

SEQ ID NO: 197562 - RNA, 22 nt, Human
uuauagcagcaugauuuauagu

SEQ ID NO: 197563 - RNA, 22 nt, Human
acugccuugauugccaguuucc

SEQ ID NO: 197564 - RNA, 22 nt, Human
uaaaagaucacuggcugcuuua

SEQ ID NO: 197565 - RNA, 21 nt, Human
ucuguucaaggaacuacggau

SEQ ID NO: 197566 - RNA, 22 nt, Human
cugggccacaagccugugugau

SEQ ID NO: 197567 - RNA, 23 nt, Human
aggagccaugaguuggauauguu

SEQ ID NO: 197568 - RNA, 23 nt, Human
uggaaucagccuuuuuuccaagg

SEQ ID NO: 197569 - RNA, 22 nt, Human
uucuagacaaauguguucauuc

SEQ ID NO: 197570 - RNA, 20 nt, Human
ugugagcagaugcugaguga

SEQ ID NO: 197571 - RNA, 22 nt, Human
caauuacuuuugcaccaauaua

SEQ ID NO: 197572 - RNA, 22 nt, Human
ggagcagccgcgucucagggca

SEQ ID NO: 197573 - RNA, 22 nt, Human
guguuacucaagagauagcuuu

SEQ ID NO: 197574 - RNA, 18 nt, Human
gggcuaggcaaggaccac

SEQ ID NO: 197575 - RNA, 22 nt, Human
guaaacaucgacccaacagggg

SEQ ID NO: 197576 - RNA, 23 nt, Human
acagagacugccaagauauucuc

SEQ ID NO: 197577 - RNA, 22 nt, Human
acagguggcauaggcaguuuga

SEQ ID NO: 197578 - RNA, 22 nt, Human
gagccaccuucaacucaggaau

SEQ ID NO: 197579 - RNA, 22 nt, Human
ggcuuugccuggaauuuccuug

SEQ ID NO: 197580 - RNA, 22 nt, Human
ggagcugggacccugucaucug

SEQ ID NO: 197581 - RNA, 22 nt, Human
ggacaaaauccaaacuucuuag

SEQ ID NO: 197582 - RNA, 22 nt, Human
gggaugagagcugggacagaag

SEQ ID NO: 197583 - RNA, 22 nt, Human
acuccagggguugcuauuuaca

SEQ ID NO: 197584 - RNA, 22 nt, Human
ggagaugcgacucgcggggcug

SEQ ID NO: 197585 - RNA, 22 nt, Human
cgaggcagacaaaaguuggaag

SEQ ID NO: 197586 - RNA, 22 nt, Human
uccaggucccagacugggcagc

SEQ ID NO: 197587 - RNA, 21 nt, Human
guucuguugacugugggcauc

SEQ ID NO: 197588 - RNA, 22 nt, Human
acaccagggauaugaggaagga

SEQ ID NO: 197589 - RNA, 22 nt, Human
ccauuugugguuuauuugcucu

SEQ ID NO: 197590 - RNA, 22 nt, Human
guguacaguaagugaaucuagg

SEQ ID NO: 197591 - RNA, 22 nt, Human
cugaggcaguuuaauuuuugaa

SEQ ID NO: 197592 - RNA, 22 nt, Human
uaccauuuugaggauggagaga

SEQ ID NO: 197593 - RNA, 21 nt, Human
uaugugucuguggaaaacuag

SEQ ID NO: 197594 - RNA, 22 nt, Human
agugaaggaaacaauugguuga

SEQ ID NO: 197595 - RNA, 22 nt, Human
uggcacagcccauucagagaag

SEQ ID NO: 197596 - RNA, 22 nt, Human
uuuauugggugcagugcccaca

SEQ ID NO: 197597 - RNA, 22 nt, Human
uuauagugggcccaacauggcg

SEQ ID NO: 197598 - RNA, 22 nt, Human
cugggcucaaauccuaucucca

SEQ ID NO: 197599 - RNA, 18 nt, Human
gauggaaaguguaugagu

SEQ ID NO: 197600 - RNA, 16 nt, Human
cagaguguaaacagga

SEQ ID NO: 197601 - RNA, 22 nt, Human
uccuggcauugugcagggugug

SEQ ID NO: 197602 - RNA, 22 nt, Human
agagcuguguuaagaacaggcc

SEQ ID NO: 197603 - RNA, 22 nt, Human
aauuaaaaaaggagagcuugcu

SEQ ID NO: 197604 - RNA, 22 nt, Human
guauuacaaauaaauguuacug

SEQ ID NO: 197605 - RNA, 22 nt, Human
aagggcuguagacaagauugcu

SEQ ID NO: 197606 - RNA, 22 nt, Human
gugcaaaaguaauugcaguacu

SEQ ID NO: 197607 - RNA, 21 nt, Human
ucugugcugccgucaacaucc

SEQ ID NO: 197608 - RNA, 20 nt, Human
acugacagggaacuaaggcu

SEQ ID NO: 197609 - RNA, 22 nt, Human
acucaguacaucuggaguuggc

SEQ ID NO: 197610 - RNA, 22 nt, Human
gucagagcccccagcggcgcgg

SEQ ID NO: 197611 - RNA, 22 nt, Human
aggcagcagacuguuaaucaga

SEQ ID NO: 197612 - RNA, 22 nt, Human
ugccugggagugaccaagacuc

SEQ ID NO: 197613 - RNA, 22 nt, Human
aaaguggucugcaucccuucug

SEQ ID NO: 197614 - RNA, 22 nt, Human
gggacacagagaaacuggagaa

SEQ ID NO: 197615 - RNA, 22 nt, Human
gacuccaggugcaggaggagcc

SEQ ID NO: 197616 - RNA, 22 nt, Human
aaggcugauuagacugauagcu

SEQ ID NO: 197617 - RNA, 22 nt, Human
uuacauucaauuucuagaggua

SEQ ID NO: 197618 - RNA, 22 nt, Human
gaguccuugucauaauucagug

SEQ ID NO: 197619 - RNA, 22 nt, Human
aguuaacacaaguaagauucca

SEQ ID NO: 197620 - RNA, 22 nt, Human
gggcucucgauuagacccuggg

SEQ ID NO: 197621 - RNA, 22 nt, Human
cuuggaggaaggggcucuucug

SEQ ID NO: 197622 - RNA, 22 nt, Human
ugggugcucugcuucccugcac

SEQ ID NO: 197623 - RNA, 22 nt, Human
cagaagaguagcugaacaaguu

SEQ ID NO: 197624 - RNA, 22 nt, Human
agguguggcuggggcagaggcc

SEQ ID NO: 197625 - RNA, 22 nt, Human
uguuaacauguguauuguauga

SEQ ID NO: 197626 - RNA, 22 nt, Human
caggccugaguguggaagucuu

SEQ ID NO: 197627 - RNA, 22 nt, Human
agacagcucuggguuccacacu

SEQ ID NO: 197628 - RNA, 22 nt, Human
cccuccugugccugaggccagc

SEQ ID NO: 197629 - RNA, 22 nt, Human
ucaaggcacuucaugucucagu

SEQ ID NO: 197630 - RNA, 22 nt, Human
cagauccacccuuguagugaca

SEQ ID NO: 197631 - RNA, 22 nt, Human
ggucucugacuuagagauggau

SEQ ID NO: 197632 - RNA, 22 nt, Human
gcaaaugcuaaaguguagagac

SEQ ID NO: 197633 - RNA, 22 nt, Human
ccuggcugcuuccucugccaug

SEQ ID NO: 197634 - RNA, 22 nt, Human
ccugaaaaucaagguaguuugg

SEQ ID NO: 197635 - RNA, 22 nt, Human
auggaaauacagccagagcaga

SEQ ID NO: 197636 - RNA, 22 nt, Human
gccaggcaguucaaguacacca

SEQ ID NO: 197637 - RNA, 22 nt, Human
gaacuuggaacuggggcuacug

SEQ ID NO: 197638 - RNA, 22 nt, Human
ggcugagcguggcugccguggg

SEQ ID NO: 197639 - RNA, 19 nt, Human
aggauuuauuaugugcuca

SEQ ID NO: 197640 - RNA, 22 nt, Human
cuuuacuugcuuuguuacaaaa

SEQ ID NO: 197641 - RNA, 22 nt, Human
acauuucuaguuguucaucucc

SEQ ID NO: 197642 - RNA, 22 nt, Human
aaaucccacucagaaacugcca

SEQ ID NO: 197643 - RNA, 22 nt, Human
cuuuguuaucuguaaaugguua

SEQ ID NO: 197644 - RNA, 22 nt, Human
ccagcccuuugugguucacuga

SEQ ID NO: 197645 - RNA, 21 nt, Human
uguuuuccaccuugaggcaag

SEQ ID NO: 197646 - RNA, 22 nt, Human
caggcugauaggguccaaaguu

SEQ ID NO: 197647 - RNA, 22 nt, Human
ucaggagaguguucaguggagg

SEQ ID NO: 197648 - RNA, 22 nt, Human
agaacuuaggaacaacagcuua

SEQ ID NO: 197649 - RNA, 23 nt, Human
acagcuugccaauuagccuuccg

SEQ ID NO: 197650 - RNA, 22 nt, Human
augaguaaaaccacuauuuaca

SEQ ID NO: 197651 - RNA, 22 nt, Human
uccccagggucccugcuuccau

SEQ ID NO: 197652 - RNA, 22 nt, Human
agaagccauguuuaguaggaug

SEQ ID NO: 197653 - RNA, 22 nt, Human
uccagcuugccuggucuuuugg

SEQ ID NO: 197654 - RNA, 22 nt, Human
caggcauggugagaacucagcc

SEQ ID NO: 197655 - RNA, 22 nt, Human
aauaccuuuccugccauucacu

SEQ ID NO: 197656 - RNA, 22 nt, Human
uccauauauauuagucuuccuu

SEQ ID NO: 197657 - RNA, 22 nt, Human
ugcccuguggguaucugauggc

SEQ ID NO: 197658 - RNA, 22 nt, Human
uguaaaaccaaaucaaucuagu

SEQ ID NO: 197659 - RNA, 22 nt, Human
uuugugcaagacaugcuaagag

SEQ ID NO: 197660 - RNA, 20 nt, Human
gcagcugugcauucuuagga

SEQ ID NO: 197661 - RNA, 22 nt, Human
augugguugaagaauuacaucu

SEQ ID NO: 197662 - RNA, 22 nt, Human
ucagggcacaggccuguggguu

SEQ ID NO: 197663 - RNA, 22 nt, Human
guuuucauuacugcugugauuu

SEQ ID NO: 197664 - RNA, 22 nt, Human
ucaggaggccugaguagcucua

SEQ ID NO: 197665 - RNA, 22 nt, Human
uggagagaaaaaagacaguucu

SEQ ID NO: 197666 - RNA, 22 nt, Human
acaggacaaaaaucuggauggc

SEQ ID NO: 197667 - RNA, 22 nt, Human
aauucauauggauaugcuagua

SEQ ID NO: 197668 - RNA, 22 nt, Human
uuucuagggcucuugucuucug

SEQ ID NO: 197669 - RNA, 22 nt, Human
gugggagcccucagggaggugc

SEQ ID NO: 197670 - RNA, 22 nt, Human
aggccucacacaacagaugcau

SEQ ID NO: 197671 - RNA, 22 nt, Human
gccacagggcagaugcgcagag

SEQ ID NO: 197672 - RNA, 22 nt, Human
uuauuacagucccagggaguag

SEQ ID NO: 197673 - RNA, 22 nt, Human
aggcaggggagcuggaagggua

SEQ ID NO: 197674 - RNA, 22 nt, Human
cuccagcugcuggucugagacu

SEQ ID NO: 197675 - RNA, 20 nt, Human
ugucagugccugaggcacag

SEQ ID NO: 197676 - RNA, 22 nt, Human
agugcagagaccuggucaggca

SEQ ID NO: 197677 - RNA, 22 nt, Human
aaauacacguacauguguaaaa

SEQ ID NO: 197678 - RNA, 22 nt, Human
aucuccagaauggcuuguuaau

SEQ ID NO: 197679 - RNA, 22 nt, Human
auugugaauagugccgcaguaa

SEQ ID NO: 197680 - RNA, 22 nt, Human
gaaucuuaaaucggaaucuuaa

SEQ ID NO: 197681 - RNA, 21 nt, Human
ggcugcucaccuaggucccaa

SEQ ID NO: 197682 - RNA, 22 nt, Human
cauuuacaauguacagguugug

SEQ ID NO: 197683 - RNA, 22 nt, Human
auggggggaugaaggaguccaa

SEQ ID NO: 197684 - RNA, 22 nt, Human
agucuggucuguucauggguca

SEQ ID NO: 197685 - RNA, 21 nt, Human
aacagugcuuaguagauguuc

SEQ ID NO: 197686 - RNA, 22 nt, Human
auccugggcagugugucacucu

SEQ ID NO: 197687 - RNA, 23 nt, Human
agcugcaagacucccugucugag

SEQ ID NO: 197688 - RNA, 22 nt, Human
cagcccugagagaaccaucuau

SEQ ID NO: 197689 - RNA, 22 nt, Human
caguguaagcucuagacuagaa

SEQ ID NO: 197690 - RNA, 22 nt, Human
ugcagccuuuagaaguucagau

SEQ ID NO: 197691 - RNA, 22 nt, Human
gucauaaagcuuguugcauuua

SEQ ID NO: 197692 - RNA, 22 nt, Human
auauuuuguaacuuggaauagg

SEQ ID NO: 197693 - RNA, 22 nt, Human
uggcugccuuucaccucaucuc

SEQ ID NO: 197694 - RNA, 22 nt, Human
cugggucuuuuucuuccauuga

SEQ ID NO: 197695 - RNA, 16 nt, Human
gcuguaaaaggauuca

SEQ ID NO: 197696 - RNA, 22 nt, Human
gaacuggugaagugaagggcag

SEQ ID NO: 197697 - RNA, 22 nt, Human
agaagccaagaacagacagugc

SEQ ID NO: 197698 - RNA, 22 nt, Human
auucucuguagauggcuugaga

SEQ ID NO: 197699 - RNA, 22 nt, Human
aaguuucuggaccuuaccugcu

SEQ ID NO: 197700 - RNA, 20 nt, Human
uagagagaggauauuaaagu

SEQ ID NO: 197701 - RNA, 22 nt, Human
uuccuggggggauagauuucac

SEQ ID NO: 197702 - RNA, 22 nt, Human
aacacuggaagggacaucaagu

SEQ ID NO: 197703 - RNA, 22 nt, Human
ucuuuuuuuccugugcagagcu

SEQ ID NO: 197704 - RNA, 21 nt, Human
uccuuccuugagguccuuucc

SEQ ID NO: 197705 - RNA, 22 nt, Human
uucacagugugaucuaugggca

SEQ ID NO: 197706 - RNA, 22 nt, Human
aauuagaguagagccuaagaau

SEQ ID NO: 197707 - RNA, 22 nt, Human
agcagcuggguccggcggagca

SEQ ID NO: 197708 - RNA, 17 nt, Human
cauccgugagcucggca

SEQ ID NO: 197709 - RNA, 22 nt, Human
cucccuggcuuuguccugaggc

SEQ ID NO: 197710 - RNA, 22 nt, Human
uugcuauuuugagagucauagu

SEQ ID NO: 197711 - RNA, 22 nt, Human
aaauguuuugcucccauguggu

SEQ ID NO: 197712 - RNA, 22 nt, Human
aucauuuuauggcugagaggac

SEQ ID NO: 197713 - RNA, 22 nt, Human
augacaaaaugaaugcagcuag

SEQ ID NO: 197714 - RNA, 22 nt, Human
auauaguuggguuucauucuac

SEQ ID NO: 197715 - RNA, 22 nt, Human
gcugggacggcucaguaagaag

SEQ ID NO: 197716 - RNA, 22 nt, Human
ccuuagaucaggcugucuaggg

SEQ ID NO: 197717 - RNA, 22 nt, Human
agacaggaugcauacucuuggu

SEQ ID NO: 197718 - RNA, 22 nt, Human
ccugagcaucagcgccuccuua

SEQ ID NO: 197719 - RNA, 22 nt, Human
uuucccagagguaugaauaagu

SEQ ID NO: 197720 - RNA, 22 nt, Human
cagcccagaacucacgucucca

SEQ ID NO: 197721 - RNA, 22 nt, Human
gggcagagaaauggacaguugg

SEQ ID NO: 197722 - RNA, 22 nt, Human
ucacaucacaugagugcaagga

SEQ ID NO: 197723 - RNA, 22 nt, Human
ggccaggcacugugugagauau

SEQ ID NO: 197724 - RNA, 22 nt, Human
ugaaagcacucacuucugcucu

SEQ ID NO: 197725 - RNA, 22 nt, Human
gacagacaggaggccaccugcu

SEQ ID NO: 197726 - RNA, 22 nt, Human
accacaucgggcggacacuggg

SEQ ID NO: 197727 - RNA, 18 nt, Human
gagacacaagggccugga

SEQ ID NO: 197728 - RNA, 22 nt, Human
gugcagaggacguggcggccuc

SEQ ID NO: 197729 - RNA, 22 nt, Human
uggcccugucugcacacaggau

SEQ ID NO: 197730 - RNA, 22 nt, Human
ggcucccacccauagggcgagu

SEQ ID NO: 197731 - RNA, 18 nt, Human
uagggcucuagggaguga

SEQ ID NO: 197732 - RNA, 22 nt, Human
acaaugcaccagcaucuucacc

SEQ ID NO: 197733 - RNA, 22 nt, Human
aguuuauuuuugauaagucuug

SEQ ID NO: 197734 - RNA, 22 nt, Human
ccaggccugauugggaaucuug

SEQ ID NO: 197735 - RNA, 22 nt, Human
ucaggaaggcgccccaucagga

SEQ ID NO: 197736 - RNA, 22 nt, Human
aguggcagagcugugucuugaa

SEQ ID NO: 197737 - RNA, 23 nt, Human
ugcaggugugcagagggcucuug

SEQ ID NO: 197738 - RNA, 22 nt, Human
gggaaacuguccaguucucccc

SEQ ID NO: 197739 - RNA, 22 nt, Human
aagcauaaaacguuacaacaug

SEQ ID NO: 197740 - RNA, 22 nt, Human
auuccacuccaauaagugucaa

SEQ ID NO: 197741 - RNA, 22 nt, Human
cccacaggcaggugcaugggcu

SEQ ID NO: 197742 - RNA, 22 nt, Human
aggguagggcccggagacagac

SEQ ID NO: 197743 - RNA, 22 nt, Human
gcacagagacaguccugagauc

SEQ ID NO: 197744 - RNA, 22 nt, Human
ugguuguauaaugucacuaagc

SEQ ID NO: 197745 - RNA, 22 nt, Human
cagcaugguuggguucugggga

SEQ ID NO: 197746 - RNA, 22 nt, Human
caccaucagcagcaggugucaa

SEQ ID NO: 197747 - RNA, 22 nt, Human
ugagccagccucagaagucacg

SEQ ID NO: 197748 - RNA, 22 nt, Human
uauuaugcauaggcaauaaugg

SEQ ID NO: 197749 - RNA, 22 nt, Human
cacagguaauagccuaggcuau

SEQ ID NO: 197750 - RNA, 22 nt, Human
uuuacagcaacagugcagaggu

SEQ ID NO: 197751 - RNA, 22 nt, Human
ucuucagagcauuucugaggua

SEQ ID NO: 197752 - RNA, 22 nt, Human
uggcuucugcuuucaguggagg

SEQ ID NO: 197753 - RNA, 22 nt, Human
ucucacagugagccugaggucg

SEQ ID NO: 197754 - RNA, 22 nt, Human
gcugucuuuccccugcuccaga

SEQ ID NO: 197755 - RNA, 22 nt, Human
aggcuggaguguagcagugcag

SEQ ID NO: 197756 - RNA, 21 nt, Human
ugucauauuucaauacaguuu

SEQ ID NO: 197757 - RNA, 17 nt, Human
uccuggcucugccacug

SEQ ID NO: 197758 - RNA, 22 nt, Human
uuacacuaugaaugagaauaua

SEQ ID NO: 197759 - RNA, 22 nt, Human
acaguaccaggccaaaccauga

SEQ ID NO: 197760 - RNA, 22 nt, Human
uagcccucagcuuggagcgugg

SEQ ID NO: 197761 - RNA, 22 nt, Human
aagaacaugauggccaugugca

SEQ ID NO: 197762 - RNA, 20 nt, Human
gccucagaggguuugaguuu

SEQ ID NO: 197763 - RNA, 20 nt, Human
uggcaggagccacuggaagc

SEQ ID NO: 197764 - RNA, 22 nt, Human
ccuggccaggcuccaaguacug

SEQ ID NO: 197765 - RNA, 22 nt, Human
gccagccccuccauccuguuca

SEQ ID NO: 197766 - RNA, 22 nt, Human
ucaggaugguguggaggaaaua

SEQ ID NO: 197767 - RNA, 22 nt, Human
cagggaugcugcuuaggcaguu

SEQ ID NO: 197768 - RNA, 22 nt, Human
ccagcuuuauagcuucaaagga

SEQ ID NO: 197769 - RNA, 22 nt, Human
uacaaacucuuuauauuucaua

SEQ ID NO: 197770 - RNA, 22 nt, Human
uuauauguuucuguuuggaggc

SEQ ID NO: 197771 - RNA, 22 nt, Human
ucugagcucuaucugugggaau

SEQ ID NO: 197772 - RNA, 22 nt, Human
caccagcagaagacugagggug

SEQ ID NO: 197773 - RNA, 22 nt, Human
uaagacacauugagaaacacaa

SEQ ID NO: 197774 - RNA, 22 nt, Human
aggauaacuauaggauaaugcu

SEQ ID NO: 197775 - RNA, 22 nt, Human
caacuuggcucucuggcuaucc

SEQ ID NO: 197776 - RNA, 22 nt, Human
acagauguuagcaaugaugaug

SEQ ID NO: 197777 - RNA, 22 nt, Human
guguuuuauuggugcagucaga

SEQ ID NO: 197778 - RNA, 22 nt, Human
gaagccaguacugugcucugca

SEQ ID NO: 197779 - RNA, 22 nt, Human
cugugucugccugggauccauu

SEQ ID NO: 197780 - RNA, 22 nt, Human
gucuacuuuugucaucauugca

SEQ ID NO: 197781 - RNA, 22 nt, Human
uucaggaaaugucugccuacca

SEQ ID NO: 197782 - RNA, 22 nt, Human
gcuucaugggugugcaaccugu

SEQ ID NO: 197783 - RNA, 23 nt, Human
uaggccagggugaccuggggaga

SEQ ID NO: 197784 - RNA, 22 nt, Human
ggcuccuguccccucagcugcu

SEQ ID NO: 197785 - RNA, 22 nt, Human
uucugggcccaacccuagagug

SEQ ID NO: 197786 - RNA, 22 nt, Human
gccaggcaauguguuagaagcg

SEQ ID NO: 197787 - RNA, 22 nt, Human
cucucugguuucagcgaagggg

SEQ ID NO: 197788 - RNA, 15 nt, Human
uugcuuuaagacaug

SEQ ID NO: 197789 - RNA, 22 nt, Human
aaucuugaguaucagaccaaga

SEQ ID NO: 197790 - RNA, 22 nt, Human
auggcagcggagcuggaaauga

SEQ ID NO: 197791 - RNA, 22 nt, Human
ugaggugacaauucauucucca

SEQ ID NO: 197792 - RNA, 19 nt, Human
ugugaccccagacaagcug

SEQ ID NO: 197793 - RNA, 22 nt, Human
uagaaacucaggauacucuucc

SEQ ID NO: 197794 - RNA, 22 nt, Human
ggguccagauggugagaguuaa

SEQ ID NO: 197795 - RNA, 22 nt, Human
aguaaaacagagaaaucacuca

SEQ ID NO: 197796 - RNA, 20 nt, Human
uaggaaauauguuuuuaccc

SEQ ID NO: 197797 - RNA, 22 nt, Human
ucuucuguggcucucaccaccc

SEQ ID NO: 197798 - RNA, 23 nt, Human
uuccagaguccacaucugccacc

SEQ ID NO: 197799 - RNA, 20 nt, Human
acuagaaagucacugggggg

SEQ ID NO: 197800 - RNA, 22 nt, Human
ucugugaacaucacauugacag

SEQ ID NO: 197801 - RNA, 22 nt, Human
cagcaaagguagaagcacagga

SEQ ID NO: 197802 - RNA, 22 nt, Human
gcuuuagaucugacuuucugug

SEQ ID NO: 197803 - RNA, 22 nt, Human
gcuuuggucagguguccagccc

SEQ ID NO: 197804 - RNA, 22 nt, Human
uuucucaacagaguaugcccuu

SEQ ID NO: 197805 - RNA, 22 nt, Human
auaaauagugugucauaaaguc

SEQ ID NO: 197806 - RNA, 22 nt, Human
ucuuagauguuagcucugugug

SEQ ID NO: 197807 - RNA, 22 nt, Human
augacacucgaaaaauugaugc

SEQ ID NO: 197808 - RNA, 22 nt, Human
uaaagacauaggaucagggaga

SEQ ID NO: 197809 - RNA, 22 nt, Human
uugcagggaaauagaaauaaac

SEQ ID NO: 197810 - RNA, 22 nt, Human
uauagaagagacaugugcauag

SEQ ID NO: 197811 - RNA, 22 nt, Human
ugaagccacacuagcuuguccu

SEQ ID NO: 197812 - RNA, 22 nt, Human
ccaaaaagcucagagauauguu

SEQ ID NO: 197813 - RNA, 22 nt, Human
auguaaauuguacugacacacg

SEQ ID NO: 197814 - RNA, 22 nt, Human
uuacuguacuagugagacuagg

SEQ ID NO: 197815 - RNA, 22 nt, Human
gcuggcagguaaagccccgggg

SEQ ID NO: 197816 - RNA, 22 nt, Human
auaguuuucuaugcacuguuau

SEQ ID NO: 197817 - RNA, 22 nt, Human
ucucugugaauggcgucaccug

SEQ ID NO: 197818 - RNA, 22 nt, Human
uagagcaguggguaccauggca

SEQ ID NO: 197819 - RNA, 22 nt, Human
agaccaagugcaggugccacua

SEQ ID NO: 197820 - RNA, 20 nt, Human
ugaaggccauuuguuccaga

SEQ ID NO: 197821 - RNA, 22 nt, Human
uucugugacuccucagagauuu

SEQ ID NO: 197822 - RNA, 22 nt, Human
uuggcuucccagagcuuacgcu

SEQ ID NO: 197823 - RNA, 22 nt, Human
cuggcaggaagaggaaagguca

SEQ ID NO: 197824 - RNA, 22 nt, Human
aggcaggcaaguucauaugagg

SEQ ID NO: 197825 - RNA, 22 nt, Human
ucauggcuggaagcucaguuag

SEQ ID NO: 197826 - RNA, 22 nt, Human
cucucagacacccauuuggaaa

SEQ ID NO: 197827 - RNA, 22 nt, Human
aacaaucaaguuucuaaaugac

SEQ ID NO: 197828 - RNA, 22 nt, Human
ucauggcacuuagcacaguccu

SEQ ID NO: 197829 - RNA, 22 nt, Human
gcucccugcacucugcagcccu

SEQ ID NO: 197830 - RNA, 22 nt, Human
guucuauuacucccugcuucuu

SEQ ID NO: 197831 - RNA, 22 nt, Human
uggagagugguuugggggacau

SEQ ID NO: 197832 - RNA, 22 nt, Human
ucaggaagucucaauuagcuac

SEQ ID NO: 197833 - RNA, 22 nt, Human
agagccuggacuuuucugagcc

SEQ ID NO: 197834 - RNA, 22 nt, Human
ugcaaauaagcuauuauggaau

SEQ ID NO: 197835 - RNA, 22 nt, Human
acccagcaugacaccugcacau

SEQ ID NO: 197836 - RNA, 22 nt, Human
ugggaaccauguagcugagaug

SEQ ID NO: 197837 - RNA, 20 nt, Human
uccagggcaaacucaucacc

SEQ ID NO: 197838 - RNA, 22 nt, Human
uuauagaaugguggauuuucug

SEQ ID NO: 197839 - RNA, 22 nt, Human
gggcacagucuaaaguugggcc

SEQ ID NO: 197840 - RNA, 21 nt, Human
ucucugugucuuuaagcugga

SEQ ID NO: 197841 - RNA, 22 nt, Human
gcugacaaacaaggugguguca

SEQ ID NO: 197842 - RNA, 22 nt, Human
ccaaaggccaggcacugagguu

SEQ ID NO: 197843 - RNA, 22 nt, Human
uagcaaacucauacaugugggu

SEQ ID NO: 197844 - RNA, 22 nt, Human
uaacugccuacugugcaaauau

SEQ ID NO: 197845 - RNA, 20 nt, Human
uuccaacucacaucucuaca

SEQ ID NO: 197846 - RNA, 22 nt, Human
agcagcugccacuggaauagga

SEQ ID NO: 197847 - RNA, 22 nt, Human
auacuaaaguauagaacuuagu

SEQ ID NO: 197848 - RNA, 19 nt, Human
cccagcuugaccaccugcu

SEQ ID NO: 197849 - RNA, 21 nt, Human
acagcuaagcaacaacuacug

SEQ ID NO: 197850 - RNA, 22 nt, Human
auagcaaaaggcaccagaguga

SEQ ID NO: 197851 - RNA, 22 nt, Human
aggaauguaauaguguggcuca

SEQ ID NO: 197852 - RNA, 22 nt, Human
aaaggcuuuccagcgcgcggac

SEQ ID NO: 197853 - RNA, 22 nt, Human
ugcuuugccagacaguucccuu

SEQ ID NO: 197854 - RNA, 22 nt, Human
ugcucagagcucuggugcaggu

SEQ ID NO: 197855 - RNA, 22 nt, Human
ucaccuugugaucucccugccu

SEQ ID NO: 197856 - RNA, 22 nt, Human
cccaggaugucgaggcugcagu

SEQ ID NO: 197857 - RNA, 22 nt, Human
gagaggcuggcagugccagguu

SEQ ID NO: 197858 - RNA, 22 nt, Human
gccucuagggcuguugggaauu

SEQ ID NO: 197859 - RNA, 19 nt, Human
aaggcagaaguuggauaug

SEQ ID NO: 197860 - RNA, 22 nt, Human
caggacacaggguguggcugau

SEQ ID NO: 197861 - RNA, 22 nt, Human
ugcugguaccgcgccuccgcca

SEQ ID NO: 197862 - RNA, 22 nt, Human
uucucugcagcuuaggcccagu

SEQ ID NO: 197863 - RNA, 22 nt, Human
agucauaugacccuucacaaac

SEQ ID NO: 197864 - RNA, 19 nt, Human
uccaguuuggcaggaagac

SEQ ID NO: 197865 - RNA, 22 nt, Human
ucugcuguugagcacaagugaa

SEQ ID NO: 197866 - RNA, 22 nt, Human
cagcaguggcugcaggcagcug

SEQ ID NO: 197867 - RNA, 20 nt, Human
uuccaaggucuaugcuucuu

SEQ ID NO: 197868 - RNA, 22 nt, Human
aauuuuaugccuugcacguugg

SEQ ID NO: 197869 - RNA, 22 nt, Human
ucaugcucaucauuagagugac

SEQ ID NO: 197870 - RNA, 22 nt, Human
cagagcauaauugacaugaggu

SEQ ID NO: 197871 - RNA, 22 nt, Human
gcccucagugaccacugauuca

SEQ ID NO: 197872 - RNA, 23 nt, Human
uuugaaaguaucaacucgccuga

SEQ ID NO: 197873 - RNA, 22 nt, Human
ggcagagacuggguuggcagag

SEQ ID NO: 197874 - RNA, 21 nt, Human
agaguuacugucauccuaggu

SEQ ID NO: 197875 - RNA, 22 nt, Human
uggaggaauaacagcaaccuua

SEQ ID NO: 197876 - RNA, 22 nt, Human
caaggacacugauguucauccu

SEQ ID NO: 197877 - RNA, 22 nt, Human
gauugcugggucccacucccag

SEQ ID NO: 197878 - RNA, 22 nt, Human
ucagagucuaaauagaagaaua

SEQ ID NO: 197879 - RNA, 19 nt, Human
gcucugagaggggcauggg

SEQ ID NO: 197880 - RNA, 22 nt, Human
gaagggugcauggagggaaguc

SEQ ID NO: 197881 - RNA, 22 nt, Human
cuuucccacgcaguggaugaga

SEQ ID NO: 197882 - RNA, 21 nt, Human
uccuggcuuuaugcuaccucu

SEQ ID NO: 197883 - RNA, 20 nt, Human
agcaguguggggagacugug

SEQ ID NO: 197884 - RNA, 22 nt, Human
ugucuccauagaguagcuugau

SEQ ID NO: 197885 - RNA, 22 nt, Human
agcuguuuuugucugcugaucc

SEQ ID NO: 197886 - RNA, 22 nt, Human
uuccuggcucacagcagugggg

SEQ ID NO: 197887 - RNA, 21 nt, Human
auucucugugaugggauuagg

SEQ ID NO: 197888 - RNA, 22 nt, Human
ggucuggccuggcauucuaugg

SEQ ID NO: 197889 - RNA, 22 nt, Human
caugaaggcugccagcaggcau

SEQ ID NO: 197890 - RNA, 22 nt, Human
ggcugccagcacugguguagag

SEQ ID NO: 197891 - RNA, 22 nt, Human
uagcccagagagccaggggcuu

SEQ ID NO: 197892 - RNA, 18 nt, Human
gcugggguugagcucucc

SEQ ID NO: 197893 - RNA, 22 nt, Human
caguuaaaaugugcuauaagaa

SEQ ID NO: 197894 - RNA, 22 nt, Human
ucugaaggucugagaaccagga

SEQ ID NO: 197895 - RNA, 22 nt, Human
cuccuuccugcagaucugagau

SEQ ID NO: 197896 - RNA, 23 nt, Human
gcagauggccccagagugcugcc

SEQ ID NO: 197897 - RNA, 22 nt, Human
uacacuuuucaauguagucugu

SEQ ID NO: 197898 - RNA, 22 nt, Human
cuggcuuucugaacaucaguga

SEQ ID NO: 197899 - RNA, 22 nt, Human
gugugggaaggcuaggaugcug

SEQ ID NO: 197900 - RNA, 22 nt, Human
gugcucuguggauugaguugaa

SEQ ID NO: 197901 - RNA, 22 nt, Human
gccuggcaguggggcccuggga

SEQ ID NO: 197902 - RNA, 22 nt, Human
ccugcuggcgcuugucugggag

SEQ ID NO: 197903 - RNA, 22 nt, Human
caguuaaagcugcaugugucag

SEQ ID NO: 197904 - RNA, 22 nt, Human
uucuggguuuacaucugacuuc

SEQ ID NO: 197905 - RNA, 22 nt, Human
uccccuccaacuccaacuaugg

SEQ ID NO: 197906 - RNA, 18 nt, Human
gagcugggagaaggaagg

SEQ ID NO: 197907 - RNA, 22 nt, Human
agccaugcaccuuacucuugcu

SEQ ID NO: 197908 - RNA, 22 nt, Human
agcaaaguggcuuuccaaacca

SEQ ID NO: 197909 - RNA, 22 nt, Human
ucugcacccugaccucuguuuc

SEQ ID NO: 197910 - RNA, 23 nt, Human
ucaagcaauaauugguaauagug

SEQ ID NO: 197911 - RNA, 22 nt, Human
uugggagguaauggagccaagu

SEQ ID NO: 197912 - RNA, 20 nt, Human
gcccaagcgccggccgcaga

SEQ ID NO: 197913 - RNA, 22 nt, Human
aguccaggccucccucuccugc

SEQ ID NO: 197914 - RNA, 22 nt, Human
agcugagagguggcaagcugua

SEQ ID NO: 197915 - RNA, 22 nt, Human
gcuggccugagggccgaggcuc

SEQ ID NO: 197916 - RNA, 22 nt, Human
caggcuuggcagggaggcuggu

SEQ ID NO: 197917 - RNA, 22 nt, Human
augucagagcuuccacaauagu

SEQ ID NO: 197918 - RNA, 22 nt, Human
ugcccagcacccagcaugaugc

SEQ ID NO: 197919 - RNA, 22 nt, Human
cacauaauaaauguuccugaug

SEQ ID NO: 197920 - RNA, 22 nt, Human
gaaggcuuagaaacaagggagc

SEQ ID NO: 197921 - RNA, 22 nt, Human
agcccugcccugccauguggca

SEQ ID NO: 197922 - RNA, 22 nt, Human
aggagagaauuacuggguguca

SEQ ID NO: 197923 - RNA, 22 nt, Human
cuugugcaaauccucgagcaca

SEQ ID NO: 197924 - RNA, 22 nt, Human
ucuuuggaagcuuucagagaag

SEQ ID NO: 197925 - RNA, 22 nt, Human
gguguccuuugggggcuccgag

SEQ ID NO: 197926 - RNA, 22 nt, Human
cagcugccccgcuggcugacca

SEQ ID NO: 197927 - RNA, 22 nt, Human
cucugagggcugucaggaaagg

SEQ ID NO: 197928 - RNA, 22 nt, Human
ggugggaggcaggcugcuccca

SEQ ID NO: 197929 - RNA, 23 nt, Human
ucagagaaguuguaggcugggga

SEQ ID NO: 197930 - RNA, 22 nt, Human
ugcugaaugguaaagaaguaua

SEQ ID NO: 197931 - RNA, 22 nt, Human
ccaaaguauuaaaucuuagcaa

SEQ ID NO: 197932 - RNA, 22 nt, Human
cccaggcuggagugcaauggug

SEQ ID NO: 197933 - RNA, 22 nt, Human
cucagcagcugcugcugguggg

SEQ ID NO: 197934 - RNA, 21 nt, Human
agccaagccuugggagccagg

SEQ ID NO: 197935 - RNA, 22 nt, Human
ucuguaggguaguaguggagau

SEQ ID NO: 197936 - RNA, 21 nt, Human
ccugggcugugguuuggagac

SEQ ID NO: 197937 - RNA, 22 nt, Human
agcuguaugcccaagaugcuau

SEQ ID NO: 197938 - RNA, 22 nt, Human
uggccuccccuaacagccucuu

SEQ ID NO: 197939 - RNA, 22 nt, Human
ucagggacugcagagggaagcu

SEQ ID NO: 197940 - RNA, 22 nt, Human
augucuguuuucauaucagaua

SEQ ID NO: 197941 - RNA, 22 nt, Human
uugcaguuugcuuuuaauggga

SEQ ID NO: 197942 - RNA, 22 nt, Human
ugucagugccaacuuugcuggu

SEQ ID NO: 197943 - RNA, 22 nt, Human
ugccuggauucgguuguuguca

SEQ ID NO: 197944 - RNA, 22 nt, Human
cccuuggaagguagcuggcagu

SEQ ID NO: 197945 - RNA, 22 nt, Human
ggagaagcagcuucuugaugaa

SEQ ID NO: 197946 - RNA, 22 nt, Human
agacuucuuugugagcauuuuc

SEQ ID NO: 197947 - RNA, 22 nt, Human
ugaggaaguuguuucucuucua

SEQ ID NO: 197948 - RNA, 22 nt, Human
aaagggcugucaaauaagcaac

SEQ ID NO: 197949 - RNA, 22 nt, Human
uucaacuaauguuuauuuuaug

SEQ ID NO: 197950 - RNA, 22 nt, Human
ugcugccaauuucuggucuuga

SEQ ID NO: 197951 - RNA, 22 nt, Human
uuggcugcugggaacucaaaca

SEQ ID NO: 197952 - RNA, 22 nt, Human
gaggcuccgugcugcugcccug

SEQ ID NO: 197953 - RNA, 22 nt, Human
aaacugcagccuugaguucagg

SEQ ID NO: 197954 - RNA, 22 nt, Human
uccccacacagauacagaguag

SEQ ID NO: 197955 - RNA, 22 nt, Human
auuaaaauuccaagguaugcca

SEQ ID NO: 197956 - RNA, 22 nt, Human
caguuugugcuaggcacuauuu

SEQ ID NO: 197957 - RNA, 22 nt, Human
ggcaguggaggacccugugucu

SEQ ID NO: 197958 - RNA, 22 nt, Human
ccaggcuggagugcaauggugc

SEQ ID NO: 197959 - RNA, 22 nt, Human
agcaggugucggcgagggucuu

SEQ ID NO: 197960 - RNA, 22 nt, Human
cugggaccuccucacuguucua

SEQ ID NO: 197961 - RNA, 22 nt, Human
agcugagagcugugucaagaua

SEQ ID NO: 197962 - RNA, 22 nt, Human
ucauucaucaguugguagagau

SEQ ID NO: 197963 - RNA, 22 nt, Human
ccauggccgccgcugcucagga

SEQ ID NO: 197964 - RNA, 20 nt, Human
ucuggccccuuccuguccug

SEQ ID NO: 197965 - RNA, 22 nt, Human
cugugcaagcccaagauaaaac

SEQ ID NO: 197966 - RNA, 22 nt, Human
guccacagcuggccagggccuc

SEQ ID NO: 197967 - RNA, 22 nt, Human
uguuauauaacuuacaaccugu

SEQ ID NO: 197968 - RNA, 22 nt, Human
guccuuucgagggugagugaaa

SEQ ID NO: 197969 - RNA, 22 nt, Human
caagcaggaugaagcccaggga

SEQ ID NO: 197970 - RNA, 22 nt, Human
uguuuuaaucucccauugcucu

SEQ ID NO: 197971 - RNA, 22 nt, Human
cgccaggcuugguagcucaugc

SEQ ID NO: 197972 - RNA, 22 nt, Human
uuucucugcagagccccaagga

SEQ ID NO: 197973 - RNA, 22 nt, Human
cuaaaucuagucuuuacugauu

SEQ ID NO: 197974 - RNA, 22 nt, Human
gguuucaacuaaaucaagaagg

SEQ ID NO: 197975 - RNA, 22 nt, Human
ugggaaagacucaggacaggag

SEQ ID NO: 197976 - RNA, 22 nt, Human
ccuucucugcagguaguuggcu

SEQ ID NO: 197977 - RNA, 22 nt, Human
uuuggccucguuuagaaauggc

SEQ ID NO: 197978 - RNA, 22 nt, Human
gcccuguggauuaaugagcagg

SEQ ID NO: 197979 - RNA, 22 nt, Human
agcccugagcuggccugggcuu

SEQ ID NO: 197980 - RNA, 21 nt, Human
ugacauuuggauucauaguaa

SEQ ID NO: 197981 - RNA, 20 nt, Human
aagaggugauaacaggugag

SEQ ID NO: 197982 - RNA, 22 nt, Human
gcagcaguacucaauauccugg

SEQ ID NO: 197983 - RNA, 22 nt, Human
caaagcccuggaaagaugaaga

SEQ ID NO: 197984 - RNA, 22 nt, Human
aucugccugcaguggagguggg

SEQ ID NO: 197985 - RNA, 22 nt, Human
uacaggcucuugucagacguau

SEQ ID NO: 197986 - RNA, 21 nt, Human
gcaggguccuuuccauuccua

SEQ ID NO: 197987 - RNA, 22 nt, Human
ccucagaugucuuaaggcacug

SEQ ID NO: 197988 - RNA, 22 nt, Human
ugccauacuauaaggcugucaa

SEQ ID NO: 197989 - RNA, 16 nt, Human
cuggacagaaaaaccu

SEQ ID NO: 197990 - RNA, 22 nt, Human
caugucaauaaauauaacugca

SEQ ID NO: 197991 - RNA, 20 nt, Human
acacagacucagcuuggaug

SEQ ID NO: 197992 - RNA, 22 nt, Human
gagcacagugcaguuucugcua

SEQ ID NO: 197993 - RNA, 22 nt, Human
aaauuguugaucuacaguaagg

SEQ ID NO: 197994 - RNA, 22 nt, Human
uugugcaaaggggguuaaucau

SEQ ID NO: 197995 - RNA, 22 nt, Human
uaguccaggaagguggggcaga

SEQ ID NO: 197996 - RNA, 22 nt, Human
ucucucucagccauuacagaac

SEQ ID NO: 197997 - RNA, 22 nt, Human
gacuguggccuuggaccauggg

SEQ ID NO: 197998 - RNA, 22 nt, Human
cagaggccuggcuuggacaccu

SEQ ID NO: 197999 - RNA, 22 nt, Human
gucacugccucuuaacuuuuuc

SEQ ID NO: 198000 - RNA, 22 nt, Human
ggucacauucugaggaaucagg

SEQ ID NO: 198001 - RNA, 22 nt, Human
caguggccgcggggcugugggu

SEQ ID NO: 198002 - RNA, 22 nt, Human
acugcugauuuuaggacuguua

SEQ ID NO: 198003 - RNA, 22 nt, Human
ugggaauguagaauguaaacca

SEQ ID NO: 198004 - RNA, 22 nt, Human
cuggucccugcagugugcuggg

SEQ ID NO: 198005 - RNA, 22 nt, Human
uugaaugaagggaugaccgaag

SEQ ID NO: 198006 - RNA, 22 nt, Human
agcuugaaccacaugaaauugc

SEQ ID NO: 198007 - RNA, 22 nt, Human
cauguccuucucauugccucau

SEQ ID NO: 198008 - RNA, 22 nt, Human
cuaugaaaugucagauucugca

SEQ ID NO: 198009 - RNA, 22 nt, Human
acaauguguuuuuauacauuug

SEQ ID NO: 198010 - RNA, 22 nt, Human
cauuauauuacagcacuguuaa

SEQ ID NO: 198011 - RNA, 22 nt, Human
gcagguggugggggagccguuc

SEQ ID NO: 198012 - RNA, 22 nt, Human
uacacaaaggcacucuguuguu

SEQ ID NO: 198013 - RNA, 22 nt, Human
uucuuuuggacucaaagagaac

SEQ ID NO: 198014 - RNA, 22 nt, Human
ccuggccuccuggccuucucau

SEQ ID NO: 198015 - RNA, 22 nt, Human
uggcagugggaauggacaaaca

SEQ ID NO: 198016 - RNA, 22 nt, Human
cagacuggccacaucugcacug

SEQ ID NO: 198017 - RNA, 22 nt, Human
uuagaaagguuuugcucugaaa

SEQ ID NO: 198018 - RNA, 22 nt, Human
gcagcugggccccagccucucc

SEQ ID NO: 198019 - RNA, 20 nt, Human
cugcccacuagaacuaccug

SEQ ID NO: 198020 - RNA, 22 nt, Human
gaugcugauaauucaugagaag

SEQ ID NO: 198021 - RNA, 22 nt, Human
uaagacugugagcucagagacu

SEQ ID NO: 198022 - RNA, 22 nt, Human
gaggcucaguuaugucaucagg

SEQ ID NO: 198023 - RNA, 22 nt, Human
agcuggcauacuuugcuaggaa

SEQ ID NO: 198024 - RNA, 22 nt, Human
acccugagaaagucacaugcau

SEQ ID NO: 198025 - RNA, 22 nt, Human
cugggcagcugugcaaacaaua

SEQ ID NO: 198026 - RNA, 22 nt, Human
augcacccuuaugaauaugauc

SEQ ID NO: 198027 - RNA, 22 nt, Human
aagugaccucaugguuucuccu

SEQ ID NO: 198028 - RNA, 22 nt, Human
acccaggccauuggcaagaguc

SEQ ID NO: 198029 - RNA, 21 nt, Human
ugaggcaggggugcuuuuguc

SEQ ID NO: 198030 - RNA, 22 nt, Human
gcacagaggaugaggcagcucu

SEQ ID NO: 198031 - RNA, 22 nt, Human
aauugcuuugaagaagggagcg

SEQ ID NO: 198032 - RNA, 22 nt, Human
uccagcagaaccagagaccugg

SEQ ID NO: 198033 - RNA, 22 nt, Human
cccugugcauuggaggguguuu

SEQ ID NO: 198034 - RNA, 19 nt, Human
uagguguccgccggaggug

SEQ ID NO: 198035 - RNA, 23 nt, Human
uggcugagcccacuaucuuggcc

SEQ ID NO: 198036 - RNA, 22 nt, Human
aguauuucugaauauuaucaua

SEQ ID NO: 198037 - RNA, 22 nt, Human
agaaccaugaguuugaguaucu

SEQ ID NO: 198038 - RNA, 22 nt, Human
gcugggcagcugaggccucuca

SEQ ID NO: 198039 - RNA, 22 nt, Human
aaagcuuaagguagguacagag

SEQ ID NO: 198040 - RNA, 22 nt, Human
gccugagauucccggagccgug

SEQ ID NO: 198041 - RNA, 22 nt, Human
uggcccaguauguauaaucuua

SEQ ID NO: 198042 - RNA, 22 nt, Human
ucuucagaagaucacaucagug

SEQ ID NO: 198043 - RNA, 22 nt, Human
acaugagagaaaaguauucuga

SEQ ID NO: 198044 - RNA, 22 nt, Human
gcccauggcuucccuaggcaca

SEQ ID NO: 198045 - RNA, 22 nt, Human
gucccuuccucauuccacuuua

SEQ ID NO: 198046 - RNA, 22 nt, Human
agaaguuaauuccugaaauucu

SEQ ID NO: 198047 - RNA, 22 nt, Human
uguacacaacgugcagguuugu

SEQ ID NO: 198048 - RNA, 22 nt, Human
guugcugaaauuaauauuggag

SEQ ID NO: 198049 - RNA, 22 nt, Human
ucaucacauguguagucauccc

SEQ ID NO: 198050 - RNA, 22 nt, Human
cacaguuugguuuugcuguaau

SEQ ID NO: 198051 - RNA, 22 nt, Human
ugccucugccuccauuguuagu

SEQ ID NO: 198052 - RNA, 22 nt, Human
uucacauuguuuuaaugugaau

SEQ ID NO: 198053 - RNA, 22 nt, Human
aaauccaggagaauuuccacuu

SEQ ID NO: 198054 - RNA, 22 nt, Human
aucaaagugaaaagugcugaug

SEQ ID NO: 198055 - RNA, 22 nt, Human
acgugcauauguauacacacau

SEQ ID NO: 198056 - RNA, 22 nt, Human
agaggaguauuuucuaagggaa

SEQ ID NO: 198057 - RNA, 22 nt, Human
cucucuggaagggggagcugau

SEQ ID NO: 198058 - RNA, 22 nt, Human
ggacaggugcaaagggcacaug

SEQ ID NO: 198059 - RNA, 20 nt, Human
aacuuuagacauaaucucuu

SEQ ID NO: 198060 - RNA, 22 nt, Human
ugcuggcucugggccaagcagg

SEQ ID NO: 198061 - RNA, 19 nt, Human
uucacauuuugcucugagg

SEQ ID NO: 198062 - RNA, 22 nt, Human
cugccugcaugcugccauagcu

SEQ ID NO: 198063 - RNA, 20 nt, Human
gcugaggggucuauggcaua

SEQ ID NO: 198064 - RNA, 22 nt, Human
gcuggccucaucacugacuucu

SEQ ID NO: 198065 - RNA, 23 nt, Human
ucucuguacagaugaggacacac

SEQ ID NO: 198066 - RNA, 22 nt, Human
gcaugggcuuucucagaguucu

SEQ ID NO: 198067 - RNA, 22 nt, Human
uagaacaugacuuauuuuugga

SEQ ID NO: 198068 - RNA, 22 nt, Human
ccaggucuuuggccuuggcacu

SEQ ID NO: 198069 - RNA, 17 nt, Human
uuuuguucaucuucaaa

SEQ ID NO: 198070 - RNA, 18 nt, Human
caaauacuguugucuuau

SEQ ID NO: 198071 - RNA, 22 nt, Human
cacaucauagagacucaaucca

SEQ ID NO: 198072 - RNA, 22 nt, Human
uuacacaucuagacccauuuuu

SEQ ID NO: 198073 - RNA, 22 nt, Human
cugagcuguggaauaaacacug

SEQ ID NO: 198074 - RNA, 21 nt, Human
agaauuaaauuggauuugugu

SEQ ID NO: 198075 - RNA, 22 nt, Human
uauuccaccagagaugugaauu

SEQ ID NO: 198076 - RNA, 22 nt, Human
ugaguucuccaggaagcagacu

SEQ ID NO: 198077 - RNA, 22 nt, Human
uuagaagugaaauagcuguaca

SEQ ID NO: 198078 - RNA, 22 nt, Human
ccuggcucuucgggaguuuguu

SEQ ID NO: 198079 - RNA, 22 nt, Human
gaggaguggguuagugcuuauu

SEQ ID NO: 198080 - RNA, 22 nt, Human
uggccuggaagagaggucgagg

SEQ ID NO: 198081 - RNA, 22 nt, Human
guguccugggucucugauucuu

SEQ ID NO: 198082 - RNA, 22 nt, Human
uaagaaacccaggaauuucuua

SEQ ID NO: 198083 - RNA, 20 nt, Human
uauuugaaauggccaagugu

SEQ ID NO: 198084 - RNA, 22 nt, Human
uggccacaguguccagcagcag

SEQ ID NO: 198085 - RNA, 22 nt, Human
acacaagauuguguauugaauu

SEQ ID NO: 198086 - RNA, 22 nt, Human
gaagcacauggcugugagcaac

SEQ ID NO: 198087 - RNA, 20 nt, Human
gccacugugcuuacacugcu

SEQ ID NO: 198088 - RNA, 22 nt, Human
agaccaggaaggccuacagaua

SEQ ID NO: 198089 - RNA, 22 nt, Human
agcaauuauggaguuguugacg

SEQ ID NO: 198090 - RNA, 22 nt, Human
ucucaggccccugaguuucucu

SEQ ID NO: 198091 - RNA, 22 nt, Human
ucaugcagaggaaggcuaguuu

SEQ ID NO: 198092 - RNA, 22 nt, Human
aacacucucuguugguaaggcu

SEQ ID NO: 198093 - RNA, 22 nt, Human
cuacaguaugaaaccuuuacuc

SEQ ID NO: 198094 - RNA, 22 nt, Human
uuacaugaugauuucauaaaca

SEQ ID NO: 198095 - RNA, 22 nt, Human
uuagaauccaugguugcagugg

SEQ ID NO: 198096 - RNA, 22 nt, Human
aagacaugcaguuuguuccauu

SEQ ID NO: 198097 - RNA, 22 nt, Human
uggucaaagaccaggaaaugcu

SEQ ID NO: 198098 - RNA, 20 nt, Human
agcaguuuccuaacucagcu

SEQ ID NO: 198099 - RNA, 22 nt, Human
aguaaacauagaauguucuucc

SEQ ID NO: 198100 - RNA, 22 nt, Human
gcagaggagaugaagauacuuu

SEQ ID NO: 198101 - RNA, 22 nt, Human
cugaaggcuaaaauggacugaa

SEQ ID NO: 198102 - RNA, 22 nt, Human
gccuguccccaggagaguccgg

SEQ ID NO: 198103 - RNA, 22 nt, Human
agucucucacagaggauucucc

SEQ ID NO: 198104 - RNA, 19 nt, Human
auggcugcugauuggggau

SEQ ID NO: 198105 - RNA, 22 nt, Human
uucacaguuugcugggacagga

SEQ ID NO: 198106 - RNA, 22 nt, Human
gagccaggaggcagagacugca

SEQ ID NO: 198107 - RNA, 22 nt, Human
guuccucauccagucaugacua

SEQ ID NO: 198108 - RNA, 22 nt, Human
uccuagaacagcccaccuggaa

SEQ ID NO: 198109 - RNA, 22 nt, Human
uaaguguuauuauucucacuuu

SEQ ID NO: 198110 - RNA, 22 nt, Human
uccacagguaugaggccccacc

SEQ ID NO: 198111 - RNA, 22 nt, Human
caagggcuucaaguggccaaga

SEQ ID NO: 198112 - RNA, 22 nt, Human
uggccugcccagagcagcucug

SEQ ID NO: 198113 - RNA, 22 nt, Human
acucuugucucaacuuuuguau

SEQ ID NO: 198114 - RNA, 17 nt, Human
ggcuggaggggacccgg

SEQ ID NO: 198115 - RNA, 16 nt, Human
caugagucaguaagca

SEQ ID NO: 198116 - RNA, 22 nt, Human
caaauguguuuuuucuucuaca

SEQ ID NO: 198117 - RNA, 22 nt, Human
ggucacauucugagguauuagg

SEQ ID NO: 198118 - RNA, 22 nt, Human
agcaguuacgggccuaucuagg

SEQ ID NO: 198119 - RNA, 22 nt, Human
agaccuggguucgaguccuaac

SEQ ID NO: 198120 - RNA, 22 nt, Human
uggauaaaugugcagaugacau

SEQ ID NO: 198121 - RNA, 22 nt, Human
ggagcugaggacacuacauuuu

SEQ ID NO: 198122 - RNA, 22 nt, Human
gcuguggaguacagagcugguu

SEQ ID NO: 198123 - RNA, 22 nt, Human
aggcugaggcggguagaucacc

SEQ ID NO: 198124 - RNA, 22 nt, Human
gcugggccagagcagcagcacu

SEQ ID NO: 198125 - RNA, 22 nt, Human
gaggcauaaaucacaguguuca

SEQ ID NO: 198126 - RNA, 22 nt, Human
auuuucaucgcuagguuggccu

SEQ ID NO: 198127 - RNA, 22 nt, Human
cucuggaggccuaaggaagugg

SEQ ID NO: 198128 - RNA, 22 nt, Human
ggcuuucuccuugccuuagucu

SEQ ID NO: 198129 - RNA, 22 nt, Human
augcugugccuggaaagcggcu

SEQ ID NO: 198130 - RNA, 22 nt, Human
uuuuauucucagcuccagagag

SEQ ID NO: 198131 - RNA, 20 nt, Human
cugccaugauugauagagug

SEQ ID NO: 198132 - RNA, 22 nt, Human
ucaggcucugccaccuagauua

SEQ ID NO: 198133 - RNA, 19 nt, Human
gaaggcuuuugguauguuu

SEQ ID NO: 198134 - RNA, 22 nt, Human
agagggaaggacagauguuuca

SEQ ID NO: 198135 - RNA, 22 nt, Human
cguauacaugaagacauugcug

SEQ ID NO: 198136 - RNA, 22 nt, Human
agucagugggcuuggcacagaa

SEQ ID NO: 198137 - RNA, 22 nt, Human
ugggaggaucucuugaggccag

SEQ ID NO: 198138 - RNA, 22 nt, Human
gguugguaacucccugugcagu

SEQ ID NO: 198139 - RNA, 22 nt, Human
gcagcuggucuggccuagagua

SEQ ID NO: 198140 - RNA, 22 nt, Human
cggccaagccggggccccgaag

SEQ ID NO: 198141 - RNA, 22 nt, Human
uuauuccauucaguucaacaag

SEQ ID NO: 198142 - RNA, 20 nt, Human
uagaaucuacuauuuggccc

SEQ ID NO: 198143 - RNA, 22 nt, Human
agugcuggaaagggacggagga

SEQ ID NO: 198144 - RNA, 22 nt, Human
gcagguguggauuugcauccag

SEQ ID NO: 198145 - RNA, 22 nt, Human
gcucagggccauggaccagcag

SEQ ID NO: 198146 - RNA, 22 nt, Human
cugccccagccuggggccuucu

SEQ ID NO: 198147 - RNA, 22 nt, Human
gugugcagaagacacaagacau

SEQ ID NO: 198148 - RNA, 22 nt, Human
gaaggggaaaguugagcaaaua

SEQ ID NO: 198149 - RNA, 22 nt, Human
guacccaggcacgccuugcuga

SEQ ID NO: 198150 - RNA, 22 nt, Human
auguuucaccagcaaauuaccu

SEQ ID NO: 198151 - RNA, 22 nt, Human
gaauuucagagguaacaucauc

SEQ ID NO: 198152 - RNA, 22 nt, Human
cagagagagucaaaucuuugcu

SEQ ID NO: 198153 - RNA, 22 nt, Human
caggcaccugugugucucaggg

SEQ ID NO: 198154 - RNA, 22 nt, Human
caggcugggcagccuccccggc

SEQ ID NO: 198155 - RNA, 22 nt, Human
gagagucuaggaaccucauaua

SEQ ID NO: 198156 - RNA, 22 nt, Human
ugauggaaauaaaagcauagcu

SEQ ID NO: 198157 - RNA, 22 nt, Human
cuggcugugcugacugagaggg

SEQ ID NO: 198158 - RNA, 22 nt, Human
ucuuucuggucucgccuuauuc

SEQ ID NO: 198159 - RNA, 22 nt, Human
aguggcagagugcacucaggca

SEQ ID NO: 198160 - RNA, 22 nt, Human
cucagaggcaagcaaggagcug

SEQ ID NO: 198161 - RNA, 22 nt, Human
uuccuggugaccucacugguag

SEQ ID NO: 198162 - RNA, 22 nt, Human
agagcuggggccagagucaagg

SEQ ID NO: 198163 - RNA, 22 nt, Human
gagcaggcaacucugcagugcc

SEQ ID NO: 198164 - RNA, 23 nt, Human
aggaagcuaaguguggcugcgga

SEQ ID NO: 198165 - RNA, 22 nt, Human
ugccuggcacuccuggagcuca

SEQ ID NO: 198166 - RNA, 22 nt, Human
caggaggaaaugugacccugcu

SEQ ID NO: 198167 - RNA, 23 nt, Human
uuucuguuggguauauauccaag

SEQ ID NO: 198168 - RNA, 22 nt, Human
uuuacauugcauuagguauuau

SEQ ID NO: 198169 - RNA, 22 nt, Human
agggacagucuacuguucacug

SEQ ID NO: 198170 - RNA, 22 nt, Human
accugaggaagggcgagaagcu

SEQ ID NO: 198171 - RNA, 22 nt, Human
auucugggugacuacgugauca

SEQ ID NO: 198172 - RNA, 22 nt, Human
augauggagguguccuggauuu

SEQ ID NO: 198173 - RNA, 22 nt, Human
uagaaaauagggccuguggagc

SEQ ID NO: 198174 - RNA, 22 nt, Human
cccuuccucccaggcuucugug

SEQ ID NO: 198175 - RNA, 16 nt, Human
gugagggacauagcuu

SEQ ID NO: 198176 - RNA, 22 nt, Human
uggaugaaaaaugagaauuuuc

SEQ ID NO: 198177 - RNA, 22 nt, Human
gaaaggcuaaaauuauaagggu

SEQ ID NO: 198178 - RNA, 22 nt, Human
agaugaaauuuguguugaguug

SEQ ID NO: 198179 - RNA, 22 nt, Human
ccaggaggaugguuguuaggug

SEQ ID NO: 198180 - RNA, 22 nt, Human
ggucccaguugcccaggucagg

SEQ ID NO: 198181 - RNA, 22 nt, Human
guaacugguuuucuucccucuc

SEQ ID NO: 198182 - RNA, 22 nt, Human
cucuguagacuccaccuuugag

SEQ ID NO: 198183 - RNA, 22 nt, Human
ucagcaggcucugguugaccau

SEQ ID NO: 198184 - RNA, 22 nt, Human
auuaauauacacuguuagcaug

SEQ ID NO: 198185 - RNA, 17 nt, Human
ugaugcaaagucagcug

SEQ ID NO: 198186 - RNA, 23 nt, Human
cuggcccuggcucugugaucaug

SEQ ID NO: 198187 - RNA, 22 nt, Human
cuuagaagugggcuauaauuag

SEQ ID NO: 198188 - RNA, 22 nt, Human
gcuucccaaacuuguggauaga

SEQ ID NO: 198189 - RNA, 19 nt, Human
aggagaaguagcagaaauu

SEQ ID NO: 198190 - RNA, 22 nt, Human
aggcuaggcaugugcuaccaca

SEQ ID NO: 198191 - RNA, 22 nt, Human
caguccaggccuggaggagcca

SEQ ID NO: 198192 - RNA, 22 nt, Human
ucacaucuccauguguuguuca

SEQ ID NO: 198193 - RNA, 18 nt, Human
uccaggccugaagugucc

SEQ ID NO: 198194 - RNA, 22 nt, Human
auucagcauucauuaugcgcca

SEQ ID NO: 198195 - RNA, 22 nt, Human
ccagacagcaguuaaaggacau

SEQ ID NO: 198196 - RNA, 22 nt, Human
caaggagaguaauugaaugaga

SEQ ID NO: 198197 - RNA, 22 nt, Human
ugaggaaacugaggcacagaug

SEQ ID NO: 198198 - RNA, 20 nt, Human
ccuggcugguggaggaaagg

SEQ ID NO: 198199 - RNA, 23 nt, Human
uuacuacacaaguaacgauuccc

SEQ ID NO: 198200 - RNA, 22 nt, Human
ugugucuuacauaauuacaugu

SEQ ID NO: 198201 - RNA, 22 nt, Human
ggccuuccauugcucuuuucua

SEQ ID NO: 198202 - RNA, 22 nt, Human
cagaggguugaugugaggcuua

SEQ ID NO: 198203 - RNA, 22 nt, Human
ggaccugcucucccaguucucu

SEQ ID NO: 198204 - RNA, 22 nt, Human
uaggaaauuggaaacucuucac

SEQ ID NO: 198205 - RNA, 22 nt, Human
aaggcagccgugugacugcaug

SEQ ID NO: 198206 - RNA, 22 nt, Human
agcugugcuguggucaucuggg

SEQ ID NO: 198207 - RNA, 22 nt, Human
agucacauagaaguggguuuaa

SEQ ID NO: 198208 - RNA, 22 nt, Human
ucucaggcuaccuugcacaagg

SEQ ID NO: 198209 - RNA, 22 nt, Human
ccaggcaucacgggcauguggc

SEQ ID NO: 198210 - RNA, 22 nt, Human
ucagggcauggcugcacuuggc

SEQ ID NO: 198211 - RNA, 22 nt, Human
ucuaggguggagcugggaaucc

SEQ ID NO: 198212 - RNA, 23 nt, Human
gcuuuuaaaccugugacugccgc

SEQ ID NO: 198213 - RNA, 22 nt, Human
aaggaaagauucucucucuaga

SEQ ID NO: 198214 - RNA, 22 nt, Human
gaagcaguagcaacugugucuu

SEQ ID NO: 198215 - RNA, 22 nt, Human
ccuguaggcgagggauggacag

SEQ ID NO: 198216 - RNA, 20 nt, Human
aauccauuggucuauauguc

SEQ ID NO: 198217 - RNA, 22 nt, Human
acuguacauauggauucuaaga

SEQ ID NO: 198218 - RNA, 22 nt, Human
gguccaggggguagauauguga

SEQ ID NO: 198219 - RNA, 22 nt, Human
gcacacaggcaguuuccagcca

SEQ ID NO: 198220 - RNA, 22 nt, Human
cuuuccaaugcauuuccaaugu

SEQ ID NO: 198221 - RNA, 22 nt, Human
cagaggcaggaagaugggcagu

SEQ ID NO: 198222 - RNA, 22 nt, Human
auggcucucuagggcccagguu

SEQ ID NO: 198223 - RNA, 22 nt, Human
uuacuaagagaaguaaauauuu

SEQ ID NO: 198224 - RNA, 22 nt, Human
agcucaguggcucaguggguau

SEQ ID NO: 198225 - RNA, 22 nt, Human
aaggaacuaaauaguucuggaa

SEQ ID NO: 198226 - RNA, 22 nt, Human
uaaagcuuguauugcaauauuu

SEQ ID NO: 198227 - RNA, 22 nt, Human
uuaacauacaucaugaacaaug

SEQ ID NO: 198228 - RNA, 22 nt, Human
cacaggagggagcgggcagcca

SEQ ID NO: 198229 - RNA, 22 nt, Human
gaaaguuauugaaccuuauuua

SEQ ID NO: 198230 - RNA, 22 nt, Human
agccaacucccucucauugagc

SEQ ID NO: 198231 - RNA, 22 nt, Human
auagaagcugauaaacuacuuc

SEQ ID NO: 198232 - RNA, 22 nt, Human
agcaggcaggcccagcggcugg

SEQ ID NO: 198233 - RNA, 22 nt, Human
ugucaguucaauuauaguaauu

SEQ ID NO: 198234 - RNA, 22 nt, Human
gcagcuuuaaaggaggcucuga

SEQ ID NO: 198235 - RNA, 22 nt, Human
ugaagaauguugcagugagcau

SEQ ID NO: 198236 - RNA, 22 nt, Human
uuaaauauuauguugucugcaa

SEQ ID NO: 198237 - RNA, 22 nt, Human
cagcagccagacaagauacauc

SEQ ID NO: 198238 - RNA, 22 nt, Human
cacagaggagugcacacucucu

SEQ ID NO: 198239 - RNA, 19 nt, Human
gacuuuggaaaugcuguuu

SEQ ID NO: 198240 - RNA, 21 nt, Human
acaggagaccgccuggcaguc

SEQ ID NO: 198241 - RNA, 23 nt, Human
uaucaguaagcaucccugaaccc

SEQ ID NO: 198242 - RNA, 22 nt, Human
gaagcaguucgaaagcaguugg

SEQ ID NO: 198243 - RNA, 22 nt, Human
acaucuuugcucuuauagagcu

SEQ ID NO: 198244 - RNA, 22 nt, Human
gaaggcuucccaccugauauuu

SEQ ID NO: 198245 - RNA, 22 nt, Human
ccaagcuggauuuagcugcaca

SEQ ID NO: 198246 - RNA, 22 nt, Human
accacugcccauggugaaaacu

SEQ ID NO: 198247 - RNA, 22 nt, Human
ucacauaaauuauacaauuuca

SEQ ID NO: 198248 - RNA, 22 nt, Human
aguguauuaaugcuccaggagu

SEQ ID NO: 198249 - RNA, 22 nt, Human
uccugggauuaagguggugauu

SEQ ID NO: 198250 - RNA, 22 nt, Human
cugagaggcggagcuugcagug

SEQ ID NO: 198251 - RNA, 22 nt, Human
ugcucugucaagaaaagaugcc

SEQ ID NO: 198252 - RNA, 22 nt, Human
acucucugggcaugccccacca

SEQ ID NO: 198253 - RNA, 19 nt, Human
guggcugccgaucgcggcu

SEQ ID NO: 198254 - RNA, 22 nt, Human
gauagauaaaacuauauuuuca

SEQ ID NO: 198255 - RNA, 21 nt, Human
aucucacagcccagagaagcc

SEQ ID NO: 198256 - RNA, 21 nt, Human
acacaacaggcagucauuuuc

SEQ ID NO: 198257 - RNA, 22 nt, Human
gcucuggcuuggggcacucguc

SEQ ID NO: 198258 - RNA, 22 nt, Human
gcugcccagcaggccccagggg

SEQ ID NO: 198259 - RNA, 22 nt, Human
cuggccagguuuugaacaguug

SEQ ID NO: 198260 - RNA, 22 nt, Human
ugguaccaugacaaaugucagg

SEQ ID NO: 198261 - RNA, 22 nt, Human
ugguaucguguuggcacucagu

SEQ ID NO: 198262 - RNA, 22 nt, Human
caggcugcugacaggcuuggag

SEQ ID NO: 198263 - RNA, 22 nt, Human
uaaagcagccagggucuaagcc

SEQ ID NO: 198264 - RNA, 20 nt, Human
acacaagcacuucugguauu

SEQ ID NO: 198265 - RNA, 22 nt, Human
uccugccugagcguggaggagg

SEQ ID NO: 198266 - RNA, 22 nt, Human
augggcagcugcagcaguggug

SEQ ID NO: 198267 - RNA, 22 nt, Human
aaggaggaauucugaguucaug

SEQ ID NO: 198268 - RNA, 22 nt, Human
ugucagaccugugauuucagca

SEQ ID NO: 198269 - RNA, 22 nt, Human
aguccagucucacucuuggcag

SEQ ID NO: 198270 - RNA, 22 nt, Human
gggagaagaaugugucaauugu

SEQ ID NO: 198271 - RNA, 22 nt, Human
guccagccaggcugcagcaccc

SEQ ID NO: 198272 - RNA, 18 nt, Human
gagaaaccugugaaugcu

SEQ ID NO: 198273 - RNA, 22 nt, Human
aggucucugaguacugcuggac

SEQ ID NO: 198274 - RNA, 22 nt, Human
uaucagauuuagaggagucaua

SEQ ID NO: 198275 - RNA, 22 nt, Human
uucauguuguaguauguaucag

SEQ ID NO: 198276 - RNA, 22 nt, Human
gccuguuucuccuccuuggccc

SEQ ID NO: 198277 - RNA, 22 nt, Human
gcuggaaaucaaagaaguggau

SEQ ID NO: 198278 - RNA, 22 nt, Human
uugaaaagcaaaugauggguag

SEQ ID NO: 198279 - RNA, 22 nt, Human
uagauaauuuggcaucauauug

SEQ ID NO: 198280 - RNA, 22 nt, Human
augagauuuuaaaacuucacuu

SEQ ID NO: 198281 - RNA, 22 nt, Human
ggagucugagcuuguguccugg

SEQ ID NO: 198282 - RNA, 22 nt, Human
uggagagaacagugucugaaag

SEQ ID NO: 198283 - RNA, 23 nt, Human
ugacaggcuuugcuccuucugcc

SEQ ID NO: 198284 - RNA, 22 nt, Human
aaaauuauucauggcuuuugga

SEQ ID NO: 198285 - RNA, 22 nt, Human
auguuaaaaaccaguacaguug

SEQ ID NO: 198286 - RNA, 22 nt, Human
cuauaaaucuacccagcauugg

SEQ ID NO: 198287 - RNA, 22 nt, Human
gacaugcuaauuacugguucaa

SEQ ID NO: 198288 - RNA, 22 nt, Human
ucuggcuguuguuagguuccug

SEQ ID NO: 198289 - RNA, 23 nt, Human
agcaaugcugggagacucuguaa

SEQ ID NO: 198290 - RNA, 22 nt, Human
gaggggcaagaaguuggccucu

SEQ ID NO: 198291 - RNA, 22 nt, Human
aggaagcuuguguguauugguc

SEQ ID NO: 198292 - RNA, 22 nt, Human
ucucaacuaauggugcaagaug

SEQ ID NO: 198293 - RNA, 22 nt, Human
ugcuucugggcaaaugugugug

SEQ ID NO: 198294 - RNA, 22 nt, Human
aauucuuaaucccauaaaguga

SEQ ID NO: 198295 - RNA, 22 nt, Human
ucaggcuguggcuucaguucuu

SEQ ID NO: 198296 - RNA, 22 nt, Human
aacauggcucaugagagauuug

SEQ ID NO: 198297 - RNA, 22 nt, Human
ggaggagacggagugauuagug

SEQ ID NO: 198298 - RNA, 22 nt, Human
ugguuagacacaugcaugucau

SEQ ID NO: 198299 - RNA, 22 nt, Human
gaaucuaaaaacgggcuugguu

SEQ ID NO: 198300 - RNA, 22 nt, Human
ugccagggccauagggagucua

SEQ ID NO: 198301 - RNA, 21 nt, Human
ggcugggucaugcagcuggcc

SEQ ID NO: 198302 - RNA, 22 nt, Human
gacccuggaguuaguccugugu

SEQ ID NO: 198303 - RNA, 22 nt, Human
ugagcagagaugacugggcauu

SEQ ID NO: 198304 - RNA, 22 nt, Human
uucugagagcugaagaaauguu

SEQ ID NO: 198305 - RNA, 23 nt, Human
caguuggagguacagagacacug

SEQ ID NO: 198306 - RNA, 21 nt, Human
aaucugcuucccugugacuug

SEQ ID NO: 198307 - RNA, 22 nt, Human
gagggaugguaguugacacuga

SEQ ID NO: 198308 - RNA, 22 nt, Human
auuauucaaauucccacuauac

SEQ ID NO: 198309 - RNA, 22 nt, Human
aagugugacacuguguuaauua

SEQ ID NO: 198310 - RNA, 22 nt, Human
caagagcucaccggagagcauu

SEQ ID NO: 198311 - RNA, 22 nt, Human
uuuguucacugauguaucccaa

SEQ ID NO: 198312 - RNA, 22 nt, Human
ccauggccucgcucuacguggg

SEQ ID NO: 198313 - RNA, 22 nt, Human
ucuuugaaagcuguucuagagu

SEQ ID NO: 198314 - RNA, 22 nt, Human
gagaggcugcauaugcacacug

SEQ ID NO: 198315 - RNA, 22 nt, Human
cuggcucugggcuaagcuccca

SEQ ID NO: 198316 - RNA, 22 nt, Human
agcuuuaucagaggagucucua

SEQ ID NO: 198317 - RNA, 23 nt, Human
acaagcagcccagugcucugccu

SEQ ID NO: 198318 - RNA, 22 nt, Human
aaucacaaaugcaaguugucac

SEQ ID NO: 198319 - RNA, 22 nt, Human
agcaugaaaacaugaaacagca

SEQ ID NO: 198320 - RNA, 22 nt, Human
acacaugugauucuaagacagc

SEQ ID NO: 198321 - RNA, 22 nt, Human
uggaggcaucagagugcuuggc

SEQ ID NO: 198322 - RNA, 22 nt, Human
cucacagcaaggagguaaggua

SEQ ID NO: 198323 - RNA, 22 nt, Human
gucaccucgcugucuuccugag

SEQ ID NO: 198324 - RNA, 22 nt, Human
ugcagagaaaccaguggaggac

SEQ ID NO: 198325 - RNA, 22 nt, Human
auccugggaaugggagggucau

SEQ ID NO: 198326 - RNA, 22 nt, Human
uggcucagccauucguguugcc

SEQ ID NO: 198327 - RNA, 22 nt, Human
aacagaauuguacaccagggag

SEQ ID NO: 198328 - RNA, 22 nt, Human
auaguuuuauagauauugugua

SEQ ID NO: 198329 - RNA, 22 nt, Human
ucuuagucacagaggugagaaa

SEQ ID NO: 198330 - RNA, 22 nt, Human
agagggaucacccuguuucugg

SEQ ID NO: 198331 - RNA, 22 nt, Human
gagggugggcuccuaucugggu

SEQ ID NO: 198332 - RNA, 17 nt, Human
auggaggcagacagguc

SEQ ID NO: 198333 - RNA, 22 nt, Human
augcuacuauccuucugcuuaa

SEQ ID NO: 198334 - RNA, 22 nt, Human
guguccuuauaagaagagaugc

SEQ ID NO: 198335 - RNA, 22 nt, Human
gggcacagagggucuugaagaa

SEQ ID NO: 198336 - RNA, 22 nt, Human
cagcuugggggcgcuggccuca

SEQ ID NO: 198337 - RNA, 22 nt, Human
gauguacacucagaaaagucau

SEQ ID NO: 198338 - RNA, 22 nt, Human
aaaaguguucaggaagaauaau

SEQ ID NO: 198339 - RNA, 22 nt, Human
acagguguguucccggaaagcc

SEQ ID NO: 198340 - RNA, 21 nt, Human
ugucagcaacaauacuuucuc

SEQ ID NO: 198341 - RNA, 21 nt, Human
uccuuauauuugaauacuuua

SEQ ID NO: 198342 - RNA, 20 nt, Human
agcccaucucccacagcuac

SEQ ID NO: 198343 - RNA, 22 nt, Human
gggcuggaccgcucgccucccu

SEQ ID NO: 198344 - RNA, 22 nt, Human
acacaugcuccagucuccagga

SEQ ID NO: 198345 - RNA, 21 nt, Human
uucaaugaaaacaaagugagg

SEQ ID NO: 198346 - RNA, 22 nt, Human
gaagacaagcugaguguugucc

SEQ ID NO: 198347 - RNA, 22 nt, Human
ucugugcugucucagauaagca

SEQ ID NO: 198348 - RNA, 22 nt, Human
gugggaguggagcucagcaugu

SEQ ID NO: 198349 - RNA, 22 nt, Human
cugccccuggcuggugaagcag

SEQ ID NO: 198350 - RNA, 22 nt, Human
gggcagugguuacacagcugag

SEQ ID NO: 198351 - RNA, 22 nt, Human
cugaauuaagcauuacauacau

SEQ ID NO: 198352 - RNA, 22 nt, Human
ucaucucuccccagugucuuua

SEQ ID NO: 198353 - RNA, 22 nt, Human
acaaaugucuccucuuuuguua

SEQ ID NO: 198354 - RNA, 22 nt, Human
acaguuuaggaugagagaacac

SEQ ID NO: 198355 - RNA, 22 nt, Human
ccaaaauauuagugcuuaagua

SEQ ID NO: 198356 - RNA, 22 nt, Human
uacugucuuuagggguagaaau

SEQ ID NO: 198357 - RNA, 22 nt, Human
ugggcagggaucucuuuugcaa

SEQ ID NO: 198358 - RNA, 22 nt, Human
acacaagaaguuaaugggcaaa

SEQ ID NO: 198359 - RNA, 22 nt, Human
gagggucccgagcccugucaga

SEQ ID NO: 198360 - RNA, 22 nt, Human
aacaguaggcaucacauaauga

SEQ ID NO: 198361 - RNA, 22 nt, Human
cgcaggcaagagaguacaguua

SEQ ID NO: 198362 - RNA, 22 nt, Human
aggcuguggugaugauuggguc

SEQ ID NO: 198363 - RNA, 22 nt, Human
gaggcucaccuagggagcacug

SEQ ID NO: 198364 - RNA, 22 nt, Human
gacucuuucccugugacagagu

SEQ ID NO: 198365 - RNA, 22 nt, Human
cauggccaaggaugcucaacca

SEQ ID NO: 198366 - RNA, 22 nt, Human
gcaggcugaguauuacccuagu

SEQ ID NO: 198367 - RNA, 22 nt, Human
agagggggaaaauagagguguu

SEQ ID NO: 198368 - RNA, 17 nt, Human
gucucugucuugcuuuu

SEQ ID NO: 198369 - RNA, 22 nt, Human
uacagcaaugguucuaagaguc

SEQ ID NO: 198370 - RNA, 22 nt, Human
ugggagcuccuggagggcagga

SEQ ID NO: 198371 - RNA, 22 nt, Human
auuuuguugaugguggaguagc

SEQ ID NO: 198372 - RNA, 22 nt, Human
ucagaguccucacccugaggau

SEQ ID NO: 198373 - RNA, 22 nt, Human
ugcauuuaccuggaggucauuu

SEQ ID NO: 198374 - RNA, 22 nt, Human
cccucugccugcgcccuggugu

SEQ ID NO: 198375 - RNA, 22 nt, Human
ugagggacucccggcccugcca

SEQ ID NO: 198376 - RNA, 19 nt, Human
uucuccaggcugcagaggg

SEQ ID NO: 198377 - RNA, 22 nt, Human
cugugccauccuagggcugcug

SEQ ID NO: 198378 - RNA, 22 nt, Human
gaguggcagaacuggggguccu

SEQ ID NO: 198379 - RNA, 22 nt, Human
agguggagugaaggaaaggcag

SEQ ID NO: 198380 - RNA, 22 nt, Human
cuggcagguccagcuggacuca

SEQ ID NO: 198381 - RNA, 22 nt, Human
ucucugagcuuaagguguuuca

SEQ ID NO: 198382 - RNA, 22 nt, Human
gcagggcucauucuaguacaau

SEQ ID NO: 198383 - RNA, 22 nt, Human
aaagccuugggauuugugauca

SEQ ID NO: 198384 - RNA, 22 nt, Human
agcacagaaugagguggaagug

SEQ ID NO: 198385 - RNA, 19 nt, Human
aguagcagaaagugcagug

SEQ ID NO: 198386 - RNA, 22 nt, Human
gcuguggcuguacagagaccau

SEQ ID NO: 198387 - RNA, 21 nt, Human
agagaagggauuccaggcccu

SEQ ID NO: 198388 - RNA, 22 nt, Human
cuucacaguauaggucccugag

SEQ ID NO: 198389 - RNA, 22 nt, Human
auguauuucuauguagugaaga

SEQ ID NO: 198390 - RNA, 22 nt, Human
aagaagguguggaaagaugcuc

SEQ ID NO: 198391 - RNA, 22 nt, Human
gcuggcuuuaucgucagacucc

SEQ ID NO: 198392 - RNA, 22 nt, Human
cuucucugcccauaggaaaugc

SEQ ID NO: 198393 - RNA, 20 nt, Human
ccuguucacugcgcaguuuc

SEQ ID NO: 198394 - RNA, 22 nt, Human
gauguccagcgucuggcugccu

SEQ ID NO: 198395 - RNA, 22 nt, Human
agcuguggggaggaggcuagca

SEQ ID NO: 198396 - RNA, 22 nt, Human
gaccuccagcggcccugcagag

SEQ ID NO: 198397 - RNA, 22 nt, Human
agagacaggaauggcauuaaga

SEQ ID NO: 198398 - RNA, 20 nt, Human
gcaaauggaucccacaagcc

SEQ ID NO: 198399 - RNA, 22 nt, Human
uugcccugcggguccugcgcaa

SEQ ID NO: 198400 - RNA, 22 nt, Human
ugugcuuuucucugcuccugga

SEQ ID NO: 198401 - RNA, 18 nt, Human
cuccagagcugugagaca

SEQ ID NO: 198402 - RNA, 22 nt, Human
uggagcagagaugguggccuuc

SEQ ID NO: 198403 - RNA, 22 nt, Human
guaagcacaugugugugcaugg

SEQ ID NO: 198404 - RNA, 22 nt, Human
gcucugagaucauucacuguaa

SEQ ID NO: 198405 - RNA, 22 nt, Human
uccaggucagacuucugugccc

SEQ ID NO: 198406 - RNA, 22 nt, Human
ucauucccccauaaugguauuu

SEQ ID NO: 198407 - RNA, 22 nt, Human
gucccauaaguagugcaacuug

SEQ ID NO: 198408 - RNA, 22 nt, Human
caguagcuugcuuaggcuuuua

SEQ ID NO: 198409 - RNA, 22 nt, Human
aggcaauccccugaggauacuu

SEQ ID NO: 198410 - RNA, 19 nt, Human
ucucccggcacuccugccc

SEQ ID NO: 198411 - RNA, 22 nt, Human
ggcugcugaguuggccaggaga

SEQ ID NO: 198412 - RNA, 22 nt, Human
uuuccucugucaugacagcuga

SEQ ID NO: 198413 - RNA, 22 nt, Human
uaguuuaauggucaacuaauga

SEQ ID NO: 198414 - RNA, 22 nt, Human
caguggccuugaugccucauuc

SEQ ID NO: 198415 - RNA, 22 nt, Human
caagcuggcucuuaugcaaaaa

SEQ ID NO: 198416 - RNA, 22 nt, Human
cuucaaaagccagaagccugcg

SEQ ID NO: 198417 - RNA, 22 nt, Human
cagcaggugcugccugucaccc

SEQ ID NO: 198418 - RNA, 22 nt, Human
uaauaauuaguuauugaucgug

SEQ ID NO: 198419 - RNA, 22 nt, Human
auuuaugacuggugaauagaac

SEQ ID NO: 198420 - RNA, 20 nt, Human
ucaauguaaucauaucauca

SEQ ID NO: 198421 - RNA, 22 nt, Human
cagcaguuuccuaugguucagc

SEQ ID NO: 198422 - RNA, 22 nt, Human
gcugccugccuugccuggagga

SEQ ID NO: 198423 - RNA, 22 nt, Human
uuuuagaaguucacuuggguuu

SEQ ID NO: 198424 - RNA, 22 nt, Human
gaauucugggagagaucugaca

SEQ ID NO: 198425 - RNA, 20 nt, Human
ucagugauuuugaagaggaa

SEQ ID NO: 198426 - RNA, 22 nt, Human
ucaucugucuguucaacagccu

SEQ ID NO: 198427 - RNA, 22 nt, Human
ucacugugaauguuaucaucuu

SEQ ID NO: 198428 - RNA, 22 nt, Human
aagcaggcaugggaggccaucc

SEQ ID NO: 198429 - RNA, 22 nt, Human
uagcuguggagcagaggucucc

SEQ ID NO: 198430 - RNA, 19 nt, Human
uccagaugauauggauuac

SEQ ID NO: 198431 - RNA, 22 nt, Human
acuuucugcaguguuggaaaug

SEQ ID NO: 198432 - RNA, 22 nt, Human
aggagaaggaagugcaucacua

SEQ ID NO: 198433 - RNA, 21 nt, Human
acacugugucauaaugcuuaa

SEQ ID NO: 198434 - RNA, 22 nt, Human
ccacuggcaguuggcuagccuu

SEQ ID NO: 198435 - RNA, 22 nt, Human
ucccgcaugccgccggugaaca

SEQ ID NO: 198436 - RNA, 22 nt, Human
gcggggggaggaacaucuugca

SEQ ID NO: 198437 - RNA, 22 nt, Human
guggcugcagcucugaacggac

SEQ ID NO: 198438 - RNA, 22 nt, Human
cuguacaaaguagcugcuggga

SEQ ID NO: 198439 - RNA, 22 nt, Human
gcuucucuuguccaagggcagg

SEQ ID NO: 198440 - RNA, 22 nt, Human
aucugagguauaugacuggcua

SEQ ID NO: 198441 - RNA, 22 nt, Human
guucugaguccuccuuugaagg

SEQ ID NO: 198442 - RNA, 22 nt, Human
cucuggaguggguggccgggag

SEQ ID NO: 198443 - RNA, 22 nt, Human
agaagaaaugaggccguucugc

SEQ ID NO: 198444 - RNA, 22 nt, Human
acuguggcaaaagaacauugga

SEQ ID NO: 198445 - RNA, 22 nt, Human
ggaagccaguugcuuggugugg

SEQ ID NO: 198446 - RNA, 22 nt, Human
guuuggauagugagagauacuu

SEQ ID NO: 198447 - RNA, 22 nt, Human
gccaaauuugugagcccccaag

SEQ ID NO: 198448 - RNA, 19 nt, Human
ccugugcacauguguccuu

SEQ ID NO: 198449 - RNA, 22 nt, Human
uugcuguagcucauuucacucu

SEQ ID NO: 198450 - RNA, 22 nt, Human
gccuggagacagcagaggcggc

SEQ ID NO: 198451 - RNA, 21 nt, Human
agcagccauggaugguaugua

SEQ ID NO: 198452 - RNA, 22 nt, Human
agccccaggcccggacgccucu

SEQ ID NO: 198453 - RNA, 22 nt, Human
gggcagguacuggguggugagc

SEQ ID NO: 198454 - RNA, 22 nt, Human
uuuaucuauuguauuguugaug

SEQ ID NO: 198455 - RNA, 22 nt, Human
cagcucagucuugaagcacugg

SEQ ID NO: 198456 - RNA, 22 nt, Human
gcucucagggugauggcauacu

SEQ ID NO: 198457 - RNA, 22 nt, Human
uuuaugauuauuuuaaagcagc

SEQ ID NO: 198458 - RNA, 22 nt, Human
acacagugguguuuacaaaauu

SEQ ID NO: 198459 - RNA, 22 nt, Human
cauuagggccaccauaacaaaa

SEQ ID NO: 198460 - RNA, 22 nt, Human
uaaugucaaggugauagauuug

SEQ ID NO: 198461 - RNA, 16 nt, Human
ggguccagaucugcuc

SEQ ID NO: 198462 - RNA, 22 nt, Human
gccuguuuggaaucuguuuaau

SEQ ID NO: 198463 - RNA, 22 nt, Human
cuggcuggguuccaggauucca

SEQ ID NO: 198464 - RNA, 22 nt, Human
cuguagcaaguuauucaauaaa

SEQ ID NO: 198465 - RNA, 22 nt, Human
uguaaagagaagaaacgugagc

SEQ ID NO: 198466 - RNA, 22 nt, Human
auuucaggguaaaaaguguuca

SEQ ID NO: 198467 - RNA, 22 nt, Human
uaguuacagaucuaggacuguu

SEQ ID NO: 198468 - RNA, 22 nt, Human
aggcaagcccaggcacuuggag

SEQ ID NO: 198469 - RNA, 22 nt, Human
cuggcuguaugcuggccucaga

SEQ ID NO: 198470 - RNA, 22 nt, Human
ugagcugcauuacagccucugu

SEQ ID NO: 198471 - RNA, 22 nt, Human
aaggcauaugcuguguacaguu

SEQ ID NO: 198472 - RNA, 22 nt, Human
aacugcaaagccaaucucagga

SEQ ID NO: 198473 - RNA, 22 nt, Human
acagugcauuauugcugaaugc

SEQ ID NO: 198474 - RNA, 22 nt, Human
auuucucacugagcagauaaaa

SEQ ID NO: 198475 - RNA, 22 nt, Human
cagcuugaaauauuaggagaug

SEQ ID NO: 198476 - RNA, 22 nt, Human
auuuggaaaaucugguuauaga

SEQ ID NO: 198477 - RNA, 23 nt, Human
uccuugggccugcccagaguggu

SEQ ID NO: 198478 - RNA, 22 nt, Human
ucaggagcucuucccuggugug

SEQ ID NO: 198479 - RNA, 22 nt, Human
gccuggcugguagagggggcuc

SEQ ID NO: 198480 - RNA, 22 nt, Human
uuaccuuuuaggcaagcaucuu

SEQ ID NO: 198481 - RNA, 22 nt, Human
ucacacacauggauaguauuuu

SEQ ID NO: 198482 - RNA, 23 nt, Human
agcauggaauaggaaagaggcag

SEQ ID NO: 198483 - RNA, 22 nt, Human
guuuuacaaaugacggcauuca

SEQ ID NO: 198484 - RNA, 22 nt, Human
ugcauauaucuuauuuuucugu

SEQ ID NO: 198485 - RNA, 22 nt, Human
ugauucugagggagcauucugc

SEQ ID NO: 198486 - RNA, 22 nt, Human
cuaguguuuggaagucauagcc

SEQ ID NO: 198487 - RNA, 22 nt, Human
ccagagggaacugggccucauu

SEQ ID NO: 198488 - RNA, 22 nt, Human
ucucagggugaggaaagaauuu

SEQ ID NO: 198489 - RNA, 21 nt, Human
cauuucuaagccuggcuauag

SEQ ID NO: 198490 - RNA, 22 nt, Human
ucugggcuuggauuggcucugc

SEQ ID NO: 198491 - RNA, 22 nt, Human
agagugaaaagcuagagcagua

SEQ ID NO: 198492 - RNA, 22 nt, Human
ggguccaggucuucaggcagag

SEQ ID NO: 198493 - RNA, 22 nt, Human
uaaauucugaucaaguuccuuc

SEQ ID NO: 198494 - RNA, 22 nt, Human
caugaagcuugaagcaguccac

SEQ ID NO: 198495 - RNA, 22 nt, Human
acacaugaggaaggccucaccc

SEQ ID NO: 198496 - RNA, 22 nt, Human
aagcccugggguugcacaaggc

SEQ ID NO: 198497 - RNA, 22 nt, Human
gcugggagccccgagccagcgc

SEQ ID NO: 198498 - RNA, 22 nt, Human
ccucccacauugaggacaugcu

SEQ ID NO: 198499 - RNA, 22 nt, Human
uuccagagaaaagguuuauuuc

SEQ ID NO: 198500 - RNA, 22 nt, Human
gagugaggcuggaaucauggcu

SEQ ID NO: 198501 - RNA, 22 nt, Human
auacucuuuaugacauuccagc

SEQ ID NO: 198502 - RNA, 21 nt, Human
uccagccuuucccucacuucc

SEQ ID NO: 198503 - RNA, 22 nt, Human
cuuccaguaguaucauucucau

SEQ ID NO: 198504 - RNA, 22 nt, Human
gaaagugccucaguccucuuau

SEQ ID NO: 198505 - RNA, 22 nt, Human
cuuagaaauaaugguuucaguu

SEQ ID NO: 198506 - RNA, 22 nt, Human
ggucccagcuggucacugucag

SEQ ID NO: 198507 - RNA, 22 nt, Human
ccuuuagaaagucaguaguugc

SEQ ID NO: 198508 - RNA, 22 nt, Human
cagcaguggaacuacccaggga

SEQ ID NO: 198509 - RNA, 22 nt, Human
gggagccacagugaggugcaug

SEQ ID NO: 198510 - RNA, 22 nt, Human
gcuggcccagggucaccuagga

SEQ ID NO: 198511 - RNA, 22 nt, Human
caagauuugccaguggccaacu

SEQ ID NO: 198512 - RNA, 22 nt, Human
aagacaaagggguccuuggaug

SEQ ID NO: 198513 - RNA, 22 nt, Human
agggucaacauuucauugauuc

SEQ ID NO: 198514 - RNA, 22 nt, Human
cagggcauaagaugaggcugua

SEQ ID NO: 198515 - RNA, 22 nt, Human
aaucaguuguccaaaguucaca

SEQ ID NO: 198516 - RNA, 22 nt, Human
gaggcagcucuucugaaugggg

SEQ ID NO: 198517 - RNA, 22 nt, Human
aagacauuuaugaaaagugcug

SEQ ID NO: 198518 - RNA, 22 nt, Human
cacuagaugauaaucagcugga

SEQ ID NO: 198519 - RNA, 22 nt, Human
ucccucagcuugucuccaugca

SEQ ID NO: 198520 - RNA, 22 nt, Human
cuuacaagcaaaacaacuguag

SEQ ID NO: 198521 - RNA, 22 nt, Human
uucauuuaauuuguguauuaac

SEQ ID NO: 198522 - RNA, 22 nt, Human
ccagugcuucuuugcuagcugg

SEQ ID NO: 198523 - RNA, 22 nt, Human
gaagcagcgaaguggaagggac

SEQ ID NO: 198524 - RNA, 22 nt, Human
aggaagcccaagucucaucuuc

SEQ ID NO: 198525 - RNA, 22 nt, Human
caggacaucgucaucaugggga

SEQ ID NO: 198526 - RNA, 22 nt, Human
gcuugggaaacguaguuccuag

SEQ ID NO: 198527 - RNA, 22 nt, Human
gccuggcuuuugccucauguuc

SEQ ID NO: 198528 - RNA, 17 nt, Human
ugauaguucauuuuaag

SEQ ID NO: 198529 - RNA, 22 nt, Human
auuucuaaagagggugguuugg

SEQ ID NO: 198530 - RNA, 22 nt, Human
acuagaaauuacucagaauaaa

SEQ ID NO: 198531 - RNA, 19 nt, Human
ggaaggagagaaaugcaug

SEQ ID NO: 198532 - RNA, 22 nt, Human
ggugcuggacacguggcacucc

SEQ ID NO: 198533 - RNA, 22 nt, Human
ucagcacugaaauucuucacau

SEQ ID NO: 198534 - RNA, 22 nt, Human
aaucacauuuacauugcuaauu

SEQ ID NO: 198535 - RNA, 22 nt, Human
aacugagacacgaacuaugauu

SEQ ID NO: 198536 - RNA, 22 nt, Human
cugaugaggauauagauacaca

SEQ ID NO: 198537 - RNA, 22 nt, Human
cagagggaguuucugagguugc

SEQ ID NO: 198538 - RNA, 22 nt, Human
uauucacuguaacucagcaaua

SEQ ID NO: 198539 - RNA, 22 nt, Human
accucuuaauauugcaccuucu

SEQ ID NO: 198540 - RNA, 22 nt, Human
cacaugcaucugucauguuugg

SEQ ID NO: 198541 - RNA, 22 nt, Human
gcugagggauagcugcucacug

SEQ ID NO: 198542 - RNA, 22 nt, Human
ugggcucugguuuccuggcugg

SEQ ID NO: 198543 - RNA, 22 nt, Human
ucuuccaggagggugggcaaac

SEQ ID NO: 198544 - RNA, 22 nt, Human
uuugaugaugaugauaaaguuu

SEQ ID NO: 198545 - RNA, 21 nt, Human
aggcccagcuuuccucuugcu

SEQ ID NO: 198546 - RNA, 22 nt, Human
ccuggaaucuggaguuggaauc

SEQ ID NO: 198547 - RNA, 21 nt, Human
cuuuggcaagggagaagucac

SEQ ID NO: 198548 - RNA, 22 nt, Human
cuucccacagaauucaaucagu

SEQ ID NO: 198549 - RNA, 22 nt, Human
cauucauuuacuuucaacagcu

SEQ ID NO: 198550 - RNA, 22 nt, Human
gggagcuguaguccagauaccg

SEQ ID NO: 198551 - RNA, 22 nt, Human
cugguuggugccacaugguggc

SEQ ID NO: 198552 - RNA, 22 nt, Human
aauagacauuauuucucuauga

SEQ ID NO: 198553 - RNA, 22 nt, Human
ugaggcucagagcaccugcucc

SEQ ID NO: 198554 - RNA, 22 nt, Human
gcaguaucuaugugauggguug

SEQ ID NO: 198555 - RNA, 22 nt, Human
auggcagaguccuaagccuuua

SEQ ID NO: 198556 - RNA, 22 nt, Human
uuccugggcugcagagagcacc

SEQ ID NO: 198557 - RNA, 22 nt, Human
gccuggagggcucuagagaggc

SEQ ID NO: 198558 - RNA, 22 nt, Human
ccuggaggcucugggagggcag

SEQ ID NO: 198559 - RNA, 22 nt, Human
gcugggcugagaaguuaagcaa

SEQ ID NO: 198560 - RNA, 22 nt, Human
ucagcacugauguuucagaaga

SEQ ID NO: 198561 - RNA, 23 nt, Human
uccuggugacaugccugagcauc

SEQ ID NO: 198562 - RNA, 22 nt, Human
aaguccugugugcuuacacuug

SEQ ID NO: 198563 - RNA, 22 nt, Human
cagcuauugauaaauguugggg

SEQ ID NO: 198564 - RNA, 22 nt, Human
ucauagaaauggaaaguauauu

SEQ ID NO: 198565 - RNA, 22 nt, Human
ugcuggcugucccuaccuggcu

SEQ ID NO: 198566 - RNA, 22 nt, Human
auguccagagaacauuugcuuu

SEQ ID NO: 198567 - RNA, 22 nt, Human
guguaaagaugccaggaaucuu

SEQ ID NO: 198568 - RNA, 21 nt, Human
aagcaggacauaugaugcccu

SEQ ID NO: 198569 - RNA, 22 nt, Human
ggcacuggaagucccauugucu

SEQ ID NO: 198570 - RNA, 22 nt, Human
cuguggaaauaaacaaugcuaa

SEQ ID NO: 198571 - RNA, 22 nt, Human
uccuggcacaacccuuuaccag

SEQ ID NO: 198572 - RNA, 22 nt, Human
uuuucaaagacuggaggcugau

SEQ ID NO: 198573 - RNA, 22 nt, Human
ucaucuaagagucuuacauuua

SEQ ID NO: 198574 - RNA, 22 nt, Human
caagcagguccugaaucugguc

SEQ ID NO: 198575 - RNA, 22 nt, Human
ucaaaggcugcuugucuucugg

SEQ ID NO: 198576 - RNA, 22 nt, Human
gauugcugugcgccccaggugu

SEQ ID NO: 198577 - RNA, 22 nt, Human
ucugacauuagauuaauuggaa

SEQ ID NO: 198578 - RNA, 22 nt, Human
ucuagacaaugcacuguaagga

SEQ ID NO: 198579 - RNA, 22 nt, Human
gccagccagagaggcaugguua

SEQ ID NO: 198580 - RNA, 22 nt, Human
gagcugcuugcccagaagcaga

SEQ ID NO: 198581 - RNA, 22 nt, Human
ugcaauauguugcauuguaugg

SEQ ID NO: 198582 - RNA, 22 nt, Human
aauaugaauuauuguuacaagu

SEQ ID NO: 198583 - RNA, 22 nt, Human
aaacugcacuuuauuuugucaa

SEQ ID NO: 198584 - RNA, 22 nt, Human
guacaacaugauuuuacucucu

SEQ ID NO: 198585 - RNA, 22 nt, Human
gugcauuccaccgugcagguug

SEQ ID NO: 198586 - RNA, 22 nt, Human
auuucucaguaggugcacagug

SEQ ID NO: 198587 - RNA, 17 nt, Human
gucaacaggauuucuuu

SEQ ID NO: 198588 - RNA, 22 nt, Human
uggucagaacucagcgugcuug

SEQ ID NO: 198589 - RNA, 22 nt, Human
aggcccugcccagagcuccucg

SEQ ID NO: 198590 - RNA, 22 nt, Human
cagguggcaugacugccuacaa

SEQ ID NO: 198591 - RNA, 22 nt, Human
ccauuuacauuguacucuguga

SEQ ID NO: 198592 - RNA, 22 nt, Human
gggcuccagaguccauguucuu

SEQ ID NO: 198593 - RNA, 22 nt, Human
gauuuuuauauaaagugagaaa

SEQ ID NO: 198594 - RNA, 22 nt, Human
gaguucuuaggcaaacaacucu

SEQ ID NO: 198595 - RNA, 22 nt, Human
guucuucaguaaaauuaaaugu

SEQ ID NO: 198596 - RNA, 22 nt, Human
uuucaguuuaugucuugaauua

SEQ ID NO: 198597 - RNA, 22 nt, Human
gucugcagagggaaggcuucag

SEQ ID NO: 198598 - RNA, 22 nt, Human
ugcaggugugugcaagggaggg

SEQ ID NO: 198599 - RNA, 22 nt, Human
ucucugcagcuaagaaauuaau

SEQ ID NO: 198600 - RNA, 22 nt, Human
uagcaggguccaaugugaggca

SEQ ID NO: 198601 - RNA, 22 nt, Human
uuuuguguuguaaugucagcua

SEQ ID NO: 198602 - RNA, 22 nt, Human
cagggcugaaaucaagguguag

SEQ ID NO: 198603 - RNA, 22 nt, Human
uggcccagggucuacagccuca

SEQ ID NO: 198604 - RNA, 22 nt, Human
aggucucaauuccugcuccugu

SEQ ID NO: 198605 - RNA, 22 nt, Human
uugagggaaauaacugaugcuu

SEQ ID NO: 198606 - RNA, 22 nt, Human
ccaggaaggccuggaugccccc

SEQ ID NO: 198607 - RNA, 22 nt, Human
gaauacaugaacccuccugugg

SEQ ID NO: 198608 - RNA, 19 nt, Human
ucuccaguuuauucuucca

SEQ ID NO: 198609 - RNA, 22 nt, Human
agacaccuaauagaugaauuca

SEQ ID NO: 198610 - RNA, 22 nt, Human
cuggguucucugcuuagggccu

SEQ ID NO: 198611 - RNA, 22 nt, Human
acugggccagaucagagcaacu

SEQ ID NO: 198612 - RNA, 22 nt, Human
gaaaggcuacugucaucaauua

SEQ ID NO: 198613 - RNA, 19 nt, Human
gagacauguagauagaaga

SEQ ID NO: 198614 - RNA, 22 nt, Human
cuuaggaaugucccuucccaca

SEQ ID NO: 198615 - RNA, 22 nt, Human
uuauaacaacaguuuacuuuaa

SEQ ID NO: 198616 - RNA, 22 nt, Human
cagaagaauggugucugagcuc

SEQ ID NO: 198617 - RNA, 22 nt, Human
acagguggcagaagcauuuacu

SEQ ID NO: 198618 - RNA, 22 nt, Human
cuggcuggaacgccgaggcggc

SEQ ID NO: 198619 - RNA, 17 nt, Human
gagagucuaaugggaga

SEQ ID NO: 198620 - RNA, 22 nt, Human
uggugcaguagaaggccgacuu

SEQ ID NO: 198621 - RNA, 22 nt, Human
ucagugcuuuugagaagcuccu

SEQ ID NO: 198622 - RNA, 22 nt, Human
aauucugagaacaaaagguacu

SEQ ID NO: 198623 - RNA, 22 nt, Human
aacuguagugcuuauagacucu

SEQ ID NO: 198624 - RNA, 22 nt, Human
ucucuggcuuagguugagugca

SEQ ID NO: 198625 - RNA, 22 nt, Human
ccuuuucugaaccacuuaaaua

SEQ ID NO: 198626 - RNA, 22 nt, Human
cugcgugagcgugcccgucuug

SEQ ID NO: 198627 - RNA, 22 nt, Human
uuugacucaagcccucauguua

SEQ ID NO: 198628 - RNA, 22 nt, Human
ccagguguggggaggacucaca

SEQ ID NO: 198629 - RNA, 22 nt, Human
gugaaaauaaggcugguucuug

SEQ ID NO: 198630 - RNA, 22 nt, Human
uaaggccagccagcaaaucugu

SEQ ID NO: 198631 - RNA, 22 nt, Human
gcgagggcacgcgguugaaggc

SEQ ID NO: 198632 - RNA, 22 nt, Human
uuagaaaugucacagaucugau

SEQ ID NO: 198633 - RNA, 22 nt, Human
aauguacacugaaagccuauca

SEQ ID NO: 198634 - RNA, 22 nt, Human
uaggcuaggcugaagguuuugg

SEQ ID NO: 198635 - RNA, 22 nt, Human
gcagggaccaaaagaggcagua

SEQ ID NO: 198636 - RNA, 22 nt, Human
ggcaggucagguccaugaccaa

SEQ ID NO: 198637 - RNA, 22 nt, Human
ccuccuggagcauuggugagga

SEQ ID NO: 198638 - RNA, 22 nt, Human
ugguuuugcuaaaauagaaaga

SEQ ID NO: 198639 - RNA, 22 nt, Human
aaggccucccugugugcaggug

SEQ ID NO: 198640 - RNA, 22 nt, Human
ucuucaaguuccaaagugcagg

SEQ ID NO: 198641 - RNA, 22 nt, Human
ccuccagucaccuggaugagaa

SEQ ID NO: 198642 - RNA, 22 nt, Human
aggagcuucagagagaaccugg

SEQ ID NO: 198643 - RNA, 22 nt, Human
gcagauggugggggaggaguac

SEQ ID NO: 198644 - RNA, 20 nt, Human
gaauguuucacuugcuccau

SEQ ID NO: 198645 - RNA, 22 nt, Human
guuggcuaugagagcuuuagug

SEQ ID NO: 198646 - RNA, 22 nt, Human
cugucagguuucccaucugcaa

SEQ ID NO: 198647 - RNA, 22 nt, Human
auccagagacuggggcugggau

SEQ ID NO: 198648 - RNA, 22 nt, Human
uuauacaccaucacugccuugg

SEQ ID NO: 198649 - RNA, 22 nt, Human
agaggcaaguucagagcuagga

SEQ ID NO: 198650 - RNA, 20 nt, Human
ccugcuguuuccauggggcc

SEQ ID NO: 198651 - RNA, 22 nt, Human
ucucccaggcuggagugcagug

SEQ ID NO: 198652 - RNA, 22 nt, Human
cagucucuggugaguugacagu

SEQ ID NO: 198653 - RNA, 22 nt, Human
uuucauguuaguugguucuugg

SEQ ID NO: 198654 - RNA, 22 nt, Human
uccugcagugugucuccugcac

SEQ ID NO: 198655 - RNA, 22 nt, Human
uagacauuuucucaacaucucu

SEQ ID NO: 198656 - RNA, 22 nt, Human
agcagcuggggccugugacgau

SEQ ID NO: 198657 - RNA, 22 nt, Human
uugggcucaggaguuugagacc

SEQ ID NO: 198658 - RNA, 22 nt, Human
aguccaggaagcaucauggucu

SEQ ID NO: 198659 - RNA, 22 nt, Human
auuccuucuaaaacgcugcccu

SEQ ID NO: 198660 - RNA, 22 nt, Human
aucuguggcagugaugagucuu

SEQ ID NO: 198661 - RNA, 22 nt, Human
uuucuucucuaaucucaaugau

SEQ ID NO: 198662 - RNA, 22 nt, Human
gugcuggggguuucuguagguc

SEQ ID NO: 198663 - RNA, 20 nt, Human
ugcaaacauuacuugggugu

SEQ ID NO: 198664 - RNA, 22 nt, Human
uuacagugagggugacauuuac

SEQ ID NO: 198665 - RNA, 22 nt, Human
uuaagcauaauuaaagugaaau

SEQ ID NO: 198666 - RNA, 22 nt, Human
aaagacaguggauucaaaaucc

SEQ ID NO: 198667 - RNA, 20 nt, Human
cuuugccuauucucugccug

SEQ ID NO: 198668 - RNA, 22 nt, Human
auuaguguguaggcuggaaaaa

SEQ ID NO: 198669 - RNA, 22 nt, Human
aacuccuuaaugcauuucagag

SEQ ID NO: 198670 - RNA, 22 nt, Human
ggcuccaggagggccuuggcca

SEQ ID NO: 198671 - RNA, 22 nt, Human
auuagaauuaugcuugcuaaug

SEQ ID NO: 198672 - RNA, 22 nt, Human
gagagugagauccuccugggga

SEQ ID NO: 198673 - RNA, 22 nt, Human
cagugcugacagggaggaaccu

SEQ ID NO: 198674 - RNA, 19 nt, Human
uaucuuuaugcaguggugg

SEQ ID NO: 198675 - RNA, 22 nt, Human
uguauucucucaauauuucaua

SEQ ID NO: 198676 - RNA, 22 nt, Human
acuucugauuaaggaugaaugc

SEQ ID NO: 198677 - RNA, 22 nt, Human
aucaaaguucguaacugauaac

SEQ ID NO: 198678 - RNA, 22 nt, Human
acacauuaaaacgucuacaaug

SEQ ID NO: 198679 - RNA, 22 nt, Human
cugcaggguuuuucaaggacaa

SEQ ID NO: 198680 - RNA, 22 nt, Human
cucugagguucccuggguccca

SEQ ID NO: 198681 - RNA, 22 nt, Human
cucccagauuccugcuguggga

SEQ ID NO: 198682 - RNA, 19 nt, Human
uggcauugguccagauaaa

SEQ ID NO: 198683 - RNA, 22 nt, Human
ucuccuggcucuaaaaggcugu

SEQ ID NO: 198684 - RNA, 22 nt, Human
cauuagaaaagcagcugggacc

SEQ ID NO: 198685 - RNA, 22 nt, Human
cuucucuggcuccucagcgccc

SEQ ID NO: 198686 - RNA, 22 nt, Human
gcugggcucguucccacacgcg

SEQ ID NO: 198687 - RNA, 22 nt, Human
uccccaggggcaucucucugcu

SEQ ID NO: 198688 - RNA, 20 nt, Human
agacaaugagugacagaguu

SEQ ID NO: 198689 - RNA, 22 nt, Human
caaaugcagauucaggaguucu

SEQ ID NO: 198690 - RNA, 22 nt, Human
uuauuugcccauguuuagcaga

SEQ ID NO: 198691 - RNA, 22 nt, Human
auuucagauucagaaauguagg

SEQ ID NO: 198692 - RNA, 22 nt, Human
ccugagagagugagcccugaca

SEQ ID NO: 198693 - RNA, 22 nt, Human
acucugugccaggcacuuuggg

SEQ ID NO: 198694 - RNA, 22 nt, Human
auguacaaccugcaugacaguc

SEQ ID NO: 198695 - RNA, 22 nt, Human
uugaaacaguagcucauagacc

SEQ ID NO: 198696 - RNA, 20 nt, Human
ugugucuuccuuucuuuaug

SEQ ID NO: 198697 - RNA, 22 nt, Human
gccaacaggccuugcucugcuc

SEQ ID NO: 198698 - RNA, 22 nt, Human
ggagcuguugauuguuugagga

SEQ ID NO: 198699 - RNA, 22 nt, Human
ugaaugauguauaauauugaga

SEQ ID NO: 198700 - RNA, 22 nt, Human
aacaugaaaagcccagagaggu

SEQ ID NO: 198701 - RNA, 22 nt, Human
guuauauauaguauuucucuga

SEQ ID NO: 198702 - RNA, 19 nt, Human
cacagccacagccaaccuc

SEQ ID NO: 198703 - RNA, 22 nt, Human
accccccagauaaucccuugag

SEQ ID NO: 198704 - RNA, 18 nt, Human
ucagcuuuugaaaaccaa

SEQ ID NO: 198705 - RNA, 22 nt, Human
uucauuuauucagcagguauuu

SEQ ID NO: 198706 - RNA, 22 nt, Human
ggaaggcucuguuccuugacuu

SEQ ID NO: 198707 - RNA, 21 nt, Human
uugcauuccuguuaguauaag

SEQ ID NO: 198708 - RNA, 22 nt, Human
agcuggcuggccccuuccugcc

SEQ ID NO: 198709 - RNA, 22 nt, Human
uacaagcucgggcagcucauua

SEQ ID NO: 198710 - RNA, 22 nt, Human
caaauguuaaauguguuaagac

SEQ ID NO: 198711 - RNA, 22 nt, Human
acccuuucuuacucacacgcuc

SEQ ID NO: 198712 - RNA, 22 nt, Human
ccagccuggagggcaguggugg

SEQ ID NO: 198713 - RNA, 22 nt, Human
uuacuucuuacaaaagaaauau

SEQ ID NO: 198714 - RNA, 22 nt, Human
gcuguccaggagugcagagauu

SEQ ID NO: 198715 - RNA, 22 nt, Human
aaggccagcuggagggaugagg

SEQ ID NO: 198716 - RNA, 22 nt, Human
augagcaauuaggaagaaaaca

SEQ ID NO: 198717 - RNA, 22 nt, Human
ccaaggcaaugugcagcuggug

SEQ ID NO: 198718 - RNA, 22 nt, Human
acucuguagaucucccgggagc

SEQ ID NO: 198719 - RNA, 22 nt, Human
cggagccugcuuguugcagcug

SEQ ID NO: 198720 - RNA, 22 nt, Human
uagaaagacagagguuuugucu

SEQ ID NO: 198721 - RNA, 22 nt, Human
agugaguggagagcucuagguu

SEQ ID NO: 198722 - RNA, 20 nt, Human
ugggguccuggaggggaucc

SEQ ID NO: 198723 - RNA, 22 nt, Human
ugaggcaaaguucaagcugaaa

SEQ ID NO: 198724 - RNA, 22 nt, Human
uccuggccaaguagauguggcg

SEQ ID NO: 198725 - RNA, 22 nt, Human
caggaagcacagugaggagacc

SEQ ID NO: 198726 - RNA, 22 nt, Human
aggcaacaugggccaggcagaa

SEQ ID NO: 198727 - RNA, 22 nt, Human
uguaucugacaguggagcggag

SEQ ID NO: 198728 - RNA, 22 nt, Human
cuagaacagucaaagugagcuc

SEQ ID NO: 198729 - RNA, 22 nt, Human
gagggcugccacguugggcgag

SEQ ID NO: 198730 - RNA, 22 nt, Human
uugcaaauauuguuuaccuuuc

SEQ ID NO: 198731 - RNA, 23 nt, Human
aaacuacaacgccaggcacugag

SEQ ID NO: 198732 - RNA, 23 nt, Human
uggccacaguccaugcaugccca

SEQ ID NO: 198733 - RNA, 22 nt, Human
gcuugaaaauucauagguauuu

SEQ ID NO: 198734 - RNA, 22 nt, Human
gagaugggcgagaagguggacu

SEQ ID NO: 198735 - RNA, 22 nt, Human
auguuuguugaaugaagaaagg

SEQ ID NO: 198736 - RNA, 22 nt, Human
agaaaugucaggaaagaagucc

SEQ ID NO: 198737 - RNA, 22 nt, Human
cagaguuuugugaacaacuugg

SEQ ID NO: 198738 - RNA, 22 nt, Human
cagacagcaggccuggaugugu

SEQ ID NO: 198739 - RNA, 22 nt, Human
gcagccacccucaaggcugaau

SEQ ID NO: 198740 - RNA, 22 nt, Human
ugacauguauguauuuguuuau

SEQ ID NO: 198741 - RNA, 23 nt, Human
ucaggugugcggacugcugaguc

SEQ ID NO: 198742 - RNA, 22 nt, Human
ccucaggcaggaaacugucccg

SEQ ID NO: 198743 - RNA, 22 nt, Human
gacauaaaugaaguuugacuau

SEQ ID NO: 198744 - RNA, 22 nt, Human
gaggaggcacuaguuagugaca

SEQ ID NO: 198745 - RNA, 18 nt, Human
ccucagggagagagacgc

SEQ ID NO: 198746 - RNA, 18 nt, Human
cgcccugcuauaaaugac

SEQ ID NO: 198747 - RNA, 22 nt, Human
aagcugauucuaaaauuuauua

SEQ ID NO: 198748 - RNA, 22 nt, Human
uggcugugaacaaagagaauaa

SEQ ID NO: 198749 - RNA, 22 nt, Human
cucccagccuucgccagucuga

SEQ ID NO: 198750 - RNA, 22 nt, Human
cccugugcagauggcagcuggg

SEQ ID NO: 198751 - RNA, 22 nt, Human
agugcacaccuuaguacaaagu

SEQ ID NO: 198752 - RNA, 22 nt, Human
cagagucuggacugcaggcucc

SEQ ID NO: 198753 - RNA, 22 nt, Human
ccucaggcugcucacacuuguc

SEQ ID NO: 198754 - RNA, 22 nt, Human
uaaacaagaaacauuuucuguu

SEQ ID NO: 198755 - RNA, 22 nt, Human
agagggugaaugagauagaaaa

SEQ ID NO: 198756 - RNA, 22 nt, Human
agcugaggcaugaugcuaucag

SEQ ID NO: 198757 - RNA, 22 nt, Human
aguguacaaaaugauagauaaa

SEQ ID NO: 198758 - RNA, 22 nt, Human
ccaggcuuccuaaugugugcag

SEQ ID NO: 198759 - RNA, 22 nt, Human
auauauaagcugaugagccaca

SEQ ID NO: 198760 - RNA, 22 nt, Human
uggcucagaagaaaagguaaac

SEQ ID NO: 198761 - RNA, 20 nt, Human
cccucccagaugcuucccaa

SEQ ID NO: 198762 - RNA, 22 nt, Human
uguuaugaacuucuagaaaaca

SEQ ID NO: 198763 - RNA, 22 nt, Human
gagagaaaagggggaauugauu

SEQ ID NO: 198764 - RNA, 22 nt, Human
gagcacguugaagcgcacuguc

SEQ ID NO: 198765 - RNA, 23 nt, Human
acagaggcuuaaaugaguggcag

SEQ ID NO: 198766 - RNA, 22 nt, Human
ggcagggcuugucucugugaug

SEQ ID NO: 198767 - RNA, 22 nt, Human
accaggcagcacuuuccuugca

SEQ ID NO: 198768 - RNA, 22 nt, Human
aggaggaauugacacagaagcc

SEQ ID NO: 198769 - RNA, 22 nt, Human
aagagcuggaguuugcagcccu

SEQ ID NO: 198770 - RNA, 22 nt, Human
aguuuuauguagacaauucauu

SEQ ID NO: 198771 - RNA, 22 nt, Human
gggcauggccaggugagggguc

SEQ ID NO: 198772 - RNA, 22 nt, Human
uguccauggagaagcucagggc

SEQ ID NO: 198773 - RNA, 22 nt, Human
gggcugcugcugccagcgacac

SEQ ID NO: 198774 - RNA, 22 nt, Human
aggcuccuagccuguggcuggu

SEQ ID NO: 198775 - RNA, 22 nt, Human
ugucucuccacacagccagugc

SEQ ID NO: 198776 - RNA, 22 nt, Human
aaguuccugggccaaguccagg

SEQ ID NO: 198777 - RNA, 22 nt, Human
ucuucuuuuauuucaagggugu

SEQ ID NO: 198778 - RNA, 22 nt, Human
ucacagaaagcuguguccugac

SEQ ID NO: 198779 - RNA, 22 nt, Human
cagcaccuguuagcauuaaaua

SEQ ID NO: 198780 - RNA, 22 nt, Human
ugggaaggcguggaaguagaag

SEQ ID NO: 198781 - RNA, 22 nt, Human
agucuuuuauucaaggcuaagu

SEQ ID NO: 198782 - RNA, 20 nt, Human
uggcggggaugagggaguua

SEQ ID NO: 198783 - RNA, 22 nt, Human
gauucuuacuucuaagcaagcu

SEQ ID NO: 198784 - RNA, 22 nt, Human
uuccucagcucagcgagagaga

SEQ ID NO: 198785 - RNA, 22 nt, Human
cacauuuacauauaaaacuuuc

SEQ ID NO: 198786 - RNA, 22 nt, Human
aggaagaggugugcaauggugu

SEQ ID NO: 198787 - RNA, 22 nt, Human
gcucagagauaaaacugaucag

SEQ ID NO: 198788 - RNA, 22 nt, Human
cucugcagauucaucccuucac

SEQ ID NO: 198789 - RNA, 20 nt, Human
gacaggagaguuagguaggu

SEQ ID NO: 198790 - RNA, 22 nt, Human
ggagaaggaagaaagcuacuau

SEQ ID NO: 198791 - RNA, 22 nt, Human
ucucaucauuccuucaaagccc

SEQ ID NO: 198792 - RNA, 22 nt, Human
agauggcugggccccaccccag

SEQ ID NO: 198793 - RNA, 22 nt, Human
aaagggaggggcgauaagccgg

SEQ ID NO: 198794 - RNA, 22 nt, Human
augguuuaagggagaauauuga

SEQ ID NO: 198795 - RNA, 22 nt, Human
uggucacacauguaucucaaug

SEQ ID NO: 198796 - RNA, 22 nt, Human
ugaccuuucuuugagauuccug

SEQ ID NO: 198797 - RNA, 22 nt, Human
cagagaaaaaauccugcucuca

SEQ ID NO: 198798 - RNA, 22 nt, Human
gugggcagcaccagggaagugu

SEQ ID NO: 198799 - RNA, 20 nt, Human
cccaggagugagcagcuuua

SEQ ID NO: 198800 - RNA, 22 nt, Human
ggagaugacacaauuuauuuau

SEQ ID NO: 198801 - RNA, 22 nt, Human
aagccaagguuuuggucacagc

SEQ ID NO: 198802 - RNA, 22 nt, Human
aggcucugugauccacaaugag

SEQ ID NO: 198803 - RNA, 22 nt, Human
gagcaugguuccauagguuggu

SEQ ID NO: 198804 - RNA, 22 nt, Human
ggcucaguguuuguggaacaua

SEQ ID NO: 198805 - RNA, 22 nt, Human
ucaggcccagagucacggaucc

SEQ ID NO: 198806 - RNA, 22 nt, Human
caucugcugcugaagccagcau

SEQ ID NO: 198807 - RNA, 18 nt, Human
ugagagaauguucaugcu

SEQ ID NO: 198808 - RNA, 19 nt, Human
cuuggcuuagcuucuuagc

SEQ ID NO: 198809 - RNA, 22 nt, Human
ccugcaccuucaagaaaauaau

SEQ ID NO: 198810 - RNA, 22 nt, Human
ccugcucagagcgucuugugug

SEQ ID NO: 198811 - RNA, 22 nt, Human
agagacagaucugagggaccuc

SEQ ID NO: 198812 - RNA, 22 nt, Human
aacugguauggugagaagagag

SEQ ID NO: 198813 - RNA, 22 nt, Human
auauuagggucucuaaauucua

SEQ ID NO: 198814 - RNA, 22 nt, Human
uuuccucacacagaagaucuug

SEQ ID NO: 198815 - RNA, 22 nt, Human
uccagcuuauagguagauuuaa

SEQ ID NO: 198816 - RNA, 22 nt, Human
aaacuuucauguaucucuuuca

SEQ ID NO: 198817 - RNA, 22 nt, Human
gcucagagaaguuaaggaauuu

SEQ ID NO: 198818 - RNA, 22 nt, Human
uuacaaguucagauuuucucau

SEQ ID NO: 198819 - RNA, 22 nt, Human
ucagcaggucugaggcggggcc

SEQ ID NO: 198820 - RNA, 22 nt, Human
uccuccucuaucagacagugcc

SEQ ID NO: 198821 - RNA, 17 nt, Human
uguauuuaucaugucag

SEQ ID NO: 198822 - RNA, 22 nt, Human
cugccuuuggggaguuagaggg

SEQ ID NO: 198823 - RNA, 22 nt, Human
agcuucucccuuuccuauuggu

SEQ ID NO: 198824 - RNA, 22 nt, Human
agagucuuagccucauuaguca

SEQ ID NO: 198825 - RNA, 22 nt, Human
gaggcagcuuggggcugugggu

SEQ ID NO: 198826 - RNA, 21 nt, Human
uggagcugccacuugagcugc

SEQ ID NO: 198827 - RNA, 22 nt, Human
ugcaggugcuccgggggugccc

SEQ ID NO: 198828 - RNA, 22 nt, Human
uccccucucugcgcucccaggu

SEQ ID NO: 198829 - RNA, 22 nt, Human
aagcauuucuguuuaucuaucg

SEQ ID NO: 198830 - RNA, 22 nt, Human
cccagugugccccuccugcagc

SEQ ID NO: 198831 - RNA, 22 nt, Human
cugcuucugggaugauggagua

SEQ ID NO: 198832 - RNA, 22 nt, Human
aggaaggggagaaguuaaagcu

SEQ ID NO: 198833 - RNA, 22 nt, Human
agucacuucuauucuauuaagu

SEQ ID NO: 198834 - RNA, 22 nt, Human
cuaaacuucauauguugcuuua

SEQ ID NO: 198835 - RNA, 22 nt, Human
gaggaacccagcugggguugcc

SEQ ID NO: 198836 - RNA, 22 nt, Human
aucccaugagaccacguuggcu

SEQ ID NO: 198837 - RNA, 22 nt, Human
guaauaaugguccccaaacacu

SEQ ID NO: 198838 - RNA, 21 nt, Human
augcacaaaaagacucuuucu

SEQ ID NO: 198839 - RNA, 22 nt, Human
gacaugugucugcaaguugauc

SEQ ID NO: 198840 - RNA, 22 nt, Human
auuauucauggucuuccacaau

SEQ ID NO: 198841 - RNA, 22 nt, Human
ccugagagccagugccugccca

SEQ ID NO: 198842 - RNA, 22 nt, Human
accacccucagcagagcugaaa

SEQ ID NO: 198843 - RNA, 20 nt, Human
acaguuuauuuuacuugguu

SEQ ID NO: 198844 - RNA, 22 nt, Human
uugaaacauucuccuauugauu

SEQ ID NO: 198845 - RNA, 22 nt, Human
aagggcacagggaaagagugca

SEQ ID NO: 198846 - RNA, 22 nt, Human
gccugugacccagggcccagga

SEQ ID NO: 198847 - RNA, 23 nt, Human
ucauucaaggcugguaucuuuca

SEQ ID NO: 198848 - RNA, 22 nt, Human
uuggccagugcuugugauuuuc

SEQ ID NO: 198849 - RNA, 22 nt, Human
ggcuuucucacagcauggcagc

SEQ ID NO: 198850 - RNA, 22 nt, Human
ucuucaauuagauuuaccaauu

SEQ ID NO: 198851 - RNA, 23 nt, Human
ggaaagagaggaguugugcauag

SEQ ID NO: 198852 - RNA, 22 nt, Human
aaguuacaguuauuauuuaaaa

SEQ ID NO: 198853 - RNA, 22 nt, Human
uuguguuaaggugcaucuagug

SEQ ID NO: 198854 - RNA, 22 nt, Human
gcuggcugggucccugagaggc

SEQ ID NO: 198855 - RNA, 22 nt, Human
cuguauuugaaagaaaagauuu

SEQ ID NO: 198856 - RNA, 22 nt, Human
uagaggcacagucuauguagag

SEQ ID NO: 198857 - RNA, 22 nt, Human
cuccagccagagugccucuguu

SEQ ID NO: 198858 - RNA, 21 nt, Human
gcugagacgcaaccucaguga

SEQ ID NO: 198859 - RNA, 22 nt, Human
cugugugcugaaaugcagugag

SEQ ID NO: 198860 - RNA, 22 nt, Human
ggcuggcuggcuuagcagagga

SEQ ID NO: 198861 - RNA, 20 nt, Human
cugcagggugagugggcgau

SEQ ID NO: 198862 - RNA, 22 nt, Human
ggaugucuuuacuuugggauuu

SEQ ID NO: 198863 - RNA, 22 nt, Human
acugggccaggggcuuuggagc

SEQ ID NO: 198864 - RNA, 22 nt, Human
gggaccugaggcccugcuccac

SEQ ID NO: 198865 - RNA, 22 nt, Human
ccugggcugaagucaagugugg

SEQ ID NO: 198866 - RNA, 17 nt, Human
cucccccccacgugucc

SEQ ID NO: 198867 - RNA, 22 nt, Human
agggcagagagaugaaugggau

SEQ ID NO: 198868 - RNA, 22 nt, Human
cagggcuguuagcugcugcucu

SEQ ID NO: 198869 - RNA, 22 nt, Human
cugggucucaggaguucugagg

SEQ ID NO: 198870 - RNA, 20 nt, Human
cuaagcacuuugauaaacug

SEQ ID NO: 198871 - RNA, 22 nt, Human
cucccaggcagggcugcccacu

SEQ ID NO: 198872 - RNA, 22 nt, Human
cagcagcugggaaggaggcuga

SEQ ID NO: 198873 - RNA, 22 nt, Human
ccuuuggagcaacugagagcua

SEQ ID NO: 198874 - RNA, 22 nt, Human
uuccaaagaaguucacauuuac

SEQ ID NO: 198875 - RNA, 22 nt, Human
ucugggagguguuuugagaacu

SEQ ID NO: 198876 - RNA, 22 nt, Human
agagucuuaucuuuuacaagua

SEQ ID NO: 198877 - RNA, 16 nt, Human
uaugugucucaucuac

SEQ ID NO: 198878 - RNA, 22 nt, Human
ccaggcucugagaggaauguga

SEQ ID NO: 198879 - RNA, 22 nt, Human
ccuuugguaauucuguguagag

SEQ ID NO: 198880 - RNA, 22 nt, Human
gcugccucccagagcccugcag

SEQ ID NO: 198881 - RNA, 22 nt, Human
auuucaaggacuacuuuucaau

SEQ ID NO: 198882 - RNA, 22 nt, Human
gugcaaaaggcauugugguuuu

SEQ ID NO: 198883 - RNA, 17 nt, Human
uuccugugguuugaucu

SEQ ID NO: 198884 - RNA, 22 nt, Human
aacuguuuggaacucuuccaca

SEQ ID NO: 198885 - RNA, 22 nt, Human
gccuggcagccuccaaccuuca

SEQ ID NO: 198886 - RNA, 22 nt, Human
uuucacauaaauauuaugccua

SEQ ID NO: 198887 - RNA, 22 nt, Human
uagcaccaugauggaagagcug

SEQ ID NO: 198888 - RNA, 22 nt, Human
uaauuacagguccaaaacaauc

SEQ ID NO: 198889 - RNA, 22 nt, Human
ggcucuggggccuccucccuug

SEQ ID NO: 198890 - RNA, 22 nt, Human
cagcuaggaaaccagagggcag

SEQ ID NO: 198891 - RNA, 22 nt, Human
ucagccaguauuugagugcuca

SEQ ID NO: 198892 - RNA, 22 nt, Human
ugccugccucuggcagcccugc

SEQ ID NO: 198893 - RNA, 22 nt, Human
uaaaugugaccuucauuuuaua

SEQ ID NO: 198894 - RNA, 22 nt, Human
guacaaguucuacucuauaaau

SEQ ID NO: 198895 - RNA, 22 nt, Human
uguugcugacaagagaggagca

SEQ ID NO: 198896 - RNA, 22 nt, Human
aggacacacuucugaggucuuu

SEQ ID NO: 198897 - RNA, 23 nt, Human
ccauaaucaggguuguggggucc

SEQ ID NO: 198898 - RNA, 22 nt, Human
ggccagggggcuucagacucca

SEQ ID NO: 198899 - RNA, 22 nt, Human
ucugggaaaugcuguuccuugu

SEQ ID NO: 198900 - RNA, 22 nt, Human
ugucaccucuuuggcugcagcu

SEQ ID NO: 198901 - RNA, 21 nt, Human
ucugccugagacuuugcuggu

SEQ ID NO: 198902 - RNA, 22 nt, Human
caaguccucgcuucuagcugug

SEQ ID NO: 198903 - RNA, 22 nt, Human
uuucucucuggcccugauuguc

SEQ ID NO: 198904 - RNA, 22 nt, Human
agaacaaggcuguuuccaaugc

SEQ ID NO: 198905 - RNA, 22 nt, Human
ugaggucaagcccagagcagca

SEQ ID NO: 198906 - RNA, 22 nt, Human
uugagaaaauaguucgaauguu

SEQ ID NO: 198907 - RNA, 22 nt, Human
cagucuuugacaagcccuuuca

SEQ ID NO: 198908 - RNA, 22 nt, Human
uagggauggaaacuaggaaucu

SEQ ID NO: 198909 - RNA, 22 nt, Human
agcagagccaggucucucugua

SEQ ID NO: 198910 - RNA, 22 nt, Human
uauccauaguuuauagaucaag

SEQ ID NO: 198911 - RNA, 22 nt, Human
gcucuggcccaaacccuuucua

SEQ ID NO: 198912 - RNA, 22 nt, Human
ucaggcugaaggaggccuaucu

SEQ ID NO: 198913 - RNA, 22 nt, Human
ucugccuucgcugcucccugaa

SEQ ID NO: 198914 - RNA, 22 nt, Human
gauuagaugacuaaugagcugu

SEQ ID NO: 198915 - RNA, 22 nt, Human
acacaacagaagagcaauugca

SEQ ID NO: 198916 - RNA, 22 nt, Human
ucaggcugguccccacagugga

SEQ ID NO: 198917 - RNA, 22 nt, Human
agacacuggugaagaaaucagg

SEQ ID NO: 198918 - RNA, 22 nt, Human
gguguccuacagggccgcaggc

SEQ ID NO: 198919 - RNA, 22 nt, Human
agcacagaguugcagagagcgu

SEQ ID NO: 198920 - RNA, 22 nt, Human
acucacuuuccauucaagcacc

SEQ ID NO: 198921 - RNA, 22 nt, Human
agcaaagcuaucucuauggaga

SEQ ID NO: 198922 - RNA, 22 nt, Human
guauuacauuuaguaauuaggc

SEQ ID NO: 198923 - RNA, 22 nt, Human
acccaggguagaaccucagagc

SEQ ID NO: 198924 - RNA, 22 nt, Human
augcaagaaacagagacgcuga

SEQ ID NO: 198925 - RNA, 20 nt, Human
uuucuuguacuuggagaagg

SEQ ID NO: 198926 - RNA, 22 nt, Human
ccugccugcggcccgcggggag

SEQ ID NO: 198927 - RNA, 23 nt, Human
auguccaguuuacuucaggauga

SEQ ID NO: 198928 - RNA, 22 nt, Human
uggcagagguauauugggagga

SEQ ID NO: 198929 - RNA, 22 nt, Human
ccaggcuuuaagagguggaaac

SEQ ID NO: 198930 - RNA, 22 nt, Human
gagcuuggccucuugaacgugg

SEQ ID NO: 198931 - RNA, 22 nt, Human
caggcucccugcaggccaguga

SEQ ID NO: 198932 - RNA, 22 nt, Human
uauccuguuuugcacaauuaua

SEQ ID NO: 198933 - RNA, 23 nt, Human
ugguccugccaacggugccccuc

SEQ ID NO: 198934 - RNA, 22 nt, Human
gacagcugccucuguguagauc

SEQ ID NO: 198935 - RNA, 22 nt, Human
gcugagguuucaggaguggcag

SEQ ID NO: 198936 - RNA, 17 nt, Human
gagugcagacacaagca

SEQ ID NO: 198937 - RNA, 22 nt, Human
cuguccccgcgaguccagagcu

SEQ ID NO: 198938 - RNA, 20 nt, Human
uuggcucagauuuuuauggg

SEQ ID NO: 198939 - RNA, 22 nt, Human
ggaaauacaaagauacaccacu

SEQ ID NO: 198940 - RNA, 22 nt, Human
uccaggcuagguuuacaggaca

SEQ ID NO: 198941 - RNA, 22 nt, Human
aaauuucuaagucaagaagaac

SEQ ID NO: 198942 - RNA, 22 nt, Human
cacagcugcccuaacuguacuc

SEQ ID NO: 198943 - RNA, 22 nt, Human
agguauaugaagaugaaauaac

SEQ ID NO: 198944 - RNA, 22 nt, Human
cauuuguacagaacagcuuuau

SEQ ID NO: 198945 - RNA, 18 nt, Human
aggagacagccucaccug

SEQ ID NO: 198946 - RNA, 22 nt, Human
gcugcagguugggcaacagagu

SEQ ID NO: 198947 - RNA, 22 nt, Human
cagccagagaaagggcacugcc

SEQ ID NO: 198948 - RNA, 22 nt, Human
gaaggagacccugaagaugcug

SEQ ID NO: 198949 - RNA, 22 nt, Human
uccuguuuaucugugugacucg

SEQ ID NO: 198950 - RNA, 22 nt, Human
cagaggcucagauggcccuggc

SEQ ID NO: 198951 - RNA, 22 nt, Human
uaacacugguuaucccugugca

SEQ ID NO: 198952 - RNA, 22 nt, Human
caaggccaagguuuugugaacu

SEQ ID NO: 198953 - RNA, 22 nt, Human
uagcaagaccaauauguagaua

SEQ ID NO: 198954 - RNA, 22 nt, Human
ugcauucaguuggucagcuuuu

SEQ ID NO: 198955 - RNA, 22 nt, Human
uguacauacauagauauacaca

SEQ ID NO: 198956 - RNA, 22 nt, Human
accaaaggcagagcugaacacu

SEQ ID NO: 198957 - RNA, 22 nt, Human
uauguauccguguguguacaga

SEQ ID NO: 198958 - RNA, 22 nt, Human
ucuugggauagugucucauggc

SEQ ID NO: 198959 - RNA, 22 nt, Human
ugacagagccaagaucaguacu

SEQ ID NO: 198960 - RNA, 22 nt, Human
acagaauaguagcuuaaaguca

SEQ ID NO: 198961 - RNA, 22 nt, Human
uugacaaaaaccucauuucacc

SEQ ID NO: 198962 - RNA, 22 nt, Human
uggggaaaggagagcauuauuu

SEQ ID NO: 198963 - RNA, 22 nt, Human
caggggaaggagccuugaaacu

SEQ ID NO: 198964 - RNA, 22 nt, Human
aggguccauucuuugccuuuuc

SEQ ID NO: 198965 - RNA, 22 nt, Human
guggccauaggaggucagauga

SEQ ID NO: 198966 - RNA, 22 nt, Human
cugcuuuaauuuagacaaggca

SEQ ID NO: 198967 - RNA, 22 nt, Human
auucuuuagccagcagguauau

SEQ ID NO: 198968 - RNA, 22 nt, Human
acauuucagcgugcaugacaug

SEQ ID NO: 198969 - RNA, 22 nt, Human
augaaaacagccuccugugaua

SEQ ID NO: 198970 - RNA, 22 nt, Human
ugaguccaagagccagugggaa

SEQ ID NO: 198971 - RNA, 22 nt, Human
uuauauaacucaggugggcuca

SEQ ID NO: 198972 - RNA, 22 nt, Human
ccacaggcugcugcaggucccg

SEQ ID NO: 198973 - RNA, 22 nt, Human
ugagcuggucuugaguguagcu

SEQ ID NO: 198974 - RNA, 22 nt, Human
auugugaauugagaguacuucu

SEQ ID NO: 198975 - RNA, 22 nt, Human
aaaaugagcauauugauccuuu

SEQ ID NO: 198976 - RNA, 22 nt, Human
ggcugagccuggagcaucuggu

SEQ ID NO: 198977 - RNA, 22 nt, Human
uccaagcauguggucaggagcc

SEQ ID NO: 198978 - RNA, 22 nt, Human
acaaguggguccuacauaaagc

SEQ ID NO: 198979 - RNA, 22 nt, Human
ccugagaagagcuuaugaguga

SEQ ID NO: 198980 - RNA, 22 nt, Human
auguccuuuguaucccuaggca

SEQ ID NO: 198981 - RNA, 22 nt, Human
auguaacauugaauuauauagu

SEQ ID NO: 198982 - RNA, 22 nt, Human
aagagcacuaacagagcugaua

SEQ ID NO: 198983 - RNA, 22 nt, Human
ucccagagcccaaguuggagag

SEQ ID NO: 198984 - RNA, 22 nt, Human
uagcagggagggccagugucaa

SEQ ID NO: 198985 - RNA, 22 nt, Human
cucaggauauugggcuggagca

SEQ ID NO: 198986 - RNA, 22 nt, Human
acugggccuugugugucucauc

SEQ ID NO: 198987 - RNA, 22 nt, Human
ugcugcaggccuuggcugggaa

SEQ ID NO: 198988 - RNA, 22 nt, Human
aagcucagcaugucuccuagaa

SEQ ID NO: 198989 - RNA, 22 nt, Human
cuggcagcaggucacacgcaga

SEQ ID NO: 198990 - RNA, 22 nt, Human
gagcuguggaaggcagggacca

SEQ ID NO: 198991 - RNA, 22 nt, Human
cagcuucuaaagugugaagcca

SEQ ID NO: 198992 - RNA, 22 nt, Human
acaguaaauaaugcauguugau

SEQ ID NO: 198993 - RNA, 22 nt, Human
aucugccuccaaguccaugugu

SEQ ID NO: 198994 - RNA, 22 nt, Human
uuuaagagcuaguaugucauuu

SEQ ID NO: 198995 - RNA, 21 nt, Human
ugggcgcuugaccucugcacu

SEQ ID NO: 198996 - RNA, 22 nt, Human
augacaagggaggguccugcua

SEQ ID NO: 198997 - RNA, 22 nt, Human
uauaucauggagauuaacauuc

SEQ ID NO: 198998 - RNA, 22 nt, Human
guuuauuccagcaaucugcuua

SEQ ID NO: 198999 - RNA, 22 nt, Human
uuugcaaauaccaugaaacuug

SEQ ID NO: 199000 - RNA, 19 nt, Human
uccaggccauucccagagc

SEQ ID NO: 199001 - RNA, 22 nt, Human
gcagugcaugucggaacucauu

SEQ ID NO: 199002 - RNA, 22 nt, Human
ugucauuuucauccuaaggagc

SEQ ID NO: 199003 - RNA, 23 nt, Human
auuuaaugcugaguugaauguua

SEQ ID NO: 199004 - RNA, 22 nt, Human
cagcuuuagagaaaacauauuu

SEQ ID NO: 199005 - RNA, 22 nt, Human
ucucagugauggcccauuugga

SEQ ID NO: 199006 - RNA, 22 nt, Human
ucucuuuaaaaauagugaaaua

SEQ ID NO: 199007 - RNA, 21 nt, Human
aucacugaaugccuucaagga

SEQ ID NO: 199008 - RNA, 18 nt, Human
agacaaacuucuucugcc

SEQ ID NO: 199009 - RNA, 22 nt, Human
aggagcagauugguaagaucau

SEQ ID NO: 199010 - RNA, 22 nt, Human
uugugucuaugguuugagcauc

SEQ ID NO: 199011 - RNA, 22 nt, Human
gcugcaggagauuuugagaguc

SEQ ID NO: 199012 - RNA, 22 nt, Human
agaaccaguuuaagauuugggu

SEQ ID NO: 199013 - RNA, 23 nt, Human
acucaaaauuuggcauuugagga

SEQ ID NO: 199014 - RNA, 22 nt, Human
ggcuccaguuugugccuucagc

SEQ ID NO: 199015 - RNA, 21 nt, Human
gcucagcugcuugguuccugu

SEQ ID NO: 199016 - RNA, 22 nt, Human
uuaaauuuuagaaacagacucu

SEQ ID NO: 199017 - RNA, 22 nt, Human
ggcacuggaaggaucaugugag

SEQ ID NO: 199018 - RNA, 22 nt, Human
cccucaccaggcuccaggcaug

SEQ ID NO: 199019 - RNA, 22 nt, Human
cauucacaaaaccacaugccau

SEQ ID NO: 199020 - RNA, 22 nt, Human
cuccagagucacacugccuggg

SEQ ID NO: 199021 - RNA, 22 nt, Human
ucaaacacuguaacauggaaaa

SEQ ID NO: 199022 - RNA, 22 nt, Human
auguaccucugcauuccugccu

SEQ ID NO: 199023 - RNA, 17 nt, Human
guaaggcuugcagaugc

SEQ ID NO: 199024 - RNA, 22 nt, Human
cacauucacuucucuguccacc

SEQ ID NO: 199025 - RNA, 22 nt, Human
aaaaucuggcaacacuaaguuu

SEQ ID NO: 199026 - RNA, 22 nt, Human
auuaggaaguaaguaucacaag

SEQ ID NO: 199027 - RNA, 22 nt, Human
agccuuguagaccauuuuaagg

SEQ ID NO: 199028 - RNA, 22 nt, Human
uagagucuaguguauacaaagu

SEQ ID NO: 199029 - RNA, 22 nt, Human
cauaauccuugauucaaauaau

SEQ ID NO: 199030 - RNA, 22 nt, Human
acaguggaauuuguagaugugu

SEQ ID NO: 199031 - RNA, 22 nt, Human
acccuccaggcugcagcuccug

SEQ ID NO: 199032 - RNA, 22 nt, Human
uaaagcauguguuagaagugca

SEQ ID NO: 199033 - RNA, 22 nt, Human
acaaguuuauuugauuagaaca

SEQ ID NO: 199034 - RNA, 22 nt, Human
ucuguggcugugcugggccaga

SEQ ID NO: 199035 - RNA, 19 nt, Human
ggaagcccugggucagagc

SEQ ID NO: 199036 - RNA, 22 nt, Human
ucaggaaaguguucucagagga

SEQ ID NO: 199037 - RNA, 15 nt, Human
ccaggcucugcacuc

SEQ ID NO: 199038 - RNA, 22 nt, Human
gucucugucuuaggccaggccu

SEQ ID NO: 199039 - RNA, 22 nt, Human
agcuccucuagaucugccacuu

SEQ ID NO: 199040 - RNA, 20 nt, Human
uucuaaacuguuaggcuugc

SEQ ID NO: 199041 - RNA, 22 nt, Human
gggcagguaggugaaauaauga

SEQ ID NO: 199042 - RNA, 22 nt, Human
uccaggcucagcacuugcuacu

SEQ ID NO: 199043 - RNA, 19 nt, Human
cugcugggugcugagggag

SEQ ID NO: 199044 - RNA, 22 nt, Human
gggggcuguccugugcauugua

SEQ ID NO: 199045 - RNA, 22 nt, Human
cagcaggucugcauuugagguc

SEQ ID NO: 199046 - RNA, 22 nt, Human
gauuauuuugugcaauaaucgg

SEQ ID NO: 199047 - RNA, 22 nt, Human
agucugguagaggaagaggccu

SEQ ID NO: 199048 - RNA, 22 nt, Human
gugcugaggagagggggugguc

SEQ ID NO: 199049 - RNA, 22 nt, Human
ugagccagcaggccuccagugg

SEQ ID NO: 199050 - RNA, 23 nt, Human
agccucagccgguggcagaagug

SEQ ID NO: 199051 - RNA, 22 nt, Human
ucuaccuggaguccguuguuaa

SEQ ID NO: 199052 - RNA, 22 nt, Human
ccaguuaguuaaaggcgcagua

SEQ ID NO: 199053 - RNA, 22 nt, Human
uccagugcuggaccagagcacc

SEQ ID NO: 199054 - RNA, 22 nt, Human
aucuggcuuaccuagggugccu

SEQ ID NO: 199055 - RNA, 22 nt, Human
uuccagaaaaaaauguauaucu

SEQ ID NO: 199056 - RNA, 22 nt, Human
ugcugugggcaguacauaagcu

SEQ ID NO: 199057 - RNA, 22 nt, Human
ccucucagcgauuccucuugga

SEQ ID NO: 199058 - RNA, 20 nt, Human
cacagaacaaauugcaggac

SEQ ID NO: 199059 - RNA, 22 nt, Human
gacagacaggugugguaggcac

SEQ ID NO: 199060 - RNA, 22 nt, Human
uacagggauuccugccgcucgc

SEQ ID NO: 199061 - RNA, 22 nt, Human
uggggaagcacuuugaacuuaa

SEQ ID NO: 199062 - RNA, 22 nt, Human
agaaugcaucuaaaagcagaga

SEQ ID NO: 199063 - RNA, 22 nt, Human
gucaucugugcuuuugguagga

SEQ ID NO: 199064 - RNA, 22 nt, Human
cucugaaaaugugguggggaaa

SEQ ID NO: 199065 - RNA, 22 nt, Human
uguaauuauuucugugcaguca

SEQ ID NO: 199066 - RNA, 22 nt, Human
ugucuuuuauaacugacauaua

SEQ ID NO: 199067 - RNA, 22 nt, Human
uaaggaggcugcugugaagaaa

SEQ ID NO: 199068 - RNA, 22 nt, Human
aaugucaauaacuuuaucccuc

SEQ ID NO: 199069 - RNA, 22 nt, Human
aagugauuauuguuuucagguu

SEQ ID NO: 199070 - RNA, 22 nt, Human
gcuuucugguuugugcuacagg

SEQ ID NO: 199071 - RNA, 22 nt, Human
cuguuggccuuucaucaguaau

SEQ ID NO: 199072 - RNA, 22 nt, Human
acuagaaaguuuccagaguuau

SEQ ID NO: 199073 - RNA, 22 nt, Human
uggcaggugaaguuguuaggga

SEQ ID NO: 199074 - RNA, 22 nt, Human
uggcuccucaucacaguuggug

SEQ ID NO: 199075 - RNA, 22 nt, Human
uagggcagccuuauagcuccca

SEQ ID NO: 199076 - RNA, 22 nt, Human
uugaggcacacacagguugcau

SEQ ID NO: 199077 - RNA, 22 nt, Human
augaauaaaacauuuuaaucag

SEQ ID NO: 199078 - RNA, 22 nt, Human
aaggcuuucagcuaacuugauu

SEQ ID NO: 199079 - RNA, 22 nt, Human
cuggguggaaagugcugagaau

SEQ ID NO: 199080 - RNA, 19 nt, Human
ggagaggcuggagggaugc

SEQ ID NO: 199081 - RNA, 22 nt, Human
ggagucugauuuuuuaugggug

SEQ ID NO: 199082 - RNA, 22 nt, Human
ccaccagcuucagcagccgcgg

SEQ ID NO: 199083 - RNA, 22 nt, Human
cuggaaggcggagguuguagug

SEQ ID NO: 199084 - RNA, 22 nt, Human
ucugacuugcaucuuaaaggag

SEQ ID NO: 199085 - RNA, 22 nt, Human
acacuucucuuugaagaacaau

SEQ ID NO: 199086 - RNA, 22 nt, Human
aagucuuuuugaaucuauaacu

SEQ ID NO: 199087 - RNA, 22 nt, Human
uucaggaucauuuguuuuaucu

SEQ ID NO: 199088 - RNA, 22 nt, Human
aucagacaauuguugaguacug

SEQ ID NO: 199089 - RNA, 22 nt, Human
ugaugacaaacuuuccugaugc

SEQ ID NO: 199090 - RNA, 22 nt, Human
ucuccaggggcugcugugccac

SEQ ID NO: 199091 - RNA, 18 nt, Human
ugagaggcuauuuuuugc

SEQ ID NO: 199092 - RNA, 22 nt, Human
gcucccuguucucagccaugau

SEQ ID NO: 199093 - RNA, 22 nt, Human
acuuaaaaacagauccagcagg

SEQ ID NO: 199094 - RNA, 22 nt, Human
gggagggaucugcuaggcaaug

SEQ ID NO: 199095 - RNA, 22 nt, Human
caaggcaugcaaugucuucagg

SEQ ID NO: 199096 - RNA, 22 nt, Human
acagagaccagcaucuucugcc

SEQ ID NO: 199097 - RNA, 22 nt, Human
uuccugugaagaucugggugcu

SEQ ID NO: 199098 - RNA, 22 nt, Human
gaucuuuagccaagacacacca

SEQ ID NO: 199099 - RNA, 23 nt, Human
uggcacagcaggugugcuuuguu

SEQ ID NO: 199100 - RNA, 22 nt, Human
cuucugagaggggcuaggagca

SEQ ID NO: 199101 - RNA, 22 nt, Human
uuucacagucaauuuggaguca

SEQ ID NO: 199102 - RNA, 22 nt, Human
gggagucugggcuagacuccuu

SEQ ID NO: 199103 - RNA, 22 nt, Human
ccuccuggauggauuuggugga

SEQ ID NO: 199104 - RNA, 15 nt, Human
gcaggcaggucaccu

SEQ ID NO: 199105 - RNA, 22 nt, Human
gagcuccucccaggguagcacu

SEQ ID NO: 199106 - RNA, 22 nt, Human
gacaugugagagcucgguuuuc

SEQ ID NO: 199107 - RNA, 22 nt, Human
aacuuugagucauugccucuuu

SEQ ID NO: 199108 - RNA, 22 nt, Human
aacaagucuaagagaauggcag

SEQ ID NO: 199109 - RNA, 22 nt, Human
cccaggagguggaguucacagu

SEQ ID NO: 199110 - RNA, 22 nt, Human
ugacaaauucauauuucagagg

SEQ ID NO: 199111 - RNA, 22 nt, Human
gcacuagauacuguucaggaaa

SEQ ID NO: 199112 - RNA, 22 nt, Human
ucugcagacaggaagcugaggc

SEQ ID NO: 199113 - RNA, 22 nt, Human
auuugccucugcuuucaaggau

SEQ ID NO: 199114 - RNA, 22 nt, Human
caggaaauucuuuuguuugugc

SEQ ID NO: 199115 - RNA, 22 nt, Human
uucauagguuugcugugaacau

SEQ ID NO: 199116 - RNA, 22 nt, Human
caaggccaugagcagcgagugu

SEQ ID NO: 199117 - RNA, 20 nt, Human
gggaggcgagggcugagcag

SEQ ID NO: 199118 - RNA, 22 nt, Human
cuuaaagaugucaaggcuguuu

SEQ ID NO: 199119 - RNA, 22 nt, Human
ugaaaugcuugggaccagaagu

SEQ ID NO: 199120 - RNA, 22 nt, Human
cuuuggaacaagaagaaauggc

SEQ ID NO: 199121 - RNA, 22 nt, Human
gcacuuuguggauuguauuucc

SEQ ID NO: 199122 - RNA, 22 nt, Human
cacagggaggcggucacuggcu

SEQ ID NO: 199123 - RNA, 22 nt, Human
agcacuguaguuauagcuaaca

SEQ ID NO: 199124 - RNA, 22 nt, Human
ugcagaaauaacucauauugca

SEQ ID NO: 199125 - RNA, 22 nt, Human
uacacauguuuggcaaguaugu

SEQ ID NO: 199126 - RNA, 22 nt, Human
uucuuacaaguauuccaggucc

SEQ ID NO: 199127 - RNA, 22 nt, Human
uugcaggguuaaaguaagguag

SEQ ID NO: 199128 - RNA, 20 nt, Human
acugguggacuguucauuga

SEQ ID NO: 199129 - RNA, 22 nt, Human
gugugcagaacagggagugggu

SEQ ID NO: 199130 - RNA, 23 nt, Human
agcaggcaucuguggcacaaggc

SEQ ID NO: 199131 - RNA, 22 nt, Human
ugaaggcccuaucuccauauac

SEQ ID NO: 199132 - RNA, 20 nt, Human
gggugugugcagggccuggu

SEQ ID NO: 199133 - RNA, 22 nt, Human
ucucuucacaugcuugcuccaa

SEQ ID NO: 199134 - RNA, 22 nt, Human
caggagugucuccacacagcaa

SEQ ID NO: 199135 - RNA, 22 nt, Human
aacccacaagcagcuguagccc

SEQ ID NO: 199136 - RNA, 18 nt, Human
gcugccuucccagucaag

SEQ ID NO: 199137 - RNA, 22 nt, Human
ucaagcaaaguuuagcugguua

SEQ ID NO: 199138 - RNA, 22 nt, Human
ccuggcagcagcacaugccuuc

SEQ ID NO: 199139 - RNA, 22 nt, Human
acacagcaaggucugacuuugg

SEQ ID NO: 199140 - RNA, 22 nt, Human
aucuuugugaaucucaacuugg

SEQ ID NO: 199141 - RNA, 22 nt, Human
agcugcaaguaagcuugcuccu

SEQ ID NO: 199142 - RNA, 22 nt, Human
cugagaggcagccagagaaaau

SEQ ID NO: 199143 - RNA, 21 nt, Human
gaucuagacuugggcccagua

SEQ ID NO: 199144 - RNA, 22 nt, Human
cagcuccuauuagacacugaau

SEQ ID NO: 199145 - RNA, 22 nt, Human
uugguacauuacaguuugauug

SEQ ID NO: 199146 - RNA, 22 nt, Human
ucuccuggcaugugggucaucu

SEQ ID NO: 199147 - RNA, 22 nt, Human
cugccacuuuggagugcucaga

SEQ ID NO: 199148 - RNA, 22 nt, Human
agaaaacuugucacagcucuca

SEQ ID NO: 199149 - RNA, 20 nt, Human
cugagcccagaucccagguc

SEQ ID NO: 199150 - RNA, 22 nt, Human
uggcacuuuacacccauuuggc

SEQ ID NO: 199151 - RNA, 22 nt, Human
ugaguucuaggcuuaaaacuaa

SEQ ID NO: 199152 - RNA, 22 nt, Human
aauggcacuuuauaaauguuaa

SEQ ID NO: 199153 - RNA, 22 nt, Human
ucagaaucuuucuagagucuag

SEQ ID NO: 199154 - RNA, 22 nt, Human
caggacagacagaaugccuaac

SEQ ID NO: 199155 - RNA, 22 nt, Human
uuguuucugaguuuucauguau

SEQ ID NO: 199156 - RNA, 22 nt, Human
acccagagcagagcuuggcuuc

SEQ ID NO: 199157 - RNA, 22 nt, Human
auaacuucaucaaauaggcaca

SEQ ID NO: 199158 - RNA, 22 nt, Human
cagagaaacucagauagcugau

SEQ ID NO: 199159 - RNA, 22 nt, Human
ucaggaagggugguccacaggg

SEQ ID NO: 199160 - RNA, 22 nt, Human
acacauauaccacuguaaauga

SEQ ID NO: 199161 - RNA, 22 nt, Human
uucagucuuguugaaaacuugg

SEQ ID NO: 199162 - RNA, 22 nt, Human
gcacacaucuuguaauccugag

SEQ ID NO: 199163 - RNA, 22 nt, Human
uggcugcugagaaggcagcugu

SEQ ID NO: 199164 - RNA, 22 nt, Human
ucuacugugguccuuguaacca

SEQ ID NO: 199165 - RNA, 22 nt, Human
caggcacaaauuucuagauaag

SEQ ID NO: 199166 - RNA, 22 nt, Human
cagggcacggagaagucacccc

SEQ ID NO: 199167 - RNA, 22 nt, Human
cagaaggcaaacaaaaggauuu

SEQ ID NO: 199168 - RNA, 22 nt, Human
agcugugggauuugggugugcc

SEQ ID NO: 199169 - RNA, 22 nt, Human
uucuuagugguagucaucuuug

SEQ ID NO: 199170 - RNA, 22 nt, Human
ugagcaucuuuuuacagguuua

SEQ ID NO: 199171 - RNA, 22 nt, Human
agcagcuggaacauaugaagaa

SEQ ID NO: 199172 - RNA, 22 nt, Human
gucccaggggagcucucugauu

SEQ ID NO: 199173 - RNA, 22 nt, Human
gccaggcagcagcgaggauggu

SEQ ID NO: 199174 - RNA, 22 nt, Human
uagggcucagcucuagcuccug

SEQ ID NO: 199175 - RNA, 22 nt, Human
gaggaaaugguuguucaggugg

SEQ ID NO: 199176 - RNA, 22 nt, Human
caauagcaggucuacagagaga

SEQ ID NO: 199177 - RNA, 22 nt, Human
ugaucaguguugguucuaucua

SEQ ID NO: 199178 - RNA, 22 nt, Human
ucagugucagucuuuuagauau

SEQ ID NO: 199179 - RNA, 22 nt, Human
acaugagaggcuguggaguaca

SEQ ID NO: 199180 - RNA, 22 nt, Human
uuccucagcuuuagacuaugaa

SEQ ID NO: 199181 - RNA, 22 nt, Human
ucaaaauuagugaccaaaggca

SEQ ID NO: 199182 - RNA, 20 nt, Human
auuccacuuguuugagguac

SEQ ID NO: 199183 - RNA, 22 nt, Human
uucaaugcuuauauggacuaau

SEQ ID NO: 199184 - RNA, 22 nt, Human
gggacaggcugagacuugagcu

SEQ ID NO: 199185 - RNA, 22 nt, Human
acugaauuagggaacacugaac

SEQ ID NO: 199186 - RNA, 20 nt, Human
cagaggcaaggagacuugga

SEQ ID NO: 199187 - RNA, 22 nt, Human
acacuugagguuuuuaggugcg

SEQ ID NO: 199188 - RNA, 22 nt, Human
uuguagaaaauuagaugcaugg

SEQ ID NO: 199189 - RNA, 23 nt, Human
uccucagcauguuuugucaugua

SEQ ID NO: 199190 - RNA, 22 nt, Human
agggccaccucucuggguuccc

SEQ ID NO: 199191 - RNA, 22 nt, Human
ucucugagccccugccucuuuc

SEQ ID NO: 199192 - RNA, 22 nt, Human
ccauggccugaaggagugcauc

SEQ ID NO: 199193 - RNA, 22 nt, Human
uaacagaaguuguucauugugg

SEQ ID NO: 199194 - RNA, 22 nt, Human
aaggagucugggccauucagag

SEQ ID NO: 199195 - RNA, 22 nt, Human
gcucagagaaguugugccuggc

SEQ ID NO: 199196 - RNA, 22 nt, Human
ccuggccagccagggcuggggu

SEQ ID NO: 199197 - RNA, 22 nt, Human
ugcacuuuaaaaaauggugaug

SEQ ID NO: 199198 - RNA, 22 nt, Human
aagagacaaugucuuuuggaua

SEQ ID NO: 199199 - RNA, 22 nt, Human
aaguacauccuagucucuuuca

SEQ ID NO: 199200 - RNA, 22 nt, Human
auucaacauauucugaguaaaa

SEQ ID NO: 199201 - RNA, 22 nt, Human
aauguucagggcagcccugcua

SEQ ID NO: 199202 - RNA, 22 nt, Human
auguuuacugguuuauagaaua

SEQ ID NO: 199203 - RNA, 19 nt, Human
uggccagguacugucugcu

SEQ ID NO: 199204 - RNA, 22 nt, Human
uccagagaucacacugggcagg

SEQ ID NO: 199205 - RNA, 22 nt, Human
ugcuuucuuuagcuccugaguc

SEQ ID NO: 199206 - RNA, 22 nt, Human
uaaggagggggaaugauuggca

SEQ ID NO: 199207 - RNA, 22 nt, Human
auggcagggcagccucucagag

SEQ ID NO: 199208 - RNA, 22 nt, Human
cacauuucugugagucaauauu

SEQ ID NO: 199209 - RNA, 22 nt, Human
uugagaacaggaguguucuuuu

SEQ ID NO: 199210 - RNA, 22 nt, Human
gcuggccauggggagugaggag

SEQ ID NO: 199211 - RNA, 22 nt, Human
cugcuccuguccagcagggcca

SEQ ID NO: 199212 - RNA, 22 nt, Human
ugucuccauagaagagacugca

SEQ ID NO: 199213 - RNA, 18 nt, Human
acucugggaccuguuauu

SEQ ID NO: 199214 - RNA, 22 nt, Human
gaggugugaugcagaguggugg

SEQ ID NO: 199215 - RNA, 22 nt, Human
acucaucugccauuccuguacc

SEQ ID NO: 199216 - RNA, 22 nt, Human
ugaaaacuugacaagugaggua

SEQ ID NO: 199217 - RNA, 22 nt, Human
gcagacagggcuacagagguac

SEQ ID NO: 199218 - RNA, 22 nt, Human
gugggggcuggcucguccugug

SEQ ID NO: 199219 - RNA, 22 nt, Human
aaaauucauggcuugggaaaag

SEQ ID NO: 199220 - RNA, 22 nt, Human
gaggccaggggagucagcgucc

SEQ ID NO: 199221 - RNA, 22 nt, Human
gaugagggccugguggcugugc

SEQ ID NO: 199222 - RNA, 22 nt, Human
uacagaacugaaguagugaaaa

SEQ ID NO: 199223 - RNA, 22 nt, Human
ccuggcagguggcgcccucggc

SEQ ID NO: 199224 - RNA, 22 nt, Human
gcuguggcccuuggcaucugcg

SEQ ID NO: 199225 - RNA, 22 nt, Human
gcaugcagucaaccaguaaggg

SEQ ID NO: 199226 - RNA, 22 nt, Human
guggcucuccauugacauggaa

SEQ ID NO: 199227 - RNA, 22 nt, Human
cagugccucaggccagccugca

SEQ ID NO: 199228 - RNA, 22 nt, Human
acaguaaccucuccucugaagg

SEQ ID NO: 199229 - RNA, 22 nt, Human
ucccaggacaugggcucugcuc

SEQ ID NO: 199230 - RNA, 22 nt, Human
uuucacauguauauaggcauua

SEQ ID NO: 199231 - RNA, 22 nt, Human
gcaacaaguguaaacaugcauu

SEQ ID NO: 199232 - RNA, 22 nt, Human
aacuucuggauguuucaaaugu

SEQ ID NO: 199233 - RNA, 22 nt, Human
uguaauaaugaggcauccagcc

SEQ ID NO: 199234 - RNA, 21 nt, Human
ggccucugucauccugggaag

SEQ ID NO: 199235 - RNA, 22 nt, Human
caugccauucccugauccuaac

SEQ ID NO: 199236 - RNA, 22 nt, Human
cauugauuauugaagggucuuu

SEQ ID NO: 199237 - RNA, 22 nt, Human
ggguccagguuuagucauuugu

SEQ ID NO: 199238 - RNA, 22 nt, Human
cagcccagcagucuuagccugc

SEQ ID NO: 199239 - RNA, 22 nt, Human
ucuguuuaaugggaaugauacu

SEQ ID NO: 199240 - RNA, 22 nt, Human
agucucaagggaugucucuaua

SEQ ID NO: 199241 - RNA, 21 nt, Human
gggcuuuuuauuuagcacugu

SEQ ID NO: 199242 - RNA, 22 nt, Human
uuagaaagggugucugaaucug

SEQ ID NO: 199243 - RNA, 20 nt, Human
cuuagaaauuuuuacccugg

SEQ ID NO: 199244 - RNA, 22 nt, Human
ccuggcagguagcauugaggag

SEQ ID NO: 199245 - RNA, 22 nt, Human
ccucucccaggcgcggcggcag

SEQ ID NO: 199246 - RNA, 22 nt, Human
ucagcagauggguuguguuggc

SEQ ID NO: 199247 - RNA, 22 nt, Human
cagacagggguaaccuuccuca

SEQ ID NO: 199248 - RNA, 22 nt, Human
acagaaacccagaaaaccucuc

SEQ ID NO: 199249 - RNA, 22 nt, Human
cucagcaccccgacaggacauu

SEQ ID NO: 199250 - RNA, 22 nt, Human
aucuuacagcagcaaggaagua

SEQ ID NO: 199251 - RNA, 22 nt, Human
uucagugugugauaccugcugu

SEQ ID NO: 199252 - RNA, 22 nt, Human
agucacucugcuacaugacagc

SEQ ID NO: 199253 - RNA, 22 nt, Human
ucaguuuaauacccagaugccu

SEQ ID NO: 199254 - RNA, 22 nt, Human
ugauuucucuccguuauuucag

SEQ ID NO: 199255 - RNA, 22 nt, Human
cagccccuuccuggcaucugga

SEQ ID NO: 199256 - RNA, 20 nt, Human
aaugaguccugcuggaucac

SEQ ID NO: 199257 - RNA, 22 nt, Human
agugagcaucuucaggagccaa

SEQ ID NO: 199258 - RNA, 22 nt, Human
aucagagcacugagcaggacac

SEQ ID NO: 199259 - RNA, 22 nt, Human
guuuuuaucuaauagcaguuau

SEQ ID NO: 199260 - RNA, 22 nt, Human
caggcccuggcagggcugaguc

SEQ ID NO: 199261 - RNA, 22 nt, Human
uaacauuagguagacauaagcc

SEQ ID NO: 199262 - RNA, 23 nt, Human
auauucacgccgccagagguccc

SEQ ID NO: 199263 - RNA, 22 nt, Human
ucacagaagcaucauacccgga

SEQ ID NO: 199264 - RNA, 22 nt, Human
gcugugcaucuucauucuggac

SEQ ID NO: 199265 - RNA, 22 nt, Human
uggcuucucuggcauccccauc

SEQ ID NO: 199266 - RNA, 22 nt, Human
gaaguuauuuccugguguugga

SEQ ID NO: 199267 - RNA, 22 nt, Human
uggggccagggaggaccagaca

SEQ ID NO: 199268 - RNA, 22 nt, Human
caggucuggguugauggccugg

SEQ ID NO: 199269 - RNA, 22 nt, Human
acucaggaaaugaagacugguu

SEQ ID NO: 199270 - RNA, 21 nt, Human
aaaaaugaaguuguucaggaa

SEQ ID NO: 199271 - RNA, 22 nt, Human
ugggagaagacguacuuuagac

SEQ ID NO: 199272 - RNA, 22 nt, Human
uccugcagacauuuacaccuuu

SEQ ID NO: 199273 - RNA, 22 nt, Human
uuucucugugccauuuccauaa

SEQ ID NO: 199274 - RNA, 22 nt, Human
uaaaaugacuuccuccaacauc

SEQ ID NO: 199275 - RNA, 22 nt, Human
uaguggagaguuguuuugugca

SEQ ID NO: 199276 - RNA, 19 nt, Human
ucugucauuucuucuguac

SEQ ID NO: 199277 - RNA, 22 nt, Human
guccugggccugcugaggcuga

SEQ ID NO: 199278 - RNA, 22 nt, Human
auugacagaaaauuggauggca

SEQ ID NO: 199279 - RNA, 22 nt, Human
ucccucagagaccguggugcag

SEQ ID NO: 199280 - RNA, 22 nt, Human
cuguaaauaugaagaauauaug

SEQ ID NO: 199281 - RNA, 18 nt, Human
cucucuuuccacucuuug

SEQ ID NO: 199282 - RNA, 22 nt, Human
ucccauauaugcaaaaauguaa

SEQ ID NO: 199283 - RNA, 22 nt, Human
aguaacucuccuuugacauauu

SEQ ID NO: 199284 - RNA, 22 nt, Human
aaagcacaggagaguucaguaa

SEQ ID NO: 199285 - RNA, 22 nt, Human
ugguuugacaaugaggacuggu

SEQ ID NO: 199286 - RNA, 22 nt, Human
ugcaaauagccuauauuuauag

SEQ ID NO: 199287 - RNA, 22 nt, Human
uacuuucaugucuauacauauu

SEQ ID NO: 199288 - RNA, 22 nt, Human
uugcuuuacggcaaggccccag

SEQ ID NO: 199289 - RNA, 22 nt, Human
ccucuuccugcacugacauuuu

SEQ ID NO: 199290 - RNA, 22 nt, Human
acauguuagaaaugcagaaucu

SEQ ID NO: 199291 - RNA, 22 nt, Human
gcccagcccugaggucacagcu

SEQ ID NO: 199292 - RNA, 20 nt, Human
uccuccaaccagcugcuaau

SEQ ID NO: 199293 - RNA, 19 nt, Human
agcacagacaagaccagca

SEQ ID NO: 199294 - RNA, 22 nt, Human
uagaauccaccuacacaagaga

SEQ ID NO: 199295 - RNA, 22 nt, Human
uucuagaugcuuauaggcauau

SEQ ID NO: 199296 - RNA, 22 nt, Human
acuacauucaugcucguguugg

SEQ ID NO: 199297 - RNA, 22 nt, Human
ugggagauauugcuguggcugu

SEQ ID NO: 199298 - RNA, 22 nt, Human
uguuuuggaacaaaagcuauuc

SEQ ID NO: 199299 - RNA, 22 nt, Human
uuugucauaucacacaauuuug

SEQ ID NO: 199300 - RNA, 22 nt, Human
auuuccuguaggggcuugcgaa

SEQ ID NO: 199301 - RNA, 22 nt, Human
cugagaguguggcuuccaggcc

SEQ ID NO: 199302 - RNA, 22 nt, Human
acaaaaguguaggaauuccuua

SEQ ID NO: 199303 - RNA, 22 nt, Human
aaagcaguauaguggaagggcu

SEQ ID NO: 199304 - RNA, 22 nt, Human
cuuugaaaggaagccacacagc

SEQ ID NO: 199305 - RNA, 22 nt, Human
uugguuacaaguuugcucugcc

SEQ ID NO: 199306 - RNA, 22 nt, Human
uaaaggcucagggaaccagauc

SEQ ID NO: 199307 - RNA, 22 nt, Human
gcagcccugcagcuccacaccg

SEQ ID NO: 199308 - RNA, 22 nt, Human
gacaucauaucaggaggcaugu

SEQ ID NO: 199309 - RNA, 22 nt, Human
uugcuuuaaugagauuuugcca

SEQ ID NO: 199310 - RNA, 22 nt, Human
ggaccaggcaagcugaggcggg

SEQ ID NO: 199311 - RNA, 22 nt, Human
gacagcagacagccuggccccu

SEQ ID NO: 199312 - RNA, 22 nt, Human
auacacuaaucaugugcucagu

SEQ ID NO: 199313 - RNA, 22 nt, Human
uuucuagucucgaucucuuaau

SEQ ID NO: 199314 - RNA, 22 nt, Human
ggcacugggugagggucacugg

SEQ ID NO: 199315 - RNA, 22 nt, Human
ccagcaucuaacgcuccuggga

SEQ ID NO: 199316 - RNA, 22 nt, Human
acauuguuugagaauacagaug

SEQ ID NO: 199317 - RNA, 18 nt, Human
gccagagguacuacugau

SEQ ID NO: 199318 - RNA, 22 nt, Human
cugucuguguggacacggcugc

SEQ ID NO: 199319 - RNA, 22 nt, Human
ugaggaauggcuuaauguggga

SEQ ID NO: 199320 - RNA, 23 nt, Human
uagaaugucauucaaugauaugg

SEQ ID NO: 199321 - RNA, 22 nt, Human
agaaagcuggagucaagcagag

SEQ ID NO: 199322 - RNA, 22 nt, Human
gagaggccaaaaucccugcccc

SEQ ID NO: 199323 - RNA, 22 nt, Human
uuggaaauacgaguaguaucau

SEQ ID NO: 199324 - RNA, 22 nt, Human
uggcucugagucugcccuuggc

SEQ ID NO: 199325 - RNA, 22 nt, Human
ccugcaccacacucacugcuca

SEQ ID NO: 199326 - RNA, 22 nt, Human
uuagaauuucugcucacuuuga

SEQ ID NO: 199327 - RNA, 22 nt, Human
uugcucaggcuuagagcuacua

SEQ ID NO: 199328 - RNA, 22 nt, Human
gaugugucuccauacaccaccc

SEQ ID NO: 199329 - RNA, 22 nt, Human
aggguggcuuaauuccaaaggg

SEQ ID NO: 199330 - RNA, 22 nt, Human
ggguaggaaauccagagguggc

SEQ ID NO: 199331 - RNA, 22 nt, Human
cuagaaacauuacauguguuaa

SEQ ID NO: 199332 - RNA, 22 nt, Human
cauuuccugucuggaggucaaa

SEQ ID NO: 199333 - RNA, 22 nt, Human
auacaugacucacacauucugc

SEQ ID NO: 199334 - RNA, 22 nt, Human
ggcagcuguuuguccuccuguu

SEQ ID NO: 199335 - RNA, 22 nt, Human
aucuccagggugcccuuguucu

SEQ ID NO: 199336 - RNA, 20 nt, Human
guguuucaugugauacaaug

SEQ ID NO: 199337 - RNA, 22 nt, Human
gcuucagcuuugucuccuuggg

SEQ ID NO: 199338 - RNA, 22 nt, Human
caguccugggcacagcccuggg

SEQ ID NO: 199339 - RNA, 22 nt, Human
gggcuucucucagaaacuauca

SEQ ID NO: 199340 - RNA, 22 nt, Human
gcccaggacucagggugucgcg

SEQ ID NO: 199341 - RNA, 22 nt, Human
ucugcuuucuuacuaaaaauga

SEQ ID NO: 199342 - RNA, 22 nt, Human
cccugccaaucccgucucucug

SEQ ID NO: 199343 - RNA, 22 nt, Human
cugccagaagguuccugcugca

SEQ ID NO: 199344 - RNA, 22 nt, Human
cucuccagccaggggcuuccug

SEQ ID NO: 199345 - RNA, 22 nt, Human
uuagaggcaugauucaguaaag

SEQ ID NO: 199346 - RNA, 22 nt, Human
uuaauuaugagaaagggaaaag

SEQ ID NO: 199347 - RNA, 22 nt, Human
uuauacagcauugcuagugaug

SEQ ID NO: 199348 - RNA, 22 nt, Human
cucagagaaaugucacaacaau

SEQ ID NO: 199349 - RNA, 22 nt, Human
gaggcacauauauacagagccc

SEQ ID NO: 199350 - RNA, 22 nt, Human
uggguacuccuauuaguucagu

SEQ ID NO: 199351 - RNA, 20 nt, Human
acagugcauggggggacagc

SEQ ID NO: 199352 - RNA, 22 nt, Human
cagaaguucuagauuugagucc

SEQ ID NO: 199353 - RNA, 20 nt, Human
augauuuugcacuaacuuca

SEQ ID NO: 199354 - RNA, 22 nt, Human
gccaggcugguuauuuaaugag

SEQ ID NO: 199355 - RNA, 22 nt, Human
ucuacuguagugaugcugcagu

SEQ ID NO: 199356 - RNA, 22 nt, Human
cugugccaggcccagcugacuu

SEQ ID NO: 199357 - RNA, 22 nt, Human
ucucuccaacaugguggugcug

SEQ ID NO: 199358 - RNA, 22 nt, Human
cuggcucaugugaugagggcaa

SEQ ID NO: 199359 - RNA, 22 nt, Human
cuggaagaccccccaggacuca

SEQ ID NO: 199360 - RNA, 22 nt, Human
cugcacagaggucggucugcca

SEQ ID NO: 199361 - RNA, 22 nt, Human
auuaaggugucaauguauuugg

SEQ ID NO: 199362 - RNA, 22 nt, Human
gaaguuccagugauauaaaacu

SEQ ID NO: 199363 - RNA, 22 nt, Human
cacagaaaaaggcuugaaaauc

SEQ ID NO: 199364 - RNA, 22 nt, Human
aggacuuagaacauuauguacu

SEQ ID NO: 199365 - RNA, 22 nt, Human
uaacagaguaacagguauguaa

SEQ ID NO: 199366 - RNA, 22 nt, Human
gacuguggcaggcucagcacug

SEQ ID NO: 199367 - RNA, 22 nt, Human
gcccagcccagaaagguucgga

SEQ ID NO: 199368 - RNA, 22 nt, Human
ccugcagaaaggguccccagga

SEQ ID NO: 199369 - RNA, 22 nt, Human
acucugggagaggacaaacaaa

SEQ ID NO: 199370 - RNA, 22 nt, Human
cucagcauucaauguccagucc

SEQ ID NO: 199371 - RNA, 22 nt, Human
caugcauguuuacuacagugac

SEQ ID NO: 199372 - RNA, 20 nt, Human
ugacacaaauugcuuucuca

SEQ ID NO: 199373 - RNA, 22 nt, Human
cauuuuaccuagaagcugaaag

SEQ ID NO: 199374 - RNA, 22 nt, Human
augcaggagcccucuugagggc

SEQ ID NO: 199375 - RNA, 18 nt, Human
ccugugacagaggcauca

SEQ ID NO: 199376 - RNA, 22 nt, Human
auauaacucuccauuaagggcc

SEQ ID NO: 199377 - RNA, 22 nt, Human
gagaaccuacuguauacuauau

SEQ ID NO: 199378 - RNA, 18 nt, Human
uguagcuggaggccaggc

SEQ ID NO: 199379 - RNA, 21 nt, Human
cagacaugagucucagcuuug

SEQ ID NO: 199380 - RNA, 20 nt, Human
uccucagaagacauuugggg

SEQ ID NO: 199381 - RNA, 22 nt, Human
ugugaaggagaugaagggagug

SEQ ID NO: 199382 - RNA, 22 nt, Human
auucuucagcaggggacacuau

SEQ ID NO: 199383 - RNA, 22 nt, Human
ccagugggagggagcuaggcca

SEQ ID NO: 199384 - RNA, 22 nt, Human
guggccugugcugucuccccaa

SEQ ID NO: 199385 - RNA, 22 nt, Human
uugaaagauagugaagccagcc

SEQ ID NO: 199386 - RNA, 22 nt, Human
gcaccaggaagcuguuauagca

SEQ ID NO: 199387 - RNA, 22 nt, Human
cuagggaccucagcuccuggag

SEQ ID NO: 199388 - RNA, 22 nt, Human
uugauuaaacaggcauauucaa

SEQ ID NO: 199389 - RNA, 22 nt, Human
ugguggcaauucaaagacagca

SEQ ID NO: 199390 - RNA, 22 nt, Human
gcccuccugcaggggcuucugg

SEQ ID NO: 199391 - RNA, 22 nt, Human
uuauuuacuggauggccuuggg

SEQ ID NO: 199392 - RNA, 22 nt, Human
aaaaccacaaugacuuuugcac

SEQ ID NO: 199393 - RNA, 22 nt, Human
caggcagcugcgacaagagagc

SEQ ID NO: 199394 - RNA, 22 nt, Human
ucacaggagucauaauuacagu

SEQ ID NO: 199395 - RNA, 22 nt, Human
cagggcuguaaauuagugcuga

SEQ ID NO: 199396 - RNA, 22 nt, Human
gccaggcucuuccauuuggguc

SEQ ID NO: 199397 - RNA, 22 nt, Human
uauuucugaggcccaggaagug

SEQ ID NO: 199398 - RNA, 22 nt, Human
gccucaggugcaucucucauuc

SEQ ID NO: 199399 - RNA, 22 nt, Human
uccaggaagccacacugggccu

SEQ ID NO: 199400 - RNA, 22 nt, Human
uggcaaagugacuccuuggggc

SEQ ID NO: 199401 - RNA, 22 nt, Human
ucuguggcuggagaacuugucu

SEQ ID NO: 199402 - RNA, 22 nt, Human
agggccucugacgcccccagcc

SEQ ID NO: 199403 - RNA, 22 nt, Human
cuguuauuuuccucugaacucu

SEQ ID NO: 199404 - RNA, 22 nt, Human
auauuuguugaguucuuaugau

SEQ ID NO: 199405 - RNA, 22 nt, Human
cucucuguucauugagucaaaa

SEQ ID NO: 199406 - RNA, 22 nt, Human
ugggagauaauucauuguguuc

SEQ ID NO: 199407 - RNA, 22 nt, Human
aaaguauucuugacuguuuuuc

SEQ ID NO: 199408 - RNA, 22 nt, Human
augcugaagaguucaugauuau

SEQ ID NO: 199409 - RNA, 22 nt, Human
ucugggucuuuacccauggaau

SEQ ID NO: 199410 - RNA, 22 nt, Human
uugcuuagagccaaucuugauu

SEQ ID NO: 199411 - RNA, 22 nt, Human
uuuuaauccaucugguaaaccu

SEQ ID NO: 199412 - RNA, 22 nt, Human
uggcucagagccuugagagcug

SEQ ID NO: 199413 - RNA, 23 nt, Human
uguuuucuuguccugguauaauu

SEQ ID NO: 199414 - RNA, 22 nt, Human
auguuacaaauccuacagguag

SEQ ID NO: 199415 - RNA, 22 nt, Human
gcagaauugauggagaacuuaa

SEQ ID NO: 199416 - RNA, 22 nt, Human
accccuuggaguccgcgcccag

SEQ ID NO: 199417 - RNA, 22 nt, Human
ucacaucacccugcucuuaauu

SEQ ID NO: 199418 - RNA, 22 nt, Human
agauggcuauagauagccuuuc

SEQ ID NO: 199419 - RNA, 22 nt, Human
uuuagagaggcucuguaaaaug

SEQ ID NO: 199420 - RNA, 22 nt, Human
auguaucagauaaagcaugugg

SEQ ID NO: 199421 - RNA, 22 nt, Human
agaugagaauuuuuagagugcu

SEQ ID NO: 199422 - RNA, 22 nt, Human
auagacaaacacgaagaugaca

SEQ ID NO: 199423 - RNA, 22 nt, Human
gacauaaaguucuugcuugaau

SEQ ID NO: 199424 - RNA, 22 nt, Human
uuccucagggaggcuagcagua

SEQ ID NO: 199425 - RNA, 22 nt, Human
uacauaauaaggggcauggugu

SEQ ID NO: 199426 - RNA, 22 nt, Human
aggcugcucugcgaagucagcu

SEQ ID NO: 199427 - RNA, 22 nt, Human
gcaguaagaaagucaagcaguu

SEQ ID NO: 199428 - RNA, 22 nt, Human
agguccagccugcccucucucc

SEQ ID NO: 199429 - RNA, 22 nt, Human
cuauuucagcugccuuugacug

SEQ ID NO: 199430 - RNA, 21 nt, Human
uccaggccaugguggggaggc

SEQ ID NO: 199431 - RNA, 22 nt, Human
ccagcugcugugcagggaggcu

SEQ ID NO: 199432 - RNA, 22 nt, Human
guuaucuucuauuucucauacu

SEQ ID NO: 199433 - RNA, 22 nt, Human
ggaccuuccuggcuccuggggu

SEQ ID NO: 199434 - RNA, 22 nt, Human
aggcaggccgugucccuccuca

SEQ ID NO: 199435 - RNA, 22 nt, Human
ccugucuggccaccagggcgau

SEQ ID NO: 199436 - RNA, 22 nt, Human
ucugcuggaaaaccagggaauu

SEQ ID NO: 199437 - RNA, 21 nt, Human
cagugaggcccuccuguuccc

SEQ ID NO: 199438 - RNA, 22 nt, Human
ucaauucaacacaugcacauug

SEQ ID NO: 199439 - RNA, 22 nt, Human
cccagccuuccacccuggacua

SEQ ID NO: 199440 - RNA, 21 nt, Human
ggauggauagggaagagauuu

SEQ ID NO: 199441 - RNA, 22 nt, Human
caguugcagcugugacauugcg

SEQ ID NO: 199442 - RNA, 22 nt, Human
gcucagaggccacuguuggaaa

SEQ ID NO: 199443 - RNA, 22 nt, Human
gcugcuuuacugaagagauaug

SEQ ID NO: 199444 - RNA, 22 nt, Human
acagaauugaaaguauaaucug

SEQ ID NO: 199445 - RNA, 22 nt, Human
uacagacauucaauuuugaccc

SEQ ID NO: 199446 - RNA, 22 nt, Human
uacuuccuguuuccaugucugu

SEQ ID NO: 199447 - RNA, 22 nt, Human
cuaaucaucuuucucuuaaagc

SEQ ID NO: 199448 - RNA, 22 nt, Human
ccuggacuguguccugugguca

SEQ ID NO: 199449 - RNA, 22 nt, Human
gaauccaggguuguuugagcua

SEQ ID NO: 199450 - RNA, 22 nt, Human
aaagugcauucgaaaguccauc

SEQ ID NO: 199451 - RNA, 22 nt, Human
aauguguucaguuaaaugaacu

SEQ ID NO: 199452 - RNA, 22 nt, Human
ucucugcuaagauugugucuag

SEQ ID NO: 199453 - RNA, 22 nt, Human
ccaacacagauguguuaguguu

SEQ ID NO: 199454 - RNA, 22 nt, Human
uugacacaguuuucucauuaag

SEQ ID NO: 199455 - RNA, 22 nt, Human
cuuuaguucuaaugcauugaaa

SEQ ID NO: 199456 - RNA, 22 nt, Human
caacuguuauaaaucaacagag

SEQ ID NO: 199457 - RNA, 23 nt, Human
auaaugcaaguggugguaaucug

SEQ ID NO: 199458 - RNA, 22 nt, Human
agaacaaaauuagaggagugca

SEQ ID NO: 199459 - RNA, 22 nt, Human
uggaugagggcugagcacuggg

SEQ ID NO: 199460 - RNA, 22 nt, Human
cuuaauuuaaaauaguucaggc

SEQ ID NO: 199461 - RNA, 22 nt, Human
gaguagcauucuagaguaugcu

SEQ ID NO: 199462 - RNA, 22 nt, Human
cugaggcagagagaacccgggc

SEQ ID NO: 199463 - RNA, 22 nt, Human
cugugccuggggggcagagcug

SEQ ID NO: 199464 - RNA, 22 nt, Human
uagaggguuauuaggacagaag

SEQ ID NO: 199465 - RNA, 17 nt, Human
aagacccuagucuaccc

SEQ ID NO: 199466 - RNA, 22 nt, Human
aaaggcuugguauuuuggaguu

SEQ ID NO: 199467 - RNA, 22 nt, Human
uggcuucuucauaugugaucuu

SEQ ID NO: 199468 - RNA, 22 nt, Human
agcugcaauuaaagacugugaa

SEQ ID NO: 199469 - RNA, 22 nt, Human
cauccauucauuaauucuaaag

SEQ ID NO: 199470 - RNA, 21 nt, Human
caggcuugaggaaugugccug

SEQ ID NO: 199471 - RNA, 22 nt, Human
ugcuuuauguggcugauacuca

SEQ ID NO: 199472 - RNA, 22 nt, Human
gcugggcaccggagagacccca

SEQ ID NO: 199473 - RNA, 22 nt, Human
caggaggccaacugugggacuu

SEQ ID NO: 199474 - RNA, 22 nt, Human
caggcacagcuaagacuggcca

SEQ ID NO: 199475 - RNA, 23 nt, Human
cugcuuucccacuccaugcucuu

SEQ ID NO: 199476 - RNA, 19 nt, Human
ugcauaaauuauauacuuu

SEQ ID NO: 199477 - RNA, 19 nt, Human
agaaucaucuugaagugau

SEQ ID NO: 199478 - RNA, 22 nt, Human
ccucccucuuucagucccacag

SEQ ID NO: 199479 - RNA, 17 nt, Human
agcagcuggguugaucu

SEQ ID NO: 199480 - RNA, 22 nt, Human
ugucccagcacuuugggagucu

SEQ ID NO: 199481 - RNA, 22 nt, Human
aguccggggucuggacaccugg

SEQ ID NO: 199482 - RNA, 19 nt, Human
uccuccuuacuuccucuug

SEQ ID NO: 199483 - RNA, 22 nt, Human
uugagauggagcuucacucuug

SEQ ID NO: 199484 - RNA, 22 nt, Human
cuuguagcugcuucuucugaag

SEQ ID NO: 199485 - RNA, 23 nt, Human
agcuggaaauggccgagcucugc

SEQ ID NO: 199486 - RNA, 22 nt, Human
ugucugaguggugcaaggcuga

SEQ ID NO: 199487 - RNA, 22 nt, Human
gagauuuaauuggauuaacuua

SEQ ID NO: 199488 - RNA, 22 nt, Human
acucagaaugacugaugcugug

SEQ ID NO: 199489 - RNA, 22 nt, Human
gggccggagcugggucccgcgc

SEQ ID NO: 199490 - RNA, 22 nt, Human
aucuguggaaauuggcaagugc

SEQ ID NO: 199491 - RNA, 17 nt, Human
uuucugcaugauuggac

SEQ ID NO: 199492 - RNA, 22 nt, Human
auuuugaaucaccuuggaagaa

SEQ ID NO: 199493 - RNA, 22 nt, Human
ccaggugugucuggccccgaag

SEQ ID NO: 199494 - RNA, 22 nt, Human
cauaauaucuccgauuacuugc

SEQ ID NO: 199495 - RNA, 22 nt, Human
ugagacagucccaugaucugca

SEQ ID NO: 199496 - RNA, 22 nt, Human
ugccagcccaccuuggggccuc

SEQ ID NO: 199497 - RNA, 22 nt, Human
uccuagaggaugguaggaagcu

SEQ ID NO: 199498 - RNA, 22 nt, Human
acuuguuugaaucucucuagag

SEQ ID NO: 199499 - RNA, 22 nt, Human
agagcuggguggacuuguaguu

SEQ ID NO: 199500 - RNA, 22 nt, Human
uagcuuuaaaaaucaucaaagc

SEQ ID NO: 199501 - RNA, 22 nt, Human
ccagagaccagaacauggggau

SEQ ID NO: 199502 - RNA, 18 nt, Human
gagcccugagucugcaca

SEQ ID NO: 199503 - RNA, 22 nt, Human
aucacaaaggcugcuucaugau

SEQ ID NO: 199504 - RNA, 22 nt, Human
uuuagagagaaauaaaugagau

SEQ ID NO: 199505 - RNA, 22 nt, Human
uucaaaaugcacaaagggcuag

SEQ ID NO: 199506 - RNA, 22 nt, Human
aacacaguccugcucacuuauu

SEQ ID NO: 199507 - RNA, 22 nt, Human
ccugugcaauguugagguuuca

SEQ ID NO: 199508 - RNA, 22 nt, Human
cagaagguuugaaagaugucuu

SEQ ID NO: 199509 - RNA, 22 nt, Human
agcagggcuuugcagacuuggg

SEQ ID NO: 199510 - RNA, 22 nt, Human
acugugcauuugucaugggguu

SEQ ID NO: 199511 - RNA, 22 nt, Human
agggagaaaauuggaugcacaa

SEQ ID NO: 199512 - RNA, 23 nt, Human
ucucugcauguccugagcacauc

SEQ ID NO: 199513 - RNA, 23 nt, Human
aagcaucuuuuccuagcuccauc

SEQ ID NO: 199514 - RNA, 22 nt, Human
uaaagcuguucagugcagaaag

SEQ ID NO: 199515 - RNA, 22 nt, Human
aggcauggacauuucggcagcu

SEQ ID NO: 199516 - RNA, 22 nt, Human
gggcagauggggcacaggcuga

SEQ ID NO: 199517 - RNA, 22 nt, Human
uuucuaaaauagauuuuauggu

SEQ ID NO: 199518 - RNA, 22 nt, Human
uccuagggauucaacacugaac

SEQ ID NO: 199519 - RNA, 23 nt, Human
agagagaguuugugucagguacc

SEQ ID NO: 199520 - RNA, 22 nt, Human
uucuuuaaaugaauucucugua

SEQ ID NO: 199521 - RNA, 22 nt, Human
augcuaaagcuuugcuuucauu

SEQ ID NO: 199522 - RNA, 22 nt, Human
ccugcccuaauccagagacuag

SEQ ID NO: 199523 - RNA, 22 nt, Human
aguuuccuugggcauuuguuua

SEQ ID NO: 199524 - RNA, 22 nt, Human
acauuugacucuguucauauua

SEQ ID NO: 199525 - RNA, 22 nt, Human
ccugcaggggagagacuucuag

SEQ ID NO: 199526 - RNA, 22 nt, Human
aauaugcauuauacagacugau

SEQ ID NO: 199527 - RNA, 22 nt, Human
cagcugguguccagggaagugg

SEQ ID NO: 199528 - RNA, 22 nt, Human
ucccugcacagccgagccaugc

SEQ ID NO: 199529 - RNA, 22 nt, Human
ugugagguaacgcugcucuguu

SEQ ID NO: 199530 - RNA, 22 nt, Human
gucucuguuauuuccaggguca

SEQ ID NO: 199531 - RNA, 22 nt, Human
ucagggacagggugcugcugcg

SEQ ID NO: 199532 - RNA, 22 nt, Human
acagugucuccugguacccagu

SEQ ID NO: 199533 - RNA, 22 nt, Human
gugcccucacaaaguggaaaga

SEQ ID NO: 199534 - RNA, 22 nt, Human
aguggaauguagaaaaaagaug

SEQ ID NO: 199535 - RNA, 19 nt, Human
ucuguggcaccugggaggg

SEQ ID NO: 199536 - RNA, 22 nt, Human
guuucucacuuaccaacacaug

SEQ ID NO: 199537 - RNA, 22 nt, Human
ugcccuggaaccaucuacaguc

SEQ ID NO: 199538 - RNA, 22 nt, Human
agggagaggcugaacuauccua

SEQ ID NO: 199539 - RNA, 22 nt, Human
cucucagguagagcccaagaau

SEQ ID NO: 199540 - RNA, 22 nt, Human
gcaccugccugggacugaagau

SEQ ID NO: 199541 - RNA, 20 nt, Human
cuggcuucgggaacuaguuu

SEQ ID NO: 199542 - RNA, 22 nt, Human
uucuauugggaagugugagagu

SEQ ID NO: 199543 - RNA, 22 nt, Human
uagaggaaauuuccaaggugag

SEQ ID NO: 199544 - RNA, 20 nt, Human
uaacaggaagcauuauuuua

SEQ ID NO: 199545 - RNA, 22 nt, Human
gaugcugauuauuucuugcuag

SEQ ID NO: 199546 - RNA, 22 nt, Human
cuacaacauuaugcuuucuguc

SEQ ID NO: 199547 - RNA, 22 nt, Human
cugcagggaacugaggcccaga

SEQ ID NO: 199548 - RNA, 22 nt, Human
caggccucuauggucagcugag

SEQ ID NO: 199549 - RNA, 22 nt, Human
auucucaauuuugccaaagggu

SEQ ID NO: 199550 - RNA, 22 nt, Human
gugaggcaagggcauacuaggc

SEQ ID NO: 199551 - RNA, 22 nt, Human
ccaugaguagcgauuucauuuu

SEQ ID NO: 199552 - RNA, 22 nt, Human
caggccagugggaaauagggau

SEQ ID NO: 199553 - RNA, 22 nt, Human
augcacaggugcugaugcacgc

SEQ ID NO: 199554 - RNA, 22 nt, Human
agguagaaggaccagaauuuau

SEQ ID NO: 199555 - RNA, 22 nt, Human
caguucaggccggcugacucag

SEQ ID NO: 199556 - RNA, 20 nt, Human
acuuuacugagcuguaauuc

SEQ ID NO: 199557 - RNA, 22 nt, Human
cuguggcuuuggggcggaggac

SEQ ID NO: 199558 - RNA, 22 nt, Human
agucuucuuucauuuacucagu

SEQ ID NO: 199559 - RNA, 22 nt, Human
acuuccuuuugggaaacuguuu

SEQ ID NO: 199560 - RNA, 22 nt, Human
auucucugugucugcuuuccca

SEQ ID NO: 199561 - RNA, 22 nt, Human
gcugccuguguggccacucacu

SEQ ID NO: 199562 - RNA, 17 nt, Human
gcacagugauauuauuu

SEQ ID NO: 199563 - RNA, 22 nt, Human
cagugauauuuauccuacucac

SEQ ID NO: 199564 - RNA, 22 nt, Human
caguggcaaugggacagagcac

SEQ ID NO: 199565 - RNA, 22 nt, Human
agaccauagggaccucagguug

SEQ ID NO: 199566 - RNA, 22 nt, Human
cucaccugggucagacaguugu

SEQ ID NO: 199567 - RNA, 22 nt, Human
caggacagugcagguccauccu

SEQ ID NO: 199568 - RNA, 22 nt, Human
agagauuugucaaugauuucca

SEQ ID NO: 199569 - RNA, 21 nt, Human
ucacagacuggucagugaggc

SEQ ID NO: 199570 - RNA, 22 nt, Human
gcccagggugaagugcaguugu

SEQ ID NO: 199571 - RNA, 22 nt, Human
uggcugaguuucaugcaucaug

SEQ ID NO: 199572 - RNA, 22 nt, Human
gauguguccccagaggauugaa

SEQ ID NO: 199573 - RNA, 18 nt, Human
acaggccucaguccugca

SEQ ID NO: 199574 - RNA, 19 nt, Human
cugcagggaugugcagagu

SEQ ID NO: 199575 - RNA, 22 nt, Human
gagggcagaaaauuaugcggug

SEQ ID NO: 199576 - RNA, 22 nt, Human
ggcaggcuagcacugauguccu

SEQ ID NO: 199577 - RNA, 22 nt, Human
augagcucauccgagucacacu

SEQ ID NO: 199578 - RNA, 22 nt, Human
gggcuccaacuacaucagccuu

SEQ ID NO: 199579 - RNA, 21 nt, Human
gauuuaguggcuguucuaccu

SEQ ID NO: 199580 - RNA, 22 nt, Human
cuccaggcuggauccaagucaa

SEQ ID NO: 199581 - RNA, 22 nt, Human
augauuacucccauuugauaga

SEQ ID NO: 199582 - RNA, 22 nt, Human
cuauaacuggguauuagacuac

SEQ ID NO: 199583 - RNA, 22 nt, Human
gcaaagugaaauggggcagaga

SEQ ID NO: 199584 - RNA, 22 nt, Human
uauauguuucuuacaaaauauu

SEQ ID NO: 199585 - RNA, 22 nt, Human
aacaguuuaucaaguuuuuaca

SEQ ID NO: 199586 - RNA, 22 nt, Human
uugcagggcaucuaugucuggu

SEQ ID NO: 199587 - RNA, 22 nt, Human
aggcagcccugugcuggaugcu

SEQ ID NO: 199588 - RNA, 22 nt, Human
uaauugaacuaacaugcaaaca

SEQ ID NO: 199589 - RNA, 22 nt, Human
uccagcauuuuucaauagaauu

SEQ ID NO: 199590 - RNA, 22 nt, Human
cucugaaagcaaaacuagagaa

SEQ ID NO: 199591 - RNA, 22 nt, Human
ucucaggaagauuagggcuaag

SEQ ID NO: 199592 - RNA, 22 nt, Human
gguaacaguuacaguaacagua

SEQ ID NO: 199593 - RNA, 15 nt, Human
cauaucacugggaau

SEQ ID NO: 199594 - RNA, 22 nt, Human
uacaguaauaaaaugagcuaca

SEQ ID NO: 199595 - RNA, 22 nt, Human
aaacugugagcuaguaaauagg

SEQ ID NO: 199596 - RNA, 22 nt, Human
augcuuucucuuaguucauuga

SEQ ID NO: 199597 - RNA, 22 nt, Human
aucuccaguuagcaguacugau

SEQ ID NO: 199598 - RNA, 22 nt, Human
uuucuuauauucugucauuguu

SEQ ID NO: 199599 - RNA, 22 nt, Human
ugacagacuacugccucuauug

SEQ ID NO: 199600 - RNA, 23 nt, Human
uggcucagcuaguuuuccauuuc

SEQ ID NO: 199601 - RNA, 22 nt, Human
gaacaguaacugucugcugugu

SEQ ID NO: 199602 - RNA, 22 nt, Human
aaacuuuguucguccagacuca

SEQ ID NO: 199603 - RNA, 22 nt, Human
uagguguccauauaugugugua

SEQ ID NO: 199604 - RNA, 22 nt, Human
gcacuggagaauggcuguauuc

SEQ ID NO: 199605 - RNA, 22 nt, Human
cucugcugcuuugccaguggaa

SEQ ID NO: 199606 - RNA, 22 nt, Human
agggccaguaaauguuuccuca

SEQ ID NO: 199607 - RNA, 22 nt, Human
uaccucaugcuguacagcacgu

SEQ ID NO: 199608 - RNA, 22 nt, Human
agauccauuuuggugucaacuc

SEQ ID NO: 199609 - RNA, 23 nt, Human
ugcaacaaugaggaaagcuacug

SEQ ID NO: 199610 - RNA, 22 nt, Human
aagaguuugucagaucugcacg

SEQ ID NO: 199611 - RNA, 22 nt, Human
ggcucuggcguccaauggagcg

SEQ ID NO: 199612 - RNA, 20 nt, Human
uccuaauaaccugaagaaau

SEQ ID NO: 199613 - RNA, 22 nt, Human
cucucugaggcaggccuguggg

SEQ ID NO: 199614 - RNA, 22 nt, Human
uggcucaaguaacaaaaauaua

SEQ ID NO: 199615 - RNA, 22 nt, Human
uaguuuaugauuuuuuggaagg

SEQ ID NO: 199616 - RNA, 16 nt, Human
agccaggcugccucgg

SEQ ID NO: 199617 - RNA, 22 nt, Human
augaaauucaucugagaaugcu

SEQ ID NO: 199618 - RNA, 22 nt, Human
gugaggugccuaauaccgugac

SEQ ID NO: 199619 - RNA, 22 nt, Human
acacuuucuggagcugcacaua

SEQ ID NO: 199620 - RNA, 22 nt, Human
cugggaaggggaagguccucuc

SEQ ID NO: 199621 - RNA, 22 nt, Human
uccaggcacuauauauacuuuu

SEQ ID NO: 199622 - RNA, 22 nt, Human
gauuuucauuugcacucuagaa

SEQ ID NO: 199623 - RNA, 19 nt, Human
gcucagcagacccagugcu

SEQ ID NO: 199624 - RNA, 22 nt, Human
auucauguagugauugagucac

SEQ ID NO: 199625 - RNA, 22 nt, Human
ugaggaugagaugagauaacac

SEQ ID NO: 199626 - RNA, 22 nt, Human
ucacucugcugcccgagggcug

SEQ ID NO: 199627 - RNA, 22 nt, Human
uuuguacauauauaaaaucugu

SEQ ID NO: 199628 - RNA, 22 nt, Human
uacauccaaaugaauuagaauu

SEQ ID NO: 199629 - RNA, 22 nt, Human
aauuucagaugucauaaauaua

SEQ ID NO: 199630 - RNA, 22 nt, Human
ccauuuggcaagaaagagucau

SEQ ID NO: 199631 - RNA, 22 nt, Human
ugcagcagagugggccugggug

SEQ ID NO: 199632 - RNA, 22 nt, Human
gccugcuuccuuuucauagaug

SEQ ID NO: 199633 - RNA, 22 nt, Human
auuagggaaggauuuggccuga

SEQ ID NO: 199634 - RNA, 22 nt, Human
guauuuuucaguuaggagcuua

SEQ ID NO: 199635 - RNA, 22 nt, Human
cuccaggcuggggugcagguug

SEQ ID NO: 199636 - RNA, 22 nt, Human
ccuccaggaggaaauggaacac

SEQ ID NO: 199637 - RNA, 22 nt, Human
acuuagaagaugcaguaaagca

SEQ ID NO: 199638 - RNA, 22 nt, Human
ucaauuucuugguuugauaaua

SEQ ID NO: 199639 - RNA, 22 nt, Human
auggaguucugccagcgcugcu

SEQ ID NO: 199640 - RNA, 22 nt, Human
uugugaauggugccgcaauaaa

SEQ ID NO: 199641 - RNA, 22 nt, Human
caagauggguguugugaugguu

SEQ ID NO: 199642 - RNA, 22 nt, Human
uggcccagggaguucauggugu

SEQ ID NO: 199643 - RNA, 22 nt, Human
ugguuagaggcuucuugcuugg

SEQ ID NO: 199644 - RNA, 22 nt, Human
ccacauuuuugauacucucacu

SEQ ID NO: 199645 - RNA, 22 nt, Human
aggaaaaugaaacagcaacugu

SEQ ID NO: 199646 - RNA, 23 nt, Human
ugagagccuggcagccuggguuc

SEQ ID NO: 199647 - RNA, 22 nt, Human
aucacaauguacguuaaaaugu

SEQ ID NO: 199648 - RNA, 22 nt, Human
uccuucaaaaguugagagagcc

SEQ ID NO: 199649 - RNA, 22 nt, Human
ucuaggaauguucuuagggauu

SEQ ID NO: 199650 - RNA, 22 nt, Human
gugcagcucaguugaaaugcag

SEQ ID NO: 199651 - RNA, 22 nt, Human
uauaugcaauuuuuuagugcaa

SEQ ID NO: 199652 - RNA, 22 nt, Human
uuauuccaauuucuccuacaaa

SEQ ID NO: 199653 - RNA, 22 nt, Human
cucugggcaggaccaguggacc

SEQ ID NO: 199654 - RNA, 22 nt, Human
cugcuaaaccucucugagagcu

SEQ ID NO: 199655 - RNA, 22 nt, Human
aagugcaggucucagcuacucu

SEQ ID NO: 199656 - RNA, 22 nt, Human
aauagugaacaggaacaugcuu

SEQ ID NO: 199657 - RNA, 18 nt, Human
ggucacugagaugcuacu

SEQ ID NO: 199658 - RNA, 17 nt, Human
aggugcuggagcaucag

SEQ ID NO: 199659 - RNA, 22 nt, Human
cauggaggacccucagggagcu

SEQ ID NO: 199660 - RNA, 22 nt, Human
gaggugucaucaggcagcucug

SEQ ID NO: 199661 - RNA, 22 nt, Human
agcacagacuggucccaggucu

SEQ ID NO: 199662 - RNA, 22 nt, Human
cagggcaggacagauacauuac

SEQ ID NO: 199663 - RNA, 22 nt, Human
cccaggucuccugcuucccagg

SEQ ID NO: 199664 - RNA, 22 nt, Human
aauuuaagagcauagcuccaac

SEQ ID NO: 199665 - RNA, 22 nt, Human
uggcuggcaguaggcuaguggc

SEQ ID NO: 199666 - RNA, 22 nt, Human
uccugggacccugggugcagag

SEQ ID NO: 199667 - RNA, 22 nt, Human
auuccauuguauguguagacua

SEQ ID NO: 199668 - RNA, 22 nt, Human
ucccucucccuauugccuggag

SEQ ID NO: 199669 - RNA, 22 nt, Human
agaccuggauuccaauccuacc

SEQ ID NO: 199670 - RNA, 23 nt, Human
cagagcuggcucagagcugccug

SEQ ID NO: 199671 - RNA, 22 nt, Human
ucuagggagcucuagcaguggu

SEQ ID NO: 199672 - RNA, 22 nt, Human
caggccugugaguugaggcccc

SEQ ID NO: 199673 - RNA, 16 nt, Human
ugagugggagaagggg

SEQ ID NO: 199674 - RNA, 20 nt, Human
gcauguguauggaaggggga

SEQ ID NO: 199675 - RNA, 22 nt, Human
aauacuugugaauucaaagucu

SEQ ID NO: 199676 - RNA, 22 nt, Human
ggaaggaggggcaaagcaguuc

SEQ ID NO: 199677 - RNA, 22 nt, Human
ucaggcucuacacuugacacac

SEQ ID NO: 199678 - RNA, 22 nt, Human
cuggaauugcauaauauguccu

SEQ ID NO: 199679 - RNA, 21 nt, Human
ccuggccaaucugauaggguu

SEQ ID NO: 199680 - RNA, 22 nt, Human
aggcuuggcuggcagcccuggg

SEQ ID NO: 199681 - RNA, 22 nt, Human
uaaaugucuuugucacguuggg

SEQ ID NO: 199682 - RNA, 22 nt, Human
uggcagggugggcuucagcccc

SEQ ID NO: 199683 - RNA, 22 nt, Human
aaagcacugcacauauauuugc

SEQ ID NO: 199684 - RNA, 22 nt, Human
aaaucuagaaguuuaaaaggau

SEQ ID NO: 199685 - RNA, 22 nt, Human
gcagggcaugggcccugucugc

SEQ ID NO: 199686 - RNA, 19 nt, Human
cuggggcuuugguacugcc

SEQ ID NO: 199687 - RNA, 22 nt, Human
ccugucuguccucucaugagcc

SEQ ID NO: 199688 - RNA, 22 nt, Human
ccacaucucccuauugcucuuu

SEQ ID NO: 199689 - RNA, 20 nt, Human
aagauucauuguaauuaggg

SEQ ID NO: 199690 - RNA, 22 nt, Human
uggauuucuccagcucuccauu

SEQ ID NO: 199691 - RNA, 22 nt, Human
gauacacacccuugauaggacu

SEQ ID NO: 199692 - RNA, 22 nt, Human
agcuuccugacuggugcucuua

SEQ ID NO: 199693 - RNA, 22 nt, Human
uuucugauauacuguagaaucc

SEQ ID NO: 199694 - RNA, 22 nt, Human
uccagcccugugucugggagag

SEQ ID NO: 199695 - RNA, 22 nt, Human
uggaagagcaggcagacaaugc

SEQ ID NO: 199696 - RNA, 22 nt, Human
gggucccuggaauuacuugaca

SEQ ID NO: 199697 - RNA, 22 nt, Human
aaguuaacccaguauuucuuuu

SEQ ID NO: 199698 - RNA, 22 nt, Human
guauuuuuaguagagucggggu

SEQ ID NO: 199699 - RNA, 22 nt, Human
gucuggugggauuccaaguggc

SEQ ID NO: 199700 - RNA, 22 nt, Human
gcauggcucuggccucagugug

SEQ ID NO: 199701 - RNA, 22 nt, Human
ccuugcucucccaagcccgcag

SEQ ID NO: 199702 - RNA, 22 nt, Human
cacagcgugaugaauguagcgu

SEQ ID NO: 199703 - RNA, 22 nt, Human
gcaggagcccuggcauguucuu

SEQ ID NO: 199704 - RNA, 22 nt, Human
agcaggugacccaagcaggcug

SEQ ID NO: 199705 - RNA, 22 nt, Human
acucugcuguuuacucucuaua

SEQ ID NO: 199706 - RNA, 22 nt, Human
cagaagccugccucagaugcac

SEQ ID NO: 199707 - RNA, 22 nt, Human
cacaucugaaaagaugcacaag

SEQ ID NO: 199708 - RNA, 22 nt, Human
aagcaggauggagguugaguua

SEQ ID NO: 199709 - RNA, 22 nt, Human
acugagacugaaucugaaugau

SEQ ID NO: 199710 - RNA, 23 nt, Human
ucaaacagguuucagagcaucuu

SEQ ID NO: 199711 - RNA, 22 nt, Human
guuggcuauagggagauggggc

SEQ ID NO: 199712 - RNA, 22 nt, Human
ccccagccagcaggaccucuga

SEQ ID NO: 199713 - RNA, 22 nt, Human
ggacccugggcuugcuccuggg

SEQ ID NO: 199714 - RNA, 22 nt, Human
uuuuagauaguuuaacugcacu

SEQ ID NO: 199715 - RNA, 22 nt, Human
ucuccagggcagagaauagcaa

SEQ ID NO: 199716 - RNA, 22 nt, Human
aggaccagugagucuggcaagu

SEQ ID NO: 199717 - RNA, 22 nt, Human
uccuucccaggugucgccgccu

SEQ ID NO: 199718 - RNA, 22 nt, Human
caugaaauaugcuaccugucuu

SEQ ID NO: 199719 - RNA, 22 nt, Human
uuggcugcuggucuuuggauau

SEQ ID NO: 199720 - RNA, 22 nt, Human
guggcauuaggccaggugcaua

SEQ ID NO: 199721 - RNA, 22 nt, Human
aaucagaaaauucaguggaauu

SEQ ID NO: 199722 - RNA, 22 nt, Human
cuccagugucucagagcagaug

SEQ ID NO: 199723 - RNA, 22 nt, Human
cccaggcagagagcuggugagc

SEQ ID NO: 199724 - RNA, 22 nt, Human
auguuuccagauaugucacccu

SEQ ID NO: 199725 - RNA, 22 nt, Human
cauuucacaguaaagugauuuc

SEQ ID NO: 199726 - RNA, 22 nt, Human
ucugaggcccugcaggcagugu

SEQ ID NO: 199727 - RNA, 22 nt, Human
guuuuccugaaacugauggugu

SEQ ID NO: 199728 - RNA, 22 nt, Human
uauuaacaugaacugacuuuuc

SEQ ID NO: 199729 - RNA, 22 nt, Human
ggggugugaguagagcugggga

SEQ ID NO: 199730 - RNA, 22 nt, Human
augauuuguuaacagacuuaau

SEQ ID NO: 199731 - RNA, 22 nt, Human
ucacuacaaccgcuaccugaca

SEQ ID NO: 199732 - RNA, 22 nt, Human
cuccaggaaagccugaggcccg

SEQ ID NO: 199733 - RNA, 22 nt, Human
gaaggcaucacagaggcuguga

SEQ ID NO: 199734 - RNA, 22 nt, Human
gcugccuugaacuuggccuggg

SEQ ID NO: 199735 - RNA, 22 nt, Human
ugccuuuaacuuaaagcaugac

SEQ ID NO: 199736 - RNA, 22 nt, Human
aggcagguguugggagacacca

SEQ ID NO: 199737 - RNA, 22 nt, Human
gcagagugaagcauuucuuucu

SEQ ID NO: 199738 - RNA, 22 nt, Human
uaagugauuuguaguauacuau

SEQ ID NO: 199739 - RNA, 22 nt, Human
ucaccaggauuccuaucaguag

SEQ ID NO: 199740 - RNA, 22 nt, Human
caggacaggaguggggucaaag

SEQ ID NO: 199741 - RNA, 22 nt, Human
gccagugugucuugcaggcucc

SEQ ID NO: 199742 - RNA, 21 nt, Human
ucagagagucacagugaacug

SEQ ID NO: 199743 - RNA, 22 nt, Human
cacauuucucuaccucacacaa

SEQ ID NO: 199744 - RNA, 22 nt, Human
augcuagaagggagcacuaugu

SEQ ID NO: 199745 - RNA, 22 nt, Human
caauuuuauugguccaaauaca

SEQ ID NO: 199746 - RNA, 20 nt, Human
ucauguguguccuacagaga

SEQ ID NO: 199747 - RNA, 20 nt, Human
ucagagucaucaaagauggu

SEQ ID NO: 199748 - RNA, 22 nt, Human
aggucuggcucuucuccacaga

SEQ ID NO: 199749 - RNA, 22 nt, Human
uggcucaguuucaguccugguu

SEQ ID NO: 199750 - RNA, 22 nt, Human
ucaagcagcuuuuacagaagag

SEQ ID NO: 199751 - RNA, 22 nt, Human
aagucugagugucagugcaagu

SEQ ID NO: 199752 - RNA, 22 nt, Human
agaaggcaucagaaguguguag

SEQ ID NO: 199753 - RNA, 21 nt, Human
cuuguuccaagcaugucugag

SEQ ID NO: 199754 - RNA, 22 nt, Human
auauuuguuagagucuaugugu

SEQ ID NO: 199755 - RNA, 22 nt, Human
uaugcaacaucugguagaaauc

SEQ ID NO: 199756 - RNA, 19 nt, Human
uagugaguagugaauuaga

SEQ ID NO: 199757 - RNA, 21 nt, Human
aggcucagagaucaaacagua

SEQ ID NO: 199758 - RNA, 22 nt, Human
ugcaggaauuuuuugcagaaag

SEQ ID NO: 199759 - RNA, 22 nt, Human
uacaguaagaugaaauagcaau

SEQ ID NO: 199760 - RNA, 22 nt, Human
aaaugcaaggauuuuguuaggc

SEQ ID NO: 199761 - RNA, 22 nt, Human
uucaguguucuuuucuguuagc

SEQ ID NO: 199762 - RNA, 22 nt, Human
ucaggaaagaguaauguauaca

SEQ ID NO: 199763 - RNA, 22 nt, Human
cucucaaaugucauuccucuau

SEQ ID NO: 199764 - RNA, 22 nt, Human
auuuuacuuugugaauauugac

SEQ ID NO: 199765 - RNA, 22 nt, Human
cauaaaguaaagaugucuucca

SEQ ID NO: 199766 - RNA, 22 nt, Human
uuucuccuccagagagacacag

SEQ ID NO: 199767 - RNA, 22 nt, Human
cuaaauuauuugcacauuagag

SEQ ID NO: 199768 - RNA, 21 nt, Human
uugacaggaaagaggggagau

SEQ ID NO: 199769 - RNA, 22 nt, Human
guuguaaauacagcagauaauu

SEQ ID NO: 199770 - RNA, 22 nt, Human
ccucauggccuugagcugaggg

SEQ ID NO: 199771 - RNA, 22 nt, Human
ggucuccagcugggacccugca

SEQ ID NO: 199772 - RNA, 22 nt, Human
guaacacuagcucugucacuuu

SEQ ID NO: 199773 - RNA, 17 nt, Human
ccaggugggaggugggg

SEQ ID NO: 199774 - RNA, 22 nt, Human
auucucugucuuuuugaaaaca

SEQ ID NO: 199775 - RNA, 22 nt, Human
cugggcaguuuauucaguucug

SEQ ID NO: 199776 - RNA, 22 nt, Human
caucuccagguuuagggagcac

SEQ ID NO: 199777 - RNA, 22 nt, Human
agcagggcuuugucucugugaa

SEQ ID NO: 199778 - RNA, 22 nt, Human
gcaggggcuaaggacacagaga

SEQ ID NO: 199779 - RNA, 21 nt, Human
aaaugcuuuguauauaucugu

SEQ ID NO: 199780 - RNA, 22 nt, Human
auggccugcagugcugccacag

SEQ ID NO: 199781 - RNA, 22 nt, Human
acaggaaauuggcauaucaguu

SEQ ID NO: 199782 - RNA, 22 nt, Human
cagagucuuguguguucagccc

SEQ ID NO: 199783 - RNA, 22 nt, Human
cagagcccuuggcuggagccca

SEQ ID NO: 199784 - RNA, 22 nt, Human
cuucuugugcugggccagcuuc

SEQ ID NO: 199785 - RNA, 22 nt, Human
gagcaagaguguuggacuuuga

SEQ ID NO: 199786 - RNA, 22 nt, Human
ugcaguggaaucuggagagcag

SEQ ID NO: 199787 - RNA, 22 nt, Human
uucugauaauaccacaucgcag

SEQ ID NO: 199788 - RNA, 22 nt, Human
uugacccagcuuuccccacaau

SEQ ID NO: 199789 - RNA, 22 nt, Human
aagcccaguuucacacugagac

SEQ ID NO: 199790 - RNA, 22 nt, Human
ugacaggggcugguggauaaau

SEQ ID NO: 199791 - RNA, 22 nt, Human
gcucugggaaguccuuuaccau

SEQ ID NO: 199792 - RNA, 22 nt, Human
augaaauaucuugaagaaauuc

SEQ ID NO: 199793 - RNA, 20 nt, Human
uggaagaagaacucaggcuu

SEQ ID NO: 199794 - RNA, 22 nt, Human
ugucagcaguaucucuaucuca

SEQ ID NO: 199795 - RNA, 22 nt, Human
uggagaaggccggccaggagug

SEQ ID NO: 199796 - RNA, 22 nt, Human
uaguuacagaagauaaggguau

SEQ ID NO: 199797 - RNA, 22 nt, Human
aaagcagugcugugagaacacu

SEQ ID NO: 199798 - RNA, 22 nt, Human
cacagggcuaaaugaaggguug

SEQ ID NO: 199799 - RNA, 22 nt, Human
uauggaaagggaguuuaauuug

SEQ ID NO: 199800 - RNA, 22 nt, Human
aaagccauaagccuaauacuaa

SEQ ID NO: 199801 - RNA, 22 nt, Human
cuguggcuggccugucugacau

SEQ ID NO: 199802 - RNA, 22 nt, Human
guccuuggcuugaggcaccuca

SEQ ID NO: 199803 - RNA, 22 nt, Human
guaacauuauucaugagauaca

SEQ ID NO: 199804 - RNA, 22 nt, Human
gcacaguaggcucagcucuauc

SEQ ID NO: 199805 - RNA, 22 nt, Human
cccaaguauuccuccucugccc

SEQ ID NO: 199806 - RNA, 22 nt, Human
auuucgauagaccuaacaauug

SEQ ID NO: 199807 - RNA, 22 nt, Human
auuuccaucaucauuaggccua

SEQ ID NO: 199808 - RNA, 22 nt, Human
agacacauuuucagcucugcca

SEQ ID NO: 199809 - RNA, 22 nt, Human
guuuauaaggcccaauauuucu

SEQ ID NO: 199810 - RNA, 22 nt, Human
ugaaugaguuuggcugcuguuc

SEQ ID NO: 199811 - RNA, 22 nt, Human
aauguacagcugcugcugaagg

SEQ ID NO: 199812 - RNA, 19 nt, Human
acacaaugacacauauaua

SEQ ID NO: 199813 - RNA, 22 nt, Human
aaauagcagccuuuaguuaaca

SEQ ID NO: 199814 - RNA, 22 nt, Human
agggagccuuccuggcuguggu

SEQ ID NO: 199815 - RNA, 23 nt, Human
uuuguucaucauuagagucuagc

SEQ ID NO: 199816 - RNA, 22 nt, Human
ugagccaggucucacucaccuu

SEQ ID NO: 199817 - RNA, 22 nt, Human
uuuucucuauauugucugugaa

SEQ ID NO: 199818 - RNA, 17 nt, Human
ccccuaccuccguuuga

SEQ ID NO: 199819 - RNA, 22 nt, Human
ucuucagaaaauuaucacuugu

SEQ ID NO: 199820 - RNA, 22 nt, Human
ccagcugguaagugauggagcc

SEQ ID NO: 199821 - RNA, 22 nt, Human
uccaauguuccugcuuucagcu

SEQ ID NO: 199822 - RNA, 22 nt, Human
agaggauugaucaaacacugca

SEQ ID NO: 199823 - RNA, 22 nt, Human
uggcucaguuaggucagaaaca

SEQ ID NO: 199824 - RNA, 22 nt, Human
uuuacagcauugcugaaaguuc

SEQ ID NO: 199825 - RNA, 22 nt, Human
ugggagagagaauucccagugg

SEQ ID NO: 199826 - RNA, 22 nt, Human
ggcacagggagccgcaguugca

SEQ ID NO: 199827 - RNA, 22 nt, Human
cagcuauugguccacagguaug

SEQ ID NO: 199828 - RNA, 22 nt, Human
ggcaggagcucuccaguuugcc

SEQ ID NO: 199829 - RNA, 22 nt, Human
auggccaaauaacagcuugcau

SEQ ID NO: 199830 - RNA, 22 nt, Human
gacaacugagcagaggaaauga

SEQ ID NO: 199831 - RNA, 22 nt, Human
aauuuuauuaacuggauguagc

SEQ ID NO: 199832 - RNA, 20 nt, Human
cuuagaagggacauccuggg

SEQ ID NO: 199833 - RNA, 22 nt, Human
uuguguccuaagcaccagaugg

SEQ ID NO: 199834 - RNA, 22 nt, Human
uguuuuaaagccauugccuuuc

SEQ ID NO: 199835 - RNA, 22 nt, Human
agggccagccccacccucucug

SEQ ID NO: 199836 - RNA, 22 nt, Human
caggaaaucagaacucaagugg

SEQ ID NO: 199837 - RNA, 22 nt, Human
cauuugauccucacaacaaucu

SEQ ID NO: 199838 - RNA, 22 nt, Human
uuacuacaagauucuguuuuau

SEQ ID NO: 199839 - RNA, 22 nt, Human
gagccaagggcgugcuggagag

SEQ ID NO: 199840 - RNA, 22 nt, Human
ugcuuuauggagcccaucucau

SEQ ID NO: 199841 - RNA, 16 nt, Human
uugaaugacugugugc

SEQ ID NO: 199842 - RNA, 22 nt, Human
cugggacagcugagacaggaga

SEQ ID NO: 199843 - RNA, 22 nt, Human
uuggaaaugauuucuauuauua

SEQ ID NO: 199844 - RNA, 22 nt, Human
gcacugcaucuacuggcaagua

SEQ ID NO: 199845 - RNA, 22 nt, Human
uccugcagccuugggcuggagc

SEQ ID NO: 199846 - RNA, 22 nt, Human
aguguccuugagguuccuagga

SEQ ID NO: 199847 - RNA, 22 nt, Human
guuguacauaugaggauaaguu

SEQ ID NO: 199848 - RNA, 22 nt, Human
uggucagguaccucuggcuguc

SEQ ID NO: 199849 - RNA, 22 nt, Human
ggggucugggcuuagcuggaau

SEQ ID NO: 199850 - RNA, 22 nt, Human
gcuauguucccuuuugcuauaa

SEQ ID NO: 199851 - RNA, 18 nt, Human
ucuggagggaagcuuuga

SEQ ID NO: 199852 - RNA, 22 nt, Human
ugcagagaccacugugccuucc

SEQ ID NO: 199853 - RNA, 20 nt, Human
cucagugcuuucauugccuc

SEQ ID NO: 199854 - RNA, 22 nt, Human
uugcucauacucauguugugau

SEQ ID NO: 199855 - RNA, 22 nt, Human
ucugggcugugccaaagcucuu

SEQ ID NO: 199856 - RNA, 22 nt, Human
ugucagagagcaggcaguagaa

SEQ ID NO: 199857 - RNA, 22 nt, Human
ugaccugucacauuuugaugaa

SEQ ID NO: 199858 - RNA, 22 nt, Human
aaacuggugucacugagggcug

SEQ ID NO: 199859 - RNA, 22 nt, Human
gggaagggacuuguuuaagguc

SEQ ID NO: 199860 - RNA, 22 nt, Human
guccuuugaaggcaaaaggaga

SEQ ID NO: 199861 - RNA, 23 nt, Human
aggacugcucacuugaggcuucc

SEQ ID NO: 199862 - RNA, 22 nt, Human
aaggccaggggcuggcgccucc

SEQ ID NO: 199863 - RNA, 22 nt, Human
agcagugagugggaggaccaug

SEQ ID NO: 199864 - RNA, 22 nt, Human
uuuaaauaggacuccugggggu

SEQ ID NO: 199865 - RNA, 22 nt, Human
uccccaccuaagauacccaucu

SEQ ID NO: 199866 - RNA, 19 nt, Human
ccugugacuaucuuuguaa

SEQ ID NO: 199867 - RNA, 22 nt, Human
auucuggccuuggcucugucac

SEQ ID NO: 199868 - RNA, 22 nt, Human
auuacacaggcuggcucuuuga

SEQ ID NO: 199869 - RNA, 22 nt, Human
uggggacccggacuccuggguc

SEQ ID NO: 199870 - RNA, 22 nt, Human
uuuacugugcauuagaaucacc

SEQ ID NO: 199871 - RNA, 22 nt, Human
ucucagagcucacaccuccugg

SEQ ID NO: 199872 - RNA, 23 nt, Human
uucuuucaagaaguucacagugc

SEQ ID NO: 199873 - RNA, 21 nt, Human
uccugggagucugagauccug

SEQ ID NO: 199874 - RNA, 23 nt, Human
uggaagaaaaugguuuggcugug

SEQ ID NO: 199875 - RNA, 22 nt, Human
uuguguccuauaugcauguucu

SEQ ID NO: 199876 - RNA, 22 nt, Human
ugcagggagcucuggggugcag

SEQ ID NO: 199877 - RNA, 22 nt, Human
gcagagccaggcuggggcaggu

SEQ ID NO: 199878 - RNA, 22 nt, Human
gugugagagcaaaacugcagga

SEQ ID NO: 199879 - RNA, 18 nt, Human
uguuuauucuccugacag

SEQ ID NO: 199880 - RNA, 22 nt, Human
ccugggcucaccaugccuugga

SEQ ID NO: 199881 - RNA, 22 nt, Human
uccagcagccacaccucuggac

SEQ ID NO: 199882 - RNA, 22 nt, Human
gacacagaauuccccuccaagu

SEQ ID NO: 199883 - RNA, 22 nt, Human
ugucugagcuuuaugauggaag

SEQ ID NO: 199884 - RNA, 22 nt, Human
auugaaagcacaaagaacaagu

SEQ ID NO: 199885 - RNA, 17 nt, Human
uaaguuauagcagaaga

SEQ ID NO: 199886 - RNA, 22 nt, Human
agaguggcagcaaaaagugugc

SEQ ID NO: 199887 - RNA, 22 nt, Human
gagucagaugaagauaaaaggg

SEQ ID NO: 199888 - RNA, 22 nt, Human
ggagaaggcgaagucauucuuu

SEQ ID NO: 199889 - RNA, 22 nt, Human
aaggcuuuaugugaccaaaaga

SEQ ID NO: 199890 - RNA, 22 nt, Human
uccagagagccacggacagggg

SEQ ID NO: 199891 - RNA, 22 nt, Human
ugguggcaucacucagccuccc

SEQ ID NO: 199892 - RNA, 22 nt, Human
aggaaaaaagucugugauuaua

SEQ ID NO: 199893 - RNA, 22 nt, Human
ugccucugugggcagagcugcc

SEQ ID NO: 199894 - RNA, 22 nt, Human
aagugaaauugccauucuuaua

SEQ ID NO: 199895 - RNA, 18 nt, Human
aguccaugcauggcuaua

SEQ ID NO: 199896 - RNA, 22 nt, Human
aguuguaagagacagauauaaa

SEQ ID NO: 199897 - RNA, 22 nt, Human
cacaggagugcugcuauuguug

SEQ ID NO: 199898 - RNA, 19 nt, Human
uggcugggugccaauggcc

SEQ ID NO: 199899 - RNA, 22 nt, Human
cguguccuuuuagcuucagguc

SEQ ID NO: 199900 - RNA, 22 nt, Human
uugcagggcaggaccauggaca

SEQ ID NO: 199901 - RNA, 22 nt, Human
aacuggaagagugaauauaacu

SEQ ID NO: 199902 - RNA, 22 nt, Human
uuccaugccuagaacaggauuc

SEQ ID NO: 199903 - RNA, 22 nt, Human
acaggcugguuuguaaaagaug

SEQ ID NO: 199904 - RNA, 22 nt, Human
gcaugcagacagucugagacca

SEQ ID NO: 199905 - RNA, 22 nt, Human
uuaauaaaguaugaauuggaaa

SEQ ID NO: 199906 - RNA, 22 nt, Human
ugagcagggacuuugaguguag

SEQ ID NO: 199907 - RNA, 22 nt, Human
ucccugggguaacauuagaggg

SEQ ID NO: 199908 - RNA, 22 nt, Human
uuuguguggauggaaggcagua

SEQ ID NO: 199909 - RNA, 22 nt, Human
ccucaggcccugucccugcgcc

SEQ ID NO: 199910 - RNA, 22 nt, Human
cuggcuggccggagcgaggcgg

SEQ ID NO: 199911 - RNA, 22 nt, Human
uggcaaggcugugggggcagag

SEQ ID NO: 199912 - RNA, 22 nt, Human
gcagaauacugagagcugauug

SEQ ID NO: 199913 - RNA, 22 nt, Human
aaacccugcucuuauggaacuu

SEQ ID NO: 199914 - RNA, 22 nt, Human
ucaaucaaagcacugggcuuug

SEQ ID NO: 199915 - RNA, 19 nt, Human
aggcuuggcuagauuuacu

SEQ ID NO: 199916 - RNA, 21 nt, Human
ccuuuacaauuuugcauuccu

SEQ ID NO: 199917 - RNA, 22 nt, Human
uuuggaguuuaacaacuugaag

SEQ ID NO: 199918 - RNA, 22 nt, Human
agucucaagcaccgaaagcugu

SEQ ID NO: 199919 - RNA, 22 nt, Human
ucucagugacacucuucauaca

SEQ ID NO: 199920 - RNA, 22 nt, Human
uauguacaagcacacaugugac

SEQ ID NO: 199921 - RNA, 22 nt, Human
agaaucucuacucaaguacuug

SEQ ID NO: 199922 - RNA, 22 nt, Human
cugcaaaauuguucuuugcucc

SEQ ID NO: 199923 - RNA, 22 nt, Human
augucacagcaggaguauucuu

SEQ ID NO: 199924 - RNA, 22 nt, Human
cuuagaaggaacaguuuagugc

SEQ ID NO: 199925 - RNA, 22 nt, Human
aagaggaaaugauugacuauau

SEQ ID NO: 199926 - RNA, 22 nt, Human
aagcccuguccggggggaagaa

SEQ ID NO: 199927 - RNA, 18 nt, Human
gucagaggauggggaaau

SEQ ID NO: 199928 - RNA, 22 nt, Human
uagaaagcaaaauccuaccaag

SEQ ID NO: 199929 - RNA, 22 nt, Human
uggguccuugccaucuuggagu

SEQ ID NO: 199930 - RNA, 22 nt, Human
ccagugugaaaggucauuuauc

SEQ ID NO: 199931 - RNA, 22 nt, Human
auauauuuacucuccuguugca

SEQ ID NO: 199932 - RNA, 21 nt, Human
agcucagccgggcacaguggc

SEQ ID NO: 199933 - RNA, 17 nt, Human
uuuucucucuuggauuc

SEQ ID NO: 199934 - RNA, 22 nt, Human
aguccaggccuccucuuuuccu

SEQ ID NO: 199935 - RNA, 22 nt, Human
caauaacuaguaauuauuccgg

SEQ ID NO: 199936 - RNA, 22 nt, Human
uucugugcccauuuuaaaaugg

SEQ ID NO: 199937 - RNA, 22 nt, Human
cagcucagugaugccuucacag

SEQ ID NO: 199938 - RNA, 18 nt, Human
ucauuuugucugccuuug

SEQ ID NO: 199939 - RNA, 22 nt, Human
cacccccagcagggaaaggagg

SEQ ID NO: 199940 - RNA, 22 nt, Human
caccccagcuucucaggauaga

SEQ ID NO: 199941 - RNA, 22 nt, Human
gcugcccuacccgaggcacucu

SEQ ID NO: 199942 - RNA, 22 nt, Human
aagagucagcuucuguaugggu

SEQ ID NO: 199943 - RNA, 22 nt, Human
uaaaaccauuccugcuuucaug

SEQ ID NO: 199944 - RNA, 22 nt, Human
aagcacauuuuccagcagcucu

SEQ ID NO: 199945 - RNA, 22 nt, Human
gacagcagauaagaccucauca

SEQ ID NO: 199946 - RNA, 23 nt, Human
ucuagaaaaugaaagaaugcagu

SEQ ID NO: 199947 - RNA, 22 nt, Human
aggaaggacugcagcauuuggu

SEQ ID NO: 199948 - RNA, 22 nt, Human
agccagacucauuuggaaguau

SEQ ID NO: 199949 - RNA, 22 nt, Human
cacuggucagucggucagucuc

SEQ ID NO: 199950 - RNA, 19 nt, Human
auacagauguauccaugau

SEQ ID NO: 199951 - RNA, 22 nt, Human
cagccagcugaauguaccauga

SEQ ID NO: 199952 - RNA, 22 nt, Human
agcacugcuuuagagccucugc

SEQ ID NO: 199953 - RNA, 22 nt, Human
cuguggaagguuuagauaggua

SEQ ID NO: 199954 - RNA, 22 nt, Human
aaauacuguugaaugaaguaag

SEQ ID NO: 199955 - RNA, 22 nt, Human
gagcuggugaucagcuggagga

SEQ ID NO: 199956 - RNA, 22 nt, Human
uggcucuggggacaguaagucc

SEQ ID NO: 199957 - RNA, 22 nt, Human
aagcucagagucucggagggaa

SEQ ID NO: 199958 - RNA, 22 nt, Human
caugaaugcuggguucauguaa

SEQ ID NO: 199959 - RNA, 19 nt, Human
ucagcucuggggucagugg

SEQ ID NO: 199960 - RNA, 22 nt, Human
ucuucagauugcacugagcaag

SEQ ID NO: 199961 - RNA, 22 nt, Human
ggacccuggagacccacuggga

SEQ ID NO: 199962 - RNA, 22 nt, Human
cacccccaccugugggcuccug

SEQ ID NO: 199963 - RNA, 22 nt, Human
cuaugaaaggauuuggaguugu

SEQ ID NO: 199964 - RNA, 22 nt, Human
uggagcaggugccaggugugug

SEQ ID NO: 199965 - RNA, 22 nt, Human
cuguggaaggccuguccugaaa

SEQ ID NO: 199966 - RNA, 22 nt, Human
acacaguucaggaucaaauagc

SEQ ID NO: 199967 - RNA, 22 nt, Human
agcaucugcauaaugccuuccc

SEQ ID NO: 199968 - RNA, 22 nt, Human
uugagggucuggaucugcugcu

SEQ ID NO: 199969 - RNA, 23 nt, Human
ucaaaguaguuuuauccaauaaa

SEQ ID NO: 199970 - RNA, 22 nt, Human
cuucaguuagaguuuacaaagu

SEQ ID NO: 199971 - RNA, 21 nt, Human
acuuucuguggguucaagcau

SEQ ID NO: 199972 - RNA, 22 nt, Human
aauauaaauuccugggcccagc

SEQ ID NO: 199973 - RNA, 22 nt, Human
uuccuggggcuuagcaauggag

SEQ ID NO: 199974 - RNA, 22 nt, Human
ugaggcagugugagauaauaaa

SEQ ID NO: 199975 - RNA, 22 nt, Human
uuuggaaauacgcguaggcaga

SEQ ID NO: 199976 - RNA, 21 nt, Human
acauaacugucaaguaacguu

SEQ ID NO: 199977 - RNA, 22 nt, Human
ccaaaguccauaguuuacauaa

SEQ ID NO: 199978 - RNA, 22 nt, Human
caggaugcacuaggaaccaggg

SEQ ID NO: 199979 - RNA, 22 nt, Human
uucacaguggcugugccauuug

SEQ ID NO: 199980 - RNA, 22 nt, Human
uaagcaagauuuauugaauuuu

SEQ ID NO: 199981 - RNA, 22 nt, Human
agggcagcauugccuuucucca

SEQ ID NO: 199982 - RNA, 22 nt, Human
agagccuugaagaucuggaaaa

SEQ ID NO: 199983 - RNA, 22 nt, Human
cuuaaacugggcauucagagaa

SEQ ID NO: 199984 - RNA, 19 nt, Human
ccaggucuggggccagauu

SEQ ID NO: 199985 - RNA, 22 nt, Human
agacuacauuaugacagcauuu

SEQ ID NO: 199986 - RNA, 22 nt, Human
acucugggccccagguggagcu

SEQ ID NO: 199987 - RNA, 22 nt, Human
aggcaggcccucuggaaaggua

SEQ ID NO: 199988 - RNA, 22 nt, Human
gcccagcuggcuuccagcacau

SEQ ID NO: 199989 - RNA, 22 nt, Human
gggggcggagcacgugaccacg

SEQ ID NO: 199990 - RNA, 19 nt, Human
ccucuuccucugacacuau

SEQ ID NO: 199991 - RNA, 22 nt, Human
ucauucauugcuuacccugugu

SEQ ID NO: 199992 - RNA, 22 nt, Human
uauugcugaggauugaggcuug

SEQ ID NO: 199993 - RNA, 22 nt, Human
cccuccagagccuggacauucu

SEQ ID NO: 199994 - RNA, 22 nt, Human
gagggcucuaccaaguaacucu

SEQ ID NO: 199995 - RNA, 22 nt, Human
gaauguuuaaggaaggcguggc

SEQ ID NO: 199996 - RNA, 22 nt, Human
uugauucaguaaagcuaaauuu

SEQ ID NO: 199997 - RNA, 22 nt, Human
caggagccacauuccaccuuga

SEQ ID NO: 199998 - RNA, 22 nt, Human
ucaggccugcaggcuuccugga

SEQ ID NO: 199999 - RNA, 22 nt, Human
ccaagcagaaccauucaggcac

SEQ ID NO: 200000 - RNA, 22 nt, Human
agaggccagaaggcgcaccccg

SEQ ID NO: 200001 - RNA, 22 nt, Human
auacaugaucacuguauuauaa

SEQ ID NO: 200002 - RNA, 22 nt, Human
uauguuuacgcugguagaauua

SEQ ID NO: 200003 - RNA, 21 nt, Human
uggacauuauggagagaguag

SEQ ID NO: 200004 - RNA, 22 nt, Human
ugucuccauggugaagcagggu

SEQ ID NO: 200005 - RNA, 22 nt, Human
aauagugcuuuuguacauagga

SEQ ID NO: 200006 - RNA, 22 nt, Human
ucucagggcgcagugaggcagu

SEQ ID NO: 200007 - RNA, 22 nt, Human
cacugggaccuaggacugagcu

SEQ ID NO: 200008 - RNA, 22 nt, Human
gggagaaguggaaaucucauua

SEQ ID NO: 200009 - RNA, 22 nt, Human
ggcucuggugaggguaggagau

SEQ ID NO: 200010 - RNA, 22 nt, Human
aagaacauuuaugauggcauuu

SEQ ID NO: 200011 - RNA, 19 nt, Human
ggcaagcacaaaagcuuug

SEQ ID NO: 200012 - RNA, 22 nt, Human
ggagucugcggcagacacugua

SEQ ID NO: 200013 - RNA, 22 nt, Human
agaaaugaagagagucaagguu

SEQ ID NO: 200014 - RNA, 20 nt, Human
agggccugcucugugguguc

SEQ ID NO: 200015 - RNA, 22 nt, Human
cagaggaacguuuggauugauu

SEQ ID NO: 200016 - RNA, 22 nt, Human
gaggacagcuuagggcuuccug

SEQ ID NO: 200017 - RNA, 22 nt, Human
uuuuccucaccuaacucaaggu

SEQ ID NO: 200018 - RNA, 22 nt, Human
uccugggagagugggacuguau

SEQ ID NO: 200019 - RNA, 22 nt, Human
uaguuaggguucugcagagaca

SEQ ID NO: 200020 - RNA, 22 nt, Human
ucuggccucuugggaugcuccc

SEQ ID NO: 200021 - RNA, 23 nt, Human
ugaaugauuguacugagcuuuua

SEQ ID NO: 200022 - RNA, 22 nt, Human
auguuuaaucggcugccuuucc

SEQ ID NO: 200023 - RNA, 22 nt, Human
aguccaggcucuuccugaagaa

SEQ ID NO: 200024 - RNA, 22 nt, Human
caauuuucaauuccuucagaua

SEQ ID NO: 200025 - RNA, 22 nt, Human
ugggggcuccaggcuccaggga

SEQ ID NO: 200026 - RNA, 23 nt, Human
uguuuuucauucacaugggcugu

SEQ ID NO: 200027 - RNA, 22 nt, Human
gcggcuccgaagccaggccgcg

SEQ ID NO: 200028 - RNA, 22 nt, Human
ugaaauguuaaacaaguggcuc

SEQ ID NO: 200029 - RNA, 22 nt, Human
ugaaggcugggcucagccagcu

SEQ ID NO: 200030 - RNA, 22 nt, Human
ucucuuaauuuuggaauagugu

SEQ ID NO: 200031 - RNA, 22 nt, Human
agcugucugugaacacagcauu

SEQ ID NO: 200032 - RNA, 23 nt, Human
cccugcagucagggugagauggu

SEQ ID NO: 200033 - RNA, 18 nt, Human
ugaggcagucagugaugg

SEQ ID NO: 200034 - RNA, 20 nt, Human
ucuuggaaaaaguucagaau

SEQ ID NO: 200035 - RNA, 22 nt, Human
aggguagggccguagggccaug

SEQ ID NO: 200036 - RNA, 22 nt, Human
agguucuggcauugcucaguaa

SEQ ID NO: 200037 - RNA, 22 nt, Human
uuacuuacaaaggcaaaggaag

SEQ ID NO: 200038 - RNA, 22 nt, Human
ccaaaguccauaguuuacauua

SEQ ID NO: 200039 - RNA, 22 nt, Human
cuuaucagauuaucugggcugu

SEQ ID NO: 200040 - RNA, 22 nt, Human
ucaggaaagaagaugcucagug

SEQ ID NO: 200041 - RNA, 21 nt, Human
agggcucaaaugugcuugcug

SEQ ID NO: 200042 - RNA, 22 nt, Human
aaggccucaggugaggcugccc

SEQ ID NO: 200043 - RNA, 22 nt, Human
gagcccugcuuccaagggggca

SEQ ID NO: 200044 - RNA, 22 nt, Human
caacaguguugcaaucugaaaa

SEQ ID NO: 200045 - RNA, 22 nt, Human
uccuguguugauagagaugguu

SEQ ID NO: 200046 - RNA, 22 nt, Human
agggugcagucacaggaaaugu

SEQ ID NO: 200047 - RNA, 22 nt, Human
ucugagggcuugaggggaagua

SEQ ID NO: 200048 - RNA, 22 nt, Human
guggcccacacagacagcaucu

SEQ ID NO: 200049 - RNA, 22 nt, Human
gacuuuaaaaguuugugcuugg

SEQ ID NO: 200050 - RNA, 22 nt, Human
agcuggaacgucacaggagcag

SEQ ID NO: 200051 - RNA, 19 nt, Human
caggccagugucagggggc

SEQ ID NO: 200052 - RNA, 22 nt, Human
ucugccaggcuuggugcuagau

SEQ ID NO: 200053 - RNA, 22 nt, Human
guccagagaggcaggaggcuac

SEQ ID NO: 200054 - RNA, 22 nt, Human
ggccagaggugguacauagcuu

SEQ ID NO: 200055 - RNA, 23 nt, Human
ucccuguguacagccugcaugag

SEQ ID NO: 200056 - RNA, 22 nt, Human
ucaggagcugcauuauccugug

SEQ ID NO: 200057 - RNA, 22 nt, Human
uuuauugucuaugaacugcuug

SEQ ID NO: 200058 - RNA, 22 nt, Human
uauauauucuuaaguaguguag

SEQ ID NO: 200059 - RNA, 22 nt, Human
uggguccuggaaggcgacaggu

SEQ ID NO: 200060 - RNA, 19 nt, Human
gaaggcugaaaugaagcac

SEQ ID NO: 200061 - RNA, 22 nt, Human
uaccauuugagagagaacauaa

SEQ ID NO: 200062 - RNA, 22 nt, Human
auguucuuugaaauauuuuaga

SEQ ID NO: 200063 - RNA, 22 nt, Human
auggcugcccacguuggugcuu

SEQ ID NO: 200064 - RNA, 22 nt, Human
uggcagcuacagacagagguga

SEQ ID NO: 200065 - RNA, 18 nt, Human
cucagagaugcccuuauu

SEQ ID NO: 200066 - RNA, 22 nt, Human
uugggucuguuuagcugagaag

SEQ ID NO: 200067 - RNA, 22 nt, Human
aagaaucuccaucugauucacu

SEQ ID NO: 200068 - RNA, 22 nt, Human
gggccugggaacuugcauuuag

SEQ ID NO: 200069 - RNA, 22 nt, Human
cugcagccacgagucacagccc

SEQ ID NO: 200070 - RNA, 22 nt, Human
gcagagcugucuaagucacuuc

SEQ ID NO: 200071 - RNA, 22 nt, Human
gcucagaggccaagugcccgcc

SEQ ID NO: 200072 - RNA, 22 nt, Human
gugguggaugucuguaaucuca

SEQ ID NO: 200073 - RNA, 22 nt, Human
ugacauguggcuuugacccagg

SEQ ID NO: 200074 - RNA, 22 nt, Human
auagaaccuguugugaaauuca

SEQ ID NO: 200075 - RNA, 22 nt, Human
gaaagaaugcuauagugacuuc

SEQ ID NO: 200076 - RNA, 21 nt, Human
uccagggcuuugauucucuca

SEQ ID NO: 200077 - RNA, 22 nt, Human
ccuuagaaaaucauggaauauu

SEQ ID NO: 200078 - RNA, 22 nt, Human
gccuggcucacagagcagccuu

SEQ ID NO: 200079 - RNA, 22 nt, Human
ugcuggccaagcagaggucaau

SEQ ID NO: 200080 - RNA, 22 nt, Human
ccuaaggaaagccaaagaggcc

SEQ ID NO: 200081 - RNA, 22 nt, Human
gacaucaugucacuaacugcua

SEQ ID NO: 200082 - RNA, 22 nt, Human
auuaaagugaaguucucagaug

SEQ ID NO: 200083 - RNA, 22 nt, Human
cuccuggcccugagcucccagg

SEQ ID NO: 200084 - RNA, 22 nt, Human
aggguggcugugaagugcuugg

SEQ ID NO: 200085 - RNA, 22 nt, Human
uccuggccaaguuacucucugc

SEQ ID NO: 200086 - RNA, 22 nt, Human
ugucacaaaaaucaguaauugc

SEQ ID NO: 200087 - RNA, 18 nt, Human
uggcuucucaaagcccag

SEQ ID NO: 200088 - RNA, 20 nt, Human
cguguccuuggcgggagagc

SEQ ID NO: 200089 - RNA, 22 nt, Human
uucucucccaugaagcuucuau

SEQ ID NO: 200090 - RNA, 22 nt, Human
agguguccaauccugguuggau

SEQ ID NO: 200091 - RNA, 22 nt, Human
gcugagaauguuccuacuggua

SEQ ID NO: 200092 - RNA, 22 nt, Human
ccaucccuucucuggccagcag

SEQ ID NO: 200093 - RNA, 22 nt, Human
ccugcccuaugaccagcuucac

SEQ ID NO: 200094 - RNA, 19 nt, Human
gggucccacugcccgucug

SEQ ID NO: 200095 - RNA, 22 nt, Human
uuaaaaaccaucuuccuuuccu

SEQ ID NO: 200096 - RNA, 22 nt, Human
gccagcaguccugcugugugcc

SEQ ID NO: 200097 - RNA, 22 nt, Human
gcugagacuuccacugccaucu

SEQ ID NO: 200098 - RNA, 22 nt, Human
uccagccaaucagagcugaggc

SEQ ID NO: 200099 - RNA, 22 nt, Human
aaguaaaccacagagaagccac

SEQ ID NO: 200100 - RNA, 22 nt, Human
uaggcuggaggaagcagugccu

SEQ ID NO: 200101 - RNA, 22 nt, Human
gccucagcuguugcaggggccc

SEQ ID NO: 200102 - RNA, 22 nt, Human
ucacacaggguucuggucucau

SEQ ID NO: 200103 - RNA, 22 nt, Human
ccucaggcugggcugccccugg

SEQ ID NO: 200104 - RNA, 22 nt, Human
gagacacacacaggagguggca

SEQ ID NO: 200105 - RNA, 22 nt, Human
cuuaauaauaggugaggcuaug

SEQ ID NO: 200106 - RNA, 22 nt, Human
auauuacauaaacaugagugaa

SEQ ID NO: 200107 - RNA, 22 nt, Human
gaucaugugauuugaaguaaug

SEQ ID NO: 200108 - RNA, 22 nt, Human
cuuuucugagagggccaagauu

SEQ ID NO: 200109 - RNA, 22 nt, Human
ccuuuagaauucugccccuccu

SEQ ID NO: 200110 - RNA, 22 nt, Human
gccugcugaaccucaugcaguc

SEQ ID NO: 200111 - RNA, 22 nt, Human
gggcugagcacauacugacagc

SEQ ID NO: 200112 - RNA, 18 nt, Human
ucugagggugcgggagcu

SEQ ID NO: 200113 - RNA, 22 nt, Human
ccagcuguuggaguuucacugc

SEQ ID NO: 200114 - RNA, 22 nt, Human
cagagccagggcuaggaacugg

SEQ ID NO: 200115 - RNA, 22 nt, Human
cugcuuggguccuggcaugggu

SEQ ID NO: 200116 - RNA, 22 nt, Human
cagaaagcaaaauggaucucug

SEQ ID NO: 200117 - RNA, 22 nt, Human
ccacugcucugccaggagcugg

SEQ ID NO: 200118 - RNA, 22 nt, Human
gaugaagucauuauccuuuugg

SEQ ID NO: 200119 - RNA, 22 nt, Human
aguggcugaauauauuuuacua

SEQ ID NO: 200120 - RNA, 22 nt, Human
ucuggaggcucugagggugagu

SEQ ID NO: 200121 - RNA, 22 nt, Human
ucaggauuauuucaguggcuuu

SEQ ID NO: 200122 - RNA, 18 nt, Human
cugaggccaacuacacug

SEQ ID NO: 200123 - RNA, 22 nt, Human
acugggcuagaguggaagcugg

SEQ ID NO: 200124 - RNA, 22 nt, Human
aucuccgccaucgcgaacgccu

SEQ ID NO: 200125 - RNA, 20 nt, Human
cgcccaggagggcccaugug

SEQ ID NO: 200126 - RNA, 22 nt, Human
gggcaggcugagcaugucaccu

SEQ ID NO: 200127 - RNA, 22 nt, Human
ucaaacauaggcacacauucag

SEQ ID NO: 200128 - RNA, 20 nt, Human
gcaugaggaaucauugcagc

SEQ ID NO: 200129 - RNA, 22 nt, Human
gugaggggaguaaagccauguu

SEQ ID NO: 200130 - RNA, 22 nt, Human
uauuucacaugugggaaacaua

SEQ ID NO: 200131 - RNA, 22 nt, Human
ggaagaggcucucauugagggc

SEQ ID NO: 200132 - RNA, 22 nt, Human
cuguuuauugagcaaucugcca

SEQ ID NO: 200133 - RNA, 22 nt, Human
cucaggaaaauauugaagaagu

SEQ ID NO: 200134 - RNA, 22 nt, Human
aauaacuuuuaaaagacccugg

SEQ ID NO: 200135 - RNA, 22 nt, Human
aaagauugaaagagaauuuguc

SEQ ID NO: 200136 - RNA, 22 nt, Human
uauauucaaugauuaguaucag

SEQ ID NO: 200137 - RNA, 22 nt, Human
ugaggguagaggcaggagugca

SEQ ID NO: 200138 - RNA, 22 nt, Human
uucuguauguacauauguguau

SEQ ID NO: 200139 - RNA, 22 nt, Human
ggaaaacugaggcucucagcag

SEQ ID NO: 200140 - RNA, 22 nt, Human
uauacaauggcugaaucaucca

SEQ ID NO: 200141 - RNA, 22 nt, Human
uccugaaaaauuacauguucag

SEQ ID NO: 200142 - RNA, 22 nt, Human
guucccaugccuccaagcuuca

SEQ ID NO: 200143 - RNA, 22 nt, Human
gaaagccaucuggcugcuggga

SEQ ID NO: 200144 - RNA, 22 nt, Human
agagugagggggcacugagacg

SEQ ID NO: 200145 - RNA, 22 nt, Human
uuucuacauuuguaaccagauu

SEQ ID NO: 200146 - RNA, 22 nt, Human
uaaaggaaucaguuuuagagau

SEQ ID NO: 200147 - RNA, 22 nt, Human
augagacaagagucuaaauuca

SEQ ID NO: 200148 - RNA, 22 nt, Human
ugacauuuaucaaagaaauggu

SEQ ID NO: 200149 - RNA, 22 nt, Human
gaaggagcuaccaagacugaau

SEQ ID NO: 200150 - RNA, 22 nt, Human
acccuguaugcuauaucccuaa

SEQ ID NO: 200151 - RNA, 22 nt, Human
gcaguaagauguaagugcuaua

SEQ ID NO: 200152 - RNA, 20 nt, Human
ucugugugccaucaccuaac

SEQ ID NO: 200153 - RNA, 22 nt, Human
caguauacgacuaacgcaugac

SEQ ID NO: 200154 - RNA, 22 nt, Human
uuucagaaaacuuaucaucagu

SEQ ID NO: 200155 - RNA, 22 nt, Human
gcuccuggcuccaggcagccaa

SEQ ID NO: 200156 - RNA, 22 nt, Human
acagguuuuuggauaauccuuu

SEQ ID NO: 200157 - RNA, 22 nt, Human
agcaagcagaauucuguccucu

SEQ ID NO: 200158 - RNA, 22 nt, Human
ucucucagucagaugcuaaaga

SEQ ID NO: 200159 - RNA, 22 nt, Human
uacaugcaugauacaaaguugc

SEQ ID NO: 200160 - RNA, 22 nt, Human
aguccagggcuuagucagcggg

SEQ ID NO: 200161 - RNA, 22 nt, Human
gaggagcugaggcugaggccuc

SEQ ID NO: 200162 - RNA, 22 nt, Human
cagucccaguuugagacucugg

SEQ ID NO: 200163 - RNA, 22 nt, Human
uugcaaauugcaagaguuggau

SEQ ID NO: 200164 - RNA, 22 nt, Human
ugcaaggcugccucugaggacc

SEQ ID NO: 200165 - RNA, 22 nt, Human
auaagcauguuagaauauuuga

SEQ ID NO: 200166 - RNA, 22 nt, Human
cagagccugccucuggcugugg

SEQ ID NO: 200167 - RNA, 22 nt, Human
cuuugugucuguuaauaauuau

SEQ ID NO: 200168 - RNA, 22 nt, Human
uuggaaauacagcaguuacuuu

SEQ ID NO: 200169 - RNA, 21 nt, Human
aagcuguguuccacugauagc

SEQ ID NO: 200170 - RNA, 22 nt, Human
uauuuuacuauuuggcaaaguc

SEQ ID NO: 200171 - RNA, 23 nt, Human
ccagcccuccaccagcucuaggc

SEQ ID NO: 200172 - RNA, 22 nt, Human
ccaggcccguucccuucuccag

SEQ ID NO: 200173 - RNA, 22 nt, Human
auuugcaaugauuucagugcuu

SEQ ID NO: 200174 - RNA, 22 nt, Human
gccagcagcucuugggcgggca

SEQ ID NO: 200175 - RNA, 22 nt, Human
acucagaggcagcugcucaccc

SEQ ID NO: 200176 - RNA, 22 nt, Human
ugggaaggauacguuacaagau

SEQ ID NO: 200177 - RNA, 22 nt, Human
uauuagguagauuuuacugauu

SEQ ID NO: 200178 - RNA, 22 nt, Human
uaugugucccuugguguagcaa

SEQ ID NO: 200179 - RNA, 22 nt, Human
ggcaggugaguucauuaucugc

SEQ ID NO: 200180 - RNA, 22 nt, Human
cucccaggguagggagagacua

SEQ ID NO: 200181 - RNA, 22 nt, Human
uuagagagaaccaucaggaucu

SEQ ID NO: 200182 - RNA, 22 nt, Human
ggcccagcgaggccaccuacag

SEQ ID NO: 200183 - RNA, 22 nt, Human
uggcaugauaggaggugcagaa

SEQ ID NO: 200184 - RNA, 22 nt, Human
cugcuuugacuguuaagaacca

SEQ ID NO: 200185 - RNA, 22 nt, Human
uauguacaccggggaagguggg

SEQ ID NO: 200186 - RNA, 22 nt, Human
accaggcugugaagugagacua

SEQ ID NO: 200187 - RNA, 22 nt, Human
caggagaagguuuggagugcag

SEQ ID NO: 200188 - RNA, 22 nt, Human
cauuucaauuauuugcucuucu

SEQ ID NO: 200189 - RNA, 22 nt, Human
ucuuuggcuugucuccucaguu

SEQ ID NO: 200190 - RNA, 20 nt, Human
aagcaauauagugcaaaugu

SEQ ID NO: 200191 - RNA, 22 nt, Human
acagcagguuuuaacuuugaag

SEQ ID NO: 200192 - RNA, 22 nt, Human
acaagcaguaaaggccacaguc

SEQ ID NO: 200193 - RNA, 22 nt, Human
ggaugggagcagaggacgacca

SEQ ID NO: 200194 - RNA, 22 nt, Human
acagucauuagauacaaugucu

SEQ ID NO: 200195 - RNA, 22 nt, Human
aagaguuucugauucaguaggu

SEQ ID NO: 200196 - RNA, 22 nt, Human
acaggcagugauuuccucuggu

SEQ ID NO: 200197 - RNA, 22 nt, Human
ugcaaacagaaaagcuacuuug

SEQ ID NO: 200198 - RNA, 22 nt, Human
cagaggaaguuccuugaugaga

SEQ ID NO: 200199 - RNA, 22 nt, Human
agcuucucagcuucagaacugu

SEQ ID NO: 200200 - RNA, 22 nt, Human
uuucuggaaacggguucaagcu

SEQ ID NO: 200201 - RNA, 22 nt, Human
cuugaaagcacuuaguaaauua

SEQ ID NO: 200202 - RNA, 22 nt, Human
acaggacaggcugggcuagacu

SEQ ID NO: 200203 - RNA, 22 nt, Human
ggcaggugggaacccuccccac

SEQ ID NO: 200204 - RNA, 22 nt, Human
uuaugcaacaggugagcagaca

SEQ ID NO: 200205 - RNA, 22 nt, Human
uacuuuuuagcacagugugugc

SEQ ID NO: 200206 - RNA, 22 nt, Human
augcaauauguguuucuguuua

SEQ ID NO: 200207 - RNA, 22 nt, Human
aucagagaaguuucacuggcau

SEQ ID NO: 200208 - RNA, 22 nt, Human
aaagauuauggcauugaaauac

SEQ ID NO: 200209 - RNA, 22 nt, Human
gccugcagcaugcuaggucuug

SEQ ID NO: 200210 - RNA, 22 nt, Human
ggucucagagguuucugcucag

SEQ ID NO: 200211 - RNA, 22 nt, Human
ucagcuggaagauggugcagaa

SEQ ID NO: 200212 - RNA, 22 nt, Human
cucugugaaccccuccuuucuu

SEQ ID NO: 200213 - RNA, 22 nt, Human
acauguauugacauuauauucu

SEQ ID NO: 200214 - RNA, 22 nt, Human
ugcagccuagacauucugguca

SEQ ID NO: 200215 - RNA, 22 nt, Human
caagauuuaagagucagccuug

SEQ ID NO: 200216 - RNA, 22 nt, Human
aacuuguaaugaaaggcaauag

SEQ ID NO: 200217 - RNA, 23 nt, Human
agcagucagggugguaagccauc

SEQ ID NO: 200218 - RNA, 21 nt, Human
aguacaaaaauuccuuucuca

SEQ ID NO: 200219 - RNA, 22 nt, Human
cccaggcuccugacucauucua

SEQ ID NO: 200220 - RNA, 22 nt, Human
aaguggagcuauaggcucagau

SEQ ID NO: 200221 - RNA, 22 nt, Human
uaaugcuuaauuuucacaagcc

SEQ ID NO: 200222 - RNA, 22 nt, Human
ucccuguccaaagucuuccuau

SEQ ID NO: 200223 - RNA, 22 nt, Human
ggcagggcaggaaagucaggaa

SEQ ID NO: 200224 - RNA, 22 nt, Human
aaguuuaacuugaauucuuucu

SEQ ID NO: 200225 - RNA, 16 nt, Human
ugggaccuguggccaa

SEQ ID NO: 200226 - RNA, 19 nt, Human
ggccuugaugaguggggag

SEQ ID NO: 200227 - RNA, 22 nt, Human
cagggcucagggacugcagaaa

SEQ ID NO: 200228 - RNA, 22 nt, Human
ucagcagggaggcucugugccc

SEQ ID NO: 200229 - RNA, 22 nt, Human
gggcacaggagaaggaucuggc

SEQ ID NO: 200230 - RNA, 21 nt, Human
cucagagacaaaugccauccc

SEQ ID NO: 200231 - RNA, 22 nt, Human
uuacagguggagaaguaaggcu

SEQ ID NO: 200232 - RNA, 22 nt, Human
ggcucugaagggugacagguuu

SEQ ID NO: 200233 - RNA, 22 nt, Human
uggagauggguuaauggagaga

SEQ ID NO: 200234 - RNA, 22 nt, Human
caggcagcguccugcuuccugu

SEQ ID NO: 200235 - RNA, 22 nt, Human
gccuggcugggcugaaugcuua

SEQ ID NO: 200236 - RNA, 22 nt, Human
ggaggacacuggcucugccuuc

SEQ ID NO: 200237 - RNA, 22 nt, Human
gacaucauggagaggauaaaua

SEQ ID NO: 200238 - RNA, 22 nt, Human
ugcuuaggaugcuagcaggcau

SEQ ID NO: 200239 - RNA, 22 nt, Human
gcagaauagugacuuuccuuaa

SEQ ID NO: 200240 - RNA, 22 nt, Human
gaaggcuuuucuaccagaucuu

SEQ ID NO: 200241 - RNA, 22 nt, Human
uccaagaucuacagcaguuuag

SEQ ID NO: 200242 - RNA, 22 nt, Human
uccaggucugguuggacagguu

SEQ ID NO: 200243 - RNA, 22 nt, Human
cugucauugagccugucagggc

SEQ ID NO: 200244 - RNA, 22 nt, Human
uaggaaugauuggaauuccagg

SEQ ID NO: 200245 - RNA, 22 nt, Human
gucaggaucucccaguacauau

SEQ ID NO: 200246 - RNA, 18 nt, Human
aaugugaauauuuacuuc

SEQ ID NO: 200247 - RNA, 22 nt, Human
agacacagaacacaaaagcaua

SEQ ID NO: 200248 - RNA, 22 nt, Human
ugcuccagcaacaggcuuagcu

SEQ ID NO: 200249 - RNA, 22 nt, Human
uagaaauggagaacagauuaau

SEQ ID NO: 200250 - RNA, 22 nt, Human
agucaggagcugcugcauugua

SEQ ID NO: 200251 - RNA, 15 nt, Human
uuucaaaaugaggcc

SEQ ID NO: 200252 - RNA, 22 nt, Human
cuguggcucagcacggggucag

SEQ ID NO: 200253 - RNA, 22 nt, Human
acugugcaucuauugccauuua

SEQ ID NO: 200254 - RNA, 22 nt, Human
gcuggggagcuagaccucagca

SEQ ID NO: 200255 - RNA, 22 nt, Human
uguggagaagaaggccacugca

SEQ ID NO: 200256 - RNA, 22 nt, Human
caggagcucaagaccacccugg

SEQ ID NO: 200257 - RNA, 20 nt, Human
ucucuggccagaaacaacag

SEQ ID NO: 200258 - RNA, 20 nt, Human
uuaagaaaagcacauccugc

SEQ ID NO: 200259 - RNA, 22 nt, Human
uucaaaauccgggaggcgcccc

SEQ ID NO: 200260 - RNA, 21 nt, Human
aacugcaaaugaugcuggaga

SEQ ID NO: 200261 - RNA, 21 nt, Human
ucuggucugcuguggaccugg

SEQ ID NO: 200262 - RNA, 19 nt, Human
aguguauuuuuuucuguag

SEQ ID NO: 200263 - RNA, 23 nt, Human
gcucagagguuuuucucuggaug

SEQ ID NO: 200264 - RNA, 22 nt, Human
uucugcuuuuagcuaaacuaua

SEQ ID NO: 200265 - RNA, 22 nt, Human
cuggagggggaaauguucauug

SEQ ID NO: 200266 - RNA, 22 nt, Human
ccuugaaagccaggcagaggaa

SEQ ID NO: 200267 - RNA, 22 nt, Human
aagaguuugaccugugccaucc

SEQ ID NO: 200268 - RNA, 22 nt, Human
auacauguucguguacauguuc

SEQ ID NO: 200269 - RNA, 22 nt, Human
augugaggcagcacggagauua

SEQ ID NO: 200270 - RNA, 22 nt, Human
uuuauccagaaucaggauuuuu

SEQ ID NO: 200271 - RNA, 22 nt, Human
aaagggccuccgccugggcagg

SEQ ID NO: 200272 - RNA, 22 nt, Human
cuggcaggcggcagagcccagg

SEQ ID NO: 200273 - RNA, 22 nt, Human
acaugcaagccccugaacacau

SEQ ID NO: 200274 - RNA, 22 nt, Human
cuuuccuaguuggucccagcac

SEQ ID NO: 200275 - RNA, 22 nt, Human
uaaggccaauuacauauguuca

SEQ ID NO: 200276 - RNA, 22 nt, Human
aggguccugagccuggggcgca

SEQ ID NO: 200277 - RNA, 22 nt, Human
cagaacagaaucguguggugag

SEQ ID NO: 200278 - RNA, 22 nt, Human
uuuccuuccauguugggcaaaa

SEQ ID NO: 200279 - RNA, 21 nt, Human
ucucugguuggaguugugcca

SEQ ID NO: 200280 - RNA, 22 nt, Human
gccuggcuuggggcucaguggu

SEQ ID NO: 200281 - RNA, 22 nt, Human
ucuuuugagggccagaggaaga

SEQ ID NO: 200282 - RNA, 22 nt, Human
ugauauuuaagcaaaaauaugg

SEQ ID NO: 200283 - RNA, 22 nt, Human
cagugguuauacuuacuguuuc

SEQ ID NO: 200284 - RNA, 22 nt, Human
gggagccagccuuugccuauaa

SEQ ID NO: 200285 - RNA, 22 nt, Human
gguucaguuuacauuaaaaucu

SEQ ID NO: 200286 - RNA, 22 nt, Human
uaggacaggaucaugaugcugg

SEQ ID NO: 200287 - RNA, 22 nt, Human
cuguuacuaaucuuuucugcua

SEQ ID NO: 200288 - RNA, 22 nt, Human
uggcugugauuugcacgagaug

SEQ ID NO: 200289 - RNA, 22 nt, Human
ucugggugcuacaaacaguauu

SEQ ID NO: 200290 - RNA, 22 nt, Human
gcagaaggauccgcaggugcaa

SEQ ID NO: 200291 - RNA, 22 nt, Human
ugagggacaccagggcuggagc

SEQ ID NO: 200292 - RNA, 22 nt, Human
uggcugagagaagacggggaag

SEQ ID NO: 200293 - RNA, 22 nt, Human
gcagcaucuagggcacuggccu

SEQ ID NO: 200294 - RNA, 18 nt, Human
agagcagcggcaucacac

SEQ ID NO: 200295 - RNA, 17 nt, Human
cagucgaggaggaccug

SEQ ID NO: 200296 - RNA, 22 nt, Human
ggcuccuuaucucuccuaugcc

SEQ ID NO: 200297 - RNA, 22 nt, Human
guucuucaguucaggcuguuca

SEQ ID NO: 200298 - RNA, 22 nt, Human
uaacuguauagcuuggacuaaa

SEQ ID NO: 200299 - RNA, 19 nt, Human
auucuucagcagugagacc

SEQ ID NO: 200300 - RNA, 23 nt, Human
ucuguuuugcaacaugugacaag

SEQ ID NO: 200301 - RNA, 19 nt, Human
ucuccaguugcuuucaggg

SEQ ID NO: 200302 - RNA, 22 nt, Human
ucaugaaaauagaucagaaauu

SEQ ID NO: 200303 - RNA, 22 nt, Human
ggccuggaagaggacagagaaa

SEQ ID NO: 200304 - RNA, 22 nt, Human
uagcugacagauacaaucagau

SEQ ID NO: 200305 - RNA, 22 nt, Human
gcugugugacccuagccaguag

SEQ ID NO: 200306 - RNA, 22 nt, Human
ggaggugacuggaucaugggca

SEQ ID NO: 200307 - RNA, 22 nt, Human
ucugucuuugagaucucagccu

SEQ ID NO: 200308 - RNA, 22 nt, Human
aucucagucagguugaauuugg

SEQ ID NO: 200309 - RNA, 22 nt, Human
uaguggagguggucugugaacu

SEQ ID NO: 200310 - RNA, 20 nt, Human
ugucauuuauuuaucaaaug

SEQ ID NO: 200311 - RNA, 22 nt, Human
agaauuagucacaauuauagga

SEQ ID NO: 200312 - RNA, 23 nt, Human
agacacuguaaagaauugcaguu

SEQ ID NO: 200313 - RNA, 22 nt, Human
ucagaaagcuuuuacuuaaaca

SEQ ID NO: 200314 - RNA, 22 nt, Human
uagaaacuagauugauagcgga

SEQ ID NO: 200315 - RNA, 22 nt, Human
ccaucuugggucacugcccccc

SEQ ID NO: 200316 - RNA, 22 nt, Human
cuugggcucuaaaugccaguga

SEQ ID NO: 200317 - RNA, 19 nt, Human
gugucugccuuugugccac

SEQ ID NO: 200318 - RNA, 22 nt, Human
uggaaggaaagguagcagagaa

SEQ ID NO: 200319 - RNA, 22 nt, Human
auuuuacuacuccaauuaauga

SEQ ID NO: 200320 - RNA, 22 nt, Human
gccuguuuggcaucauugguug

SEQ ID NO: 200321 - RNA, 19 nt, Human
ugcugggucauauggaaac

SEQ ID NO: 200322 - RNA, 22 nt, Human
uuuugccugugaauacuaucuu

SEQ ID NO: 200323 - RNA, 22 nt, Human
uggccuugaaccaggucuccac

SEQ ID NO: 200324 - RNA, 22 nt, Human
ucagaaggaugugcagguggca

SEQ ID NO: 200325 - RNA, 22 nt, Human
caacaauuucccaguuucccau

SEQ ID NO: 200326 - RNA, 22 nt, Human
uggacaacauagugagaccuca

SEQ ID NO: 200327 - RNA, 22 nt, Human
uagagagccaguugucauaguu

SEQ ID NO: 200328 - RNA, 22 nt, Human
agcucagcccuccugugcagcu

SEQ ID NO: 200329 - RNA, 21 nt, Human
aaugucuuuguccaugcucug

SEQ ID NO: 200330 - RNA, 22 nt, Human
gaauacaagccaggcacaaggc

SEQ ID NO: 200331 - RNA, 22 nt, Human
agucauuguaugaaguguacuc

SEQ ID NO: 200332 - RNA, 22 nt, Human
uaauuuacucagauguucaauc

SEQ ID NO: 200333 - RNA, 22 nt, Human
uccaggccccagcaccuuggga

SEQ ID NO: 200334 - RNA, 22 nt, Human
ccugggcucaagugauccuccu

SEQ ID NO: 200335 - RNA, 22 nt, Human
gccuccggagucacagugucuu

SEQ ID NO: 200336 - RNA, 22 nt, Human
auuuauuaccucggaguuucug

SEQ ID NO: 200337 - RNA, 22 nt, Human
ugacauuuuaucaauaucacag

SEQ ID NO: 200338 - RNA, 18 nt, Human
ggcugcuccucucccuac

SEQ ID NO: 200339 - RNA, 22 nt, Human
aagaugacagaugcuuagaguc

SEQ ID NO: 200340 - RNA, 22 nt, Human
ugugugucagucuuguuuaggg

SEQ ID NO: 200341 - RNA, 22 nt, Human
uaauaauuaacagugauggguc

SEQ ID NO: 200342 - RNA, 23 nt, Human
uaugagucaucugcuacaaccca

SEQ ID NO: 200343 - RNA, 22 nt, Human
caacuaauauagggcaugagaa

SEQ ID NO: 200344 - RNA, 22 nt, Human
ucaagcaaguugcauauugcua

SEQ ID NO: 200345 - RNA, 22 nt, Human
cagcugcagaucauguuuacag

SEQ ID NO: 200346 - RNA, 22 nt, Human
gcaugcuuuuauaucuguuuaa

SEQ ID NO: 200347 - RNA, 22 nt, Human
aacauuucauuggaagcuaugu

SEQ ID NO: 200348 - RNA, 22 nt, Human
acuucuucuucagcugggggau

SEQ ID NO: 200349 - RNA, 22 nt, Human
caaggcauacuccuuucucagc

SEQ ID NO: 200350 - RNA, 19 nt, Human
auauauguauacaaugugg

SEQ ID NO: 200351 - RNA, 22 nt, Human
ggagaggggaacuuguugcuug

SEQ ID NO: 200352 - RNA, 22 nt, Human
agggugucagccacggaauggg

SEQ ID NO: 200353 - RNA, 22 nt, Human
acaugauuuuuaaagagauaau

SEQ ID NO: 200354 - RNA, 18 nt, Human
aaagaaggauuggagagc

SEQ ID NO: 200355 - RNA, 19 nt, Human
uucugcuguuccuaggcug

SEQ ID NO: 200356 - RNA, 22 nt, Human
gggaguggagagcaauggauga

SEQ ID NO: 200357 - RNA, 22 nt, Human
uauucugguuuccggaucucua

SEQ ID NO: 200358 - RNA, 22 nt, Human
ucuauagacuuggacauauagu

SEQ ID NO: 200359 - RNA, 23 nt, Human
acagccaguucaccucuccuugg

SEQ ID NO: 200360 - RNA, 22 nt, Human
aagaagagaaaugugcugcugg

SEQ ID NO: 200361 - RNA, 22 nt, Human
gaggaacagagggcaaggccag

SEQ ID NO: 200362 - RNA, 22 nt, Human
cacagcuuccauuagaaugaga

SEQ ID NO: 200363 - RNA, 22 nt, Human
gcuagaaacuguuuaaucucuu

SEQ ID NO: 200364 - RNA, 22 nt, Human
ccacccuggacaggccucugag

SEQ ID NO: 200365 - RNA, 22 nt, Human
ccaggaggcucuugucccuggu

SEQ ID NO: 200366 - RNA, 22 nt, Human
aguuguaauaacaauaccaaaa

SEQ ID NO: 200367 - RNA, 22 nt, Human
gagcuuggcuggaccucacgga

SEQ ID NO: 200368 - RNA, 22 nt, Human
agcugcugggagaagugagcca

SEQ ID NO: 200369 - RNA, 21 nt, Human
aaacaucucugcuuuuguguc

SEQ ID NO: 200370 - RNA, 22 nt, Human
agccccaggaugggccgcagga

SEQ ID NO: 200371 - RNA, 22 nt, Human
cuaaagaagcuagcaaucuaua

SEQ ID NO: 200372 - RNA, 22 nt, Human
auaaagcaucuagucugucacu

SEQ ID NO: 200373 - RNA, 22 nt, Human
uguauauguuuguauguacaca

SEQ ID NO: 200374 - RNA, 20 nt, Human
uacagacaugacaauaaugg

SEQ ID NO: 200375 - RNA, 22 nt, Human
aaucuagagaacuguggggcag

SEQ ID NO: 200376 - RNA, 22 nt, Human
agucuguguaccuuuggccuuc

SEQ ID NO: 200377 - RNA, 22 nt, Human
augcaugaaagaauccaagccu

SEQ ID NO: 200378 - RNA, 23 nt, Human
acucuguaggcuguccaugugca

SEQ ID NO: 200379 - RNA, 23 nt, Human
ucugggcugagacuuggaagguc

SEQ ID NO: 200380 - RNA, 23 nt, Human
ccaucaggccuccguguccagcc

SEQ ID NO: 200381 - RNA, 22 nt, Human
aaaagucuacaagcuucaacaa

SEQ ID NO: 200382 - RNA, 22 nt, Human
uuuuucuaauggcuuaggaugu

SEQ ID NO: 200383 - RNA, 22 nt, Human
uggagccaggguagaagcagag

SEQ ID NO: 200384 - RNA, 22 nt, Human
aggcagaggagaaugaucuucc

SEQ ID NO: 200385 - RNA, 18 nt, Human
auuuacccagcaacgugg

SEQ ID NO: 200386 - RNA, 21 nt, Human
ggcagugaugugaagugcauc

SEQ ID NO: 200387 - RNA, 22 nt, Human
aaaaagcuuaaaugagcaguuc

SEQ ID NO: 200388 - RNA, 22 nt, Human
uagguucaugaaauuuucagga

SEQ ID NO: 200389 - RNA, 22 nt, Human
cccagagcaugugcugccuuug

SEQ ID NO: 200390 - RNA, 22 nt, Human
ucaagagauugaauaauaacug

SEQ ID NO: 200391 - RNA, 22 nt, Human
aggguccaacugaggcugaacu

SEQ ID NO: 200392 - RNA, 22 nt, Human
caggguagacaguaggugucug

SEQ ID NO: 200393 - RNA, 22 nt, Human
ucauacaacuaagaguuucaga

SEQ ID NO: 200394 - RNA, 22 nt, Human
caugcugugcaucuugaugacc

SEQ ID NO: 200395 - RNA, 22 nt, Human
ucagugucuagggacaguaauc

SEQ ID NO: 200396 - RNA, 22 nt, Human
auuacagauuauaaauuugagc

SEQ ID NO: 200397 - RNA, 22 nt, Human
uuucuguaaggacuuaaugcaa

SEQ ID NO: 200398 - RNA, 22 nt, Human
ucuggcagagauauccauccca

SEQ ID NO: 200399 - RNA, 20 nt, Human
gaaucuuuccccaugcaaug

SEQ ID NO: 200400 - RNA, 22 nt, Human
cagugugaggaauuagugucca

SEQ ID NO: 200401 - RNA, 22 nt, Human
acauggagaccagauggaagua

SEQ ID NO: 200402 - RNA, 22 nt, Human
ucucuuugucugcucuuaguug

SEQ ID NO: 200403 - RNA, 22 nt, Human
gcugucuuguauguuguaggac

SEQ ID NO: 200404 - RNA, 22 nt, Human
gagcuugguguuauuucugugg

SEQ ID NO: 200405 - RNA, 22 nt, Human
gcagcucagggagagggcacca

SEQ ID NO: 200406 - RNA, 20 nt, Human
auaauuacauagagauugcc

SEQ ID NO: 200407 - RNA, 18 nt, Human
gcagagugcgucucugug

SEQ ID NO: 200408 - RNA, 22 nt, Human
cauguacaugccuacuaucaau

SEQ ID NO: 200409 - RNA, 22 nt, Human
gaggugguuuguggugacucau

SEQ ID NO: 200410 - RNA, 22 nt, Human
cacaggugccaucucuucaugg

SEQ ID NO: 200411 - RNA, 22 nt, Human
gagugcaguaugagaggcugcu

SEQ ID NO: 200412 - RNA, 22 nt, Human
uagcaaaagcucaacaggaagg

SEQ ID NO: 200413 - RNA, 22 nt, Human
gggcagugucggggcccaggga

SEQ ID NO: 200414 - RNA, 19 nt, Human
caugugcaugagcacagga

SEQ ID NO: 200415 - RNA, 22 nt, Human
augcuuguacuaaaaaaauauu

SEQ ID NO: 200416 - RNA, 20 nt, Human
uuccuggcucuaggaccuug

SEQ ID NO: 200417 - RNA, 22 nt, Human
uauacaguuugaguucuugcau

SEQ ID NO: 200418 - RNA, 22 nt, Human
aggaaggagggcagauauuaag

SEQ ID NO: 200419 - RNA, 22 nt, Human
agaaauuauuagugaauagucu

SEQ ID NO: 200420 - RNA, 22 nt, Human
cuggcucuugcgacucagcuug

SEQ ID NO: 200421 - RNA, 23 nt, Human
gucucuagaguguggagcaaaga

SEQ ID NO: 200422 - RNA, 22 nt, Human
ucuggucccugcucacuucuug

SEQ ID NO: 200423 - RNA, 22 nt, Human
cugugagggccagagucagggc

SEQ ID NO: 200424 - RNA, 22 nt, Human
ucacaggaaccaucagagaaau

SEQ ID NO: 200425 - RNA, 21 nt, Human
ucuggggaagacaucuaggau

SEQ ID NO: 200426 - RNA, 22 nt, Human
uguuuacuugagguggaaacaa

SEQ ID NO: 200427 - RNA, 22 nt, Human
cagguggcugagcugaccuuug

SEQ ID NO: 200428 - RNA, 22 nt, Human
uggcuucucccucugccugauu

SEQ ID NO: 200429 - RNA, 22 nt, Human
cagaaccaggaacugauggaga

SEQ ID NO: 200430 - RNA, 22 nt, Human
cagcuggguuuaguggggugug

SEQ ID NO: 200431 - RNA, 22 nt, Human
ggccuaggaaggggauguaacu

SEQ ID NO: 200432 - RNA, 22 nt, Human
ucugaaauaagggagaagggaa

SEQ ID NO: 200433 - RNA, 22 nt, Human
aauaacagauuuucaagcugug

SEQ ID NO: 200434 - RNA, 22 nt, Human
cuguugcucccagggagagggu

SEQ ID NO: 200435 - RNA, 23 nt, Human
cagcugaagcagccugggcugga

SEQ ID NO: 200436 - RNA, 18 nt, Human
auacagagaccucaagga

SEQ ID NO: 200437 - RNA, 22 nt, Human
aauuuuaucucuaagcaggcuu

SEQ ID NO: 200438 - RNA, 22 nt, Human
uccagccccuuuuacucauuca

SEQ ID NO: 200439 - RNA, 22 nt, Human
cugcugguaccaguggccguca

SEQ ID NO: 200440 - RNA, 22 nt, Human
uuuccaggugcauagaaaacag

SEQ ID NO: 200441 - RNA, 22 nt, Human
aggggcaggugcugcacuuaga

SEQ ID NO: 200442 - RNA, 22 nt, Human
aaagaggcaaucaauguagcaa

SEQ ID NO: 200443 - RNA, 22 nt, Human
uaacugaugugaacuuaccauu

SEQ ID NO: 200444 - RNA, 22 nt, Human
gcagagauuaugccauggaaag

SEQ ID NO: 200445 - RNA, 20 nt, Human
ccuguggcucuuguaauuca

SEQ ID NO: 200446 - RNA, 22 nt, Human
uugccuggaugguccccagaga

SEQ ID NO: 200447 - RNA, 19 nt, Human
caauauauagugaguggau

SEQ ID NO: 200448 - RNA, 22 nt, Human
cugcaaaaguaauugcagguuu

SEQ ID NO: 200449 - RNA, 22 nt, Human
cagggccaggcugauggccugg

SEQ ID NO: 200450 - RNA, 22 nt, Human
aaaggagacuucagaucuccuu

SEQ ID NO: 200451 - RNA, 21 nt, Human
aggcuuggauagauauucaua

SEQ ID NO: 200452 - RNA, 22 nt, Human
ccagguguaggacaccaaggga

SEQ ID NO: 200453 - RNA, 21 nt, Human
aucccagcacccaggagugca

SEQ ID NO: 200454 - RNA, 22 nt, Human
cugugacagggaucagaaugca

SEQ ID NO: 200455 - RNA, 22 nt, Human
ccagcagaagcucccgcugggu

SEQ ID NO: 200456 - RNA, 22 nt, Human
cucuucuugccugaugaggcag

SEQ ID NO: 200457 - RNA, 22 nt, Human
ggacauuugcaccuaccucagc

SEQ ID NO: 200458 - RNA, 22 nt, Human
auguuaaaagucugagugggag

SEQ ID NO: 200459 - RNA, 20 nt, Human
gggaggccccagaguccagg

SEQ ID NO: 200460 - RNA, 22 nt, Human
ccugagccucuugcacgcucag

SEQ ID NO: 200461 - RNA, 22 nt, Human
aucuguaacugcuaucaucucc

SEQ ID NO: 200462 - RNA, 22 nt, Human
cugggugaauuugaaggaaagg

SEQ ID NO: 200463 - RNA, 22 nt, Human
uauguacucaucaacuauugaa

SEQ ID NO: 200464 - RNA, 22 nt, Human
aucuuuggaaagccaagcacag

SEQ ID NO: 200465 - RNA, 22 nt, Human
ucaggucuugagccaucaggau

SEQ ID NO: 200466 - RNA, 22 nt, Human
guggcuuggaccagucacagug

SEQ ID NO: 200467 - RNA, 19 nt, Human
caccuacuuuuggauuugc

SEQ ID NO: 200468 - RNA, 22 nt, Human
gcaaggacucccugggucauuc

SEQ ID NO: 200469 - RNA, 22 nt, Human
cuacagugacagaauuaaacag

SEQ ID NO: 200470 - RNA, 22 nt, Human
ucuucaaauccuacagugucug

SEQ ID NO: 200471 - RNA, 22 nt, Human
aagacagccagcuccaugggau

SEQ ID NO: 200472 - RNA, 22 nt, Human
gcugguuagaaaacagagcuca

SEQ ID NO: 200473 - RNA, 22 nt, Human
agccugggcccugccucuucuc

SEQ ID NO: 200474 - RNA, 22 nt, Human
uaagagaacuggauagauagga

SEQ ID NO: 200475 - RNA, 21 nt, Human
cacagaggcgcuguauggcug

SEQ ID NO: 200476 - RNA, 22 nt, Human
ugucaguuuaguugaagaaaga

SEQ ID NO: 200477 - RNA, 22 nt, Human
aacagacaacuccuguggcuca

SEQ ID NO: 200478 - RNA, 22 nt, Human
cuggacagaaagggcugcugug

SEQ ID NO: 200479 - RNA, 22 nt, Human
gcuucauagcauucauugccug

SEQ ID NO: 200480 - RNA, 22 nt, Human
aguagaaauguaagaaggauua

SEQ ID NO: 200481 - RNA, 21 nt, Human
agugcugaaaaagcaugucuc

SEQ ID NO: 200482 - RNA, 22 nt, Human
uuuuauucaaauaguucacacu

SEQ ID NO: 200483 - RNA, 19 nt, Human
ccagcuggccugggaccuc

SEQ ID NO: 200484 - RNA, 19 nt, Human
ucccaggaagcaaauguca

SEQ ID NO: 200485 - RNA, 22 nt, Human
uccuccuuguuuuccuguuuac

SEQ ID NO: 200486 - RNA, 22 nt, Human
uugagcuguauaccuaugacug

SEQ ID NO: 200487 - RNA, 21 nt, Human
uggcaggcagcuggaagcuug

SEQ ID NO: 200488 - RNA, 17 nt, Human
ggcaguggaggaagaga

SEQ ID NO: 200489 - RNA, 22 nt, Human
uacaaggaggcuaaugaugaca

SEQ ID NO: 200490 - RNA, 22 nt, Human
gcuguauuuauaugaaggcaug

SEQ ID NO: 200491 - RNA, 22 nt, Human
gcucugagucucagcuaccaca

SEQ ID NO: 200492 - RNA, 22 nt, Human
accagcucucuagcccuggucc

SEQ ID NO: 200493 - RNA, 20 nt, Human
ugccaggcugcacgccugcc

SEQ ID NO: 200494 - RNA, 22 nt, Human
aaaccaucagauaauucauacu

SEQ ID NO: 200495 - RNA, 22 nt, Human
aggaauucaagaccagcugggc

SEQ ID NO: 200496 - RNA, 22 nt, Human
acauuaaauuucauagugauua

SEQ ID NO: 200497 - RNA, 22 nt, Human
gcccaggaggucaaguagcuau

SEQ ID NO: 200498 - RNA, 22 nt, Human
gaggcagcagggcugguuccuu

SEQ ID NO: 200499 - RNA, 22 nt, Human
caggagcucucaucgucagggc

SEQ ID NO: 200500 - RNA, 22 nt, Human
ucccuccuggugaugaugcaaa

SEQ ID NO: 200501 - RNA, 22 nt, Human
uuguuuacacugcagaauuggg

SEQ ID NO: 200502 - RNA, 22 nt, Human
agugcauguucacuggcauggu

SEQ ID NO: 200503 - RNA, 22 nt, Human
uaaagugguggugcuaauguau

SEQ ID NO: 200504 - RNA, 22 nt, Human
gcaucaagacgaugugaaaucg

SEQ ID NO: 200505 - RNA, 22 nt, Human
uggcuggcaaggcuggagucag

SEQ ID NO: 200506 - RNA, 22 nt, Human
agggagccaggggccagcuauu

SEQ ID NO: 200507 - RNA, 23 nt, Human
aggcagguuugggcucuucuugu

SEQ ID NO: 200508 - RNA, 22 nt, Human
uuauugagaccguaagucaggu

SEQ ID NO: 200509 - RNA, 17 nt, Human
ucagcaggggccaagcu

SEQ ID NO: 200510 - RNA, 19 nt, Human
accagcccacucccaguuu

SEQ ID NO: 200511 - RNA, 22 nt, Human
uccugguggucugugcuucuuc

SEQ ID NO: 200512 - RNA, 22 nt, Human
uacauacauguauguguguauu

SEQ ID NO: 200513 - RNA, 22 nt, Human
ccuuggggaauauccauucuuc

SEQ ID NO: 200514 - RNA, 23 nt, Human
uuccuggcagguacaacuuuuac

SEQ ID NO: 200515 - RNA, 22 nt, Human
uggcucuguggauguucugacc

SEQ ID NO: 200516 - RNA, 22 nt, Human
uuuggacaaaugucugacuuuc

SEQ ID NO: 200517 - RNA, 22 nt, Human
uaauagaaagguauuuuuugca

SEQ ID NO: 200518 - RNA, 22 nt, Human
ugucucagcugugcuucauugg

SEQ ID NO: 200519 - RNA, 22 nt, Human
uagcagcuaugccauuuugaca

SEQ ID NO: 200520 - RNA, 22 nt, Human
ucauuuguaccauuuuuuaaga

SEQ ID NO: 200521 - RNA, 19 nt, Human
aggcucuguaggagagggc

SEQ ID NO: 200522 - RNA, 22 nt, Human
caguucaaaauuuugaagaagg

SEQ ID NO: 200523 - RNA, 22 nt, Human
ucagugaaugagauaacuuuag

SEQ ID NO: 200524 - RNA, 22 nt, Human
gaaguauuucugaguugcccag

SEQ ID NO: 200525 - RNA, 22 nt, Human
uugcaacauuguaaguuuauau

SEQ ID NO: 200526 - RNA, 22 nt, Human
gccaggcauuauuccgaucccu

SEQ ID NO: 200527 - RNA, 22 nt, Human
acugguaaauuaugcgacuuug

SEQ ID NO: 200528 - RNA, 22 nt, Human
cagaacagucgccugcauggau

SEQ ID NO: 200529 - RNA, 22 nt, Human
gaguaaaauaggugagaaucaa

SEQ ID NO: 200530 - RNA, 22 nt, Human
cagugggaaagugaagagcauu

SEQ ID NO: 200531 - RNA, 22 nt, Human
acucagagaauaucuagaagga

SEQ ID NO: 200532 - RNA, 22 nt, Human
ggcagagcuuguuccuucuguu

SEQ ID NO: 200533 - RNA, 22 nt, Human
cagcuguuugggcauggccaga

SEQ ID NO: 200534 - RNA, 22 nt, Human
gcaggcucagagcagauuagca

SEQ ID NO: 200535 - RNA, 22 nt, Human
ggcaagagugaggagugucucu

SEQ ID NO: 200536 - RNA, 22 nt, Human
ugcucauuaggacugcaaauuc

SEQ ID NO: 200537 - RNA, 22 nt, Human
ggcuggcugugcccuguacucu

SEQ ID NO: 200538 - RNA, 22 nt, Human
aaaauucauuccucagacugcc

SEQ ID NO: 200539 - RNA, 22 nt, Human
acuccuggaaaagaacgcaggg

SEQ ID NO: 200540 - RNA, 22 nt, Human
aaugagauggaauucccgccua

SEQ ID NO: 200541 - RNA, 22 nt, Human
cuuccagcugauuacaggcuau

SEQ ID NO: 200542 - RNA, 22 nt, Human
ugccauuuaaaaaugaccaaau

SEQ ID NO: 200543 - RNA, 17 nt, Human
cugguuuaugggcagug

SEQ ID NO: 200544 - RNA, 22 nt, Human
aaggcugacguuuguguuuauu

SEQ ID NO: 200545 - RNA, 22 nt, Human
ucacagcuccagacugcaacuc

SEQ ID NO: 200546 - RNA, 22 nt, Human
ggcugccuucauagaccauggg

SEQ ID NO: 200547 - RNA, 22 nt, Human
gaacaccuggguccccuggggc

SEQ ID NO: 200548 - RNA, 22 nt, Human
acuuucaugcucugagcacugg

SEQ ID NO: 200549 - RNA, 22 nt, Human
agaaaucucaguaucucaggga

SEQ ID NO: 200550 - RNA, 22 nt, Human
cucauuuaacagauuaaaaagu

SEQ ID NO: 200551 - RNA, 22 nt, Human
aagucucuuaguaauauccaac

SEQ ID NO: 200552 - RNA, 22 nt, Human
ggggagcaggcugggcugucug

SEQ ID NO: 200553 - RNA, 22 nt, Human
uggccucaaccguccuaagcac

SEQ ID NO: 200554 - RNA, 22 nt, Human
acauuguagacuuuucauaugu

SEQ ID NO: 200555 - RNA, 22 nt, Human
caggagcccugguggguggaca

SEQ ID NO: 200556 - RNA, 22 nt, Human
cugcugugugaccauggacagg

SEQ ID NO: 200557 - RNA, 22 nt, Human
agagggaaaaacucaugucauu

SEQ ID NO: 200558 - RNA, 22 nt, Human
caggucugugugccauuuccaa

SEQ ID NO: 200559 - RNA, 22 nt, Human
caggcuugaugugucuauacuu

SEQ ID NO: 200560 - RNA, 22 nt, Human
gauucaaaaguuugagcuccaa

SEQ ID NO: 200561 - RNA, 22 nt, Human
uauuucaucuggaacaagguaa

SEQ ID NO: 200562 - RNA, 22 nt, Human
ccucagaagcucaaggacauug

SEQ ID NO: 200563 - RNA, 22 nt, Human
uacauguuuacuccaagucagg

SEQ ID NO: 200564 - RNA, 22 nt, Human
auaaacugaagggaacacugag

SEQ ID NO: 200565 - RNA, 22 nt, Human
uguccuggccaaggccuugcuu

SEQ ID NO: 200566 - RNA, 22 nt, Human
ccaaaggcggaacugagucucu

SEQ ID NO: 200567 - RNA, 22 nt, Human
acuuuagauauuccucuguaca

SEQ ID NO: 200568 - RNA, 22 nt, Human
uuuugcuguguccuugagccgg

SEQ ID NO: 200569 - RNA, 22 nt, Human
uccaguggcaccuuggcccuca

SEQ ID NO: 200570 - RNA, 22 nt, Human
ucacucugggcccuacugggcu

SEQ ID NO: 200571 - RNA, 20 nt, Human
ugugcaggagagugaggcug

SEQ ID NO: 200572 - RNA, 18 nt, Human
guuaacaauuacuaacgc

SEQ ID NO: 200573 - RNA, 22 nt, Human
gcaccagccugagccucuugca

SEQ ID NO: 200574 - RNA, 22 nt, Human
acagaagcucaagagagcagug

SEQ ID NO: 200575 - RNA, 22 nt, Human
ugcccagguuugagugcccaag

SEQ ID NO: 200576 - RNA, 22 nt, Human
aaauucacuugccugcuuagcu

SEQ ID NO: 200577 - RNA, 22 nt, Human
uguagauuuuggagucuacaag

SEQ ID NO: 200578 - RNA, 22 nt, Human
caugaggauccaggugacaggc

SEQ ID NO: 200579 - RNA, 22 nt, Human
ucucuagacauggggaauguca

SEQ ID NO: 200580 - RNA, 22 nt, Human
agcagcagggucauugcucuuu

SEQ ID NO: 200581 - RNA, 22 nt, Human
ccacaggaggauguucagacaa

SEQ ID NO: 200582 - RNA, 20 nt, Human
gggcagccucgggagugggu

SEQ ID NO: 200583 - RNA, 22 nt, Human
aguaggacuagggguugaggca

SEQ ID NO: 200584 - RNA, 22 nt, Human
cucaucugucugggcugguuuu

SEQ ID NO: 200585 - RNA, 22 nt, Human
acauuuauauaacucacuagga

SEQ ID NO: 200586 - RNA, 22 nt, Human
ucuuacauauacgucauuuagu

SEQ ID NO: 200587 - RNA, 22 nt, Human
ggcccagcugggcggggacacg

SEQ ID NO: 200588 - RNA, 22 nt, Human
gcuggcuucccuaccugcaccu

SEQ ID NO: 200589 - RNA, 22 nt, Human
agugccuggaccccaugacaua

SEQ ID NO: 200590 - RNA, 22 nt, Human
ugggcuccguugccuggggcag

SEQ ID NO: 200591 - RNA, 22 nt, Human
gagagguccauuccccugucag

SEQ ID NO: 200592 - RNA, 22 nt, Human
uucaggcaucccuacaguuagg

SEQ ID NO: 200593 - RNA, 22 nt, Human
aaaauccacaacgcucauuuca

SEQ ID NO: 200594 - RNA, 22 nt, Human
uccaucugguaaaauucauuga

SEQ ID NO: 200595 - RNA, 22 nt, Human
cagugcagaggccagggaggau

SEQ ID NO: 200596 - RNA, 22 nt, Human
gucuggaggaggaagaaggcac

SEQ ID NO: 200597 - RNA, 22 nt, Human
uuauucaccauuuauuauguga

SEQ ID NO: 200598 - RNA, 22 nt, Human
cugggagaugacucagagcagg

SEQ ID NO: 200599 - RNA, 22 nt, Human
aaugaugaguucuaauagaccc

SEQ ID NO: 200600 - RNA, 22 nt, Human
cauccauucagugcaaaucaca

SEQ ID NO: 200601 - RNA, 22 nt, Human
gccugaccucuucugcccuggg

SEQ ID NO: 200602 - RNA, 22 nt, Human
aaccugcaguuuuuauucugag

SEQ ID NO: 200603 - RNA, 22 nt, Human
gcagagauggcugccucugagu

SEQ ID NO: 200604 - RNA, 22 nt, Human
aaacaugaugccuguacuaaga

SEQ ID NO: 200605 - RNA, 22 nt, Human
guauccuccccgcuggccuuca

SEQ ID NO: 200606 - RNA, 22 nt, Human
ugccuuggauugcagggaaccu

SEQ ID NO: 200607 - RNA, 23 nt, Human
ccacugaagaauccagggaguuu

SEQ ID NO: 200608 - RNA, 22 nt, Human
agcaucugcauauugggagacc

SEQ ID NO: 200609 - RNA, 22 nt, Human
gcugaaaugccuuguaaauauu

SEQ ID NO: 200610 - RNA, 22 nt, Human
gaauuacauaguuucuagguuc

SEQ ID NO: 200611 - RNA, 22 nt, Human
uaggcugggcauucuggccagg

SEQ ID NO: 200612 - RNA, 22 nt, Human
aaaggcuucacuuauuuauuuu

SEQ ID NO: 200613 - RNA, 21 nt, Human
ccagcuccaggaccuuggauc

SEQ ID NO: 200614 - RNA, 18 nt, Human
uggcagggaggaaauaua

SEQ ID NO: 200615 - RNA, 22 nt, Human
ccaugacauuuuaauuuucacu

SEQ ID NO: 200616 - RNA, 22 nt, Human
gagguggugguggaggcauagc

SEQ ID NO: 200617 - RNA, 22 nt, Human
agagccugcaguggagaccuug

SEQ ID NO: 200618 - RNA, 22 nt, Human
aguguauugauuggaacagccu

SEQ ID NO: 200619 - RNA, 22 nt, Human
uggcccugcuguaucaucugcu

SEQ ID NO: 200620 - RNA, 22 nt, Human
uuguaaauaguaguaagaugcc

SEQ ID NO: 200621 - RNA, 22 nt, Human
uauuggucaauuucaccuugau

SEQ ID NO: 200622 - RNA, 20 nt, Human
ccuuucuggagugcuguuca

SEQ ID NO: 200623 - RNA, 22 nt, Human
acaucuuuguuucuuaguguau

SEQ ID NO: 200624 - RNA, 22 nt, Human
uuauaacacugccuugucacca

SEQ ID NO: 200625 - RNA, 22 nt, Human
acaaggaggucuggggggcccu

SEQ ID NO: 200626 - RNA, 22 nt, Human
gcugugugcucacguaguggaa

SEQ ID NO: 200627 - RNA, 23 nt, Human
ggccacuuugugucaguaugugc

SEQ ID NO: 200628 - RNA, 22 nt, Human
ucuccugcagucagcagucuca

SEQ ID NO: 200629 - RNA, 22 nt, Human
gcucccagggacacuggccacu

SEQ ID NO: 200630 - RNA, 22 nt, Human
uccuggggcucugagcgagaca

SEQ ID NO: 200631 - RNA, 22 nt, Human
gaggccuccucugagacaucug

SEQ ID NO: 200632 - RNA, 18 nt, Human
cccagugcucacugccuc

SEQ ID NO: 200633 - RNA, 22 nt, Human
accaggcuggagugcaguggcg

SEQ ID NO: 200634 - RNA, 18 nt, Human
uccaggcuggauugauga

SEQ ID NO: 200635 - RNA, 22 nt, Human
gcagggcacacaagaaugauaa

SEQ ID NO: 200636 - RNA, 17 nt, Human
ccagaugcccugucucc

SEQ ID NO: 200637 - RNA, 22 nt, Human
uauuauuauauuggaugagacu

SEQ ID NO: 200638 - RNA, 20 nt, Human
ucuguucaaaucuuaguucc

SEQ ID NO: 200639 - RNA, 22 nt, Human
uacaucuaucuagaugcucaga

SEQ ID NO: 200640 - RNA, 22 nt, Human
gcuguucauagaaauggucuca

SEQ ID NO: 200641 - RNA, 22 nt, Human
ggaaggcugugccagaagaacu

SEQ ID NO: 200642 - RNA, 22 nt, Human
cugcacagccugucugggggcc

SEQ ID NO: 200643 - RNA, 22 nt, Human
uuaaaugucaauagauugcuug

SEQ ID NO: 200644 - RNA, 22 nt, Human
gcucugagugauuaaggagcuu

SEQ ID NO: 200645 - RNA, 22 nt, Human
caggcccacugcuugucuaguc

SEQ ID NO: 200646 - RNA, 21 nt, Human
aaucauacaaaacaugucagg

SEQ ID NO: 200647 - RNA, 22 nt, Human
ccagggcauguaacuaauggug

SEQ ID NO: 200648 - RNA, 22 nt, Human
gguccuggcagcucugugucca

SEQ ID NO: 200649 - RNA, 22 nt, Human
gaggcacaguguuuggucagug

SEQ ID NO: 200650 - RNA, 22 nt, Human
acagcuccuaacaaaggcucuc

SEQ ID NO: 200651 - RNA, 22 nt, Human
cuuauaguaugauguugagaau

SEQ ID NO: 200652 - RNA, 22 nt, Human
ccaggcaggcuagaauguaaau

SEQ ID NO: 200653 - RNA, 22 nt, Human
gcaggccuuuaucccugccuca

SEQ ID NO: 200654 - RNA, 22 nt, Human
uucuuacauauuuucauauggu

SEQ ID NO: 200655 - RNA, 22 nt, Human
caacaauaugccagacucaauu

SEQ ID NO: 200656 - RNA, 22 nt, Human
aggagagaauguuccaggcuug

SEQ ID NO: 200657 - RNA, 18 nt, Human
gccugagggucaagugug

SEQ ID NO: 200658 - RNA, 22 nt, Human
auucagcaaacauuuauugugu

SEQ ID NO: 200659 - RNA, 22 nt, Human
aagugaaucuccuuucuuuauu

SEQ ID NO: 200660 - RNA, 22 nt, Human
ugcaggugccucuugagcuugu

SEQ ID NO: 200661 - RNA, 22 nt, Human
ugcaucagugacugaauaugag

SEQ ID NO: 200662 - RNA, 22 nt, Human
uucucccaucucagucuuacau

SEQ ID NO: 200663 - RNA, 22 nt, Human
auacagaugggucagauuucau

SEQ ID NO: 200664 - RNA, 22 nt, Human
acuguaaagcuuuucucaugcg

SEQ ID NO: 200665 - RNA, 22 nt, Human
aaagccagcucugagcugcacc

SEQ ID NO: 200666 - RNA, 22 nt, Human
ggucacuccaccuucuccaccu

SEQ ID NO: 200667 - RNA, 22 nt, Human
uuuuccaaaguaccaugucccu

SEQ ID NO: 200668 - RNA, 22 nt, Human
uguuagagcuaagauaacaucu

SEQ ID NO: 200669 - RNA, 21 nt, Human
aggcuucuccgugcaggaaga

SEQ ID NO: 200670 - RNA, 22 nt, Human
cuccucagcugggaggaguccc

SEQ ID NO: 200671 - RNA, 22 nt, Human
acugugcaguguuguaacccga

SEQ ID NO: 200672 - RNA, 22 nt, Human
agagucuucuggggccacuuuc

SEQ ID NO: 200673 - RNA, 22 nt, Human
aaugauauuuauugaauagaug

SEQ ID NO: 200674 - RNA, 22 nt, Human
ggaggccaucagggagggcauu

SEQ ID NO: 200675 - RNA, 22 nt, Human
gucuccagcccacucuagauau

SEQ ID NO: 200676 - RNA, 22 nt, Human
aaguuacaguuggaacugugaa

SEQ ID NO: 200677 - RNA, 22 nt, Human
ccacaucugcagucccuucugu

SEQ ID NO: 200678 - RNA, 22 nt, Human
uuccucagugcccccauacggu

SEQ ID NO: 200679 - RNA, 22 nt, Human
gcagaagcagggcaggggcaaa

SEQ ID NO: 200680 - RNA, 22 nt, Human
ucucuggagcugcagauccagg

SEQ ID NO: 200681 - RNA, 22 nt, Human
uucaaacaguugcacaacuuau

SEQ ID NO: 200682 - RNA, 22 nt, Human
aagguccuuuugcagugugauc

SEQ ID NO: 200683 - RNA, 22 nt, Human
gaauuaacuggcaguuagugcu

SEQ ID NO: 200684 - RNA, 22 nt, Human
uggaccacucuggugcccaugu

SEQ ID NO: 200685 - RNA, 22 nt, Human
ugguccugcccacgcccaucug

SEQ ID NO: 200686 - RNA, 21 nt, Human
aggcccuggaggucagagaaa

SEQ ID NO: 200687 - RNA, 18 nt, Human
aggaaagacgaagagggc

SEQ ID NO: 200688 - RNA, 22 nt, Human
agggcagccauugagggauucu

SEQ ID NO: 200689 - RNA, 22 nt, Human
cuccugggaauuuaguugugag

SEQ ID NO: 200690 - RNA, 22 nt, Human
uuaaauuccagccucauaauag

SEQ ID NO: 200691 - RNA, 22 nt, Human
gaaaggaaauugagggacgcau

SEQ ID NO: 200692 - RNA, 22 nt, Human
ucacagaaucucugauaagucu

SEQ ID NO: 200693 - RNA, 22 nt, Human
acccagcuguuucccgugucau

SEQ ID NO: 200694 - RNA, 22 nt, Human
agcuggccggccuccaggugga

SEQ ID NO: 200695 - RNA, 22 nt, Human
gaaucuagggccuagaucacag

SEQ ID NO: 200696 - RNA, 22 nt, Human
ccagagcugaugggcccagggu

SEQ ID NO: 200697 - RNA, 22 nt, Human
gcuagaaaucgacuucagaauu

SEQ ID NO: 200698 - RNA, 22 nt, Human
cuucuccucugaguccugggag

SEQ ID NO: 200699 - RNA, 22 nt, Human
aagauguaaaggcaauauaaag

SEQ ID NO: 200700 - RNA, 22 nt, Human
caaugauuuuuccauugcagga

SEQ ID NO: 200701 - RNA, 22 nt, Human
uaugaaaagguggccaauguag

SEQ ID NO: 200702 - RNA, 22 nt, Human
uucauugcaguucuucagguua

SEQ ID NO: 200703 - RNA, 22 nt, Human
ccaaguguuuuauaagggacag

SEQ ID NO: 200704 - RNA, 22 nt, Human
acacacuuuaaauuaaaccucu

SEQ ID NO: 200705 - RNA, 22 nt, Human
guggcugcagcccagcggcacg

SEQ ID NO: 200706 - RNA, 22 nt, Human
agggccucuggaacacugaggg

SEQ ID NO: 200707 - RNA, 22 nt, Human
caaaguuaucaacugcaacauu

SEQ ID NO: 200708 - RNA, 22 nt, Human
ucucaagcuuguugguauguuu

SEQ ID NO: 200709 - RNA, 22 nt, Human
cucugagggucuaaggagucac

SEQ ID NO: 200710 - RNA, 22 nt, Human
guggcgaggggagguccuggcg

SEQ ID NO: 200711 - RNA, 22 nt, Human
uaggaaauuagaacuuggaaac

SEQ ID NO: 200712 - RNA, 22 nt, Human
cagggccucuccuccaggaacu

SEQ ID NO: 200713 - RNA, 22 nt, Human
aggcaagauuaggaccagaaga

SEQ ID NO: 200714 - RNA, 22 nt, Human
ggccuaguuuuuucugguaggu

SEQ ID NO: 200715 - RNA, 22 nt, Human
cagugggggggccaugcugcag

SEQ ID NO: 200716 - RNA, 22 nt, Human
cagagccucagaauccugugga

SEQ ID NO: 200717 - RNA, 22 nt, Human
cuggagaguuggaagauggacu

SEQ ID NO: 200718 - RNA, 22 nt, Human
aguaaacauaauuuaccuguag

SEQ ID NO: 200719 - RNA, 22 nt, Human
aggcugugaaauguggcaagga

SEQ ID NO: 200720 - RNA, 22 nt, Human
cuguuuccccaugcccugacuc

SEQ ID NO: 200721 - RNA, 22 nt, Human
uccugaggcuaaagugcagugg

SEQ ID NO: 200722 - RNA, 22 nt, Human
aaaacauguccauacagaaacu

SEQ ID NO: 200723 - RNA, 20 nt, Human
uaacaguaagugauguuaca

SEQ ID NO: 200724 - RNA, 22 nt, Human
aaguauuucagcgguucuuugu

SEQ ID NO: 200725 - RNA, 22 nt, Human
acuccugugagguagguggcaa

SEQ ID NO: 200726 - RNA, 21 nt, Human
accuucaagccagaggugguc

SEQ ID NO: 200727 - RNA, 22 nt, Human
agcccuccaaagguugggggag

SEQ ID NO: 200728 - RNA, 22 nt, Human
uuaauagugcuaaaccauugac

SEQ ID NO: 200729 - RNA, 22 nt, Human
ucaaggaggugcuuggcuucac

SEQ ID NO: 200730 - RNA, 18 nt, Human
ggccuuaguaugugccuu

SEQ ID NO: 200731 - RNA, 22 nt, Human
uuuaaaauuuagaccucuccac

SEQ ID NO: 200732 - RNA, 22 nt, Human
gaguauucaauauauacaaaug

SEQ ID NO: 200733 - RNA, 22 nt, Human
gacgccucuucccugcugcacu

SEQ ID NO: 200734 - RNA, 20 nt, Human
guggccuguccuguuguggg

SEQ ID NO: 200735 - RNA, 22 nt, Human
gucuggagacuugggucaucaa

SEQ ID NO: 200736 - RNA, 17 nt, Human
acagaggcaggagugga

SEQ ID NO: 200737 - RNA, 22 nt, Human
ccuggcuggacuggaccguggc

SEQ ID NO: 200738 - RNA, 22 nt, Human
aggccucugggccugcggguuu

SEQ ID NO: 200739 - RNA, 22 nt, Human
ggcagaggaagcuggaaguggg

SEQ ID NO: 200740 - RNA, 22 nt, Human
uucagaaauucauggaguucag

SEQ ID NO: 200741 - RNA, 22 nt, Human
agaaaguacagaugagacacuu

SEQ ID NO: 200742 - RNA, 22 nt, Human
agucaaauaucuuaaaaggcua

SEQ ID NO: 200743 - RNA, 22 nt, Human
ugggcacaaacaucugccuguu

SEQ ID NO: 200744 - RNA, 22 nt, Human
aggaaggcacauuguuggcuaa

SEQ ID NO: 200745 - RNA, 22 nt, Human
acagggggucccauggccugga

SEQ ID NO: 200746 - RNA, 22 nt, Human
caggagaaacauaauuuucugg

SEQ ID NO: 200747 - RNA, 22 nt, Human
uccagcagaccaucaaggcuca

SEQ ID NO: 200748 - RNA, 22 nt, Human
gcuagccugcaguggcuauggu

SEQ ID NO: 200749 - RNA, 22 nt, Human
uuggaagcauucugaaugucca

SEQ ID NO: 200750 - RNA, 22 nt, Human
uacaugugguagggagggcagu

SEQ ID NO: 200751 - RNA, 22 nt, Human
ucccugagagcacuggggagcc

SEQ ID NO: 200752 - RNA, 22 nt, Human
gugagcauauauguaaucguuu

SEQ ID NO: 200753 - RNA, 19 nt, Human
uagcugauagcuacuuuau

SEQ ID NO: 200754 - RNA, 22 nt, Human
gcuggccuugugucugaggaag

SEQ ID NO: 200755 - RNA, 22 nt, Human
auugaaagauuuugggcucaug

SEQ ID NO: 200756 - RNA, 22 nt, Human
gcuccuggcauccugcuuuuaa

SEQ ID NO: 200757 - RNA, 22 nt, Human
ucacauuuauuucaaaguuacu

SEQ ID NO: 200758 - RNA, 22 nt, Human
cauccugcggggagcagagggc

SEQ ID NO: 200759 - RNA, 22 nt, Human
cagagcugucauuugccaguga

SEQ ID NO: 200760 - RNA, 22 nt, Human
aagauaaugugucugucuuugc

SEQ ID NO: 200761 - RNA, 22 nt, Human
uaggaaaugaaugcaggcuccc

SEQ ID NO: 200762 - RNA, 22 nt, Human
ggaggaugccaagcugugcaca

SEQ ID NO: 200763 - RNA, 22 nt, Human
cuaucucuccacaaugccagug

SEQ ID NO: 200764 - RNA, 22 nt, Human
uaacagaauuugcuaaacuccg

SEQ ID NO: 200765 - RNA, 22 nt, Human
ccugccaggagcuggugcugca

SEQ ID NO: 200766 - RNA, 22 nt, Human
agcagggggccacagucacagc

SEQ ID NO: 200767 - RNA, 23 nt, Human
cacuuccccuguggcgagccugc

SEQ ID NO: 200768 - RNA, 22 nt, Human
caggccugggcuucggggcuga

SEQ ID NO: 200769 - RNA, 22 nt, Human
uguggcaggcauucugaggcug

SEQ ID NO: 200770 - RNA, 22 nt, Human
gugagaagauaaguauugcaaa

SEQ ID NO: 200771 - RNA, 22 nt, Human
ugguaagaacccaucagagaag

SEQ ID NO: 200772 - RNA, 22 nt, Human
gcuuugugugaaguccauggcg

SEQ ID NO: 200773 - RNA, 22 nt, Human
aagccacugagauuucacugca

SEQ ID NO: 200774 - RNA, 22 nt, Human
caggcacuguguuaggcacugu

SEQ ID NO: 200775 - RNA, 22 nt, Human
ggcagaccucuccagccccaca

SEQ ID NO: 200776 - RNA, 22 nt, Human
aggacaugugccuccagggcag

SEQ ID NO: 200777 - RNA, 22 nt, Human
ugaggacaugagugggacagag

SEQ ID NO: 200778 - RNA, 22 nt, Human
aaguccaugaucaagauguggc

SEQ ID NO: 200779 - RNA, 22 nt, Human
agcaagcagugaaguugaaugu

SEQ ID NO: 200780 - RNA, 22 nt, Human
ucugagacccauacaggcccac

SEQ ID NO: 200781 - RNA, 22 nt, Human
gcacacagagaggugguauguc

SEQ ID NO: 200782 - RNA, 22 nt, Human
ggaaacaugccugcuggacagu

SEQ ID NO: 200783 - RNA, 22 nt, Human
uacagagacccacaagagacug

SEQ ID NO: 200784 - RNA, 22 nt, Human
uuguccagagccaggcugucgg

SEQ ID NO: 200785 - RNA, 22 nt, Human
aaagaaauaccuuucucagcuu

SEQ ID NO: 200786 - RNA, 22 nt, Human
uuggcauuuauucuaaggucaa

SEQ ID NO: 200787 - RNA, 22 nt, Human
accaguuauuagcccuacaacu

SEQ ID NO: 200788 - RNA, 22 nt, Human
aaaggucuuaagguuaagcagg

SEQ ID NO: 200789 - RNA, 22 nt, Human
aggcccaguccucugccgucug

SEQ ID NO: 200790 - RNA, 22 nt, Human
uacaguuccaggaucauagggu

SEQ ID NO: 200791 - RNA, 19 nt, Human
gccucugagggcaggacac

SEQ ID NO: 200792 - RNA, 22 nt, Human
cacaugaguccugccagguaug

SEQ ID NO: 200793 - RNA, 22 nt, Human
agacaucaaugaucagagguag

SEQ ID NO: 200794 - RNA, 22 nt, Human
uggcuaagcuggggaggccugg

SEQ ID NO: 200795 - RNA, 20 nt, Human
ccaagagcaugcaugaggaa

SEQ ID NO: 200796 - RNA, 22 nt, Human
uccagcacccaauguggcuaag

SEQ ID NO: 200797 - RNA, 22 nt, Human
gaggaaggucccaucagaauuu

SEQ ID NO: 200798 - RNA, 22 nt, Human
uaacugguuaagggugaaaucc

SEQ ID NO: 200799 - RNA, 22 nt, Human
cauuacaaccccaaauuacaaa

SEQ ID NO: 200800 - RNA, 22 nt, Human
uccaggcauagaaggcacgcac

SEQ ID NO: 200801 - RNA, 22 nt, Human
uagugucaggagggaaaugcaa

SEQ ID NO: 200802 - RNA, 22 nt, Human
guggguggaucaccugagguca

SEQ ID NO: 200803 - RNA, 22 nt, Human
gugcaguggcagauccuagcuc

SEQ ID NO: 200804 - RNA, 22 nt, Human
ccucccuccauugccaucgucu

SEQ ID NO: 200805 - RNA, 22 nt, Human
caggaucugcccaggccuuugg

SEQ ID NO: 200806 - RNA, 22 nt, Human
ccagccagcugguuggacgccu

SEQ ID NO: 200807 - RNA, 22 nt, Human
ucuauauuccagauacagauua

SEQ ID NO: 200808 - RNA, 22 nt, Human
ugccaggcugucaauucaccca

SEQ ID NO: 200809 - RNA, 22 nt, Human
auacacguguguguacaugcac

SEQ ID NO: 200810 - RNA, 22 nt, Human
cucaagaucaucaauauaccaa

SEQ ID NO: 200811 - RNA, 22 nt, Human
gguccagccaggugcucaugcc

SEQ ID NO: 200812 - RNA, 22 nt, Human
gaugugucuauucaacaugaaa

SEQ ID NO: 200813 - RNA, 22 nt, Human
ugggccaguccagccccaggga

SEQ ID NO: 200814 - RNA, 22 nt, Human
aacugagguaucugcuguguuu

SEQ ID NO: 200815 - RNA, 22 nt, Human
auccauauaggcagauggcaca

SEQ ID NO: 200816 - RNA, 22 nt, Human
auuuggaacaaauauuaguaaa

SEQ ID NO: 200817 - RNA, 22 nt, Human
cgguccuggcacuugcggcucc

SEQ ID NO: 200818 - RNA, 22 nt, Human
agacaggccacucuggucuggu

SEQ ID NO: 200819 - RNA, 22 nt, Human
gaggcuuuucucuaaauagugg

SEQ ID NO: 200820 - RNA, 22 nt, Human
aucagaaauagucauguuacuu

SEQ ID NO: 200821 - RNA, 22 nt, Human
agguucugguaagcuguugcuu

SEQ ID NO: 200822 - RNA, 19 nt, Human
gcagggcucucccagaugc

SEQ ID NO: 200823 - RNA, 22 nt, Human
ggucagggggaucugugaggua

SEQ ID NO: 200824 - RNA, 22 nt, Human
gcagugucagugccuggguggu

SEQ ID NO: 200825 - RNA, 22 nt, Human
cagcugucuaaguugagcagga

SEQ ID NO: 200826 - RNA, 22 nt, Human
agagccuugcucuaaauuucuc

SEQ ID NO: 200827 - RNA, 17 nt, Human
ccagagcuacugagacu

SEQ ID NO: 200828 - RNA, 22 nt, Human
cuccuggcaguuccccuuguca

SEQ ID NO: 200829 - RNA, 22 nt, Human
aucucugugccaucauugcccc

SEQ ID NO: 200830 - RNA, 22 nt, Human
auccacagucuuagccaucaaa

SEQ ID NO: 200831 - RNA, 22 nt, Human
accaaaaauuguggggcugaau

SEQ ID NO: 200832 - RNA, 22 nt, Human
ucaaggagacagaaagcaaugg

SEQ ID NO: 200833 - RNA, 22 nt, Human
auuaauaaaauaccacuuuguu

SEQ ID NO: 200834 - RNA, 22 nt, Human
gagcacagcugucuugcaagcu

SEQ ID NO: 200835 - RNA, 22 nt, Human
uauugauuccugcuuucugcuc

SEQ ID NO: 200836 - RNA, 22 nt, Human
ugugccuggagucccugaggag

SEQ ID NO: 200837 - RNA, 22 nt, Human
ggucagaaggauucugggaaau

SEQ ID NO: 200838 - RNA, 22 nt, Human
ggacugggagaauggaggcaag

SEQ ID NO: 200839 - RNA, 22 nt, Human
agcugcaguucguuccagcucu

SEQ ID NO: 200840 - RNA, 22 nt, Human
agcaguggcauacauuuugagu

SEQ ID NO: 200841 - RNA, 22 nt, Human
ccagggcaggggcuggaguuca

SEQ ID NO: 200842 - RNA, 22 nt, Human
uugcugaauugaauccuuuggu

SEQ ID NO: 200843 - RNA, 22 nt, Human
uccaggcugugcaugaguuuag

SEQ ID NO: 200844 - RNA, 19 nt, Human
acaggcagaauugggugug

SEQ ID NO: 200845 - RNA, 22 nt, Human
gcagggacaaggcagguguucu

SEQ ID NO: 200846 - RNA, 22 nt, Human
cuccuggagcagcaggcgcagg

SEQ ID NO: 200847 - RNA, 22 nt, Human
augcugugucaggaauuugaua

SEQ ID NO: 200848 - RNA, 22 nt, Human
acacauguuuguguagucaguu

SEQ ID NO: 200849 - RNA, 22 nt, Human
gggagcgggacugcgcaggcuu

SEQ ID NO: 200850 - RNA, 22 nt, Human
cagagcugauuggauccagaga

SEQ ID NO: 200851 - RNA, 22 nt, Human
cugcaccauccuucaugcucug

SEQ ID NO: 200852 - RNA, 22 nt, Human
ucgcugugaaaaccuuggacaa

SEQ ID NO: 200853 - RNA, 20 nt, Human
agugggagagggcagacugc

SEQ ID NO: 200854 - RNA, 22 nt, Human
gcacagcccuggucggggcccc

SEQ ID NO: 200855 - RNA, 22 nt, Human
acuggcuuugccucugccucuc

SEQ ID NO: 200856 - RNA, 22 nt, Human
gcagagcccuggggguauggug

SEQ ID NO: 200857 - RNA, 22 nt, Human
aaaacuuucagggauacagaaa

SEQ ID NO: 200858 - RNA, 22 nt, Human
agagacaggguuuugucguguu

SEQ ID NO: 200859 - RNA, 22 nt, Human
gacacaguuuuucucacggugg

SEQ ID NO: 200860 - RNA, 22 nt, Human
auagucagugucuauaucguug

SEQ ID NO: 200861 - RNA, 22 nt, Human
aagagguugucugugaugaguu

SEQ ID NO: 200862 - RNA, 22 nt, Human
aaacagaguuugguaaauagcc

SEQ ID NO: 200863 - RNA, 22 nt, Human
cagucccaccaggaucgcucuu

SEQ ID NO: 200864 - RNA, 17 nt, Human
cagacaggcugucaccc

SEQ ID NO: 200865 - RNA, 22 nt, Human
aaaggcaagcauuuauauagga

SEQ ID NO: 200866 - RNA, 22 nt, Human
cucccugggcagauguggcucu

SEQ ID NO: 200867 - RNA, 22 nt, Human
gcuggcagagacaagaagacua

SEQ ID NO: 200868 - RNA, 22 nt, Human
agcagccacccagcugcucauu

SEQ ID NO: 200869 - RNA, 22 nt, Human
uguacaugugucuguauaucuu

SEQ ID NO: 200870 - RNA, 18 nt, Human
aacaguuuccagauucuc

SEQ ID NO: 200871 - RNA, 22 nt, Human
uggaugucauaguuggauauac

SEQ ID NO: 200872 - RNA, 22 nt, Human
aucucagggcuggagcccugga

SEQ ID NO: 200873 - RNA, 22 nt, Human
accaugaugggaagcucagggc

SEQ ID NO: 200874 - RNA, 22 nt, Human
aacuuugggccuaaguacuguu

SEQ ID NO: 200875 - RNA, 23 nt, Human
cucaacccuaguaagggaguagg

SEQ ID NO: 200876 - RNA, 22 nt, Human
gcagcuuucugcaaugucaucc

SEQ ID NO: 200877 - RNA, 22 nt, Human
ugcacccacuuagcugaaguuc

SEQ ID NO: 200878 - RNA, 21 nt, Human
ggccccagcccauggguucuc

SEQ ID NO: 200879 - RNA, 22 nt, Human
ucccaggaaaacacucgaggac

SEQ ID NO: 200880 - RNA, 22 nt, Human
acuguaaaauacauaaguauug

SEQ ID NO: 200881 - RNA, 22 nt, Human
uacaagugcuagcagauauugu

SEQ ID NO: 200882 - RNA, 22 nt, Human
ugacagcaugaccacagggucu

SEQ ID NO: 200883 - RNA, 22 nt, Human
aaagccagaauucguccagccu

SEQ ID NO: 200884 - RNA, 22 nt, Human
ucucagaaaugacaggagguac

SEQ ID NO: 200885 - RNA, 22 nt, Human
uguauauauuucuuucauucua

SEQ ID NO: 200886 - RNA, 22 nt, Human
uaaaaguuagcuaggacaaagu

SEQ ID NO: 200887 - RNA, 22 nt, Human
augccaguaagucucagcuagg

SEQ ID NO: 200888 - RNA, 22 nt, Human
agcaggugggcaugaaagcuga

SEQ ID NO: 200889 - RNA, 22 nt, Human
ucaaugauaguacaaucagccu

SEQ ID NO: 200890 - RNA, 22 nt, Human
caaauaagcaauuccauucuuc

SEQ ID NO: 200891 - RNA, 22 nt, Human
uggcucccgcagacccugugcu

SEQ ID NO: 200892 - RNA, 22 nt, Human
ugccaggcugaacagggucuua

SEQ ID NO: 200893 - RNA, 22 nt, Human
caugaaaucugaguauguuucc

SEQ ID NO: 200894 - RNA, 22 nt, Human
aaggaagaugcuggccugggga

SEQ ID NO: 200895 - RNA, 23 nt, Human
ggcuccugcuucaugucccaccu

SEQ ID NO: 200896 - RNA, 22 nt, Human
gcugccuucccggaaugucauc

SEQ ID NO: 200897 - RNA, 23 nt, Human
aguggcugagaguguuucauaug

SEQ ID NO: 200898 - RNA, 22 nt, Human
acagaggguguggaggaagacg

SEQ ID NO: 200899 - RNA, 22 nt, Human
uccuguggagaggacuggaggu

SEQ ID NO: 200900 - RNA, 22 nt, Human
cagagucaauguccaagaagcu

SEQ ID NO: 200901 - RNA, 17 nt, Human
uuugguaauauauuaag

SEQ ID NO: 200902 - RNA, 22 nt, Human
ugccaggcuccggaacgacagu

SEQ ID NO: 200903 - RNA, 16 nt, Human
agccuuaggaacagcc

SEQ ID NO: 200904 - RNA, 22 nt, Human
auaugcaagcacauagaauacu

SEQ ID NO: 200905 - RNA, 22 nt, Human
ucagauauggagucuaaaacca

SEQ ID NO: 200906 - RNA, 22 nt, Human
gagaaucuccagaugaaguccu

SEQ ID NO: 200907 - RNA, 22 nt, Human
uccuccuuguucuuuugccuac

SEQ ID NO: 200908 - RNA, 22 nt, Human
uucucagagcacugcugacaaa

SEQ ID NO: 200909 - RNA, 22 nt, Human
cccaggauggggcugcaguuau

SEQ ID NO: 200910 - RNA, 22 nt, Human
ucugggaggggcugccauugcu

SEQ ID NO: 200911 - RNA, 22 nt, Human
ccuggcccagggacuuucgccu

SEQ ID NO: 200912 - RNA, 22 nt, Human
gcccaugccccuccuucuggca

SEQ ID NO: 200913 - RNA, 22 nt, Human
gcaaaguauuaaccaacaggau

SEQ ID NO: 200914 - RNA, 20 nt, Human
gaggcucugggcauggcgcc

SEQ ID NO: 200915 - RNA, 22 nt, Human
ggcuucuccuggaaguacagag

SEQ ID NO: 200916 - RNA, 22 nt, Human
cagcuucuagcaucggcuuuga

SEQ ID NO: 200917 - RNA, 19 nt, Human
gccuggcugggaugagccc

SEQ ID NO: 200918 - RNA, 22 nt, Human
cuggaggagagucugaaugaca

SEQ ID NO: 200919 - RNA, 22 nt, Human
cuggcccaggaagacguguccc

SEQ ID NO: 200920 - RNA, 22 nt, Human
acucagcacagcacugggaacc

SEQ ID NO: 200921 - RNA, 22 nt, Human
gagugggugacagaaggaggua

SEQ ID NO: 200922 - RNA, 18 nt, Human
cugggccagaguuucugc

SEQ ID NO: 200923 - RNA, 21 nt, Human
agccuggguauccuuugagga

SEQ ID NO: 200924 - RNA, 22 nt, Human
ugucagaacucuauugaugucc

SEQ ID NO: 200925 - RNA, 22 nt, Human
acuuccuggauucccaagggcu

SEQ ID NO: 200926 - RNA, 22 nt, Human
uaaggcuagugccugacugggu

SEQ ID NO: 200927 - RNA, 19 nt, Human
agcagcagaagugugccuu

SEQ ID NO: 200928 - RNA, 22 nt, Human
uucaggaagguccuauagcaga

SEQ ID NO: 200929 - RNA, 22 nt, Human
ccuguucaugaaacugcuuucc

SEQ ID NO: 200930 - RNA, 22 nt, Human
cuggccagagguuccucugccc

SEQ ID NO: 200931 - RNA, 19 nt, Human
ccuuccuccccagggccau

SEQ ID NO: 200932 - RNA, 22 nt, Human
cccagccaaggugcugguguug

SEQ ID NO: 200933 - RNA, 22 nt, Human
aggagcucccgugaggagacca

SEQ ID NO: 200934 - RNA, 22 nt, Human
uaggauuauuuguucuauuucu

SEQ ID NO: 200935 - RNA, 22 nt, Human
aaucuagaauuuuagggguaua

SEQ ID NO: 200936 - RNA, 22 nt, Human
ucagaguauuucauucuuaggu

SEQ ID NO: 200937 - RNA, 21 nt, Human
acagggcaugcagcuggcugu

SEQ ID NO: 200938 - RNA, 22 nt, Human
uucaugaauguuccaugugagu

SEQ ID NO: 200939 - RNA, 23 nt, Human
ugccucugccucccuagucugca

SEQ ID NO: 200940 - RNA, 22 nt, Human
cuccuccaguccuccaaggaca

SEQ ID NO: 200941 - RNA, 22 nt, Human
gacaaaacacauuaguuuaaaa

SEQ ID NO: 200942 - RNA, 22 nt, Human
uggcucagaggggaagugguuu

SEQ ID NO: 200943 - RNA, 19 nt, Human
aggaaggcggcggcugccc

SEQ ID NO: 200944 - RNA, 22 nt, Human
agggaggaucugcuccuugucu

SEQ ID NO: 200945 - RNA, 22 nt, Human
agaaccuuccaucacucccuac

SEQ ID NO: 200946 - RNA, 22 nt, Human
caggagcucacagucuuugggu

SEQ ID NO: 200947 - RNA, 22 nt, Human
ggcccagaauacaugaaguaua

SEQ ID NO: 200948 - RNA, 22 nt, Human
agucucuuggcauucugaaaca

SEQ ID NO: 200949 - RNA, 22 nt, Human
ccuggcugcuuucacuauggag

SEQ ID NO: 200950 - RNA, 22 nt, Human
cacagucuuaucccaaccacca

SEQ ID NO: 200951 - RNA, 16 nt, Human
caggaaacuuaaagac

SEQ ID NO: 200952 - RNA, 22 nt, Human
agaagcuaggcuagacaaguga

SEQ ID NO: 200953 - RNA, 22 nt, Human
cuggccaccaagagcuugcuca

SEQ ID NO: 200954 - RNA, 22 nt, Human
cucugggcacauuuuccaggac

SEQ ID NO: 200955 - RNA, 22 nt, Human
gcuaauaauuccuuugugaacu

SEQ ID NO: 200956 - RNA, 22 nt, Human
ucucagaaaagagcuucagaaa

SEQ ID NO: 200957 - RNA, 22 nt, Human
auguccagagccggccugcuga

SEQ ID NO: 200958 - RNA, 22 nt, Human
auuuccacauaagggaaauaag

SEQ ID NO: 200959 - RNA, 22 nt, Human
cuccaguaucuguaggaaaagg

SEQ ID NO: 200960 - RNA, 22 nt, Human
uguccaggacccuauucucacu

SEQ ID NO: 200961 - RNA, 22 nt, Human
cagagcagucuggagauccagc

SEQ ID NO: 200962 - RNA, 22 nt, Human
aucuuugacugccauucuugac

SEQ ID NO: 200963 - RNA, 22 nt, Human
aaagaaucagaagucucaaaca

SEQ ID NO: 200964 - RNA, 22 nt, Human
ccagccagaugauaagcucuau

SEQ ID NO: 200965 - RNA, 23 nt, Human
ucagucuuggcuucugauuuucc

SEQ ID NO: 200966 - RNA, 22 nt, Human
uuccuggggcgacuguaucuga

SEQ ID NO: 200967 - RNA, 22 nt, Human
uggaaagagaaacucuugcuaa

SEQ ID NO: 200968 - RNA, 22 nt, Human
acuguggccugcuguaugggcu

SEQ ID NO: 200969 - RNA, 22 nt, Human
agugaaauuccuggucuuuguu

SEQ ID NO: 200970 - RNA, 22 nt, Human
cucugcaugccuugcucagaca

SEQ ID NO: 200971 - RNA, 22 nt, Human
ugcugccagccaggccauggag

SEQ ID NO: 200972 - RNA, 22 nt, Human
aaggcagcaagaauuccagguu

SEQ ID NO: 200973 - RNA, 22 nt, Human
uugauucaaccacuuaauaauc

SEQ ID NO: 200974 - RNA, 22 nt, Human
ccuguacauggccaucuuuacc

SEQ ID NO: 200975 - RNA, 22 nt, Human
cuuaagaagcaagucucagcaa

SEQ ID NO: 200976 - RNA, 22 nt, Human
agcaaacagaugucuccuuuag

SEQ ID NO: 200977 - RNA, 22 nt, Human
cugucaggaagcugggcaucca

SEQ ID NO: 200978 - RNA, 22 nt, Human
ccuccugggcuccugucugcac

SEQ ID NO: 200979 - RNA, 22 nt, Human
ucugaagauggaggaacuuaga

SEQ ID NO: 200980 - RNA, 22 nt, Human
uccagguccuacuggcccauag

SEQ ID NO: 200981 - RNA, 22 nt, Human
auguaauuguagcaaaaugaug

SEQ ID NO: 200982 - RNA, 22 nt, Human
cacagguguguccuggucuugu

SEQ ID NO: 200983 - RNA, 22 nt, Human
caugaaauguuagaauuagaca

SEQ ID NO: 200984 - RNA, 21 nt, Human
uuugacuccucauuuuuauau

SEQ ID NO: 200985 - RNA, 22 nt, Human
ccaaaauuaagccucuuauguu

SEQ ID NO: 200986 - RNA, 22 nt, Human
aggcucuccuccccaggaccau

SEQ ID NO: 200987 - RNA, 22 nt, Human
gggaccucuggagucggccuua

SEQ ID NO: 200988 - RNA, 22 nt, Human
cacacaggagagugcuggaggu

SEQ ID NO: 200989 - RNA, 22 nt, Human
cauaauuauaaacgcaaguuca

SEQ ID NO: 200990 - RNA, 22 nt, Human
aguaaacauguaauuguucauu

SEQ ID NO: 200991 - RNA, 22 nt, Human
acagaugaguuaaagcagagug

SEQ ID NO: 200992 - RNA, 22 nt, Human
agauuaugcuggcugcuacaag

SEQ ID NO: 200993 - RNA, 22 nt, Human
uucuguacuucaggggcucugu

SEQ ID NO: 200994 - RNA, 22 nt, Human
ucagagagcuggugggcagagg

SEQ ID NO: 200995 - RNA, 22 nt, Human
acauucuauagcaagcugaucu

SEQ ID NO: 200996 - RNA, 22 nt, Human
uguguccuccagggagauguaa

SEQ ID NO: 200997 - RNA, 22 nt, Human
caguauaugcucuuucaucaaa

SEQ ID NO: 200998 - RNA, 22 nt, Human
acuuugcaaaaggaaaucaccu

SEQ ID NO: 200999 - RNA, 22 nt, Human
ucauuucugagccuuccaugau

SEQ ID NO: 201000 - RNA, 22 nt, Human
uguauacaugucugugugcaca

SEQ ID NO: 201001 - RNA, 22 nt, Human
caugaggucagggggagccggu

SEQ ID NO: 201002 - RNA, 22 nt, Human
aauaucuuggcccaacuccaga

SEQ ID NO: 201003 - RNA, 22 nt, Human
cacuccuguuccacuaaaugag

SEQ ID NO: 201004 - RNA, 22 nt, Human
gagugcagaugccagccccagu

SEQ ID NO: 201005 - RNA, 22 nt, Human
ucucugcauccccagggcucuc

SEQ ID NO: 201006 - RNA, 22 nt, Human
auggaaauaucuuuagagcuua

SEQ ID NO: 201007 - RNA, 22 nt, Human
gagacagaucucggcuccaugc

SEQ ID NO: 201008 - RNA, 21 nt, Human
uccuccuggccaggcggcccc

SEQ ID NO: 201009 - RNA, 22 nt, Human
aucucuggcaaugcagcaucgu

SEQ ID NO: 201010 - RNA, 22 nt, Human
uuguauuuggguaguauagaga

SEQ ID NO: 201011 - RNA, 22 nt, Human
gaccaagauacagcaucauaga

SEQ ID NO: 201012 - RNA, 22 nt, Human
ucugagccaauuucugugucca

SEQ ID NO: 201013 - RNA, 22 nt, Human
uacuucuggauauucagaacuu

SEQ ID NO: 201014 - RNA, 22 nt, Human
uggcugaguuacgaacagagca

SEQ ID NO: 201015 - RNA, 22 nt, Human
gccacuguugcuccucaggaaa

SEQ ID NO: 201016 - RNA, 22 nt, Human
gccgugucaucugcggguggca

SEQ ID NO: 201017 - RNA, 22 nt, Human
ucacucugagaggucacuggaa

SEQ ID NO: 201018 - RNA, 20 nt, Human
ugcugcaguuucaugggacu

SEQ ID NO: 201019 - RNA, 22 nt, Human
gcccuggagagggauauggcau

SEQ ID NO: 201020 - RNA, 22 nt, Human
acccucugagaggcacacuuug

SEQ ID NO: 201021 - RNA, 22 nt, Human
ugacauuuaagccucugauuuc

SEQ ID NO: 201022 - RNA, 22 nt, Human
aaaaguuugugcaaacacucag

SEQ ID NO: 201023 - RNA, 22 nt, Human
ggcugugcuuuguuagguuguc

SEQ ID NO: 201024 - RNA, 22 nt, Human
uaaauagagaaucagcuuggag

SEQ ID NO: 201025 - RNA, 22 nt, Human
uagcaagaucgugucucuaaaa

SEQ ID NO: 201026 - RNA, 22 nt, Human
uguuuuccuccugguuucugcc

SEQ ID NO: 201027 - RNA, 22 nt, Human
ucacagacgccuccccucgccu

SEQ ID NO: 201028 - RNA, 22 nt, Human
acccccacggaaggccguacgc

SEQ ID NO: 201029 - RNA, 22 nt, Human
guauccaugggggauugguucc

SEQ ID NO: 201030 - RNA, 22 nt, Human
ugguaauuuacgcauuucugua

SEQ ID NO: 201031 - RNA, 22 nt, Human
cugggccuggggcuguugagag

SEQ ID NO: 201032 - RNA, 17 nt, Human
gcauccaguaacaugcc

SEQ ID NO: 201033 - RNA, 22 nt, Human
cucccuggaggcccagaccugg

SEQ ID NO: 201034 - RNA, 22 nt, Human
uuucauugagaauauaagauuu

SEQ ID NO: 201035 - RNA, 22 nt, Human
uucugaggcacuggcucuccca

SEQ ID NO: 201036 - RNA, 22 nt, Human
cagugauggauauggagaaguc

SEQ ID NO: 201037 - RNA, 22 nt, Human
uaggccaggagucagacagauu

SEQ ID NO: 201038 - RNA, 22 nt, Human
gugaggagcucuuugacucacg

SEQ ID NO: 201039 - RNA, 22 nt, Human
ccugggucccugagagaugauu

SEQ ID NO: 201040 - RNA, 22 nt, Human
gagagcccugcauggcugauga

SEQ ID NO: 201041 - RNA, 22 nt, Human
uugcauuuuugagcacgaaguu

SEQ ID NO: 201042 - RNA, 22 nt, Human
ucucugugcuugacuuucccau

SEQ ID NO: 201043 - RNA, 22 nt, Human
gcugcccaauuacagggccgug

SEQ ID NO: 201044 - RNA, 22 nt, Human
auuuaguuuaggaaaaguaggu

SEQ ID NO: 201045 - RNA, 22 nt, Human
aggcucaguauagcuggcaagu

SEQ ID NO: 201046 - RNA, 22 nt, Human
gggacaggcaaagguaugcuuc

SEQ ID NO: 201047 - RNA, 22 nt, Human
aaagacuugggagcaguaugcu

SEQ ID NO: 201048 - RNA, 22 nt, Human
gcuguagguaaggauggcaaag

SEQ ID NO: 201049 - RNA, 22 nt, Human
aaguaguuggaaauaagacaga

SEQ ID NO: 201050 - RNA, 22 nt, Human
auauuaaugggauuuagucagg

SEQ ID NO: 201051 - RNA, 22 nt, Human
ucaaggaagauagcuauuauga

SEQ ID NO: 201052 - RNA, 22 nt, Human
uucuaagaaauggaaaacgauu

SEQ ID NO: 201053 - RNA, 22 nt, Human
acccauuccuuuacuucaucug

SEQ ID NO: 201054 - RNA, 23 nt, Human
cacagguguuucaucuucucagu

SEQ ID NO: 201055 - RNA, 22 nt, Human
agaggaauaugggugcacuaga

SEQ ID NO: 201056 - RNA, 22 nt, Human
acacauuucucuuuuuguaagu

SEQ ID NO: 201057 - RNA, 22 nt, Human
aucuaaagugucauaaguagcu

SEQ ID NO: 201058 - RNA, 22 nt, Human
ccacaggaccagaggagaucac

SEQ ID NO: 201059 - RNA, 22 nt, Human
caggaucuguuaaguuguucca

SEQ ID NO: 201060 - RNA, 22 nt, Human
ugaacaaacugcauucuucacu

SEQ ID NO: 201061 - RNA, 22 nt, Human
ugaacuuuguaguaauggagau

SEQ ID NO: 201062 - RNA, 22 nt, Human
uuccagugaugggcaauuuggu

SEQ ID NO: 201063 - RNA, 22 nt, Human
gaggccagacugccuuuuauga

SEQ ID NO: 201064 - RNA, 22 nt, Human
cugccugggccggccacccucu

SEQ ID NO: 201065 - RNA, 22 nt, Human
uuucaaauaccauaaaccuaau

SEQ ID NO: 201066 - RNA, 22 nt, Human
ggcugggccgcggcuacccaga

SEQ ID NO: 201067 - RNA, 22 nt, Human
gaguaguugcugcagagaauac

SEQ ID NO: 201068 - RNA, 22 nt, Human
aauuagaaccagaagccauauu

SEQ ID NO: 201069 - RNA, 22 nt, Human
aaggcucccucuucucgagugu

SEQ ID NO: 201070 - RNA, 22 nt, Human
caaggcuguguuagcugcccuc

SEQ ID NO: 201071 - RNA, 22 nt, Human
ugccaaauugcccuauaaauga

SEQ ID NO: 201072 - RNA, 22 nt, Human
ucccacccccuccaaggaggaa

SEQ ID NO: 201073 - RNA, 22 nt, Human
uacagaaacagcgugguuagaa

SEQ ID NO: 201074 - RNA, 22 nt, Human
ugaagaggccaaacuaucauug

SEQ ID NO: 201075 - RNA, 22 nt, Human
guuuucuggcaguuauuccuua

SEQ ID NO: 201076 - RNA, 22 nt, Human
uaguugacuucucuaucccagc

SEQ ID NO: 201077 - RNA, 22 nt, Human
auuuagaaguuggagggcaaga

SEQ ID NO: 201078 - RNA, 22 nt, Human
gaggccagugaaauguuauaaa

SEQ ID NO: 201079 - RNA, 22 nt, Human
ucaggaagcucuugcugauucu

SEQ ID NO: 201080 - RNA, 22 nt, Human
aagugauuuuccuacuugcuaa

SEQ ID NO: 201081 - RNA, 22 nt, Human
caagucauuguuuagucauguu

SEQ ID NO: 201082 - RNA, 22 nt, Human
ugcccagucuccgggccagccc

SEQ ID NO: 201083 - RNA, 20 nt, Human
uaaugucaaagucacaaggu

SEQ ID NO: 201084 - RNA, 22 nt, Human
ucuccuggcucaccaggcugga

SEQ ID NO: 201085 - RNA, 22 nt, Human
uauuugaagggagaaagugcca

SEQ ID NO: 201086 - RNA, 22 nt, Human
aguggcuaugcaugacuggaau

SEQ ID NO: 201087 - RNA, 22 nt, Human
uuccaggacuucauggcucuga

SEQ ID NO: 201088 - RNA, 22 nt, Human
caggacaaagcccuuugagaaa

SEQ ID NO: 201089 - RNA, 22 nt, Human
uuuagcagcaaauaaguagugc

SEQ ID NO: 201090 - RNA, 19 nt, Human
ucuguaacacucuagccuu

SEQ ID NO: 201091 - RNA, 22 nt, Human
aagggaggccagagguuuugca

SEQ ID NO: 201092 - RNA, 22 nt, Human
gaugaggcucaugcacccugcg

SEQ ID NO: 201093 - RNA, 22 nt, Human
ccagggcccacggccagaauag

SEQ ID NO: 201094 - RNA, 18 nt, Human
agaccagacaagaauggu

SEQ ID NO: 201095 - RNA, 22 nt, Human
ggccucuguuuggagccaggau

SEQ ID NO: 201096 - RNA, 22 nt, Human
aaggcuggagaugguuggaaug

SEQ ID NO: 201097 - RNA, 22 nt, Human
auccugggccucagaggugugu

SEQ ID NO: 201098 - RNA, 22 nt, Human
ggaggugguuugauuucuauau

SEQ ID NO: 201099 - RNA, 22 nt, Human
gaaauacuguaaaguuauuauu

SEQ ID NO: 201100 - RNA, 22 nt, Human
ccugcagagcaggagaggcauc

SEQ ID NO: 201101 - RNA, 22 nt, Human
ccagagagggcgccaccuggag

SEQ ID NO: 201102 - RNA, 22 nt, Human
aucuuguuaaaaagcagauucu

SEQ ID NO: 201103 - RNA, 22 nt, Human
agaaauacuaggaauauucaua

SEQ ID NO: 201104 - RNA, 22 nt, Human
ugguacaauggcaucuaucuau

SEQ ID NO: 201105 - RNA, 22 nt, Human
aguugcuggcaccugugaguau

SEQ ID NO: 201106 - RNA, 22 nt, Human
ucagucuuuugcccugaggagu

SEQ ID NO: 201107 - RNA, 22 nt, Human
cgguccagagcuaguucauugc

SEQ ID NO: 201108 - RNA, 18 nt, Human
gccugccaacuccugauc

SEQ ID NO: 201109 - RNA, 21 nt, Human
uucuucaugaugauuaauggc

SEQ ID NO: 201110 - RNA, 22 nt, Human
ugcaguuagccuaggauugagc

SEQ ID NO: 201111 - RNA, 22 nt, Human
ucauucaucugguguuaguccu

SEQ ID NO: 201112 - RNA, 22 nt, Human
uaacuuuaguguaugagguaag

SEQ ID NO: 201113 - RNA, 22 nt, Human
uauacacauaucuucuaggccu

SEQ ID NO: 201114 - RNA, 22 nt, Human
ugauuugcgucucauuugaaau

SEQ ID NO: 201115 - RNA, 22 nt, Human
uugcuauuuccugaaauaagca

SEQ ID NO: 201116 - RNA, 22 nt, Human
ccaggcuagagugcaauggcau

SEQ ID NO: 201117 - RNA, 22 nt, Human
guccuucagcuuuaucugaaca

SEQ ID NO: 201118 - RNA, 22 nt, Human
agucuucagcagccuucucagg

SEQ ID NO: 201119 - RNA, 22 nt, Human
agugucaauucucaaaucucgg

SEQ ID NO: 201120 - RNA, 22 nt, Human
aauuaucagauauaaaacugca

SEQ ID NO: 201121 - RNA, 22 nt, Human
caggaaaaucugcccacacaag

SEQ ID NO: 201122 - RNA, 22 nt, Human
uggcuuccgccgcgggccucgg

SEQ ID NO: 201123 - RNA, 22 nt, Human
aaauagcuacaugaucucuagg

SEQ ID NO: 201124 - RNA, 22 nt, Human
uuucugggacuggggagauucu

SEQ ID NO: 201125 - RNA, 22 nt, Human
ggcugcucggcagcuccugagc

SEQ ID NO: 201126 - RNA, 22 nt, Human
ggguaggcagugcguccugccu

SEQ ID NO: 201127 - RNA, 22 nt, Human
uaagcauuaacucugcugcaag

SEQ ID NO: 201128 - RNA, 22 nt, Human
cuggcacucauaggccaguuca

SEQ ID NO: 201129 - RNA, 22 nt, Human
auacagagaagggguagaggau

SEQ ID NO: 201130 - RNA, 21 nt, Human
gcccagcaaggugagaaggcc

SEQ ID NO: 201131 - RNA, 22 nt, Human
aaagugccugacucauaguuag

SEQ ID NO: 201132 - RNA, 22 nt, Human
uauuccaaaauaguuaagcacu

SEQ ID NO: 201133 - RNA, 22 nt, Human
gacuguacuugagagaggaacu

SEQ ID NO: 201134 - RNA, 22 nt, Human
cagaggcaggauaagaacugcg

SEQ ID NO: 201135 - RNA, 19 nt, Human
uggcaugaugauggauggg

SEQ ID NO: 201136 - RNA, 22 nt, Human
agcaguccaacugagguggcau

SEQ ID NO: 201137 - RNA, 22 nt, Human
caugaaugaguaauuuacaaag

SEQ ID NO: 201138 - RNA, 22 nt, Human
cugccugccuuggccuccagga

SEQ ID NO: 201139 - RNA, 22 nt, Human
uccugcuccaccgugggcugga

SEQ ID NO: 201140 - RNA, 22 nt, Human
cagugaaguucuacugaauggu

SEQ ID NO: 201141 - RNA, 22 nt, Human
cagagcuggccugugauuuuug

SEQ ID NO: 201142 - RNA, 22 nt, Human
ugcucagggagcuuccuggugg

SEQ ID NO: 201143 - RNA, 22 nt, Human
cuuuuuuccuaaggcaacauga

SEQ ID NO: 201144 - RNA, 22 nt, Human
auuauuuuaugugcggccugau

SEQ ID NO: 201145 - RNA, 22 nt, Human
cucugggcugccuuuuagcucu

SEQ ID NO: 201146 - RNA, 22 nt, Human
gcucugugccacaugcaguguu

SEQ ID NO: 201147 - RNA, 22 nt, Human
acugggcucaagugauuguccu

SEQ ID NO: 201148 - RNA, 19 nt, Human
gggagcugucugcccgugg

SEQ ID NO: 201149 - RNA, 23 nt, Human
ccuccaugguaagaagcuuagag

SEQ ID NO: 201150 - RNA, 22 nt, Human
aaggagcucuuaaaaucagaga

SEQ ID NO: 201151 - RNA, 22 nt, Human
gcacagaauaacacucugggcu

SEQ ID NO: 201152 - RNA, 22 nt, Human
uuucugaagguuaaggaauuag

SEQ ID NO: 201153 - RNA, 22 nt, Human
uucuuuguuguacuuuccuaca

SEQ ID NO: 201154 - RNA, 21 nt, Human
agccauccugaauggugccau

SEQ ID NO: 201155 - RNA, 22 nt, Human
uccagcccaguuuggugaauug

SEQ ID NO: 201156 - RNA, 22 nt, Human
aauuagggaggacaaagguaca

SEQ ID NO: 201157 - RNA, 22 nt, Human
gcaggugggggucggugcaucu

SEQ ID NO: 201158 - RNA, 22 nt, Human
ugcagagugggagaggugcggg

SEQ ID NO: 201159 - RNA, 22 nt, Human
ugagcccaggaggcagagguug

SEQ ID NO: 201160 - RNA, 22 nt, Human
cugugccacugccccaggccuc

SEQ ID NO: 201161 - RNA, 22 nt, Human
ucuucagauggccaguuguccc

SEQ ID NO: 201162 - RNA, 22 nt, Human
ucagaaguccccagucaaggag

SEQ ID NO: 201163 - RNA, 22 nt, Human
gcuuugcuggcuugaaaugcug

SEQ ID NO: 201164 - RNA, 22 nt, Human
ugguucauaauuugcacuacug

SEQ ID NO: 201165 - RNA, 22 nt, Human
uauucuugucuuuuccagaaau

SEQ ID NO: 201166 - RNA, 21 nt, Human
uaagcaaggaaagggcagccc

SEQ ID NO: 201167 - RNA, 22 nt, Human
gaggcugcccaacuggagugga

SEQ ID NO: 201168 - RNA, 20 nt, Human
aagagcugacucacaguggu

SEQ ID NO: 201169 - RNA, 22 nt, Human
cccaggaggugugcccaacucg

SEQ ID NO: 201170 - RNA, 22 nt, Human
cugaggaguuucuuauaugugu

SEQ ID NO: 201171 - RNA, 22 nt, Human
aaggggaaguagcaccagaggu

SEQ ID NO: 201172 - RNA, 21 nt, Human
ugggagagggcucagcuaccc

SEQ ID NO: 201173 - RNA, 22 nt, Human
aaccuugaauacuuaaauacau

SEQ ID NO: 201174 - RNA, 22 nt, Human
gcuuucuggagccugggggaac

SEQ ID NO: 201175 - RNA, 22 nt, Human
ugcucagcaaaaagcuugugag

SEQ ID NO: 201176 - RNA, 22 nt, Human
aaucagaaccuugggucauaac

SEQ ID NO: 201177 - RNA, 22 nt, Human
uuuuuauaccaccucucacuua

SEQ ID NO: 201178 - RNA, 22 nt, Human
ugacaaagcaugauggugacag

SEQ ID NO: 201179 - RNA, 22 nt, Human
uauuucagggagaauaaauuug

SEQ ID NO: 201180 - RNA, 19 nt, Human
gucuuguaacacauaagug

SEQ ID NO: 201181 - RNA, 23 nt, Human
ugagcaucacaggagaaccaggc

SEQ ID NO: 201182 - RNA, 22 nt, Human
ugaggcaggagaaucaccggaa

SEQ ID NO: 201183 - RNA, 22 nt, Human
ugguccgcuccuauucgccgca

SEQ ID NO: 201184 - RNA, 22 nt, Human
augugcccuuucugcuuugcag

SEQ ID NO: 201185 - RNA, 22 nt, Human
uccaugucuucaugugucuaac

SEQ ID NO: 201186 - RNA, 20 nt, Human
uuucacagucccuguuuccu

SEQ ID NO: 201187 - RNA, 22 nt, Human
uauuggugaugacuugaggcca

SEQ ID NO: 201188 - RNA, 22 nt, Human
agccacaaugccaaccucuacu

SEQ ID NO: 201189 - RNA, 22 nt, Human
guauauaagguaaagcgauugu

SEQ ID NO: 201190 - RNA, 22 nt, Human
ucucugagcucaggagcugcag

SEQ ID NO: 201191 - RNA, 22 nt, Human
aggaaacuaauuaguagaauaa

SEQ ID NO: 201192 - RNA, 22 nt, Human
gggcacagucugcagcccccca

SEQ ID NO: 201193 - RNA, 22 nt, Human
ugaggcaggacugagcgggaug

SEQ ID NO: 201194 - RNA, 22 nt, Human
ugucauuuuauguauguggucu

SEQ ID NO: 201195 - RNA, 22 nt, Human
ggcaaacaccaggcgagggagc

SEQ ID NO: 201196 - RNA, 22 nt, Human
agggaggaguccucaaagucau

SEQ ID NO: 201197 - RNA, 22 nt, Human
cauuuuccucugcugguguuca

SEQ ID NO: 201198 - RNA, 22 nt, Human
ugaauaaacuaugaggaggaau

SEQ ID NO: 201199 - RNA, 22 nt, Human
uguaaugauguacuuagaagga

SEQ ID NO: 201200 - RNA, 22 nt, Human
uuccugggaggcuguguacuug

SEQ ID NO: 201201 - RNA, 22 nt, Human
ucugugugguaguuucagugaa

SEQ ID NO: 201202 - RNA, 22 nt, Human
agaacgcuauucagaacacugg

SEQ ID NO: 201203 - RNA, 22 nt, Human
agagaugcauucagcauggaug

SEQ ID NO: 201204 - RNA, 22 nt, Human
cuuuccaggaauccucacagcc

SEQ ID NO: 201205 - RNA, 22 nt, Human
gacccuccugucuucuaaccaa

SEQ ID NO: 201206 - RNA, 22 nt, Human
uacauguggguuaaaaacacuc

SEQ ID NO: 201207 - RNA, 21 nt, Human
acaggcucacgauccauuucu

SEQ ID NO: 201208 - RNA, 22 nt, Human
agggcucugugacuaucacugc

SEQ ID NO: 201209 - RNA, 22 nt, Human
ugcuauuugugagugucuucgu

SEQ ID NO: 201210 - RNA, 22 nt, Human
cagacauaucccugcucccuua

SEQ ID NO: 201211 - RNA, 22 nt, Human
uaguuacaauuaugcauggaaa

SEQ ID NO: 201212 - RNA, 22 nt, Human
uugaaucucucugagauucagu

SEQ ID NO: 201213 - RNA, 22 nt, Human
cuggcagcuggaggcuagaggc

SEQ ID NO: 201214 - RNA, 22 nt, Human
gagcuggaagucuguggucaga

SEQ ID NO: 201215 - RNA, 22 nt, Human
uccugcagcugaagcucaugug

SEQ ID NO: 201216 - RNA, 23 nt, Human
aacacauugcuaauuacauucaa

SEQ ID NO: 201217 - RNA, 22 nt, Human
guccuucaagaguccccuacug

SEQ ID NO: 201218 - RNA, 22 nt, Human
agucucugcaugccugcugugc

SEQ ID NO: 201219 - RNA, 22 nt, Human
guguguccuguuuuaaaauagu

SEQ ID NO: 201220 - RNA, 22 nt, Human
aagaacuuuuggcaaguguuau

SEQ ID NO: 201221 - RNA, 22 nt, Human
ugacagggggcagagguggcug

SEQ ID NO: 201222 - RNA, 22 nt, Human
cagaagcaaaugccuugcugag

SEQ ID NO: 201223 - RNA, 22 nt, Human
aaacugcaauuacuuuugcacc

SEQ ID NO: 201224 - RNA, 21 nt, Human
ucacuacaauguucucuuaua

SEQ ID NO: 201225 - RNA, 22 nt, Human
uacaagaaugucuuaaaagcuc

SEQ ID NO: 201226 - RNA, 20 nt, Human
uuuuccucguguuuguucua

SEQ ID NO: 201227 - RNA, 22 nt, Human
ucuguucauaguaguguauaug

SEQ ID NO: 201228 - RNA, 22 nt, Human
cugaaaaacgggauuuggcugg

SEQ ID NO: 201229 - RNA, 22 nt, Human
augcaggauuagaaaguugccu

SEQ ID NO: 201230 - RNA, 22 nt, Human
uggcucaggaucuaagcagaau

SEQ ID NO: 201231 - RNA, 22 nt, Human
agucgcagacaugguccccuuu

SEQ ID NO: 201232 - RNA, 22 nt, Human
aucauucugauggucaaugcua

SEQ ID NO: 201233 - RNA, 22 nt, Human
aaacugcacaagggugcauagc

SEQ ID NO: 201234 - RNA, 22 nt, Human
uuccuggcacacuccugaaugu

SEQ ID NO: 201235 - RNA, 22 nt, Human
aaacauugagcacuugcuauuu

SEQ ID NO: 201236 - RNA, 22 nt, Human
ccaggcagagggaauagcaagu

SEQ ID NO: 201237 - RNA, 22 nt, Human
ugcagcugccuagggcuggcuu

SEQ ID NO: 201238 - RNA, 22 nt, Human
ucacacauuguugcuuaaguug

SEQ ID NO: 201239 - RNA, 22 nt, Human
guuucauuaccugacccaugag

SEQ ID NO: 201240 - RNA, 22 nt, Human
gggcugaggaacauauuuuguu

SEQ ID NO: 201241 - RNA, 22 nt, Human
guccucugaaguugugcaaugc

SEQ ID NO: 201242 - RNA, 22 nt, Human
gagcccucaccgccugaccagg

SEQ ID NO: 201243 - RNA, 22 nt, Human
gcugguggcagagcuccgcggc

SEQ ID NO: 201244 - RNA, 22 nt, Human
acagggcagugucuugaaaaau

SEQ ID NO: 201245 - RNA, 22 nt, Human
aggacagcagccauuggcaguc

SEQ ID NO: 201246 - RNA, 22 nt, Human
caaaugaagaaccuucucaccu

SEQ ID NO: 201247 - RNA, 22 nt, Human
aagucuggaaccucaugcuggc

SEQ ID NO: 201248 - RNA, 20 nt, Human
aacauugcuucaauguaacc

SEQ ID NO: 201249 - RNA, 22 nt, Human
ucuggcucuaacuaggcaucag

SEQ ID NO: 201250 - RNA, 22 nt, Human
aaauaguuguuuggaucaauaa

SEQ ID NO: 201251 - RNA, 20 nt, Human
ucucgcacucggagcagccg

SEQ ID NO: 201252 - RNA, 22 nt, Human
cauuacagaauauguaaugauc

SEQ ID NO: 201253 - RNA, 22 nt, Human
uagauuaacaguuuuguugaag

SEQ ID NO: 201254 - RNA, 22 nt, Human
ccaggacagugaacauguaaga

SEQ ID NO: 201255 - RNA, 22 nt, Human
cagcuccuaugaguaugauucc

SEQ ID NO: 201256 - RNA, 22 nt, Human
aggcagcauccagaggagaaug

SEQ ID NO: 201257 - RNA, 22 nt, Human
guucuuuaggggcccaauuucc

SEQ ID NO: 201258 - RNA, 22 nt, Human
gaaaguuucuucauuaagaugu

SEQ ID NO: 201259 - RNA, 22 nt, Human
gauuuagauucgcuggggcugg

SEQ ID NO: 201260 - RNA, 22 nt, Human
agcaacaggguggucuucagaa

SEQ ID NO: 201261 - RNA, 20 nt, Human
cugcuugggccccucuggcc

SEQ ID NO: 201262 - RNA, 23 nt, Human
agucucaagcuggagaauuaccu

SEQ ID NO: 201263 - RNA, 22 nt, Human
gaggagaaauuauccuuggugu

SEQ ID NO: 201264 - RNA, 22 nt, Human
ccaggucugcgggcggcaggca

SEQ ID NO: 201265 - RNA, 20 nt, Human
uucugcuugcaaauaucaag

SEQ ID NO: 201266 - RNA, 22 nt, Human
aacuacauuuuacagaagauga

SEQ ID NO: 201267 - RNA, 22 nt, Human
uugcaggggagaggaacaaaca

SEQ ID NO: 201268 - RNA, 22 nt, Human
acuguuuaggaggcuuauaugc

SEQ ID NO: 201269 - RNA, 23 nt, Human
agcucugaaauagggaaagagga

SEQ ID NO: 201270 - RNA, 22 nt, Human
aaauagaauuggaagcagaguu

SEQ ID NO: 201271 - RNA, 19 nt, Human
gcucagagacaccuguugc

SEQ ID NO: 201272 - RNA, 22 nt, Human
uuguguccccuguucuaccugu

SEQ ID NO: 201273 - RNA, 22 nt, Human
caagcugggugcgggcaguaua

SEQ ID NO: 201274 - RNA, 23 nt, Human
acaggcucuuaaucagugcuccu

SEQ ID NO: 201275 - RNA, 22 nt, Human
uggcccaagucugcuagaagag

SEQ ID NO: 201276 - RNA, 21 nt, Human
uuauugagacauuuguggaaa

SEQ ID NO: 201277 - RNA, 22 nt, Human
auucuagaaggcaaagcaaggg

SEQ ID NO: 201278 - RNA, 22 nt, Human
gaaggcuuauuuucuuuguaaa

SEQ ID NO: 201279 - RNA, 22 nt, Human
gugccagggaguggaggagcuu

SEQ ID NO: 201280 - RNA, 18 nt, Human
aggaagcaggaggaaggc

SEQ ID NO: 201281 - RNA, 16 nt, Human
uggcagagguucagcc

SEQ ID NO: 201282 - RNA, 22 nt, Human
cacagcuggugacagagcccag

SEQ ID NO: 201283 - RNA, 22 nt, Human
ugcauaggguucaaaggcugua

SEQ ID NO: 201284 - RNA, 22 nt, Human
cuguuaagcaacaugaguaagu

SEQ ID NO: 201285 - RNA, 22 nt, Human
uuuaauguuugagucaguauau

SEQ ID NO: 201286 - RNA, 22 nt, Human
ucagaucuggugaaguuauagu

SEQ ID NO: 201287 - RNA, 22 nt, Human
uuguuuuccugggauaccaacc

SEQ ID NO: 201288 - RNA, 23 nt, Human
auggaaauagcaugugucauuua

SEQ ID NO: 201289 - RNA, 22 nt, Human
uacugucuggaguugccaaagg

SEQ ID NO: 201290 - RNA, 22 nt, Human
gggauggaggguagagcaagug

SEQ ID NO: 201291 - RNA, 22 nt, Human
guuguacaaaauaucagugagg

SEQ ID NO: 201292 - RNA, 22 nt, Human
gcugcugggauccugggucuca

SEQ ID NO: 201293 - RNA, 22 nt, Human
ugacagguuguguagguggcca

SEQ ID NO: 201294 - RNA, 22 nt, Human
gagaagcagguuuagcagacaa

SEQ ID NO: 201295 - RNA, 22 nt, Human
uccuuggcuaguacuggccagc

SEQ ID NO: 201296 - RNA, 22 nt, Human
gcaguggcccagcuugcaggcu

SEQ ID NO: 201297 - RNA, 22 nt, Human
uggcagugaugcuuaugguuug

SEQ ID NO: 201298 - RNA, 23 nt, Human
ucuccuguccuaauuaccacccc

SEQ ID NO: 201299 - RNA, 22 nt, Human
aagcacaggagacgcacagcca

SEQ ID NO: 201300 - RNA, 22 nt, Human
gguccagguuugcucuacuugu

SEQ ID NO: 201301 - RNA, 22 nt, Human
gcacagagagcagugggggaca

SEQ ID NO: 201302 - RNA, 22 nt, Human
ucaggaagccgguuaaauagau

SEQ ID NO: 201303 - RNA, 22 nt, Human
ggguaggcugcuccuggggccc

SEQ ID NO: 201304 - RNA, 22 nt, Human
ggcugugcaccauccaccuccc

SEQ ID NO: 201305 - RNA, 22 nt, Human
ugaauagagcuuggcacuagaa

SEQ ID NO: 201306 - RNA, 22 nt, Human
acagugcucaugugacauggug

SEQ ID NO: 201307 - RNA, 22 nt, Human
ggcuggguacagggcagugugc

SEQ ID NO: 201308 - RNA, 22 nt, Human
aguugacauccagagacauucu

SEQ ID NO: 201309 - RNA, 22 nt, Human
ugugggaggauucagaauuggg

SEQ ID NO: 201310 - RNA, 22 nt, Human
gauggcagugggccucgagucc

SEQ ID NO: 201311 - RNA, 22 nt, Human
ccagugucuagcagaugacagg

SEQ ID NO: 201312 - RNA, 22 nt, Human
aguggcagagccaagauaugau

SEQ ID NO: 201313 - RNA, 22 nt, Human
aguaggaggcgggagcaugaag

SEQ ID NO: 201314 - RNA, 22 nt, Human
cagagcuggggacuguuggaug

SEQ ID NO: 201315 - RNA, 22 nt, Human
agauacaaaagauaagauuuag

SEQ ID NO: 201316 - RNA, 21 nt, Human
uuuuaacaaggauuucccuag

SEQ ID NO: 201317 - RNA, 23 nt, Human
ugcaggggaggcuuaaagcaggu

SEQ ID NO: 201318 - RNA, 22 nt, Human
aauuuguuagcauacucuaguu

SEQ ID NO: 201319 - RNA, 20 nt, Human
aagagucuuuacugagcuaa

SEQ ID NO: 201320 - RNA, 22 nt, Human
aggccuuaccauagcuguagca

SEQ ID NO: 201321 - RNA, 22 nt, Human
gcaagcaaaaugggagauuccc

SEQ ID NO: 201322 - RNA, 22 nt, Human
ugagcagugguguuuuucuauc

SEQ ID NO: 201323 - RNA, 22 nt, Human
gcuuagaaguacacaugccuuu

SEQ ID NO: 201324 - RNA, 22 nt, Human
uuagcauuucaguacacauguu

SEQ ID NO: 201325 - RNA, 20 nt, Human
ggcaggcuuuauauggaggg

SEQ ID NO: 201326 - RNA, 21 nt, Human
cuggcauuaugauagcguccu

SEQ ID NO: 201327 - RNA, 22 nt, Human
aagcaaaugugggugcagaauu

SEQ ID NO: 201328 - RNA, 22 nt, Human
agcaaugauguuuucaaguagg

SEQ ID NO: 201329 - RNA, 20 nt, Human
uguggacucaguuucuugcu

SEQ ID NO: 201330 - RNA, 21 nt, Human
cugcagagcaugcaaaauguu

SEQ ID NO: 201331 - RNA, 19 nt, Human
gcugugggacagcagggug

SEQ ID NO: 201332 - RNA, 22 nt, Human
gguggcaguggucucugacaga

SEQ ID NO: 201333 - RNA, 22 nt, Human
cugaggaguuuggguuguucaa

SEQ ID NO: 201334 - RNA, 21 nt, Human
uggcugccuggcucugugguu

SEQ ID NO: 201335 - RNA, 22 nt, Human
cugcagagcaaguucucuguug

SEQ ID NO: 201336 - RNA, 22 nt, Human
gagacacaggcacagaagaggc

SEQ ID NO: 201337 - RNA, 22 nt, Human
gcugagagugggugcagugcuu

SEQ ID NO: 201338 - RNA, 22 nt, Human
uuuacagucaccaaacuuugcu

SEQ ID NO: 201339 - RNA, 22 nt, Human
ccaggcauccauugcuuccucu

SEQ ID NO: 201340 - RNA, 22 nt, Human
ggcaccagggcaagggucuuuc

SEQ ID NO: 201341 - RNA, 22 nt, Human
agcaacagcaacgacauuucuc

SEQ ID NO: 201342 - RNA, 22 nt, Human
uuccuguggcugucacuccugg

SEQ ID NO: 201343 - RNA, 22 nt, Human
cagugcaauuacaagcuaauuc

SEQ ID NO: 201344 - RNA, 22 nt, Human
ucccaggccacacuuggggaac

SEQ ID NO: 201345 - RNA, 22 nt, Human
ugcagggcuccuggcuccaauc

SEQ ID NO: 201346 - RNA, 22 nt, Human
aagcugaauuuucuaaaagaau

SEQ ID NO: 201347 - RNA, 22 nt, Human
gcucuguauguaguucuugcuu

SEQ ID NO: 201348 - RNA, 21 nt, Human
cuguccucagauguggacgag

SEQ ID NO: 201349 - RNA, 22 nt, Human
cuucugcaauaaguuuuggucc

SEQ ID NO: 201350 - RNA, 22 nt, Human
agucacuguuucagaacugagu

SEQ ID NO: 201351 - RNA, 22 nt, Human
agcuggguuucuggcaggcuua

SEQ ID NO: 201352 - RNA, 22 nt, Human
ugggggugaaagucuggacagu

SEQ ID NO: 201353 - RNA, 22 nt, Human
guccugugagauucaugcucaa

SEQ ID NO: 201354 - RNA, 22 nt, Human
aagagaaggugaggaagccggu

SEQ ID NO: 201355 - RNA, 22 nt, Human
auccaggcugcuaugaggauga

SEQ ID NO: 201356 - RNA, 20 nt, Human
cagcaggcuauggggcaccc

SEQ ID NO: 201357 - RNA, 22 nt, Human
caacaguucucauagcagauuc

SEQ ID NO: 201358 - RNA, 22 nt, Human
ugcuggcugcagugcugucaaa

SEQ ID NO: 201359 - RNA, 22 nt, Human
aacuucuuugagcuccaguuuu

SEQ ID NO: 201360 - RNA, 22 nt, Human
gguggcugggauuaguagccca

SEQ ID NO: 201361 - RNA, 22 nt, Human
auugcaaaugguuuggucaucu

SEQ ID NO: 201362 - RNA, 22 nt, Human
caggaccccauauucacugaac

SEQ ID NO: 201363 - RNA, 22 nt, Human
aaaggcaguggguauguggauc

SEQ ID NO: 201364 - RNA, 22 nt, Human
aggcugugggaguugagagucu

SEQ ID NO: 201365 - RNA, 22 nt, Human
ucacagaaugucuagcauaauu

SEQ ID NO: 201366 - RNA, 22 nt, Human
ucuugacauuguuguuagcagg

SEQ ID NO: 201367 - RNA, 23 nt, Human
auuuccuaaaagauaaucauuac

SEQ ID NO: 201368 - RNA, 22 nt, Human
ccuugggagaaauugcagaguc

SEQ ID NO: 201369 - RNA, 22 nt, Human
aaaucagaaaauauggagagga

SEQ ID NO: 201370 - RNA, 23 nt, Human
ggguccagagaagccauuagggc

SEQ ID NO: 201371 - RNA, 22 nt, Human
acuuugcaauacuuaauacaaa

SEQ ID NO: 201372 - RNA, 22 nt, Human
ugagcaggugagucuagggcag

SEQ ID NO: 201373 - RNA, 22 nt, Human
cacaggcaggagguucuccagu

SEQ ID NO: 201374 - RNA, 22 nt, Human
ggcuucugcucagccugcacgc

SEQ ID NO: 201375 - RNA, 22 nt, Human
uagaaaucauuuagaaguauug

SEQ ID NO: 201376 - RNA, 22 nt, Human
agacagcugcucgcagagcuau

SEQ ID NO: 201377 - RNA, 22 nt, Human
aaauuguaaugacuucacuuga

SEQ ID NO: 201378 - RNA, 22 nt, Human
augaaggcaguuaaacgucauc

SEQ ID NO: 201379 - RNA, 20 nt, Human
agcuccugguauaggugccu

SEQ ID NO: 201380 - RNA, 20 nt, Human
agauggcugucauuucuguc

SEQ ID NO: 201381 - RNA, 22 nt, Human
cuguccagugcagagaacagag

SEQ ID NO: 201382 - RNA, 21 nt, Human
gagugcaggucugaugccauc

SEQ ID NO: 201383 - RNA, 22 nt, Human
auucuuuucccaacugcuuuaa

SEQ ID NO: 201384 - RNA, 22 nt, Human
auuguuuacacuaacuucauaa

SEQ ID NO: 201385 - RNA, 22 nt, Human
guuuuauuuccaugagagaccg

SEQ ID NO: 201386 - RNA, 22 nt, Human
ugaugagggggaacagagauuu

SEQ ID NO: 201387 - RNA, 22 nt, Human
ucuggccagugaaaugcagaau

SEQ ID NO: 201388 - RNA, 22 nt, Human
gaugauaacucuuuaugaugaa

SEQ ID NO: 201389 - RNA, 22 nt, Human
ugaaccuuuguguuggaccugg

SEQ ID NO: 201390 - RNA, 22 nt, Human
uucuaaguuucucaguuucagu

SEQ ID NO: 201391 - RNA, 22 nt, Human
augaccagccgagauaaacaga

SEQ ID NO: 201392 - RNA, 22 nt, Human
agggccugaggcugacggggag

SEQ ID NO: 201393 - RNA, 22 nt, Human
ucacauuuuaucugagauugac

SEQ ID NO: 201394 - RNA, 22 nt, Human
ugcaugcaugugagcaugcaua

SEQ ID NO: 201395 - RNA, 22 nt, Human
aaucucaagcuguaaauaccuc

SEQ ID NO: 201396 - RNA, 22 nt, Human
gaaggcuugguuuuuucaacac

SEQ ID NO: 201397 - RNA, 22 nt, Human
ugagcugagaacacuugggcua

SEQ ID NO: 201398 - RNA, 18 nt, Human
agagggaaagcaggcuga

SEQ ID NO: 201399 - RNA, 22 nt, Human
uccuuucccuuuccauccuggc

SEQ ID NO: 201400 - RNA, 22 nt, Human
acacuguguggucucucucgga

SEQ ID NO: 201401 - RNA, 21 nt, Human
gccugcagaccccaccaggcu

SEQ ID NO: 201402 - RNA, 22 nt, Human
ucagugcauucuaccaaaaggc

SEQ ID NO: 201403 - RNA, 22 nt, Human
gaggcagcaugguaccuuggag

SEQ ID NO: 201404 - RNA, 22 nt, Human
ugcaggugccaucgcugcucau

SEQ ID NO: 201405 - RNA, 21 nt, Human
auggaaauuggcaaaugcuac

SEQ ID NO: 201406 - RNA, 20 nt, Human
ggcugcccacuccagaguac

SEQ ID NO: 201407 - RNA, 22 nt, Human
aauguggaugauacuaguacuu

SEQ ID NO: 201408 - RNA, 22 nt, Human
caaauguuuuuauucuacaaca

SEQ ID NO: 201409 - RNA, 22 nt, Human
agucucugagguucagaugccu

SEQ ID NO: 201410 - RNA, 22 nt, Human
agcaguguggccuuagacccgg

SEQ ID NO: 201411 - RNA, 22 nt, Human
cuggcucccagcuuucagggag

SEQ ID NO: 201412 - RNA, 22 nt, Human
agauggcuuagccuggcuccca

SEQ ID NO: 201413 - RNA, 22 nt, Human
ugcccucagaauugcucccugc

SEQ ID NO: 201414 - RNA, 22 nt, Human
gagggcugcuggaaaaaugcag

SEQ ID NO: 201415 - RNA, 22 nt, Human
agaugguugucgcaaaugaaug

SEQ ID NO: 201416 - RNA, 22 nt, Human
aaucuggacuugucugugaaga

SEQ ID NO: 201417 - RNA, 22 nt, Human
caggguggggaaauagcgcccu

SEQ ID NO: 201418 - RNA, 20 nt, Human
uccaggcuccuccacuuagu

SEQ ID NO: 201419 - RNA, 22 nt, Human
acaucuggaaaguuacuugaga

SEQ ID NO: 201420 - RNA, 22 nt, Human
acagcucuuaggcagaaccaac

SEQ ID NO: 201421 - RNA, 23 nt, Human
ccugcucaggcgugugcccugcu

SEQ ID NO: 201422 - RNA, 22 nt, Human
cugggagauugcuagagaugca

SEQ ID NO: 201423 - RNA, 22 nt, Human
caccagcuucucauugcggguc

SEQ ID NO: 201424 - RNA, 22 nt, Human
cagaugaaggccugaaugucua

SEQ ID NO: 201425 - RNA, 22 nt, Human
gccuugggcacaggcagggccc

SEQ ID NO: 201426 - RNA, 22 nt, Human
aaggugucacugggacaggaaa

SEQ ID NO: 201427 - RNA, 22 nt, Human
uaaagugcuuccuaacccagag

SEQ ID NO: 201428 - RNA, 22 nt, Human
agcuaguucacugaagccuaug

SEQ ID NO: 201429 - RNA, 22 nt, Human
ugccugugcccuuugcugggag

SEQ ID NO: 201430 - RNA, 22 nt, Human
acuuucuguuagaugaauggau

SEQ ID NO: 201431 - RNA, 22 nt, Human
ucugaaauaggagccauguaga

SEQ ID NO: 201432 - RNA, 22 nt, Human
acaggcuguugggguccagggu

SEQ ID NO: 201433 - RNA, 22 nt, Human
gcauuuacauggagcuaucuaa

SEQ ID NO: 201434 - RNA, 22 nt, Human
gaggccaacuuuggagaacagg

SEQ ID NO: 201435 - RNA, 22 nt, Human
aggagcagaccguaguccugca

SEQ ID NO: 201436 - RNA, 22 nt, Human
aaguccagguccucauuccauc

SEQ ID NO: 201437 - RNA, 22 nt, Human
ggugggaguggaacguggaaga

SEQ ID NO: 201438 - RNA, 22 nt, Human
acaagaauuuacauguagugga

SEQ ID NO: 201439 - RNA, 22 nt, Human
ccagcccuuagauaaaccuggc

SEQ ID NO: 201440 - RNA, 22 nt, Human
uuuuauguuccucuuuaugcga

SEQ ID NO: 201441 - RNA, 22 nt, Human
cucaggagcuuccucagcccau

SEQ ID NO: 201442 - RNA, 22 nt, Human
auagaugucauugucauccauc

SEQ ID NO: 201443 - RNA, 22 nt, Human
gucaggauguuuauucuccagu

SEQ ID NO: 201444 - RNA, 22 nt, Human
ucaucacauaugucaugauuug

SEQ ID NO: 201445 - RNA, 19 nt, Human
acagugcaugggaccuggu

SEQ ID NO: 201446 - RNA, 22 nt, Human
gcagaggacacaggagggcaag

SEQ ID NO: 201447 - RNA, 19 nt, Human
ccuguucaugacucugucc

SEQ ID NO: 201448 - RNA, 22 nt, Human
agacagugauggacaggcagac

SEQ ID NO: 201449 - RNA, 22 nt, Human
gcauucuucacaguauuccucc

SEQ ID NO: 201450 - RNA, 22 nt, Human
aaggcugaccaguuuacacuuu

SEQ ID NO: 201451 - RNA, 22 nt, Human
uccaauaaccacaaucagauag

SEQ ID NO: 201452 - RNA, 22 nt, Human
ccuccugggccuugcucuguga

SEQ ID NO: 201453 - RNA, 22 nt, Human
caagggaaggcuaagggcaaca

SEQ ID NO: 201454 - RNA, 22 nt, Human
ccuugguccaacccugcacagc

SEQ ID NO: 201455 - RNA, 22 nt, Human
auuacaguucuacacauccuuu

SEQ ID NO: 201456 - RNA, 22 nt, Human
cagguaaggucacauucugaag

SEQ ID NO: 201457 - RNA, 21 nt, Human
caguguggugaccagggucuc

SEQ ID NO: 201458 - RNA, 22 nt, Human
cagcugaguggacccuagaggc

SEQ ID NO: 201459 - RNA, 22 nt, Human
aucaagaguauugacaagacca

SEQ ID NO: 201460 - RNA, 22 nt, Human
gagaaaccgauucugcauguca

SEQ ID NO: 201461 - RNA, 21 nt, Human
gggagggauggaaaugauguu

SEQ ID NO: 201462 - RNA, 22 nt, Human
cauuucaguguuauucuaauuu

SEQ ID NO: 201463 - RNA, 22 nt, Human
caauccaguuucugucagcuac

SEQ ID NO: 201464 - RNA, 22 nt, Human
aggcucaguucacgucaacuuu

SEQ ID NO: 201465 - RNA, 22 nt, Human
gcuggggccugaacagucagcu

SEQ ID NO: 201466 - RNA, 22 nt, Human
cugggucucuuaccaugugacu

SEQ ID NO: 201467 - RNA, 22 nt, Human
agcacugauuuaaacuggauuu

SEQ ID NO: 201468 - RNA, 22 nt, Human
uccuaggcccagccugagcugu

SEQ ID NO: 201469 - RNA, 22 nt, Human
uccaggccccagaccguacugc

SEQ ID NO: 201470 - RNA, 22 nt, Human
ucacuggguaggacaugcugau

SEQ ID NO: 201471 - RNA, 22 nt, Human
agaggccaggcagcccaaggug

SEQ ID NO: 201472 - RNA, 22 nt, Human
uacagcaauaaugacaccgcuc

SEQ ID NO: 201473 - RNA, 22 nt, Human
uggaaauagcuccaguuaagca

SEQ ID NO: 201474 - RNA, 22 nt, Human
ucaggaaggcaaauugcaugau

SEQ ID NO: 201475 - RNA, 22 nt, Human
uaucacaggugugauuuacauu

SEQ ID NO: 201476 - RNA, 22 nt, Human
aagcaaagaguuuaguggguga

SEQ ID NO: 201477 - RNA, 22 nt, Human
caugcuaaaccagaacauagga

SEQ ID NO: 201478 - RNA, 20 nt, Human
cccagggaccugagcuccau

SEQ ID NO: 201479 - RNA, 18 nt, Human
augcuucugauagaagca

SEQ ID NO: 201480 - RNA, 22 nt, Human
ucugagcuacgaugccugucac

SEQ ID NO: 201481 - RNA, 22 nt, Human
ggcucugaaggagacagcugcu

SEQ ID NO: 201482 - RNA, 22 nt, Human
agcucccaggcagucaugagga

SEQ ID NO: 201483 - RNA, 22 nt, Human
caggaaaugaaagcuagcuaau

SEQ ID NO: 201484 - RNA, 22 nt, Human
auggcccagaaguuuggaaagg

SEQ ID NO: 201485 - RNA, 22 nt, Human
acagcaggaagcuggagggaaa

SEQ ID NO: 201486 - RNA, 22 nt, Human
uaggcaaguugcccaaucucuc

SEQ ID NO: 201487 - RNA, 22 nt, Human
cucuucaguaaaugacacuguu

SEQ ID NO: 201488 - RNA, 22 nt, Human
caggcugcccuagcuuggacau

SEQ ID NO: 201489 - RNA, 22 nt, Human
uggaagaauauggggguacaga

SEQ ID NO: 201490 - RNA, 22 nt, Human
guccugggagaugggacccuga

SEQ ID NO: 201491 - RNA, 22 nt, Human
cugggcagaauuuuaggauggc

SEQ ID NO: 201492 - RNA, 20 nt, Human
ucagggcaugggacagcccc

SEQ ID NO: 201493 - RNA, 22 nt, Human
ugcuugggcggccagcauggcg

SEQ ID NO: 201494 - RNA, 22 nt, Human
gacuuagacccugucuuuauuc

SEQ ID NO: 201495 - RNA, 22 nt, Human
aggcacagcacaccuggccccc

SEQ ID NO: 201496 - RNA, 22 nt, Human
gcaggagagucugugccagguu

SEQ ID NO: 201497 - RNA, 22 nt, Human
acagaugaauuuuaauuguguu

SEQ ID NO: 201498 - RNA, 22 nt, Human
uaugagaaaggagaaugacuuu

SEQ ID NO: 201499 - RNA, 22 nt, Human
auaaucuggucuuuguaugagu

SEQ ID NO: 201500 - RNA, 22 nt, Human
aaggcaggagcuguaucuuauu

SEQ ID NO: 201501 - RNA, 22 nt, Human
ugagauuuuaauauugagaaaa

SEQ ID NO: 201502 - RNA, 22 nt, Human
gcagccagagggggugugauca

SEQ ID NO: 201503 - RNA, 22 nt, Human
gagcucuguucucguccugcug

SEQ ID NO: 201504 - RNA, 22 nt, Human
ggcuccuggaggcaccacuggu

SEQ ID NO: 201505 - RNA, 22 nt, Human
ggugugacucgcccucagggac

SEQ ID NO: 201506 - RNA, 22 nt, Human
ucacaauuuggauacagcuaug

SEQ ID NO: 201507 - RNA, 19 nt, Human
gcuggggccugaccagaca

SEQ ID NO: 201508 - RNA, 22 nt, Human
gcaggagaaaugaagauugggu

SEQ ID NO: 201509 - RNA, 22 nt, Human
gcagggaagacccggagcagcg

SEQ ID NO: 201510 - RNA, 22 nt, Human
ucucugggaaugggccugggua

SEQ ID NO: 201511 - RNA, 21 nt, Human
agagacugucacugcaguacc

SEQ ID NO: 201512 - RNA, 22 nt, Human
guguaugauuucaaauggcuag

SEQ ID NO: 201513 - RNA, 22 nt, Human
aaacagcuaaguacauucaagg

SEQ ID NO: 201514 - RNA, 22 nt, Human
gaauuugaaaagugaugggaau

SEQ ID NO: 201515 - RNA, 22 nt, Human
guuacagugcauguggcuucug

SEQ ID NO: 201516 - RNA, 22 nt, Human
uugguacaaaaguaacuguggu

SEQ ID NO: 201517 - RNA, 23 nt, Human
agagccugaaagacuucuggcac

SEQ ID NO: 201518 - RNA, 22 nt, Human
aggugaguccugggcacaggua

SEQ ID NO: 201519 - RNA, 22 nt, Human
auuucaguguuuuaagaguuca

SEQ ID NO: 201520 - RNA, 22 nt, Human
uccaggccugcaaugacaaagc

SEQ ID NO: 201521 - RNA, 22 nt, Human
ccugagaauguuuaacagagaa

SEQ ID NO: 201522 - RNA, 22 nt, Human
caggagcccagaguccucagcu

SEQ ID NO: 201523 - RNA, 22 nt, Human
uaguuuguagaaaucuagaaau

SEQ ID NO: 201524 - RNA, 20 nt, Human
auuuggcaugaaguauugau

SEQ ID NO: 201525 - RNA, 22 nt, Human
cuuuauguacuguguauuugaa

SEQ ID NO: 201526 - RNA, 22 nt, Human
caucuaccagaauugcuauaaa

SEQ ID NO: 201527 - RNA, 22 nt, Human
cuucauuaacuauuggaaugca

SEQ ID NO: 201528 - RNA, 22 nt, Human
auacaguauuaccuguucagga

SEQ ID NO: 201529 - RNA, 22 nt, Human
uggaggucgcgcgggugcugca

SEQ ID NO: 201530 - RNA, 23 nt, Human
agcacucaugcugcagaagucau

SEQ ID NO: 201531 - RNA, 18 nt, Human
uuugcaaaggaaguaugg

SEQ ID NO: 201532 - RNA, 22 nt, Human
guccugggcaugcagggcuuuc

SEQ ID NO: 201533 - RNA, 22 nt, Human
acugggccggugcagaguaguu

SEQ ID NO: 201534 - RNA, 22 nt, Human
agcaagauugaggcuuccucag

SEQ ID NO: 201535 - RNA, 22 nt, Human
acaggcaggagcuccccauucc

SEQ ID NO: 201536 - RNA, 22 nt, Human
uuucauaauagugcaguuuguu

SEQ ID NO: 201537 - RNA, 22 nt, Human
uaacacuggcuuuugcugaggc

SEQ ID NO: 201538 - RNA, 22 nt, Human
gauggccaaggaccacgcaucg

SEQ ID NO: 201539 - RNA, 22 nt, Human
ugcugcagggccuucccugcau

SEQ ID NO: 201540 - RNA, 22 nt, Human
ugcucagcugcucuguauucuu

SEQ ID NO: 201541 - RNA, 22 nt, Human
ccugaggcuccaccuccagaga

SEQ ID NO: 201542 - RNA, 19 nt, Human
uucuuuggugguggugacc

SEQ ID NO: 201543 - RNA, 22 nt, Human
ggugcaugguggaggugacccu

SEQ ID NO: 201544 - RNA, 22 nt, Human
ccagggaguuuccaaucugaga

SEQ ID NO: 201545 - RNA, 22 nt, Human
ucaggcccuuugcugcugcccc

SEQ ID NO: 201546 - RNA, 22 nt, Human
ucuuauuuagagaggacuagag

SEQ ID NO: 201547 - RNA, 19 nt, Human
gcucagagucccccugcgg

SEQ ID NO: 201548 - RNA, 22 nt, Human
cauggccucaaaggacugcaga

SEQ ID NO: 201549 - RNA, 22 nt, Human
agggggcucagcauggauggag

SEQ ID NO: 201550 - RNA, 22 nt, Human
accaaggaguuugguauuuuag

SEQ ID NO: 201551 - RNA, 22 nt, Human
caucucaggucugugguucacu

SEQ ID NO: 201552 - RNA, 22 nt, Human
uucuccagcacauuuucuuuga

SEQ ID NO: 201553 - RNA, 22 nt, Human
cucagcaggucuuggguagggg

SEQ ID NO: 201554 - RNA, 22 nt, Human
gaggaauguuauuaaaggagcu

SEQ ID NO: 201555 - RNA, 22 nt, Human
gcuucccagcagaggaaagacu

SEQ ID NO: 201556 - RNA, 22 nt, Human
augaguucauacuuucaguacc

SEQ ID NO: 201557 - RNA, 22 nt, Human
ggaaaaguguuaagguguugau

SEQ ID NO: 201558 - RNA, 22 nt, Human
auggcugccccaaauuguugcu

SEQ ID NO: 201559 - RNA, 22 nt, Human
aacaggcuaaguauuugguagc

SEQ ID NO: 201560 - RNA, 20 nt, Human
gagcuacacaaaugcugcuu

SEQ ID NO: 201561 - RNA, 17 nt, Human
cugcuggcuggggcuug

SEQ ID NO: 201562 - RNA, 22 nt, Human
ucaagaaagggcuucaccagga

SEQ ID NO: 201563 - RNA, 22 nt, Human
caaagacacgggaaacaacguu

SEQ ID NO: 201564 - RNA, 21 nt, Human
agucucucuaauaaaugcuug

SEQ ID NO: 201565 - RNA, 22 nt, Human
gggagccacucagcugagaguu

SEQ ID NO: 201566 - RNA, 22 nt, Human
gcaccagcugccuucugugccc

SEQ ID NO: 201567 - RNA, 22 nt, Human
gcccacaggggaccugguggcu

SEQ ID NO: 201568 - RNA, 18 nt, Human
aaagcuguuauuccagaa

SEQ ID NO: 201569 - RNA, 22 nt, Human
uaacaacugcugagguauuuga

SEQ ID NO: 201570 - RNA, 22 nt, Human
ugguacaagcagacucagcaga

SEQ ID NO: 201571 - RNA, 22 nt, Human
gcuuggccagcagccgggaugc

SEQ ID NO: 201572 - RNA, 22 nt, Human
ggacagagcagacgagcagcgg

SEQ ID NO: 201573 - RNA, 22 nt, Human
ccagguguuuggccugcaugau

SEQ ID NO: 201574 - RNA, 20 nt, Human
guuuuucucucuugccacua

SEQ ID NO: 201575 - RNA, 22 nt, Human
aucuuuuacauuacugcccaga

SEQ ID NO: 201576 - RNA, 23 nt, Human
cucagugugugacccauggccuc

SEQ ID NO: 201577 - RNA, 22 nt, Human
ugaggcuugauuugcccgagag

SEQ ID NO: 201578 - RNA, 22 nt, Human
gaagccaagggcugcuuuuccu

SEQ ID NO: 201579 - RNA, 20 nt, Human
aguggcaggcgaucauuacu

SEQ ID NO: 201580 - RNA, 22 nt, Human
auacagggacauccaguuuuuc

SEQ ID NO: 201581 - RNA, 22 nt, Human
ggcugcagcggauuggggauug

SEQ ID NO: 201582 - RNA, 22 nt, Human
ucugagauuuguauggugagac

SEQ ID NO: 201583 - RNA, 22 nt, Human
uggcccagcacuccaaguaggg

SEQ ID NO: 201584 - RNA, 22 nt, Human
caggugcugcguggcggagcug

SEQ ID NO: 201585 - RNA, 22 nt, Human
aagcaagcccaggcucagucaa

SEQ ID NO: 201586 - RNA, 22 nt, Human
agguccagugaaacuuuauuug

SEQ ID NO: 201587 - RNA, 17 nt, Human
uuacaacgucaucucug

SEQ ID NO: 201588 - RNA, 20 nt, Human
gcacaucugcuuuggauuuc

SEQ ID NO: 201589 - RNA, 22 nt, Human
agagacaccgcgcaucauggcu

SEQ ID NO: 201590 - RNA, 22 nt, Human
cuuagaaaucgaacucagguua

SEQ ID NO: 201591 - RNA, 22 nt, Human
cucccuggucuuucccaucauu

SEQ ID NO: 201592 - RNA, 20 nt, Human
uauuggaucuaagaaauggg

SEQ ID NO: 201593 - RNA, 22 nt, Human
ggcccagagcucccuggcaccu

SEQ ID NO: 201594 - RNA, 22 nt, Human
ucgccaucgucggacacaguga

SEQ ID NO: 201595 - RNA, 22 nt, Human
ugaaaauucaucucauagcaga

SEQ ID NO: 201596 - RNA, 22 nt, Human
ucugauaucgcacuaaacucug

SEQ ID NO: 201597 - RNA, 18 nt, Human
ggaaggaagaaugcauuu

SEQ ID NO: 201598 - RNA, 22 nt, Human
aggcccuauucaauggggccca

SEQ ID NO: 201599 - RNA, 22 nt, Human
cucagaagaacccaggguccca

SEQ ID NO: 201600 - RNA, 22 nt, Human
gagaugagugggggaucucuca

SEQ ID NO: 201601 - RNA, 22 nt, Human
cucaggcagugcccucuggccg

SEQ ID NO: 201602 - RNA, 22 nt, Human
ccucuuugacucucaggucuuu

SEQ ID NO: 201603 - RNA, 21 nt, Human
uucuucaaagaagaaggcaca

SEQ ID NO: 201604 - RNA, 22 nt, Human
agcaucucugggagucauccgu

SEQ ID NO: 201605 - RNA, 22 nt, Human
ugguccugucucaaggagccuu

SEQ ID NO: 201606 - RNA, 22 nt, Human
cacaauauuggccgggcugguc

SEQ ID NO: 201607 - RNA, 22 nt, Human
ucaggcacugcuuucugauaug

SEQ ID NO: 201608 - RNA, 22 nt, Human
gaaccauuguugaaaagaauag

SEQ ID NO: 201609 - RNA, 22 nt, Human
uauuauuuuagcacugaggauu

SEQ ID NO: 201610 - RNA, 22 nt, Human
ccucagaguaggucucagcugu

SEQ ID NO: 201611 - RNA, 22 nt, Human
auguucuuccaaaucuguaaca

SEQ ID NO: 201612 - RNA, 23 nt, Human
agugcugaauugaaagcuccagg

SEQ ID NO: 201613 - RNA, 23 nt, Human
uugcaaaaugagucuugagugaa

SEQ ID NO: 201614 - RNA, 22 nt, Human
ccagagguuacuuugccuugga

SEQ ID NO: 201615 - RNA, 22 nt, Human
cuggcccagguggucguugagg

SEQ ID NO: 201616 - RNA, 22 nt, Human
aagugccaucauagcauggcug

SEQ ID NO: 201617 - RNA, 22 nt, Human
cccugcagaucuaggguccuuc

SEQ ID NO: 201618 - RNA, 22 nt, Human
uuccuggguuuacguauugggu

SEQ ID NO: 201619 - RNA, 22 nt, Human
cacuggaauggauagagcagag

SEQ ID NO: 201620 - RNA, 22 nt, Human
agauauauuuccugcccaaggc

SEQ ID NO: 201621 - RNA, 19 nt, Human
ccacaaaauuauuuuaguu

SEQ ID NO: 201622 - RNA, 22 nt, Human
auaacagaauaagucauuaccg

SEQ ID NO: 201623 - RNA, 22 nt, Human
caguuuauagcucuagcagcuu

SEQ ID NO: 201624 - RNA, 22 nt, Human
acagcagagccuagcuuaaucu

SEQ ID NO: 201625 - RNA, 22 nt, Human
ugauaaacagcugaugaagacc

SEQ ID NO: 201626 - RNA, 22 nt, Human
aauagcuuaguccugauucugu

SEQ ID NO: 201627 - RNA, 22 nt, Human
gacuuuaucuuguccuuccugc

SEQ ID NO: 201628 - RNA, 22 nt, Human
agucugggcauuuaggauguug

SEQ ID NO: 201629 - RNA, 22 nt, Human
agaggcuuggaggugcaagguu

SEQ ID NO: 201630 - RNA, 22 nt, Human
acaugagaagcugcaacaugac

SEQ ID NO: 201631 - RNA, 22 nt, Human
aacaggcuauuucuuuacaaac

SEQ ID NO: 201632 - RNA, 22 nt, Human
ccuggguccuggcagccuccug

SEQ ID NO: 201633 - RNA, 22 nt, Human
augaaacaguguguauagcaaa

SEQ ID NO: 201634 - RNA, 22 nt, Human
aagcaaagugaauuuugccaag

SEQ ID NO: 201635 - RNA, 22 nt, Human
uuuacagaauguugaauuuggg

SEQ ID NO: 201636 - RNA, 22 nt, Human
gagcagagaauccagcuaagug

SEQ ID NO: 201637 - RNA, 22 nt, Human
cccagacucaucccugggagcu

SEQ ID NO: 201638 - RNA, 22 nt, Human
gggaccagugucugugagaaaa

SEQ ID NO: 201639 - RNA, 22 nt, Human
ugugcccagacugccucaguga

SEQ ID NO: 201640 - RNA, 22 nt, Human
ugcuggccugggcugcaccuug

SEQ ID NO: 201641 - RNA, 22 nt, Human
ucugagaacaugcuuugaucau

SEQ ID NO: 201642 - RNA, 20 nt, Human
aguguuugcucacagucucc

SEQ ID NO: 201643 - RNA, 22 nt, Human
agccuugacacuggggaaacug

SEQ ID NO: 201644 - RNA, 22 nt, Human
ggcugagacaaccugggaccca

SEQ ID NO: 201645 - RNA, 22 nt, Human
cuuggaggaaaggcagggagac

SEQ ID NO: 201646 - RNA, 22 nt, Human
acaguggaugacauccuuuugc

SEQ ID NO: 201647 - RNA, 22 nt, Human
agcggcugcucuuuucagaucc

SEQ ID NO: 201648 - RNA, 22 nt, Human
uuccaggauggcaauaaugaau

SEQ ID NO: 201649 - RNA, 22 nt, Human
ccugugacucugucugaugguc

SEQ ID NO: 201650 - RNA, 22 nt, Human
uacaagaugacaggugcaugau

SEQ ID NO: 201651 - RNA, 22 nt, Human
aaagcugcuuugguuucuggaa

SEQ ID NO: 201652 - RNA, 22 nt, Human
uuucaucuuccuuggcauaggu

SEQ ID NO: 201653 - RNA, 22 nt, Human
acugugcauuugaagggaucau

SEQ ID NO: 201654 - RNA, 22 nt, Human
agggcacaggcuggcaggaucu

SEQ ID NO: 201655 - RNA, 22 nt, Human
acucuguacgcaagagauggag

SEQ ID NO: 201656 - RNA, 22 nt, Human
uucacaaucuggcuuagcauug

SEQ ID NO: 201657 - RNA, 22 nt, Human
acagauggagcuacuagguaaa

SEQ ID NO: 201658 - RNA, 22 nt, Human
acuggcaggcugcuggccggcg

SEQ ID NO: 201659 - RNA, 15 nt, Human
uucaggauaugacuc

SEQ ID NO: 201660 - RNA, 22 nt, Human
gcugcagagugaugaagugggg

SEQ ID NO: 201661 - RNA, 22 nt, Human
uccugagagucaagaaugcagg

SEQ ID NO: 201662 - RNA, 22 nt, Human
uccuuagagauacugucuugaa

SEQ ID NO: 201663 - RNA, 22 nt, Human
uuacacagaaauuuuauugccu

SEQ ID NO: 201664 - RNA, 22 nt, Human
uggcagagugcagaagaggcau

SEQ ID NO: 201665 - RNA, 22 nt, Human
uuggaaguaaugaagagguggg

SEQ ID NO: 201666 - RNA, 22 nt, Human
uagggcucagagaaguggggcc

SEQ ID NO: 201667 - RNA, 22 nt, Human
uggccuuggagaggcacggccc

SEQ ID NO: 201668 - RNA, 20 nt, Human
aggcucaggguguuuaggaa

SEQ ID NO: 201669 - RNA, 22 nt, Human
cacggucacccaucagagucca

SEQ ID NO: 201670 - RNA, 22 nt, Human
ucuaggguccacagggucagcc

SEQ ID NO: 201671 - RNA, 22 nt, Human
uguucuucuagauugccuuuua

SEQ ID NO: 201672 - RNA, 22 nt, Human
uuaauacagucuccagaaguaa

SEQ ID NO: 201673 - RNA, 17 nt, Human
agggacagcaguuuagg

SEQ ID NO: 201674 - RNA, 22 nt, Human
ggcuucucugucuaguuucuac

SEQ ID NO: 201675 - RNA, 23 nt, Human
caugaagguagcacaaagccucu

SEQ ID NO: 201676 - RNA, 22 nt, Human
ugaaaugaaacagaacauauca

SEQ ID NO: 201677 - RNA, 22 nt, Human
acucuggguccugccauucacu

SEQ ID NO: 201678 - RNA, 22 nt, Human
uguacaaagccagaacucccaa

SEQ ID NO: 201679 - RNA, 22 nt, Human
aaaaguauuuauggcuauguaa

SEQ ID NO: 201680 - RNA, 22 nt, Human
aacucaguguguuucuuaguau

SEQ ID NO: 201681 - RNA, 22 nt, Human
gcugccacucugagcuugcuuc

SEQ ID NO: 201682 - RNA, 22 nt, Human
uauauugucucugccuugucug

SEQ ID NO: 201683 - RNA, 22 nt, Human
ucagagccccuccgcuguccca

SEQ ID NO: 201684 - RNA, 21 nt, Human
agagagggagaugaaacaucc

SEQ ID NO: 201685 - RNA, 22 nt, Human
ggccugugggaggacagcuggg

SEQ ID NO: 201686 - RNA, 20 nt, Human
agguccugggacuggcagag

SEQ ID NO: 201687 - RNA, 22 nt, Human
ucauuucccuccuacaaagagg

SEQ ID NO: 201688 - RNA, 22 nt, Human
ccuugcccugagcaggggucag

SEQ ID NO: 201689 - RNA, 22 nt, Human
uaaguguugguaauuacaauga

SEQ ID NO: 201690 - RNA, 22 nt, Human
caccagcccccucacgcuguca

SEQ ID NO: 201691 - RNA, 22 nt, Human
uccaggcccauggagcagagcu

SEQ ID NO: 201692 - RNA, 17 nt, Human
gcccucagcuuuaacca

SEQ ID NO: 201693 - RNA, 22 nt, Human
uagguucauauucuagaaucau

SEQ ID NO: 201694 - RNA, 22 nt, Human
aaagacauugaagaaggacuua

SEQ ID NO: 201695 - RNA, 22 nt, Human
gugcuggcuggacauggagcac

SEQ ID NO: 201696 - RNA, 21 nt, Human
uggagcugccacuuguccucc

SEQ ID NO: 201697 - RNA, 22 nt, Human
agcuccagaaagguacacacag

SEQ ID NO: 201698 - RNA, 22 nt, Human
guaggcagugguuggaagagaa

SEQ ID NO: 201699 - RNA, 22 nt, Human
ugagcugguucuugaggcauga

SEQ ID NO: 201700 - RNA, 22 nt, Human
acuguagagaaucugagaaaaa

SEQ ID NO: 201701 - RNA, 21 nt, Human
ucuuuuaacaccaggaauucc

SEQ ID NO: 201702 - RNA, 22 nt, Human
uuugaaugcaggacauacagaa

SEQ ID NO: 201703 - RNA, 22 nt, Human
cauuuguuaaccaguguggauu

SEQ ID NO: 201704 - RNA, 22 nt, Human
agaauucuuggugguuagaaua

SEQ ID NO: 201705 - RNA, 22 nt, Human
acugugcaagucaaagaugggc

SEQ ID NO: 201706 - RNA, 22 nt, Human
uugaacauuaacuucagucuau

SEQ ID NO: 201707 - RNA, 22 nt, Human
uggcagugccccuugaccagug

SEQ ID NO: 201708 - RNA, 22 nt, Human
ucauuucagaugcauuuagaau

SEQ ID NO: 201709 - RNA, 22 nt, Human
ucuagaaacagguuucuagaaa

SEQ ID NO: 201710 - RNA, 22 nt, Human
auaaaaaggacagauguggucu

SEQ ID NO: 201711 - RNA, 22 nt, Human
gcuuucugcucuguaaaauggg

SEQ ID NO: 201712 - RNA, 22 nt, Human
auggaucuaccuucaggcucug

SEQ ID NO: 201713 - RNA, 22 nt, Human
aaagccauuacaaaauuucaua

SEQ ID NO: 201714 - RNA, 20 nt, Human
gucugaggagcagugggaaa

SEQ ID NO: 201715 - RNA, 22 nt, Human
aauuucaguugcuaauaaguuc

SEQ ID NO: 201716 - RNA, 22 nt, Human
agagucugaggaggaccaacag

SEQ ID NO: 201717 - RNA, 22 nt, Human
agcccugccauucucuggagcu

SEQ ID NO: 201718 - RNA, 22 nt, Human
ggugccagugggucucaggaua

SEQ ID NO: 201719 - RNA, 22 nt, Human
aguggcaguagaugagcugguu

SEQ ID NO: 201720 - RNA, 22 nt, Human
acccagggccacagcccgcagu

SEQ ID NO: 201721 - RNA, 22 nt, Human
ccugugccagccccuucugcug

SEQ ID NO: 201722 - RNA, 22 nt, Human
gggagggaaagcuugaucuguc

SEQ ID NO: 201723 - RNA, 22 nt, Human
acuguccucgaaguaccugugc

SEQ ID NO: 201724 - RNA, 22 nt, Human
caggccagcuuccugacauccu

SEQ ID NO: 201725 - RNA, 22 nt, Human
guccuuccccagccagcucugg

SEQ ID NO: 201726 - RNA, 22 nt, Human
ccaggcugcuuuauuacucugu

SEQ ID NO: 201727 - RNA, 22 nt, Human
aaacaccagucccaguauacac

SEQ ID NO: 201728 - RNA, 22 nt, Human
gcagcaucagguucacugcgug

SEQ ID NO: 201729 - RNA, 20 nt, Human
uccugugugucucaucaacc

SEQ ID NO: 201730 - RNA, 22 nt, Human
gacuuucuaaugcucuguagau

SEQ ID NO: 201731 - RNA, 22 nt, Human
uaacuggugaguugguugagug

SEQ ID NO: 201732 - RNA, 21 nt, Human
cauuucaugauuauagaaaug

SEQ ID NO: 201733 - RNA, 22 nt, Human
gguguuaacuuguuuaugacaa

SEQ ID NO: 201734 - RNA, 22 nt, Human
ugaguuuugucuugcuagaagu

SEQ ID NO: 201735 - RNA, 22 nt, Human
caucacauguaggcagcaucac

SEQ ID NO: 201736 - RNA, 22 nt, Human
acugggauuacaggugggaguc

SEQ ID NO: 201737 - RNA, 22 nt, Human
ggcuccaggugcaugccaggcu

SEQ ID NO: 201738 - RNA, 22 nt, Human
accaggcacucuuguggcagug

SEQ ID NO: 201739 - RNA, 22 nt, Human
cuuuacagauaggaacuacuca

SEQ ID NO: 201740 - RNA, 22 nt, Human
aacaguaaagacagaauuuauc

SEQ ID NO: 201741 - RNA, 22 nt, Human
ccagugugguagguccacaggu

SEQ ID NO: 201742 - RNA, 22 nt, Human
uguccugucucuuuccuaauug

SEQ ID NO: 201743 - RNA, 22 nt, Human
aagaagcagagcuguggguguu

SEQ ID NO: 201744 - RNA, 22 nt, Human
uccagugccucacugaggauuc

SEQ ID NO: 201745 - RNA, 21 nt, Human
uauugauucaauuucuugagu

SEQ ID NO: 201746 - RNA, 22 nt, Human
aggucaaaaucaggcagggaag

SEQ ID NO: 201747 - RNA, 22 nt, Human
ugcaaauccuguuuggaguaag

SEQ ID NO: 201748 - RNA, 22 nt, Human
ucuagggaacaugggucaagcu

SEQ ID NO: 201749 - RNA, 22 nt, Human
uucccugguuaaccauuuucug

SEQ ID NO: 201750 - RNA, 22 nt, Human
uguucugagugcagcuuaauaa

SEQ ID NO: 201751 - RNA, 22 nt, Human
ccacaguacaggaaaucuuguu

SEQ ID NO: 201752 - RNA, 19 nt, Human
guguuuacugugugcagaa

SEQ ID NO: 201753 - RNA, 23 nt, Human
uugcaaauuucaguuaguucaug

SEQ ID NO: 201754 - RNA, 22 nt, Human
ugaguaauaaacugucuugcuc

SEQ ID NO: 201755 - RNA, 22 nt, Human
ugcugggucaggcaucugcaga

SEQ ID NO: 201756 - RNA, 22 nt, Human
ucccagaggucucugcugguuc

SEQ ID NO: 201757 - RNA, 19 nt, Human
ugcacacagauaaguaucu

SEQ ID NO: 201758 - RNA, 22 nt, Human
guguacaguuagccaccaaauu

SEQ ID NO: 201759 - RNA, 22 nt, Human
ucuauuuguucucaggaucauc

SEQ ID NO: 201760 - RNA, 22 nt, Human
caugcaggaggaaaaagcagcu

SEQ ID NO: 201761 - RNA, 22 nt, Human
acaucuuuauacuaguccuuga

SEQ ID NO: 201762 - RNA, 21 nt, Human
uuuaucaucacgagcuugagc

SEQ ID NO: 201763 - RNA, 22 nt, Human
aagcugucaggagguuaccuuu

SEQ ID NO: 201764 - RNA, 20 nt, Human
cacccucccagcaccuaugc

SEQ ID NO: 201765 - RNA, 21 nt, Human
aauuacagauggaauuacaga

SEQ ID NO: 201766 - RNA, 22 nt, Human
gcagcagaguuugggagauggu

SEQ ID NO: 201767 - RNA, 19 nt, Human
uugaaagauuagcuuucua

SEQ ID NO: 201768 - RNA, 22 nt, Human
aauuccuaguuguacuuaguga

SEQ ID NO: 201769 - RNA, 22 nt, Human
guuuaagaaaauucauguuguu

SEQ ID NO: 201770 - RNA, 22 nt, Human
accagaaaggaauaauagaauu

SEQ ID NO: 201771 - RNA, 20 nt, Human
uccugggguaagccaugguc

SEQ ID NO: 201772 - RNA, 22 nt, Human
ucucugggccucaguuuucuca

SEQ ID NO: 201773 - RNA, 22 nt, Human
aggacacagugguggggaaaag

SEQ ID NO: 201774 - RNA, 23 nt, Human
ugaauguuuauucucggugcaga

SEQ ID NO: 201775 - RNA, 22 nt, Human
guucuggguucaaaccccggcc

SEQ ID NO: 201776 - RNA, 22 nt, Human
cugccagcucaccggcucagac

SEQ ID NO: 201777 - RNA, 20 nt, Human
guaaugaauguaaacaguaa

SEQ ID NO: 201778 - RNA, 22 nt, Human
ggugagacuuuagaagagccag

SEQ ID NO: 201779 - RNA, 22 nt, Human
cugagucuccuggggaggugaa

SEQ ID NO: 201780 - RNA, 19 nt, Human
ugccuggacaaaugugggg

SEQ ID NO: 201781 - RNA, 21 nt, Human
acauaggcgaauguucgggag

SEQ ID NO: 201782 - RNA, 22 nt, Human
uuccccaggcuggagugcagug

SEQ ID NO: 201783 - RNA, 22 nt, Human
gcucaggacuggaggagcgggg

SEQ ID NO: 201784 - RNA, 22 nt, Human
ucagaaaugaucguuauucauu

SEQ ID NO: 201785 - RNA, 22 nt, Human
cuucucuggcauagcaagcagg

SEQ ID NO: 201786 - RNA, 22 nt, Human
acacauuugcuaaaaugagcuc

SEQ ID NO: 201787 - RNA, 22 nt, Human
cagauagaaugcaagaccucuc

SEQ ID NO: 201788 - RNA, 22 nt, Human
caccuagcauuccucuuccuca

SEQ ID NO: 201789 - RNA, 22 nt, Human
aggcugagacugugcauuagug

SEQ ID NO: 201790 - RNA, 17 nt, Human
uuccuccucaccauguu

SEQ ID NO: 201791 - RNA, 22 nt, Human
ugcagggcaguggagguugagu

SEQ ID NO: 201792 - RNA, 22 nt, Human
agcuccuggucuuuguccagag

SEQ ID NO: 201793 - RNA, 22 nt, Human
uuggaaggcugaauggccucuc

SEQ ID NO: 201794 - RNA, 22 nt, Human
cuuucuuucgaagacgugauua

SEQ ID NO: 201795 - RNA, 21 nt, Human
uccaaaucccauucuguaguc

SEQ ID NO: 201796 - RNA, 22 nt, Human
auuaggucauggggaggcccua

SEQ ID NO: 201797 - RNA, 22 nt, Human
gagcagugacuggagcaugaga

SEQ ID NO: 201798 - RNA, 22 nt, Human
gaauuuccucuaaaccccugag

SEQ ID NO: 201799 - RNA, 22 nt, Human
acccagccacagcauugaggga

SEQ ID NO: 201800 - RNA, 22 nt, Human
gauuagaagaacuuguuagccu

SEQ ID NO: 201801 - RNA, 22 nt, Human
acaggcugaaaguuaaguucug

SEQ ID NO: 201802 - RNA, 22 nt, Human
ccuccagguguuacauaugacu

SEQ ID NO: 201803 - RNA, 22 nt, Human
uggcccugaggggcugugcccc

SEQ ID NO: 201804 - RNA, 22 nt, Human
uggggauguagaaaugaacaac

SEQ ID NO: 201805 - RNA, 22 nt, Human
gcugggcuuguggccagcuggg

SEQ ID NO: 201806 - RNA, 22 nt, Human
auggucuugauuuuccauaggu

SEQ ID NO: 201807 - RNA, 22 nt, Human
aggcagugugggccaagcuucc

SEQ ID NO: 201808 - RNA, 22 nt, Human
uugauuacuauguguugaaagc

SEQ ID NO: 201809 - RNA, 22 nt, Human
auguuacaacccugaggagccg

SEQ ID NO: 201810 - RNA, 22 nt, Human
aaacuugacagugagacaguuu

SEQ ID NO: 201811 - RNA, 22 nt, Human
cagcugcucuucuggccuguca

SEQ ID NO: 201812 - RNA, 22 nt, Human
uuccaugaaauguguuaugcuu

SEQ ID NO: 201813 - RNA, 22 nt, Human
aacugcaacuucguaaagugag

SEQ ID NO: 201814 - RNA, 22 nt, Human
cagcugaagguaggaaccagga

SEQ ID NO: 201815 - RNA, 22 nt, Human
acaagguuguucugaggauuua

SEQ ID NO: 201816 - RNA, 22 nt, Human
uuccuucuucauuguguuacag

SEQ ID NO: 201817 - RNA, 22 nt, Human
agguggccggugccagccgggc

SEQ ID NO: 201818 - RNA, 22 nt, Human
ugagacuuccugaugaggcccg

SEQ ID NO: 201819 - RNA, 22 nt, Human
aacaugaaaacuaccugugauu

SEQ ID NO: 201820 - RNA, 22 nt, Human
acugucaucuuguaagcaaugu

SEQ ID NO: 201821 - RNA, 22 nt, Human
gcagaagucagaccaucugaau

SEQ ID NO: 201822 - RNA, 22 nt, Human
agagagcagucuggaagaaaca

SEQ ID NO: 201823 - RNA, 22 nt, Human
auuuucaucauggguuuaacau

SEQ ID NO: 201824 - RNA, 22 nt, Human
gggcucuguguucuagcucucg

SEQ ID NO: 201825 - RNA, 22 nt, Human
agccagugggauuagagccucu

SEQ ID NO: 201826 - RNA, 22 nt, Human
uacagaauguuaugaagcauag

SEQ ID NO: 201827 - RNA, 22 nt, Human
caggaaaaggagacuuuagcac

SEQ ID NO: 201828 - RNA, 22 nt, Human
aaggccacagagccucagagag

SEQ ID NO: 201829 - RNA, 22 nt, Human
gcuccucuauuccccacauuuu

SEQ ID NO: 201830 - RNA, 22 nt, Human
aggaaaagugugaaguauggag

SEQ ID NO: 201831 - RNA, 22 nt, Human
aaguaguuaguccgccugcucu

SEQ ID NO: 201832 - RNA, 22 nt, Human
ugggcucucuuuaccucauaac

SEQ ID NO: 201833 - RNA, 17 nt, Human
cugaagaguccuggcua

SEQ ID NO: 201834 - RNA, 22 nt, Human
uggcaguuggggaugaagugag

SEQ ID NO: 201835 - RNA, 22 nt, Human
agaaagccucaaucuucaggcc

SEQ ID NO: 201836 - RNA, 22 nt, Human
gauugcuguucccagggggcug

SEQ ID NO: 201837 - RNA, 22 nt, Human
aguucccaggugaugcugaugu

SEQ ID NO: 201838 - RNA, 22 nt, Human
cagcuucuccggccuggugcgg

SEQ ID NO: 201839 - RNA, 22 nt, Human
ccauacacacaccaaauuugua

SEQ ID NO: 201840 - RNA, 22 nt, Human
augagcagguuuaagagaggcc

SEQ ID NO: 201841 - RNA, 20 nt, Human
agguccugguucucugggau

SEQ ID NO: 201842 - RNA, 22 nt, Human
accuucaagaaacauuuccuug

SEQ ID NO: 201843 - RNA, 22 nt, Human
ucuagagauuggacuuccuaga

SEQ ID NO: 201844 - RNA, 22 nt, Human
ugaaaaugcacgcuggaaagca

SEQ ID NO: 201845 - RNA, 22 nt, Human
ugcacuuugcaggcauggaaac

SEQ ID NO: 201846 - RNA, 22 nt, Human
uguggccuccuguuccugggua

SEQ ID NO: 201847 - RNA, 22 nt, Human
ccaggagagcagaagcccaggc

SEQ ID NO: 201848 - RNA, 22 nt, Human
uuucauguuacauuuaaaaugu

SEQ ID NO: 201849 - RNA, 18 nt, Human
augcaagcuauggauuug

SEQ ID NO: 201850 - RNA, 22 nt, Human
ugaggcaaucccuaggguaagg

SEQ ID NO: 201851 - RNA, 22 nt, Human
caagagcuagacuuugucagga

SEQ ID NO: 201852 - RNA, 22 nt, Human
acucuucauucaaguaugcaaa

SEQ ID NO: 201853 - RNA, 22 nt, Human
agacaugcaauaaugugcacuc

SEQ ID NO: 201854 - RNA, 22 nt, Human
agauaaaaugguucaaaggcua

SEQ ID NO: 201855 - RNA, 22 nt, Human
uauuuguugcgggaauugcuau

SEQ ID NO: 201856 - RNA, 22 nt, Human
ccacauggagcaggaggugggg

SEQ ID NO: 201857 - RNA, 22 nt, Human
acaugccaauuugguuaguuca

SEQ ID NO: 201858 - RNA, 22 nt, Human
acacaucuccagaagugggcug

SEQ ID NO: 201859 - RNA, 22 nt, Human
agcagggcccacuaggggagau

SEQ ID NO: 201860 - RNA, 22 nt, Human
auuuccuugcaaguuucuguaa

SEQ ID NO: 201861 - RNA, 22 nt, Human
cauguaaagcacuucauaacag

SEQ ID NO: 201862 - RNA, 22 nt, Human
caucauuucacuuagaugaagu

SEQ ID NO: 201863 - RNA, 22 nt, Human
ucuaacuugugaguauagauga

SEQ ID NO: 201864 - RNA, 22 nt, Human
cugggaggcccacguugggaag

SEQ ID NO: 201865 - RNA, 18 nt, Human
ucugggcuucccgaggcu

SEQ ID NO: 201866 - RNA, 23 nt, Human
ccuggcagcaaacgaggagguua

SEQ ID NO: 201867 - RNA, 22 nt, Human
aggguccuucuguuccugagca

SEQ ID NO: 201868 - RNA, 22 nt, Human
agucagcagugaaagcacagcc

SEQ ID NO: 201869 - RNA, 22 nt, Human
cucugagcagaggccguggcua

SEQ ID NO: 201870 - RNA, 22 nt, Human
aaggggccucacagaugggcuu

SEQ ID NO: 201871 - RNA, 22 nt, Human
agagggaagaugguccaaucuu

SEQ ID NO: 201872 - RNA, 22 nt, Human
gagccagccuucuucugagguc

SEQ ID NO: 201873 - RNA, 22 nt, Human
uaaauuacccuuuagggaauug

SEQ ID NO: 201874 - RNA, 22 nt, Human
ugggugcucugcgaccguaggg

SEQ ID NO: 201875 - RNA, 20 nt, Human
uauacuaacauauaucuguu

SEQ ID NO: 201876 - RNA, 22 nt, Human
cccaggcaucccauuaaggagc

SEQ ID NO: 201877 - RNA, 22 nt, Human
aguguuugggggccuuguaaca

SEQ ID NO: 201878 - RNA, 22 nt, Human
uccuggcuccagcagcucuucc

SEQ ID NO: 201879 - RNA, 22 nt, Human
acagaauagagacugccugcuc

SEQ ID NO: 201880 - RNA, 17 nt, Human
agccaggcauaugaagu

SEQ ID NO: 201881 - RNA, 23 nt, Human
ugcuuauucaaaaggugcuuuca

SEQ ID NO: 201882 - RNA, 22 nt, Human
cauguguguggcugacaauuuu

SEQ ID NO: 201883 - RNA, 22 nt, Human
aucugcugucacauguuugaag

SEQ ID NO: 201884 - RNA, 22 nt, Human
acagugugaugggccugccuga

SEQ ID NO: 201885 - RNA, 22 nt, Human
ucaggaguaaagaagacuugac

SEQ ID NO: 201886 - RNA, 22 nt, Human
ucccuggggaagggcaagcaag

SEQ ID NO: 201887 - RNA, 22 nt, Human
uggucaaggcuuggagauagua

SEQ ID NO: 201888 - RNA, 22 nt, Human
cccuccccagggucauauugaa

SEQ ID NO: 201889 - RNA, 22 nt, Human
aaaggcuuaacagaagaccuuu

SEQ ID NO: 201890 - RNA, 22 nt, Human
agucugggagggaugccagugu

SEQ ID NO: 201891 - RNA, 22 nt, Human
uguuucugucuguuuucuacau

SEQ ID NO: 201892 - RNA, 21 nt, Human
gggcaggucucugaugucaac

SEQ ID NO: 201893 - RNA, 22 nt, Human
aggcuccacggcaggaugcugu

SEQ ID NO: 201894 - RNA, 22 nt, Human
aggccagcaccagagucaagaa

SEQ ID NO: 201895 - RNA, 22 nt, Human
ccuguucuguuaauuaaacuuu

SEQ ID NO: 201896 - RNA, 22 nt, Human
ucucaucuauucacauuaacug

SEQ ID NO: 201897 - RNA, 22 nt, Human
cugcugagagccccagcugaga

SEQ ID NO: 201898 - RNA, 17 nt, Human
ucuguucaagugagagg

SEQ ID NO: 201899 - RNA, 22 nt, Human
ugcacuucaaaaaugucacuga

SEQ ID NO: 201900 - RNA, 22 nt, Human
gcuguauuuauuuucuaggguu

SEQ ID NO: 201901 - RNA, 22 nt, Human
agcuggggguuggauaagggua

SEQ ID NO: 201902 - RNA, 22 nt, Human
cagugaaguuuaaaguguagau

SEQ ID NO: 201903 - RNA, 22 nt, Human
cagagcuggguuugggaaaccu

SEQ ID NO: 201904 - RNA, 22 nt, Human
ggccagggccaaggcuuuccca

SEQ ID NO: 201905 - RNA, 22 nt, Human
cuccucaaggucucaggaauaa

SEQ ID NO: 201906 - RNA, 22 nt, Human
uacagaccaguaguucucagcg

SEQ ID NO: 201907 - RNA, 22 nt, Human
ucucugggaucguuuugggcuc

SEQ ID NO: 201908 - RNA, 22 nt, Human
cagcaggucccacugagggccc

SEQ ID NO: 201909 - RNA, 22 nt, Human
uacaaagauaaaaucucaccau

SEQ ID NO: 201910 - RNA, 22 nt, Human
cugcccugagggccuguguguu

SEQ ID NO: 201911 - RNA, 22 nt, Human
cuggcacagagugagcauucaa

SEQ ID NO: 201912 - RNA, 19 nt, Human
cugggccugcaugguuguu

SEQ ID NO: 201913 - RNA, 22 nt, Human
agguggcagagugacaggcuga

SEQ ID NO: 201914 - RNA, 22 nt, Human
cagccagagaggaaggaaugca

SEQ ID NO: 201915 - RNA, 22 nt, Human
gguguccuuguugaacgaaaau

SEQ ID NO: 201916 - RNA, 22 nt, Human
caucuagaaaaaagaccuguug

SEQ ID NO: 201917 - RNA, 23 nt, Human
aaauccugccucuuguauuuauc

SEQ ID NO: 201918 - RNA, 22 nt, Human
aggaccaccgguccauccaccc

SEQ ID NO: 201919 - RNA, 22 nt, Human
guucagcagcagugauuuugug

SEQ ID NO: 201920 - RNA, 22 nt, Human
uugugcauuagggaaaggaacu

SEQ ID NO: 201921 - RNA, 22 nt, Human
ucauucggcaauaguguguuag

SEQ ID NO: 201922 - RNA, 22 nt, Human
uuuuaauacugcuauuguagga

SEQ ID NO: 201923 - RNA, 22 nt, Human
ugaccccacugugcucagaggu

SEQ ID NO: 201924 - RNA, 22 nt, Human
acauugaagcugugaaaucaaa

SEQ ID NO: 201925 - RNA, 22 nt, Human
aggcacagauuuggggaaagca

SEQ ID NO: 201926 - RNA, 22 nt, Human
uucaguaucccugcuuggacag

SEQ ID NO: 201927 - RNA, 22 nt, Human
acagauacaaauauacaaauac

SEQ ID NO: 201928 - RNA, 20 nt, Human
uagggaugccaguacuucuc

SEQ ID NO: 201929 - RNA, 22 nt, Human
agaggcagaaguguucaaaccc

SEQ ID NO: 201930 - RNA, 18 nt, Human
uggcagguccagcugugg

SEQ ID NO: 201931 - RNA, 22 nt, Human
augauuucuauauaaacuuaaa

SEQ ID NO: 201932 - RNA, 22 nt, Human
ggugacaucuagagacauccaa

SEQ ID NO: 201933 - RNA, 22 nt, Human
gcagccuguuguaccagccugu

SEQ ID NO: 201934 - RNA, 22 nt, Human
gaguccaguguuuaccaggggu

SEQ ID NO: 201935 - RNA, 22 nt, Human
ggagaagggcaugguaguuuua

SEQ ID NO: 201936 - RNA, 22 nt, Human
ccugggcaucucaugcaccugc

SEQ ID NO: 201937 - RNA, 22 nt, Human
cuucucccuggcuucugcacac

SEQ ID NO: 201938 - RNA, 23 nt, Human
uccaggcugggacuucaacuggc

SEQ ID NO: 201939 - RNA, 21 nt, Human
aggcccaggaauaugcauuuu

SEQ ID NO: 201940 - RNA, 22 nt, Human
caggaaggcgcggcugugccug

SEQ ID NO: 201941 - RNA, 22 nt, Human
uacugagggcaaagagugaagc

SEQ ID NO: 201942 - RNA, 22 nt, Human
aaguuuuugauucuaagagaga

SEQ ID NO: 201943 - RNA, 22 nt, Human
cacuuuggaugccacuggucua

SEQ ID NO: 201944 - RNA, 22 nt, Human
cagcagagacgguaagcagaac

SEQ ID NO: 201945 - RNA, 22 nt, Human
cuuaagauugucagcuucagcc

SEQ ID NO: 201946 - RNA, 22 nt, Human
gcuuccaggucauucucacccu

SEQ ID NO: 201947 - RNA, 22 nt, Human
uacagaaaaacuggcauugaag

SEQ ID NO: 201948 - RNA, 22 nt, Human
ucagaauauauucauguuguca

SEQ ID NO: 201949 - RNA, 22 nt, Human
acugggcuuaugcuguggagua

SEQ ID NO: 201950 - RNA, 21 nt, Human
agcaugucucagucaacaagg

SEQ ID NO: 201951 - RNA, 22 nt, Human
uuggcugaugcaagagcuuccu

SEQ ID NO: 201952 - RNA, 22 nt, Human
gcaauuauaucaccagagaucu

SEQ ID NO: 201953 - RNA, 22 nt, Human
uacuuuuugucucuuugaaugu

SEQ ID NO: 201954 - RNA, 22 nt, Human
ugagcaggacucacugcagccu

SEQ ID NO: 201955 - RNA, 22 nt, Human
acaugaagcaagaaagaugcua

SEQ ID NO: 201956 - RNA, 22 nt, Human
cacaugaauaaggcuuuauugu

SEQ ID NO: 201957 - RNA, 22 nt, Human
ucccaggaagaucccagggacc

SEQ ID NO: 201958 - RNA, 22 nt, Human
uuuucagaggccuaagagguuu

SEQ ID NO: 201959 - RNA, 22 nt, Human
ucuuuagagcucagaaauacag

SEQ ID NO: 201960 - RNA, 22 nt, Human
guuugcaaauuguguuaaagcu

SEQ ID NO: 201961 - RNA, 22 nt, Human
ggcuggcacugaggagagcucu

SEQ ID NO: 201962 - RNA, 22 nt, Human
cuggaaggucuguccccacugc

SEQ ID NO: 201963 - RNA, 20 nt, Human
agaaucugacccagagagac

SEQ ID NO: 201964 - RNA, 22 nt, Human
cccaaguuaaaauucagugcuc

SEQ ID NO: 201965 - RNA, 22 nt, Human
uuaaucugaaucaguaaacacu

SEQ ID NO: 201966 - RNA, 20 nt, Human
uaacagaaguagaagugggu

SEQ ID NO: 201967 - RNA, 21 nt, Human
agcugccacccuagcuucuga

SEQ ID NO: 201968 - RNA, 22 nt, Human
uuugaacaggaguaucuauagu

SEQ ID NO: 201969 - RNA, 22 nt, Human
auguuauuaaaguacagauucu

SEQ ID NO: 201970 - RNA, 22 nt, Human
cuggagucuuagguuaugguga

SEQ ID NO: 201971 - RNA, 22 nt, Human
accaugaucugcucugguguuu

SEQ ID NO: 201972 - RNA, 22 nt, Human
gcauccuggcucuaggugucau

SEQ ID NO: 201973 - RNA, 22 nt, Human
aaacuaaggugcuguggacuga

SEQ ID NO: 201974 - RNA, 22 nt, Human
gcccucagaggacagcugacuu

SEQ ID NO: 201975 - RNA, 22 nt, Human
aguauuucuucauaugauuacu

SEQ ID NO: 201976 - RNA, 22 nt, Human
cuggggaggcagggcugccccu

SEQ ID NO: 201977 - RNA, 22 nt, Human
uggcuucucugugguggcuccc

SEQ ID NO: 201978 - RNA, 22 nt, Human
cuggguguagauggaaguuugg

SEQ ID NO: 201979 - RNA, 22 nt, Human
cuggcccuguggccuaaggacu

SEQ ID NO: 201980 - RNA, 22 nt, Human
acacuucuauucccugcacaaa

SEQ ID NO: 201981 - RNA, 22 nt, Human
acaggcugccuaccaaguauca

SEQ ID NO: 201982 - RNA, 22 nt, Human
acugccuuagaacaaagcagga

SEQ ID NO: 201983 - RNA, 22 nt, Human
agggccugcucuaucacucuca

SEQ ID NO: 201984 - RNA, 22 nt, Human
aguccucugcugugcgucuuug

SEQ ID NO: 201985 - RNA, 22 nt, Human
cagugacacccagucuggccca

SEQ ID NO: 201986 - RNA, 22 nt, Human
cagacagguugcaaaacuucaa

SEQ ID NO: 201987 - RNA, 22 nt, Human
acauauauguaaaguacuuugu

SEQ ID NO: 201988 - RNA, 20 nt, Human
ggaggguggaagaaagcaag

SEQ ID NO: 201989 - RNA, 22 nt, Human
ggucagaggggauuccuuggga

SEQ ID NO: 201990 - RNA, 22 nt, Human
uguccuggggacaagaggcccu

SEQ ID NO: 201991 - RNA, 22 nt, Human
accaagugaguacuuggcagaa

SEQ ID NO: 201992 - RNA, 22 nt, Human
auuguauaauuguauugccaaa

SEQ ID NO: 201993 - RNA, 22 nt, Human
ucuccaggaaccaucaugguaa

SEQ ID NO: 201994 - RNA, 22 nt, Human
aacacaggggguuacaaauugu

SEQ ID NO: 201995 - RNA, 22 nt, Human
ugugcuucucacaucacuguug

SEQ ID NO: 201996 - RNA, 22 nt, Human
uccccucuggaggcugcagggg

SEQ ID NO: 201997 - RNA, 22 nt, Human
aaggaggagcggaggcuuguug

SEQ ID NO: 201998 - RNA, 22 nt, Human
uuucagaaagcugaacauauga

SEQ ID NO: 201999 - RNA, 22 nt, Human
uucuaacucuacacuagcuuug

SEQ ID NO: 202000 - RNA, 23 nt, Human
gccugugccuaugcccagcucug

SEQ ID NO: 202001 - RNA, 22 nt, Human
accucagagauacaaaccaugg

SEQ ID NO: 202002 - RNA, 22 nt, Human
uucuggcuuaguuguuguauau

SEQ ID NO: 202003 - RNA, 22 nt, Human
uacagugacccuauuuccaaau

SEQ ID NO: 202004 - RNA, 22 nt, Human
aaaaucuugacuguuuuuagaa

SEQ ID NO: 202005 - RNA, 22 nt, Human
uggguccugcacugcaagcacc

SEQ ID NO: 202006 - RNA, 22 nt, Human
cacaggugcaagaaguugcagu

SEQ ID NO: 202007 - RNA, 23 nt, Human
aaaaaaccauguaggcacucagu

SEQ ID NO: 202008 - RNA, 22 nt, Human
agcuccugggagcaggugguac

SEQ ID NO: 202009 - RNA, 20 nt, Human
uauucaacuuuaaaaacuua

SEQ ID NO: 202010 - RNA, 22 nt, Human
augaggcacagagauguuaaug

SEQ ID NO: 202011 - RNA, 19 nt, Human
ucccucagucugccaggcc

SEQ ID NO: 202012 - RNA, 22 nt, Human
uuaagugucauaauuuccaaga

SEQ ID NO: 202013 - RNA, 18 nt, Human
ugaggccucugcugggcc

SEQ ID NO: 202014 - RNA, 22 nt, Human
caggauggucuucauuuggcuc

SEQ ID NO: 202015 - RNA, 18 nt, Human
gugugcaguugcaggggu

SEQ ID NO: 202016 - RNA, 22 nt, Human
uggguccuucaaagcugggucu

SEQ ID NO: 202017 - RNA, 22 nt, Human
aggcacugacucaagggagcca

SEQ ID NO: 202018 - RNA, 22 nt, Human
accaguuuauagcgaucuguca

SEQ ID NO: 202019 - RNA, 22 nt, Human
gccccagcucugccacaacuag

SEQ ID NO: 202020 - RNA, 22 nt, Human
aguccaggcauuccagccauuc

SEQ ID NO: 202021 - RNA, 22 nt, Human
guggcuucuggcugggccucag

SEQ ID NO: 202022 - RNA, 22 nt, Human
cuucugugcuucacaguugcca

SEQ ID NO: 202023 - RNA, 22 nt, Human
auuguaacauguucagaucacu

SEQ ID NO: 202024 - RNA, 22 nt, Human
uccugggcagccucucuggaag

SEQ ID NO: 202025 - RNA, 23 nt, Human
agaaaccacugaagagauccagu

SEQ ID NO: 202026 - RNA, 22 nt, Human
ccugagcugaacuaagcaguuu

SEQ ID NO: 202027 - RNA, 22 nt, Human
cuggcuuccaugcuguaguggc

SEQ ID NO: 202028 - RNA, 22 nt, Human
acagcuuuugaaaaauuacugg

SEQ ID NO: 202029 - RNA, 20 nt, Human
ugcaggugggcccuucuggg

SEQ ID NO: 202030 - RNA, 22 nt, Human
guuacagucaggagauauuuug

SEQ ID NO: 202031 - RNA, 22 nt, Human
uggccuguugcuccuagggguc

SEQ ID NO: 202032 - RNA, 22 nt, Human
aggcugagcugguagugaguac

SEQ ID NO: 202033 - RNA, 22 nt, Human
uggcacuggaaucguagccuug

SEQ ID NO: 202034 - RNA, 19 nt, Human
ccugccugagcugucccuc

SEQ ID NO: 202035 - RNA, 22 nt, Human
ucugcaucucuuauaaaugaug

SEQ ID NO: 202036 - RNA, 22 nt, Human
auuuccaugaaggcagauuuua

SEQ ID NO: 202037 - RNA, 22 nt, Human
uuuccaaaaugaaucuaaugca

SEQ ID NO: 202038 - RNA, 22 nt, Human
acucuuuagagguacaucucuu

SEQ ID NO: 202039 - RNA, 22 nt, Human
ucugagaaauuucuuugugaug

SEQ ID NO: 202040 - RNA, 22 nt, Human
auucagagucugcacaacagca

SEQ ID NO: 202041 - RNA, 22 nt, Human
gaagauuugaaacacauagaca

SEQ ID NO: 202042 - RNA, 22 nt, Human
agcagcugagaugguaagauuc

SEQ ID NO: 202043 - RNA, 22 nt, Human
cacagugcuguuuguaaagaga

SEQ ID NO: 202044 - RNA, 22 nt, Human
ccagcugacgaugccuggucuc

SEQ ID NO: 202045 - RNA, 22 nt, Human
ccugagagugagggccuccuua

SEQ ID NO: 202046 - RNA, 23 nt, Human
uagucaguauguaagucuaauug

SEQ ID NO: 202047 - RNA, 22 nt, Human
gcagauguaauggcuggagguc

SEQ ID NO: 202048 - RNA, 22 nt, Human
gaacuuuguggggcugagagga

SEQ ID NO: 202049 - RNA, 22 nt, Human
agaauuguucuguagcuuggcu

SEQ ID NO: 202050 - RNA, 22 nt, Human
guccaucuguaggagggacaca

SEQ ID NO: 202051 - RNA, 22 nt, Human
ucaaaaauggucuuugagcugc

SEQ ID NO: 202052 - RNA, 22 nt, Human
caaggccauaagagauacaaaa

SEQ ID NO: 202053 - RNA, 22 nt, Human
ccucagcucccaugagaucugc

SEQ ID NO: 202054 - RNA, 22 nt, Human
ucugagacuuuaaccuggggcc

SEQ ID NO: 202055 - RNA, 22 nt, Human
gugcuuuuaaaggcaauuagua

SEQ ID NO: 202056 - RNA, 22 nt, Human
gcugucugacuccaaguuggag

SEQ ID NO: 202057 - RNA, 22 nt, Human
uaguaacugguugaacaacugu

SEQ ID NO: 202058 - RNA, 19 nt, Human
accugccaugacagccuga

SEQ ID NO: 202059 - RNA, 22 nt, Human
uuacauguacugguuugacuua

SEQ ID NO: 202060 - RNA, 18 nt, Human
cccugaggcuagcaugcu

SEQ ID NO: 202061 - RNA, 22 nt, Human
aagucagagaucaaggugucua

SEQ ID NO: 202062 - RNA, 22 nt, Human
auaugagaauuggaaaauauca

SEQ ID NO: 202063 - RNA, 22 nt, Human
aaaugcuugcucuugauuauuu

SEQ ID NO: 202064 - RNA, 22 nt, Human
ugaaaauuguuguacuugauaa

SEQ ID NO: 202065 - RNA, 19 nt, Human
augcuuuauguuauuucuu

SEQ ID NO: 202066 - RNA, 22 nt, Human
aucuguacuaauuaauuaaugu

SEQ ID NO: 202067 - RNA, 22 nt, Human
cuuagcccugagaguucugagc

SEQ ID NO: 202068 - RNA, 22 nt, Human
ccuggaucagucacuguugcug

SEQ ID NO: 202069 - RNA, 21 nt, Human
ucagaacuggugcagaugaau

SEQ ID NO: 202070 - RNA, 22 nt, Human
cuggcacugaguggcuuaugac

SEQ ID NO: 202071 - RNA, 22 nt, Human
uaucugauacaacagaauaaca

SEQ ID NO: 202072 - RNA, 22 nt, Human
gcucagagggaacaaggggcug

SEQ ID NO: 202073 - RNA, 22 nt, Human
aggaggccccuccuggguugcu

SEQ ID NO: 202074 - RNA, 22 nt, Human
agccugagcugccugccgccuc

SEQ ID NO: 202075 - RNA, 22 nt, Human
gguccuuugaaagggguguguc

SEQ ID NO: 202076 - RNA, 22 nt, Human
auuuccuaggugcucgagugcu

SEQ ID NO: 202077 - RNA, 22 nt, Human
ugucacaugaaacuugcucauc

SEQ ID NO: 202078 - RNA, 21 nt, Human
ucccugaguucucugagcauc

SEQ ID NO: 202079 - RNA, 22 nt, Human
gccugggugaauuugauccuaa

SEQ ID NO: 202080 - RNA, 22 nt, Human
uuacagaaggaacacuacucag

SEQ ID NO: 202081 - RNA, 16 nt, Human
gcagguggaucaccug

SEQ ID NO: 202082 - RNA, 22 nt, Human
uagaacagaguuccagugauca

SEQ ID NO: 202083 - RNA, 22 nt, Human
aagccagguuccauggaggagc

SEQ ID NO: 202084 - RNA, 22 nt, Human
aagcaaagacaguuugagugga

SEQ ID NO: 202085 - RNA, 22 nt, Human
ggccaggagauggacaccacau

SEQ ID NO: 202086 - RNA, 23 nt, Human
cccauuuucauguuaacuccugg

SEQ ID NO: 202087 - RNA, 22 nt, Human
cuuuagaaggguaacggaauua

SEQ ID NO: 202088 - RNA, 22 nt, Human
uacaaggaaaauuuuauaguaa

SEQ ID NO: 202089 - RNA, 22 nt, Human
acacacagcgccuaccaugugc

SEQ ID NO: 202090 - RNA, 22 nt, Human
ugaaacagugcuucacucagcc

SEQ ID NO: 202091 - RNA, 22 nt, Human
cugugcuggugaaacccacaga

SEQ ID NO: 202092 - RNA, 22 nt, Human
agcagcaggaggcuguccacca

SEQ ID NO: 202093 - RNA, 22 nt, Human
uugggggcauauugaguagugg

SEQ ID NO: 202094 - RNA, 22 nt, Human
cugucugucaaguucaucucca

SEQ ID NO: 202095 - RNA, 22 nt, Human
gcauucugugcuacagccauuc

SEQ ID NO: 202096 - RNA, 22 nt, Human
gagggagggaaaguuuaacacu

SEQ ID NO: 202097 - RNA, 22 nt, Human
agagccaaggcugagagcuauu

SEQ ID NO: 202098 - RNA, 21 nt, Human
cagagccuguguugacaguug

SEQ ID NO: 202099 - RNA, 22 nt, Human
ggucacaugugauuugagccaa

SEQ ID NO: 202100 - RNA, 22 nt, Human
ugcuauuugggggcuacaugau

SEQ ID NO: 202101 - RNA, 22 nt, Human
uacugcauaacuggcauguggg

SEQ ID NO: 202102 - RNA, 17 nt, Human
aggcaugaggcaucacu

SEQ ID NO: 202103 - RNA, 22 nt, Human
aaaagauuguuagggagaaugu

SEQ ID NO: 202104 - RNA, 22 nt, Human
aggcuggcagccaccucagcag

SEQ ID NO: 202105 - RNA, 22 nt, Human
cacugagcugauuucaggugcc

SEQ ID NO: 202106 - RNA, 22 nt, Human
acauuugauggaguuaguaggu

SEQ ID NO: 202107 - RNA, 22 nt, Human
cauuuccacuucugaaaacugg

SEQ ID NO: 202108 - RNA, 22 nt, Human
ucucuucacauuccuggcaaac

SEQ ID NO: 202109 - RNA, 22 nt, Human
uguuaaauguauuauguguucu

SEQ ID NO: 202110 - RNA, 22 nt, Human
gcagggcugacucagccacccu

SEQ ID NO: 202111 - RNA, 22 nt, Human
ccucuaggauguggcuggagga

SEQ ID NO: 202112 - RNA, 22 nt, Human
gucaggauuuacaaacuucagu

SEQ ID NO: 202113 - RNA, 22 nt, Human
uguuaucugguugucugauuac

SEQ ID NO: 202114 - RNA, 22 nt, Human
ggggaagggaguccaaguguua

SEQ ID NO: 202115 - RNA, 23 nt, Human
gcucuuuguucauguggaugccu

SEQ ID NO: 202116 - RNA, 22 nt, Human
ugucugagugcauaugugcugg

SEQ ID NO: 202117 - RNA, 22 nt, Human
cugagcagaccauggcagaggu

SEQ ID NO: 202118 - RNA, 22 nt, Human
gugugcaguagagaaagagcag

SEQ ID NO: 202119 - RNA, 23 nt, Human
gcucagaggugaaauguuuuggg

SEQ ID NO: 202120 - RNA, 22 nt, Human
gaggcaguuccugagugacaag

SEQ ID NO: 202121 - RNA, 22 nt, Human
cacaucagggcugcuugggggu

SEQ ID NO: 202122 - RNA, 22 nt, Human
gaggagcuugugagaagauguc

SEQ ID NO: 202123 - RNA, 22 nt, Human
acagugucucacugcugaaauc

SEQ ID NO: 202124 - RNA, 22 nt, Human
ugagagagcgccugggaucauu

SEQ ID NO: 202125 - RNA, 20 nt, Human
ugcauggcgcacaucugugg

SEQ ID NO: 202126 - RNA, 22 nt, Human
aaagugcuuucccacauuuguu

SEQ ID NO: 202127 - RNA, 22 nt, Human
gcugugcacuaccuauacaucc

SEQ ID NO: 202128 - RNA, 22 nt, Human
ucagcaggcugucagcaggggc

SEQ ID NO: 202129 - RNA, 22 nt, Human
ucugacuuuucucacuguugug

SEQ ID NO: 202130 - RNA, 22 nt, Human
ucucuucuauuugagacuauuu

SEQ ID NO: 202131 - RNA, 22 nt, Human
aguaacacuauuuucauaugua

SEQ ID NO: 202132 - RNA, 22 nt, Human
aacauguagcagaaacgacuaa

SEQ ID NO: 202133 - RNA, 22 nt, Human
ucucagaaggguggugcuggag

SEQ ID NO: 202134 - RNA, 22 nt, Human
agucuaguaggaucucugggcu

SEQ ID NO: 202135 - RNA, 22 nt, Human
aaggaaacagaggaugaccuug

SEQ ID NO: 202136 - RNA, 22 nt, Human
uagaggagaguugcuggaugga

SEQ ID NO: 202137 - RNA, 22 nt, Human
uagggaccuuagaauuguaugu

SEQ ID NO: 202138 - RNA, 23 nt, Human
uggcucugagcuuccugguggcc

SEQ ID NO: 202139 - RNA, 22 nt, Human
acauuucagugagcuauugaag

SEQ ID NO: 202140 - RNA, 22 nt, Human
auggcugcuucaguaccaguuc

SEQ ID NO: 202141 - RNA, 22 nt, Human
uuccuggcugaucuaccaaagu

SEQ ID NO: 202142 - RNA, 22 nt, Human
ugcagcugaaccuagagucugu

SEQ ID NO: 202143 - RNA, 22 nt, Human
aaggcauaugcauagaagacag

SEQ ID NO: 202144 - RNA, 20 nt, Human
aaaauauguauaacucuucu

SEQ ID NO: 202145 - RNA, 22 nt, Human
uagauuuguuuccuucucucca

SEQ ID NO: 202146 - RNA, 22 nt, Human
cucccucaggccuuagcccugc

SEQ ID NO: 202147 - RNA, 22 nt, Human
aggcuucaguagggagcauguc

SEQ ID NO: 202148 - RNA, 21 nt, Human
aguuggaggcaguuuggcaau

SEQ ID NO: 202149 - RNA, 22 nt, Human
ucccagagucagagguggggcc

SEQ ID NO: 202150 - RNA, 22 nt, Human
gcagaugcagaacucagugggu

SEQ ID NO: 202151 - RNA, 22 nt, Human
caaacugagcaucagaaaguuu

SEQ ID NO: 202152 - RNA, 18 nt, Human
uccaggucccaggggaag

SEQ ID NO: 202153 - RNA, 23 nt, Human
uaagacacccgacuccagagaug

SEQ ID NO: 202154 - RNA, 22 nt, Human
ucuggcaguaauaggggagaga

SEQ ID NO: 202155 - RNA, 18 nt, Human
ugcugugcacagcccuau

SEQ ID NO: 202156 - RNA, 21 nt, Human
cuggaggguagaguugggcug

SEQ ID NO: 202157 - RNA, 22 nt, Human
ugcugaggaauaauuguuccug

SEQ ID NO: 202158 - RNA, 22 nt, Human
cucuccagucauauucucaguc

SEQ ID NO: 202159 - RNA, 22 nt, Human
cuucucuguguagagauucaga

SEQ ID NO: 202160 - RNA, 22 nt, Human
guuuauuauucaacuucauguu

SEQ ID NO: 202161 - RNA, 22 nt, Human
ucauauuuaggccuuuaauuca

SEQ ID NO: 202162 - RNA, 22 nt, Human
cucccggcacuuggcaugucau

SEQ ID NO: 202163 - RNA, 22 nt, Human
ccaggcccugccugugguuccu

SEQ ID NO: 202164 - RNA, 22 nt, Human
uucacauguuggacauagagga

SEQ ID NO: 202165 - RNA, 22 nt, Human
guguuacuaaaauuugauucuu

SEQ ID NO: 202166 - RNA, 20 nt, Human
gaggcugaaguguuuuugcu

SEQ ID NO: 202167 - RNA, 22 nt, Human
uuacaaggaggauagcauuucc

SEQ ID NO: 202168 - RNA, 22 nt, Human
gagaggcugauccugcagagaa

SEQ ID NO: 202169 - RNA, 22 nt, Human
auuuuuucuguaaacuggccuu

SEQ ID NO: 202170 - RNA, 22 nt, Human
acaggugggcuuaagagucggc

SEQ ID NO: 202171 - RNA, 22 nt, Human
uccugucuuaaugaucucgugc

SEQ ID NO: 202172 - RNA, 22 nt, Human
cuggccccaggcagccugcugg

SEQ ID NO: 202173 - RNA, 22 nt, Human
gcagugcuuuagucuguccuuu

SEQ ID NO: 202174 - RNA, 22 nt, Human
uugacaauguccuuugaauuuc

SEQ ID NO: 202175 - RNA, 22 nt, Human
caagagcacgugcccuccauaa

SEQ ID NO: 202176 - RNA, 22 nt, Human
ucagagcucaugagcagagcca

SEQ ID NO: 202177 - RNA, 22 nt, Human
uuagccauugucagcacauggc

SEQ ID NO: 202178 - RNA, 22 nt, Human
ucuuuagugacaguugugcaag

SEQ ID NO: 202179 - RNA, 22 nt, Human
uggcugagugauauuugcaaag

SEQ ID NO: 202180 - RNA, 22 nt, Human
uuguuuuggagaugagcuaaaa

SEQ ID NO: 202181 - RNA, 22 nt, Human
aaagccagaguguguuagagac

SEQ ID NO: 202182 - RNA, 22 nt, Human
agaggccucuguuguucagacg

SEQ ID NO: 202183 - RNA, 22 nt, Human
aauauccacuucaauacaggca

SEQ ID NO: 202184 - RNA, 22 nt, Human
uugagggauuuacagagguggg

SEQ ID NO: 202185 - RNA, 23 nt, Human
aggagacagggaagugccuggcu

SEQ ID NO: 202186 - RNA, 22 nt, Human
aguggcuguaucagucaacccu

SEQ ID NO: 202187 - RNA, 17 nt, Human
aaggccauuuccaccca

SEQ ID NO: 202188 - RNA, 21 nt, Human
ugauacaggaaugguucuaug

SEQ ID NO: 202189 - RNA, 22 nt, Human
uuuguuuacaaaaauaagcagu

SEQ ID NO: 202190 - RNA, 22 nt, Human
ggcucagggaaugaggaagaau

SEQ ID NO: 202191 - RNA, 22 nt, Human
agccaggucagcucacccugcu

SEQ ID NO: 202192 - RNA, 22 nt, Human
ucuuagcacagcuauauaaguu

SEQ ID NO: 202193 - RNA, 22 nt, Human
ccuggcucugggaucuucgcuu

SEQ ID NO: 202194 - RNA, 22 nt, Human
acuuguuucaacuguacucuca

SEQ ID NO: 202195 - RNA, 22 nt, Human
ggccucuggucaagacaagcau

SEQ ID NO: 202196 - RNA, 22 nt, Human
ccccucauucucugagcuaguu

SEQ ID NO: 202197 - RNA, 22 nt, Human
gaggacaggagacucacuguuu

SEQ ID NO: 202198 - RNA, 22 nt, Human
ggaguagcugcauuccgagcac

SEQ ID NO: 202199 - RNA, 22 nt, Human
cagcuucugucugauuagcaag

SEQ ID NO: 202200 - RNA, 22 nt, Human
caaaaggccaguacuuuguuug

SEQ ID NO: 202201 - RNA, 22 nt, Human
gcccucuguguaacaauccaga

SEQ ID NO: 202202 - RNA, 22 nt, Human
gagagcuggccagcuucaguau

SEQ ID NO: 202203 - RNA, 22 nt, Human
accauauaacaaguuuaggaga

SEQ ID NO: 202204 - RNA, 22 nt, Human
cauucuuacacaauauuuuaau

SEQ ID NO: 202205 - RNA, 22 nt, Human
gaagcaaagagcuagugccgcu

SEQ ID NO: 202206 - RNA, 22 nt, Human
gagauccacuuaauuuuuuugc

SEQ ID NO: 202207 - RNA, 22 nt, Human
auuuauugagccuuuccuaugu

SEQ ID NO: 202208 - RNA, 20 nt, Human
cccuccagcaaccaggacuu

SEQ ID NO: 202209 - RNA, 22 nt, Human
aagccaauggauugguugcuuu

SEQ ID NO: 202210 - RNA, 22 nt, Human
caggcugggaacgccacccgcu

SEQ ID NO: 202211 - RNA, 22 nt, Human
aaugggaagccagaagacaagg

SEQ ID NO: 202212 - RNA, 22 nt, Human
aaagugacaaccauuuauuaag

SEQ ID NO: 202213 - RNA, 22 nt, Human
ugguccuguguucuuccugccu

SEQ ID NO: 202214 - RNA, 22 nt, Human
augaagcagcguuguagaguga

SEQ ID NO: 202215 - RNA, 22 nt, Human
gacuuuauucguuaacuguuaa

SEQ ID NO: 202216 - RNA, 22 nt, Human
cacaccuguaauaccagcuacu

SEQ ID NO: 202217 - RNA, 22 nt, Human
ccccagccuuccaugggaauug

SEQ ID NO: 202218 - RNA, 22 nt, Human
gugggugugagugacggcgucc

SEQ ID NO: 202219 - RNA, 22 nt, Human
uccaggccuuugcacauguugu

SEQ ID NO: 202220 - RNA, 22 nt, Human
ugagucucugcacuaaggagag

SEQ ID NO: 202221 - RNA, 22 nt, Human
aaacuuugguauguagcaaaac

SEQ ID NO: 202222 - RNA, 22 nt, Human
aaaaacugguaacuauucccca

SEQ ID NO: 202223 - RNA, 22 nt, Human
acauuugucuucuuucagauua

SEQ ID NO: 202224 - RNA, 22 nt, Human
aaggaaagacaggacggaauuc

SEQ ID NO: 202225 - RNA, 22 nt, Human
caggcagaaggaaguaccaggc

SEQ ID NO: 202226 - RNA, 22 nt, Human
aaauacuauugaccaggucucu

SEQ ID NO: 202227 - RNA, 20 nt, Human
aacuuucucccauuggacug

SEQ ID NO: 202228 - RNA, 22 nt, Human
caggcugagcucuggccugggc

SEQ ID NO: 202229 - RNA, 22 nt, Human
ucuaacuugaacucaugacugu

SEQ ID NO: 202230 - RNA, 22 nt, Human
cuauuagguaugugguugcuau

SEQ ID NO: 202231 - RNA, 22 nt, Human
aagcauguguauaagcugggca

SEQ ID NO: 202232 - RNA, 22 nt, Human
agacacuguucucacaugcuug

SEQ ID NO: 202233 - RNA, 22 nt, Human
cagggucuuauaaggccaauuu

SEQ ID NO: 202234 - RNA, 22 nt, Human
uccauacauaaaauguuuaaug

SEQ ID NO: 202235 - RNA, 22 nt, Human
ugucuuuaagcaaacaguguuu

SEQ ID NO: 202236 - RNA, 22 nt, Human
auuugcauuuacauagcauaga

SEQ ID NO: 202237 - RNA, 22 nt, Human
gagggcugcugccagauaugcc

SEQ ID NO: 202238 - RNA, 22 nt, Human
ucugaggaaucuugacacauuu

SEQ ID NO: 202239 - RNA, 22 nt, Human
cuaggaaagacacagagaguuu

SEQ ID NO: 202240 - RNA, 22 nt, Human
cugcagugaggauucuuaggug

SEQ ID NO: 202241 - RNA, 22 nt, Human
caugugugucuccaccagcugc

SEQ ID NO: 202242 - RNA, 22 nt, Human
uuccuggcaugaaaaauaucac

SEQ ID NO: 202243 - RNA, 22 nt, Human
uuuaaguuccuuuucaacaacu

SEQ ID NO: 202244 - RNA, 23 nt, Human
agcaggcugcuucuccacagcug

SEQ ID NO: 202245 - RNA, 22 nt, Human
cagggccuguacaagucccacc

SEQ ID NO: 202246 - RNA, 22 nt, Human
aucuguuauuuacccaucucug

SEQ ID NO: 202247 - RNA, 22 nt, Human
aggcuggcugagcugcagccug

SEQ ID NO: 202248 - RNA, 22 nt, Human
uaucuguuuauuguuacuguca

SEQ ID NO: 202249 - RNA, 21 nt, Human
uggaaaaauguggccuaguga

SEQ ID NO: 202250 - RNA, 22 nt, Human
ccuggcugguggcagcgacaag

SEQ ID NO: 202251 - RNA, 22 nt, Human
uggcagugguaccggcucucag

SEQ ID NO: 202252 - RNA, 22 nt, Human
acaguuuagaaugccacauagu

SEQ ID NO: 202253 - RNA, 22 nt, Human
acuacaguacuauaucuauagg

SEQ ID NO: 202254 - RNA, 22 nt, Human
ggaacaggaaaggagggaugcu

SEQ ID NO: 202255 - RNA, 22 nt, Human
uaaucuagaacauaugagagca

SEQ ID NO: 202256 - RNA, 22 nt, Human
aggaagagcauucacaugguag

SEQ ID NO: 202257 - RNA, 22 nt, Human
aacugcaaguggggcuugucau

SEQ ID NO: 202258 - RNA, 22 nt, Human
ugcauuaaaaugauggagaaau

SEQ ID NO: 202259 - RNA, 22 nt, Human
gaugugucuggcuccccugcaa

SEQ ID NO: 202260 - RNA, 22 nt, Human
uuacaacauaugauaggagucu

SEQ ID NO: 202261 - RNA, 22 nt, Human
ccagcagacacacaggcguggg

SEQ ID NO: 202262 - RNA, 22 nt, Human
ugcauuuauggagcaaggcagu

SEQ ID NO: 202263 - RNA, 21 nt, Human
gccugcccucugugauggcca

SEQ ID NO: 202264 - RNA, 22 nt, Human
uucuacuucugacacuguuugu

SEQ ID NO: 202265 - RNA, 22 nt, Human
ucaaugcaaucauuggacaagu

SEQ ID NO: 202266 - RNA, 22 nt, Human
aagauagaugucaucagcauau

SEQ ID NO: 202267 - RNA, 22 nt, Human
uggccugguuguugcugccguu

SEQ ID NO: 202268 - RNA, 22 nt, Human
uugaucagguugcuguggugua

SEQ ID NO: 202269 - RNA, 22 nt, Human
cgcugugccuggcacccagugu

SEQ ID NO: 202270 - RNA, 22 nt, Human
gaucaaaagcuggguucuaaaa

SEQ ID NO: 202271 - RNA, 22 nt, Human
ccucaaauuggcauuaauuaag

SEQ ID NO: 202272 - RNA, 22 nt, Human
ucucuggggguagaacucaggc

SEQ ID NO: 202273 - RNA, 22 nt, Human
cagcucaggcucuccaugcucc

SEQ ID NO: 202274 - RNA, 22 nt, Human
ucacuuagauggggaucaucac

SEQ ID NO: 202275 - RNA, 22 nt, Human
ggagggagggcuagaccaaaga

SEQ ID NO: 202276 - RNA, 22 nt, Human
aggcaggagcaagcccuacaag

SEQ ID NO: 202277 - RNA, 22 nt, Human
ucagcuuuugucagaaauugua

SEQ ID NO: 202278 - RNA, 19 nt, Human
ccaggaaccccuagcuacc

SEQ ID NO: 202279 - RNA, 22 nt, Human
gagccaggagauaccuaagggg

SEQ ID NO: 202280 - RNA, 22 nt, Human
uccccccagccuuucacaugag

SEQ ID NO: 202281 - RNA, 22 nt, Human
agggaggucuuugaggggcuua

SEQ ID NO: 202282 - RNA, 22 nt, Human
gucugaaaauaugauuuugccu

SEQ ID NO: 202283 - RNA, 22 nt, Human
uccuggcagaaauggggcugug

SEQ ID NO: 202284 - RNA, 22 nt, Human
ggugaggaauuggggacugacc

SEQ ID NO: 202285 - RNA, 23 nt, Human
acuauaaaguuguucugauuuac

SEQ ID NO: 202286 - RNA, 22 nt, Human
uguauucaacuucuuaaaaauu

SEQ ID NO: 202287 - RNA, 22 nt, Human
uccgggcaacugaagggagguu

SEQ ID NO: 202288 - RNA, 22 nt, Human
uguuugcuaggguugguauuua

SEQ ID NO: 202289 - RNA, 21 nt, Human
ucuuguauuggaucugugugu

SEQ ID NO: 202290 - RNA, 22 nt, Human
uuuagagaaguuaggaaauaaa

SEQ ID NO: 202291 - RNA, 22 nt, Human
accugggagagaggagccggcg

SEQ ID NO: 202292 - RNA, 22 nt, Human
ucucugguuaugucauuaagca

SEQ ID NO: 202293 - RNA, 22 nt, Human
cgcagguguucaguaaauguau

SEQ ID NO: 202294 - RNA, 22 nt, Human
uaauaacaauuguaggacauga

SEQ ID NO: 202295 - RNA, 22 nt, Human
caggcucagaugcccugcgcug

SEQ ID NO: 202296 - RNA, 22 nt, Human
agaggccucuagggccccucag

SEQ ID NO: 202297 - RNA, 22 nt, Human
ccugccagggccagaggccagc

SEQ ID NO: 202298 - RNA, 23 nt, Human
ggccuguguuuugucugaaguac

SEQ ID NO: 202299 - RNA, 22 nt, Human
aaggugguugcaauuaccauaa

SEQ ID NO: 202300 - RNA, 22 nt, Human
uugugaauagugcugcaauaaa

SEQ ID NO: 202301 - RNA, 22 nt, Human
cuccaggcgcuuaccaagcgcu

SEQ ID NO: 202302 - RNA, 22 nt, Human
uaaaaguaggaaugaaacgcau

SEQ ID NO: 202303 - RNA, 22 nt, Human
gccugcagauauauaggauggu

SEQ ID NO: 202304 - RNA, 22 nt, Human
ucugaaauuccuuccagacuuu

SEQ ID NO: 202305 - RNA, 22 nt, Human
aggguccugggugcaguugcuu

SEQ ID NO: 202306 - RNA, 22 nt, Human
agggccugugcuuccugagaua

SEQ ID NO: 202307 - RNA, 21 nt, Human
aggugcagagccagggaccag

SEQ ID NO: 202308 - RNA, 22 nt, Human
caggccucaugguguguccuuc

SEQ ID NO: 202309 - RNA, 22 nt, Human
uauucagaaaauaaauuggauu

SEQ ID NO: 202310 - RNA, 22 nt, Human
cauggcagagccugcagguggg

SEQ ID NO: 202311 - RNA, 22 nt, Human
acuagaaauguauugguagcug

SEQ ID NO: 202312 - RNA, 22 nt, Human
aggaagcuuggggcagggcuac

SEQ ID NO: 202313 - RNA, 20 nt, Human
ucaggcuccgcauuaacuua

SEQ ID NO: 202314 - RNA, 22 nt, Human
aucccuggacggcgccucccca

SEQ ID NO: 202315 - RNA, 22 nt, Human
cccacacaaaucauggggagaa

SEQ ID NO: 202316 - RNA, 21 nt, Human
agcugggugggcugagugaca

SEQ ID NO: 202317 - RNA, 22 nt, Human
gggaggugauggcaagcagcgg

SEQ ID NO: 202318 - RNA, 22 nt, Human
gagcccugcccacuugucugag

SEQ ID NO: 202319 - RNA, 19 nt, Human
ugagcuggcugagccucuc

SEQ ID NO: 202320 - RNA, 22 nt, Human
uuggaauagauuuguuagaaaa

SEQ ID NO: 202321 - RNA, 22 nt, Human
ucacagagagguuaagcaguug

SEQ ID NO: 202322 - RNA, 14 nt, Human
gcagguggaucacc

SEQ ID NO: 202323 - RNA, 14 nt, Human
gcaggcggaucacu

SEQ ID NO: 202324 - RNA, 22 nt, Human
acuucucuucauagguggcaau

SEQ ID NO: 202325 - RNA, 22 nt, Human
uggcagcaguagccaccccagc

SEQ ID NO: 202326 - RNA, 22 nt, Human
guauauaugugugaacauguau

SEQ ID NO: 202327 - RNA, 22 nt, Human
ggccucuggcaggcaggcccuc

SEQ ID NO: 202328 - RNA, 22 nt, Human
cagagggcucggcggccgcucc

SEQ ID NO: 202329 - RNA, 22 nt, Human
cacaaugauuugguucaaaaau

SEQ ID NO: 202330 - RNA, 18 nt, Human
gacaccagccucugcccc

SEQ ID NO: 202331 - RNA, 22 nt, Human
uuggaauuugagaccaagaaaa

SEQ ID NO: 202332 - RNA, 22 nt, Human
uucagaaaucgaguuucauguc

SEQ ID NO: 202333 - RNA, 22 nt, Human
uuuagcauauuuaaggaaugau

SEQ ID NO: 202334 - RNA, 22 nt, Human
cuccugagcucugaggaagcuu

SEQ ID NO: 202335 - RNA, 20 nt, Human
aauuauauaacuccaacauu

SEQ ID NO: 202336 - RNA, 22 nt, Human
gcagggaccuaugacgauggaa

SEQ ID NO: 202337 - RNA, 22 nt, Human
ucucccccagucucuacagcag

SEQ ID NO: 202338 - RNA, 23 nt, Human
uggcauuuuaguuagcuucagug

SEQ ID NO: 202339 - RNA, 22 nt, Human
ugucaucuggccugauuggugu

SEQ ID NO: 202340 - RNA, 22 nt, Human
auuucaaggcuauuaauauaaa

SEQ ID NO: 202341 - RNA, 22 nt, Human
gagccagaaaagcugccugacu

SEQ ID NO: 202342 - RNA, 22 nt, Human
uauuucacauaccacagagugu

SEQ ID NO: 202343 - RNA, 21 nt, Human
cuuugcaucuauauguucuca

SEQ ID NO: 202344 - RNA, 22 nt, Human
uaaugucuccaggguugaccua

SEQ ID NO: 202345 - RNA, 22 nt, Human
gccagcugcuggaacagcgcga

SEQ ID NO: 202346 - RNA, 23 nt, Human
cagggcccugcucaauuucucca

SEQ ID NO: 202347 - RNA, 22 nt, Human
cuucugagcagaccuccugggg

SEQ ID NO: 202348 - RNA, 22 nt, Human
caucuaaauuugacuccaagga

SEQ ID NO: 202349 - RNA, 22 nt, Human
auauugaucuuggaacugauuu

SEQ ID NO: 202350 - RNA, 22 nt, Human
ggcaggcucuuggccuuaugag

SEQ ID NO: 202351 - RNA, 22 nt, Human
caggaagggggauccuuggaag

SEQ ID NO: 202352 - RNA, 22 nt, Human
cuguuuucuagggcugagguga

SEQ ID NO: 202353 - RNA, 22 nt, Human
uggcugaguguuccaaggagca

SEQ ID NO: 202354 - RNA, 19 nt, Human
aauauuuuagccucuuccu

SEQ ID NO: 202355 - RNA, 22 nt, Human
gggagcuggaugauugaggcaa

SEQ ID NO: 202356 - RNA, 19 nt, Human
ccuuucagaacagaagcca

SEQ ID NO: 202357 - RNA, 19 nt, Human
agaaggcuccuguuggaga

SEQ ID NO: 202358 - RNA, 22 nt, Human
caggaaggcccaccuguccugu

SEQ ID NO: 202359 - RNA, 22 nt, Human
cuguguccugucuccuaaggug

SEQ ID NO: 202360 - RNA, 22 nt, Human
caugcauauuacuagcacagca

SEQ ID NO: 202361 - RNA, 22 nt, Human
ccugcaccaggcccagcauggu

SEQ ID NO: 202362 - RNA, 22 nt, Human
cugaaugaggaaaagagugagg

SEQ ID NO: 202363 - RNA, 22 nt, Human
aaaggcaugcauggucugcucc

SEQ ID NO: 202364 - RNA, 22 nt, Human
uuaaggaaagccaaaaugaauu

SEQ ID NO: 202365 - RNA, 22 nt, Human
gcaggaagccuuaccaagccca

SEQ ID NO: 202366 - RNA, 22 nt, Human
uggcagaggagaauuaagauua

SEQ ID NO: 202367 - RNA, 22 nt, Human
uauguacauacaugugcauacg

SEQ ID NO: 202368 - RNA, 22 nt, Human
gacacugugcuagcugggcuua

SEQ ID NO: 202369 - RNA, 22 nt, Human
uugcucauauuugcauguguuu

SEQ ID NO: 202370 - RNA, 22 nt, Human
gaauagcuuccuuuuuuccaaa

SEQ ID NO: 202371 - RNA, 22 nt, Human
aaggcugagggcuguaccuggc

SEQ ID NO: 202372 - RNA, 22 nt, Human
gugagguagcagagacagugaa

SEQ ID NO: 202373 - RNA, 22 nt, Human
augcaauaaauacuuuccagcu

SEQ ID NO: 202374 - RNA, 22 nt, Human
uuggaaggcccugccuagcagg

SEQ ID NO: 202375 - RNA, 22 nt, Human
acuuccaggaggugucacugaa

SEQ ID NO: 202376 - RNA, 22 nt, Human
gccuguccuugugaggucccag

SEQ ID NO: 202377 - RNA, 22 nt, Human
ccaaggcuucccagagaugcuc

SEQ ID NO: 202378 - RNA, 22 nt, Human
gcuggaggaggaagugugaggg

SEQ ID NO: 202379 - RNA, 22 nt, Human
ugaauuagcaguagacagacug

SEQ ID NO: 202380 - RNA, 22 nt, Human
acacaguggugagucuggaccu

SEQ ID NO: 202381 - RNA, 22 nt, Human
ccacccuaacaauccuuacugu

SEQ ID NO: 202382 - RNA, 22 nt, Human
acugugccuuucacuugcacuu

SEQ ID NO: 202383 - RNA, 22 nt, Human
acacuucucauuugauacuaac

SEQ ID NO: 202384 - RNA, 22 nt, Human
auaaggcaucucucaguuagca

SEQ ID NO: 202385 - RNA, 17 nt, Human
aggcagguaagaguuau

SEQ ID NO: 202386 - RNA, 22 nt, Human
acacagcuaugggguaggaaac

SEQ ID NO: 202387 - RNA, 22 nt, Human
ugagauccccaggaaggacaac

SEQ ID NO: 202388 - RNA, 19 nt, Human
uccagcuguuuugagucac

SEQ ID NO: 202389 - RNA, 22 nt, Human
augaggagucaaggagucggag

SEQ ID NO: 202390 - RNA, 22 nt, Human
uccaggaguuugaccugugggc

SEQ ID NO: 202391 - RNA, 18 nt, Human
ugcccagaaaagcaggga

SEQ ID NO: 202392 - RNA, 22 nt, Human
ggagucuuggccugcugagaaa

SEQ ID NO: 202393 - RNA, 22 nt, Human
ucaggcuugaggucuguaugug

SEQ ID NO: 202394 - RNA, 22 nt, Human
uagacaggguggcuuagaaaca

SEQ ID NO: 202395 - RNA, 21 nt, Human
uucagcaguccucuagagaua

SEQ ID NO: 202396 - RNA, 22 nt, Human
auuuacauaauagacuuuaggu

SEQ ID NO: 202397 - RNA, 22 nt, Human
ccaggugugcucugcaguggau

SEQ ID NO: 202398 - RNA, 22 nt, Human
acaaaauuuuuagacaaggcuu

SEQ ID NO: 202399 - RNA, 22 nt, Human
aguucucaagacaauuaccugu

SEQ ID NO: 202400 - RNA, 22 nt, Human
agaaaucuuaucaagaaaugcc

SEQ ID NO: 202401 - RNA, 22 nt, Human
acaugacaagguuuauaaggcu

SEQ ID NO: 202402 - RNA, 22 nt, Human
ggggaguguuuucaugggcuug

SEQ ID NO: 202403 - RNA, 22 nt, Human
aggcagcugcccucuccuuccu

SEQ ID NO: 202404 - RNA, 22 nt, Human
aguggcugcugacuuuaauaca

SEQ ID NO: 202405 - RNA, 22 nt, Human
caauaagccagguguuuguguu

SEQ ID NO: 202406 - RNA, 22 nt, Human
gcaauaaacauguuugaugcgc

SEQ ID NO: 202407 - RNA, 22 nt, Human
ccagcauucacacugguuccuu

SEQ ID NO: 202408 - RNA, 22 nt, Human
aguggcaggcagaagcuucuca

SEQ ID NO: 202409 - RNA, 22 nt, Human
ugaggcagcauucuucaagaca

SEQ ID NO: 202410 - RNA, 22 nt, Human
gcugggagccguaccugucacg

SEQ ID NO: 202411 - RNA, 22 nt, Human
uauacacauccuccaaagauag

SEQ ID NO: 202412 - RNA, 22 nt, Human
ucucaggaaauaggauuugagu

SEQ ID NO: 202413 - RNA, 23 nt, Human
cacacccaucacuaagagcuccu

SEQ ID NO: 202414 - RNA, 22 nt, Human
agcuucuggaaggcaaggcuug

SEQ ID NO: 202415 - RNA, 22 nt, Human
uugaaauuuuaggccuugcaau

SEQ ID NO: 202416 - RNA, 22 nt, Human
gccagcuggagugagagugggc

SEQ ID NO: 202417 - RNA, 22 nt, Human
ucucagagggaaacaugaguga

SEQ ID NO: 202418 - RNA, 22 nt, Human
agcaccaggucgcuggcacgcu

SEQ ID NO: 202419 - RNA, 18 nt, Human
gcagccccucuuccuucc

SEQ ID NO: 202420 - RNA, 22 nt, Human
gggcuucucuuuagugagcuga

SEQ ID NO: 202421 - RNA, 22 nt, Human
cuuccuggaugaacaguagaaa

SEQ ID NO: 202422 - RNA, 22 nt, Human
aaggaggcagaacucacaugga

SEQ ID NO: 202423 - RNA, 22 nt, Human
ucucugggagcaauuguuugcu

SEQ ID NO: 202424 - RNA, 21 nt, Human
ugccuggccuuugcuuuuccu

SEQ ID NO: 202425 - RNA, 22 nt, Human
aggcccagcuugaagugggaag

SEQ ID NO: 202426 - RNA, 22 nt, Human
gcagcagugucucccaucuugc

SEQ ID NO: 202427 - RNA, 22 nt, Human
aaaacauugaauugcacacuau

SEQ ID NO: 202428 - RNA, 22 nt, Human
cccugaggcacaggccacguau

SEQ ID NO: 202429 - RNA, 22 nt, Human
guagucuuggauuuuaaaaagu

SEQ ID NO: 202430 - RNA, 22 nt, Human
cagcaggcccaggugcugguga

SEQ ID NO: 202431 - RNA, 22 nt, Human
aauuuggcagugucuugaagua

SEQ ID NO: 202432 - RNA, 22 nt, Human
ucuccacaaguguugagaguac

SEQ ID NO: 202433 - RNA, 22 nt, Human
auggccugaugcaccuguccca

SEQ ID NO: 202434 - RNA, 22 nt, Human
cuauuagaaagcaucuucuaua

SEQ ID NO: 202435 - RNA, 22 nt, Human
uuugagaaaugggcucugugcu

SEQ ID NO: 202436 - RNA, 22 nt, Human
uaauuucuggagggagaaagag

SEQ ID NO: 202437 - RNA, 22 nt, Human
agagugauucuaguuagggaau

SEQ ID NO: 202438 - RNA, 22 nt, Human
cucccaggacuggcucuaacug

SEQ ID NO: 202439 - RNA, 22 nt, Human
ggauucagugucuguuaauagu

SEQ ID NO: 202440 - RNA, 22 nt, Human
gcccacagaggcaccaccaggc

SEQ ID NO: 202441 - RNA, 22 nt, Human
ugagguaggugucgagagaggu

SEQ ID NO: 202442 - RNA, 23 nt, Human
acucguggaauucucugcgaucg

SEQ ID NO: 202443 - RNA, 20 nt, Human
cugagcugagcuccaugggu

SEQ ID NO: 202444 - RNA, 22 nt, Human
agacaacaccaaaugcuagugu

SEQ ID NO: 202445 - RNA, 22 nt, Human
uaguuacacauggguagggaau

SEQ ID NO: 202446 - RNA, 22 nt, Human
gcugggagucgcgucuguggcc

SEQ ID NO: 202447 - RNA, 22 nt, Human
ugccuugcuuaacaagauggca

SEQ ID NO: 202448 - RNA, 22 nt, Human
agcccggcuuccccgguugcua

SEQ ID NO: 202449 - RNA, 22 nt, Human
acauugauugagcacccauuau

SEQ ID NO: 202450 - RNA, 22 nt, Human
gaggccacaguccugaggcauc

SEQ ID NO: 202451 - RNA, 22 nt, Human
cuaggcuagauaguauauuggu

SEQ ID NO: 202452 - RNA, 22 nt, Human
gucuccaguuacagcagccagg

SEQ ID NO: 202453 - RNA, 22 nt, Human
gcauucuuugaaugcuucuaau

SEQ ID NO: 202454 - RNA, 22 nt, Human
caggcccugcacuaggcccugg

SEQ ID NO: 202455 - RNA, 23 nt, Human
gaggagggucugacaaguguagc

SEQ ID NO: 202456 - RNA, 22 nt, Human
ucagucuucaaaucugagucgu

SEQ ID NO: 202457 - RNA, 22 nt, Human
uauuugcaaagaacuacacuag

SEQ ID NO: 202458 - RNA, 22 nt, Human
gcucucuggaggccauggacag

SEQ ID NO: 202459 - RNA, 22 nt, Human
aaucuucacagagaaaauuagg

SEQ ID NO: 202460 - RNA, 22 nt, Human
ccuggcaacauuucaaggucuu

SEQ ID NO: 202461 - RNA, 22 nt, Human
cuucuuuucauggcuugggaag

SEQ ID NO: 202462 - RNA, 22 nt, Human
ugcagcaguguuccuuggcuug

SEQ ID NO: 202463 - RNA, 22 nt, Human
agauaucuccagugaugcucgu

SEQ ID NO: 202464 - RNA, 22 nt, Human
uuauagaaggagcauucacuua

SEQ ID NO: 202465 - RNA, 22 nt, Human
ucugaggaccuacugaagaguu

SEQ ID NO: 202466 - RNA, 22 nt, Human
uuacagugaagauucagguucc

SEQ ID NO: 202467 - RNA, 22 nt, Human
aagguauuggcagggcugaguu

SEQ ID NO: 202468 - RNA, 18 nt, Human
ggucaggggcggagagaa

SEQ ID NO: 202469 - RNA, 22 nt, Human
cucccaggggaacuaucaagua

SEQ ID NO: 202470 - RNA, 22 nt, Human
aggacacagcucuucaguaaga

SEQ ID NO: 202471 - RNA, 22 nt, Human
cugaggcucaagggcagguggg

SEQ ID NO: 202472 - RNA, 22 nt, Human
ggacaggcaggugauuuccaga

SEQ ID NO: 202473 - RNA, 22 nt, Human
uggcagggugccaguugcgagu

SEQ ID NO: 202474 - RNA, 20 nt, Human
cagcaggaaaagugccucag

SEQ ID NO: 202475 - RNA, 22 nt, Human
ugguuaaaugggaagagcaaca

SEQ ID NO: 202476 - RNA, 22 nt, Human
cugcucuggggaagccagaugu

SEQ ID NO: 202477 - RNA, 22 nt, Human
gagagccuuugaagggaaguga

SEQ ID NO: 202478 - RNA, 20 nt, Human
uggcacagaacccuugccua

SEQ ID NO: 202479 - RNA, 22 nt, Human
aagagggagggcaaaggcacug

SEQ ID NO: 202480 - RNA, 22 nt, Human
ccuggcuguggcggugcucuca

SEQ ID NO: 202481 - RNA, 22 nt, Human
uuagcaggaagaguuggcugga

SEQ ID NO: 202482 - RNA, 22 nt, Human
agugccagcuccacacagcagc

SEQ ID NO: 202483 - RNA, 22 nt, Human
agcuucuccugguacagaacug

SEQ ID NO: 202484 - RNA, 20 nt, Human
cuuuggcaaugagaacaggg

SEQ ID NO: 202485 - RNA, 22 nt, Human
ugcaaacagaaaguuuauugug

SEQ ID NO: 202486 - RNA, 22 nt, Human
auacaugucaucauauguuugu

SEQ ID NO: 202487 - RNA, 22 nt, Human
agaauacuaggcuucagaaagg

SEQ ID NO: 202488 - RNA, 19 nt, Human
auggaaaauuguacucaau

SEQ ID NO: 202489 - RNA, 22 nt, Human
cauuccuauuaugucccuagug

SEQ ID NO: 202490 - RNA, 22 nt, Human
ccugcagagggacuggcaggaa

SEQ ID NO: 202491 - RNA, 22 nt, Human
aguccagugucaaggugccauu

SEQ ID NO: 202492 - RNA, 22 nt, Human
ugcaggugucuccagggcaggu

SEQ ID NO: 202493 - RNA, 22 nt, Human
ccaggacuucgaggcuacagug

SEQ ID NO: 202494 - RNA, 18 nt, Human
uccugccugugccccagg

SEQ ID NO: 202495 - RNA, 22 nt, Human
uaacuggugaguaggauuuaua

SEQ ID NO: 202496 - RNA, 22 nt, Human
agagccacaguggauaggagcc

SEQ ID NO: 202497 - RNA, 22 nt, Human
aaaagaggagugguuuaugaca

SEQ ID NO: 202498 - RNA, 22 nt, Human
uaccugcaaaguuccuuuugcc

SEQ ID NO: 202499 - RNA, 22 nt, Human
caggacacagaauaaggcaguu

SEQ ID NO: 202500 - RNA, 22 nt, Human
gacagcauggugucuguucagg

SEQ ID NO: 202501 - RNA, 22 nt, Human
aaacagcuggucucaaauguuc

SEQ ID NO: 202502 - RNA, 22 nt, Human
cucuuagagaguuguugaucag

SEQ ID NO: 202503 - RNA, 22 nt, Human
uuuuacaccucagaugagcaga

SEQ ID NO: 202504 - RNA, 22 nt, Human
uagaaccaccuucuccuuuacc

SEQ ID NO: 202505 - RNA, 22 nt, Human
ccagggagcggggcugggucuc

SEQ ID NO: 202506 - RNA, 22 nt, Human
caaauacuuacugaaccugugc

SEQ ID NO: 202507 - RNA, 22 nt, Human
agggcagaccacgugcaaggau

SEQ ID NO: 202508 - RNA, 22 nt, Human
gccucuccgagccacugccucu

SEQ ID NO: 202509 - RNA, 22 nt, Human
caaauagacuucaaucucuuga

SEQ ID NO: 202510 - RNA, 22 nt, Human
uuaaacacacugagauuuaugu

SEQ ID NO: 202511 - RNA, 22 nt, Human
cucuuuggauguuuaugauaag

SEQ ID NO: 202512 - RNA, 22 nt, Human
ucuucuuuuugucccacagaau

SEQ ID NO: 202513 - RNA, 22 nt, Human
ugcagugugagguccacaucug

SEQ ID NO: 202514 - RNA, 22 nt, Human
gcacagagagucccgggugccc

SEQ ID NO: 202515 - RNA, 22 nt, Human
auuggucugugagcuguugaca

SEQ ID NO: 202516 - RNA, 22 nt, Human
gcccuggccuccuggaacaggc

SEQ ID NO: 202517 - RNA, 22 nt, Human
ggcaggagaaaggucucuucuu

SEQ ID NO: 202518 - RNA, 22 nt, Human
ccuggagggcagcccauucugg

SEQ ID NO: 202519 - RNA, 20 nt, Human
cugagccaacucucuucuug

SEQ ID NO: 202520 - RNA, 22 nt, Human
uccugggaguaauugagucaug

SEQ ID NO: 202521 - RNA, 22 nt, Human
uggagcagaggaagaaggcuuu

SEQ ID NO: 202522 - RNA, 22 nt, Human
agggagcuuucagguagcuuaa

SEQ ID NO: 202523 - RNA, 22 nt, Human
ugcugaggucaccuugcugcua

SEQ ID NO: 202524 - RNA, 22 nt, Human
ucaggcuggaaugcaguggggc

SEQ ID NO: 202525 - RNA, 22 nt, Human
aauggaauucuccauuagaugu

SEQ ID NO: 202526 - RNA, 22 nt, Human
ucuagaacuucucuaaaaugaa

SEQ ID NO: 202527 - RNA, 22 nt, Human
gagcuggccgcagagagggcag

SEQ ID NO: 202528 - RNA, 22 nt, Human
ugaggggagguuggggcacauc

SEQ ID NO: 202529 - RNA, 22 nt, Human
auguguacacuggacuucugau

SEQ ID NO: 202530 - RNA, 19 nt, Human
gcauuucucuuuacagcca

SEQ ID NO: 202531 - RNA, 22 nt, Human
agaaagcacgggccccaggcuc

SEQ ID NO: 202532 - RNA, 22 nt, Human
uguuaacaaagguuggcugggc

SEQ ID NO: 202533 - RNA, 21 nt, Human
uaaaucucuguauucuucagu

SEQ ID NO: 202534 - RNA, 22 nt, Human
ugucaauaucaggcagaccuaa

SEQ ID NO: 202535 - RNA, 22 nt, Human
agaaaugaaaccaaagccuaga

SEQ ID NO: 202536 - RNA, 22 nt, Human
uaaaagcugagauauccuguac

SEQ ID NO: 202537 - RNA, 22 nt, Human
cagugcagaggugcaagcaugu

SEQ ID NO: 202538 - RNA, 22 nt, Human
aagcucugguuaaaaggccugg

SEQ ID NO: 202539 - RNA, 22 nt, Human
gccagaucugacauaguggaag

SEQ ID NO: 202540 - RNA, 22 nt, Human
uccaugaguuugaggaaaagag

SEQ ID NO: 202541 - RNA, 22 nt, Human
aauuaagaaaauguuuuaugau

SEQ ID NO: 202542 - RNA, 22 nt, Human
ugauuuacaauuguaaaaguuu

SEQ ID NO: 202543 - RNA, 22 nt, Human
accagggcccgggagagcucuc

SEQ ID NO: 202544 - RNA, 22 nt, Human
uaagacaucauuaaacagcaau

SEQ ID NO: 202545 - RNA, 19 nt, Human
ugacaggcuguugccuuga

SEQ ID NO: 202546 - RNA, 22 nt, Human
uuggaauccugccucugcuacu

SEQ ID NO: 202547 - RNA, 22 nt, Human
gcugggccuuccgauucucaag

SEQ ID NO: 202548 - RNA, 22 nt, Human
caaauauuccagguacaucccu

SEQ ID NO: 202549 - RNA, 22 nt, Human
uccugccuguuuaccuguacuu

SEQ ID NO: 202550 - RNA, 22 nt, Human
gucugcucaugcuaccgcgggc

SEQ ID NO: 202551 - RNA, 22 nt, Human
ccaccaggcucuguccgagcgg

SEQ ID NO: 202552 - RNA, 22 nt, Human
aaugucugagucucuguauccc

SEQ ID NO: 202553 - RNA, 22 nt, Human
gguggacaguguuagcucuggg

SEQ ID NO: 202554 - RNA, 21 nt, Human
agcaggugaaccuccaguaca

SEQ ID NO: 202555 - RNA, 22 nt, Human
acuucucuuuaguacuaaaugu

SEQ ID NO: 202556 - RNA, 22 nt, Human
acaguggcaguauuagggcaga

SEQ ID NO: 202557 - RNA, 22 nt, Human
caagcaggccuggcuggaccgu

SEQ ID NO: 202558 - RNA, 22 nt, Human
ccucagagcagcacccagauga

SEQ ID NO: 202559 - RNA, 22 nt, Human
aagccuggcacauuggagucug

SEQ ID NO: 202560 - RNA, 22 nt, Human
ucagaacaauuccuuuauaaca

SEQ ID NO: 202561 - RNA, 22 nt, Human
ucugccagugccagaguacaua

SEQ ID NO: 202562 - RNA, 23 nt, Human
cuggccaccaucuuucuggcuuc

SEQ ID NO: 202563 - RNA, 21 nt, Human
ccuccugcccgcaagcuaggg

SEQ ID NO: 202564 - RNA, 20 nt, Human
gugggcagcaggcauacugg

SEQ ID NO: 202565 - RNA, 22 nt, Human
guggauggcccugcacacaggu

SEQ ID NO: 202566 - RNA, 22 nt, Human
agccagaguugaaugugagucu

SEQ ID NO: 202567 - RNA, 22 nt, Human
ggccagcagaccucagggacuc

SEQ ID NO: 202568 - RNA, 22 nt, Human
ucuccaggcacuuggcugcuac

SEQ ID NO: 202569 - RNA, 21 nt, Human
ggcagcacuaccugaagcaua

SEQ ID NO: 202570 - RNA, 22 nt, Human
ucagugcauucauggguggcug

SEQ ID NO: 202571 - RNA, 22 nt, Human
cugagcccuggcucgccuggag

SEQ ID NO: 202572 - RNA, 22 nt, Human
caguguuugcuuaaguuauaug

SEQ ID NO: 202573 - RNA, 22 nt, Human
cauuugaauuguucugugggaa

SEQ ID NO: 202574 - RNA, 22 nt, Human
uggaauagaggugcugauauua

SEQ ID NO: 202575 - RNA, 22 nt, Human
agcugguaaguggcagagauuc

SEQ ID NO: 202576 - RNA, 22 nt, Human
uauucaugagauaggcaguuuu

SEQ ID NO: 202577 - RNA, 22 nt, Human
cauguaaagaauuucacacaag

SEQ ID NO: 202578 - RNA, 22 nt, Human
gagucaggcuagggugacaggc

SEQ ID NO: 202579 - RNA, 22 nt, Human
aagauauucaaagauuuauuag

SEQ ID NO: 202580 - RNA, 22 nt, Human
ccagcaggagacuagcaacaua

SEQ ID NO: 202581 - RNA, 22 nt, Human
gcugccugucccaggaugagga

SEQ ID NO: 202582 - RNA, 22 nt, Human
aaacugaauucaaguauccagu

SEQ ID NO: 202583 - RNA, 22 nt, Human
uuauuuuuaaaaguucacacag

SEQ ID NO: 202584 - RNA, 22 nt, Human
cuggaggcaaagcagaggcaug

SEQ ID NO: 202585 - RNA, 22 nt, Human
gcuggagugcuggagugcagug

SEQ ID NO: 202586 - RNA, 22 nt, Human
agagagcauggcacagaggggu

SEQ ID NO: 202587 - RNA, 22 nt, Human
ucucauggagucaggagcagaa

SEQ ID NO: 202588 - RNA, 22 nt, Human
uccagggagauggcagaggcug

SEQ ID NO: 202589 - RNA, 22 nt, Human
gcaccaggaggcccuucucauc

SEQ ID NO: 202590 - RNA, 22 nt, Human
gcauuuaaauuugaacuucaga

SEQ ID NO: 202591 - RNA, 22 nt, Human
uauccaaaggaacaaucacagc

SEQ ID NO: 202592 - RNA, 22 nt, Human
cacagggagaggaacagcgcag

SEQ ID NO: 202593 - RNA, 22 nt, Human
ugagccaggaguuugaggcugu

SEQ ID NO: 202594 - RNA, 22 nt, Human
agcccuggauucugagguccaa

SEQ ID NO: 202595 - RNA, 22 nt, Human
cagaccagaaggaagccgacaa

SEQ ID NO: 202596 - RNA, 22 nt, Human
auggacagagcugagcuccacc

SEQ ID NO: 202597 - RNA, 22 nt, Human
caaaugcaaaauauaacccugu

SEQ ID NO: 202598 - RNA, 22 nt, Human
ggcucuggugggaagguuagau

SEQ ID NO: 202599 - RNA, 22 nt, Human
uuccugugguccagagucaucc

SEQ ID NO: 202600 - RNA, 23 nt, Human
uacauucauuugcacagccagua

SEQ ID NO: 202601 - RNA, 22 nt, Human
uaggaggguuagagggaaauau

SEQ ID NO: 202602 - RNA, 22 nt, Human
agaaucauuauauuuauuaagc

SEQ ID NO: 202603 - RNA, 22 nt, Human
uggucucuucuuccaagauggc

SEQ ID NO: 202604 - RNA, 22 nt, Human
gugcagggcagguguccuucca

SEQ ID NO: 202605 - RNA, 22 nt, Human
uuggcuucugauguauuccuga

SEQ ID NO: 202606 - RNA, 22 nt, Human
aggagcugauaaaaggggguca

SEQ ID NO: 202607 - RNA, 19 nt, Human
cucucuggcggugucugcg

SEQ ID NO: 202608 - RNA, 22 nt, Human
gcccuggagcuagacuaggaca

SEQ ID NO: 202609 - RNA, 17 nt, Human
ucugcucugccaaucca

SEQ ID NO: 202610 - RNA, 22 nt, Human
gcugagacuggcagcaggaagu

SEQ ID NO: 202611 - RNA, 22 nt, Human
cugggcccacaaguggaaucgu

SEQ ID NO: 202612 - RNA, 22 nt, Human
gcugccugcccugggucaucug

SEQ ID NO: 202613 - RNA, 22 nt, Human
cucagucucuugggcugugaag

SEQ ID NO: 202614 - RNA, 22 nt, Human
uccuccaagcguggguguuuga

SEQ ID NO: 202615 - RNA, 22 nt, Human
gccucuuguuuccuuacaugga

SEQ ID NO: 202616 - RNA, 22 nt, Human
cuuccccaggaccucugcuaaa

SEQ ID NO: 202617 - RNA, 22 nt, Human
cagugagggcauucagugcugg

SEQ ID NO: 202618 - RNA, 22 nt, Human
auucuuuccagacacugauugc

SEQ ID NO: 202619 - RNA, 22 nt, Human
agaaggcuagagacuugcccaa

SEQ ID NO: 202620 - RNA, 22 nt, Human
ucauugcagaaauaaaggugaa

SEQ ID NO: 202621 - RNA, 22 nt, Human
cacagguuagguauuauacuau

SEQ ID NO: 202622 - RNA, 22 nt, Human
gauaccagacagggagggagaa

SEQ ID NO: 202623 - RNA, 22 nt, Human
ucucaaauauuuggagagagga

SEQ ID NO: 202624 - RNA, 22 nt, Human
uuuucagugggcaaugauguga

SEQ ID NO: 202625 - RNA, 21 nt, Human
gcucagaguauugcacuguuu

SEQ ID NO: 202626 - RNA, 22 nt, Human
cccagagaaucuuucagaaagg

SEQ ID NO: 202627 - RNA, 22 nt, Human
uuuaaaggccuugcugagccac

SEQ ID NO: 202628 - RNA, 22 nt, Human
uccuggacaagcccuucacccu

SEQ ID NO: 202629 - RNA, 22 nt, Human
cugagggucaacuugauuguau

SEQ ID NO: 202630 - RNA, 22 nt, Human
gagucuucuacgcucacacaaa

SEQ ID NO: 202631 - RNA, 22 nt, Human
aauaucucaccaugacaaagca

SEQ ID NO: 202632 - RNA, 22 nt, Human
aaacuguugugguuuaucauua

SEQ ID NO: 202633 - RNA, 22 nt, Human
acuaugaaaguauaauauugaa

SEQ ID NO: 202634 - RNA, 19 nt, Human
caguuacagcagcuaagac

SEQ ID NO: 202635 - RNA, 22 nt, Human
augaaggauagggcaaaauuuu

SEQ ID NO: 202636 - RNA, 22 nt, Human
agggaaaguaagcauuucauua

SEQ ID NO: 202637 - RNA, 22 nt, Human
gagguggccucaagcagucuuc

SEQ ID NO: 202638 - RNA, 23 nt, Human
ucuguucuuuuagcugaucauuu

SEQ ID NO: 202639 - RNA, 16 nt, Human
ggcaccagugaacaca

SEQ ID NO: 202640 - RNA, 22 nt, Human
caggagagauaugaguccccac

SEQ ID NO: 202641 - RNA, 22 nt, Human
cuggcccagagcucuggccuuu

SEQ ID NO: 202642 - RNA, 22 nt, Human
ugggaagaugaggugccauggg

SEQ ID NO: 202643 - RNA, 22 nt, Human
auugcagaacaugaggucuucu

SEQ ID NO: 202644 - RNA, 22 nt, Human
uccuggcacauugcaggggcuc

SEQ ID NO: 202645 - RNA, 22 nt, Human
caugagucauagugaagcagga

SEQ ID NO: 202646 - RNA, 22 nt, Human
aaggcauuaccuaaguuuggga

SEQ ID NO: 202647 - RNA, 22 nt, Human
auguuacaauucaaaaugcugc

SEQ ID NO: 202648 - RNA, 23 nt, Human
uggccaggcauaaaggugggugg

SEQ ID NO: 202649 - RNA, 18 nt, Human
aguaggcacugugggguu

SEQ ID NO: 202650 - RNA, 16 nt, Human
acccuggguaguccug

SEQ ID NO: 202651 - RNA, 22 nt, Human
uuaauaaguaguaguuauuguu

SEQ ID NO: 202652 - RNA, 22 nt, Human
uaacaugaaacuccaaauggua

SEQ ID NO: 202653 - RNA, 22 nt, Human
uauuacaguucgaguuucuagg

SEQ ID NO: 202654 - RNA, 22 nt, Human
cagcgucucguugugggccucg

SEQ ID NO: 202655 - RNA, 22 nt, Human
uguagcaccagucaccagccca

SEQ ID NO: 202656 - RNA, 22 nt, Human
uuucuccacgccagcuugcuua

SEQ ID NO: 202657 - RNA, 22 nt, Human
aagacauuggacaauccagagg

SEQ ID NO: 202658 - RNA, 22 nt, Human
uaggccuaugcagaaggugguu

SEQ ID NO: 202659 - RNA, 20 nt, Human
acucaucuacuccagacccu

SEQ ID NO: 202660 - RNA, 22 nt, Human
uuccucuuucucugugcuaugu

SEQ ID NO: 202661 - RNA, 22 nt, Human
ugucgauucagcucuucagaga

SEQ ID NO: 202662 - RNA, 22 nt, Human
aaugauuggcacuagauacaca

SEQ ID NO: 202663 - RNA, 22 nt, Human
gcaccugggguacacagcuaca

SEQ ID NO: 202664 - RNA, 22 nt, Human
cucuccagaauaugccgccgug

SEQ ID NO: 202665 - RNA, 22 nt, Human
cugcccagaaucacucacucga

SEQ ID NO: 202666 - RNA, 21 nt, Human
acagccaggaacaugaggggc

SEQ ID NO: 202667 - RNA, 22 nt, Human
agguucuugguguccagauuuc

SEQ ID NO: 202668 - RNA, 22 nt, Human
uauuucuuguucccuccaaguu

SEQ ID NO: 202669 - RNA, 22 nt, Human
cggcuggguucggcugcaggcc

SEQ ID NO: 202670 - RNA, 21 nt, Human
cucuugugucagagccagagg

SEQ ID NO: 202671 - RNA, 22 nt, Human
accuccuggcuuaucauggaca

SEQ ID NO: 202672 - RNA, 22 nt, Human
gccacagccucugggaaaacuc

SEQ ID NO: 202673 - RNA, 22 nt, Human
auagggcagucaggccgccacu

SEQ ID NO: 202674 - RNA, 22 nt, Human
aguuauaaucugcuacugauau

SEQ ID NO: 202675 - RNA, 22 nt, Human
acaugcaaagccacaggacccg

SEQ ID NO: 202676 - RNA, 22 nt, Human
uguccaggcuaaagugcagugg

SEQ ID NO: 202677 - RNA, 22 nt, Human
ggcagcagaacuggcccuguau

SEQ ID NO: 202678 - RNA, 22 nt, Human
acacaggacagggauguguuuu

SEQ ID NO: 202679 - RNA, 22 nt, Human
gaaaaccaccucccaucaagca

SEQ ID NO: 202680 - RNA, 22 nt, Human
ugucaaaaccagcaauuuuguu

SEQ ID NO: 202681 - RNA, 22 nt, Human
ccuggcuuccuggagcucacaa

SEQ ID NO: 202682 - RNA, 22 nt, Human
gagguguccucagccaacucug

SEQ ID NO: 202683 - RNA, 22 nt, Human
uccuguuucuccugcaaaaucc

SEQ ID NO: 202684 - RNA, 23 nt, Human
uugcacauuggagcuggucuucu

SEQ ID NO: 202685 - RNA, 22 nt, Human
uggaaugacagagagucugaau

SEQ ID NO: 202686 - RNA, 22 nt, Human
ggagucuuaaaaaucaaaugga

SEQ ID NO: 202687 - RNA, 22 nt, Human
aauuucagaacccaaauuagcg

SEQ ID NO: 202688 - RNA, 22 nt, Human
uugcuuuauuuggcaugccacu

SEQ ID NO: 202689 - RNA, 22 nt, Human
gcuuuagaagacacucuguuuu

SEQ ID NO: 202690 - RNA, 22 nt, Human
uguaaaauaccauuccuuguca

SEQ ID NO: 202691 - RNA, 22 nt, Human
uucaaucauuuuuacauagucc

SEQ ID NO: 202692 - RNA, 19 nt, Human
aauacaguguuauagaauu

SEQ ID NO: 202693 - RNA, 22 nt, Human
uggcaguucuaauugaccauuu

SEQ ID NO: 202694 - RNA, 22 nt, Human
auuacaguaacagcuacaaugc

SEQ ID NO: 202695 - RNA, 22 nt, Human
cccaggguagcugagcuggcag

SEQ ID NO: 202696 - RNA, 22 nt, Human
aacuagaaagaacauauuucca

SEQ ID NO: 202697 - RNA, 22 nt, Human
agauuucaauggauauugcaag

SEQ ID NO: 202698 - RNA, 22 nt, Human
agcuggugaggguugaggggua

SEQ ID NO: 202699 - RNA, 22 nt, Human
gcaccugcuggggcugaugaga

SEQ ID NO: 202700 - RNA, 22 nt, Human
uggcacugaccccaggccugug

SEQ ID NO: 202701 - RNA, 22 nt, Human
ccagacaggggcuguuccugcu

SEQ ID NO: 202702 - RNA, 22 nt, Human
uguaagaagggccagagcucca

SEQ ID NO: 202703 - RNA, 22 nt, Human
cuucauagaacagaaauuuaau

SEQ ID NO: 202704 - RNA, 22 nt, Human
ugggagaauauauuuaaaacuu

SEQ ID NO: 202705 - RNA, 22 nt, Human
aagcaucuucuaucaguuagac

SEQ ID NO: 202706 - RNA, 22 nt, Human
aaaugugcuucuuacucucaau

SEQ ID NO: 202707 - RNA, 22 nt, Human
caggcauaaguaauguuuuaug

SEQ ID NO: 202708 - RNA, 22 nt, Human
gcagucaguaaggcagccagaa

SEQ ID NO: 202709 - RNA, 22 nt, Human
ggcaugcuugccaugggccagu

SEQ ID NO: 202710 - RNA, 22 nt, Human
cagcaucuccauggcuuuggag

SEQ ID NO: 202711 - RNA, 22 nt, Human
ucacagagaacuauaauccauc

SEQ ID NO: 202712 - RNA, 22 nt, Human
aauucuuggaaacauuacugga

SEQ ID NO: 202713 - RNA, 22 nt, Human
ucuggucccuuuuccugcaguc

SEQ ID NO: 202714 - RNA, 22 nt, Human
agcuggguucagaggcacaugg

SEQ ID NO: 202715 - RNA, 22 nt, Human
agcccagcuuucaccccucugg

SEQ ID NO: 202716 - RNA, 22 nt, Human
ugauuucuuccuugucauuaga

SEQ ID NO: 202717 - RNA, 22 nt, Human
auaucuggggacugaauuuaga

SEQ ID NO: 202718 - RNA, 22 nt, Human
ccaaggagaaugacaccaugga

SEQ ID NO: 202719 - RNA, 23 nt, Human
agggaacaagcaagcugcuaguc

SEQ ID NO: 202720 - RNA, 22 nt, Human
cucugcccgugccuuucccagu

SEQ ID NO: 202721 - RNA, 22 nt, Human
acauuucgugcucuguuuuguu

SEQ ID NO: 202722 - RNA, 22 nt, Human
auuaaagaaacccagcauguga

SEQ ID NO: 202723 - RNA, 22 nt, Human
ccugggcccucaccgccggugg

SEQ ID NO: 202724 - RNA, 22 nt, Human
guggaauguccuugaucauaag

SEQ ID NO: 202725 - RNA, 22 nt, Human
gaaauaaccucaugcaccauga

SEQ ID NO: 202726 - RNA, 20 nt, Human
aaagucuguuuaucucugga

SEQ ID NO: 202727 - RNA, 22 nt, Human
aaacugaggaacaaggaaggau

SEQ ID NO: 202728 - RNA, 22 nt, Human
gucucuuagaaucgcauauugu

SEQ ID NO: 202729 - RNA, 22 nt, Human
gggcugagagcuggaaucugag

SEQ ID NO: 202730 - RNA, 22 nt, Human
augguuuacagaacuccuagca

SEQ ID NO: 202731 - RNA, 22 nt, Human
gcuccaggcagagccucuuucg

SEQ ID NO: 202732 - RNA, 19 nt, Human
agugugaguaauuggaguu

SEQ ID NO: 202733 - RNA, 22 nt, Human
auuagucuacugucuaauaaau

SEQ ID NO: 202734 - RNA, 22 nt, Human
agaacaauugccccaaagcuug

SEQ ID NO: 202735 - RNA, 21 nt, Human
cucugcugagcuccauuuuca

SEQ ID NO: 202736 - RNA, 19 nt, Human
ggacagacgcagagaucug

SEQ ID NO: 202737 - RNA, 22 nt, Human
aagccaguggugagaagauagc

SEQ ID NO: 202738 - RNA, 22 nt, Human
gccuccuggguucaugccauuc

SEQ ID NO: 202739 - RNA, 22 nt, Human
caguggcacccacgggcugggc

SEQ ID NO: 202740 - RNA, 22 nt, Human
gcaguggauggccagcaggggc

SEQ ID NO: 202741 - RNA, 22 nt, Human
auaauauuugcauuacugugau

SEQ ID NO: 202742 - RNA, 22 nt, Human
guuagagggaaaaaucauuugc

SEQ ID NO: 202743 - RNA, 22 nt, Human
agcucagcuuccucuccaugcu

SEQ ID NO: 202744 - RNA, 22 nt, Human
cccugaggggcuuacuuugccc

SEQ ID NO: 202745 - RNA, 22 nt, Human
cuuguauuccccuaucucuaaa

SEQ ID NO: 202746 - RNA, 22 nt, Human
auccacagagaggaagaauagu

SEQ ID NO: 202747 - RNA, 22 nt, Human
aggcagugagaaauagcaagau

SEQ ID NO: 202748 - RNA, 22 nt, Human
ccucagagguucugugugggaa

SEQ ID NO: 202749 - RNA, 22 nt, Human
cagauaaauagauagauaaacu

SEQ ID NO: 202750 - RNA, 22 nt, Human
uagaagcagcaggaguaaaggc

SEQ ID NO: 202751 - RNA, 22 nt, Human
ugcucugcaagcaggagcaaga

SEQ ID NO: 202752 - RNA, 22 nt, Human
ugaggccucauaaugagauuuc

SEQ ID NO: 202753 - RNA, 22 nt, Human
gagcccagcuugcacauggagc

SEQ ID NO: 202754 - RNA, 22 nt, Human
augcaacauacauucugaagcu

SEQ ID NO: 202755 - RNA, 22 nt, Human
cucagagcacaguuuaugacag

SEQ ID NO: 202756 - RNA, 22 nt, Human
guaaucguggugguuaauucca

SEQ ID NO: 202757 - RNA, 19 nt, Human
uggcuuggcugcagaugcu

SEQ ID NO: 202758 - RNA, 21 nt, Human
uaagugcaaagagacagauac

SEQ ID NO: 202759 - RNA, 22 nt, Human
ccccuguguuguucaaggguca

SEQ ID NO: 202760 - RNA, 22 nt, Human
aggcugagcugaccugguuugg

SEQ ID NO: 202761 - RNA, 22 nt, Human
uuuccuuuccaaaauucugccu

SEQ ID NO: 202762 - RNA, 22 nt, Human
acucuguaaagcauaacguuug

SEQ ID NO: 202763 - RNA, 22 nt, Human
gaggaaaucauuccagaaaagg

SEQ ID NO: 202764 - RNA, 22 nt, Human
aacugcuuagugauggaugacc

SEQ ID NO: 202765 - RNA, 22 nt, Human
ucauuucuguugugcaucacug

SEQ ID NO: 202766 - RNA, 22 nt, Human
caaaaggcaggggaaagagugc

SEQ ID NO: 202767 - RNA, 22 nt, Human
caagugggaccugucugauucc

SEQ ID NO: 202768 - RNA, 22 nt, Human
uuucuuuugcccuguggguuag

SEQ ID NO: 202769 - RNA, 22 nt, Human
agcacaguggcuucuaugucua

SEQ ID NO: 202770 - RNA, 20 nt, Human
aagucccuaagucucuggcc

SEQ ID NO: 202771 - RNA, 22 nt, Human
gauucuuuacaucucugcugac

SEQ ID NO: 202772 - RNA, 22 nt, Human
auagauauuugaguuguuucca

SEQ ID NO: 202773 - RNA, 22 nt, Human
uucugccaucugcagaagggga

SEQ ID NO: 202774 - RNA, 22 nt, Human
aucuguguaugaaaguauaacu

SEQ ID NO: 202775 - RNA, 22 nt, Human
cuccccagcucgcgggugacgg

SEQ ID NO: 202776 - RNA, 22 nt, Human
caaauccagaucccagucguag

SEQ ID NO: 202777 - RNA, 22 nt, Human
uuguacagacccugaaaagcuc

SEQ ID NO: 202778 - RNA, 22 nt, Human
uuccuucuuuuacaccauaaau

SEQ ID NO: 202779 - RNA, 22 nt, Human
gaauuccucugagcuaggagau

SEQ ID NO: 202780 - RNA, 22 nt, Human
acaggaggggcaugaaagacgg

SEQ ID NO: 202781 - RNA, 22 nt, Human
cuagagaaaacuguguaucuug

SEQ ID NO: 202782 - RNA, 22 nt, Human
cuuagugaggaaugaauuuguu

SEQ ID NO: 202783 - RNA, 22 nt, Human
acauguggaggaggcgagggua

SEQ ID NO: 202784 - RNA, 22 nt, Human
uccugggcugcagggaagagca

SEQ ID NO: 202785 - RNA, 22 nt, Human
ccuggcagcuaagugcuuugag

SEQ ID NO: 202786 - RNA, 22 nt, Human
uauuuauuggacaguguugcug

SEQ ID NO: 202787 - RNA, 22 nt, Human
ucucagagugguggucccucug

SEQ ID NO: 202788 - RNA, 22 nt, Human
caggaacaauguaagucucauu

SEQ ID NO: 202789 - RNA, 22 nt, Human
ucucuggggauggaccugggag

SEQ ID NO: 202790 - RNA, 22 nt, Human
auuuguagugaagugaaaauaa

SEQ ID NO: 202791 - RNA, 22 nt, Human
gcaggucucaaucugagcaggc

SEQ ID NO: 202792 - RNA, 22 nt, Human
ucuggcuguguaugagaguuuu

SEQ ID NO: 202793 - RNA, 22 nt, Human
cuugauugcuucuacgugacug

SEQ ID NO: 202794 - RNA, 22 nt, Human
gaccauuugcuaguaaauugca

SEQ ID NO: 202795 - RNA, 22 nt, Human
agcaagcagaaaugccauggca

SEQ ID NO: 202796 - RNA, 22 nt, Human
uuaugcaaaggggccucuuccu

SEQ ID NO: 202797 - RNA, 22 nt, Human
ugaggagcgggcagggaugcag

SEQ ID NO: 202798 - RNA, 22 nt, Human
ggcacagcacaguggacccagg

SEQ ID NO: 202799 - RNA, 18 nt, Human
auuuugaacaaugcugua

SEQ ID NO: 202800 - RNA, 22 nt, Human
caguuaaacgggccaugugagu

SEQ ID NO: 202801 - RNA, 22 nt, Human
ugucuaaaugaaaagagaugcc

SEQ ID NO: 202802 - RNA, 22 nt, Human
cggcuggugucgggcacagcaa

SEQ ID NO: 202803 - RNA, 22 nt, Human
cuccuacauuccaccuuggacu

SEQ ID NO: 202804 - RNA, 22 nt, Human
uccauccauaccacuuggagac

SEQ ID NO: 202805 - RNA, 22 nt, Human
uacaggugguaaaaauauuguu

SEQ ID NO: 202806 - RNA, 19 nt, Human
auguacccagugucaaucc

SEQ ID NO: 202807 - RNA, 22 nt, Human
cacaauuauuaucucuuucuac

SEQ ID NO: 202808 - RNA, 22 nt, Human
gugcaaaagucauugugguuuu

SEQ ID NO: 202809 - RNA, 22 nt, Human
ucccucucuagccuguucagua

SEQ ID NO: 202810 - RNA, 23 nt, Human
uuuguacauugaggaggcagaau

SEQ ID NO: 202811 - RNA, 22 nt, Human
agucagagagcucucagcauag

SEQ ID NO: 202812 - RNA, 22 nt, Human
aaaaguauuuugagcacuuuau

SEQ ID NO: 202813 - RNA, 22 nt, Human
uugugcugagcuucuagcugug

SEQ ID NO: 202814 - RNA, 22 nt, Human
gaaggcuuccugaugccaacca

SEQ ID NO: 202815 - RNA, 21 nt, Human
uucuucuuggacuguuuuggc

SEQ ID NO: 202816 - RNA, 22 nt, Human
uuuccuguugccaucaagaaug

SEQ ID NO: 202817 - RNA, 22 nt, Human
ccugagaauaauucuccauagc

SEQ ID NO: 202818 - RNA, 22 nt, Human
uggguccucugagagggcagcg

SEQ ID NO: 202819 - RNA, 22 nt, Human
gucuccagggcugcuggcgccu

SEQ ID NO: 202820 - RNA, 21 nt, Human
acagacagggccagugucccc

SEQ ID NO: 202821 - RNA, 22 nt, Human
guuuacauguaauguguuauug

SEQ ID NO: 202822 - RNA, 22 nt, Human
aaguaaucuggaauuugguuuu

SEQ ID NO: 202823 - RNA, 22 nt, Human
uuccuuucucuggacugcagcc

SEQ ID NO: 202824 - RNA, 22 nt, Human
ccuggcagcauugguagagauu

SEQ ID NO: 202825 - RNA, 22 nt, Human
cugggccuugcaucccagagcc

SEQ ID NO: 202826 - RNA, 20 nt, Human
acccagcucugugcccuggg

SEQ ID NO: 202827 - RNA, 22 nt, Human
uaagaaucuauuaggaauaugu

SEQ ID NO: 202828 - RNA, 22 nt, Human
uuugcaaagugcuugcagagua

SEQ ID NO: 202829 - RNA, 22 nt, Human
auuuagaaccccuuccaaccug

SEQ ID NO: 202830 - RNA, 22 nt, Human
caguuaaaagguaugcuaccaa

SEQ ID NO: 202831 - RNA, 22 nt, Human
aagcauuuuagauaaagcauca

SEQ ID NO: 202832 - RNA, 20 nt, Human
ucugggcagggcacauggaa

SEQ ID NO: 202833 - RNA, 22 nt, Human
uacagacaguuuuucagauauu

SEQ ID NO: 202834 - RNA, 22 nt, Human
ucuggccuuaucuguccaagcc

SEQ ID NO: 202835 - RNA, 22 nt, Human
gccuggcugcucagccacucac

SEQ ID NO: 202836 - RNA, 22 nt, Human
uagauccagcuguuauguuaug

SEQ ID NO: 202837 - RNA, 22 nt, Human
uucuauugggcagcauugcuuc

SEQ ID NO: 202838 - RNA, 22 nt, Human
aguuagcaucuccuccagucua

SEQ ID NO: 202839 - RNA, 22 nt, Human
ugcagccucucugcuucaggaa

SEQ ID NO: 202840 - RNA, 22 nt, Human
uccaauauuucucauauaugga

SEQ ID NO: 202841 - RNA, 21 nt, Human
gagauuuagaaggaucaauuu

SEQ ID NO: 202842 - RNA, 22 nt, Human
uucuucagagaguagaagcaag

SEQ ID NO: 202843 - RNA, 22 nt, Human
gauguacaaguaaaauaugugu

SEQ ID NO: 202844 - RNA, 22 nt, Human
cugccaccaaauagcugcauga

SEQ ID NO: 202845 - RNA, 22 nt, Human
aggcccuguccauggugcugaa

SEQ ID NO: 202846 - RNA, 22 nt, Human
ucacagaagguggccauagcug

SEQ ID NO: 202847 - RNA, 22 nt, Human
agugucugccuauuuuucaagc

SEQ ID NO: 202848 - RNA, 22 nt, Human
ccagaauaggaguaauaaaacc

SEQ ID NO: 202849 - RNA, 22 nt, Human
ucauguauugaaaagcauuuua

SEQ ID NO: 202850 - RNA, 19 nt, Human
agcuuuuacuaacagcaga

SEQ ID NO: 202851 - RNA, 22 nt, Human
cucuggcuuaguaugcuccaaa

SEQ ID NO: 202852 - RNA, 22 nt, Human
aauuucaauuacuuuugcacca

SEQ ID NO: 202853 - RNA, 22 nt, Human
uuuccaaauaaggucacacuca

SEQ ID NO: 202854 - RNA, 22 nt, Human
ccaguggguaggccauggugag

SEQ ID NO: 202855 - RNA, 22 nt, Human
cugagcugguggaagcaugcag

SEQ ID NO: 202856 - RNA, 22 nt, Human
gacagguggguucucguaucug

SEQ ID NO: 202857 - RNA, 22 nt, Human
uaguguucuaagaacauccaug

SEQ ID NO: 202858 - RNA, 22 nt, Human
uuuccuucuuagcgguguucuu

SEQ ID NO: 202859 - RNA, 23 nt, Human
acaaugcacuuuaaaugguuccc

SEQ ID NO: 202860 - RNA, 22 nt, Human
agacaauuaaaaaauuaugcuu

SEQ ID NO: 202861 - RNA, 22 nt, Human
acaaucuggaaaaguuaacuau

SEQ ID NO: 202862 - RNA, 22 nt, Human
uauuuagaaugcguguacgugu

SEQ ID NO: 202863 - RNA, 22 nt, Human
ucucaggcuuccuggugcugug

SEQ ID NO: 202864 - RNA, 22 nt, Human
ugagaggauauuuugggaggau

SEQ ID NO: 202865 - RNA, 22 nt, Human
gacagggaaacauugaaguguc

SEQ ID NO: 202866 - RNA, 22 nt, Human
uaauauaccaaacuguaauuuu

SEQ ID NO: 202867 - RNA, 23 nt, Human
gaagugucugagcuguauuuuuc

SEQ ID NO: 202868 - RNA, 21 nt, Human
ucagagucucaggagcaaggg

SEQ ID NO: 202869 - RNA, 22 nt, Human
uuacaggugggaaaacuaagcu

SEQ ID NO: 202870 - RNA, 22 nt, Human
gcagggacaucuucagaucacu

SEQ ID NO: 202871 - RNA, 22 nt, Human
ugaggcaggacauggacaacug

SEQ ID NO: 202872 - RNA, 22 nt, Human
uacaauacuuaaccuauuuugc

SEQ ID NO: 202873 - RNA, 22 nt, Human
gcagcccagguggaguaaucua

SEQ ID NO: 202874 - RNA, 23 nt, Human
agggagcuaaaaggcuggagcag

SEQ ID NO: 202875 - RNA, 22 nt, Human
gugggcagugguuugcgcgguc

SEQ ID NO: 202876 - RNA, 20 nt, Human
gaagcagcuucauguagaca

SEQ ID NO: 202877 - RNA, 22 nt, Human
auggggagagaagggcugagcu

SEQ ID NO: 202878 - RNA, 20 nt, Human
ucauuguguugccaauuccc

SEQ ID NO: 202879 - RNA, 22 nt, Human
agaggcaguauacaauccgagc

SEQ ID NO: 202880 - RNA, 21 nt, Human
ugguuucuaagcugucagucu

SEQ ID NO: 202881 - RNA, 22 nt, Human
agggcugaguggugcagucaaa

SEQ ID NO: 202882 - RNA, 22 nt, Human
acaguacaaaacccaccagagg

SEQ ID NO: 202883 - RNA, 18 nt, Human
acuguuaucugauaaggc

SEQ ID NO: 202884 - RNA, 22 nt, Human
ucaucugucccaggcuuuuuuc

SEQ ID NO: 202885 - RNA, 22 nt, Human
ucuuugcauuccugugugcuuu

SEQ ID NO: 202886 - RNA, 22 nt, Human
ucugugcucaugcaugugaauu

SEQ ID NO: 202887 - RNA, 22 nt, Human
uagugaaaugagaauguaugac

SEQ ID NO: 202888 - RNA, 22 nt, Human
ucauaaaugcagugucauaaau

SEQ ID NO: 202889 - RNA, 22 nt, Human
agcugccuccuggugccccauc

SEQ ID NO: 202890 - RNA, 22 nt, Human
ugagggggguaaucacuggguu

SEQ ID NO: 202891 - RNA, 22 nt, Human
uaaagcugaaaugauuaugaca

SEQ ID NO: 202892 - RNA, 21 nt, Human
ccuggacuaaaaccaggccac

SEQ ID NO: 202893 - RNA, 19 nt, Human
cccucauucacuuauucuc

SEQ ID NO: 202894 - RNA, 22 nt, Human
ugucuuuacuuaauaaauauac

SEQ ID NO: 202895 - RNA, 22 nt, Human
uuugacucuugcccaguuuggc

SEQ ID NO: 202896 - RNA, 22 nt, Human
uggcccugggcaucuuucguga

SEQ ID NO: 202897 - RNA, 22 nt, Human
uuggagaauguuuuccugcagu

SEQ ID NO: 202898 - RNA, 22 nt, Human
uucaagcaccaaauuaguaggc

SEQ ID NO: 202899 - RNA, 22 nt, Human
agaguuugaauuuugaaaagau

SEQ ID NO: 202900 - RNA, 22 nt, Human
uggcagccuucucugagaaggu

SEQ ID NO: 202901 - RNA, 22 nt, Human
ucagggaccccucugaguggag

SEQ ID NO: 202902 - RNA, 22 nt, Human
agccuuccagguagauggcaca

SEQ ID NO: 202903 - RNA, 22 nt, Human
ucacuuuggauuauguaauuuc

SEQ ID NO: 202904 - RNA, 22 nt, Human
cagaaucuguugggguugcaga

SEQ ID NO: 202905 - RNA, 22 nt, Human
ggcuuuugaauuccaaggcauu

SEQ ID NO: 202906 - RNA, 22 nt, Human
uuguuuuaucuuucuacagacu

SEQ ID NO: 202907 - RNA, 22 nt, Human
guggcagucgcugacagauaca

SEQ ID NO: 202908 - RNA, 22 nt, Human
ggggccagcuucgcgugcucuu

SEQ ID NO: 202909 - RNA, 21 nt, Human
cacauuccaugggucuauuua

SEQ ID NO: 202910 - RNA, 22 nt, Human
gguccugcgucuggcucgcccg

SEQ ID NO: 202911 - RNA, 22 nt, Human
gcuggcagcuggaaguugggcu

SEQ ID NO: 202912 - RNA, 17 nt, Human
gcucugccccagccucu

SEQ ID NO: 202913 - RNA, 22 nt, Human
uagaaagagcuuugcuuccuuu

SEQ ID NO: 202914 - RNA, 20 nt, Human
gagggcaggcacccauuuca

SEQ ID NO: 202915 - RNA, 22 nt, Human
uuaugaaaacaaucaguaggca

SEQ ID NO: 202916 - RNA, 22 nt, Human
ucuuuccacauucucuguuuag

SEQ ID NO: 202917 - RNA, 22 nt, Human
gcccuggaugcucauggcauca

SEQ ID NO: 202918 - RNA, 22 nt, Human
aagucuggaagucucaguuuuc

SEQ ID NO: 202919 - RNA, 22 nt, Human
cccugagcgugaggaggaagua

SEQ ID NO: 202920 - RNA, 22 nt, Human
uugguguugaacaaaacuaaau

SEQ ID NO: 202921 - RNA, 22 nt, Human
auucaagcugaauggugacaga

SEQ ID NO: 202922 - RNA, 22 nt, Human
ugucuucgcuacaaugaaaagg

SEQ ID NO: 202923 - RNA, 22 nt, Human
cggaaacuacgugacacccguu

SEQ ID NO: 202924 - RNA, 22 nt, Human
caguuuuaggacauguggaugu

SEQ ID NO: 202925 - RNA, 22 nt, Human
ccaggccagccuggagcauggc

SEQ ID NO: 202926 - RNA, 22 nt, Human
ggcacagggaggcccuggugug

SEQ ID NO: 202927 - RNA, 22 nt, Human
cagcccucaucccgccugcguu

SEQ ID NO: 202928 - RNA, 22 nt, Human
augaggauguuaguggacugga

SEQ ID NO: 202929 - RNA, 22 nt, Human
agaacaucuaaauaucugagac

SEQ ID NO: 202930 - RNA, 22 nt, Human
aauagcaaaguuaucaaauuaa

SEQ ID NO: 202931 - RNA, 21 nt, Human
uucuccuccaaguugcuccug

SEQ ID NO: 202932 - RNA, 22 nt, Human
uuuguguuaaauguuaaauuca

SEQ ID NO: 202933 - RNA, 22 nt, Human
augcagagcuuccaguggccug

SEQ ID NO: 202934 - RNA, 22 nt, Human
auauucacuggguacuaaaaag

SEQ ID NO: 202935 - RNA, 22 nt, Human
uuauuagcugggcuucagggug

SEQ ID NO: 202936 - RNA, 23 nt, Human
uggcucuguggaucccucaggag

SEQ ID NO: 202937 - RNA, 22 nt, Human
agugagcauucguuuggaaccc

SEQ ID NO: 202938 - RNA, 22 nt, Human
uggcugacaauguagcaguaac

SEQ ID NO: 202939 - RNA, 22 nt, Human
acacaugaaauaauauuaugca

SEQ ID NO: 202940 - RNA, 20 nt, Human
gaggagucuuguagaaaaug

SEQ ID NO: 202941 - RNA, 21 nt, Human
ucuugaaaaguuagauucucu

SEQ ID NO: 202942 - RNA, 22 nt, Human
uaagaaacuuaacugggaacua

SEQ ID NO: 202943 - RNA, 22 nt, Human
caaauuaaugugucucaaaaua

SEQ ID NO: 202944 - RNA, 22 nt, Human
aucaggaucugcaucauaagaa

SEQ ID NO: 202945 - RNA, 22 nt, Human
uucacauugugguucaugugaa

SEQ ID NO: 202946 - RNA, 22 nt, Human
cucuuuccaggguaccccaggu

SEQ ID NO: 202947 - RNA, 22 nt, Human
ccaggucuuguuugacaucaau

SEQ ID NO: 202948 - RNA, 22 nt, Human
uacaggaaguuacagacuauga

SEQ ID NO: 202949 - RNA, 22 nt, Human
caagaauccuguucuugaagau

SEQ ID NO: 202950 - RNA, 22 nt, Human
cugagccaugggucuaagcacu

SEQ ID NO: 202951 - RNA, 22 nt, Human
ggcaggugagagcucuuugaaa

SEQ ID NO: 202952 - RNA, 22 nt, Human
uuucccagccuccuuugcagcu

SEQ ID NO: 202953 - RNA, 22 nt, Human
aaacauagauaauagauagaug

SEQ ID NO: 202954 - RNA, 22 nt, Human
uuuccauguuggugaaaugagg

SEQ ID NO: 202955 - RNA, 23 nt, Human
uuccugugguauauuuuauaggg

SEQ ID NO: 202956 - RNA, 22 nt, Human
uucaguguggcccaugaagagg

SEQ ID NO: 202957 - RNA, 22 nt, Human
cugcacccucaaacuccugggc

SEQ ID NO: 202958 - RNA, 22 nt, Human
caaggaggcagugggacuugaa

SEQ ID NO: 202959 - RNA, 20 nt, Human
uuccacaucuuugcacaugc

SEQ ID NO: 202960 - RNA, 22 nt, Human
gagcacaggcugcugugaacug

SEQ ID NO: 202961 - RNA, 22 nt, Human
aacagacagaaaaaugugaucu

SEQ ID NO: 202962 - RNA, 22 nt, Human
uggaaauaugcuccauucuuuu

SEQ ID NO: 202963 - RNA, 22 nt, Human
ggagaugccagaauugcaaauu

SEQ ID NO: 202964 - RNA, 22 nt, Human
ggagaggugagagguacaaguu

SEQ ID NO: 202965 - RNA, 22 nt, Human
caggaggcccaaagggcgcaga

SEQ ID NO: 202966 - RNA, 22 nt, Human
gauggcagguaguggucucauc

SEQ ID NO: 202967 - RNA, 22 nt, Human
uuagauacauucucauuuguuu

SEQ ID NO: 202968 - RNA, 22 nt, Human
uuuucauugagcaccugaguaa

SEQ ID NO: 202969 - RNA, 22 nt, Human
uagcaacaugguuaucacauua

SEQ ID NO: 202970 - RNA, 22 nt, Human
cccccaccugaggacagucuua

SEQ ID NO: 202971 - RNA, 22 nt, Human
ccuccccacagcccaggagacu

SEQ ID NO: 202972 - RNA, 22 nt, Human
gaggcacaguucuuccuccaga

SEQ ID NO: 202973 - RNA, 22 nt, Human
gaacaaauuggagaaaucagga

SEQ ID NO: 202974 - RNA, 22 nt, Human
agcccuccuuuguucaugcugc

SEQ ID NO: 202975 - RNA, 22 nt, Human
aauuugcaugaugagaacaaua

SEQ ID NO: 202976 - RNA, 22 nt, Human
guuguauuugccugaaugcagu

SEQ ID NO: 202977 - RNA, 23 nt, Human
agcaaaguuguugcuaaccucau

SEQ ID NO: 202978 - RNA, 22 nt, Human
gaagucuuuuagcaaaacgaac

SEQ ID NO: 202979 - RNA, 22 nt, Human
auccaaaggugacacagaauac

SEQ ID NO: 202980 - RNA, 22 nt, Human
ccaaguacagauuccuccacug

SEQ ID NO: 202981 - RNA, 22 nt, Human
agcaaacacaagagguaauuuc

SEQ ID NO: 202982 - RNA, 22 nt, Human
ugggucagaaucagagaguugc

SEQ ID NO: 202983 - RNA, 22 nt, Human
uuucauuauacagcuucauaaa

SEQ ID NO: 202984 - RNA, 22 nt, Human
gaggcucacuaggcauccuggg

SEQ ID NO: 202985 - RNA, 22 nt, Human
agcuacaguggacaagugaacu

SEQ ID NO: 202986 - RNA, 22 nt, Human
gauaaagggggaccaaaugacu

SEQ ID NO: 202987 - RNA, 22 nt, Human
aagccaaguuggaagacugaau

SEQ ID NO: 202988 - RNA, 22 nt, Human
gccaucugcugcucuccagugu

SEQ ID NO: 202989 - RNA, 22 nt, Human
auggccuggggauuccugagca

SEQ ID NO: 202990 - RNA, 17 nt, Human
agcagcugaagcagcca

SEQ ID NO: 202991 - RNA, 22 nt, Human
ccagagaguaggaggcauuauu

SEQ ID NO: 202992 - RNA, 22 nt, Human
acaguggaaagaaacgaauuag

SEQ ID NO: 202993 - RNA, 20 nt, Human
uuagaaagagcgugauaaga

SEQ ID NO: 202994 - RNA, 22 nt, Human
uuguguccauuugagucaugug

SEQ ID NO: 202995 - RNA, 22 nt, Human
gaaggagaggauugugaggcug

SEQ ID NO: 202996 - RNA, 22 nt, Human
uagaaagugaagguuaauuaau

SEQ ID NO: 202997 - RNA, 22 nt, Human
uggcuucccauagcuugcuagu

SEQ ID NO: 202998 - RNA, 22 nt, Human
auuaggaaauguguugcaagca

SEQ ID NO: 202999 - RNA, 22 nt, Human
ugaguuuuuucaacauaugaag

SEQ ID NO: 203000 - RNA, 22 nt, Human
uacuguuuucuuuauaguacag

SEQ ID NO: 203001 - RNA, 22 nt, Human
gucugcccucacaugcacucuu

SEQ ID NO: 203002 - RNA, 22 nt, Human
uagaaaucagguuuuuagaaag

SEQ ID NO: 203003 - RNA, 22 nt, Human
ucccagccacaguuuccaccug

SEQ ID NO: 203004 - RNA, 22 nt, Human
uuuaguagaauaguauaucaaa

SEQ ID NO: 203005 - RNA, 22 nt, Human
uuuaccuucuuuuaacuacagu

SEQ ID NO: 203006 - RNA, 22 nt, Human
ugucagugguagacccagaggu

SEQ ID NO: 203007 - RNA, 22 nt, Human
cccuuccuggaguacccucugu

SEQ ID NO: 203008 - RNA, 21 nt, Human
agauguuucccccuuggcuuc

SEQ ID NO: 203009 - RNA, 22 nt, Human
cuguguccuccccaucacuucu

SEQ ID NO: 203010 - RNA, 23 nt, Human
aguguugguugggaagccaagca

SEQ ID NO: 203011 - RNA, 22 nt, Human
guggcugcagagccagcaagcu

SEQ ID NO: 203012 - RNA, 22 nt, Human
aaggcaggaugcggacccaucu

SEQ ID NO: 203013 - RNA, 22 nt, Human
uucuguaggcauggaacaggga

SEQ ID NO: 203014 - RNA, 22 nt, Human
ucacacacauuugcugucugau

SEQ ID NO: 203015 - RNA, 22 nt, Human
uuguuucuucauuuagaagcuu

SEQ ID NO: 203016 - RNA, 20 nt, Human
acauagaucagugauugaca

SEQ ID NO: 203017 - RNA, 22 nt, Human
gucauauacacugcauguaauc

SEQ ID NO: 203018 - RNA, 22 nt, Human
aaaggcuuuaaaauguacauau

SEQ ID NO: 203019 - RNA, 22 nt, Human
uuuaucuuuaggacuuugcaga

SEQ ID NO: 203020 - RNA, 22 nt, Human
uaauuucuagggacuaaggugc

SEQ ID NO: 203021 - RNA, 22 nt, Human
cgaggcaggcaggcggaggaua

SEQ ID NO: 203022 - RNA, 22 nt, Human
cagcucugguuccugggcccag

SEQ ID NO: 203023 - RNA, 22 nt, Human
uacuuucuuucccaagaggugg

SEQ ID NO: 203024 - RNA, 22 nt, Human
gagacagaguuucacucuuguu

SEQ ID NO: 203025 - RNA, 22 nt, Human
ccaggagagcucucguucagug

SEQ ID NO: 203026 - RNA, 22 nt, Human
uauacuucccugcagaguaaag

SEQ ID NO: 203027 - RNA, 22 nt, Human
acauucaaaauugugguuuaga

SEQ ID NO: 203028 - RNA, 22 nt, Human
gaggaagcuuuugaucgcccag

SEQ ID NO: 203029 - RNA, 22 nt, Human
uacuaguucucauaugaaauaa

SEQ ID NO: 203030 - RNA, 22 nt, Human
ucuuucaaugugaaaccaugua

SEQ ID NO: 203031 - RNA, 22 nt, Human
cagcacugugauaacugagcca

SEQ ID NO: 203032 - RNA, 22 nt, Human
aagggcucugggcuacgcacug

SEQ ID NO: 203033 - RNA, 22 nt, Human
gccuguggcccaacugucuguc

SEQ ID NO: 203034 - RNA, 19 nt, Human
cagagcugcuggccucguc

SEQ ID NO: 203035 - RNA, 22 nt, Human
gucuggaaauuuaagguaugag

SEQ ID NO: 203036 - RNA, 22 nt, Human
uaauuuuaauaguauguggcau

SEQ ID NO: 203037 - RNA, 22 nt, Human
guuauauucaaaaugaggcugu

SEQ ID NO: 203038 - RNA, 22 nt, Human
ugacuccaaacagaaaacgaau

SEQ ID NO: 203039 - RNA, 22 nt, Human
ugggaccagauaaagggagguc

SEQ ID NO: 203040 - RNA, 22 nt, Human
auuucuguugcuuauaaauuac

SEQ ID NO: 203041 - RNA, 22 nt, Human
uggcugggccgggccuugugcc

SEQ ID NO: 203042 - RNA, 20 nt, Human
ggauuuacaggggaaaagug

SEQ ID NO: 203043 - RNA, 22 nt, Human
cccugcagaccaaugccauaga

SEQ ID NO: 203044 - RNA, 22 nt, Human
auggccagcaaguucagaauuu

SEQ ID NO: 203045 - RNA, 22 nt, Human
caguucuggaggauagaagucu

SEQ ID NO: 203046 - RNA, 22 nt, Human
augugcuguaauccauugaagg

SEQ ID NO: 203047 - RNA, 22 nt, Human
aagcccuggcggguggagggcc

SEQ ID NO: 203048 - RNA, 22 nt, Human
cugaggcuuguccucucagcuu

SEQ ID NO: 203049 - RNA, 22 nt, Human
gugcgggccuggggguuucucu

SEQ ID NO: 203050 - RNA, 22 nt, Human
agaaccauuuugacagauauac

SEQ ID NO: 203051 - RNA, 22 nt, Human
ucuguucuucuccacuguaugu

SEQ ID NO: 203052 - RNA, 22 nt, Human
aagcugaggcccauggcaaggu

SEQ ID NO: 203053 - RNA, 22 nt, Human
auaacauggaguuugucauuua

SEQ ID NO: 203054 - RNA, 23 nt, Human
gccuucagcucgggaaggcuccc

SEQ ID NO: 203055 - RNA, 18 nt, Human
uggaggcagaguucuggc

SEQ ID NO: 203056 - RNA, 22 nt, Human
cucucugugcucacaagggcag

SEQ ID NO: 203057 - RNA, 22 nt, Human
ugcaggugguacuucuuuuucu

SEQ ID NO: 203058 - RNA, 22 nt, Human
ucugugcuaaugcuucacaaua

SEQ ID NO: 203059 - RNA, 22 nt, Human
ucacacagguuugcaaugauuu

SEQ ID NO: 203060 - RNA, 22 nt, Human
ucuuuaauuguggaagagcagc

SEQ ID NO: 203061 - RNA, 22 nt, Human
gucuguagaauaaauaugagua

SEQ ID NO: 203062 - RNA, 22 nt, Human
uacugugguaacauuuuaaauu

SEQ ID NO: 203063 - RNA, 22 nt, Human
aacaggccuuguuuuuguucau

SEQ ID NO: 203064 - RNA, 22 nt, Human
aaagugaggacuugaguacugu

SEQ ID NO: 203065 - RNA, 19 nt, Human
cucuggagcagacacugga

SEQ ID NO: 203066 - RNA, 22 nt, Human
agauccaugugauuuggaguuc

SEQ ID NO: 203067 - RNA, 22 nt, Human
aaagucauacauggugcuuacu

SEQ ID NO: 203068 - RNA, 22 nt, Human
gggcuucucugggaguccuggu

SEQ ID NO: 203069 - RNA, 22 nt, Human
acagguguagaaaacagauuau

SEQ ID NO: 203070 - RNA, 22 nt, Human
ggaccaggcugagcaccugccu

SEQ ID NO: 203071 - RNA, 22 nt, Human
uacagagaacucauagaaagaa

SEQ ID NO: 203072 - RNA, 21 nt, Human
gacaggugauucagagcaggg

SEQ ID NO: 203073 - RNA, 21 nt, Human
gugcugggacacagccaggcu

SEQ ID NO: 203074 - RNA, 22 nt, Human
ucagaacaucccagauaguaga

SEQ ID NO: 203075 - RNA, 22 nt, Human
auccauuuuuucagaaugcucu

SEQ ID NO: 203076 - RNA, 22 nt, Human
gcuggcaggauagaagucuaau

SEQ ID NO: 203077 - RNA, 22 nt, Human
aggucaagggagcugagggcca

SEQ ID NO: 203078 - RNA, 22 nt, Human
ccugccuguacuagagacccag

SEQ ID NO: 203079 - RNA, 22 nt, Human
gggcucuguuuagaucagagau

SEQ ID NO: 203080 - RNA, 22 nt, Human
ugucuagaggccaacaggaaag

SEQ ID NO: 203081 - RNA, 22 nt, Human
gcagauggcagcccaggcuggg

SEQ ID NO: 203082 - RNA, 22 nt, Human
agagaguugaggaagcaacacu

SEQ ID NO: 203083 - RNA, 22 nt, Human
aggguggggugcuacaucuuua

SEQ ID NO: 203084 - RNA, 22 nt, Human
uggcugagaaguucugguggga

SEQ ID NO: 203085 - RNA, 22 nt, Human
guagggcaacaugggcacuagg

SEQ ID NO: 203086 - RNA, 22 nt, Human
ugacagacuuuacuucuccuau

SEQ ID NO: 203087 - RNA, 22 nt, Human
gggcuuggccccagaagagcua

SEQ ID NO: 203088 - RNA, 22 nt, Human
gucucaguccgugcuguucagg

SEQ ID NO: 203089 - RNA, 22 nt, Human
uacauucaaacgauuuauugau

SEQ ID NO: 203090 - RNA, 22 nt, Human
ggcaccagcaggcaccgaugcc

SEQ ID NO: 203091 - RNA, 22 nt, Human
aagucccuuuaaucagugccuu

SEQ ID NO: 203092 - RNA, 22 nt, Human
uucacuguuaugaagcucuggg

SEQ ID NO: 203093 - RNA, 22 nt, Human
ugcuggcugccagguucccugu

SEQ ID NO: 203094 - RNA, 18 nt, Human
caauagaaacaguaggaa

SEQ ID NO: 203095 - RNA, 22 nt, Human
caaauaguuuuucauguauuau

SEQ ID NO: 203096 - RNA, 22 nt, Human
cuucuucauguauugauagucu

SEQ ID NO: 203097 - RNA, 22 nt, Human
uuccuggggacuuaccgucauu

SEQ ID NO: 203098 - RNA, 22 nt, Human
acaauuagcugugugucuaucu

SEQ ID NO: 203099 - RNA, 22 nt, Human
gaacugguuacagagggauguu

SEQ ID NO: 203100 - RNA, 22 nt, Human
cugaagcaauugagagauguuu

SEQ ID NO: 203101 - RNA, 22 nt, Human
cucuucuuuaguccagaccauc

SEQ ID NO: 203102 - RNA, 22 nt, Human
cugucucuguugccuguaggug

SEQ ID NO: 203103 - RNA, 22 nt, Human
guccuggggaauacagaagccg

SEQ ID NO: 203104 - RNA, 22 nt, Human
ccccagcagcaccuggggcagu

SEQ ID NO: 203105 - RNA, 19 nt, Human
cugguccugacugaggggu

SEQ ID NO: 203106 - RNA, 22 nt, Human
uuggaaaauguauuucuagaag

SEQ ID NO: 203107 - RNA, 22 nt, Human
guggcugcuaagucuccuuccu

SEQ ID NO: 203108 - RNA, 18 nt, Human
caggucagccuggccuca

SEQ ID NO: 203109 - RNA, 22 nt, Human
acaaaauagaguucuccccugg

SEQ ID NO: 203110 - RNA, 22 nt, Human
uggaaacuagagugugggaagc

SEQ ID NO: 203111 - RNA, 22 nt, Human
ucagggcauguauguuucuuua

SEQ ID NO: 203112 - RNA, 22 nt, Human
ggccuuccuguuguguccaccg

SEQ ID NO: 203113 - RNA, 22 nt, Human
cauagcaacagcaucaagucaa

SEQ ID NO: 203114 - RNA, 22 nt, Human
aggcucauccccacaaagcaaa

SEQ ID NO: 203115 - RNA, 22 nt, Human
cucucugaugucaggucgcuga

SEQ ID NO: 203116 - RNA, 22 nt, Human
agcaucagagagaaguuaacua

SEQ ID NO: 203117 - RNA, 22 nt, Human
cccaggaggcagaaguugcagu

SEQ ID NO: 203118 - RNA, 22 nt, Human
auguagucucuuugggaaacuc

SEQ ID NO: 203119 - RNA, 22 nt, Human
ucugcaggaggcuggcugcagg

SEQ ID NO: 203120 - RNA, 22 nt, Human
ggucagcaucugguugagggca

SEQ ID NO: 203121 - RNA, 22 nt, Human
acaaaauuguguuaaacuuuau

SEQ ID NO: 203122 - RNA, 22 nt, Human
gugaauuuaguuuguaagaagg

SEQ ID NO: 203123 - RNA, 22 nt, Human
aaacggaaugaguaagaguauc

SEQ ID NO: 203124 - RNA, 22 nt, Human
cacuugaacccgggaggcugag

SEQ ID NO: 203125 - RNA, 22 nt, Human
aauaacuucauguaacauuuaa

SEQ ID NO: 203126 - RNA, 22 nt, Human
auccugaggaaggugcagagau

SEQ ID NO: 203127 - RNA, 22 nt, Human
gguguucuuaguggcacuggca

SEQ ID NO: 203128 - RNA, 22 nt, Human
uccaggcccagacggggugagg

SEQ ID NO: 203129 - RNA, 22 nt, Human
caaagucauggggaugcagguc

SEQ ID NO: 203130 - RNA, 21 nt, Human
ccugggccaaauucccuggac

SEQ ID NO: 203131 - RNA, 22 nt, Human
agaaacaagguguagguugacc

SEQ ID NO: 203132 - RNA, 22 nt, Human
ugcccugccaagacugaguggu

SEQ ID NO: 203133 - RNA, 22 nt, Human
ccagugucagaaagauuauccu

SEQ ID NO: 203134 - RNA, 22 nt, Human
aaucuugaguguuacucucauu

SEQ ID NO: 203135 - RNA, 21 nt, Human
ggacaccagucacacuggauu

SEQ ID NO: 203136 - RNA, 22 nt, Human
cagacacuaggugacagagugc

SEQ ID NO: 203137 - RNA, 22 nt, Human
agcugagacacuugagagacua

SEQ ID NO: 203138 - RNA, 22 nt, Human
augguauucucagcaccuagca

SEQ ID NO: 203139 - RNA, 22 nt, Human
ccacccugugcaggcgugggua

SEQ ID NO: 203140 - RNA, 22 nt, Human
aggcaacaaggguagucaguga

SEQ ID NO: 203141 - RNA, 22 nt, Human
uugaaaaaauugguagaggaug

SEQ ID NO: 203142 - RNA, 19 nt, Human
agaaucaggucaggugaca

SEQ ID NO: 203143 - RNA, 19 nt, Human
uagaaagccagaaaacaga

SEQ ID NO: 203144 - RNA, 17 nt, Human
gaauuucuuggucaaaa

SEQ ID NO: 203145 - RNA, 18 nt, Human
ugagagccugcuuguccc

SEQ ID NO: 203146 - RNA, 22 nt, Human
uuccagauuucuacacaagacc

SEQ ID NO: 203147 - RNA, 22 nt, Human
uuuguauuuuucccagcuagcu

SEQ ID NO: 203148 - RNA, 22 nt, Human
aauguacaauaagacaaagagg

SEQ ID NO: 203149 - RNA, 22 nt, Human
gcuccuggcucucugagggcug

SEQ ID NO: 203150 - RNA, 22 nt, Human
agacaucuaccuuucauucaaa

SEQ ID NO: 203151 - RNA, 22 nt, Human
auguacaaucuaucacaagaag

SEQ ID NO: 203152 - RNA, 22 nt, Human
ccugaagagugaauguggcagu

SEQ ID NO: 203153 - RNA, 22 nt, Human
uauacacacaugcuccggccuu

SEQ ID NO: 203154 - RNA, 18 nt, Human
gagaggagccagaauuuu

SEQ ID NO: 203155 - RNA, 18 nt, Human
uaaaggaagugggagagg

SEQ ID NO: 203156 - RNA, 22 nt, Human
uagcauaacagguaagagugag

SEQ ID NO: 203157 - RNA, 22 nt, Human
cucuuucucauugucagcagaa

SEQ ID NO: 203158 - RNA, 22 nt, Human
ucauaaaacacaccagguaguu

SEQ ID NO: 203159 - RNA, 22 nt, Human
aaggaagagaauccuucucaga

SEQ ID NO: 203160 - RNA, 22 nt, Human
ggcaggcuugauauggggggac

SEQ ID NO: 203161 - RNA, 22 nt, Human
cucugggcaaguaugauagaaa

SEQ ID NO: 203162 - RNA, 22 nt, Human
ucuuuggaucccaacuggcugg

SEQ ID NO: 203163 - RNA, 22 nt, Human
aacuauguuaauaaguuucauu

SEQ ID NO: 203164 - RNA, 22 nt, Human
aaccuuugaggggagcucuuuc

SEQ ID NO: 203165 - RNA, 22 nt, Human
uucuguggaauaugaacuagca

SEQ ID NO: 203166 - RNA, 22 nt, Human
uaaaguuauaaauuaccuguca

SEQ ID NO: 203167 - RNA, 22 nt, Human
ugguccaguuuagcauugagug

SEQ ID NO: 203168 - RNA, 22 nt, Human
acuuuagaaaaggaacagagga

SEQ ID NO: 203169 - RNA, 22 nt, Human
gcuggcugcagauuuuagaggu

SEQ ID NO: 203170 - RNA, 22 nt, Human
gcucugagcacugugcggcugg

SEQ ID NO: 203171 - RNA, 22 nt, Human
gaccuggugcagguggacagag

SEQ ID NO: 203172 - RNA, 17 nt, Human
ucuuucccugggagaug

SEQ ID NO: 203173 - RNA, 22 nt, Human
cuguauuuaguuaaaaugcuaa

SEQ ID NO: 203174 - RNA, 22 nt, Human
gaguuagagccauagagcacgg

SEQ ID NO: 203175 - RNA, 22 nt, Human
gcagugcagugggacagggcgc

SEQ ID NO: 203176 - RNA, 22 nt, Human
ugucuuucugacccaagguagu

SEQ ID NO: 203177 - RNA, 22 nt, Human
aguaaaaucuuaagcacagugg

SEQ ID NO: 203178 - RNA, 19 nt, Human
cucagcaagauagaaaugg

SEQ ID NO: 203179 - RNA, 22 nt, Human
cagcugccuguauuguccucau

SEQ ID NO: 203180 - RNA, 22 nt, Human
ucaggaagaaauucuguaucuu

SEQ ID NO: 203181 - RNA, 22 nt, Human
gguguccucggauucagggcag

SEQ ID NO: 203182 - RNA, 22 nt, Human
ccugaggaugccagcaugggug

SEQ ID NO: 203183 - RNA, 22 nt, Human
uuuaauaucucacacuuccaug

SEQ ID NO: 203184 - RNA, 22 nt, Human
uaaagccaauauaccuagcaua

SEQ ID NO: 203185 - RNA, 22 nt, Human
caucaaagcuuuuuucuguguu

SEQ ID NO: 203186 - RNA, 22 nt, Human
uagcccagaaagcaaaugucuc

SEQ ID NO: 203187 - RNA, 22 nt, Human
agaaauacuuuguaaaucucac

SEQ ID NO: 203188 - RNA, 22 nt, Human
uuuccaaagguggcaggaacaa

SEQ ID NO: 203189 - RNA, 22 nt, Human
uggccacccagcugacgccuuc

SEQ ID NO: 203190 - RNA, 22 nt, Human
caaauagugucacauugugagg

SEQ ID NO: 203191 - RNA, 22 nt, Human
acacacugagugccauaggacc

SEQ ID NO: 203192 - RNA, 22 nt, Human
uggaaaaaaauuggcuagcuuc

SEQ ID NO: 203193 - RNA, 21 nt, Human
aagagacauuucucaucagca

SEQ ID NO: 203194 - RNA, 22 nt, Human
gugagcagggcaggacugggga

SEQ ID NO: 203195 - RNA, 22 nt, Human
cagagaccccuggcaugguggu

SEQ ID NO: 203196 - RNA, 22 nt, Human
caggcccugccuuggcaugugu

SEQ ID NO: 203197 - RNA, 22 nt, Human
ucauguuuuagcugcaaaauga

SEQ ID NO: 203198 - RNA, 22 nt, Human
gggcacaugcuuagggaggaaa

SEQ ID NO: 203199 - RNA, 22 nt, Human
auaauucagguuuucuggcaca

SEQ ID NO: 203200 - RNA, 22 nt, Human
cagcugaaucagugaguggaaa

SEQ ID NO: 203201 - RNA, 22 nt, Human
gccuguggguuggagcuuggcc

SEQ ID NO: 203202 - RNA, 22 nt, Human
ggcuaggcgggcacauggugga

SEQ ID NO: 203203 - RNA, 22 nt, Human
cucagcccggugcucgugccac

SEQ ID NO: 203204 - RNA, 23 nt, Human
uccuccuuuugcuugugcuuccc

SEQ ID NO: 203205 - RNA, 22 nt, Human
uuagccauucugauagguaugu

SEQ ID NO: 203206 - RNA, 22 nt, Human
acgcgcaaccaggcaugcacau

SEQ ID NO: 203207 - RNA, 22 nt, Human
uauuguacauuucaaaguagcu

SEQ ID NO: 203208 - RNA, 22 nt, Human
cugggcucuucucacccuguuu

SEQ ID NO: 203209 - RNA, 22 nt, Human
gagcuguuaagagggagugaca

SEQ ID NO: 203210 - RNA, 23 nt, Human
cagggcugguagggaagagcgug

SEQ ID NO: 203211 - RNA, 22 nt, Human
aggggaugccugaggaucugua

SEQ ID NO: 203212 - RNA, 22 nt, Human
agcagguggauuuagacgggag

SEQ ID NO: 203213 - RNA, 21 nt, Human
cuguuucuugugaagugacac

SEQ ID NO: 203214 - RNA, 22 nt, Human
uaaacugcuucucucagucugu

SEQ ID NO: 203215 - RNA, 22 nt, Human
augccuggucccaccucuaggu

SEQ ID NO: 203216 - RNA, 18 nt, Human
caggcccugucuggccuc

SEQ ID NO: 203217 - RNA, 22 nt, Human
uacaugcuccacuuucuccugu

SEQ ID NO: 203218 - RNA, 22 nt, Human
ugggcaccugaggccuggcagg

SEQ ID NO: 203219 - RNA, 22 nt, Human
ugcagcuguaacagaggccuca

SEQ ID NO: 203220 - RNA, 22 nt, Human
aaggcacucauucaaggagaua

SEQ ID NO: 203221 - RNA, 22 nt, Human
ugcacacaggucuaggacaugg

SEQ ID NO: 203222 - RNA, 22 nt, Human
cucagcuccagcccucagcagc

SEQ ID NO: 203223 - RNA, 22 nt, Human
ggcuucugguaaagaccacacc

SEQ ID NO: 203224 - RNA, 22 nt, Human
aauacacuauuuugugcucagu

SEQ ID NO: 203225 - RNA, 22 nt, Human
gaagacauguuuuuaauaugua

SEQ ID NO: 203226 - RNA, 22 nt, Human
uccccaguaagccugcacugug

SEQ ID NO: 203227 - RNA, 22 nt, Human
agguagggaagaaggcaugaaa

SEQ ID NO: 203228 - RNA, 22 nt, Human
gcucucugcagccuccuuggag

SEQ ID NO: 203229 - RNA, 22 nt, Human
uuucaaagucaagaaggauacu

SEQ ID NO: 203230 - RNA, 22 nt, Human
gcuuccucccugcugcucacua

SEQ ID NO: 203231 - RNA, 22 nt, Human
acugccaaugguaguuugaugg

SEQ ID NO: 203232 - RNA, 22 nt, Human
acucuguaauucuauaugcagu

SEQ ID NO: 203233 - RNA, 22 nt, Human
augaggcaaagguggagguggg

SEQ ID NO: 203234 - RNA, 22 nt, Human
uccauuuuguagguaugcuaca

SEQ ID NO: 203235 - RNA, 19 nt, Human
uuagccauccacagugaaa

SEQ ID NO: 203236 - RNA, 22 nt, Human
aaggguccaaggcuuugcguuu

SEQ ID NO: 203237 - RNA, 22 nt, Human
gaguccuggcguccaauuuccu

SEQ ID NO: 203238 - RNA, 22 nt, Human
cucuuagauauggagaauuacc

SEQ ID NO: 203239 - RNA, 22 nt, Human
agagcacagccaccauuuacaa

SEQ ID NO: 203240 - RNA, 22 nt, Human
auguuucugaaguuuacagaua

SEQ ID NO: 203241 - RNA, 20 nt, Human
ucacaauaugagcucauaca

SEQ ID NO: 203242 - RNA, 22 nt, Human
cuggcccauugccuucucucuc

SEQ ID NO: 203243 - RNA, 22 nt, Human
ugaucuuuucaaagacaagcuu

SEQ ID NO: 203244 - RNA, 22 nt, Human
agaggccuaauugcuacccuuu

SEQ ID NO: 203245 - RNA, 22 nt, Human
agauauaauaauuuacaagugu

SEQ ID NO: 203246 - RNA, 18 nt, Human
guucaucuuuuucuaaag

SEQ ID NO: 203247 - RNA, 22 nt, Human
aagaggcgccggguacguggcg

SEQ ID NO: 203248 - RNA, 22 nt, Human
uucagaaaaaacuucaauaagu

SEQ ID NO: 203249 - RNA, 22 nt, Human
agucugugaaaagauaggaagu

SEQ ID NO: 203250 - RNA, 22 nt, Human
gagugcauggacuacuggcuug

SEQ ID NO: 203251 - RNA, 22 nt, Human
uggccaggccucuuggugccca

SEQ ID NO: 203252 - RNA, 22 nt, Human
ucugaagguuacuucugcucag

SEQ ID NO: 203253 - RNA, 22 nt, Human
uaaauagaaucuaaacugcuca

SEQ ID NO: 203254 - RNA, 21 nt, Human
cucccagggugacuguucaac

SEQ ID NO: 203255 - RNA, 22 nt, Human
uggcuucaagucuagguucuac

SEQ ID NO: 203256 - RNA, 21 nt, Human
agugccaguagguauggagga

SEQ ID NO: 203257 - RNA, 21 nt, Human
gcucaggcucuugacagagca

SEQ ID NO: 203258 - RNA, 21 nt, Human
gccaaggaggcuagagaacau

SEQ ID NO: 203259 - RNA, 22 nt, Human
ggugcugacugaggauggcuug

SEQ ID NO: 203260 - RNA, 22 nt, Human
ucugggauuuuugacacugaag

SEQ ID NO: 203261 - RNA, 22 nt, Human
ccuuccuuucagggcuaugccu

SEQ ID NO: 203262 - RNA, 22 nt, Human
accaguuuguaaccuguuuuca

SEQ ID NO: 203263 - RNA, 22 nt, Human
cuuauagaauuagagagauuuu

SEQ ID NO: 203264 - RNA, 22 nt, Human
agauggaguuaguaccagaguc

SEQ ID NO: 203265 - RNA, 22 nt, Human
gugaacaggagaaagugaugga

SEQ ID NO: 203266 - RNA, 19 nt, Human
gcuaggguugguggcgugc

SEQ ID NO: 203267 - RNA, 21 nt, Human
aggcagccagucaugcucccu

SEQ ID NO: 203268 - RNA, 22 nt, Human
cuuguauuaugguucgcuuagu

SEQ ID NO: 203269 - RNA, 22 nt, Human
cucauuuacuguagaacaguua

SEQ ID NO: 203270 - RNA, 18 nt, Human
cucuagaaugggagauuu

SEQ ID NO: 203271 - RNA, 22 nt, Human
ucaggcaggcagagggcaaaug

SEQ ID NO: 203272 - RNA, 22 nt, Human
auggauaaucaugaacuuugag

SEQ ID NO: 203273 - RNA, 22 nt, Human
auggcagagggauugaacagcu

SEQ ID NO: 203274 - RNA, 22 nt, Human
cguggcaguggaaggcugggug

SEQ ID NO: 203275 - RNA, 22 nt, Human
gagggccagcagccucagcaug

SEQ ID NO: 203276 - RNA, 22 nt, Human
ggggugggguuacucauugugc

SEQ ID NO: 203277 - RNA, 22 nt, Human
uuuuaaacugcagaauuuagaa

SEQ ID NO: 203278 - RNA, 23 nt, Human
agacugaggcugccagggucaga

SEQ ID NO: 203279 - RNA, 22 nt, Human
gcacaggcaauagauacagcua

SEQ ID NO: 203280 - RNA, 22 nt, Human
gcacagcuccugguaagcuggg

SEQ ID NO: 203281 - RNA, 22 nt, Human
uuuuggcucuugguaggucaga

SEQ ID NO: 203282 - RNA, 22 nt, Human
cucaggcuugggaggaggccca

SEQ ID NO: 203283 - RNA, 22 nt, Human
uggcuccuuuccgggucuccag

SEQ ID NO: 203284 - RNA, 22 nt, Human
gaugaguaauagcuaaugguuc

SEQ ID NO: 203285 - RNA, 22 nt, Human
ugguccugggcacaguauaugc

SEQ ID NO: 203286 - RNA, 22 nt, Human
ucauagaaugaguuaaugaacu

SEQ ID NO: 203287 - RNA, 20 nt, Human
ggcucaucuugucugcugac

SEQ ID NO: 203288 - RNA, 22 nt, Human
uaguggaggccuguugugugca

SEQ ID NO: 203289 - RNA, 22 nt, Human
agucacuuugcuacucugccuu

SEQ ID NO: 203290 - RNA, 22 nt, Human
ggccugggcccacugucaagag

SEQ ID NO: 203291 - RNA, 22 nt, Human
uagcaccacuucaugcuuucag

SEQ ID NO: 203292 - RNA, 22 nt, Human
uagggcucacugagaugaauau

SEQ ID NO: 203293 - RNA, 22 nt, Human
uucuaagaggcuaaugaagaau

SEQ ID NO: 203294 - RNA, 22 nt, Human
auucaaaagaccaugcagacuc

SEQ ID NO: 203295 - RNA, 22 nt, Human
uuauaugauugagcaucuuggu

SEQ ID NO: 203296 - RNA, 22 nt, Human
aaagccaguuucuggaaguacc

SEQ ID NO: 203297 - RNA, 22 nt, Human
gugcaaaauuuggccaauaaca

SEQ ID NO: 203298 - RNA, 21 nt, Human
cucuuuauauaguaaagauau

SEQ ID NO: 203299 - RNA, 22 nt, Human
ccaggcagucaggguugugugu

SEQ ID NO: 203300 - RNA, 22 nt, Human
ggcugagggccagggcuagucu

SEQ ID NO: 203301 - RNA, 22 nt, Human
ucugagcuccaugcaggaggcu

SEQ ID NO: 203302 - RNA, 22 nt, Human
uaguacacucuguaaguuuaaa

SEQ ID NO: 203303 - RNA, 22 nt, Human
uucuguuacuguuggucauaac

SEQ ID NO: 203304 - RNA, 22 nt, Human
uagugaaaguauuaaacagcug

SEQ ID NO: 203305 - RNA, 22 nt, Human
uacaacauguaaagugguuuaa

SEQ ID NO: 203306 - RNA, 22 nt, Human
agagaugccaccuuuuugcugu

SEQ ID NO: 203307 - RNA, 22 nt, Human
cagagcucugacagcuacagcc

SEQ ID NO: 203308 - RNA, 22 nt, Human
caggcugccgugaagcaggccu

SEQ ID NO: 203309 - RNA, 23 nt, Human
uagauguauuaagugcauuuuca

SEQ ID NO: 203310 - RNA, 22 nt, Human
agcagggguaacagaaggaaag

SEQ ID NO: 203311 - RNA, 22 nt, Human
gucugagggguuucccaggaca

SEQ ID NO: 203312 - RNA, 22 nt, Human
uggaaagagguagaggaucugg

SEQ ID NO: 203313 - RNA, 22 nt, Human
caccagggcucugagcucugaa

SEQ ID NO: 203314 - RNA, 22 nt, Human
gagggcguucagucagugucuc

SEQ ID NO: 203315 - RNA, 21 nt, Human
agguuccagcagccagagaau

SEQ ID NO: 203316 - RNA, 22 nt, Human
uucuuuggcuuacgucuggccu

SEQ ID NO: 203317 - RNA, 22 nt, Human
augguauucucuaacucagcuu

SEQ ID NO: 203318 - RNA, 22 nt, Human
uacaguaaucuggacaugauuu

SEQ ID NO: 203319 - RNA, 21 nt, Human
agaauaaugguaucauuugcu

SEQ ID NO: 203320 - RNA, 22 nt, Human
aauaauauuccucugugugcgu

SEQ ID NO: 203321 - RNA, 22 nt, Human
ugguaagaauaggggcuuugga

SEQ ID NO: 203322 - RNA, 22 nt, Human
aggcagcaagauuauuuaaucc

SEQ ID NO: 203323 - RNA, 22 nt, Human
cacaggagagcugggaggugcc

SEQ ID NO: 203324 - RNA, 22 nt, Human
aggacacagacugauugcagca

SEQ ID NO: 203325 - RNA, 22 nt, Human
acagagcuaaauuucaauccca

SEQ ID NO: 203326 - RNA, 22 nt, Human
aaggugucucucugcuucuugg

SEQ ID NO: 203327 - RNA, 18 nt, Human
agcaguguggcaagcaga

SEQ ID NO: 203328 - RNA, 22 nt, Human
aaggcagaggaaggucuaguuu

SEQ ID NO: 203329 - RNA, 22 nt, Human
uuuaauacagaacuugucaggg

SEQ ID NO: 203330 - RNA, 22 nt, Human
agaguuauggacuuaaugcagg

SEQ ID NO: 203331 - RNA, 17 nt, Human
ggcagccucaggcguuu

SEQ ID NO: 203332 - RNA, 22 nt, Human
agugucugcgggcagaggagcg

SEQ ID NO: 203333 - RNA, 22 nt, Human
gaauuauaggcaaagcagucau

SEQ ID NO: 203334 - RNA, 22 nt, Human
cccagggauguggcagauguua

SEQ ID NO: 203335 - RNA, 22 nt, Human
gccugugcuuaacugacgugag

SEQ ID NO: 203336 - RNA, 22 nt, Human
augaacaaucuggcaagaacuu

SEQ ID NO: 203337 - RNA, 22 nt, Human
gcuauucauggagcauguacug

SEQ ID NO: 203338 - RNA, 18 nt, Human
cucugggagaggcauaca

SEQ ID NO: 203339 - RNA, 22 nt, Human
uuccagcccgcgacuuguucag

SEQ ID NO: 203340 - RNA, 21 nt, Human
ugcagaggcacaaacaagccc

SEQ ID NO: 203341 - RNA, 22 nt, Human
auaacagacuuagaguuacaag

SEQ ID NO: 203342 - RNA, 22 nt, Human
gcagccucugaugauggccgua

SEQ ID NO: 203343 - RNA, 19 nt, Human
ugguccagcuucuucuccu

SEQ ID NO: 203344 - RNA, 22 nt, Human
auucagcagccauggcuucuga

SEQ ID NO: 203345 - RNA, 22 nt, Human
guucaauuuagaaagcacaguu

SEQ ID NO: 203346 - RNA, 22 nt, Human
ccugcaagagcggagaagccag

SEQ ID NO: 203347 - RNA, 22 nt, Human
ucugccuuuucacugccacuaa

SEQ ID NO: 203348 - RNA, 22 nt, Human
gccugcagaacugugaggcaau

SEQ ID NO: 203349 - RNA, 22 nt, Human
gcugcccugucugcagcaggac

SEQ ID NO: 203350 - RNA, 22 nt, Human
gcuucaggguuaugcaagagug

SEQ ID NO: 203351 - RNA, 22 nt, Human
cagcagcuguuuacggaacacc

SEQ ID NO: 203352 - RNA, 21 nt, Human
cuccucaggaccagccacagg

SEQ ID NO: 203353 - RNA, 22 nt, Human
guguccuuauuucugucucuca

SEQ ID NO: 203354 - RNA, 22 nt, Human
ggugacagccgcuugcccugua

SEQ ID NO: 203355 - RNA, 18 nt, Human
cagagcagagguggagcg

SEQ ID NO: 203356 - RNA, 22 nt, Human
gaauguaauagucaguagaaca

SEQ ID NO: 203357 - RNA, 22 nt, Human
uauagaacaaguuauuuaugcu

SEQ ID NO: 203358 - RNA, 22 nt, Human
uuauuguuuacuaguuugcaga

SEQ ID NO: 203359 - RNA, 22 nt, Human
caguggcagaucaccaacugga

SEQ ID NO: 203360 - RNA, 20 nt, Human
ggcaggcaggagguuuccag

SEQ ID NO: 203361 - RNA, 17 nt, Human
uggcaucuuuugcucau

SEQ ID NO: 203362 - RNA, 16 nt, Human
augcugcuauuagagg

SEQ ID NO: 203363 - RNA, 22 nt, Human
ucugugcaccagaaugauauuu

SEQ ID NO: 203364 - RNA, 22 nt, Human
ccuggacucagaggugcuggug

SEQ ID NO: 203365 - RNA, 22 nt, Human
cucucagaaguuuaugucagaa

SEQ ID NO: 203366 - RNA, 22 nt, Human
uucaauucuaaacuaauauucu

SEQ ID NO: 203367 - RNA, 22 nt, Human
uaaauuacucaaugcacauaaa

SEQ ID NO: 203368 - RNA, 19 nt, Human
uuuagcuuacguuucauug

SEQ ID NO: 203369 - RNA, 22 nt, Human
cacagacuccccgccauagugg

SEQ ID NO: 203370 - RNA, 22 nt, Human
gucuguagaugagucuuaagaa

SEQ ID NO: 203371 - RNA, 22 nt, Human
ggcaggcacugugauagauucu

SEQ ID NO: 203372 - RNA, 22 nt, Human
uccaggagguugagacugcagu

SEQ ID NO: 203373 - RNA, 22 nt, Human
uaacaguauccccauuugcaag

SEQ ID NO: 203374 - RNA, 22 nt, Human
gggcaggugugcagagcuguug

SEQ ID NO: 203375 - RNA, 22 nt, Human
ccugggcucaggcuugggcagc

SEQ ID NO: 203376 - RNA, 19 nt, Human
aauuagggagucgguuaag

SEQ ID NO: 203377 - RNA, 21 nt, Human
auuuuguacauagaauuuguc

SEQ ID NO: 203378 - RNA, 22 nt, Human
agaaaucuuuccugaaguguuu

SEQ ID NO: 203379 - RNA, 22 nt, Human
gagcucagguggucaaaacaau

SEQ ID NO: 203380 - RNA, 22 nt, Human
cugccguguuuuucauguuaaa

SEQ ID NO: 203381 - RNA, 22 nt, Human
ccacaugaugaggaagcugaac

SEQ ID NO: 203382 - RNA, 22 nt, Human
cagaauccagaauugcugaggu

SEQ ID NO: 203383 - RNA, 20 nt, Human
guuuagcauggcagugaaag

SEQ ID NO: 203384 - RNA, 22 nt, Human
gcuugggacuggagaauagggu

SEQ ID NO: 203385 - RNA, 22 nt, Human
guccagccacucaccuuccagc

SEQ ID NO: 203386 - RNA, 22 nt, Human
guccagccagcugguccuugcc

SEQ ID NO: 203387 - RNA, 22 nt, Human
aaauucauauguugaaaugcua

SEQ ID NO: 203388 - RNA, 22 nt, Human
agcuuugcagcugugggaggag

SEQ ID NO: 203389 - RNA, 22 nt, Human
cuccugggcucauaucauucag

SEQ ID NO: 203390 - RNA, 22 nt, Human
gccuccggaguugcagugucuu

SEQ ID NO: 203391 - RNA, 22 nt, Human
gcacugcuccagguguggcuug

SEQ ID NO: 203392 - RNA, 22 nt, Human
auuguauaacagcauguauuuu

SEQ ID NO: 203393 - RNA, 22 nt, Human
uugaaugaccaugaugcaaggg

SEQ ID NO: 203394 - RNA, 18 nt, Human
cuguccaguagacucugc

SEQ ID NO: 203395 - RNA, 22 nt, Human
augcaacagucaguacauccgg

SEQ ID NO: 203396 - RNA, 21 nt, Human
uguuucaugcuauuuucuugu

SEQ ID NO: 203397 - RNA, 22 nt, Human
cugguacauaguaagaacacaa

SEQ ID NO: 203398 - RNA, 22 nt, Human
ccuuuggagaguuuguuagggg

SEQ ID NO: 203399 - RNA, 22 nt, Human
acugguaacaauggaagcuucu

SEQ ID NO: 203400 - RNA, 22 nt, Human
ucagucuucuaaagggaugcaa

SEQ ID NO: 203401 - RNA, 22 nt, Human
uuagagcaggaguugacagauu

SEQ ID NO: 203402 - RNA, 22 nt, Human
guaauagucucaaacuccugga

SEQ ID NO: 203403 - RNA, 22 nt, Human
gaaucauuuagcucugcaugga

SEQ ID NO: 203404 - RNA, 22 nt, Human
ucacaaugcaaguguucagugg

SEQ ID NO: 203405 - RNA, 22 nt, Human
cagccaccauacagcagaagcu

SEQ ID NO: 203406 - RNA, 21 nt, Human
cucagggcuugguguccucau

SEQ ID NO: 203407 - RNA, 22 nt, Human
agguucuuuuggccaaccucau

SEQ ID NO: 203408 - RNA, 22 nt, Human
gccagggcugugcagguuuguu

SEQ ID NO: 203409 - RNA, 22 nt, Human
gugcuuuaguucuugcaacugg

SEQ ID NO: 203410 - RNA, 22 nt, Human
aaguguggggucucagagcuga

SEQ ID NO: 203411 - RNA, 22 nt, Human
auagggcuguugugaggauuaa

SEQ ID NO: 203412 - RNA, 22 nt, Human
ggucugaggcuccaaggaggug

SEQ ID NO: 203413 - RNA, 17 nt, Human
gugcagggaugaaggau

SEQ ID NO: 203414 - RNA, 22 nt, Human
ugcagguggauaucucaucaga

SEQ ID NO: 203415 - RNA, 22 nt, Human
agugauuugaggauuauugcuc

SEQ ID NO: 203416 - RNA, 22 nt, Human
ggcuggagugggcuccagaguu

SEQ ID NO: 203417 - RNA, 22 nt, Human
uagugaaaccugacagaucaug

SEQ ID NO: 203418 - RNA, 22 nt, Human
cuagaaucugggauuucugacu

SEQ ID NO: 203419 - RNA, 22 nt, Human
ccagagggcuugguuugggcca

SEQ ID NO: 203420 - RNA, 22 nt, Human
ggcagcccaccagcccacgucu

SEQ ID NO: 203421 - RNA, 22 nt, Human
uagugucaugaaaaguacacua

SEQ ID NO: 203422 - RNA, 22 nt, Human
guccagccacccuggaggcacg

SEQ ID NO: 203423 - RNA, 19 nt, Human
acacugaauguagaauugg

SEQ ID NO: 203424 - RNA, 22 nt, Human
uuuauaugugaagguuugcaga

SEQ ID NO: 203425 - RNA, 19 nt, Human
ucaguggagaaaggggaag

SEQ ID NO: 203426 - RNA, 23 nt, Human
cugagcacagcucugugggccuc

SEQ ID NO: 203427 - RNA, 22 nt, Human
auguuuauggagcagguauuag

SEQ ID NO: 203428 - RNA, 22 nt, Human
cuuccuggcaugggucucauga

SEQ ID NO: 203429 - RNA, 22 nt, Human
aggagcucugggcagggccucc

SEQ ID NO: 203430 - RNA, 22 nt, Human
agcuguggggcaggcagcgagg

SEQ ID NO: 203431 - RNA, 22 nt, Human
cagacaggagacuggaucaugg

SEQ ID NO: 203432 - RNA, 22 nt, Human
uuuccaggaaguaaggauaauc

SEQ ID NO: 203433 - RNA, 22 nt, Human
uauuugcaggacauagauaugg

SEQ ID NO: 203434 - RNA, 22 nt, Human
ugcugcauuugcaguccuuuaa

SEQ ID NO: 203435 - RNA, 22 nt, Human
cacucugagcccaagcaggcug

SEQ ID NO: 203436 - RNA, 21 nt, Human
aggccucuucauggccaugau

SEQ ID NO: 203437 - RNA, 22 nt, Human
ccacaucucgguccccucuuug

SEQ ID NO: 203438 - RNA, 22 nt, Human
acaguauuugcgauacugauga

SEQ ID NO: 203439 - RNA, 22 nt, Human
agacucaagacugcagaagacg

SEQ ID NO: 203440 - RNA, 18 nt, Human
acugcaggagaggugagg

SEQ ID NO: 203441 - RNA, 22 nt, Human
agauguggaacacuagacugcu

SEQ ID NO: 203442 - RNA, 22 nt, Human
aaacugccuccugggcaacuaa

SEQ ID NO: 203443 - RNA, 22 nt, Human
acugugcauuccccaaccugug

SEQ ID NO: 203444 - RNA, 22 nt, Human
ccugguggcgaauggugguagg

SEQ ID NO: 203445 - RNA, 17 nt, Human
acagcagggaaguguug

SEQ ID NO: 203446 - RNA, 22 nt, Human
auuucucauuaagaucuuccaa

SEQ ID NO: 203447 - RNA, 22 nt, Human
cugguuuauaaaucuguggcca

SEQ ID NO: 203448 - RNA, 22 nt, Human
gugguaauuuaauccuacacug

SEQ ID NO: 203449 - RNA, 22 nt, Human
ccuccuggggugaaggauggga

SEQ ID NO: 203450 - RNA, 22 nt, Human
ucucagagauuuauggaaaacu

SEQ ID NO: 203451 - RNA, 22 nt, Human
cacaugaguguaggaagaggga

SEQ ID NO: 203452 - RNA, 22 nt, Human
ucaggagcagggggaagcucug

SEQ ID NO: 203453 - RNA, 22 nt, Human
uguggacuuuauuuuagggagg

SEQ ID NO: 203454 - RNA, 22 nt, Human
uuucuucuugauuuaaacaggg

SEQ ID NO: 203455 - RNA, 22 nt, Human
ucuacaaagaagaauuaauguc

SEQ ID NO: 203456 - RNA, 22 nt, Human
ugguggacaccgcagccaugaa

SEQ ID NO: 203457 - RNA, 22 nt, Human
ucucacagugcaggucugucuc

SEQ ID NO: 203458 - RNA, 22 nt, Human
cuagaaaucucuguuuacauca

SEQ ID NO: 203459 - RNA, 22 nt, Human
cugagaggugacagcgugcugg

SEQ ID NO: 203460 - RNA, 22 nt, Human
agcuucuggaagccuggcagca

SEQ ID NO: 203461 - RNA, 22 nt, Human
gaggcuccagcgacaccuaggc

SEQ ID NO: 203462 - RNA, 22 nt, Human
ucuuuccuagaggcugaugagu

SEQ ID NO: 203463 - RNA, 22 nt, Human
uguuuacuucaucgaguacuuc

SEQ ID NO: 203464 - RNA, 22 nt, Human
ucagugcagcggcagcagcucu

SEQ ID NO: 203465 - RNA, 22 nt, Human
acugccuucuuuaauccuaguu

SEQ ID NO: 203466 - RNA, 22 nt, Human
acguuugcuuucuuuggccugg

SEQ ID NO: 203467 - RNA, 22 nt, Human
ucucuggcagaggcccuauccc

SEQ ID NO: 203468 - RNA, 22 nt, Human
uggggaaagggauggcucccgc

SEQ ID NO: 203469 - RNA, 22 nt, Human
agaagagccuggggaccauggc

SEQ ID NO: 203470 - RNA, 22 nt, Human
acagagagggagugauaaaucc

SEQ ID NO: 203471 - RNA, 22 nt, Human
auagcugacuccagacauagcu

SEQ ID NO: 203472 - RNA, 22 nt, Human
cugcagggauugcuucuguaua

SEQ ID NO: 203473 - RNA, 22 nt, Human
gccuggcuccuaagagcacaac

SEQ ID NO: 203474 - RNA, 22 nt, Human
aaacucuagcuacuaggauaac

SEQ ID NO: 203475 - RNA, 22 nt, Human
aauguauuccucaugcaagagu

SEQ ID NO: 203476 - RNA, 22 nt, Human
caagggcucuaagucacaagau

SEQ ID NO: 203477 - RNA, 22 nt, Human
cugccaucugagccaaaagugc

SEQ ID NO: 203478 - RNA, 22 nt, Human
acauucaaaauauuucugaugu

SEQ ID NO: 203479 - RNA, 22 nt, Human
uucuucuccuaaggagaguccu

SEQ ID NO: 203480 - RNA, 19 nt, Human
ccuguggcagaguggaaac

SEQ ID NO: 203481 - RNA, 22 nt, Human
ucuagaauacugugacaugcca

SEQ ID NO: 203482 - RNA, 21 nt, Human
gagauggcccaguagcgggcc

SEQ ID NO: 203483 - RNA, 22 nt, Human
acccucugccuugagcagugcc

SEQ ID NO: 203484 - RNA, 19 nt, Human
caggacaguuugccaagaa

SEQ ID NO: 203485 - RNA, 22 nt, Human
uugaaaggaauacagaggccua

SEQ ID NO: 203486 - RNA, 23 nt, Human
ugacaggccagaagagcagcugg

SEQ ID NO: 203487 - RNA, 22 nt, Human
aggcagcuuucagugucucuca

SEQ ID NO: 203488 - RNA, 22 nt, Human
uguagauaaguaaaagcccagu

SEQ ID NO: 203489 - RNA, 19 nt, Human
ugcuuugcaucugauuguu

SEQ ID NO: 203490 - RNA, 22 nt, Human
ucugggcuuuguaaugggaggu

SEQ ID NO: 203491 - RNA, 22 nt, Human
ucacaggacccugaggguggcg

SEQ ID NO: 203492 - RNA, 22 nt, Human
aucagagcugcauuuuagagcc

SEQ ID NO: 203493 - RNA, 22 nt, Human
uacaggaagucucaguacagua

SEQ ID NO: 203494 - RNA, 22 nt, Human
ugggagcagcagggagaugcgg

SEQ ID NO: 203495 - RNA, 22 nt, Human
aaaguauuuuugacaggcauua

SEQ ID NO: 203496 - RNA, 21 nt, Human
uggcugccuacaugcugcagg

SEQ ID NO: 203497 - RNA, 22 nt, Human
caagcguggcugcucugaugga

SEQ ID NO: 203498 - RNA, 22 nt, Human
ccaggcuuuucucauggaguca

SEQ ID NO: 203499 - RNA, 22 nt, Human
cuucaguuuaucccaucaucca

SEQ ID NO: 203500 - RNA, 22 nt, Human
auuacuaugauuugaucauuac

SEQ ID NO: 203501 - RNA, 22 nt, Human
auguguucacgugcacaugugc

SEQ ID NO: 203502 - RNA, 22 nt, Human
uggaaaauuaguagugaaaggc

SEQ ID NO: 203503 - RNA, 22 nt, Human
gaugcauagugaagcugacaga

SEQ ID NO: 203504 - RNA, 22 nt, Human
cugcagggcccgccugagcccu

SEQ ID NO: 203505 - RNA, 22 nt, Human
ucucccaguggugcagaaagca

SEQ ID NO: 203506 - RNA, 20 nt, Human
uauuucugggcaaccauuua

SEQ ID NO: 203507 - RNA, 22 nt, Human
uucuucaaaacaacacuggccu

SEQ ID NO: 203508 - RNA, 18 nt, Human
cagagcuccuggaugcag

SEQ ID NO: 203509 - RNA, 22 nt, Human
gcugccuuaugucuauuaguau

SEQ ID NO: 203510 - RNA, 22 nt, Human
caugucaagcuuaucucugugg

SEQ ID NO: 203511 - RNA, 22 nt, Human
uuuuccucaggaaugcuaagcu

SEQ ID NO: 203512 - RNA, 22 nt, Human
auguccagaguguccuggaaag

SEQ ID NO: 203513 - RNA, 22 nt, Human
ucuggaugaaagggcuauauau

SEQ ID NO: 203514 - RNA, 20 nt, Human
cccuggagagaagcuccacg

SEQ ID NO: 203515 - RNA, 22 nt, Human
ccaggcucuaucccuccuucuu

SEQ ID NO: 203516 - RNA, 22 nt, Human
ggcuggccucaggguccucgcu

SEQ ID NO: 203517 - RNA, 22 nt, Human
ucauuuguacuugugugcuugu

SEQ ID NO: 203518 - RNA, 22 nt, Human
agcauaaguugguacagccacu

SEQ ID NO: 203519 - RNA, 21 nt, Human
uucaguaugcgucaugcuguu

SEQ ID NO: 203520 - RNA, 22 nt, Human
uccuuucucccagguuaguugu

SEQ ID NO: 203521 - RNA, 22 nt, Human
gaggccagggaugcaaugagag

SEQ ID NO: 203522 - RNA, 22 nt, Human
aacauugaauuuaaaauacagu

SEQ ID NO: 203523 - RNA, 23 nt, Human
cuggggcuuucaaaucugggcag

SEQ ID NO: 203524 - RNA, 22 nt, Human
gaagacacaauuggugggucca

SEQ ID NO: 203525 - RNA, 22 nt, Human
gggagccaaggagagaggccuu

SEQ ID NO: 203526 - RNA, 22 nt, Human
agggagaguagauaucaggugu

SEQ ID NO: 203527 - RNA, 22 nt, Human
gauuuucaugauaaacuuguga

SEQ ID NO: 203528 - RNA, 22 nt, Human
uacagguggaucacuaguauag

SEQ ID NO: 203529 - RNA, 22 nt, Human
ugaaaauauaguuuuccagacu

SEQ ID NO: 203530 - RNA, 20 nt, Human
ccacaagggaauauuguuga

SEQ ID NO: 203531 - RNA, 22 nt, Human
augggaagguuuugagagcggg

SEQ ID NO: 203532 - RNA, 22 nt, Human
aagugguuuuaagagguuccuu

SEQ ID NO: 203533 - RNA, 22 nt, Human
ucugcagggaugugagggguga

SEQ ID NO: 203534 - RNA, 22 nt, Human
uccugacccaccaagucuguaa

SEQ ID NO: 203535 - RNA, 22 nt, Human
acccuguugguggaucagauug

SEQ ID NO: 203536 - RNA, 22 nt, Human
cuuggucuugggagcagggaca

SEQ ID NO: 203537 - RNA, 22 nt, Human
gaauaauugugaugcuugaagu

SEQ ID NO: 203538 - RNA, 22 nt, Human
cauuuccuuccugcugcuccuc

SEQ ID NO: 203539 - RNA, 22 nt, Human
uuuuccucuguauuugaaaugc

SEQ ID NO: 203540 - RNA, 22 nt, Human
ucuccacaagcuuucuccuuuu

SEQ ID NO: 203541 - RNA, 22 nt, Human
gaguuuguaaacuauucacuaa

SEQ ID NO: 203542 - RNA, 22 nt, Human
cucugcaaucugagcacuugua

SEQ ID NO: 203543 - RNA, 22 nt, Human
aguagauuuuugaauguaaguu

SEQ ID NO: 203544 - RNA, 22 nt, Human
uugguuuacuaggauucaaauu

SEQ ID NO: 203545 - RNA, 22 nt, Human
cugaaggcugaggcuguguugu

SEQ ID NO: 203546 - RNA, 20 nt, Human
ccucagagcgcaggcccccu

SEQ ID NO: 203547 - RNA, 22 nt, Human
acagcuacucugcagauaaauc

SEQ ID NO: 203548 - RNA, 22 nt, Human
cugggccugugggcacacggac

SEQ ID NO: 203549 - RNA, 22 nt, Human
guccuuggagguguggaaucug

SEQ ID NO: 203550 - RNA, 22 nt, Human
agcaggcaggaaugguggaaca

SEQ ID NO: 203551 - RNA, 22 nt, Human
uuccuucuuugugguagaaagu

SEQ ID NO: 203552 - RNA, 22 nt, Human
ugagacagcagucagggaaaua

SEQ ID NO: 203553 - RNA, 22 nt, Human
uggcucaggggucuggcucugu

SEQ ID NO: 203554 - RNA, 22 nt, Human
auuaguguuguaagaagcugcc

SEQ ID NO: 203555 - RNA, 22 nt, Human
ugccuucauccauguuauagug

SEQ ID NO: 203556 - RNA, 22 nt, Human
ugaggcucacaaaucugcauuu

SEQ ID NO: 203557 - RNA, 22 nt, Human
uugauucauggacaggccaggu

SEQ ID NO: 203558 - RNA, 22 nt, Human
uuugacucuucuagcaagugug

SEQ ID NO: 203559 - RNA, 22 nt, Human
aacaguaucuuuuaucagaaau

SEQ ID NO: 203560 - RNA, 22 nt, Human
aagaagcagcugccaggccagu

SEQ ID NO: 203561 - RNA, 22 nt, Human
uagcagaggcugucugacuuaa

SEQ ID NO: 203562 - RNA, 22 nt, Human
caagagagaugcagcucacuca

SEQ ID NO: 203563 - RNA, 22 nt, Human
accaggcuugaugauuugcuua

SEQ ID NO: 203564 - RNA, 22 nt, Human
uaaaaggcaauacuagaugagu

SEQ ID NO: 203565 - RNA, 22 nt, Human
ucacagaaggaccuuguuucau

SEQ ID NO: 203566 - RNA, 22 nt, Human
ucaguuaacggaaaggggugug

SEQ ID NO: 203567 - RNA, 22 nt, Human
agcuuugguugaggggagugug

SEQ ID NO: 203568 - RNA, 22 nt, Human
ccaggugugagcauucugucuu

SEQ ID NO: 203569 - RNA, 22 nt, Human
uuucuuuugaauaguguguggu

SEQ ID NO: 203570 - RNA, 19 nt, Human
uucuagaacuguucucuca

SEQ ID NO: 203571 - RNA, 22 nt, Human
uucagggcagagaguucaggga

SEQ ID NO: 203572 - RNA, 22 nt, Human
accaggaaaaacacuguguugg

SEQ ID NO: 203573 - RNA, 22 nt, Human
uauaauuaguaaauggcagauu

SEQ ID NO: 203574 - RNA, 22 nt, Human
ccagcuggcaggagagucaggg

SEQ ID NO: 203575 - RNA, 22 nt, Human
caguaaaagauggaaauagaau

SEQ ID NO: 203576 - RNA, 22 nt, Human
auaucuguguuucccuuuugcu

SEQ ID NO: 203577 - RNA, 22 nt, Human
ucacagaauuuuugcuuccagu

SEQ ID NO: 203578 - RNA, 22 nt, Human
aauauccauugggagcaaaugg

SEQ ID NO: 203579 - RNA, 22 nt, Human
uggagccaaugaacauuugcug

SEQ ID NO: 203580 - RNA, 22 nt, Human
cagugaaaucacaacuuuaguu

SEQ ID NO: 203581 - RNA, 22 nt, Human
agcccuccucacaucagcgucc

SEQ ID NO: 203582 - RNA, 22 nt, Human
ugggguggaacccuucugcugg

SEQ ID NO: 203583 - RNA, 22 nt, Human
uccugggcagaaugggauggcu

SEQ ID NO: 203584 - RNA, 22 nt, Human
acuuggcuuaaaguagugaucg

SEQ ID NO: 203585 - RNA, 18 nt, Human
uccugggaacuugcuagc

SEQ ID NO: 203586 - RNA, 22 nt, Human
ggccccagcagacccuccucug

SEQ ID NO: 203587 - RNA, 23 nt, Human
cagaucauauauccagcuguaag

SEQ ID NO: 203588 - RNA, 22 nt, Human
aaucuguuuaguucugcguaug

SEQ ID NO: 203589 - RNA, 22 nt, Human
uggcuuggcuaagaucuaagcu

SEQ ID NO: 203590 - RNA, 22 nt, Human
ugaauucuuaaugaaaucuacu

SEQ ID NO: 203591 - RNA, 22 nt, Human
uggcagagcuggcugcggauga

SEQ ID NO: 203592 - RNA, 22 nt, Human
cacugugcuccuaacuagcugu

SEQ ID NO: 203593 - RNA, 20 nt, Human
auacacauucauagaaaaau

SEQ ID NO: 203594 - RNA, 22 nt, Human
cccagcaucccagugggcagca

SEQ ID NO: 203595 - RNA, 22 nt, Human
ugagucugauuuuucuagcauu

SEQ ID NO: 203596 - RNA, 22 nt, Human
gcagagcugcagcgaggccugg

SEQ ID NO: 203597 - RNA, 22 nt, Human
cuguccuggagggcauaggacg

SEQ ID NO: 203598 - RNA, 22 nt, Human
uccagggaaggugugaggcugg

SEQ ID NO: 203599 - RNA, 22 nt, Human
uccucagcauggaaucuggacu

SEQ ID NO: 203600 - RNA, 22 nt, Human
auuuaauuuggagagagaaacc

SEQ ID NO: 203601 - RNA, 22 nt, Human
guacuacaguuucucauuaaau

SEQ ID NO: 203602 - RNA, 22 nt, Human
cuccagauguauacuuuccaag

SEQ ID NO: 203603 - RNA, 22 nt, Human
aggcagacaaguccagaacugg

SEQ ID NO: 203604 - RNA, 22 nt, Human
aagaaaacaugaucuaauuuaa

SEQ ID NO: 203605 - RNA, 22 nt, Human
agcuguggccagaugugagcgg

SEQ ID NO: 203606 - RNA, 22 nt, Human
cagucccaucucccagguggcu

SEQ ID NO: 203607 - RNA, 22 nt, Human
ucaguggauuggaugagaucug

SEQ ID NO: 203608 - RNA, 19 nt, Human
agacagagacugaaauaga

SEQ ID NO: 203609 - RNA, 22 nt, Human
uggaauguuuuccuaaaucaga

SEQ ID NO: 203610 - RNA, 22 nt, Human
aagaagaaguguuauuuuuaga

SEQ ID NO: 203611 - RNA, 22 nt, Human
uugggacagcaaccaucugcua

SEQ ID NO: 203612 - RNA, 22 nt, Human
uuuauuuaaagucguguguuaa

SEQ ID NO: 203613 - RNA, 22 nt, Human
gaaaaaugcuccaaaucugugg

SEQ ID NO: 203614 - RNA, 23 nt, Human
gcuuuauaguucucccaacauua

SEQ ID NO: 203615 - RNA, 22 nt, Human
agaucauaugaaaaauuucaag

SEQ ID NO: 203616 - RNA, 22 nt, Human
caggcccacgaggcacacagag

SEQ ID NO: 203617 - RNA, 22 nt, Human
ccauuggagaguuuuaagaagg

SEQ ID NO: 203618 - RNA, 22 nt, Human
gauuuuauauggcauacugugg

SEQ ID NO: 203619 - RNA, 22 nt, Human
acacugaauaauugagaguuga

SEQ ID NO: 203620 - RNA, 21 nt, Human
ucucuggaguuagcagagaga

SEQ ID NO: 203621 - RNA, 22 nt, Human
ugagagccaggaucugcucuau

SEQ ID NO: 203622 - RNA, 22 nt, Human
uccuggagagugggcgagcaca

SEQ ID NO: 203623 - RNA, 22 nt, Human
acagcacuuuacuucucaguga

SEQ ID NO: 203624 - RNA, 22 nt, Human
aagaacauuuuguagaaugaca

SEQ ID NO: 203625 - RNA, 22 nt, Human
cagcaugaaacaauugagccca

SEQ ID NO: 203626 - RNA, 22 nt, Human
ugaugaguuuacucuuuucuaa

SEQ ID NO: 203627 - RNA, 22 nt, Human
ugagccugggagauggaggcug

SEQ ID NO: 203628 - RNA, 22 nt, Human
gagggcugauguugccaccuca

SEQ ID NO: 203629 - RNA, 22 nt, Human
gagaaggcugauccuuggaguu

SEQ ID NO: 203630 - RNA, 22 nt, Human
cuugaaagucagcagaguggau

SEQ ID NO: 203631 - RNA, 22 nt, Human
cagaaugggaaggacugcaguu

SEQ ID NO: 203632 - RNA, 22 nt, Human
ucaggaagccacuccacagaga

SEQ ID NO: 203633 - RNA, 22 nt, Human
ucaggccaagguagacaugacu

SEQ ID NO: 203634 - RNA, 22 nt, Human
agagcccugaagcagagcuaaa

SEQ ID NO: 203635 - RNA, 22 nt, Human
aaagcauuacuagacuggauuu

SEQ ID NO: 203636 - RNA, 22 nt, Human
ccacaguuauucauuugugaca

SEQ ID NO: 203637 - RNA, 22 nt, Human
aauaucuggagaugcuuuuugu

SEQ ID NO: 203638 - RNA, 22 nt, Human
uuuaucacagaauaagaaguca

SEQ ID NO: 203639 - RNA, 22 nt, Human
ggcagcaacucggagagaagag

SEQ ID NO: 203640 - RNA, 22 nt, Human
cuggcaggagcuguggccguag

SEQ ID NO: 203641 - RNA, 22 nt, Human
augauucuggcaaauuuauuau

SEQ ID NO: 203642 - RNA, 22 nt, Human
uucuuuuccuacacagcgauuu

SEQ ID NO: 203643 - RNA, 22 nt, Human
accuggaagugggugcuauggc

SEQ ID NO: 203644 - RNA, 20 nt, Human
auacacaugcagacagaugc

SEQ ID NO: 203645 - RNA, 22 nt, Human
uagaaacucucaaucugggaug

SEQ ID NO: 203646 - RNA, 23 nt, Human
auuucuaggggauuuucuggugc

SEQ ID NO: 203647 - RNA, 22 nt, Human
uagcacccauggaaucugcugg

SEQ ID NO: 203648 - RNA, 22 nt, Human
cagggacagcgggacucugaca

SEQ ID NO: 203649 - RNA, 22 nt, Human
caaggcagucccuacucccugc

SEQ ID NO: 203650 - RNA, 22 nt, Human
gcugccuucugagaaguuaaau

SEQ ID NO: 203651 - RNA, 22 nt, Human
ucagggugaaccaggcaggaau

SEQ ID NO: 203652 - RNA, 22 nt, Human
ucacugggagagcugacaagga

SEQ ID NO: 203653 - RNA, 22 nt, Human
aauguacagcugucuuuccucc

SEQ ID NO: 203654 - RNA, 22 nt, Human
cuggcuccacucccugccugac

SEQ ID NO: 203655 - RNA, 22 nt, Human
gugcuuccuguauugauuccau

SEQ ID NO: 203656 - RNA, 22 nt, Human
cauauauucugguuuucacugg

SEQ ID NO: 203657 - RNA, 22 nt, Human
gugugcugagugacugucauca

SEQ ID NO: 203658 - RNA, 22 nt, Human
uuuccagagcaugucugcucag

SEQ ID NO: 203659 - RNA, 22 nt, Human
aagguuaguaauauuucuauau

SEQ ID NO: 203660 - RNA, 22 nt, Human
ggauugagagcacugguagcug

SEQ ID NO: 203661 - RNA, 22 nt, Human
gccagaaacauacacaucacuu

SEQ ID NO: 203662 - RNA, 22 nt, Human
cuguauuucuuggacaguugcu

SEQ ID NO: 203663 - RNA, 22 nt, Human
ucucagaguuugaaucuggagu

SEQ ID NO: 203664 - RNA, 22 nt, Human
acagcugugauuucuaucauga

SEQ ID NO: 203665 - RNA, 22 nt, Human
uucccucucuccagggcugccu

SEQ ID NO: 203666 - RNA, 22 nt, Human
uugugucccuggagcuucugug

SEQ ID NO: 203667 - RNA, 22 nt, Human
gccuggcuggucacugccuggc

SEQ ID NO: 203668 - RNA, 22 nt, Human
uagaaucaagcaguagagcaga

SEQ ID NO: 203669 - RNA, 22 nt, Human
acagucucuugcuugaauacua

SEQ ID NO: 203670 - RNA, 22 nt, Human
uucacauuccgcggcuauuuuc

SEQ ID NO: 203671 - RNA, 22 nt, Human
ugccagaguuacaugaggguca

SEQ ID NO: 203672 - RNA, 22 nt, Human
uugaaagucacaauggcauuaa

SEQ ID NO: 203673 - RNA, 22 nt, Human
gagacacaagaagacaugcaca

SEQ ID NO: 203674 - RNA, 22 nt, Human
cuggaggagcauggacuggagu

SEQ ID NO: 203675 - RNA, 22 nt, Human
acaaggaggauauguuuaaggg

SEQ ID NO: 203676 - RNA, 22 nt, Human
ugcugggcugcacccccagagu

SEQ ID NO: 203677 - RNA, 22 nt, Human
cagaggacuucccacucaucug

SEQ ID NO: 203678 - RNA, 22 nt, Human
ccugggaggcugugggucugcu

SEQ ID NO: 203679 - RNA, 22 nt, Human
uuaguagaagacagauaacaaa

SEQ ID NO: 203680 - RNA, 22 nt, Human
ucucaguguuuaaaaagauuuc

SEQ ID NO: 203681 - RNA, 22 nt, Human
uggcagugugggaggaagguac

SEQ ID NO: 203682 - RNA, 22 nt, Human
cacugcccaggcacccaucuug

SEQ ID NO: 203683 - RNA, 22 nt, Human
ggaguaggccccgggagagagu

SEQ ID NO: 203684 - RNA, 22 nt, Human
aggcuucagguuugcuuugcag

SEQ ID NO: 203685 - RNA, 22 nt, Human
uccuggcuucugucuccuuauu

SEQ ID NO: 203686 - RNA, 22 nt, Human
aagaagugguccuuuucuuucu

SEQ ID NO: 203687 - RNA, 22 nt, Human
agaggccugugugcuccagugg

SEQ ID NO: 203688 - RNA, 22 nt, Human
uguguguggggaggcagcagau

SEQ ID NO: 203689 - RNA, 22 nt, Human
ccagguguuacacgaguguuaa

SEQ ID NO: 203690 - RNA, 22 nt, Human
ccugccagcgcuuaucucucgg

SEQ ID NO: 203691 - RNA, 22 nt, Human
agccaaagaucagugugcaagu

SEQ ID NO: 203692 - RNA, 22 nt, Human
aggacaguauaggcuuuaggag

SEQ ID NO: 203693 - RNA, 22 nt, Human
acagauccugguuacagccauu

SEQ ID NO: 203694 - RNA, 22 nt, Human
ggcuuuauuaacucauccguaa

SEQ ID NO: 203695 - RNA, 22 nt, Human
ugcugaggaaagaggauaaaag

SEQ ID NO: 203696 - RNA, 22 nt, Human
aauaugaugccaaauugcuaca

SEQ ID NO: 203697 - RNA, 22 nt, Human
uccuuucugucuuuacucugga

SEQ ID NO: 203698 - RNA, 22 nt, Human
uccucacagcugguucauucag

SEQ ID NO: 203699 - RNA, 22 nt, Human
cucuggagaacuccuugugucu

SEQ ID NO: 203700 - RNA, 22 nt, Human
gccagcugcuucuccagaauuu

SEQ ID NO: 203701 - RNA, 22 nt, Human
gcauggccuugcuguaguggua

SEQ ID NO: 203702 - RNA, 22 nt, Human
gugggggcagugggcuucgagc

SEQ ID NO: 203703 - RNA, 22 nt, Human
guuccacaaaauguacccaguu

SEQ ID NO: 203704 - RNA, 22 nt, Human
uagccagugagacccagaaaua

SEQ ID NO: 203705 - RNA, 22 nt, Human
uggcccugguggcacagccugc

SEQ ID NO: 203706 - RNA, 22 nt, Human
aaggaacuagcaugauguguag

SEQ ID NO: 203707 - RNA, 22 nt, Human
ugauugacuuuagaauagcacu

SEQ ID NO: 203708 - RNA, 22 nt, Human
guuuuucuuugugugaagacaa

SEQ ID NO: 203709 - RNA, 19 nt, Human
uaccauguugacuuuccug

SEQ ID NO: 203710 - RNA, 19 nt, Human
gugagcuucuuguaagagg

SEQ ID NO: 203711 - RNA, 22 nt, Human
agcuuugggggagguagucugu

SEQ ID NO: 203712 - RNA, 22 nt, Human
uacuuuaauauaugugaaguuc

SEQ ID NO: 203713 - RNA, 22 nt, Human
ucaggccugcccugaaagcaca

SEQ ID NO: 203714 - RNA, 22 nt, Human
ggaauaggauuuaccucuguaa

SEQ ID NO: 203715 - RNA, 22 nt, Human
uuguuacagcagcaauagaaaa

SEQ ID NO: 203716 - RNA, 22 nt, Human
uuugcaauuugugcugcaaaug

SEQ ID NO: 203717 - RNA, 22 nt, Human
uauaucuaaguguauguaagag

SEQ ID NO: 203718 - RNA, 22 nt, Human
ggucacugagcuguaauucugu

SEQ ID NO: 203719 - RNA, 22 nt, Human
acuucucucauucagacauagc

SEQ ID NO: 203720 - RNA, 22 nt, Human
ccccaaaacuuggugacuucca

SEQ ID NO: 203721 - RNA, 22 nt, Human
ugaaucaugccacugagcuccc

SEQ ID NO: 203722 - RNA, 22 nt, Human
uccugggaagacugugaggaca

SEQ ID NO: 203723 - RNA, 22 nt, Human
gccugagauucugcauuucuaa

SEQ ID NO: 203724 - RNA, 19 nt, Human
cucuuaaauugucucuugc

SEQ ID NO: 203725 - RNA, 22 nt, Human
uaagcaagugguagaaggacaa

SEQ ID NO: 203726 - RNA, 22 nt, Human
uuuccuucaucaucugagagcu

SEQ ID NO: 203727 - RNA, 22 nt, Human
guacaaauuuugacaucuagga

SEQ ID NO: 203728 - RNA, 20 nt, Human
ucacuaguaaccaucugcuu

SEQ ID NO: 203729 - RNA, 22 nt, Human
aaaccuuuucagcugaauggag

SEQ ID NO: 203730 - RNA, 22 nt, Human
ucaaauacauggucaaucaacu

SEQ ID NO: 203731 - RNA, 22 nt, Human
uucauugacugguucguuaagu

SEQ ID NO: 203732 - RNA, 22 nt, Human
guggaggacaaaagaagccuuu

SEQ ID NO: 203733 - RNA, 22 nt, Human
augcuguguuugagaaccuagg

SEQ ID NO: 203734 - RNA, 22 nt, Human
uucaggaucacuaaacccucca

SEQ ID NO: 203735 - RNA, 22 nt, Human
gaaggaaaaauacucuguaagg

SEQ ID NO: 203736 - RNA, 22 nt, Human
auacacauaucagguguauaca

SEQ ID NO: 203737 - RNA, 22 nt, Human
gacccagugacucgucucugug

SEQ ID NO: 203738 - RNA, 22 nt, Human
agcuguuuucuaaugcauuuga

SEQ ID NO: 203739 - RNA, 22 nt, Human
uaacagaaauagaaaugagagu

SEQ ID NO: 203740 - RNA, 22 nt, Human
ccacugggcguuucuguccaau

SEQ ID NO: 203741 - RNA, 18 nt, Human
uccagagagggagaagug

SEQ ID NO: 203742 - RNA, 22 nt, Human
uccuugggaaacaucauguaau

SEQ ID NO: 203743 - RNA, 22 nt, Human
ccacagaaaauaaagcacgauu

SEQ ID NO: 203744 - RNA, 22 nt, Human
gcugcagcucgccuuccggccu

SEQ ID NO: 203745 - RNA, 22 nt, Human
guacuaaacagagaaccaauau

SEQ ID NO: 203746 - RNA, 22 nt, Human
uaacagaagagcaggcagcccu

SEQ ID NO: 203747 - RNA, 22 nt, Human
agggcagcuagcuguagaaaga

SEQ ID NO: 203748 - RNA, 22 nt, Human
ccucccugucuaccuguugugg

SEQ ID NO: 203749 - RNA, 22 nt, Human
uuuuauaagcaagaaagggaaa

SEQ ID NO: 203750 - RNA, 22 nt, Human
aggugucugggcuuuggaguca

SEQ ID NO: 203751 - RNA, 22 nt, Human
acuagaaugcaagcuccacaag

SEQ ID NO: 203752 - RNA, 21 nt, Human
uccuggcaggcccaggacccu

SEQ ID NO: 203753 - RNA, 19 nt, Human
agguccucaggaugacccu

SEQ ID NO: 203754 - RNA, 22 nt, Human
ugggugccaaccucugguggcc

SEQ ID NO: 203755 - RNA, 22 nt, Human
gacuucuucaugucuuuuccac

SEQ ID NO: 203756 - RNA, 22 nt, Human
gagcucuugcuucuaguccagg

SEQ ID NO: 203757 - RNA, 22 nt, Human
aagcaucucuauguggagagug

SEQ ID NO: 203758 - RNA, 22 nt, Human
agaggcuucucggauggggcag

SEQ ID NO: 203759 - RNA, 22 nt, Human
uuaaaugugauccugguaugca

SEQ ID NO: 203760 - RNA, 19 nt, Human
gauauaaagagauggugaa

SEQ ID NO: 203761 - RNA, 22 nt, Human
gucuugaaauucuguuaaagga

SEQ ID NO: 203762 - RNA, 21 nt, Human
ucuuuucucagcuuugugguu

SEQ ID NO: 203763 - RNA, 22 nt, Human
ggcagcuguaagaugagugaau

SEQ ID NO: 203764 - RNA, 22 nt, Human
uaaauuauggcuggcagagcag

SEQ ID NO: 203765 - RNA, 22 nt, Human
caacugguaaucuccacgguca

SEQ ID NO: 203766 - RNA, 21 nt, Human
ucuagaagagguugagaauau

SEQ ID NO: 203767 - RNA, 22 nt, Human
gggagcuguaagggacagguag

SEQ ID NO: 203768 - RNA, 22 nt, Human
ugugaggauguuaaggggauga

SEQ ID NO: 203769 - RNA, 22 nt, Human
accugaauuuuggaugagcugu

SEQ ID NO: 203770 - RNA, 22 nt, Human
cuggggcuguaggaggacuuau

SEQ ID NO: 203771 - RNA, 22 nt, Human
aaauugaauuugggaaacauug

SEQ ID NO: 203772 - RNA, 22 nt, Human
ugcuggcuacugauggcaggcc

SEQ ID NO: 203773 - RNA, 22 nt, Human
gcuggcucuuuuugccgggcuc

SEQ ID NO: 203774 - RNA, 22 nt, Human
cacagugcuuuaugagagaucu

SEQ ID NO: 203775 - RNA, 22 nt, Human
uguuucauuaguacugacaaua

SEQ ID NO: 203776 - RNA, 22 nt, Human
cuuauacacgaacacaaggugu

SEQ ID NO: 203777 - RNA, 22 nt, Human
cugaauaauuuucuguuguaug

SEQ ID NO: 203778 - RNA, 21 nt, Human
ugcacagccauacccuccuug

SEQ ID NO: 203779 - RNA, 22 nt, Human
acauucuuucgaugucugauuu

SEQ ID NO: 203780 - RNA, 22 nt, Human
acgaugcucaacuauaugaauu

SEQ ID NO: 203781 - RNA, 22 nt, Human
cuuuauuagauguagacuuucu

SEQ ID NO: 203782 - RNA, 21 nt, Human
agcugccugcucuggaccugg

SEQ ID NO: 203783 - RNA, 22 nt, Human
auggcuuuucacagaggguucu

SEQ ID NO: 203784 - RNA, 22 nt, Human
acagcacagagugguauggcug

SEQ ID NO: 203785 - RNA, 22 nt, Human
auuauagaggguuacaguuaau

SEQ ID NO: 203786 - RNA, 22 nt, Human
ccacgagggaaccagguggggu

SEQ ID NO: 203787 - RNA, 22 nt, Human
acagccaggaggaacucaguga

SEQ ID NO: 203788 - RNA, 22 nt, Human
uccagccuaauguucuucccac

SEQ ID NO: 203789 - RNA, 22 nt, Human
agcacauucugccuugcuuugc

SEQ ID NO: 203790 - RNA, 22 nt, Human
ucugggaacagccuggcugugu

SEQ ID NO: 203791 - RNA, 22 nt, Human
caggaguguugauugcucagga

SEQ ID NO: 203792 - RNA, 20 nt, Human
caucuccugccuccauguuc

SEQ ID NO: 203793 - RNA, 22 nt, Human
aaaugcaaggcacauuccuuuu

SEQ ID NO: 203794 - RNA, 22 nt, Human
uuucuuaggcucuaaaaugacu

SEQ ID NO: 203795 - RNA, 22 nt, Human
auugaaauugaugaaauucuug

SEQ ID NO: 203796 - RNA, 21 nt, Human
cugcaucugagucauuaugcc

SEQ ID NO: 203797 - RNA, 20 nt, Human
gcccaagguccagaaggggg

SEQ ID NO: 203798 - RNA, 19 nt, Human
aaaugcuguggagggcucc

SEQ ID NO: 203799 - RNA, 19 nt, Human
gcugugugaccuugggcaa

SEQ ID NO: 203800 - RNA, 22 nt, Human
aaaguagaggcauugaucaggu

SEQ ID NO: 203801 - RNA, 22 nt, Human
uugagcaggauggcuaugcaca

SEQ ID NO: 203802 - RNA, 22 nt, Human
uggcugagguaacuaugaauaa

SEQ ID NO: 203803 - RNA, 22 nt, Human
uuuagauaaugcucaagcaauu

SEQ ID NO: 203804 - RNA, 22 nt, Human
aggccacggcggguggauuacu

SEQ ID NO: 203805 - RNA, 22 nt, Human
cuuugauauaaguauacauagu

SEQ ID NO: 203806 - RNA, 22 nt, Human
guaguuacccagaacacuggaa

SEQ ID NO: 203807 - RNA, 22 nt, Human
aagcuuguagaguuugacuucc

SEQ ID NO: 203808 - RNA, 22 nt, Human
guuauucaauggcuuauaagga

SEQ ID NO: 203809 - RNA, 22 nt, Human
cagagcucucuuugcuacuaca

SEQ ID NO: 203810 - RNA, 22 nt, Human
gaaggcuuuagagagauauaaa

SEQ ID NO: 203811 - RNA, 22 nt, Human
uuucagaaauuauauuagaugc

SEQ ID NO: 203812 - RNA, 22 nt, Human
gcccucagcuccuggacacaug

SEQ ID NO: 203813 - RNA, 22 nt, Human
auguuuauguugggcuauauuu

SEQ ID NO: 203814 - RNA, 22 nt, Human
aggagggagcuuaagccaggca

SEQ ID NO: 203815 - RNA, 22 nt, Human
aaucagaacuccuaccacagag

SEQ ID NO: 203816 - RNA, 22 nt, Human
ugguuagacucaccuuauaguu

SEQ ID NO: 203817 - RNA, 22 nt, Human
gggcugugaggugagaacuuac

SEQ ID NO: 203818 - RNA, 22 nt, Human
acagguggggaggcugagguuc

SEQ ID NO: 203819 - RNA, 22 nt, Human
ucagagcugggugcuucuuccu

SEQ ID NO: 203820 - RNA, 22 nt, Human
ccaguuuuuccagugcuuucug

SEQ ID NO: 203821 - RNA, 22 nt, Human
aguuacucacugaggguuuauu

SEQ ID NO: 203822 - RNA, 22 nt, Human
uaaaugauaauaaugcuagugu

SEQ ID NO: 203823 - RNA, 22 nt, Human
gcucugggccauccuggccggg

SEQ ID NO: 203824 - RNA, 22 nt, Human
agaggaagccauugcuuacuga

SEQ ID NO: 203825 - RNA, 22 nt, Human
aacaaguguauuaauggaaaua

SEQ ID NO: 203826 - RNA, 22 nt, Human
cucagcaauuaccugugucucu

SEQ ID NO: 203827 - RNA, 22 nt, Human
ugcuauuuuggucuacagcacu

SEQ ID NO: 203828 - RNA, 22 nt, Human
agcucuggaacucccggcugcu

SEQ ID NO: 203829 - RNA, 22 nt, Human
gcaagaacgaauccuacuugcu

SEQ ID NO: 203830 - RNA, 22 nt, Human
ugucccagcagcuggguucucu

SEQ ID NO: 203831 - RNA, 19 nt, Human
uucucuggacuagaugcug

SEQ ID NO: 203832 - RNA, 20 nt, Human
cugcugugauucccuccucc

SEQ ID NO: 203833 - RNA, 22 nt, Human
cagggccacccucugcugggug

SEQ ID NO: 203834 - RNA, 22 nt, Human
auuucaguagaaaaucuugauu

SEQ ID NO: 203835 - RNA, 22 nt, Human
uagaaguuaggaaauaggaaua

SEQ ID NO: 203836 - RNA, 22 nt, Human
guauucauauuaaacauaucaa

SEQ ID NO: 203837 - RNA, 22 nt, Human
auccacaggguguguuaagaug

SEQ ID NO: 203838 - RNA, 22 nt, Human
gugagucugccuagcacaucac

SEQ ID NO: 203839 - RNA, 22 nt, Human
accuuccucuaagacauuuagc

SEQ ID NO: 203840 - RNA, 22 nt, Human
cagaggcugccagccaugugca

SEQ ID NO: 203841 - RNA, 22 nt, Human
acaaugucaccucucauguuuu

SEQ ID NO: 203842 - RNA, 23 nt, Human
cuguccugccauccacagcggcc

SEQ ID NO: 203843 - RNA, 22 nt, Human
aggcccagcuggacaaacugcu

SEQ ID NO: 203844 - RNA, 22 nt, Human
ggagacugaucugagugauaac

SEQ ID NO: 203845 - RNA, 22 nt, Human
cugcacaguggacagugaagau

SEQ ID NO: 203846 - RNA, 22 nt, Human
ucccagggugaaaugcaguagg

SEQ ID NO: 203847 - RNA, 22 nt, Human
uuacaaagaaaauuaggcauuu

SEQ ID NO: 203848 - RNA, 22 nt, Human
ugcagguguaaauuuucaagag

SEQ ID NO: 203849 - RNA, 22 nt, Human
aaguguauaacgaccuacagga

SEQ ID NO: 203850 - RNA, 20 nt, Human
ucuuggcugugugaggacac

SEQ ID NO: 203851 - RNA, 23 nt, Human
aguauucaaaaggcaagcuauau

SEQ ID NO: 203852 - RNA, 23 nt, Human
ucccugagaugcugcucuguccc

SEQ ID NO: 203853 - RNA, 23 nt, Human
gaaaggcucugggacccccaacu

SEQ ID NO: 203854 - RNA, 22 nt, Human
aagcaggagagccugggugagc

SEQ ID NO: 203855 - RNA, 22 nt, Human
ggcagguggacgugcuaaagcu

SEQ ID NO: 203856 - RNA, 22 nt, Human
cuguccucuguccucagcagga

SEQ ID NO: 203857 - RNA, 22 nt, Human
aaguuacauuuuggucuaauug

SEQ ID NO: 203858 - RNA, 22 nt, Human
cucagggccaaggaugcuguug

SEQ ID NO: 203859 - RNA, 22 nt, Human
gaggcagagucacaaagagucu

SEQ ID NO: 203860 - RNA, 22 nt, Human
gaccuccauucugucaugacug

SEQ ID NO: 203861 - RNA, 22 nt, Human
acacaucuccagccagcaggag

SEQ ID NO: 203862 - RNA, 22 nt, Human
uugagaugggcuuuauguucag

SEQ ID NO: 203863 - RNA, 22 nt, Human
aagaacuguuuacaauuuucac

SEQ ID NO: 203864 - RNA, 22 nt, Human
uuugcuuucccuuguagaaagu

SEQ ID NO: 203865 - RNA, 23 nt, Human
ccugcaaagaaacaagccaccug

SEQ ID NO: 203866 - RNA, 22 nt, Human
gagcccugacacugagggaguu

SEQ ID NO: 203867 - RNA, 22 nt, Human
acagggcugaggcuggcuucuu

SEQ ID NO: 203868 - RNA, 22 nt, Human
uaaaucuccuguuuuucaucua

SEQ ID NO: 203869 - RNA, 22 nt, Human
ggaaacagcaaauuauggcaau

SEQ ID NO: 203870 - RNA, 21 nt, Human
agucacauuggggguuuaggg

SEQ ID NO: 203871 - RNA, 22 nt, Human
uauggaaagcucuuuuugauug

SEQ ID NO: 203872 - RNA, 22 nt, Human
auaaagacaugcuuacuugccc

SEQ ID NO: 203873 - RNA, 23 nt, Human
aaauaugucugagggcaaagaau

SEQ ID NO: 203874 - RNA, 22 nt, Human
auuucuacugugagaaacauga

SEQ ID NO: 203875 - RNA, 22 nt, Human
guauaagcccauucucagagac

SEQ ID NO: 203876 - RNA, 22 nt, Human
agcagggcuggggcacgagcca

SEQ ID NO: 203877 - RNA, 22 nt, Human
acuuagauuccugguaccuccg

SEQ ID NO: 203878 - RNA, 22 nt, Human
aggcgcagacauacagggucug

SEQ ID NO: 203879 - RNA, 22 nt, Human
gcucaggcccagcggcuggugu

SEQ ID NO: 203880 - RNA, 22 nt, Human
guggugaagccccaucucugcu

SEQ ID NO: 203881 - RNA, 22 nt, Human
cagagaugggucgcagagaugg

SEQ ID NO: 203882 - RNA, 22 nt, Human
cucccugcuuguuucccuucag

SEQ ID NO: 203883 - RNA, 22 nt, Human
aguguucaggaucugaggccag

SEQ ID NO: 203884 - RNA, 22 nt, Human
ugaggaagcaaaggcuugugug

SEQ ID NO: 203885 - RNA, 22 nt, Human
ugugggaagagcaguggcagca

SEQ ID NO: 203886 - RNA, 22 nt, Human
ucauuuuuagcgcgcaaaaguu

SEQ ID NO: 203887 - RNA, 17 nt, Human
accaggcaacacgccca

SEQ ID NO: 203888 - RNA, 22 nt, Human
uccugggagcaugaagagggau

SEQ ID NO: 203889 - RNA, 22 nt, Human
aaaguuuuauucaagcauuagu

SEQ ID NO: 203890 - RNA, 22 nt, Human
cuuuaagacuaaauuagaguuu

SEQ ID NO: 203891 - RNA, 22 nt, Human
gguuccuucugaggucccugua

SEQ ID NO: 203892 - RNA, 22 nt, Human
ucagaggaaagggaacauaguc

SEQ ID NO: 203893 - RNA, 22 nt, Human
ucagaggccuaugucuacaacu

SEQ ID NO: 203894 - RNA, 18 nt, Human
cuuccucaucgcucuccc

SEQ ID NO: 203895 - RNA, 22 nt, Human
acagcagaguaguuuuccaacu

SEQ ID NO: 203896 - RNA, 19 nt, Human
aggguccagggagcggcuc

SEQ ID NO: 203897 - RNA, 22 nt, Human
augcagggaaaagagauauuau

SEQ ID NO: 203898 - RNA, 22 nt, Human
ucuuuguuauugcuuuaucuau

SEQ ID NO: 203899 - RNA, 22 nt, Human
gcugggcucugucaugccuucc

SEQ ID NO: 203900 - RNA, 22 nt, Human
ucagaggauugccucagcgagc

SEQ ID NO: 203901 - RNA, 22 nt, Human
cauuuuacgacauagggcaggc

SEQ ID NO: 203902 - RNA, 22 nt, Human
ucagagacuggucugcagaugc

SEQ ID NO: 203903 - RNA, 22 nt, Human
gguuugguuuuggccaucuucc

SEQ ID NO: 203904 - RNA, 22 nt, Human
uaaauucagugaguaauuucug

SEQ ID NO: 203905 - RNA, 22 nt, Human
aaugagcugcugcuguuccacc

SEQ ID NO: 203906 - RNA, 22 nt, Human
uguuuaugcaucguuaauacca

SEQ ID NO: 203907 - RNA, 22 nt, Human
guccucugauuucuagguauau

SEQ ID NO: 203908 - RNA, 22 nt, Human
acccaggcuagaagugaauuau

SEQ ID NO: 203909 - RNA, 20 nt, Human
ccuggccaaugagauaggaa

SEQ ID NO: 203910 - RNA, 22 nt, Human
ugggagagugcucaaugugcaa

SEQ ID NO: 203911 - RNA, 22 nt, Human
ccuguucuguagugaguuugag

SEQ ID NO: 203912 - RNA, 22 nt, Human
cgcuggucaccauggcguccug

SEQ ID NO: 203913 - RNA, 22 nt, Human
agcaaaagauagauuaacaaga

SEQ ID NO: 203914 - RNA, 22 nt, Human
cagaauuuaaguggauuauucu

SEQ ID NO: 203915 - RNA, 22 nt, Human
aacuuccuucuaguucauaugu

SEQ ID NO: 203916 - RNA, 22 nt, Human
cuguggaaggacuuagcgauac

SEQ ID NO: 203917 - RNA, 22 nt, Human
uccagccuaggggaacagcugc

SEQ ID NO: 203918 - RNA, 22 nt, Human
uccauacaguccacacggugca

SEQ ID NO: 203919 - RNA, 22 nt, Human
gugaggcagcaggagccucugu

SEQ ID NO: 203920 - RNA, 22 nt, Human
agagagagggaaacugcuaaac

SEQ ID NO: 203921 - RNA, 22 nt, Human
aacaggcuaaauuguccauuuc

SEQ ID NO: 203922 - RNA, 22 nt, Human
gccacauccuucagaaagcuuu

SEQ ID NO: 203923 - RNA, 22 nt, Human
cuggguguucaggagcugggcu

SEQ ID NO: 203924 - RNA, 22 nt, Human
gagaaucuacaggaaaccgaag

SEQ ID NO: 203925 - RNA, 22 nt, Human
guggaaggugcuagaacaagga

SEQ ID NO: 203926 - RNA, 22 nt, Human
gagcucugcuuggguucuuagg

SEQ ID NO: 203927 - RNA, 22 nt, Human
augaagcaacagcccuccuauu

SEQ ID NO: 203928 - RNA, 22 nt, Human
caaaggcaucggcaauuaggga

SEQ ID NO: 203929 - RNA, 22 nt, Human
cucagaguccccacaucugggu

SEQ ID NO: 203930 - RNA, 22 nt, Human
gaggcacagagcccuaggagcu

SEQ ID NO: 203931 - RNA, 22 nt, Human
aagacagugaucucugagagau

SEQ ID NO: 203932 - RNA, 22 nt, Human
uuuggcauagcucuuuguuccu

SEQ ID NO: 203933 - RNA, 22 nt, Human
ucauucagagagaauguuccag

SEQ ID NO: 203934 - RNA, 22 nt, Human
gcacgugcacacauguguacaa

SEQ ID NO: 203935 - RNA, 22 nt, Human
agacaagaaacugggagucucu

SEQ ID NO: 203936 - RNA, 22 nt, Human
guccugagaccauggccuuagu

SEQ ID NO: 203937 - RNA, 22 nt, Human
agcaacagggggauggccacug

SEQ ID NO: 203938 - RNA, 22 nt, Human
cucuccaggcugggacaggacc

SEQ ID NO: 203939 - RNA, 19 nt, Human
gcuguauuaaagauacaug

SEQ ID NO: 203940 - RNA, 22 nt, Human
ugggccuguggcuuggcucuag

SEQ ID NO: 203941 - RNA, 22 nt, Human
cagcuguggagauggggugcau

SEQ ID NO: 203942 - RNA, 22 nt, Human
uccaggccacugcagaggcucu

SEQ ID NO: 203943 - RNA, 22 nt, Human
ugaagccaccgaaccagaagag

SEQ ID NO: 203944 - RNA, 22 nt, Human
uacauauguaaacauguauaaa

SEQ ID NO: 203945 - RNA, 22 nt, Human
aucucagaaacauaucuaaucc

SEQ ID NO: 203946 - RNA, 22 nt, Human
acaaggagagcacacaugggga

SEQ ID NO: 203947 - RNA, 22 nt, Human
uuuguccucuccauguacaaua

SEQ ID NO: 203948 - RNA, 22 nt, Human
ugcaaacauccgacugaaagcc

SEQ ID NO: 203949 - RNA, 20 nt, Human
ccucaagcagacugacagcu

SEQ ID NO: 203950 - RNA, 22 nt, Human
aauuaagagagaguugaagcaa

SEQ ID NO: 203951 - RNA, 22 nt, Human
uuacaucagcaagaguguaugu

SEQ ID NO: 203952 - RNA, 22 nt, Human
gccucuccuggagaaggcaggg

SEQ ID NO: 203953 - RNA, 22 nt, Human
agcaggugaucgcgugugcucc

SEQ ID NO: 203954 - RNA, 16 nt, Human
uuuauuuacuaguguu

SEQ ID NO: 203955 - RNA, 22 nt, Human
ucugucauugcaauaaaauuuc

SEQ ID NO: 203956 - RNA, 22 nt, Human
ucagcagaaaggcacuagauga

SEQ ID NO: 203957 - RNA, 22 nt, Human
uuggcuucuuauaaugcaauag

SEQ ID NO: 203958 - RNA, 22 nt, Human
ggucacauauccucgguuugga

SEQ ID NO: 203959 - RNA, 22 nt, Human
aaauuccauuaugauaauuucg

SEQ ID NO: 203960 - RNA, 22 nt, Human
uacgugcacucauaccugaaau

SEQ ID NO: 203961 - RNA, 22 nt, Human
ccugggcucaagugaugguccc

SEQ ID NO: 203962 - RNA, 22 nt, Human
uggcugagagcaauugacucug

SEQ ID NO: 203963 - RNA, 22 nt, Human
aacuauacucuguaaaugugcu

SEQ ID NO: 203964 - RNA, 22 nt, Human
gacuacucaaacuuucucuaua

SEQ ID NO: 203965 - RNA, 22 nt, Human
uucuuguauauaaaaaucauuu

SEQ ID NO: 203966 - RNA, 22 nt, Human
cggcuccuccgcccuugcucac

SEQ ID NO: 203967 - RNA, 22 nt, Human
acacugugcagauucccuguga

SEQ ID NO: 203968 - RNA, 22 nt, Human
ggccucugcccucacuccuguc

SEQ ID NO: 203969 - RNA, 22 nt, Human
acaguggaugugauguccaggu

SEQ ID NO: 203970 - RNA, 22 nt, Human
gcccugcuucuggcaugcagaa

SEQ ID NO: 203971 - RNA, 22 nt, Human
ucagaagucaugcucagucugu

SEQ ID NO: 203972 - RNA, 22 nt, Human
uugcucugauuagguggaaaca

SEQ ID NO: 203973 - RNA, 22 nt, Human
aaugcacaugccacauguggua

SEQ ID NO: 203974 - RNA, 22 nt, Human
aucuagacaucugaaacauuua

SEQ ID NO: 203975 - RNA, 19 nt, Human
ugcaaauucuaaaaacuga

SEQ ID NO: 203976 - RNA, 17 nt, Human
agccagcaguagcuggu

SEQ ID NO: 203977 - RNA, 22 nt, Human
uggcccugcccucuucaucuuu

SEQ ID NO: 203978 - RNA, 22 nt, Human
gggcuggaggugagcaggacag

SEQ ID NO: 203979 - RNA, 22 nt, Human
cccccagaugcgagccauagcc

SEQ ID NO: 203980 - RNA, 22 nt, Human
uguguugugacauucuuggaug

SEQ ID NO: 203981 - RNA, 20 nt, Human
uuuccacuguaauguaugau

SEQ ID NO: 203982 - RNA, 22 nt, Human
cuagaaauauuuuacagucaag

SEQ ID NO: 203983 - RNA, 22 nt, Human
ucaaagccuguggauaguuugg

SEQ ID NO: 203984 - RNA, 22 nt, Human
caggccucagggcuguccguag

SEQ ID NO: 203985 - RNA, 22 nt, Human
cuguuaaauagacugcagugca

SEQ ID NO: 203986 - RNA, 22 nt, Human
cccucccaggaguggccagaga

SEQ ID NO: 203987 - RNA, 22 nt, Human
cucuguaugaaucauauggagu

SEQ ID NO: 203988 - RNA, 19 nt, Human
agaggccucagcagcuggc

SEQ ID NO: 203989 - RNA, 22 nt, Human
ggcaaaaaucaccccugguuca

SEQ ID NO: 203990 - RNA, 22 nt, Human
acaggccuugguccugaccuaa

SEQ ID NO: 203991 - RNA, 22 nt, Human
gcagagaggauauuauugucca

SEQ ID NO: 203992 - RNA, 22 nt, Human
guaacacucuaaagggaugcac

SEQ ID NO: 203993 - RNA, 22 nt, Human
cccacccacucugaccagaagc

SEQ ID NO: 203994 - RNA, 22 nt, Human
ugaaagcuuugggacaguguga

SEQ ID NO: 203995 - RNA, 22 nt, Human
acaugccagcccauuuaaaugg

SEQ ID NO: 203996 - RNA, 22 nt, Human
agggcagcacagcugugcuccu

SEQ ID NO: 203997 - RNA, 23 nt, Human
ucugagaagguuucagccagacu

SEQ ID NO: 203998 - RNA, 22 nt, Human
cagcuggcccuuugguagccuu

SEQ ID NO: 203999 - RNA, 19 nt, Human
ccaugcagccugggggcag

SEQ ID NO: 204000 - RNA, 22 nt, Human
gcuggcucuucaguggagauag

SEQ ID NO: 204001 - RNA, 22 nt, Human
ugccaggcccugugcuggaugc

SEQ ID NO: 204002 - RNA, 22 nt, Human
auugagaucugcaucauaagcu

SEQ ID NO: 204003 - RNA, 22 nt, Human
uggucucccagagcagggacgc

SEQ ID NO: 204004 - RNA, 22 nt, Human
uuugguuuuuaccugcugagag

SEQ ID NO: 204005 - RNA, 22 nt, Human
acucaggaaaaauguagugaua

SEQ ID NO: 204006 - RNA, 18 nt, Human
auugcuuuuguaccaacc

SEQ ID NO: 204007 - RNA, 22 nt, Human
augcagcuucaggauuaugaug

SEQ ID NO: 204008 - RNA, 22 nt, Human
gcugccugcuucaugugggaga

SEQ ID NO: 204009 - RNA, 22 nt, Human
cauguauacaguagaauacuau

SEQ ID NO: 204010 - RNA, 22 nt, Human
cauauuuaguguuuggagaucg

SEQ ID NO: 204011 - RNA, 21 nt, Human
ggaauagcuuaaagugagggg

SEQ ID NO: 204012 - RNA, 22 nt, Human
cagcuucuauuuaucuuugugu

SEQ ID NO: 204013 - RNA, 22 nt, Human
agcugugcugccaaguugcuga

SEQ ID NO: 204014 - RNA, 22 nt, Human
gcaggccugacuguagggggca

SEQ ID NO: 204015 - RNA, 22 nt, Human
ccucugcccuuuuccuguauca

SEQ ID NO: 204016 - RNA, 22 nt, Human
cugccugugaacauacuggggg

SEQ ID NO: 204017 - RNA, 20 nt, Human
ucucccaggcucagggaaga

SEQ ID NO: 204018 - RNA, 22 nt, Human
gacagcugcauccucagacaca

SEQ ID NO: 204019 - RNA, 22 nt, Human
agacauuuauugaacaccuagc

SEQ ID NO: 204020 - RNA, 22 nt, Human
uacuucugaaugugaguuuguu

SEQ ID NO: 204021 - RNA, 22 nt, Human
ccauccugcaggaccuccauau

SEQ ID NO: 204022 - RNA, 22 nt, Human
gccagcucaguuucaaaguagg

SEQ ID NO: 204023 - RNA, 22 nt, Human
augguaaaagauauacugugca

SEQ ID NO: 204024 - RNA, 22 nt, Human
ugacaagaucacagucaagugu

SEQ ID NO: 204025 - RNA, 22 nt, Human
ccaggccuggacggguggccug

SEQ ID NO: 204026 - RNA, 22 nt, Human
aagccuucagaguuggcugguc

SEQ ID NO: 204027 - RNA, 22 nt, Human
auguacaguggaaacuaacaaa

SEQ ID NO: 204028 - RNA, 18 nt, Human
ggcaggggugaaccacag

SEQ ID NO: 204029 - RNA, 22 nt, Human
ugccacagaggugaagcccacu

SEQ ID NO: 204030 - RNA, 21 nt, Human
ugacagguuuaggauuaaaau

SEQ ID NO: 204031 - RNA, 21 nt, Human
ucauuucucuauguauuucac

SEQ ID NO: 204032 - RNA, 22 nt, Human
ugcuuaaacauccagacaguau

SEQ ID NO: 204033 - RNA, 22 nt, Human
ccuggcugcuauagcagcaugu

SEQ ID NO: 204034 - RNA, 22 nt, Human
ugaucuuugguaguacgauaau

SEQ ID NO: 204035 - RNA, 22 nt, Human
gaggcagcaauaaaaagaauuu

SEQ ID NO: 204036 - RNA, 22 nt, Human
uaugaaaauuuagcugaagcau

SEQ ID NO: 204037 - RNA, 22 nt, Human
ggcuucucucccccagcuccac

SEQ ID NO: 204038 - RNA, 22 nt, Human
ggaggacaggggcugcagcaca

SEQ ID NO: 204039 - RNA, 20 nt, Human
aaagugcacagauacagcuc

SEQ ID NO: 204040 - RNA, 22 nt, Human
cacaugaacaugcuggaaaagc

SEQ ID NO: 204041 - RNA, 22 nt, Human
agccagggagguggagguugca

SEQ ID NO: 204042 - RNA, 22 nt, Human
aguuagagacacaugcacaugc

SEQ ID NO: 204043 - RNA, 22 nt, Human
caguuuuucaaaauuacaugau

SEQ ID NO: 204044 - RNA, 23 nt, Human
uuuugacaggaggaagguguuga

SEQ ID NO: 204045 - RNA, 22 nt, Human
ucagagcacuggugcuaccuug

SEQ ID NO: 204046 - RNA, 22 nt, Human
uucuguauggaaacauccucca

SEQ ID NO: 204047 - RNA, 22 nt, Human
cagggagcuuugucuucucauu

SEQ ID NO: 204048 - RNA, 22 nt, Human
aagcccagcaucccugcaccag

SEQ ID NO: 204049 - RNA, 22 nt, Human
ugguccaggguguaguacagag

SEQ ID NO: 204050 - RNA, 22 nt, Human
aaauuccaguucuuuuaccugc

SEQ ID NO: 204051 - RNA, 22 nt, Human
caggcaaggaggcacugaggga

SEQ ID NO: 204052 - RNA, 22 nt, Human
gcagcugagagaagaacagggc

SEQ ID NO: 204053 - RNA, 22 nt, Human
ugauucaagccaccacauacug

SEQ ID NO: 204054 - RNA, 22 nt, Human
ugggcagggucucuguuaucag

SEQ ID NO: 204055 - RNA, 22 nt, Human
gccacagcucacguuccccauu

SEQ ID NO: 204056 - RNA, 22 nt, Human
aagcagaggccacagagugggc

SEQ ID NO: 204057 - RNA, 23 nt, Human
ugggucagcugccuccaggacaa

SEQ ID NO: 204058 - RNA, 22 nt, Human
ucaugccagcuuugcuuguccc

SEQ ID NO: 204059 - RNA, 22 nt, Human
aggucuuaggagcauggugcug

SEQ ID NO: 204060 - RNA, 22 nt, Human
cacaaaugacugaaacgacugu

SEQ ID NO: 204061 - RNA, 22 nt, Human
auggcuggaggccgggcuuccu

SEQ ID NO: 204062 - RNA, 22 nt, Human
agcuaggacagguagagauggg

SEQ ID NO: 204063 - RNA, 22 nt, Human
ucagaggaagcaucaaguucuc

SEQ ID NO: 204064 - RNA, 22 nt, Human
uguauucagugccuagcauaug

SEQ ID NO: 204065 - RNA, 22 nt, Human
gcugccucugcacagcucacuc

SEQ ID NO: 204066 - RNA, 22 nt, Human
ggcaaaaaccgcaauaacuucu

SEQ ID NO: 204067 - RNA, 22 nt, Human
ugggcuccaauuuguccuuuca

SEQ ID NO: 204068 - RNA, 22 nt, Human
gaauacaucugaaggcuaugaa

SEQ ID NO: 204069 - RNA, 22 nt, Human
cugagaggggaccaggguguuu

SEQ ID NO: 204070 - RNA, 22 nt, Human
ggcagcucugaugaugcucugg

SEQ ID NO: 204071 - RNA, 22 nt, Human
agaauucugacaauagaauugg

SEQ ID NO: 204072 - RNA, 22 nt, Human
guucaucuuccucccagugccu

SEQ ID NO: 204073 - RNA, 23 nt, Human
ugacaacagcucucagccauguc

SEQ ID NO: 204074 - RNA, 22 nt, Human
cuggcauguguuuggcuccugu

SEQ ID NO: 204075 - RNA, 22 nt, Human
aaguuuuacugaggacacaugu

SEQ ID NO: 204076 - RNA, 22 nt, Human
agaaaugacaagacugaucagg

SEQ ID NO: 204077 - RNA, 22 nt, Human
ccagccuucaccugcucugguc

SEQ ID NO: 204078 - RNA, 22 nt, Human
agggggcuccuccggugcuucc

SEQ ID NO: 204079 - RNA, 22 nt, Human
acauuaaaaaauguugcaugaa

SEQ ID NO: 204080 - RNA, 22 nt, Human
agggaauucacuggaacgcccu

SEQ ID NO: 204081 - RNA, 22 nt, Human
cugauugagaaggaaggggauc

SEQ ID NO: 204082 - RNA, 21 nt, Human
gcugugcaggugccccugcuc

SEQ ID NO: 204083 - RNA, 22 nt, Human
agugaaaugauaguguaaauac

SEQ ID NO: 204084 - RNA, 22 nt, Human
accuagaacugcaggcuauuuu

SEQ ID NO: 204085 - RNA, 22 nt, Human
cugagggguauccaagggguaa

SEQ ID NO: 204086 - RNA, 22 nt, Human
ugaucuuugggccauuaauaaa

SEQ ID NO: 204087 - RNA, 22 nt, Human
aacauuugagaaaaauacucuu

SEQ ID NO: 204088 - RNA, 22 nt, Human
gauuagaauggauagaucccca

SEQ ID NO: 204089 - RNA, 22 nt, Human
ugaaggagauuuuuagggaggc

SEQ ID NO: 204090 - RNA, 22 nt, Human
uagcuuuacaaagugcugcacc

SEQ ID NO: 204091 - RNA, 22 nt, Human
uaccagccucaguugugagccc

SEQ ID NO: 204092 - RNA, 22 nt, Human
acagugcuuagcacagaguaga

SEQ ID NO: 204093 - RNA, 21 nt, Human
ucccagggucuuaugggaugu

SEQ ID NO: 204094 - RNA, 22 nt, Human
uuucaguucaguuuauuauauc

SEQ ID NO: 204095 - RNA, 22 nt, Human
uuucccaggcuggaaugcagug

SEQ ID NO: 204096 - RNA, 22 nt, Human
uaaauuagagccagguaaguuu

SEQ ID NO: 204097 - RNA, 21 nt, Human
uucugggccaugcugcuucuc

SEQ ID NO: 204098 - RNA, 22 nt, Human
agagacaaacacugcaacuucu

SEQ ID NO: 204099 - RNA, 22 nt, Human
cagaaucucgacuucuggcccc

SEQ ID NO: 204100 - RNA, 22 nt, Human
caaacauuugacuucucucagg

SEQ ID NO: 204101 - RNA, 19 nt, Human
uggcaggcccaggauggac

SEQ ID NO: 204102 - RNA, 22 nt, Human
ucuguaggacagagaaaugggg

SEQ ID NO: 204103 - RNA, 22 nt, Human
acucugaggagugacuagaggu

SEQ ID NO: 204104 - RNA, 22 nt, Human
aaauacagauucugacucagag

SEQ ID NO: 204105 - RNA, 20 nt, Human
aguacaauguaugauucaga

SEQ ID NO: 204106 - RNA, 22 nt, Human
gcugaaaggggugacauucuuu

SEQ ID NO: 204107 - RNA, 18 nt, Human
uuggcuuugagaacuggu

SEQ ID NO: 204108 - RNA, 22 nt, Human
uucuagaagugucuaugucugu

SEQ ID NO: 204109 - RNA, 22 nt, Human
uacagugaggugguuuccuuua

SEQ ID NO: 204110 - RNA, 22 nt, Human
ucagagaacuccacaccuuagg

SEQ ID NO: 204111 - RNA, 22 nt, Human
aggggugugcauccuggaggau

SEQ ID NO: 204112 - RNA, 22 nt, Human
ugaaaacuccaaguuucaucag

SEQ ID NO: 204113 - RNA, 21 nt, Human
ucccucagaagcucuugguca

SEQ ID NO: 204114 - RNA, 22 nt, Human
gccuacauuucccaguugaaug

SEQ ID NO: 204115 - RNA, 22 nt, Human
uuuaaaaaacuagucugagucu

SEQ ID NO: 204116 - RNA, 22 nt, Human
ugaaauguuaaucacacaaagg

SEQ ID NO: 204117 - RNA, 22 nt, Human
ggcuggcuugccaagcucaggg

SEQ ID NO: 204118 - RNA, 22 nt, Human
agaaaucauugaauuauuugcu

SEQ ID NO: 204119 - RNA, 22 nt, Human
acugggagucaugaggaaggag

SEQ ID NO: 204120 - RNA, 22 nt, Human
acuauauacacauuaucuuguu

SEQ ID NO: 204121 - RNA, 22 nt, Human
aagugauuuucuucuuaguuau

SEQ ID NO: 204122 - RNA, 22 nt, Human
cugcuuuagguggaauguucua

SEQ ID NO: 204123 - RNA, 22 nt, Human
aaagaagguagggcuggugacu

SEQ ID NO: 204124 - RNA, 22 nt, Human
cuucaauuuuugguaugaugga

SEQ ID NO: 204125 - RNA, 22 nt, Human
uugcugaucugaaacguuacug

SEQ ID NO: 204126 - RNA, 22 nt, Human
ugagcuuauucauaaaagugca

SEQ ID NO: 204127 - RNA, 22 nt, Human
uccuuuguugagauaaauuggg

SEQ ID NO: 204128 - RNA, 22 nt, Human
ggagcugaugacgucaccaugg

SEQ ID NO: 204129 - RNA, 21 nt, Human
ucccugagcccaaggggcucc

SEQ ID NO: 204130 - RNA, 22 nt, Human
ucugggucuauuccuacuguga

SEQ ID NO: 204131 - RNA, 22 nt, Human
cacagcuaugagcagccuagcu

SEQ ID NO: 204132 - RNA, 22 nt, Human
aggugcaugaugcagagugcag

SEQ ID NO: 204133 - RNA, 22 nt, Human
uuaaagggccgauuuccaggcc

SEQ ID NO: 204134 - RNA, 22 nt, Human
gaggcacaccagggagucuugu

SEQ ID NO: 204135 - RNA, 19 nt, Human
ucuguucacauuguuucgc

SEQ ID NO: 204136 - RNA, 22 nt, Human
ugaaagcacaaguucuaacagg

SEQ ID NO: 204137 - RNA, 22 nt, Human
ucagugcugcuuuaugacaguu

SEQ ID NO: 204138 - RNA, 22 nt, Human
agcuggagccagugugaggcuu

SEQ ID NO: 204139 - RNA, 22 nt, Human
gguggcugcuuccucaagagga

SEQ ID NO: 204140 - RNA, 22 nt, Human
cucuggucauuuggaagagcau

SEQ ID NO: 204141 - RNA, 22 nt, Human
ucugggccucaguuucuucauc

SEQ ID NO: 204142 - RNA, 22 nt, Human
cauguuuaauugcgauguuuga

SEQ ID NO: 204143 - RNA, 22 nt, Human
cuuuccaagaaugcagauaccu

SEQ ID NO: 204144 - RNA, 15 nt, Human
uguuaacagcuggga

SEQ ID NO: 204145 - RNA, 17 nt, Human
agcuacaaggcaguuca

SEQ ID NO: 204146 - RNA, 22 nt, Human
uccaggagucuagccucaggcc

SEQ ID NO: 204147 - RNA, 22 nt, Human
auucuaaauguaauuuagaauu

SEQ ID NO: 204148 - RNA, 22 nt, Human
gccaaaggaccugugggugaca

SEQ ID NO: 204149 - RNA, 23 nt, Human
caggagggaaugaaguuagacaa

SEQ ID NO: 204150 - RNA, 22 nt, Human
ucauggcuuuuucacuguucgc

SEQ ID NO: 204151 - RNA, 22 nt, Human
uauuuccauguuagaacuaagu

SEQ ID NO: 204152 - RNA, 22 nt, Human
acagaugaguuagaauaggcag

SEQ ID NO: 204153 - RNA, 22 nt, Human
acauucuucuugugaauuuacu

SEQ ID NO: 204154 - RNA, 22 nt, Human
ggcaagugcuuccccaaccaca

SEQ ID NO: 204155 - RNA, 22 nt, Human
cagcuuguuaccgagggagggu

SEQ ID NO: 204156 - RNA, 17 nt, Human
ggaaaagaagaguagga

SEQ ID NO: 204157 - RNA, 22 nt, Human
uccaggcacagaguuggucagu

SEQ ID NO: 204158 - RNA, 22 nt, Human
caggaaauguauaauuuuauaa

SEQ ID NO: 204159 - RNA, 22 nt, Human
auuaauuuuucugacagccaca

SEQ ID NO: 204160 - RNA, 20 nt, Human
ggagagccacauagucuccc

SEQ ID NO: 204161 - RNA, 22 nt, Human
ugaaaucuuagccauucugccu

SEQ ID NO: 204162 - RNA, 22 nt, Human
agucugguauuggucuuuaauc

SEQ ID NO: 204163 - RNA, 22 nt, Human
gagugucagcagggcagagcac

SEQ ID NO: 204164 - RNA, 22 nt, Human
ccaggaagcucugcuccacggg

SEQ ID NO: 204165 - RNA, 22 nt, Human
cagcuuucuaccuuaggcagug

SEQ ID NO: 204166 - RNA, 22 nt, Human
cuuuacuucucaaaauaaagca

SEQ ID NO: 204167 - RNA, 22 nt, Human
agcugccaccucugccuuuggg

SEQ ID NO: 204168 - RNA, 22 nt, Human
uuuugccugagauccgagucug

SEQ ID NO: 204169 - RNA, 22 nt, Human
ucauaaauaguugugccugaau

SEQ ID NO: 204170 - RNA, 22 nt, Human
ucaucauccuuuuuugaagagu

SEQ ID NO: 204171 - RNA, 22 nt, Human
cuguuauauugguauauuuaca

SEQ ID NO: 204172 - RNA, 22 nt, Human
gaggggaaagugugaggcugcg

SEQ ID NO: 204173 - RNA, 20 nt, Human
caggucuucauguggcuguc

SEQ ID NO: 204174 - RNA, 22 nt, Human
aagcaagaguuggagugauguu

SEQ ID NO: 204175 - RNA, 22 nt, Human
cugccuccucacguccacagug

SEQ ID NO: 204176 - RNA, 22 nt, Human
aagugaauagccuauuuacuag

SEQ ID NO: 204177 - RNA, 21 nt, Human
uacaguaaguugggugguccu

SEQ ID NO: 204178 - RNA, 22 nt, Human
gauguuuggcucaaacgagugu

SEQ ID NO: 204179 - RNA, 22 nt, Human
gacacuuuggugcuuugugguu

SEQ ID NO: 204180 - RNA, 22 nt, Human
uuucagaagucaacuagguaaa

SEQ ID NO: 204181 - RNA, 22 nt, Human
uauaauccugcuucacauugaa

SEQ ID NO: 204182 - RNA, 22 nt, Human
uccagcccacaccugaagcugg

SEQ ID NO: 204183 - RNA, 22 nt, Human
aggcugugagcaagaacaccua

SEQ ID NO: 204184 - RNA, 22 nt, Human
caggccucagagaguggcgggg

SEQ ID NO: 204185 - RNA, 22 nt, Human
gugccugggguugagcuaugaa

SEQ ID NO: 204186 - RNA, 22 nt, Human
gcagagauuggugcacugauga

SEQ ID NO: 204187 - RNA, 19 nt, Human
acaaauaguuacauauccu

SEQ ID NO: 204188 - RNA, 22 nt, Human
uuucuuuuccaauaucccuacu

SEQ ID NO: 204189 - RNA, 22 nt, Human
ucugagagcaaggcauuagcag

SEQ ID NO: 204190 - RNA, 22 nt, Human
aauccacacaucuggcauguga

SEQ ID NO: 204191 - RNA, 22 nt, Human
ccuaguuuucauucagcagccu

SEQ ID NO: 204192 - RNA, 22 nt, Human
uggacaggaucugagacugaga

SEQ ID NO: 204193 - RNA, 22 nt, Human
agagccaggcucccauggggca

SEQ ID NO: 204194 - RNA, 22 nt, Human
aggcuggcccuacuggcugccu

SEQ ID NO: 204195 - RNA, 22 nt, Human
ucagagcauucgggugacaaau

SEQ ID NO: 204196 - RNA, 22 nt, Human
cugcccgucccuuugcucucgc

SEQ ID NO: 204197 - RNA, 22 nt, Human
ggagaagguggcucagcaaagg

SEQ ID NO: 204198 - RNA, 22 nt, Human
uuugaaaccuaguuauaugacu

SEQ ID NO: 204199 - RNA, 22 nt, Human
gccagccacuucccagacuggc

SEQ ID NO: 204200 - RNA, 22 nt, Human
uggcaacaugucgaagugcugu

SEQ ID NO: 204201 - RNA, 22 nt, Human
uauuagggaacugcaagacuaa

SEQ ID NO: 204202 - RNA, 22 nt, Human
guggcuuuggaauuguagacuc

SEQ ID NO: 204203 - RNA, 22 nt, Human
aaagcaguccuucccuuaaggu

SEQ ID NO: 204204 - RNA, 22 nt, Human
aacaggacacugggauggcuac

SEQ ID NO: 204205 - RNA, 22 nt, Human
aguccuggugacacuccucuuc

SEQ ID NO: 204206 - RNA, 22 nt, Human
ccagguguccccgucacugcag

SEQ ID NO: 204207 - RNA, 22 nt, Human
acauuuagcuguacaaucuaug

SEQ ID NO: 204208 - RNA, 22 nt, Human
acagcaggaauuaacauauaag

SEQ ID NO: 204209 - RNA, 22 nt, Human
aacaaauuaguugcaagacugg

SEQ ID NO: 204210 - RNA, 23 nt, Human
uuuggcauguuaacuucacuuac

SEQ ID NO: 204211 - RNA, 22 nt, Human
aguucuagaagacuuuuccauu

SEQ ID NO: 204212 - RNA, 22 nt, Human
cuuccucaugugcaaugcaagc

SEQ ID NO: 204213 - RNA, 19 nt, Human
ccuuuggauuuguuuaguc

SEQ ID NO: 204214 - RNA, 22 nt, Human
ucaguuacucugauguccugug

SEQ ID NO: 204215 - RNA, 22 nt, Human
cugguuuaaaauuacugguuaa

SEQ ID NO: 204216 - RNA, 22 nt, Human
cuugcuggugucgugccuucac

SEQ ID NO: 204217 - RNA, 22 nt, Human
caaaggcuuccacugcauccuu

SEQ ID NO: 204218 - RNA, 22 nt, Human
caguaggaaggaugcagaaaaa

SEQ ID NO: 204219 - RNA, 23 nt, Human
ucugccagugugugccaggagcc

SEQ ID NO: 204220 - RNA, 22 nt, Human
ugaggaagugguuguaugguuu

SEQ ID NO: 204221 - RNA, 22 nt, Human
agggagaagguuuagcugugag

SEQ ID NO: 204222 - RNA, 22 nt, Human
aguucuuuuaccaaggcaaaug

SEQ ID NO: 204223 - RNA, 22 nt, Human
uguuuagaugcaaagucucaca

SEQ ID NO: 204224 - RNA, 22 nt, Human
uuggcugcuagaugguguuaga

SEQ ID NO: 204225 - RNA, 22 nt, Human
gugcagggagcccagaaggucc

SEQ ID NO: 204226 - RNA, 22 nt, Human
uucuccaggcuugggccagguc

SEQ ID NO: 204227 - RNA, 22 nt, Human
ggcuguggccagcggggcugag

SEQ ID NO: 204228 - RNA, 22 nt, Human
ucccaguguggcaggccaugga

SEQ ID NO: 204229 - RNA, 18 nt, Human
ccugugcuccagcaucug

SEQ ID NO: 204230 - RNA, 22 nt, Human
gucuugaucuccugaccuugug

SEQ ID NO: 204231 - RNA, 22 nt, Human
ucugccuuugcuuuggcuguca

SEQ ID NO: 204232 - RNA, 22 nt, Human
gccuggcaggccuguuggggcu

SEQ ID NO: 204233 - RNA, 22 nt, Human
uggcagagagagugcagucgac

SEQ ID NO: 204234 - RNA, 22 nt, Human
cagggcuguggaaaacuggugc

SEQ ID NO: 204235 - RNA, 22 nt, Human
ggcuguggucugggugcucccc

SEQ ID NO: 204236 - RNA, 22 nt, Human
aguggcaguggaaagcacacgg

SEQ ID NO: 204237 - RNA, 22 nt, Human
auaggacagcagacaauuagua

SEQ ID NO: 204238 - RNA, 19 nt, Human
caggagagcaugcacuuug

SEQ ID NO: 204239 - RNA, 22 nt, Human
acagugauuuuaggauagaugg

SEQ ID NO: 204240 - RNA, 22 nt, Human
aaucucuucccaguaaaaaugg

SEQ ID NO: 204241 - RNA, 22 nt, Human
ggauuuacuaucuugaaauaua

SEQ ID NO: 204242 - RNA, 22 nt, Human
auauauuugagaauauucauga

SEQ ID NO: 204243 - RNA, 22 nt, Human
auuugccuugugauuuguaagu

SEQ ID NO: 204244 - RNA, 20 nt, Human
aaccaacagaaucaugucuc

SEQ ID NO: 204245 - RNA, 22 nt, Human
gggcaggagagaacagucaugg

SEQ ID NO: 204246 - RNA, 22 nt, Human
uccuccuucgggacugcuugac

SEQ ID NO: 204247 - RNA, 22 nt, Human
gcaucucuuuagaaucagaugg

SEQ ID NO: 204248 - RNA, 22 nt, Human
ucaggcugcaguggcaaaagac

SEQ ID NO: 204249 - RNA, 21 nt, Human
cuugaaagguagagucuacag

SEQ ID NO: 204250 - RNA, 22 nt, Human
acaaaggcauagugaauguuuu

SEQ ID NO: 204251 - RNA, 22 nt, Human
gcuggccuugaggugucuuuau

SEQ ID NO: 204252 - RNA, 22 nt, Human
ugggaaaguaauugucauccuu

SEQ ID NO: 204253 - RNA, 22 nt, Human
auccagccaguguggaugacuu

SEQ ID NO: 204254 - RNA, 22 nt, Human
gccaccucuuugucucugccgc

SEQ ID NO: 204255 - RNA, 22 nt, Human
cauggcugaggcagaggacuga

SEQ ID NO: 204256 - RNA, 22 nt, Human
gucuagaaaugccauacgugcc

SEQ ID NO: 204257 - RNA, 22 nt, Human
agggccugguucuguguaggga

SEQ ID NO: 204258 - RNA, 22 nt, Human
gguccagucuuucccuucuaga

SEQ ID NO: 204259 - RNA, 22 nt, Human
cccagagccgguggugcucaca

SEQ ID NO: 204260 - RNA, 22 nt, Human
ucuuccaggaccuggggcucca

SEQ ID NO: 204261 - RNA, 22 nt, Human
uuagcaauuccagguaaguuau

SEQ ID NO: 204262 - RNA, 22 nt, Human
ggcucucuuaacuggccauccu

SEQ ID NO: 204263 - RNA, 22 nt, Human
uuucaaggauguuauauaaaug

SEQ ID NO: 204264 - RNA, 22 nt, Human
ugcaauuaauuuacaugcuuaa

SEQ ID NO: 204265 - RNA, 22 nt, Human
agaguaaaguacuuggaauacc

SEQ ID NO: 204266 - RNA, 22 nt, Human
augguauuggaguaggacuugc

SEQ ID NO: 204267 - RNA, 22 nt, Human
agcccucugcaaacaccugaua

SEQ ID NO: 204268 - RNA, 22 nt, Human
auaaugguagauguccacgcag

SEQ ID NO: 204269 - RNA, 22 nt, Human
gcagggagguuugcugaccugg

SEQ ID NO: 204270 - RNA, 20 nt, Human
uuucauugucagaaucuuau

SEQ ID NO: 204271 - RNA, 18 nt, Human
ggccucagccuggccgga

SEQ ID NO: 204272 - RNA, 22 nt, Human
gcccugccugucugcugggagg

SEQ ID NO: 204273 - RNA, 22 nt, Human
cagcaggcagccauuucacugu

SEQ ID NO: 204274 - RNA, 22 nt, Human
auaacuuagaguaggcaaaagu

SEQ ID NO: 204275 - RNA, 22 nt, Human
ucuguggcaguucugguucauc

SEQ ID NO: 204276 - RNA, 20 nt, Human
cagagcccacuuucuuauca

SEQ ID NO: 204277 - RNA, 22 nt, Human
ccuugccuugguccuucgcagg

SEQ ID NO: 204278 - RNA, 22 nt, Human
uuucauguguugaauguguaca

SEQ ID NO: 204279 - RNA, 22 nt, Human
aaguaaaagcaggugugcuggg

SEQ ID NO: 204280 - RNA, 22 nt, Human
cuggcccugccuaauguacuug

SEQ ID NO: 204281 - RNA, 22 nt, Human
ugaaggcacguggguggauacu

SEQ ID NO: 204282 - RNA, 22 nt, Human
ugcugggggugucucaccaggc

SEQ ID NO: 204283 - RNA, 21 nt, Human
uucuguuuuuuguaccagggc

SEQ ID NO: 204284 - RNA, 22 nt, Human
aggcugagguaggaggaucgcu

SEQ ID NO: 204285 - RNA, 22 nt, Human
uuauuccauagaagucaaggaa

SEQ ID NO: 204286 - RNA, 22 nt, Human
agggucugacuccucuggcaag

SEQ ID NO: 204287 - RNA, 18 nt, Human
aucuuguuuuuggauuaa

SEQ ID NO: 204288 - RNA, 22 nt, Human
aucuaagaguuaacaucaagaa

SEQ ID NO: 204289 - RNA, 22 nt, Human
uggaucucggcaaugcgggacu

SEQ ID NO: 204290 - RNA, 22 nt, Human
uggaggaaguggacaguugugu

SEQ ID NO: 204291 - RNA, 22 nt, Human
uccaggcuggaaaugucaaacu

SEQ ID NO: 204292 - RNA, 21 nt, Human
ccacagcuggucucugagccc

SEQ ID NO: 204293 - RNA, 21 nt, Human
ucagaagugcagcccaggaau

SEQ ID NO: 204294 - RNA, 22 nt, Human
ucucagagaggggccgggccuu

SEQ ID NO: 204295 - RNA, 22 nt, Human
acauguuugccugcaggcuuag

SEQ ID NO: 204296 - RNA, 22 nt, Human
agccaggcgcaguggcuuaugc

SEQ ID NO: 204297 - RNA, 22 nt, Human
auuaaugacgcagauaauaauu

SEQ ID NO: 204298 - RNA, 21 nt, Human
gucagagaugcccaacugccu

SEQ ID NO: 204299 - RNA, 21 nt, Human
ggggaugcgaccacaggcucc

SEQ ID NO: 204300 - RNA, 22 nt, Human
cagcaucucauucauucauguu

SEQ ID NO: 204301 - RNA, 22 nt, Human
augcugagauaaggcuuuaguc

SEQ ID NO: 204302 - RNA, 22 nt, Human
ccucagucugucugaucugcca

SEQ ID NO: 204303 - RNA, 19 nt, Human
acauuuaaauucagaucuc

SEQ ID NO: 204304 - RNA, 22 nt, Human
ucucuggguucucacucagcac

SEQ ID NO: 204305 - RNA, 22 nt, Human
agagauggcgucucagagccug

SEQ ID NO: 204306 - RNA, 22 nt, Human
uguggcugggaagaagguaacu

SEQ ID NO: 204307 - RNA, 22 nt, Human
ucucuggguugagaacuaggac

SEQ ID NO: 204308 - RNA, 22 nt, Human
agaucuuuugguuauuauaaga

SEQ ID NO: 204309 - RNA, 20 nt, Human
agucacaugcauacacaagu

SEQ ID NO: 204310 - RNA, 22 nt, Human
gcuuggcagcaacaggcauccc

SEQ ID NO: 204311 - RNA, 20 nt, Human
aucugggcaucaauuuugug

SEQ ID NO: 204312 - RNA, 19 nt, Human
cugggucuuauucugugaa

SEQ ID NO: 204313 - RNA, 18 nt, Human
guauuaguuuucagagag

SEQ ID NO: 204314 - RNA, 22 nt, Human
aacucacagcuguuuggauuag

SEQ ID NO: 204315 - RNA, 23 nt, Human
ugccuuaguuagcacauuucuaa

SEQ ID NO: 204316 - RNA, 22 nt, Human
uggcaggaggaugaggcggcua

SEQ ID NO: 204317 - RNA, 22 nt, Human
ucauuucucugagucugauaau

SEQ ID NO: 204318 - RNA, 22 nt, Human
uccagccccggcuuccuuacag

SEQ ID NO: 204319 - RNA, 20 nt, Human
agauuuaccuuugagccuuc

SEQ ID NO: 204320 - RNA, 22 nt, Human
gcccaggauucuuucuuccuua

SEQ ID NO: 204321 - RNA, 22 nt, Human
ccagagaggccaaggucguggu

SEQ ID NO: 204322 - RNA, 22 nt, Human
gugguaucugucucccccacug

SEQ ID NO: 204323 - RNA, 22 nt, Human
aggcagaggaaggguggauuug

SEQ ID NO: 204324 - RNA, 22 nt, Human
aaacuagaugauuaugaagcau

SEQ ID NO: 204325 - RNA, 22 nt, Human
ucuuuguaaaugccuagcauaa

SEQ ID NO: 204326 - RNA, 22 nt, Human
cagagugggcugucagccacca

SEQ ID NO: 204327 - RNA, 17 nt, Human
uccuuggcaaccaguuc

SEQ ID NO: 204328 - RNA, 22 nt, Human
uuuagcuucaguucuagcuucu

SEQ ID NO: 204329 - RNA, 22 nt, Human
ggagagaggagcccacugcugu

SEQ ID NO: 204330 - RNA, 22 nt, Human
aguguagacauaggucuggucu

SEQ ID NO: 204331 - RNA, 22 nt, Human
agugcuuuuauuauauacagga

SEQ ID NO: 204332 - RNA, 19 nt, Human
ucuguggcuguggggagga

SEQ ID NO: 204333 - RNA, 21 nt, Human
guggcucugccaggacugaaa

SEQ ID NO: 204334 - RNA, 22 nt, Human
ucuuucaaugagcauucuuucc

SEQ ID NO: 204335 - RNA, 22 nt, Human
caggcugcuccaggguaggaaa

SEQ ID NO: 204336 - RNA, 22 nt, Human
gaguuaaaguaccuuuguaugu

SEQ ID NO: 204337 - RNA, 22 nt, Human
agagggugagcagguacacaug

SEQ ID NO: 204338 - RNA, 20 nt, Human
auuccacuuauaugaggucc

SEQ ID NO: 204339 - RNA, 22 nt, Human
cauuugaaaauacucuuuucca

SEQ ID NO: 204340 - RNA, 22 nt, Human
uuucauaauacuguacaugaaa

SEQ ID NO: 204341 - RNA, 22 nt, Human
uccaauauucauuaaaaugcag

SEQ ID NO: 204342 - RNA, 22 nt, Human
uguuuguagagacagcugaugc

SEQ ID NO: 204343 - RNA, 22 nt, Human
ugagaaccucgaagauuuugcc

SEQ ID NO: 204344 - RNA, 21 nt, Human
ugcuccaggagggggcagucc

SEQ ID NO: 204345 - RNA, 22 nt, Human
uucugagggcuaauguacugua

SEQ ID NO: 204346 - RNA, 19 nt, Human
uuugaauccagcugguaac

SEQ ID NO: 204347 - RNA, 22 nt, Human
uagcagaggaaaagagaacauu

SEQ ID NO: 204348 - RNA, 22 nt, Human
aaauauacggucccuaacaguc

SEQ ID NO: 204349 - RNA, 22 nt, Human
aaaguuuuguugauuguggaau

SEQ ID NO: 204350 - RNA, 22 nt, Human
aguuugaaaguauugacagaag

SEQ ID NO: 204351 - RNA, 22 nt, Human
ggcucagaguuaggacccaugu

SEQ ID NO: 204352 - RNA, 22 nt, Human
gggaaagaagaagagccauuuu

SEQ ID NO: 204353 - RNA, 22 nt, Human
uuagccauauagaaaaagagcu

SEQ ID NO: 204354 - RNA, 22 nt, Human
uuauucaccgcaggugcuuccc

SEQ ID NO: 204355 - RNA, 22 nt, Human
aaauuucuguuguuuugagcca

SEQ ID NO: 204356 - RNA, 22 nt, Human
ucucauuugccucaucuauaaa

SEQ ID NO: 204357 - RNA, 22 nt, Human
cuggacagugcugcuugagaug

SEQ ID NO: 204358 - RNA, 22 nt, Human
auaugugugccauuucagcagu

SEQ ID NO: 204359 - RNA, 22 nt, Human
cccaggacucuucacugcagcc

SEQ ID NO: 204360 - RNA, 22 nt, Human
uuagaaaugauuucaccucuuu

SEQ ID NO: 204361 - RNA, 22 nt, Human
auaugacagcggauucacauau

SEQ ID NO: 204362 - RNA, 22 nt, Human
acuuuucuaagcaauggucuug

SEQ ID NO: 204363 - RNA, 22 nt, Human
aagcccuguucuuucucucacc

SEQ ID NO: 204364 - RNA, 22 nt, Human
gggccaggaguggagauauggg

SEQ ID NO: 204365 - RNA, 22 nt, Human
ucucuggcuccugccgggucca

SEQ ID NO: 204366 - RNA, 22 nt, Human
ugcugccaucucaacugcccuu

SEQ ID NO: 204367 - RNA, 22 nt, Human
ucagacagcuugcagggaggug

SEQ ID NO: 204368 - RNA, 22 nt, Human
caggaaauuggcuauuugggau

SEQ ID NO: 204369 - RNA, 23 nt, Human
ucaucaaacagcugcucaagaaa

SEQ ID NO: 204370 - RNA, 22 nt, Human
guaugcaucgacucaagucuga

SEQ ID NO: 204371 - RNA, 22 nt, Human
ucagcagacauuauuuucuggc

SEQ ID NO: 204372 - RNA, 22 nt, Human
aggcuuuggggcauucuguguu

SEQ ID NO: 204373 - RNA, 19 nt, Human
ggccagcugucuccugcua

SEQ ID NO: 204374 - RNA, 22 nt, Human
ugucaucagcauauaagacagu

SEQ ID NO: 204375 - RNA, 22 nt, Human
agugacuucuccguggcaggau

SEQ ID NO: 204376 - RNA, 22 nt, Human
aauaacuugaagaucucuucca

SEQ ID NO: 204377 - RNA, 22 nt, Human
ugccuuccuggagcugaaggcu

SEQ ID NO: 204378 - RNA, 22 nt, Human
ucuguacauuuguguugugaau

SEQ ID NO: 204379 - RNA, 20 nt, Human
cagagccaagagcagcaucu

SEQ ID NO: 204380 - RNA, 22 nt, Human
ucugguccucucugugaugcua

SEQ ID NO: 204381 - RNA, 22 nt, Human
auccugggcaagucaauguccc

SEQ ID NO: 204382 - RNA, 22 nt, Human
auuucucucauuguuagcuagg

SEQ ID NO: 204383 - RNA, 20 nt, Human
aggcuccuguaccugaggaa

SEQ ID NO: 204384 - RNA, 22 nt, Human
agguccagaguugagauacaga

SEQ ID NO: 204385 - RNA, 22 nt, Human
aaagcugggcuagguuuguuuc

SEQ ID NO: 204386 - RNA, 22 nt, Human
ucuucuccauaaucaacacucu

SEQ ID NO: 204387 - RNA, 22 nt, Human
cuucccugauaagagccucaga

SEQ ID NO: 204388 - RNA, 22 nt, Human
ugaggcaggagguugagaacug

SEQ ID NO: 204389 - RNA, 22 nt, Human
acugucacuaacuaagucuagu

SEQ ID NO: 204390 - RNA, 22 nt, Human
accagcucuuucuuuucacuau

SEQ ID NO: 204391 - RNA, 22 nt, Human
acauauugagcucuaaaaguac

SEQ ID NO: 204392 - RNA, 22 nt, Human
gggucaggccucaaggugggcu

SEQ ID NO: 204393 - RNA, 22 nt, Human
ucaguguuuguggcaaauguua

SEQ ID NO: 204394 - RNA, 22 nt, Human
guuagggaucaggaacaagagc

SEQ ID NO: 204395 - RNA, 22 nt, Human
cugaggccuggugaggugguga

SEQ ID NO: 204396 - RNA, 22 nt, Human
gaacauuccuggaagagugcuu

SEQ ID NO: 204397 - RNA, 22 nt, Human
uuuuggcacugcgucuacaugg

SEQ ID NO: 204398 - RNA, 22 nt, Human
cucagccugugaagagcagagg

SEQ ID NO: 204399 - RNA, 22 nt, Human
aaacaguuucuaaucauggaga

SEQ ID NO: 204400 - RNA, 22 nt, Human
uuucacauaugguuguugauug

SEQ ID NO: 204401 - RNA, 21 nt, Human
uagaagcacauagguucaaag

SEQ ID NO: 204402 - RNA, 22 nt, Human
uuauuguaggccuauuguagaa

SEQ ID NO: 204403 - RNA, 22 nt, Human
uggcuguggguggaaggaaacc

SEQ ID NO: 204404 - RNA, 22 nt, Human
cuggcugguugucucaauccag

SEQ ID NO: 204405 - RNA, 22 nt, Human
uguuuacuggcuccugugguuc

SEQ ID NO: 204406 - RNA, 22 nt, Human
ggcaggguggcccuccagugag

SEQ ID NO: 204407 - RNA, 22 nt, Human
aggugcugugcuaugcacuugu

SEQ ID NO: 204408 - RNA, 21 nt, Human
uuguaaagguuuagaagaaug

SEQ ID NO: 204409 - RNA, 22 nt, Human
cugggccugguguggcaccugc

SEQ ID NO: 204410 - RNA, 22 nt, Human
auuaagacugcccauguuuuua

SEQ ID NO: 204411 - RNA, 22 nt, Human
cuugccagcacuuggccagcug

SEQ ID NO: 204412 - RNA, 22 nt, Human
gcugcucuccauggccgugagu

SEQ ID NO: 204413 - RNA, 19 nt, Human
uugagcagugcuuagcacc

SEQ ID NO: 204414 - RNA, 21 nt, Human
agucuggggaagggaucccag

SEQ ID NO: 204415 - RNA, 22 nt, Human
gccacugcacuccagcccaggc

SEQ ID NO: 204416 - RNA, 22 nt, Human
auaucuuggccccaggauuuua

SEQ ID NO: 204417 - RNA, 22 nt, Human
cccuagaaaugaaagcauacgu

SEQ ID NO: 204418 - RNA, 22 nt, Human
cuuaauuuaagccuagaaugca

SEQ ID NO: 204419 - RNA, 22 nt, Human
gacuucaaaggucaaacaucgc

SEQ ID NO: 204420 - RNA, 18 nt, Human
aagggcuggccuuuggag

SEQ ID NO: 204421 - RNA, 22 nt, Human
cuguccuguacuuugaggcccu

SEQ ID NO: 204422 - RNA, 21 nt, Human
uuuagggaccaggucauaggc

SEQ ID NO: 204423 - RNA, 22 nt, Human
gccuggcauauaguaguugugc

SEQ ID NO: 204424 - RNA, 23 nt, Human
aacuuuuagaguuuaacaguguu

SEQ ID NO: 204425 - RNA, 22 nt, Human
ccagggcuggaccagugcuugg

SEQ ID NO: 204426 - RNA, 22 nt, Human
cagugagcacggccagagggga

SEQ ID NO: 204427 - RNA, 22 nt, Human
gagggcugauaacaggaauaca

SEQ ID NO: 204428 - RNA, 22 nt, Human
uggagccuguucugagaagccg

SEQ ID NO: 204429 - RNA, 22 nt, Human
caggacucacuucucacauccc

SEQ ID NO: 204430 - RNA, 22 nt, Human
auaaucuuguauuuccuaaagu

SEQ ID NO: 204431 - RNA, 22 nt, Human
ugaagguaauggaaucuccuga

SEQ ID NO: 204432 - RNA, 22 nt, Human
gagaugcugucaggcuaucugu

SEQ ID NO: 204433 - RNA, 22 nt, Human
guagggcagaaguucaaugugg

SEQ ID NO: 204434 - RNA, 22 nt, Human
agacaaaugaacaaauauguga

SEQ ID NO: 204435 - RNA, 22 nt, Human
cuccagugcgucuuaguaaacc

SEQ ID NO: 204436 - RNA, 22 nt, Human
guuuuauaauugcuucauaaga

SEQ ID NO: 204437 - RNA, 22 nt, Human
gggccuggggacaccaccauga

SEQ ID NO: 204438 - RNA, 22 nt, Human
cucaggccugaguggcaguccc

SEQ ID NO: 204439 - RNA, 19 nt, Human
ugccaggaauacuccagaa

SEQ ID NO: 204440 - RNA, 21 nt, Human
uuggaauuugggagcuaugug

SEQ ID NO: 204441 - RNA, 22 nt, Human
uccuggccacacauuaauagug

SEQ ID NO: 204442 - RNA, 22 nt, Human
caguuccuugagaaugguugcu

SEQ ID NO: 204443 - RNA, 22 nt, Human
aggcuggcggugacugcucuga

SEQ ID NO: 204444 - RNA, 22 nt, Human
aguggcuggucuaaggucacag

SEQ ID NO: 204445 - RNA, 22 nt, Human
caggggccuguccuggcuucug

SEQ ID NO: 204446 - RNA, 20 nt, Human
gggaugagaguccuagcucu

SEQ ID NO: 204447 - RNA, 22 nt, Human
aaagcacauuacaagcucaguc

SEQ ID NO: 204448 - RNA, 22 nt, Human
cuccuggaucuuagccagauuc

SEQ ID NO: 204449 - RNA, 22 nt, Human
agagccaggaaguggcgugggg

SEQ ID NO: 204450 - RNA, 22 nt, Human
auaucaguaucuauguauuugu

SEQ ID NO: 204451 - RNA, 22 nt, Human
ucagcagggagaggagaaugca

SEQ ID NO: 204452 - RNA, 22 nt, Human
ggaagaggcugagccagguccc

SEQ ID NO: 204453 - RNA, 22 nt, Human
gcugccuugguagugaccaucu

SEQ ID NO: 204454 - RNA, 22 nt, Human
uccucagaauggauggcagggg

SEQ ID NO: 204455 - RNA, 22 nt, Human
uucagagaagugcacaaaauca

SEQ ID NO: 204456 - RNA, 22 nt, Human
uuucaggagagaccagaaauga

SEQ ID NO: 204457 - RNA, 22 nt, Human
uugaaucuauguauucagugua

SEQ ID NO: 204458 - RNA, 22 nt, Human
ccucugccaccucccacgaggc

SEQ ID NO: 204459 - RNA, 22 nt, Human
aguaccugauuucacagaccag

SEQ ID NO: 204460 - RNA, 22 nt, Human
cagugcagguuuagggcugggg

SEQ ID NO: 204461 - RNA, 22 nt, Human
gcccagccccuggguggacgug

SEQ ID NO: 204462 - RNA, 22 nt, Human
uggaaacucuaccucucuaaga

SEQ ID NO: 204463 - RNA, 22 nt, Human
uucaguuuccacuuacauuuaa

SEQ ID NO: 204464 - RNA, 22 nt, Human
ggcuccugaggaccaggcacag

SEQ ID NO: 204465 - RNA, 22 nt, Human
cucguugcugaagccaaaguca

SEQ ID NO: 204466 - RNA, 22 nt, Human
gaaccuuaugguaaaucuagag

SEQ ID NO: 204467 - RNA, 22 nt, Human
uggagcagaaauuugaagccau

SEQ ID NO: 204468 - RNA, 22 nt, Human
cucagagccccaggagggugug

SEQ ID NO: 204469 - RNA, 22 nt, Human
uacaguuuagaaccauagaugg

SEQ ID NO: 204470 - RNA, 22 nt, Human
cugccaugugugaaaggggagg

SEQ ID NO: 204471 - RNA, 18 nt, Human
cugggccuuuguauuuuu

SEQ ID NO: 204472 - RNA, 22 nt, Human
cagaugcuaaacaaaggacuuu

SEQ ID NO: 204473 - RNA, 20 nt, Human
aauguauuguuuuguuucag

SEQ ID NO: 204474 - RNA, 22 nt, Human
ugugggaaaugggaguggaaga

SEQ ID NO: 204475 - RNA, 22 nt, Human
uggcauugacgcugaccugcac

SEQ ID NO: 204476 - RNA, 17 nt, Human
gcagugaaaagagauca

SEQ ID NO: 204477 - RNA, 20 nt, Human
guccagugggccuucauuuc

SEQ ID NO: 204478 - RNA, 22 nt, Human
cuguccagucagaacgucauua

SEQ ID NO: 204479 - RNA, 22 nt, Human
gggcuggcaucgguugcugaga

SEQ ID NO: 204480 - RNA, 22 nt, Human
uuuauuuggcauccagggagaa

SEQ ID NO: 204481 - RNA, 22 nt, Human
uuaagcauggaagugaaauaau

SEQ ID NO: 204482 - RNA, 21 nt, Human
agcugaaaaguuguuuacaag

SEQ ID NO: 204483 - RNA, 19 nt, Human
ggcugcugaagagaauuac

SEQ ID NO: 204484 - RNA, 22 nt, Human
acauggaaaacuaacugcuuuu

SEQ ID NO: 204485 - RNA, 21 nt, Human
ucaggcagugcaaauacaugg

SEQ ID NO: 204486 - RNA, 22 nt, Human
uuaauuaaauucaugagcauug

SEQ ID NO: 204487 - RNA, 22 nt, Human
uucaauucugcucugaucuuag

SEQ ID NO: 204488 - RNA, 22 nt, Human
ugcagggaggccccgcagcccu

SEQ ID NO: 204489 - RNA, 22 nt, Human
cugugacccaguuccuggcacc

SEQ ID NO: 204490 - RNA, 22 nt, Human
gccugggaaaugguggggucag

SEQ ID NO: 204491 - RNA, 22 nt, Human
uuagauaaauuaagacuuuaca

SEQ ID NO: 204492 - RNA, 22 nt, Human
aucauucuagcuguuguguuga

SEQ ID NO: 204493 - RNA, 22 nt, Human
uggcugagccacuuguucagau

SEQ ID NO: 204494 - RNA, 22 nt, Human
uguggcagaggaggcagcgucc

SEQ ID NO: 204495 - RNA, 22 nt, Human
uucagagcagauauugaagggu

SEQ ID NO: 204496 - RNA, 22 nt, Human
auuaguaguaguuagcagccuc

SEQ ID NO: 204497 - RNA, 22 nt, Human
uuuuaaaggauagcucugguug

SEQ ID NO: 204498 - RNA, 22 nt, Human
ccagaacugagaaaauaaauuu

SEQ ID NO: 204499 - RNA, 19 nt, Human
gucccuucacuccugcugg

SEQ ID NO: 204500 - RNA, 22 nt, Human
uccagggcuggguuggcucagc

SEQ ID NO: 204501 - RNA, 20 nt, Human
ugcccagcaagagugcaguu

SEQ ID NO: 204502 - RNA, 22 nt, Human
uuacuguucauguuguacacuu

SEQ ID NO: 204503 - RNA, 22 nt, Human
cuuucuggaguggaaagguauu

SEQ ID NO: 204504 - RNA, 22 nt, Human
cagcucuuggagaaaccagagc

SEQ ID NO: 204505 - RNA, 22 nt, Human
ugugucaauuuucauuccuacu

SEQ ID NO: 204506 - RNA, 22 nt, Human
gaagacacucugcagaguuauc

SEQ ID NO: 204507 - RNA, 22 nt, Human
acuaacauuuguguaugucuug

SEQ ID NO: 204508 - RNA, 22 nt, Human
caggcagcauuuacucugauga

SEQ ID NO: 204509 - RNA, 17 nt, Human
aauguggaaguacaugc

SEQ ID NO: 204510 - RNA, 22 nt, Human
gcacuucuggccuggccugugu

SEQ ID NO: 204511 - RNA, 22 nt, Human
gcagguggucacucauccccag

SEQ ID NO: 204512 - RNA, 22 nt, Human
cacaucagguagaccuacagag

SEQ ID NO: 204513 - RNA, 19 nt, Human
cuguuauugucagagcucc

SEQ ID NO: 204514 - RNA, 17 nt, Human
cuacaguguguuuccug

SEQ ID NO: 204515 - RNA, 22 nt, Human
gugcuuuuaacuuuugaaagga

SEQ ID NO: 204516 - RNA, 23 nt, Human
aaagcaaggaauuggcaacagag

SEQ ID NO: 204517 - RNA, 22 nt, Human
cuuaaagaguauuuaauauaau

SEQ ID NO: 204518 - RNA, 20 nt, Human
agcuucuucugucuaauuuu

SEQ ID NO: 204519 - RNA, 19 nt, Human
ugagaaggcaguggggagc

SEQ ID NO: 204520 - RNA, 19 nt, Human
caguggccuggaggucucu

SEQ ID NO: 204521 - RNA, 22 nt, Human
ucacauucuuuauuugccaucc

SEQ ID NO: 204522 - RNA, 22 nt, Human
ugcaggugaaaauuaugaggau

SEQ ID NO: 204523 - RNA, 22 nt, Human
ugcaggcucaccugccagggcc

SEQ ID NO: 204524 - RNA, 22 nt, Human
ucaagcugcaucagugcaguga

SEQ ID NO: 204525 - RNA, 19 nt, Human
uccuuaaaaaagcaguucu

SEQ ID NO: 204526 - RNA, 19 nt, Human
cagcagccagggggccccu

SEQ ID NO: 204527 - RNA, 22 nt, Human
caucccugcccucaugccuaua

SEQ ID NO: 204528 - RNA, 22 nt, Human
gggaagcaggugcagcucgccu

SEQ ID NO: 204529 - RNA, 22 nt, Human
ugcagggacacgaagacaaaua

SEQ ID NO: 204530 - RNA, 22 nt, Human
uaggcaggugugcacugcccac

SEQ ID NO: 204531 - RNA, 22 nt, Human
uuccugggcaggacgagagucu

SEQ ID NO: 204532 - RNA, 22 nt, Human
agaccacuuggauaagaaacag

SEQ ID NO: 204533 - RNA, 22 nt, Human
agcaggcuccuuccuucucugg

SEQ ID NO: 204534 - RNA, 22 nt, Human
auacacuucauguuuucaucug

SEQ ID NO: 204535 - RNA, 22 nt, Human
ugaucugguccuacugugggca

SEQ ID NO: 204536 - RNA, 22 nt, Human
gaauacauggcagggagucauc

SEQ ID NO: 204537 - RNA, 22 nt, Human
caugcaaaggucaagaucagga

SEQ ID NO: 204538 - RNA, 22 nt, Human
acaucuguuugagaaaaagaag

SEQ ID NO: 204539 - RNA, 22 nt, Human
ugggagaagcagcagccaagug

SEQ ID NO: 204540 - RNA, 22 nt, Human
cauaauuacugauaugcugauu

SEQ ID NO: 204541 - RNA, 22 nt, Human
uagaugaagggguucagcaugg

SEQ ID NO: 204542 - RNA, 20 nt, Human
accagaggaaagagcaguga

SEQ ID NO: 204543 - RNA, 18 nt, Human
acagcagguuucauucuu

SEQ ID NO: 204544 - RNA, 20 nt, Human
uuggaagguggagaagagga

SEQ ID NO: 204545 - RNA, 22 nt, Human
uucauacauguguacuguucca

SEQ ID NO: 204546 - RNA, 22 nt, Human
uagcagaaacuguuacagaagg

SEQ ID NO: 204547 - RNA, 22 nt, Human
ccagggaggagcauuucauggu

SEQ ID NO: 204548 - RNA, 22 nt, Human
gcuuuaaaccucuacucugucc

SEQ ID NO: 204549 - RNA, 22 nt, Human
uuuguucaauccagacaauagc

SEQ ID NO: 204550 - RNA, 22 nt, Human
cuguuacugcuggagccauuga

SEQ ID NO: 204551 - RNA, 22 nt, Human
aggcuagcuguuucagggcuag

SEQ ID NO: 204552 - RNA, 22 nt, Human
gcugguggugggccaguucugu

SEQ ID NO: 204553 - RNA, 22 nt, Human
aggagccuggcuggcccacagg

SEQ ID NO: 204554 - RNA, 22 nt, Human
auuauuguacuuucaauaaggu

SEQ ID NO: 204555 - RNA, 21 nt, Human
ugcagcagaguaagcagggga

SEQ ID NO: 204556 - RNA, 22 nt, Human
ucaggucuuuugucuccuagaa

SEQ ID NO: 204557 - RNA, 22 nt, Human
uauuuaagaugugucauaaaga

SEQ ID NO: 204558 - RNA, 22 nt, Human
gagaaagacguaggcugggagg

SEQ ID NO: 204559 - RNA, 22 nt, Human
auucucaguucacuaguuucuu

SEQ ID NO: 204560 - RNA, 22 nt, Human
ccucccaccguaucucaguggc

SEQ ID NO: 204561 - RNA, 22 nt, Human
ucuuuggauuaaaauauuugua

SEQ ID NO: 204562 - RNA, 22 nt, Human
uagggcugcugcagaugacagg

SEQ ID NO: 204563 - RNA, 22 nt, Human
cuggaucuucagagaucaccag

SEQ ID NO: 204564 - RNA, 22 nt, Human
ugucucugucuuccagggcugu

SEQ ID NO: 204565 - RNA, 22 nt, Human
ugcagaggugaaagacuagcaa

SEQ ID NO: 204566 - RNA, 22 nt, Human
ggcugugccucuggcagcacau

SEQ ID NO: 204567 - RNA, 20 nt, Human
uuguauuccuugaaucaggu

SEQ ID NO: 204568 - RNA, 22 nt, Human
ugcaggagcaccagcucacccu

SEQ ID NO: 204569 - RNA, 21 nt, Human
agcagagugcuuugacuuugu

SEQ ID NO: 204570 - RNA, 22 nt, Human
aggcuccuugcucacaggcuca

SEQ ID NO: 204571 - RNA, 22 nt, Human
gaggccuggaauuccagccugg

SEQ ID NO: 204572 - RNA, 22 nt, Human
uagcuuuaaugaguugguaaga

SEQ ID NO: 204573 - RNA, 21 nt, Human
ccugggugggaccccucuucc

SEQ ID NO: 204574 - RNA, 22 nt, Human
caaauuguguuugcuuuucucu

SEQ ID NO: 204575 - RNA, 22 nt, Human
uauuucaggggguacaagaaga

SEQ ID NO: 204576 - RNA, 22 nt, Human
gguagaaagauggaacguugaa

SEQ ID NO: 204577 - RNA, 22 nt, Human
cccaggacuaaugagcucuacg

SEQ ID NO: 204578 - RNA, 22 nt, Human
aaggagaauuuggcuugugaug

SEQ ID NO: 204579 - RNA, 19 nt, Human
uuuaagcauagaggccaga

SEQ ID NO: 204580 - RNA, 23 nt, Human
aaagagacugauacggaaguucc

SEQ ID NO: 204581 - RNA, 22 nt, Human
agcucuuccugcaccuguggcu

SEQ ID NO: 204582 - RNA, 22 nt, Human
uuucuuuauccuccuuugcaca

SEQ ID NO: 204583 - RNA, 22 nt, Human
uuucauguuacaguguaaaagu

SEQ ID NO: 204584 - RNA, 22 nt, Human
ugagcauggugggugcagagca

SEQ ID NO: 204585 - RNA, 19 nt, Human
ucaguggaugaacauguuu

SEQ ID NO: 204586 - RNA, 22 nt, Human
gcaugaaaugagcgaauauaau

SEQ ID NO: 204587 - RNA, 22 nt, Human
cagggccagccauccugcuggg

SEQ ID NO: 204588 - RNA, 22 nt, Human
cccaggcugauguucagcgggu

SEQ ID NO: 204589 - RNA, 22 nt, Human
agaugcagacuugguucaggca

SEQ ID NO: 204590 - RNA, 22 nt, Human
aguagcaguuuggcugaauuua

SEQ ID NO: 204591 - RNA, 22 nt, Human
cucacugugaccucagcagaca

SEQ ID NO: 204592 - RNA, 22 nt, Human
gaauguuugacuaaagguagcu

SEQ ID NO: 204593 - RNA, 22 nt, Human
augggaggcagcagagcccagc

SEQ ID NO: 204594 - RNA, 22 nt, Human
cagaggaggcgguauacacugc

SEQ ID NO: 204595 - RNA, 20 nt, Human
ccucuguguccugugucaua

SEQ ID NO: 204596 - RNA, 22 nt, Human
ggcacugggagaggugagacgg

SEQ ID NO: 204597 - RNA, 22 nt, Human
ugacccauuugcuuuuccugua

SEQ ID NO: 204598 - RNA, 22 nt, Human
cuugucugggcagcuugggagu

SEQ ID NO: 204599 - RNA, 22 nt, Human
aagcuggacucugccauuuacu

SEQ ID NO: 204600 - RNA, 22 nt, Human
uugcaacagguguguuuuggug

SEQ ID NO: 204601 - RNA, 22 nt, Human
acagcagaucuguggagcuuau

SEQ ID NO: 204602 - RNA, 19 nt, Human
ugugugguuggugaaacuc

SEQ ID NO: 204603 - RNA, 22 nt, Human
ugauuuuauugaaacuucacuu

SEQ ID NO: 204604 - RNA, 22 nt, Human
acccugggaccuggagguggau

SEQ ID NO: 204605 - RNA, 22 nt, Human
gcaguccuagggugcucugcag

SEQ ID NO: 204606 - RNA, 22 nt, Human
uccugaaauucugguugucacu

SEQ ID NO: 204607 - RNA, 22 nt, Human
ggugggggagacuuggucaaga

SEQ ID NO: 204608 - RNA, 22 nt, Human
gcugaggacaucauggaaggaa

SEQ ID NO: 204609 - RNA, 22 nt, Human
uccuggugucgccuggucaguu

SEQ ID NO: 204610 - RNA, 22 nt, Human
ugccaggcuuuggucaaaggcu

SEQ ID NO: 204611 - RNA, 22 nt, Human
uuccugguuuauaccuguauca

SEQ ID NO: 204612 - RNA, 22 nt, Human
ugcuuuauuaagagagaaauuu

SEQ ID NO: 204613 - RNA, 22 nt, Human
uguguacacacagauauauaca

SEQ ID NO: 204614 - RNA, 22 nt, Human
uuucaguuaaguggcuaguccc

SEQ ID NO: 204615 - RNA, 22 nt, Human
ugcagggcuaagucagagccug

SEQ ID NO: 204616 - RNA, 22 nt, Human
gggaggcacgaggcgcgcagug

SEQ ID NO: 204617 - RNA, 22 nt, Human
uaaaggcuucugcagggacuga

SEQ ID NO: 204618 - RNA, 22 nt, Human
ccauuccaugugcuacacauaa

SEQ ID NO: 204619 - RNA, 22 nt, Human
cuccagcuuuuucccaguuggc

SEQ ID NO: 204620 - RNA, 22 nt, Human
uccugaaaauaauuucacaaga

SEQ ID NO: 204621 - RNA, 22 nt, Human
uggcagcugccauguccacgug

SEQ ID NO: 204622 - RNA, 22 nt, Human
uuguacaacguuuuaaauuuga

SEQ ID NO: 204623 - RNA, 22 nt, Human
ggucuggcacucaugcagcagg

SEQ ID NO: 204624 - RNA, 22 nt, Human
ucaggaagaagacggggcagga

SEQ ID NO: 204625 - RNA, 22 nt, Human
ugcagagagaccccugggccag

SEQ ID NO: 204626 - RNA, 22 nt, Human
uugggaagaaacauguccauca

SEQ ID NO: 204627 - RNA, 22 nt, Human
guggauggcuaguugagaaggg

SEQ ID NO: 204628 - RNA, 22 nt, Human
cugggcacugcagcaggcauca

SEQ ID NO: 204629 - RNA, 22 nt, Human
gauaagcacuauauaaguauuu

SEQ ID NO: 204630 - RNA, 22 nt, Human
guuagggagggugcauaugugu

SEQ ID NO: 204631 - RNA, 22 nt, Human
cuuacaaauacacuuaggagag

SEQ ID NO: 204632 - RNA, 22 nt, Human
uaagguuucuaguuucuaaacu

SEQ ID NO: 204633 - RNA, 22 nt, Human
cuccacagagaugcugauugua

SEQ ID NO: 204634 - RNA, 22 nt, Human
gcaggugucaguccccaaggug

SEQ ID NO: 204635 - RNA, 22 nt, Human
ucaaggaaggucuguugcucca

SEQ ID NO: 204636 - RNA, 22 nt, Human
ccagaggcuggguucaccucag

SEQ ID NO: 204637 - RNA, 22 nt, Human
uugugaauagugccgcaauaaa

SEQ ID NO: 204638 - RNA, 22 nt, Human
ggaggcaucucuguggcugucu

SEQ ID NO: 204639 - RNA, 22 nt, Human
agagagcccgggccagggcaca

SEQ ID NO: 204640 - RNA, 22 nt, Human
cuucucagucuugguuagagag

SEQ ID NO: 204641 - RNA, 22 nt, Human
uacaggagcugcucugugauac

SEQ ID NO: 204642 - RNA, 22 nt, Human
gccucucuccuuggcuugcagu

SEQ ID NO: 204643 - RNA, 22 nt, Human
uuggaggauaaggauauugauu

SEQ ID NO: 204644 - RNA, 22 nt, Human
ggcuggcuggaugaauggauua

SEQ ID NO: 204645 - RNA, 22 nt, Human
aucuuuaguagaggaauauauu

SEQ ID NO: 204646 - RNA, 22 nt, Human
acagcaggcaugaagaaauguu

SEQ ID NO: 204647 - RNA, 22 nt, Human
caucacauuagucucaagagaa

SEQ ID NO: 204648 - RNA, 22 nt, Human
acaugcauaggagaagucuuua

SEQ ID NO: 204649 - RNA, 23 nt, Human
accuacauuauagggauaugggu

SEQ ID NO: 204650 - RNA, 20 nt, Human
gggugggagagucugagggu

SEQ ID NO: 204651 - RNA, 22 nt, Human
uucucugguuugcuguuucuga

SEQ ID NO: 204652 - RNA, 22 nt, Human
ugccaggaggaggugggacaga

SEQ ID NO: 204653 - RNA, 22 nt, Human
gugagcaggauaggggcucccu

SEQ ID NO: 204654 - RNA, 22 nt, Human
uccugggucugggugucugagg

SEQ ID NO: 204655 - RNA, 22 nt, Human
uucuuuagguagauccaguuuu

SEQ ID NO: 204656 - RNA, 22 nt, Human
uaguuuuuaaguguacaauuuc

SEQ ID NO: 204657 - RNA, 22 nt, Human
ugcaaccugcacucugucuuua

SEQ ID NO: 204658 - RNA, 22 nt, Human
uuaguacaagagauuaauuacu

SEQ ID NO: 204659 - RNA, 22 nt, Human
aggcuggagacccgccaagaaa

SEQ ID NO: 204660 - RNA, 22 nt, Human
ucucaaauuugcuggaccagua

SEQ ID NO: 204661 - RNA, 22 nt, Human
acaguacaagcaugauacauaa

SEQ ID NO: 204662 - RNA, 22 nt, Human
gagggcacgaaacaaccacuuc

SEQ ID NO: 204663 - RNA, 22 nt, Human
cagguauuuucaaggcuugugu

SEQ ID NO: 204664 - RNA, 22 nt, Human
uacaggcacugaaaugcuuauu

SEQ ID NO: 204665 - RNA, 22 nt, Human
uaauuuaugaugcaaagaaaag

SEQ ID NO: 204666 - RNA, 22 nt, Human
acuuggcaaguaucuauaaagu

SEQ ID NO: 204667 - RNA, 22 nt, Human
uggcacagacugggccaaggaa

SEQ ID NO: 204668 - RNA, 23 nt, Human
ugucuggggcgccagaagagaga

SEQ ID NO: 204669 - RNA, 22 nt, Human
uggcuggggccacaguuuuccu

SEQ ID NO: 204670 - RNA, 22 nt, Human
gucucugugccuucuccccacc

SEQ ID NO: 204671 - RNA, 22 nt, Human
gaggaacaagcugcuuuaucuu

SEQ ID NO: 204672 - RNA, 22 nt, Human
acacagagggcagaagauacau

SEQ ID NO: 204673 - RNA, 17 nt, Human
aagagaggcugagcugg

SEQ ID NO: 204674 - RNA, 22 nt, Human
agcagcaguccuuuguguaauu

SEQ ID NO: 204675 - RNA, 22 nt, Human
gcacagcucuccccaagacgaa

SEQ ID NO: 204676 - RNA, 22 nt, Human
uucaucuguaguuuuuccaagg

SEQ ID NO: 204677 - RNA, 22 nt, Human
agaccgagaaguucuccaggcc

SEQ ID NO: 204678 - RNA, 22 nt, Human
ucagcuccucaugcaggggaua

SEQ ID NO: 204679 - RNA, 19 nt, Human
acuguucuaacuugcagcu

SEQ ID NO: 204680 - RNA, 22 nt, Human
aaugggcuuuggccaguaggag

SEQ ID NO: 204681 - RNA, 22 nt, Human
aaggaggacacccaggacuggg

SEQ ID NO: 204682 - RNA, 22 nt, Human
caguggcuucuuccuagagcca

SEQ ID NO: 204683 - RNA, 21 nt, Human
agaagcuagucacuaaaucca

SEQ ID NO: 204684 - RNA, 22 nt, Human
ugugaaagauacuaggcagagg

SEQ ID NO: 204685 - RNA, 22 nt, Human
ugauugaagaggugaggaaguu

SEQ ID NO: 204686 - RNA, 22 nt, Human
gauagaaagagugguucuuuuu

SEQ ID NO: 204687 - RNA, 22 nt, Human
aucacugucgucaucugagauu

SEQ ID NO: 204688 - RNA, 22 nt, Human
uucccacaguguugaauccucu

SEQ ID NO: 204689 - RNA, 22 nt, Human
ucagcuuucucaaagaagcugg

SEQ ID NO: 204690 - RNA, 22 nt, Human
aaggcagcaccgccuccugaaa

SEQ ID NO: 204691 - RNA, 22 nt, Human
cuccuggaagcccgcccugcug

SEQ ID NO: 204692 - RNA, 22 nt, Human
ucacagugcaggaucaguuaau

SEQ ID NO: 204693 - RNA, 22 nt, Human
uucauacaugagacuagaugca

SEQ ID NO: 204694 - RNA, 22 nt, Human
cuucugaagagguuaucauaga

SEQ ID NO: 204695 - RNA, 22 nt, Human
aacccaggucuuuggcuuccag

SEQ ID NO: 204696 - RNA, 17 nt, Human
ccaggcuccaucacugu

SEQ ID NO: 204697 - RNA, 22 nt, Human
agauggagaccuuggaugaacu

SEQ ID NO: 204698 - RNA, 22 nt, Human
cugacugucucuucucccauga

SEQ ID NO: 204699 - RNA, 22 nt, Human
cuugccugggacugaggcauuu

SEQ ID NO: 204700 - RNA, 22 nt, Human
uucuuuauguuaaugaaucuau

SEQ ID NO: 204701 - RNA, 22 nt, Human
ucaucuguuaugggaguuuuug

SEQ ID NO: 204702 - RNA, 22 nt, Human
agggccaggaucacagccaaga

SEQ ID NO: 204703 - RNA, 22 nt, Human
uucaggauaugugauaucugaa

SEQ ID NO: 204704 - RNA, 22 nt, Human
ugggaagaagcagagaacugga

SEQ ID NO: 204705 - RNA, 21 nt, Human
cugugaccuuucuuuccuccu

SEQ ID NO: 204706 - RNA, 17 nt, Human
ggcucugggugucacau

SEQ ID NO: 204707 - RNA, 22 nt, Human
gaugaauuguuauggcuacgag

SEQ ID NO: 204708 - RNA, 17 nt, Human
ugucuucugaagagagc

SEQ ID NO: 204709 - RNA, 22 nt, Human
uccauucuaugcuuacauuuau

SEQ ID NO: 204710 - RNA, 23 nt, Human
ugggaaauguagccuuggcauga

SEQ ID NO: 204711 - RNA, 21 nt, Human
ugacaggcacccuggcuguga

SEQ ID NO: 204712 - RNA, 22 nt, Human
aaggccaggccagaugacaguc

SEQ ID NO: 204713 - RNA, 22 nt, Human
gauuuuaucuuugugugcagua

SEQ ID NO: 204714 - RNA, 19 nt, Human
auuuuucuuccucugugca

SEQ ID NO: 204715 - RNA, 22 nt, Human
cuugagaacaggguuagguaac

SEQ ID NO: 204716 - RNA, 22 nt, Human
acuugguguauuagcucucacu

SEQ ID NO: 204717 - RNA, 22 nt, Human
aacaaaguguacuuccauacug

SEQ ID NO: 204718 - RNA, 22 nt, Human
gaaaugaaauagcaccaagguu

SEQ ID NO: 204719 - RNA, 22 nt, Human
uuucugaaaucucuuuugagga

SEQ ID NO: 204720 - RNA, 22 nt, Human
uucacaaagcuggagcauuucc

SEQ ID NO: 204721 - RNA, 23 nt, Human
cauguacagaguuugauaaagug

SEQ ID NO: 204722 - RNA, 22 nt, Human
cagcuggcuggucagugcacaa

SEQ ID NO: 204723 - RNA, 22 nt, Human
uguuuucaucacagaauguaac

SEQ ID NO: 204724 - RNA, 22 nt, Human
caugugaauuccaaagcuaggu

SEQ ID NO: 204725 - RNA, 22 nt, Human
ucagaaguaagguucucccaag

SEQ ID NO: 204726 - RNA, 22 nt, Human
agcagcaaguguaacugaauau

SEQ ID NO: 204727 - RNA, 22 nt, Human
aaggaccuauauugucagagga

SEQ ID NO: 204728 - RNA, 22 nt, Human
acuguauucuagucauguuugu

SEQ ID NO: 204729 - RNA, 22 nt, Human
aauauugagaaccagcauguuu

SEQ ID NO: 204730 - RNA, 22 nt, Human
cacagaacaccaaagaaccuuc

SEQ ID NO: 204731 - RNA, 22 nt, Human
gacuccuggcuuucccucuuag

SEQ ID NO: 204732 - RNA, 22 nt, Human
augcacaauuaggauauagcuu

SEQ ID NO: 204733 - RNA, 22 nt, Human
ucugugcugcaggagucugcau

SEQ ID NO: 204734 - RNA, 22 nt, Human
ugccaaguuucucucagggacu

SEQ ID NO: 204735 - RNA, 22 nt, Human
aucaguauacaggggacauuca

SEQ ID NO: 204736 - RNA, 22 nt, Human
gauauaaauuaaucaagugcaa

SEQ ID NO: 204737 - RNA, 22 nt, Human
uuucuauugaucuaauaaacau

SEQ ID NO: 204738 - RNA, 22 nt, Human
ugucaauauguaauaacugaau

SEQ ID NO: 204739 - RNA, 22 nt, Human
ucuggcaguggaugagggcagc

SEQ ID NO: 204740 - RNA, 22 nt, Human
cuggcccuugacuuacagcagg

SEQ ID NO: 204741 - RNA, 22 nt, Human
uuucuagucuucccuaccuccc

SEQ ID NO: 204742 - RNA, 22 nt, Human
auugucuuuccacugagaaguu

SEQ ID NO: 204743 - RNA, 22 nt, Human
acacaaacugcuagaaaauugg

SEQ ID NO: 204744 - RNA, 22 nt, Human
ggccucucuccagucagugcag

SEQ ID NO: 204745 - RNA, 22 nt, Human
augacaaggguugacacauguc

SEQ ID NO: 204746 - RNA, 21 nt, Human
cugggcucaagcaauccuuuc

SEQ ID NO: 204747 - RNA, 22 nt, Human
ugccaggcuguccugggccugg

SEQ ID NO: 204748 - RNA, 22 nt, Human
agccaacacauguaaaugcacc

SEQ ID NO: 204749 - RNA, 22 nt, Human
agcaaucaccaccucuauauuu

SEQ ID NO: 204750 - RNA, 22 nt, Human
ccaguguucauaauuuuacacu

SEQ ID NO: 204751 - RNA, 22 nt, Human
ugcagggcccuugggguugaac

SEQ ID NO: 204752 - RNA, 22 nt, Human
ccaugcugugacacaguaguua

SEQ ID NO: 204753 - RNA, 22 nt, Human
acagcugggaacucacacagca

SEQ ID NO: 204754 - RNA, 22 nt, Human
uaaaggcaaauguguguuugug

SEQ ID NO: 204755 - RNA, 22 nt, Human
cugggcucuaggaaccauuccu

SEQ ID NO: 204756 - RNA, 22 nt, Human
gcacaggaggccgaugcucaug

SEQ ID NO: 204757 - RNA, 22 nt, Human
gggcuggacaucuaagguagcu

SEQ ID NO: 204758 - RNA, 22 nt, Human
auugguauguauucugaaaacu

SEQ ID NO: 204759 - RNA, 22 nt, Human
ggagaaagcuguaguggaaugu

SEQ ID NO: 204760 - RNA, 22 nt, Human
uucugacagcaaaacucagccu

SEQ ID NO: 204761 - RNA, 22 nt, Human
gguccagguccugugacagcag

SEQ ID NO: 204762 - RNA, 22 nt, Human
cccuggagcuagucugagcaga

SEQ ID NO: 204763 - RNA, 22 nt, Human
gaggcuggucagcccuaagauc

SEQ ID NO: 204764 - RNA, 22 nt, Human
gggucagggcugccugggcuca

SEQ ID NO: 204765 - RNA, 22 nt, Human
ugcuggcuuuuccuucaggcag

SEQ ID NO: 204766 - RNA, 22 nt, Human
ccaggcaccauguucuuaggac

SEQ ID NO: 204767 - RNA, 22 nt, Human
ccuuuucuggccaccaagcgcu

SEQ ID NO: 204768 - RNA, 22 nt, Human
aaacugcagagccaugguucaa

SEQ ID NO: 204769 - RNA, 20 nt, Human
aggcucugccugcaggccca

SEQ ID NO: 204770 - RNA, 22 nt, Human
uuuaucuggacugugauauaaa

SEQ ID NO: 204771 - RNA, 22 nt, Human
uuagaagcaucaccuguucugg

SEQ ID NO: 204772 - RNA, 22 nt, Human
cucaggagagucuuauaucucc

SEQ ID NO: 204773 - RNA, 22 nt, Human
guaaauaacugguaauuggggu

SEQ ID NO: 204774 - RNA, 22 nt, Human
aguguauuacagaacugacauu

SEQ ID NO: 204775 - RNA, 22 nt, Human
ccugggcuguugcaucauccuu

SEQ ID NO: 204776 - RNA, 22 nt, Human
gaggauggaggcaguuagggcc

SEQ ID NO: 204777 - RNA, 22 nt, Human
cucuguugucaguggaagcagc

SEQ ID NO: 204778 - RNA, 22 nt, Human
agggcaugcuggaggagagaca

SEQ ID NO: 204779 - RNA, 22 nt, Human
uaggguccauauggaugaaugg

SEQ ID NO: 204780 - RNA, 22 nt, Human
gccacaugcaauugcagcacgu

SEQ ID NO: 204781 - RNA, 18 nt, Human
ggaagaaaaggaacucag

SEQ ID NO: 204782 - RNA, 22 nt, Human
ugcagagagcccugccuuccuc

SEQ ID NO: 204783 - RNA, 22 nt, Human
uggucugaggaacaccagcacu

SEQ ID NO: 204784 - RNA, 22 nt, Human
ggggucugcgccacugucugcg

SEQ ID NO: 204785 - RNA, 22 nt, Human
acaauuccugagaauacuuguu

SEQ ID NO: 204786 - RNA, 18 nt, Human
uuacuguuaucaaaacag

SEQ ID NO: 204787 - RNA, 22 nt, Human
cagcuccuguuggucuugagga

SEQ ID NO: 204788 - RNA, 22 nt, Human
auuuggaagcuugaagauuauu

SEQ ID NO: 204789 - RNA, 22 nt, Human
cuccaggacccaguggcuccag

SEQ ID NO: 204790 - RNA, 22 nt, Human
gccucccuguucuuccacaaua

SEQ ID NO: 204791 - RNA, 22 nt, Human
cuagggacugggaccuuaguua

SEQ ID NO: 204792 - RNA, 22 nt, Human
ggcuuucaaggaaaggccucau

SEQ ID NO: 204793 - RNA, 22 nt, Human
auggcuuggcaccaucuccuug

SEQ ID NO: 204794 - RNA, 21 nt, Human
gcagcaugagaaagccccaaa

SEQ ID NO: 204795 - RNA, 22 nt, Human
gccuucaguaguauccucauga

SEQ ID NO: 204796 - RNA, 22 nt, Human
uccuggcaaagcaaguuaugaa

SEQ ID NO: 204797 - RNA, 22 nt, Human
uuccucagacccucauugugag

SEQ ID NO: 204798 - RNA, 22 nt, Human
cugagacauuaugacaagugga

SEQ ID NO: 204799 - RNA, 22 nt, Human
cagcaucauacuaccuaaauga

SEQ ID NO: 204800 - RNA, 22 nt, Human
agcugccacugagggugcacag

SEQ ID NO: 204801 - RNA, 22 nt, Human
cuauucaguaagccaaaaccau

SEQ ID NO: 204802 - RNA, 22 nt, Human
acacaucuuagacugaaauaug

SEQ ID NO: 204803 - RNA, 22 nt, Human
ugcuggguuaccuaagccuaaa

SEQ ID NO: 204804 - RNA, 22 nt, Human
ucucugggcccagaccuuccuu

SEQ ID NO: 204805 - RNA, 22 nt, Human
acaucuguccucugcagagcuc

SEQ ID NO: 204806 - RNA, 22 nt, Human
guuugcauaucugugaaaugga

SEQ ID NO: 204807 - RNA, 22 nt, Human
uacuucauucaaguucgcuaua

SEQ ID NO: 204808 - RNA, 22 nt, Human
uggcugcacuucaacacauccu

SEQ ID NO: 204809 - RNA, 22 nt, Human
cccaucaggaacccaggagccc

SEQ ID NO: 204810 - RNA, 22 nt, Human
ucuacagcugcugcuucucaug

SEQ ID NO: 204811 - RNA, 22 nt, Human
cagcagguuaacagaggcuggu

SEQ ID NO: 204812 - RNA, 22 nt, Human
ugugccuggcauucugggcuuc

SEQ ID NO: 204813 - RNA, 22 nt, Human
uuccucagcuguuugggcucau

SEQ ID NO: 204814 - RNA, 22 nt, Human
cacagcaggcagaacgugggca

SEQ ID NO: 204815 - RNA, 22 nt, Human
augucagaaucuacauucuacu

SEQ ID NO: 204816 - RNA, 22 nt, Human
ccugggcagggcuggacucuca

SEQ ID NO: 204817 - RNA, 22 nt, Human
caacaguauagcuuuugacugc

SEQ ID NO: 204818 - RNA, 22 nt, Human
gcacugguuacccugaguggcu

SEQ ID NO: 204819 - RNA, 22 nt, Human
acucaggaaaugagaggcucuc

SEQ ID NO: 204820 - RNA, 22 nt, Human
uacuagaaauuaccuucucacu

SEQ ID NO: 204821 - RNA, 22 nt, Human
auauacacuccacugauacagg

SEQ ID NO: 204822 - RNA, 22 nt, Human
cacagguccuuccugcccuggg

SEQ ID NO: 204823 - RNA, 22 nt, Human
accagugcuuccugcuggagcu

SEQ ID NO: 204824 - RNA, 22 nt, Human
augaggcagcuggcuuucuccc

SEQ ID NO: 204825 - RNA, 22 nt, Human
aaaugcauuucacuaauguuuc

SEQ ID NO: 204826 - RNA, 22 nt, Human
gguggcugcacccuggcuaacu

SEQ ID NO: 204827 - RNA, 22 nt, Human
augagaaauuuauuacaagcua

SEQ ID NO: 204828 - RNA, 22 nt, Human
ucugugcauccuuaacgccugc

SEQ ID NO: 204829 - RNA, 22 nt, Human
aagaaagugcuuuguaaauuau

SEQ ID NO: 204830 - RNA, 22 nt, Human
uuucucaguaauguccuggaau

SEQ ID NO: 204831 - RNA, 22 nt, Human
uauccaaacauauagucucucu

SEQ ID NO: 204832 - RNA, 22 nt, Human
acugguguugauuuggaagggg

SEQ ID NO: 204833 - RNA, 22 nt, Human
ggagaugcuacaguucagcucu

SEQ ID NO: 204834 - RNA, 22 nt, Human
agucccagaucuacaggaggga

SEQ ID NO: 204835 - RNA, 22 nt, Human
cauguuguaucauucuguuccu

SEQ ID NO: 204836 - RNA, 22 nt, Human
gcgugggcuggacugggaugaa

SEQ ID NO: 204837 - RNA, 21 nt, Human
gaagagaguccucauccugag

SEQ ID NO: 204838 - RNA, 22 nt, Human
uggcagcaauuugugauguuga

SEQ ID NO: 204839 - RNA, 22 nt, Human
cccuuggccacugcgccaguga

SEQ ID NO: 204840 - RNA, 22 nt, Human
ucuaaaaaagucuguucacuug

SEQ ID NO: 204841 - RNA, 22 nt, Human
ucugcaggucacgcuccagccu

SEQ ID NO: 204842 - RNA, 22 nt, Human
gcagcugagcgugaggaagagu

SEQ ID NO: 204843 - RNA, 22 nt, Human
uguaaauaaugcauguaaauca

SEQ ID NO: 204844 - RNA, 22 nt, Human
gauaauuuuagucugaaaauug

SEQ ID NO: 204845 - RNA, 22 nt, Human
agcacagagcucggggaaugga

SEQ ID NO: 204846 - RNA, 21 nt, Human
uccaagccuucaacacauuca

SEQ ID NO: 204847 - RNA, 23 nt, Human
ccagggccccuacaccacugucc

SEQ ID NO: 204848 - RNA, 23 nt, Human
acaggcaggcauggccaaaugug

SEQ ID NO: 204849 - RNA, 22 nt, Human
ccaggaggugaaacuucaccag

SEQ ID NO: 204850 - RNA, 22 nt, Human
uggcaagagggaugcaagguuu

SEQ ID NO: 204851 - RNA, 22 nt, Human
guuuuuacuaagguugcuaagu

SEQ ID NO: 204852 - RNA, 22 nt, Human
uuucucugaguuguuacaaaac

SEQ ID NO: 204853 - RNA, 22 nt, Human
ucuuuguaguuauaaacgacuu

SEQ ID NO: 204854 - RNA, 22 nt, Human
caucuuuggagaaacuuccguu

SEQ ID NO: 204855 - RNA, 22 nt, Human
ggauuaagaccugucaguacac

SEQ ID NO: 204856 - RNA, 22 nt, Human
uaagaacuucggacauguuauc

SEQ ID NO: 204857 - RNA, 22 nt, Human
gucuuauaguacaauuugaagu

SEQ ID NO: 204858 - RNA, 22 nt, Human
ugcugaggacaccuagccuucu

SEQ ID NO: 204859 - RNA, 22 nt, Human
aauaauguacauacauauuucg

SEQ ID NO: 204860 - RNA, 21 nt, Human
gagcugggcgaggcuccgggg

SEQ ID NO: 204861 - RNA, 22 nt, Human
gccaggcuggcaaaaggaaacc

SEQ ID NO: 204862 - RNA, 22 nt, Human
aggaagccacugaaugaaaguu

SEQ ID NO: 204863 - RNA, 22 nt, Human
gcauagucaguaggauucucaa

SEQ ID NO: 204864 - RNA, 22 nt, Human
ccaggaagccugugucucugga

SEQ ID NO: 204865 - RNA, 18 nt, Human
uccaggcuccaggcuaac

SEQ ID NO: 204866 - RNA, 17 nt, Human
agacagaccucugcauc

SEQ ID NO: 204867 - RNA, 22 nt, Human
aaugucaguguuacugcuauug

SEQ ID NO: 204868 - RNA, 22 nt, Human
gggcugagugucccaggccgaa

SEQ ID NO: 204869 - RNA, 22 nt, Human
ucucagaguuuacggggcugaa

SEQ ID NO: 204870 - RNA, 22 nt, Human
ucccugggcggacauucuccca

SEQ ID NO: 204871 - RNA, 22 nt, Human
cuuagaaaugcagauucucagg

SEQ ID NO: 204872 - RNA, 22 nt, Human
agugaaauuuguuuagauaggu

SEQ ID NO: 204873 - RNA, 22 nt, Human
cagggccugcuuccuucuuguu

SEQ ID NO: 204874 - RNA, 22 nt, Human
caaauaguaugagcaaugauuc

SEQ ID NO: 204875 - RNA, 22 nt, Human
agugcaugccuuccuguggaug

SEQ ID NO: 204876 - RNA, 22 nt, Human
uggcucaggauaauuuucccaa

SEQ ID NO: 204877 - RNA, 22 nt, Human
aucacauuguuagcauagacug

SEQ ID NO: 204878 - RNA, 18 nt, Human
caucaguauccacuaggu

SEQ ID NO: 204879 - RNA, 19 nt, Human
agagucugugcucuuccua

SEQ ID NO: 204880 - RNA, 22 nt, Human
gaggcacagucccgaggcaagg

SEQ ID NO: 204881 - RNA, 22 nt, Human
cugggcugcagcgggagcgacg

SEQ ID NO: 204882 - RNA, 22 nt, Human
ugagacagcagauuagcaauga

SEQ ID NO: 204883 - RNA, 22 nt, Human
auaaaugauucagcaggaaaua

SEQ ID NO: 204884 - RNA, 23 nt, Human
aaagauguucccaaaguucacgu

SEQ ID NO: 204885 - RNA, 22 nt, Human
uuuggaaugacagauaucaaua

SEQ ID NO: 204886 - RNA, 22 nt, Human
aggccucuucagggagcaugga

SEQ ID NO: 204887 - RNA, 20 nt, Human
uccaggccuuguucucagau

SEQ ID NO: 204888 - RNA, 22 nt, Human
ucucugugacagcuggguaugu

SEQ ID NO: 204889 - RNA, 21 nt, Human
gcugcucgagauccagugcuu

SEQ ID NO: 204890 - RNA, 22 nt, Human
caguggugaagagcaggggcuc

SEQ ID NO: 204891 - RNA, 22 nt, Human
uuucuucagagagagcuuuccc

SEQ ID NO: 204892 - RNA, 17 nt, Human
uuucuggaaugggcaaa

SEQ ID NO: 204893 - RNA, 22 nt, Human
gacaguuuagguucaaaucuca

SEQ ID NO: 204894 - RNA, 22 nt, Human
ucugggucuggcugcuggugca

SEQ ID NO: 204895 - RNA, 22 nt, Human
ucucaugugauucccgugcaug

SEQ ID NO: 204896 - RNA, 22 nt, Human
aagugauuuagucuuauaaagg

SEQ ID NO: 204897 - RNA, 22 nt, Human
ucugguggcacgugucuugcau

SEQ ID NO: 204898 - RNA, 22 nt, Human
auuuccaugaauucccacucau

SEQ ID NO: 204899 - RNA, 22 nt, Human
uccuuuaugugaguuguuuccc

SEQ ID NO: 204900 - RNA, 22 nt, Human
ugaaaggaagagggcuacuccu

SEQ ID NO: 204901 - RNA, 22 nt, Human
uagcugggucucuguuuucuca

SEQ ID NO: 204902 - RNA, 22 nt, Human
ggaccaggccagccucccugcg

SEQ ID NO: 204903 - RNA, 22 nt, Human
ccuggcucuucugugucagccc

SEQ ID NO: 204904 - RNA, 22 nt, Human
gucaggauuuuaaaaucccagu

SEQ ID NO: 204905 - RNA, 22 nt, Human
acugcagggcauccuggccaag

SEQ ID NO: 204906 - RNA, 22 nt, Human
ugaggacauuggucaggacaug

SEQ ID NO: 204907 - RNA, 22 nt, Human
ucuggcaggaccaugaagcgua

SEQ ID NO: 204908 - RNA, 22 nt, Human
cauguuaauaugcauugaguac

SEQ ID NO: 204909 - RNA, 22 nt, Human
ucauccaguaugacuggugucu

SEQ ID NO: 204910 - RNA, 22 nt, Human
agagucuuguuaacuugcuaag

SEQ ID NO: 204911 - RNA, 22 nt, Human
auuagagagagcauauuacugg

SEQ ID NO: 204912 - RNA, 22 nt, Human
agugaucugacucccaguuaga

SEQ ID NO: 204913 - RNA, 22 nt, Human
cagcacaggccugucuuugucu

SEQ ID NO: 204914 - RNA, 22 nt, Human
gacaggugugaugauuuaggcu

SEQ ID NO: 204915 - RNA, 22 nt, Human
ggagugaaguggcgcgaucucg

SEQ ID NO: 204916 - RNA, 22 nt, Human
uauuacagaaucaggcauaacu

SEQ ID NO: 204917 - RNA, 22 nt, Human
agcucuagggaagaaaggcaca

SEQ ID NO: 204918 - RNA, 19 nt, Human
ugcuagaaauucugugacu

SEQ ID NO: 204919 - RNA, 22 nt, Human
ccaugcauauaauagugccugg

SEQ ID NO: 204920 - RNA, 22 nt, Human
aagaacuuugauuucauugcau

SEQ ID NO: 204921 - RNA, 22 nt, Human
ucagguguguggcucuggacca

SEQ ID NO: 204922 - RNA, 22 nt, Human
aggucuggugggcuuuagauug

SEQ ID NO: 204923 - RNA, 22 nt, Human
uuugguuaauuuaggcuugcau

SEQ ID NO: 204924 - RNA, 22 nt, Human
ggucccaaucuaaucacaugag

SEQ ID NO: 204925 - RNA, 22 nt, Human
gacacaggaaaagcuccagccc

SEQ ID NO: 204926 - RNA, 22 nt, Human
uccaaggcuccggcccuggcgu

SEQ ID NO: 204927 - RNA, 22 nt, Human
cugagccaugagccugcgccca

SEQ ID NO: 204928 - RNA, 22 nt, Human
ggcuacuagguaccauuuagaa

SEQ ID NO: 204929 - RNA, 22 nt, Human
agaagacagagucuacauucua

SEQ ID NO: 204930 - RNA, 22 nt, Human
guccaggcuaagucccuucugc

SEQ ID NO: 204931 - RNA, 19 nt, Human
aaggaauggcuuuaaguag

SEQ ID NO: 204932 - RNA, 22 nt, Human
uucuaggaagggaagcauggca

SEQ ID NO: 204933 - RNA, 22 nt, Human
uauuggucuucuguucccuauu

SEQ ID NO: 204934 - RNA, 22 nt, Human
aaggcuuuuaaacugucaagga

SEQ ID NO: 204935 - RNA, 22 nt, Human
uuagaaucagaagagagguauu

SEQ ID NO: 204936 - RNA, 22 nt, Human
ucccugggcaaguuuacucuuc

SEQ ID NO: 204937 - RNA, 22 nt, Human
ucaaaggcaccaaggucacugc

SEQ ID NO: 204938 - RNA, 22 nt, Human
gagcccucauugaaucugcauu

SEQ ID NO: 204939 - RNA, 22 nt, Human
acagucuaaucuuguguucugu

SEQ ID NO: 204940 - RNA, 22 nt, Human
cuucagcuaggaucccugcagc

SEQ ID NO: 204941 - RNA, 23 nt, Human
uggaaacauucugaauguccauc

SEQ ID NO: 204942 - RNA, 19 nt, Human
aagcugagggcuguccacc

SEQ ID NO: 204943 - RNA, 22 nt, Human
uucuggaucugagggggaagau

SEQ ID NO: 204944 - RNA, 22 nt, Human
aaugggagguaguaugggaggu

SEQ ID NO: 204945 - RNA, 22 nt, Human
cagaagcaaguagugauucuuu

SEQ ID NO: 204946 - RNA, 22 nt, Human
cucuggcacacuccuuccaggu

SEQ ID NO: 204947 - RNA, 22 nt, Human
guauuuucaagagcaguaguau

SEQ ID NO: 204948 - RNA, 22 nt, Human
aaccuggaggcuguguagucuu

SEQ ID NO: 204949 - RNA, 22 nt, Human
uuagagguucuaugugucugga

SEQ ID NO: 204950 - RNA, 22 nt, Human
acugugauguuugugaucaucu

SEQ ID NO: 204951 - RNA, 22 nt, Human
ccaaagcaagucacaugaucaa

SEQ ID NO: 204952 - RNA, 22 nt, Human
ccucuggcuguaccacuggcac

SEQ ID NO: 204953 - RNA, 22 nt, Human
ucugcagagccucaggagaaca

SEQ ID NO: 204954 - RNA, 22 nt, Human
cagagacaggaaucagcugcag

SEQ ID NO: 204955 - RNA, 22 nt, Human
cagcuguccuuccuggugggcg

SEQ ID NO: 204956 - RNA, 22 nt, Human
aucagcaaucaaauugcagagu

SEQ ID NO: 204957 - RNA, 22 nt, Human
guggucuggggucaggccugag

SEQ ID NO: 204958 - RNA, 22 nt, Human
cgucacuucuuagucuauuuuc

SEQ ID NO: 204959 - RNA, 22 nt, Human
uguacagugccaugcaguuugc

SEQ ID NO: 204960 - RNA, 19 nt, Human
acaaaugauguugcacuga

SEQ ID NO: 204961 - RNA, 22 nt, Human
cauuucagugucuugugaugaa

SEQ ID NO: 204962 - RNA, 22 nt, Human
cugggaggugaacagaaaaacu

SEQ ID NO: 204963 - RNA, 22 nt, Human
cuggagguaauguuauuuuugu

SEQ ID NO: 204964 - RNA, 19 nt, Human
caggugguaaucugagccu

SEQ ID NO: 204965 - RNA, 22 nt, Human
ccucaguguuaggauaagagaa

SEQ ID NO: 204966 - RNA, 22 nt, Human
auaaagauuucuuuuucucuac

SEQ ID NO: 204967 - RNA, 22 nt, Human
cuggagcugcuguccuugggug

SEQ ID NO: 204968 - RNA, 22 nt, Human
auuucucauguacaaaaacacu

SEQ ID NO: 204969 - RNA, 22 nt, Human
agaguugcuauagaaggaugga

SEQ ID NO: 204970 - RNA, 22 nt, Human
uauguguccuaagcaaucaucc

SEQ ID NO: 204971 - RNA, 20 nt, Human
uccuucugaggugaggagga

SEQ ID NO: 204972 - RNA, 22 nt, Human
ucugcagauuuaucagcagcug

SEQ ID NO: 204973 - RNA, 23 nt, Human
agcucugcucgggcaugcccugc

SEQ ID NO: 204974 - RNA, 23 nt, Human
cccaggagccugaguccucucug

SEQ ID NO: 204975 - RNA, 22 nt, Human
acuacauuugcagagaagcaau

SEQ ID NO: 204976 - RNA, 22 nt, Human
cccucaugccagacagcaugca

SEQ ID NO: 204977 - RNA, 22 nt, Human
uauaguuucaugagcuuuuuaa

SEQ ID NO: 204978 - RNA, 20 nt, Human
acaguggaaauugaugucug

SEQ ID NO: 204979 - RNA, 20 nt, Human
cugccgaccacagccaugga

SEQ ID NO: 204980 - RNA, 22 nt, Human
uauuuauucauucagcaagcau

SEQ ID NO: 204981 - RNA, 22 nt, Human
cacaggaaguggucagugccag

SEQ ID NO: 204982 - RNA, 20 nt, Human
gggugugggcccggccaggc

SEQ ID NO: 204983 - RNA, 22 nt, Human
cuggaaggagaaggaggcugug

SEQ ID NO: 204984 - RNA, 22 nt, Human
gucugcccugcugaucucaccc

SEQ ID NO: 204985 - RNA, 22 nt, Human
uagagcuuagagaaugaguuug

SEQ ID NO: 204986 - RNA, 22 nt, Human
gcaggcuuugacuuggggcaac

SEQ ID NO: 204987 - RNA, 22 nt, Human
guagcugauccugaggacaggg

SEQ ID NO: 204988 - RNA, 22 nt, Human
auuucuuccucugucaguaacu

SEQ ID NO: 204989 - RNA, 22 nt, Human
uaccuucuaggugaugguuaca

SEQ ID NO: 204990 - RNA, 21 nt, Human
gauugaaaccauggcagugag

SEQ ID NO: 204991 - RNA, 22 nt, Human
gccaggcacaguucuaggugcu

SEQ ID NO: 204992 - RNA, 22 nt, Human
cugacucccuccccaaagcugg

SEQ ID NO: 204993 - RNA, 22 nt, Human
caaucacaaagagacaaguguc

SEQ ID NO: 204994 - RNA, 22 nt, Human
cggcagagcccugagucagccu

SEQ ID NO: 204995 - RNA, 18 nt, Human
uggcugcuggaguagggu

SEQ ID NO: 204996 - RNA, 22 nt, Human
agauaggagccaggacuuaaca

SEQ ID NO: 204997 - RNA, 21 nt, Human
agaaaauggcguuuuagauuu

SEQ ID NO: 204998 - RNA, 22 nt, Human
uacacauguccaaggugucacc

SEQ ID NO: 204999 - RNA, 22 nt, Human
cagggccuuguucaggagugaa

SEQ ID NO: 205000 - RNA, 22 nt, Human
aauaagcaagccugugugcaag

SEQ ID NO: 205001 - RNA, 22 nt, Human
augagaugugucuaauggaacc

SEQ ID NO: 205002 - RNA, 22 nt, Human
gucaggaaguggcauuggagaa

SEQ ID NO: 205003 - RNA, 22 nt, Human
aaagcaagaugcauccgucaag

SEQ ID NO: 205004 - RNA, 22 nt, Human
gucuuuaguugaaacauguggu

SEQ ID NO: 205005 - RNA, 22 nt, Human
cucacuggcaagacuacaggug

SEQ ID NO: 205006 - RNA, 21 nt, Human
acucauuugucugcaucuaau

SEQ ID NO: 205007 - RNA, 22 nt, Human
ucauguaaaguguagguuuaga

SEQ ID NO: 205008 - RNA, 22 nt, Human
ggaugucuaggguuuaugugcc

SEQ ID NO: 205009 - RNA, 22 nt, Human
gcgcucaggugccaggccugcg

SEQ ID NO: 205010 - RNA, 19 nt, Human
gggguggcuggggcuccag

SEQ ID NO: 205011 - RNA, 22 nt, Human
auuagaaaaucuggaggugggg

SEQ ID NO: 205012 - RNA, 21 nt, Human
ugcaggagucugugagucagg

SEQ ID NO: 205013 - RNA, 19 nt, Human
ugcuuugcucuuggacuca

SEQ ID NO: 205014 - RNA, 22 nt, Human
augaacaacuugaagcuccaug

SEQ ID NO: 205015 - RNA, 22 nt, Human
ggccugacuugaucggcucucu

SEQ ID NO: 205016 - RNA, 22 nt, Human
aaagacauuagauuaacguaca

SEQ ID NO: 205017 - RNA, 21 nt, Human
ggccugaguauaggacaggcc

SEQ ID NO: 205018 - RNA, 22 nt, Human
gggagacaguucagauaguuuc

SEQ ID NO: 205019 - RNA, 22 nt, Human
aggcagaugguaacugugauau

SEQ ID NO: 205020 - RNA, 21 nt, Human
ugacagcauagagcagggagg

SEQ ID NO: 205021 - RNA, 20 nt, Human
ggggcaguggcucaugccug

SEQ ID NO: 205022 - RNA, 22 nt, Human
uuaugugcuucaacugagccua

SEQ ID NO: 205023 - RNA, 22 nt, Human
agggcagcaaugcagcugcugc

SEQ ID NO: 205024 - RNA, 19 nt, Human
agucugucugcuuucccuc

SEQ ID NO: 205025 - RNA, 22 nt, Human
cucugcauuuuaacagaugauu

SEQ ID NO: 205026 - RNA, 19 nt, Human
ugccuguggcgagcaucuu

SEQ ID NO: 205027 - RNA, 21 nt, Human
gagugggacaugggagugguu

SEQ ID NO: 205028 - RNA, 22 nt, Human
uccagcucaggguuggcucaag

SEQ ID NO: 205029 - RNA, 22 nt, Human
uuccaggacucguucuggcuca

SEQ ID NO: 205030 - RNA, 22 nt, Human
acuuuguuuucaugaaacagcu

SEQ ID NO: 205031 - RNA, 22 nt, Human
ugcuggagcaacauuauugugc

SEQ ID NO: 205032 - RNA, 22 nt, Human
ugcagaguccucuggagggacu

SEQ ID NO: 205033 - RNA, 22 nt, Human
ccaggcucagggcagacuuuca

SEQ ID NO: 205034 - RNA, 22 nt, Human
uagaaucuggaaggggcuauuc

SEQ ID NO: 205035 - RNA, 22 nt, Human
gagaaacuuggaguuauucugg

SEQ ID NO: 205036 - RNA, 22 nt, Human
aaaauucauagaacuguacgcu

SEQ ID NO: 205037 - RNA, 22 nt, Human
aguuugaaagcuuaacaguaca

SEQ ID NO: 205038 - RNA, 22 nt, Human
cagggacaauggcagagccuga

SEQ ID NO: 205039 - RNA, 22 nt, Human
gggcucugggauucagagcaag

SEQ ID NO: 205040 - RNA, 22 nt, Human
ucccucagcaggaacuggccug

SEQ ID NO: 205041 - RNA, 22 nt, Human
caagucugucugcuccugugug

SEQ ID NO: 205042 - RNA, 22 nt, Human
caugcaaaauguauuuuauuag

SEQ ID NO: 205043 - RNA, 22 nt, Human
uuaguacauagaugaugguuga

SEQ ID NO: 205044 - RNA, 22 nt, Human
uaaaacagcagggcagagaagu

SEQ ID NO: 205045 - RNA, 22 nt, Human
agaggcaugcacagaugugcug

SEQ ID NO: 205046 - RNA, 22 nt, Human
aaauuggaugcacauuuagaaa

SEQ ID NO: 205047 - RNA, 22 nt, Human
cagggccuccuaaggcaucuaa

SEQ ID NO: 205048 - RNA, 18 nt, Human
cagugcuguuaacaguga

SEQ ID NO: 205049 - RNA, 22 nt, Human
ccaggcacugcucgaggugcua

SEQ ID NO: 205050 - RNA, 22 nt, Human
ugggacaugcuuggaaucuaga

SEQ ID NO: 205051 - RNA, 22 nt, Human
gaagguucuguguacacuacuu

SEQ ID NO: 205052 - RNA, 22 nt, Human
uccuuagaccuggcaaaugggg

SEQ ID NO: 205053 - RNA, 20 nt, Human
ucugguccaggucuucaugg

SEQ ID NO: 205054 - RNA, 22 nt, Human
uguccaggucagcagcagggac

SEQ ID NO: 205055 - RNA, 23 nt, Human
uuacuuuugcaccaaccuaauau

SEQ ID NO: 205056 - RNA, 20 nt, Human
cagagaccugucuucacaga

SEQ ID NO: 205057 - RNA, 22 nt, Human
aauuagaaucuuauuuggggaa

SEQ ID NO: 205058 - RNA, 22 nt, Human
cagcaacucuccugugcucaaa

SEQ ID NO: 205059 - RNA, 22 nt, Human
gagcucauuguggauggauggg

SEQ ID NO: 205060 - RNA, 22 nt, Human
ggugcugaggccuuggcaggga

SEQ ID NO: 205061 - RNA, 22 nt, Human
cuccuggcuuucccagaccagg

SEQ ID NO: 205062 - RNA, 22 nt, Human
agagcucaagacgcucacagua

SEQ ID NO: 205063 - RNA, 22 nt, Human
auccuucuucaaagagggaaaa

SEQ ID NO: 205064 - RNA, 22 nt, Human
ucugccugugguggaggaaguu

SEQ ID NO: 205065 - RNA, 22 nt, Human
ugccuggcacagagcagguggc

SEQ ID NO: 205066 - RNA, 22 nt, Human
cccaggacccuucaauggcucc

SEQ ID NO: 205067 - RNA, 22 nt, Human
gccucugcccuccugggacugc

SEQ ID NO: 205068 - RNA, 22 nt, Human
ugaagacaagaaaacacugggg

SEQ ID NO: 205069 - RNA, 22 nt, Human
gaaggcugcgaggggagugccg

SEQ ID NO: 205070 - RNA, 22 nt, Human
cuggcccuggagggcugugcga

SEQ ID NO: 205071 - RNA, 22 nt, Human
caggugaguuuuccuccuuggu

SEQ ID NO: 205072 - RNA, 22 nt, Human
uggucucugugcucgggcaugg

SEQ ID NO: 205073 - RNA, 22 nt, Human
ucugcuggucaaggcugggucc

SEQ ID NO: 205074 - RNA, 22 nt, Human
ggcccugggcagaggagugggc

SEQ ID NO: 205075 - RNA, 22 nt, Human
auuucuagcaaaggcucugcua

SEQ ID NO: 205076 - RNA, 22 nt, Human
gacaugggaugagaugaagcau

SEQ ID NO: 205077 - RNA, 22 nt, Human
gcccuccaugagacacagugua

SEQ ID NO: 205078 - RNA, 22 nt, Human
auuuucuucucucccuggcugc

SEQ ID NO: 205079 - RNA, 22 nt, Human
gagcacugagcuggaauuggag

SEQ ID NO: 205080 - RNA, 22 nt, Human
ucacacuaagacaaaauaauuu

SEQ ID NO: 205081 - RNA, 22 nt, Human
uagcccucaucugcucaaaagg

SEQ ID NO: 205082 - RNA, 22 nt, Human
cagugccuggauagcaacauga

SEQ ID NO: 205083 - RNA, 22 nt, Human
cacuguacuggguugaaggacg

SEQ ID NO: 205084 - RNA, 22 nt, Human
ugcaaaaacugcaauugcuuuu

SEQ ID NO: 205085 - RNA, 22 nt, Human
aucuaaacagguguucuuuaga

SEQ ID NO: 205086 - RNA, 22 nt, Human
gagccaagcaauauacccaacc

SEQ ID NO: 205087 - RNA, 20 nt, Human
ucugagacuuguagugugga

SEQ ID NO: 205088 - RNA, 21 nt, Human
agaaaaguauuugaaucaaga

SEQ ID NO: 205089 - RNA, 22 nt, Human
uggaaccuggcauuagggacac

SEQ ID NO: 205090 - RNA, 22 nt, Human
agauaacuuuuggguauucaug

SEQ ID NO: 205091 - RNA, 22 nt, Human
aaugucuuucucauaacagaua

SEQ ID NO: 205092 - RNA, 22 nt, Human
gggccaugagagguucaucaac

SEQ ID NO: 205093 - RNA, 22 nt, Human
agcccugcaggaugagggaggu

SEQ ID NO: 205094 - RNA, 22 nt, Human
gauauuuaacucucacaggucc

SEQ ID NO: 205095 - RNA, 22 nt, Human
aggcucuggcuacuacagagcu

SEQ ID NO: 205096 - RNA, 22 nt, Human
auuagcaugccaagcuuuuaga

SEQ ID NO: 205097 - RNA, 22 nt, Human
uagcagcccaguuucuggccaa

SEQ ID NO: 205098 - RNA, 22 nt, Human
ucagagucuuggcaauagguua

SEQ ID NO: 205099 - RNA, 22 nt, Human
cuuuauuguccuucuuaggugg

SEQ ID NO: 205100 - RNA, 22 nt, Human
agaagccaccagcugaggaaga

SEQ ID NO: 205101 - RNA, 22 nt, Human
ccaggaagggcucuuuaaagac

SEQ ID NO: 205102 - RNA, 22 nt, Human
uguaaagguaggugcaaaauga

SEQ ID NO: 205103 - RNA, 22 nt, Human
agagccagaccauugccgugca

SEQ ID NO: 205104 - RNA, 22 nt, Human
cccuccagggagccaugcuggg

SEQ ID NO: 205105 - RNA, 22 nt, Human
uguguauuaauguuuguauaug

SEQ ID NO: 205106 - RNA, 22 nt, Human
ucccagcacuguaauucuuugg

SEQ ID NO: 205107 - RNA, 22 nt, Human
ccagugucugugguauagaaag

SEQ ID NO: 205108 - RNA, 22 nt, Human
ugggccacuaccuucucuggau

SEQ ID NO: 205109 - RNA, 22 nt, Human
cuuggagacaggacaggcagaa

SEQ ID NO: 205110 - RNA, 21 nt, Human
cagugagguccccagccuagg

SEQ ID NO: 205111 - RNA, 22 nt, Human
caagacauugauuuuguacaga

SEQ ID NO: 205112 - RNA, 22 nt, Human
cugucccucaucaccucugggu

SEQ ID NO: 205113 - RNA, 22 nt, Human
ggcacagcuacuugcucacucu

SEQ ID NO: 205114 - RNA, 22 nt, Human
ccuggccaguuuccaggcccug

SEQ ID NO: 205115 - RNA, 22 nt, Human
uaggcaggcugaauguagauuu

SEQ ID NO: 205116 - RNA, 22 nt, Human
ggagagggggcucccugcuugg

SEQ ID NO: 205117 - RNA, 22 nt, Human
aagugcauacacuaguuaauug

SEQ ID NO: 205118 - RNA, 22 nt, Human
ggccccucagcaucugagucag

SEQ ID NO: 205119 - RNA, 22 nt, Human
ggcagcugcugcauuacguugu

SEQ ID NO: 205120 - RNA, 21 nt, Human
uuucuuucuggcucucacagu

SEQ ID NO: 205121 - RNA, 22 nt, Human
agaccugguuuaucaccagcau

SEQ ID NO: 205122 - RNA, 22 nt, Human
auuagguuagugugcaagagaa

SEQ ID NO: 205123 - RNA, 22 nt, Human
aauaauguugacgauagucuua

SEQ ID NO: 205124 - RNA, 20 nt, Human
acagguucauucugugugac

SEQ ID NO: 205125 - RNA, 22 nt, Human
agaagcugacagaugcagcagg

SEQ ID NO: 205126 - RNA, 22 nt, Human
ucucagggcucagagcucaggc

SEQ ID NO: 205127 - RNA, 22 nt, Human
uuuuggaauuuauacaguaaug

SEQ ID NO: 205128 - RNA, 22 nt, Human
guauaacugcuaccaccugaug

SEQ ID NO: 205129 - RNA, 22 nt, Human
cagggccuuauccugccauuga

SEQ ID NO: 205130 - RNA, 22 nt, Human
aucuccaggauuuucacacuca

SEQ ID NO: 205131 - RNA, 22 nt, Human
ucccucagcaggaauguggcag

SEQ ID NO: 205132 - RNA, 22 nt, Human
gagccccuucugcagucagguu

SEQ ID NO: 205133 - RNA, 22 nt, Human
agggauggaucuuggcccugga

SEQ ID NO: 205134 - RNA, 22 nt, Human
acuccagggcugaacgaggccc

SEQ ID NO: 205135 - RNA, 22 nt, Human
aggcugaggugugcugugaucg

SEQ ID NO: 205136 - RNA, 19 nt, Human
uuucccagcccuugcugug

SEQ ID NO: 205137 - RNA, 22 nt, Human
caggccugguugagcccugaga

SEQ ID NO: 205138 - RNA, 22 nt, Human
uacuaggcaauuauguaaauaa

SEQ ID NO: 205139 - RNA, 22 nt, Human
ucuggagggguuuagagggaca

SEQ ID NO: 205140 - RNA, 22 nt, Human
auucucugaugcagguggaaga

SEQ ID NO: 205141 - RNA, 22 nt, Human
caauuucucuuuauaucucaca

SEQ ID NO: 205142 - RNA, 22 nt, Human
acacaucuaucucuacacaagg

SEQ ID NO: 205143 - RNA, 23 nt, Human
aucuguucaucugacacagauuc

SEQ ID NO: 205144 - RNA, 22 nt, Human
ugggcuauuaggaccaggccau

SEQ ID NO: 205145 - RNA, 21 nt, Human
cucagacagggaggcucuggg

SEQ ID NO: 205146 - RNA, 22 nt, Human
cuuucccuuagccccauucuau

SEQ ID NO: 205147 - RNA, 22 nt, Human
ucauuuuucucuuacacguaga

SEQ ID NO: 205148 - RNA, 22 nt, Human
aauguuacgaucaacaacacau

SEQ ID NO: 205149 - RNA, 22 nt, Human
gugucauuacugaaagauugaa

SEQ ID NO: 205150 - RNA, 22 nt, Human
ccuccuuccugggacagagcug

SEQ ID NO: 205151 - RNA, 21 nt, Human
ucuggcaggcacgggcccagc

SEQ ID NO: 205152 - RNA, 22 nt, Human
uggagcugagcaccuccagggc

SEQ ID NO: 205153 - RNA, 22 nt, Human
aguuacugcuuucaggaaguuu

SEQ ID NO: 205154 - RNA, 22 nt, Human
gccaggcuggaaagaacagaca

SEQ ID NO: 205155 - RNA, 22 nt, Human
caugcuuuucaaucuaucuuaa

SEQ ID NO: 205156 - RNA, 22 nt, Human
guuggcagagagaagccuagca

SEQ ID NO: 205157 - RNA, 22 nt, Human
uuuuggcuuuuccucagcaagc

SEQ ID NO: 205158 - RNA, 22 nt, Human
gccuucccucucauccugcugg

SEQ ID NO: 205159 - RNA, 17 nt, Human
ccagguggaaucgugga

SEQ ID NO: 205160 - RNA, 20 nt, Human
acauuugaagucgcauuucu

SEQ ID NO: 205161 - RNA, 22 nt, Human
ggguggagaggcuaaguccagu

SEQ ID NO: 205162 - RNA, 22 nt, Human
uggcuuccugcacagugucugc

SEQ ID NO: 205163 - RNA, 22 nt, Human
acuugaauucaaagcgaaagca

SEQ ID NO: 205164 - RNA, 22 nt, Human
gcauucuuuuuaggagguuccu

SEQ ID NO: 205165 - RNA, 22 nt, Human
ucagugcagugaaagguuuacu

SEQ ID NO: 205166 - RNA, 22 nt, Human
uuuauucaucaucuguucauau

SEQ ID NO: 205167 - RNA, 22 nt, Human
cacugggaguacaaagaauggg

SEQ ID NO: 205168 - RNA, 22 nt, Human
uuauuaaaaugcggauuuggcu

SEQ ID NO: 205169 - RNA, 22 nt, Human
uagcugguccucagcuccagcc

SEQ ID NO: 205170 - RNA, 22 nt, Human
uucugagagugccagaaguucu

SEQ ID NO: 205171 - RNA, 18 nt, Human
gucacuguguuucugagc

SEQ ID NO: 205172 - RNA, 21 nt, Human
cagugcucaggaauagagaga

SEQ ID NO: 205173 - RNA, 21 nt, Human
ggccuaggggcagauggugcu

SEQ ID NO: 205174 - RNA, 21 nt, Human
aaacugaggcuucaagcagug

SEQ ID NO: 205175 - RNA, 22 nt, Human
ugguacuuggaggcagaaaaau

SEQ ID NO: 205176 - RNA, 22 nt, Human
gagaccuggaggauguggaugg

SEQ ID NO: 205177 - RNA, 22 nt, Human
ucauagaagcaccagaagauau

SEQ ID NO: 205178 - RNA, 22 nt, Human
caggacaguauaggcuuuagga

SEQ ID NO: 205179 - RNA, 22 nt, Human
gaggcauggccugaggcuagga

SEQ ID NO: 205180 - RNA, 22 nt, Human
uaaaaguuuuaguuguacauaa

SEQ ID NO: 205181 - RNA, 22 nt, Human
ccuguauuugcuuccuucugca

SEQ ID NO: 205182 - RNA, 16 nt, Human
gaccucagugcuggcu

SEQ ID NO: 205183 - RNA, 22 nt, Human
ggggugggcgugcagggacacc

SEQ ID NO: 205184 - RNA, 22 nt, Human
uugcuuuugugugcucucugga

SEQ ID NO: 205185 - RNA, 22 nt, Human
ggcuucacaguuguagcagcuc

SEQ ID NO: 205186 - RNA, 19 nt, Human
ugugccucuauagcaugug

SEQ ID NO: 205187 - RNA, 22 nt, Human
agaagcugagaaugaauuaaga

SEQ ID NO: 205188 - RNA, 22 nt, Human
acagggcuuuuaaucaguaguu

SEQ ID NO: 205189 - RNA, 22 nt, Human
auuauauuugaaagguuggaag

SEQ ID NO: 205190 - RNA, 22 nt, Human
guguccugguuccuuguggcug

SEQ ID NO: 205191 - RNA, 22 nt, Human
aauagauggguuaaacagcaaa

SEQ ID NO: 205192 - RNA, 23 nt, Human
acagcuguugaaauuucaguggg

SEQ ID NO: 205193 - RNA, 22 nt, Human
cuuugaauuaacgacacaagug

SEQ ID NO: 205194 - RNA, 22 nt, Human
cccaggcuggagugcaauggca

SEQ ID NO: 205195 - RNA, 22 nt, Human
cucagaagaaucagcagcuauu

SEQ ID NO: 205196 - RNA, 22 nt, Human
uuagggaaggacagugaagaaa

SEQ ID NO: 205197 - RNA, 22 nt, Human
ucugcaggagcagggcguggag

SEQ ID NO: 205198 - RNA, 22 nt, Human
uuucagaugugugucucugaag

SEQ ID NO: 205199 - RNA, 22 nt, Human
cucagcagagaccagggaggaa

SEQ ID NO: 205200 - RNA, 22 nt, Human
gaggugucccugacccuuugca

SEQ ID NO: 205201 - RNA, 22 nt, Human
aaaggaagaugccaggacucug

SEQ ID NO: 205202 - RNA, 22 nt, Human
ugggcuaauucuuugauuguuu

SEQ ID NO: 205203 - RNA, 22 nt, Human
uagcaguauauuuuaaggaagc

SEQ ID NO: 205204 - RNA, 22 nt, Human
aucucuggccccugggguccga

SEQ ID NO: 205205 - RNA, 22 nt, Human
ucugaggccccugggcaggaug

SEQ ID NO: 205206 - RNA, 22 nt, Human
uguauuuauauuagaaugguug

SEQ ID NO: 205207 - RNA, 22 nt, Human
gcacauccaaugauuguuuuga

SEQ ID NO: 205208 - RNA, 21 nt, Human
acaggcucuggggaugcuggg

SEQ ID NO: 205209 - RNA, 22 nt, Human
agcaggagacauggggguggug

SEQ ID NO: 205210 - RNA, 22 nt, Human
aggaaaaagaguugcugccuuc

SEQ ID NO: 205211 - RNA, 22 nt, Human
auagcuuuuugucauagagucu

SEQ ID NO: 205212 - RNA, 19 nt, Human
acucugagcuugcucuauc

SEQ ID NO: 205213 - RNA, 22 nt, Human
guguguguacucuguauauaaa

SEQ ID NO: 205214 - RNA, 22 nt, Human
gcuuuagauagauuuagucuuu

SEQ ID NO: 205215 - RNA, 22 nt, Human
aaggccagauucucucuagggg

SEQ ID NO: 205216 - RNA, 22 nt, Human
ugucccucugaggcuucccugg

SEQ ID NO: 205217 - RNA, 22 nt, Human
aaagcaagucucuacaaaguac

SEQ ID NO: 205218 - RNA, 22 nt, Human
ucugggcugcugugcagugacc

SEQ ID NO: 205219 - RNA, 22 nt, Human
aggccagcacgacagccgcagg

SEQ ID NO: 205220 - RNA, 22 nt, Human
aaugagacacgugaagcagaug

SEQ ID NO: 205221 - RNA, 22 nt, Human
cugagcaccccaggaccugcgc

SEQ ID NO: 205222 - RNA, 22 nt, Human
guggaagggacugccuagagga

SEQ ID NO: 205223 - RNA, 22 nt, Human
gccaaggaaggcuuccuggaag

SEQ ID NO: 205224 - RNA, 22 nt, Human
guuuuauaggugaaauauuacu

SEQ ID NO: 205225 - RNA, 22 nt, Human
acagagcugggugcccccugga

SEQ ID NO: 205226 - RNA, 22 nt, Human
gugcccagcuccaccucacaga

SEQ ID NO: 205227 - RNA, 22 nt, Human
gugguuuaggggaaagaacugu

SEQ ID NO: 205228 - RNA, 22 nt, Human
aaacaaagcaucuugcuaugca

SEQ ID NO: 205229 - RNA, 22 nt, Human
ugguuauaaaaguccucucauu

SEQ ID NO: 205230 - RNA, 21 nt, Human
aucuuuagccauccaaucaga

SEQ ID NO: 205231 - RNA, 22 nt, Human
uagcagugcacaguaggacacc

SEQ ID NO: 205232 - RNA, 23 nt, Human
uugcacaguuucggaaacugagg

SEQ ID NO: 205233 - RNA, 22 nt, Human
gcccugagggguggugucugua

SEQ ID NO: 205234 - RNA, 17 nt, Human
agacagguuauaguuga

SEQ ID NO: 205235 - RNA, 22 nt, Human
augaggagcccucauuuagguu

SEQ ID NO: 205236 - RNA, 22 nt, Human
aacaggcuggccuugaagcagu

SEQ ID NO: 205237 - RNA, 21 nt, Human
uggcagggguaguaguacagc

SEQ ID NO: 205238 - RNA, 22 nt, Human
guuuauaauccaacucugcucc

SEQ ID NO: 205239 - RNA, 22 nt, Human
ggcuggcuacauuggaggaagg

SEQ ID NO: 205240 - RNA, 22 nt, Human
cagugcaggcuuguggccgcag

SEQ ID NO: 205241 - RNA, 22 nt, Human
cugauacacucccuaaaauaua

SEQ ID NO: 205242 - RNA, 22 nt, Human
ugcaagcaaguuuuugaagugg

SEQ ID NO: 205243 - RNA, 23 nt, Human
aagcugaacuuguuugcugggag

SEQ ID NO: 205244 - RNA, 22 nt, Human
cagcugagaaauggggaaaggg

SEQ ID NO: 205245 - RNA, 22 nt, Human
agagcuuuucuguaauaacauc

SEQ ID NO: 205246 - RNA, 17 nt, Human
aggccucaggugaaacc

SEQ ID NO: 205247 - RNA, 22 nt, Human
uggcaggggaggugcuugcuua

SEQ ID NO: 205248 - RNA, 22 nt, Human
uucuccagaguuucucucacug

SEQ ID NO: 205249 - RNA, 22 nt, Human
gaaaauguuuguccggagcuga

SEQ ID NO: 205250 - RNA, 22 nt, Human
cucucagugccugcccuaggcu

SEQ ID NO: 205251 - RNA, 22 nt, Human
gaggcaugcagagcuggagcag

SEQ ID NO: 205252 - RNA, 22 nt, Human
gguccugaggggagcugaaggu

SEQ ID NO: 205253 - RNA, 17 nt, Human
agugugugaaauggugg

SEQ ID NO: 205254 - RNA, 22 nt, Human
auuuccuauuucuuguccccua

SEQ ID NO: 205255 - RNA, 22 nt, Human
agagcagccugugaugaugcac

SEQ ID NO: 205256 - RNA, 22 nt, Human
ucauaaacacacuaguaugauu

SEQ ID NO: 205257 - RNA, 22 nt, Human
ucugucugaggaguuuuugacc

SEQ ID NO: 205258 - RNA, 22 nt, Human
uuugauauccuauacaaguaaa

SEQ ID NO: 205259 - RNA, 22 nt, Human
ucuacagacagagcagguggga

SEQ ID NO: 205260 - RNA, 20 nt, Human
uggccucugagaugccacgg

SEQ ID NO: 205261 - RNA, 22 nt, Human
ucuggcagcucuccucggcgga

SEQ ID NO: 205262 - RNA, 22 nt, Human
gggugggagaaaugaguaucua

SEQ ID NO: 205263 - RNA, 22 nt, Human
auguagaauuccuucuacuuug

SEQ ID NO: 205264 - RNA, 22 nt, Human
aauaacuuguaugguuauucca

SEQ ID NO: 205265 - RNA, 22 nt, Human
ucagggaacuacuucucccuau

SEQ ID NO: 205266 - RNA, 21 nt, Human
uccagaccucccucuccuagc

SEQ ID NO: 205267 - RNA, 22 nt, Human
cuccagugcugucaucccuucc

SEQ ID NO: 205268 - RNA, 22 nt, Human
gggcucugaaucccaggucugc

SEQ ID NO: 205269 - RNA, 20 nt, Human
guggaugaucaguguagugg

SEQ ID NO: 205270 - RNA, 20 nt, Human
accaggagauggaggcaggg

SEQ ID NO: 205271 - RNA, 22 nt, Human
uguaagaaaaguaaauagugac

SEQ ID NO: 205272 - RNA, 22 nt, Human
aagggcuggaucucucugagca

SEQ ID NO: 205273 - RNA, 22 nt, Human
ugcugcagggauuucagagaca

SEQ ID NO: 205274 - RNA, 22 nt, Human
uucuuuucaagaggggcaagga

SEQ ID NO: 205275 - RNA, 22 nt, Human
uccugggauucugcauuucuaa

SEQ ID NO: 205276 - RNA, 22 nt, Human
ugacagaggagcuggaaugauu

SEQ ID NO: 205277 - RNA, 22 nt, Human
uagggcucugcucaucaguugu

SEQ ID NO: 205278 - RNA, 22 nt, Human
uauguagcaauagcaucauacu

SEQ ID NO: 205279 - RNA, 22 nt, Human
uacaagaaauuucugcauauau

SEQ ID NO: 205280 - RNA, 20 nt, Human
cagaacaugagcaucgagcc

SEQ ID NO: 205281 - RNA, 22 nt, Human
aacucugauuagcucaaguuaa

SEQ ID NO: 205282 - RNA, 22 nt, Human
cuccucuggaaauuccucugcc

SEQ ID NO: 205283 - RNA, 16 nt, Human
augaggcauaggcugc

SEQ ID NO: 205284 - RNA, 22 nt, Human
gugugucagagcucagagaagu

SEQ ID NO: 205285 - RNA, 22 nt, Human
aaacacugguaugauguauagu

SEQ ID NO: 205286 - RNA, 22 nt, Human
agugucauuccagggacccucg

SEQ ID NO: 205287 - RNA, 22 nt, Human
caacuuuugacacgugugcuaa

SEQ ID NO: 205288 - RNA, 22 nt, Human
ggcagccaugcuccaggugcag

SEQ ID NO: 205289 - RNA, 22 nt, Human
cucugggcaaguuucuucauga

SEQ ID NO: 205290 - RNA, 21 nt, Human
uccuggccagggcacuaggca

SEQ ID NO: 205291 - RNA, 22 nt, Human
ucuaugaaaagucuauucauuc

SEQ ID NO: 205292 - RNA, 22 nt, Human
uuaauacagaagcaagacacug

SEQ ID NO: 205293 - RNA, 21 nt, Human
ccuucuccacagggucuccgg

SEQ ID NO: 205294 - RNA, 22 nt, Human
aggcuucucugcaagauguuaa

SEQ ID NO: 205295 - RNA, 22 nt, Human
aucaggaugcugucaguuacca

SEQ ID NO: 205296 - RNA, 22 nt, Human
uacaccagauuauuuauaacau

SEQ ID NO: 205297 - RNA, 22 nt, Human
ucaggcucugagcugaugcuaa

SEQ ID NO: 205298 - RNA, 22 nt, Human
uggcucugaccagguagaggag

SEQ ID NO: 205299 - RNA, 22 nt, Human
uuuauuguuaucaugggugagu

SEQ ID NO: 205300 - RNA, 22 nt, Human
agcuccugucucaagggagccu

SEQ ID NO: 205301 - RNA, 22 nt, Human
aaacugaggaaugacagcauua

SEQ ID NO: 205302 - RNA, 20 nt, Human
gcuccuguccugguggaggg

SEQ ID NO: 205303 - RNA, 22 nt, Human
gaaauauacaugaagucggcug

SEQ ID NO: 205304 - RNA, 22 nt, Human
gccugggacugcagauccccag

SEQ ID NO: 205305 - RNA, 22 nt, Human
ucaggaagcauccugagguguc

SEQ ID NO: 205306 - RNA, 22 nt, Human
cagcccuggugccaagguuccc

SEQ ID NO: 205307 - RNA, 22 nt, Human
ucacauucauggugcuaauaaa

SEQ ID NO: 205308 - RNA, 22 nt, Human
uauuucagacacugaucuugca

SEQ ID NO: 205309 - RNA, 22 nt, Human
acaguuaaauauuucuacuggg

SEQ ID NO: 205310 - RNA, 22 nt, Human
gcauggcuguugaagucagcuc

SEQ ID NO: 205311 - RNA, 22 nt, Human
cuccacagguguacuguaccuu

SEQ ID NO: 205312 - RNA, 19 nt, Human
ggccucugcaggccgcccc

SEQ ID NO: 205313 - RNA, 22 nt, Human
ggccucagugggccgcugcagg

SEQ ID NO: 205314 - RNA, 18 nt, Human
aagaaguuggccaaagag

SEQ ID NO: 205315 - RNA, 22 nt, Human
ucuuucccaguagcucucccag

SEQ ID NO: 205316 - RNA, 22 nt, Human
uccugagcuuuacaguaaggac

SEQ ID NO: 205317 - RNA, 22 nt, Human
ucagaacaguucuuaauauugc

SEQ ID NO: 205318 - RNA, 22 nt, Human
aaggccaacuaggaugagcuag

SEQ ID NO: 205319 - RNA, 22 nt, Human
ccaggaaggaucguuugggagu

SEQ ID NO: 205320 - RNA, 22 nt, Human
auuagaaaauacaugggcuguc

SEQ ID NO: 205321 - RNA, 22 nt, Human
ucauccagccucaucaggagcu

SEQ ID NO: 205322 - RNA, 22 nt, Human
cucauaaaagcuuuguuuacac

SEQ ID NO: 205323 - RNA, 22 nt, Human
ugaaaucauugccaaguauuga

SEQ ID NO: 205324 - RNA, 22 nt, Human
uacacaguuccauuuaagccag

SEQ ID NO: 205325 - RNA, 22 nt, Human
ucaagaugaaagauguagccau

SEQ ID NO: 205326 - RNA, 21 nt, Human
acacugcuguagcauauuggg

SEQ ID NO: 205327 - RNA, 22 nt, Human
gcuuucugugcagugaacacua

SEQ ID NO: 205328 - RNA, 22 nt, Human
uaacagcaggguuacaggcauu

SEQ ID NO: 205329 - RNA, 22 nt, Human
aagggagacaguugugugagga

SEQ ID NO: 205330 - RNA, 22 nt, Human
ggcuucccuguuugcugugccu

SEQ ID NO: 205331 - RNA, 21 nt, Human
aggcugcucuuucuuguggua

SEQ ID NO: 205332 - RNA, 22 nt, Human
aaggcagucaguuguuuugaaa

SEQ ID NO: 205333 - RNA, 22 nt, Human
cgcccagggcaggaggccgcuc

SEQ ID NO: 205334 - RNA, 22 nt, Human
cacaguuuugucuugguuucca

SEQ ID NO: 205335 - RNA, 22 nt, Human
ucugagacugcagugagccgcu

SEQ ID NO: 205336 - RNA, 22 nt, Human
acaggcagauuaaggguaggca

SEQ ID NO: 205337 - RNA, 22 nt, Human
ggcugcuggcauugagguaggu

SEQ ID NO: 205338 - RNA, 22 nt, Human
guuugcauguguacuuaauugg

SEQ ID NO: 205339 - RNA, 23 nt, Human
ucccuggccgcaauggccgccuu

SEQ ID NO: 205340 - RNA, 22 nt, Human
cugucccaggauccugacucca

SEQ ID NO: 205341 - RNA, 22 nt, Human
acagacaucaucaacaucuucc

SEQ ID NO: 205342 - RNA, 22 nt, Human
caaugauagauuuuacaaauua

SEQ ID NO: 205343 - RNA, 23 nt, Human
cuucaugagagcccugaggaaaa

SEQ ID NO: 205344 - RNA, 22 nt, Human
gucuagaaauguucucaggggu

SEQ ID NO: 205345 - RNA, 22 nt, Human
agugcacagcgugauguauugg

SEQ ID NO: 205346 - RNA, 22 nt, Human
acaaaugaacauauaagcuuga

SEQ ID NO: 205347 - RNA, 22 nt, Human
uccagggaccucccugagagcu

SEQ ID NO: 205348 - RNA, 22 nt, Human
guccugggggcagcugugucca

SEQ ID NO: 205349 - RNA, 22 nt, Human
uccaggaggcagggcugugccc

SEQ ID NO: 205350 - RNA, 22 nt, Human
gaguuuuaaccucagcucucug

SEQ ID NO: 205351 - RNA, 22 nt, Human
cucuccccgguacgagcggccg

SEQ ID NO: 205352 - RNA, 22 nt, Human
uguauuuuuagaccuuuagacc

SEQ ID NO: 205353 - RNA, 22 nt, Human
gugcaaaagcaguugugguuuu

SEQ ID NO: 205354 - RNA, 22 nt, Human
gcucccugcauuucccacccuu

SEQ ID NO: 205355 - RNA, 19 nt, Human
auguuuuaugcugauggga

SEQ ID NO: 205356 - RNA, 22 nt, Human
uguuuucugaugguuaaugagu

SEQ ID NO: 205357 - RNA, 22 nt, Human
uucuguacccucgcgauucucc

SEQ ID NO: 205358 - RNA, 22 nt, Human
aucgccaauggggaggaaagaa

SEQ ID NO: 205359 - RNA, 22 nt, Human
ucugaagccaccucugcuuguc

SEQ ID NO: 205360 - RNA, 22 nt, Human
cuauuucauugugcugagucug

SEQ ID NO: 205361 - RNA, 22 nt, Human
cuggcugguuacuauuucuggu

SEQ ID NO: 205362 - RNA, 22 nt, Human
acagagacuuggagcaggcuga

SEQ ID NO: 205363 - RNA, 22 nt, Human
gagcaccgccuccacgaugccc

SEQ ID NO: 205364 - RNA, 22 nt, Human
ugcaaauuugacuucacacauc

SEQ ID NO: 205365 - RNA, 22 nt, Human
gagcuggucaguuucaggagag

SEQ ID NO: 205366 - RNA, 22 nt, Human
agcccugcgcucacguucugca

SEQ ID NO: 205367 - RNA, 22 nt, Human
uuucaaguggcgagauaaggaa

SEQ ID NO: 205368 - RNA, 22 nt, Human
ggguccagagccucagcccaga

SEQ ID NO: 205369 - RNA, 22 nt, Human
gcaaccauuuggaauguaaaaa

SEQ ID NO: 205370 - RNA, 22 nt, Human
uaauacagaaguguauuaaaau

SEQ ID NO: 205371 - RNA, 22 nt, Human
guuguuuuuguucucuauagcu

SEQ ID NO: 205372 - RNA, 22 nt, Human
ucuuuggccuuaggagcccuug

SEQ ID NO: 205373 - RNA, 22 nt, Human
gagacugguguuugcugggcug

SEQ ID NO: 205374 - RNA, 22 nt, Human
gcuggagguggugagaaaaggu

SEQ ID NO: 205375 - RNA, 22 nt, Human
auauaauaguuucauaaaggcu

SEQ ID NO: 205376 - RNA, 22 nt, Human
uggaaccuggccugagcuacca

SEQ ID NO: 205377 - RNA, 23 nt, Human
ucugcccucugccuguuuuugua

SEQ ID NO: 205378 - RNA, 22 nt, Human
agaggucagaggucgccagguc

SEQ ID NO: 205379 - RNA, 22 nt, Human
cggcagagcuuccugcucagcg

SEQ ID NO: 205380 - RNA, 22 nt, Human
ggacauguuccuuuucaucuuu

SEQ ID NO: 205381 - RNA, 22 nt, Human
acagcuguggggacucuugccc

SEQ ID NO: 205382 - RNA, 22 nt, Human
cagagcccagggccuacguccc

SEQ ID NO: 205383 - RNA, 22 nt, Human
aggcugugagagguggcuccca

SEQ ID NO: 205384 - RNA, 22 nt, Human
ggggacagucgaucuagugauu

SEQ ID NO: 205385 - RNA, 20 nt, Human
ugucuguaugcagucauaua

SEQ ID NO: 205386 - RNA, 22 nt, Human
aucauacauguaacuaaguaaa

SEQ ID NO: 205387 - RNA, 22 nt, Human
caugcuuucuguccaaauguua

SEQ ID NO: 205388 - RNA, 22 nt, Human
uauaggauugguucccauuuua

SEQ ID NO: 205389 - RNA, 22 nt, Human
cagagcaacacccuuuacaucg

SEQ ID NO: 205390 - RNA, 22 nt, Human
cuugaagaaauggagacaggau

SEQ ID NO: 205391 - RNA, 22 nt, Human
gaugagguguguggccacuaga

SEQ ID NO: 205392 - RNA, 22 nt, Human
uuuacagcacugaagccagggg

SEQ ID NO: 205393 - RNA, 22 nt, Human
cugggccuuaugaguaccugga

SEQ ID NO: 205394 - RNA, 18 nt, Human
gccucccuggcuacacuu

SEQ ID NO: 205395 - RNA, 22 nt, Human
gcaugugucaucugccuuucgu

SEQ ID NO: 205396 - RNA, 22 nt, Human
caauuacugguccacagaaauu

SEQ ID NO: 205397 - RNA, 22 nt, Human
uaggucugauuuccauucaguc

SEQ ID NO: 205398 - RNA, 22 nt, Human
aacaucuuugauaaacuuagug

SEQ ID NO: 205399 - RNA, 22 nt, Human
auugauucuaccagcuacuuug

SEQ ID NO: 205400 - RNA, 22 nt, Human
uugccagggccagugggggugu

SEQ ID NO: 205401 - RNA, 22 nt, Human
ucccagcauaacaaacugcccg

SEQ ID NO: 205402 - RNA, 22 nt, Human
ccuggaaaaugccacuuucaca

SEQ ID NO: 205403 - RNA, 23 nt, Human
uuuauccaacucuguaaucucuc

SEQ ID NO: 205404 - RNA, 20 nt, Human
gccagcccugacacaggagc

SEQ ID NO: 205405 - RNA, 22 nt, Human
cuuauucauauauucucgguag

SEQ ID NO: 205406 - RNA, 22 nt, Human
uugcacagaugagggugaugcu

SEQ ID NO: 205407 - RNA, 22 nt, Human
cucaguuugugugauauugucu

SEQ ID NO: 205408 - RNA, 22 nt, Human
ucucuguagaccugaccagcac

SEQ ID NO: 205409 - RNA, 22 nt, Human
uuaaguacuucccuguuggaca

SEQ ID NO: 205410 - RNA, 22 nt, Human
ccagagaggcaaaacuccuucc

SEQ ID NO: 205411 - RNA, 22 nt, Human
gcaacuuaggaguuagagcaug

SEQ ID NO: 205412 - RNA, 22 nt, Human
ugcugcucaagcugcagcaaaa

SEQ ID NO: 205413 - RNA, 22 nt, Human
aaagagcaagcugagauuugaa

SEQ ID NO: 205414 - RNA, 22 nt, Human
uuaauagauuugauuuuaaagg

SEQ ID NO: 205415 - RNA, 22 nt, Human
gcuuccaccuacuaaaugccac

SEQ ID NO: 205416 - RNA, 22 nt, Human
cuggacagaaaaggccacugga

SEQ ID NO: 205417 - RNA, 18 nt, Human
ggcagccuggacaugcuc

SEQ ID NO: 205418 - RNA, 16 nt, Human
agcagccagcacugga

SEQ ID NO: 205419 - RNA, 22 nt, Human
aaauacagaguugcuuaaaagc

SEQ ID NO: 205420 - RNA, 22 nt, Human
uguuugcucugacuaucuugcg

SEQ ID NO: 205421 - RNA, 22 nt, Human
acuguggccaaagccucuggga

SEQ ID NO: 205422 - RNA, 22 nt, Human
ggcaccagggacaauccucuuc

SEQ ID NO: 205423 - RNA, 22 nt, Human
uagaaucuguguucaaaccuac

SEQ ID NO: 205424 - RNA, 22 nt, Human
cagagacccuaggcaggugaca

SEQ ID NO: 205425 - RNA, 22 nt, Human
caacuauagaucaaaugaguuu

SEQ ID NO: 205426 - RNA, 22 nt, Human
ggugcccuguaaaagccaugca

SEQ ID NO: 205427 - RNA, 22 nt, Human
ccuguucaauauucuuccuugu

SEQ ID NO: 205428 - RNA, 22 nt, Human
aaguaugucuuuggguauuauu

SEQ ID NO: 205429 - RNA, 22 nt, Human
cagcuugugcaaagguccuggg

SEQ ID NO: 205430 - RNA, 22 nt, Human
cuucagagaguccagggacugc

SEQ ID NO: 205431 - RNA, 18 nt, Human
ugucuuuggaccacugaa

SEQ ID NO: 205432 - RNA, 22 nt, Human
gccugggauagaggcaaugcau

SEQ ID NO: 205433 - RNA, 21 nt, Human
ugaaugaggaggauggcauuu

SEQ ID NO: 205434 - RNA, 22 nt, Human
uucuagaagcugaaaaggggga

SEQ ID NO: 205435 - RNA, 22 nt, Human
ucugaaauaggcuucuuuuggu

SEQ ID NO: 205436 - RNA, 22 nt, Human
cacaguuuuaucuuauacugau

SEQ ID NO: 205437 - RNA, 22 nt, Human
augccuuauuguaaucuuucca

SEQ ID NO: 205438 - RNA, 22 nt, Human
gugguaauagagcuccaaacua

SEQ ID NO: 205439 - RNA, 22 nt, Human
ucucacagccauuucucccucu

SEQ ID NO: 205440 - RNA, 22 nt, Human
gaggaagaauugguuauuggag

SEQ ID NO: 205441 - RNA, 22 nt, Human
auccaguuccaaagaucauuua

SEQ ID NO: 205442 - RNA, 22 nt, Human
gcugccuagucugcugagcaga

SEQ ID NO: 205443 - RNA, 22 nt, Human
aagauuuacuuucuuuguaaua

SEQ ID NO: 205444 - RNA, 22 nt, Human
caggccagcguccagaacaagc

SEQ ID NO: 205445 - RNA, 22 nt, Human
gccuggaggggccaggguggua

SEQ ID NO: 205446 - RNA, 22 nt, Human
cugagggagacagugcggacua

SEQ ID NO: 205447 - RNA, 22 nt, Human
uauagaucuugcuauuuaagga

SEQ ID NO: 205448 - RNA, 22 nt, Human
cuggagccugcaguuuucacuu

SEQ ID NO: 205449 - RNA, 22 nt, Human
uugagggaacaugagaaucauc

SEQ ID NO: 205450 - RNA, 22 nt, Human
uuccaaacugccaauucagaag

SEQ ID NO: 205451 - RNA, 22 nt, Human
ucuccaaacucagacuaaguau

SEQ ID NO: 205452 - RNA, 22 nt, Human
gcuugggaggcaagcauuccau

SEQ ID NO: 205453 - RNA, 21 nt, Human
gagaaucuguuuucuugucuu

SEQ ID NO: 205454 - RNA, 23 nt, Human
uggcugagauccuacuguuugcu

SEQ ID NO: 205455 - RNA, 22 nt, Human
gaaaaguacacagcccaaacau

SEQ ID NO: 205456 - RNA, 22 nt, Human
ucccagaguuuccuguguccca

SEQ ID NO: 205457 - RNA, 22 nt, Human
guccugggaaggaagccaggga

SEQ ID NO: 205458 - RNA, 22 nt, Human
guguccagcguggaaugagggu

SEQ ID NO: 205459 - RNA, 22 nt, Human
agacucaagcagauaggaauua

SEQ ID NO: 205460 - RNA, 22 nt, Human
uuacuuacagacaguagacucu

SEQ ID NO: 205461 - RNA, 22 nt, Human
agugcauucucuaauuacaggu

SEQ ID NO: 205462 - RNA, 22 nt, Human
aucuucuucaaggaucuggagc

SEQ ID NO: 205463 - RNA, 22 nt, Human
aggcagcuagagagugaaacug

SEQ ID NO: 205464 - RNA, 22 nt, Human
gccagagcugagacacgagucc

SEQ ID NO: 205465 - RNA, 22 nt, Human
uuuguaaaggccugaauuucag

SEQ ID NO: 205466 - RNA, 22 nt, Human
acagguguacaaugcaugacag

SEQ ID NO: 205467 - RNA, 22 nt, Human
gaacagagcugacuacaaggca

SEQ ID NO: 205468 - RNA, 22 nt, Human
auaagugacugcagggaauuca

SEQ ID NO: 205469 - RNA, 22 nt, Human
gggugggaugccgcugucucca

SEQ ID NO: 205470 - RNA, 22 nt, Human
ccucagucuugaauuagccaga

SEQ ID NO: 205471 - RNA, 21 nt, Human
ucucuguguacagucucaccc

SEQ ID NO: 205472 - RNA, 22 nt, Human
aaaggcuuuugguauauaggag

SEQ ID NO: 205473 - RNA, 22 nt, Human
gauauuuacauuaagcacauug

SEQ ID NO: 205474 - RNA, 23 nt, Human
ccacagagcugccaauuccugug

SEQ ID NO: 205475 - RNA, 22 nt, Human
acuaucaacaucauugcucuag

SEQ ID NO: 205476 - RNA, 22 nt, Human
gcugcaccagcuccaccagggc

SEQ ID NO: 205477 - RNA, 22 nt, Human
gccagccugugggggcucugug

SEQ ID NO: 205478 - RNA, 22 nt, Human
gaacagaguugaaacaaggcug

SEQ ID NO: 205479 - RNA, 22 nt, Human
ugaguccauaguggauccuuca

SEQ ID NO: 205480 - RNA, 22 nt, Human
agugacuacugauuuuuacuuu

SEQ ID NO: 205481 - RNA, 22 nt, Human
agugcacuggcaccaucucagc

SEQ ID NO: 205482 - RNA, 22 nt, Human
ggguaggagaggugucugugug

SEQ ID NO: 205483 - RNA, 22 nt, Human
caagcuggaguuccucagagug

SEQ ID NO: 205484 - RNA, 22 nt, Human
caacaacaugggauucauuucu

SEQ ID NO: 205485 - RNA, 21 nt, Human
ucuuccuccacagcgugccac

SEQ ID NO: 205486 - RNA, 22 nt, Human
gaaaucaauuucuugguugaua

SEQ ID NO: 205487 - RNA, 22 nt, Human
gcagaggagcaagcuggacacc

SEQ ID NO: 205488 - RNA, 22 nt, Human
gccuugggauucuuggaugcuc

SEQ ID NO: 205489 - RNA, 22 nt, Human
ugucuucaguaaaauacacuau

SEQ ID NO: 205490 - RNA, 22 nt, Human
uuuauacauggagaauuuuugc

SEQ ID NO: 205491 - RNA, 22 nt, Human
cacugucuucaguuucacugca

SEQ ID NO: 205492 - RNA, 22 nt, Human
cucagcuccaggugugcaucuu

SEQ ID NO: 205493 - RNA, 22 nt, Human
augaggcauuccacucaaacuc

SEQ ID NO: 205494 - RNA, 22 nt, Human
uuucaaaggaggcugagaggau

SEQ ID NO: 205495 - RNA, 22 nt, Human
gucucaaacuccuaggcuaaag

SEQ ID NO: 205496 - RNA, 22 nt, Human
gugcaaaaugauauccugaagc

SEQ ID NO: 205497 - RNA, 23 nt, Human
agucagugcgggauggucagggg

SEQ ID NO: 205498 - RNA, 22 nt, Human
cucucagauggagugugaaugg

SEQ ID NO: 205499 - RNA, 22 nt, Human
ucuauuuuuauaguugaagugc

SEQ ID NO: 205500 - RNA, 22 nt, Human
uaagauguuuugguuugauaag

SEQ ID NO: 205501 - RNA, 22 nt, Human
cuccucugucuaccacgagggu

SEQ ID NO: 205502 - RNA, 22 nt, Human
caggaaguggcugggcuggguu

SEQ ID NO: 205503 - RNA, 22 nt, Human
agagacaggguuuugccauguu

SEQ ID NO: 205504 - RNA, 22 nt, Human
cagaggaagagauacaagcccu

SEQ ID NO: 205505 - RNA, 22 nt, Human
cuccaggccauggcugcggagg

SEQ ID NO: 205506 - RNA, 22 nt, Human
uuacaagguaaguuguuaaguc

SEQ ID NO: 205507 - RNA, 22 nt, Human
uuaugggagcaauuggggaggu

SEQ ID NO: 205508 - RNA, 22 nt, Human
ggcagccuggagacuuugugaa

SEQ ID NO: 205509 - RNA, 21 nt, Human
aagccagcccacagugguuug

SEQ ID NO: 205510 - RNA, 22 nt, Human
uuucaaauggagucgugaaaug

SEQ ID NO: 205511 - RNA, 22 nt, Human
uugcaaauuauuuuagucccuu

SEQ ID NO: 205512 - RNA, 22 nt, Human
gcagaaguaccucguucuaguu

SEQ ID NO: 205513 - RNA, 22 nt, Human
ugccuguguccccuucuuggca

SEQ ID NO: 205514 - RNA, 22 nt, Human
cuggaagugggguuggcuugaa

SEQ ID NO: 205515 - RNA, 22 nt, Human
gucagugcuugaagggcagaga

SEQ ID NO: 205516 - RNA, 22 nt, Human
cagcaggcaggugggccaaguc

SEQ ID NO: 205517 - RNA, 22 nt, Human
cagcugucugaagcaggagucc

SEQ ID NO: 205518 - RNA, 22 nt, Human
cuggcccucggaguccagcugc

SEQ ID NO: 205519 - RNA, 22 nt, Human
cauaucuggagacuccuggucu

SEQ ID NO: 205520 - RNA, 22 nt, Human
aggccaggacacuuaaguaaga

SEQ ID NO: 205521 - RNA, 22 nt, Human
augucccugagggucucucuga

SEQ ID NO: 205522 - RNA, 22 nt, Human
uaaauccagcuucuaauuuaga

SEQ ID NO: 205523 - RNA, 22 nt, Human
ggaggccaucuggcuggaggcu

SEQ ID NO: 205524 - RNA, 22 nt, Human
aggugcuagguguguaguggag

SEQ ID NO: 205525 - RNA, 22 nt, Human
uagaugaacagaaagccacugu

SEQ ID NO: 205526 - RNA, 22 nt, Human
cucugcccgcggaugccacguc

SEQ ID NO: 205527 - RNA, 22 nt, Human
augaaucuguuuuuugucaaua

SEQ ID NO: 205528 - RNA, 22 nt, Human
ccugggcuggaguacagcagug

SEQ ID NO: 205529 - RNA, 22 nt, Human
cagaaagccgacuuacaaugga

SEQ ID NO: 205530 - RNA, 22 nt, Human
uaaacaucugucauguguuuau

SEQ ID NO: 205531 - RNA, 22 nt, Human
ggcaccaggggauguaaugucc

SEQ ID NO: 205532 - RNA, 16 nt, Human
ugccuugcugucaguc

SEQ ID NO: 205533 - RNA, 22 nt, Human
ggcagcuggccuccucgcccac

SEQ ID NO: 205534 - RNA, 22 nt, Human
agucugguaauguagcucaacc

SEQ ID NO: 205535 - RNA, 22 nt, Human
ccagguguucuuugucccuguu

SEQ ID NO: 205536 - RNA, 22 nt, Human
uucagagaguuugugaguccuu

SEQ ID NO: 205537 - RNA, 22 nt, Human
ccaguuugaggaagaaguagau

SEQ ID NO: 205538 - RNA, 22 nt, Human
ccuguacauuagcugugaauug

SEQ ID NO: 205539 - RNA, 21 nt, Human
auuuccaaggguaccuaagau

SEQ ID NO: 205540 - RNA, 22 nt, Human
ggagaggugaauggcugcucua

SEQ ID NO: 205541 - RNA, 22 nt, Human
cuuccaggguccaggaagagcc

SEQ ID NO: 205542 - RNA, 22 nt, Human
aauaauagcagaguuuacaauc

SEQ ID NO: 205543 - RNA, 22 nt, Human
cagagccagucagucagaaacu

SEQ ID NO: 205544 - RNA, 22 nt, Human
cacaguuuugcccagggcuucu

SEQ ID NO: 205545 - RNA, 22 nt, Human
gggcuccagaggcucacccugg

SEQ ID NO: 205546 - RNA, 22 nt, Human
uuggaggauggaguuagcaucu

SEQ ID NO: 205547 - RNA, 22 nt, Human
uaaagacaaaugacauuacggc

SEQ ID NO: 205548 - RNA, 22 nt, Human
uaacaucuuuagcagcucgaac

SEQ ID NO: 205549 - RNA, 22 nt, Human
agguccugacuccacguucuag

SEQ ID NO: 205550 - RNA, 22 nt, Human
acuucuaagcucaaauugguau

SEQ ID NO: 205551 - RNA, 22 nt, Human
augcugugauuguagaaauauu

SEQ ID NO: 205552 - RNA, 22 nt, Human
accucaguucaauucaguuaga

SEQ ID NO: 205553 - RNA, 22 nt, Human
uaugucuuuugcuugcaaauag

SEQ ID NO: 205554 - RNA, 22 nt, Human
ugucucagauacgccaucaagg

SEQ ID NO: 205555 - RNA, 22 nt, Human
uaugauauucuaaauugacacc

SEQ ID NO: 205556 - RNA, 22 nt, Human
uuccagaagccuccauauuacu

SEQ ID NO: 205557 - RNA, 22 nt, Human
acagaucucaaagccuggaccc

SEQ ID NO: 205558 - RNA, 22 nt, Human
cuuuuugucucuguccugauga

SEQ ID NO: 205559 - RNA, 22 nt, Human
agaaaaagucaaggaauuggac

SEQ ID NO: 205560 - RNA, 22 nt, Human
caagauuuagccugcugccugu

SEQ ID NO: 205561 - RNA, 22 nt, Human
aagcucuuaugauauuuauuua

SEQ ID NO: 205562 - RNA, 22 nt, Human
uagcaucuugauuucagaccag

SEQ ID NO: 205563 - RNA, 21 nt, Human
gcaugugugggacuggauccu

SEQ ID NO: 205564 - RNA, 22 nt, Human
agaaggaagccaggagggugca

SEQ ID NO: 205565 - RNA, 22 nt, Human
ucaguuuauaaauuguauuuag

SEQ ID NO: 205566 - RNA, 22 nt, Human
gugcuuuuucaaucagaaggga

SEQ ID NO: 205567 - RNA, 22 nt, Human
cagcccuggccccagguggucu

SEQ ID NO: 205568 - RNA, 22 nt, Human
acauguaacauauauguagcau

SEQ ID NO: 205569 - RNA, 22 nt, Human
auuucuguaguccacauucuuu

SEQ ID NO: 205570 - RNA, 22 nt, Human
ucugccuggauuccauucucca

SEQ ID NO: 205571 - RNA, 22 nt, Human
auguuaacagcugcuucuggug

SEQ ID NO: 205572 - RNA, 22 nt, Human
cugugaaacuggacagcacuug

SEQ ID NO: 205573 - RNA, 22 nt, Human
cucugggaauucugagcaagca

SEQ ID NO: 205574 - RNA, 22 nt, Human
cuggguggcgucuggggccagu

SEQ ID NO: 205575 - RNA, 22 nt, Human
gagcuccugaaacguuccugcc

SEQ ID NO: 205576 - RNA, 22 nt, Human
ggucacaugcggggcuguagcc

SEQ ID NO: 205577 - RNA, 22 nt, Human
ugagcagggacuuuggagucug

SEQ ID NO: 205578 - RNA, 22 nt, Human
acucuggguucuuucacuugac

SEQ ID NO: 205579 - RNA, 22 nt, Human
auuugaagucuucaugauuucu

SEQ ID NO: 205580 - RNA, 22 nt, Human
guugauacaccucaugguuacu

SEQ ID NO: 205581 - RNA, 22 nt, Human
ugucuuuuggagcaucuuucuu

SEQ ID NO: 205582 - RNA, 22 nt, Human
aggagggugauccgggcugguc

SEQ ID NO: 205583 - RNA, 21 nt, Human
agaugcaguuaugagaugcag

SEQ ID NO: 205584 - RNA, 19 nt, Human
guaacaguggacauuuuag

SEQ ID NO: 205585 - RNA, 22 nt, Human
guagcugccuuucuggcccagg

SEQ ID NO: 205586 - RNA, 18 nt, Human
ucuccuggguaggggccu

SEQ ID NO: 205587 - RNA, 22 nt, Human
cuguggcauugccgaggcuggc

SEQ ID NO: 205588 - RNA, 22 nt, Human
uuccugggcuuuccccucuggu

SEQ ID NO: 205589 - RNA, 22 nt, Human
gccucugggcucugccccuggc

SEQ ID NO: 205590 - RNA, 22 nt, Human
ucccagcacgucugcuguuucu

SEQ ID NO: 205591 - RNA, 22 nt, Human
auacacauauguguguauaugu

SEQ ID NO: 205592 - RNA, 22 nt, Human
gggcccucugcagcugcccagg

SEQ ID NO: 205593 - RNA, 22 nt, Human
uggcucuggugcgggcuccugc

SEQ ID NO: 205594 - RNA, 22 nt, Human
gaagcccagcaaacugugauca

SEQ ID NO: 205595 - RNA, 22 nt, Human
cuucccuucugugcagggcaga

SEQ ID NO: 205596 - RNA, 22 nt, Human
cucagaggguacaggugaaccc

SEQ ID NO: 205597 - RNA, 22 nt, Human
auguuaacugaagccauucucg

SEQ ID NO: 205598 - RNA, 22 nt, Human
caggcuggucccagagcauugc

SEQ ID NO: 205599 - RNA, 22 nt, Human
aagugaauucauuguguuauau

SEQ ID NO: 205600 - RNA, 22 nt, Human
accaggagaggcacuugcaaug

SEQ ID NO: 205601 - RNA, 22 nt, Human
gugcaagcaguacacucaaagc

SEQ ID NO: 205602 - RNA, 22 nt, Human
aggagccccucuucaguccugg

SEQ ID NO: 205603 - RNA, 19 nt, Human
uuagguauuauugcuuucc

SEQ ID NO: 205604 - RNA, 22 nt, Human
aguuuacagaugcuacaggagc

SEQ ID NO: 205605 - RNA, 22 nt, Human
aguguggcugcguagggcucuc

SEQ ID NO: 205606 - RNA, 22 nt, Human
uuuaguguggcacugauguuca

SEQ ID NO: 205607 - RNA, 22 nt, Human
uucugggacaucuggacaguuu

SEQ ID NO: 205608 - RNA, 22 nt, Human
agucuccuuggccucaaugccu

SEQ ID NO: 205609 - RNA, 22 nt, Human
gccaggaagcaguuagaugggu

SEQ ID NO: 205610 - RNA, 22 nt, Human
aagacacaauguagcccagcac

SEQ ID NO: 205611 - RNA, 22 nt, Human
ucucccagugucuggcagucag

SEQ ID NO: 205612 - RNA, 22 nt, Human
aaagccauugaacuguacuuua

SEQ ID NO: 205613 - RNA, 22 nt, Human
caggcucuagguuaguaggaga

SEQ ID NO: 205614 - RNA, 22 nt, Human
gcuucccauaguggaauucggg

SEQ ID NO: 205615 - RNA, 22 nt, Human
acuagaaaauuccuagaaacua

SEQ ID NO: 205616 - RNA, 22 nt, Human
gacaguuuugcugaaauugagc

SEQ ID NO: 205617 - RNA, 22 nt, Human
uauaucugggaaccaaaggggg

SEQ ID NO: 205618 - RNA, 22 nt, Human
uuacauguucucauacacagag

SEQ ID NO: 205619 - RNA, 22 nt, Human
ucuggagggcccacauccacaa

SEQ ID NO: 205620 - RNA, 22 nt, Human
uggacauguaaaggcucaaggu

SEQ ID NO: 205621 - RNA, 22 nt, Human
ugcccagccccuaucccuggga

SEQ ID NO: 205622 - RNA, 22 nt, Human
ccaggccaaauucagucagcag

SEQ ID NO: 205623 - RNA, 22 nt, Human
ugaaccuuuugaauaaggacca

SEQ ID NO: 205624 - RNA, 22 nt, Human
uucucugguaaacacaugcgua

SEQ ID NO: 205625 - RNA, 22 nt, Human
auuugcuucugugaaaucaagu

SEQ ID NO: 205626 - RNA, 22 nt, Human
ucugugaaugugaccuuauuug

SEQ ID NO: 205627 - RNA, 22 nt, Human
cuccugaggacuucuauugggu

SEQ ID NO: 205628 - RNA, 22 nt, Human
ucucccaggucauacacagaga

SEQ ID NO: 205629 - RNA, 20 nt, Human
gucuucuauucccagaaagu

SEQ ID NO: 205630 - RNA, 22 nt, Human
uuuguacuucauugguucuacu

SEQ ID NO: 205631 - RNA, 20 nt, Human
cugggaggucuuccaaauca

SEQ ID NO: 205632 - RNA, 22 nt, Human
uagcaagaugucacuccaaguu

SEQ ID NO: 205633 - RNA, 20 nt, Human
cugggcagguguuugaucuc

SEQ ID NO: 205634 - RNA, 22 nt, Human
uccaggagacacaagguacaua

SEQ ID NO: 205635 - RNA, 22 nt, Human
uaucuagagcagugguucucaa

SEQ ID NO: 205636 - RNA, 22 nt, Human
ccauggccaggaaagccaaggu

SEQ ID NO: 205637 - RNA, 22 nt, Human
uucuuuucuuuaggcauugugu

SEQ ID NO: 205638 - RNA, 22 nt, Human
uuauuucauguaaaauuuaugu

SEQ ID NO: 205639 - RNA, 22 nt, Human
ucugagagucucugaggcagau

SEQ ID NO: 205640 - RNA, 22 nt, Human
guagaauauaugguuaguauug

SEQ ID NO: 205641 - RNA, 22 nt, Human
auuauaugugggauagaauuua

SEQ ID NO: 205642 - RNA, 22 nt, Human
uucugcagcccaacaguaguuu

SEQ ID NO: 205643 - RNA, 22 nt, Human
uaauggcagagucaugcuuucu

SEQ ID NO: 205644 - RNA, 22 nt, Human
caggcacacaggcucccugggc

SEQ ID NO: 205645 - RNA, 22 nt, Human
uuauaauucuggcauaggcugu

SEQ ID NO: 205646 - RNA, 22 nt, Human
ggacuccucuagaaguugaggc

SEQ ID NO: 205647 - RNA, 22 nt, Human
aucugguucuucuuaggcauca

SEQ ID NO: 205648 - RNA, 22 nt, Human
uccuggguagccuguccaagau

SEQ ID NO: 205649 - RNA, 22 nt, Human
ucaggcagagggagaagccaag

SEQ ID NO: 205650 - RNA, 22 nt, Human
aucuuuuugacauggugauggu

SEQ ID NO: 205651 - RNA, 22 nt, Human
agugacuaaagguuuuaauggc

SEQ ID NO: 205652 - RNA, 19 nt, Human
uggcuucuguuuucauguu

SEQ ID NO: 205653 - RNA, 22 nt, Human
uggagcucugauuaaauuggaa

SEQ ID NO: 205654 - RNA, 22 nt, Human
caaggcauuguguaagcacuug

SEQ ID NO: 205655 - RNA, 22 nt, Human
ugcuggcccuggcucagggaac

SEQ ID NO: 205656 - RNA, 22 nt, Human
cugccaggugccagggcgcggc

SEQ ID NO: 205657 - RNA, 22 nt, Human
gcucccagggaccgcagggcag

SEQ ID NO: 205658 - RNA, 22 nt, Human
acaaauugaccgcaagauucau

SEQ ID NO: 205659 - RNA, 23 nt, Human
acugggucuaucuccagagaaga

SEQ ID NO: 205660 - RNA, 22 nt, Human
aauuaugauuggucuaaaccag

SEQ ID NO: 205661 - RNA, 22 nt, Human
ccuuucagaugggcauggaccg

SEQ ID NO: 205662 - RNA, 18 nt, Human
cccacacagcaguagcuc

SEQ ID NO: 205663 - RNA, 21 nt, Human
uggcucuggguaggagagugc

SEQ ID NO: 205664 - RNA, 22 nt, Human
aagugcauaguaauggagucaa

SEQ ID NO: 205665 - RNA, 22 nt, Human
cuucugagggccuuugcuucca

SEQ ID NO: 205666 - RNA, 22 nt, Human
cuuugaaaccugcucugcagaa

SEQ ID NO: 205667 - RNA, 22 nt, Human
uccuuaggcaauuugggagagu

SEQ ID NO: 205668 - RNA, 22 nt, Human
guucaagguuuuacagagugua

SEQ ID NO: 205669 - RNA, 22 nt, Human
caauucaauggcaaaguauugu

SEQ ID NO: 205670 - RNA, 22 nt, Human
caggcagcugcuggguucagcc

SEQ ID NO: 205671 - RNA, 22 nt, Human
ucuuccuucuuugaugacaagg

SEQ ID NO: 205672 - RNA, 22 nt, Human
ugccuucuugaauaugguucuu

SEQ ID NO: 205673 - RNA, 22 nt, Human
ccagcuuuccugcgaguugauu

SEQ ID NO: 205674 - RNA, 22 nt, Human
ugugcuugucguggagccaggc

SEQ ID NO: 205675 - RNA, 22 nt, Human
uaucuuuauuaugucuaucugc

SEQ ID NO: 205676 - RNA, 22 nt, Human
ccugggccucacccagcucuug

SEQ ID NO: 205677 - RNA, 22 nt, Human
gggccugccaggcuuucagcau

SEQ ID NO: 205678 - RNA, 22 nt, Human
augucacauuggagcugcugga

SEQ ID NO: 205679 - RNA, 22 nt, Human
guuuauuggguauuguggagcc

SEQ ID NO: 205680 - RNA, 22 nt, Human
auuggucucugcuaaagggagg

SEQ ID NO: 205681 - RNA, 22 nt, Human
agcugggcaccccgcugcgucu

SEQ ID NO: 205682 - RNA, 19 nt, Human
ucccucccuguaaucucac

SEQ ID NO: 205683 - RNA, 22 nt, Human
gcuugaaaaugacucuugugaa

SEQ ID NO: 205684 - RNA, 22 nt, Human
ucuaaaugucaguacagaauga

SEQ ID NO: 205685 - RNA, 22 nt, Human
acagcugugaaaauccacagga

SEQ ID NO: 205686 - RNA, 22 nt, Human
acucugggcccacccucagagu

SEQ ID NO: 205687 - RNA, 22 nt, Human
uccaggucccuggggagauuuu

SEQ ID NO: 205688 - RNA, 22 nt, Human
cacauggccuguguggccagac

SEQ ID NO: 205689 - RNA, 22 nt, Human
caacaccuugaucuuggacuuc

SEQ ID NO: 205690 - RNA, 22 nt, Human
gccaaggauaccagcugugaga

SEQ ID NO: 205691 - RNA, 22 nt, Human
uuccacggggcuccccgcucuu

SEQ ID NO: 205692 - RNA, 22 nt, Human
uaaugcaacgugagauaauuaa

SEQ ID NO: 205693 - RNA, 22 nt, Human
ggcucaggaccugggauugcca

SEQ ID NO: 205694 - RNA, 22 nt, Human
guggcuauauuugaggauacgu

SEQ ID NO: 205695 - RNA, 22 nt, Human
ugcacaggugagacucaggaag

SEQ ID NO: 205696 - RNA, 22 nt, Human
gcaggugguccccguggagugg

SEQ ID NO: 205697 - RNA, 22 nt, Human
gccugaugagcuuccagcugag

SEQ ID NO: 205698 - RNA, 22 nt, Human
ggagcugcucagagccaguccc

SEQ ID NO: 205699 - RNA, 22 nt, Human
caggcagagcaacugguccaga

SEQ ID NO: 205700 - RNA, 22 nt, Human
ucccucucuggcuggggugcgg

SEQ ID NO: 205701 - RNA, 22 nt, Human
uccugggacuuucaaggcuagg

SEQ ID NO: 205702 - RNA, 22 nt, Human
ggcuuuauuaagcaggguaagu

SEQ ID NO: 205703 - RNA, 22 nt, Human
cacuuaaaacuccuggaauugu

SEQ ID NO: 205704 - RNA, 22 nt, Human
aagcugugaaaucucuagugca

SEQ ID NO: 205705 - RNA, 20 nt, Human
uuugacucaggccuuuagcc

SEQ ID NO: 205706 - RNA, 22 nt, Human
ugcugggggcuuucuggauacc

SEQ ID NO: 205707 - RNA, 22 nt, Human
agcagagaccauauagcccaga

SEQ ID NO: 205708 - RNA, 22 nt, Human
ggucaguggcaggggguacuuc

SEQ ID NO: 205709 - RNA, 22 nt, Human
aggcaguguauugcuagcggcu

SEQ ID NO: 205710 - RNA, 22 nt, Human
ugaaauagaaaaacaggcuucu

SEQ ID NO: 205711 - RNA, 22 nt, Human
ucaggauccauagacucccaaa

SEQ ID NO: 205712 - RNA, 23 nt, Human
ccaaagucgaagucuaguccaga

SEQ ID NO: 205713 - RNA, 22 nt, Human
agaauuagguaaguucaucuga

SEQ ID NO: 205714 - RNA, 22 nt, Human
ucuguaggggccggcggagccc

SEQ ID NO: 205715 - RNA, 22 nt, Human
acugaugaguaggcagacaagg

SEQ ID NO: 205716 - RNA, 22 nt, Human
guaaagaaguuuuugaaugcau

SEQ ID NO: 205717 - RNA, 22 nt, Human
auccacaguggggguggcggaa

SEQ ID NO: 205718 - RNA, 21 nt, Human
ccauaaucuuaggaucaaaau

SEQ ID NO: 205719 - RNA, 22 nt, Human
gaccaaggaagaggggagccag

SEQ ID NO: 205720 - RNA, 22 nt, Human
gaaguggaagccaucggcaguc

SEQ ID NO: 205721 - RNA, 22 nt, Human
ugcuggcuguucuagggaggcc

SEQ ID NO: 205722 - RNA, 22 nt, Human
gagcgauugcgggggucagagg

SEQ ID NO: 205723 - RNA, 22 nt, Human
aggccugggacgggagccguga

SEQ ID NO: 205724 - RNA, 22 nt, Human
aaagcauguugggucccucuuu

SEQ ID NO: 205725 - RNA, 22 nt, Human
aacugcaauuacuuuugcacua

SEQ ID NO: 205726 - RNA, 22 nt, Human
aaguguguugacugaauugggg

SEQ ID NO: 205727 - RNA, 19 nt, Human
uuuaaagugacugguauuu

SEQ ID NO: 205728 - RNA, 22 nt, Human
cugagcugggagccuggcacca

SEQ ID NO: 205729 - RNA, 22 nt, Human
ugucuccaaaacaaucucagau

SEQ ID NO: 205730 - RNA, 22 nt, Human
ugcugcaggcagccccucuacu

SEQ ID NO: 205731 - RNA, 22 nt, Human
gcugagguggcugccuuaguaa

SEQ ID NO: 205732 - RNA, 22 nt, Human
ugcagggaagcaaggguggcuc

SEQ ID NO: 205733 - RNA, 19 nt, Human
gaacaaacuuaaacuuuuc

SEQ ID NO: 205734 - RNA, 21 nt, Human
uguggcugacacccuuuggga

SEQ ID NO: 205735 - RNA, 22 nt, Human
uccagccaagccuugguagcug

SEQ ID NO: 205736 - RNA, 22 nt, Human
caggaaauugcaacagucugag

SEQ ID NO: 205737 - RNA, 22 nt, Human
uccagggcucauucccucugca

SEQ ID NO: 205738 - RNA, 22 nt, Human
uucccuggcucuucuacaucgu

SEQ ID NO: 205739 - RNA, 19 nt, Human
ggagaagcccaggaauccu

SEQ ID NO: 205740 - RNA, 22 nt, Human
uuugauaauuaaaaauuguagu

SEQ ID NO: 205741 - RNA, 22 nt, Human
aaaaccacaguuacuuuugcac

SEQ ID NO: 205742 - RNA, 19 nt, Human
ugcuuccucaccaucuccc

SEQ ID NO: 205743 - RNA, 22 nt, Human
uaagacaccucucugcccuuca

SEQ ID NO: 205744 - RNA, 22 nt, Human
gggacagaaggaagugagcaca

SEQ ID NO: 205745 - RNA, 22 nt, Human
ccauccuuggcucgcucucugu

SEQ ID NO: 205746 - RNA, 22 nt, Human
aggaguuuggggauuagucagg

SEQ ID NO: 205747 - RNA, 22 nt, Human
cuggcugguagaauugugaccu

SEQ ID NO: 205748 - RNA, 22 nt, Human
cccagcucugcagaccugcccu

SEQ ID NO: 205749 - RNA, 22 nt, Human
gagaguucuugccuggguauua

SEQ ID NO: 205750 - RNA, 22 nt, Human
auguuuguagguaagugacacu

SEQ ID NO: 205751 - RNA, 22 nt, Human
agcuuagaagugugcugagagg

SEQ ID NO: 205752 - RNA, 22 nt, Human
gugcccuccugaagccaucaca

SEQ ID NO: 205753 - RNA, 22 nt, Human
uagcuuaacagcaaaacuguug

SEQ ID NO: 205754 - RNA, 22 nt, Human
cugugggagaggugccuggauu

SEQ ID NO: 205755 - RNA, 22 nt, Human
uggcagccugcgugaaggagcu

SEQ ID NO: 205756 - RNA, 18 nt, Human
uaacugguuucuucccau

SEQ ID NO: 205757 - RNA, 22 nt, Human
cagccagguuagugcuaauugu

SEQ ID NO: 205758 - RNA, 22 nt, Human
acagacagauuuugucugaugu

SEQ ID NO: 205759 - RNA, 22 nt, Human
guacaugucaaaaaaugcauaa

SEQ ID NO: 205760 - RNA, 22 nt, Human
gguuucacaauuuagagcagug

SEQ ID NO: 205761 - RNA, 22 nt, Human
aguaaggcauuuuucauguuua

SEQ ID NO: 205762 - RNA, 22 nt, Human
ugucuuuagccagcagucuucu

SEQ ID NO: 205763 - RNA, 22 nt, Human
acaguuuauaaaaauaaugagg

SEQ ID NO: 205764 - RNA, 23 nt, Human
acacugucucauggauagacugc

SEQ ID NO: 205765 - RNA, 22 nt, Human
uaaagcaaggaauagaguaguc

SEQ ID NO: 205766 - RNA, 22 nt, Human
aaagcagacugauuugcaucac

SEQ ID NO: 205767 - RNA, 22 nt, Human
ucuccagggagguagcccagug

SEQ ID NO: 205768 - RNA, 22 nt, Human
uguccugggaggcgggguccag

SEQ ID NO: 205769 - RNA, 19 nt, Human
acucaggcaaugagaaaca

SEQ ID NO: 205770 - RNA, 22 nt, Human
uggaccagggucccagaguaug

SEQ ID NO: 205771 - RNA, 22 nt, Human
ucaggcuggggugcuaaggugu

SEQ ID NO: 205772 - RNA, 22 nt, Human
cauuauggcagccaggauauug

SEQ ID NO: 205773 - RNA, 22 nt, Human
ugcuggaggaguuuacuguggc

SEQ ID NO: 205774 - RNA, 21 nt, Human
agaaggcaaaagcagacaucu

SEQ ID NO: 205775 - RNA, 22 nt, Human
ugagccagcuccuugccuguca

SEQ ID NO: 205776 - RNA, 22 nt, Human
aauguuaguaacuugaguauuu

SEQ ID NO: 205777 - RNA, 22 nt, Human
acuuggcuuuaguaguaacuga

SEQ ID NO: 205778 - RNA, 22 nt, Human
ucaguguguacacugagcauuu

SEQ ID NO: 205779 - RNA, 22 nt, Human
acugucaugugcuaacugucca

SEQ ID NO: 205780 - RNA, 22 nt, Human
uucaaaccuucacuugcagagu

SEQ ID NO: 205781 - RNA, 22 nt, Human
uggcuucuagcaguguugauuu

SEQ ID NO: 205782 - RNA, 22 nt, Human
uuugucuuguguccuuaggacc

SEQ ID NO: 205783 - RNA, 22 nt, Human
ccugcaccucugugcuuggaac

SEQ ID NO: 205784 - RNA, 22 nt, Human
uggcccaggaggccagagggca

SEQ ID NO: 205785 - RNA, 22 nt, Human
ugcagagggacagccacagcuc

SEQ ID NO: 205786 - RNA, 22 nt, Human
uggccaggcuggucuggaacgc

SEQ ID NO: 205787 - RNA, 22 nt, Human
gagggccaggcagcaagaaggc

SEQ ID NO: 205788 - RNA, 22 nt, Human
ucugggccagaucuagggaucu

SEQ ID NO: 205789 - RNA, 22 nt, Human
cucaggucgcuauuucucuuac

SEQ ID NO: 205790 - RNA, 23 nt, Human
cccagagcacagccuccagaugc

SEQ ID NO: 205791 - RNA, 22 nt, Human
gccagcccugggagacuuaugg

SEQ ID NO: 205792 - RNA, 22 nt, Human
ucugcagaagcucacuaaaucc

SEQ ID NO: 205793 - RNA, 21 nt, Human
acccuggguucuccauacccu

SEQ ID NO: 205794 - RNA, 18 nt, Human
aucuuuccauagcauguu

SEQ ID NO: 205795 - RNA, 22 nt, Human
ugagcccuggagcccucuguua

SEQ ID NO: 205796 - RNA, 22 nt, Human
aguacaugugguccuggccaga

SEQ ID NO: 205797 - RNA, 22 nt, Human
acuggcuggacucugaccucuu

SEQ ID NO: 205798 - RNA, 22 nt, Human
ccucccaucccugcaagagagc

SEQ ID NO: 205799 - RNA, 22 nt, Human
uccuguccacagcccugaccuc

SEQ ID NO: 205800 - RNA, 22 nt, Human
auucaacuagugauuguguuau

SEQ ID NO: 205801 - RNA, 22 nt, Human
ccaugcugacccugugcaggca

SEQ ID NO: 205802 - RNA, 22 nt, Human
ggguguagacacauguucaucu

SEQ ID NO: 205803 - RNA, 22 nt, Human
ggcuuggcugucucccagccca

SEQ ID NO: 205804 - RNA, 22 nt, Human
ccugcuggacagggguguucau

SEQ ID NO: 205805 - RNA, 21 nt, Human
ccaggcuggccaugguauuga

SEQ ID NO: 205806 - RNA, 22 nt, Human
aucuacaacaucacauggcauu

SEQ ID NO: 205807 - RNA, 22 nt, Human
uggaagcagagagcuaucacca

SEQ ID NO: 205808 - RNA, 22 nt, Human
cugcaugucacucugcuguccc

SEQ ID NO: 205809 - RNA, 22 nt, Human
uaagauguacaaccacuucucu

SEQ ID NO: 205810 - RNA, 22 nt, Human
gagcuuggugcugccuguuguc

SEQ ID NO: 205811 - RNA, 22 nt, Human
gauggcuuccuucucacugugu

SEQ ID NO: 205812 - RNA, 22 nt, Human
ucugggcugcuaugaggcagag

SEQ ID NO: 205813 - RNA, 21 nt, Human
gccacugcacuccagccuggg

SEQ ID NO: 205814 - RNA, 22 nt, Human
gauacaaaauauaaauggagag

SEQ ID NO: 205815 - RNA, 22 nt, Human
ugagcccuccaaacccaggauu

SEQ ID NO: 205816 - RNA, 22 nt, Human
gggcagcucucacagcagccaa

SEQ ID NO: 205817 - RNA, 22 nt, Human
auucuuuaguuggcuucuugcc

SEQ ID NO: 205818 - RNA, 20 nt, Human
uucuuuguuccuuacauuug

SEQ ID NO: 205819 - RNA, 23 nt, Human
aagaaguuaccuaaaguuguacu

SEQ ID NO: 205820 - RNA, 22 nt, Human
uuuucauuguuccucgagcauu

SEQ ID NO: 205821 - RNA, 22 nt, Human
gcaaaucaccaccuagcuggau

SEQ ID NO: 205822 - RNA, 17 nt, Human
uggcuucagauguacau

SEQ ID NO: 205823 - RNA, 22 nt, Human
ccuggcacaugauagaugcuca

SEQ ID NO: 205824 - RNA, 22 nt, Human
gcaggcaccggguugcuccccu

SEQ ID NO: 205825 - RNA, 22 nt, Human
uacauucagcaaaagaaugguu

SEQ ID NO: 205826 - RNA, 22 nt, Human
cuguucuuuaguuccacugcaa

SEQ ID NO: 205827 - RNA, 22 nt, Human
cucugugccucaguuuucuucu

SEQ ID NO: 205828 - RNA, 22 nt, Human
ugacaguauugauggcaggauu

SEQ ID NO: 205829 - RNA, 22 nt, Human
gcacacagaauugauucacugu

SEQ ID NO: 205830 - RNA, 22 nt, Human
gcuggccuccugcuagauggaa

SEQ ID NO: 205831 - RNA, 22 nt, Human
uuccaggaacaaacucaccuua

SEQ ID NO: 205832 - RNA, 22 nt, Human
cuuggcuguaaaaucagaggcu

SEQ ID NO: 205833 - RNA, 22 nt, Human
caguucuuuguggggaguucuc

SEQ ID NO: 205834 - RNA, 22 nt, Human
uacuuuauucaggaaggcuggu

SEQ ID NO: 205835 - RNA, 22 nt, Human
ccugagccuggcucaugcacuc

SEQ ID NO: 205836 - RNA, 22 nt, Human
uugccaggcuuguuucuaggcu

SEQ ID NO: 205837 - RNA, 22 nt, Human
ugacauguccugagaagauggc

SEQ ID NO: 205838 - RNA, 22 nt, Human
aguuagagcgcauauuuuauua

SEQ ID NO: 205839 - RNA, 22 nt, Human
ugaggccacaggaaagggcccg

SEQ ID NO: 205840 - RNA, 22 nt, Human
cgaggcagaggcugaaacggcu

SEQ ID NO: 205841 - RNA, 19 nt, Human
cuugaaaugagacugaagg

SEQ ID NO: 205842 - RNA, 22 nt, Human
aaacacugugggacaucuuacu

SEQ ID NO: 205843 - RNA, 22 nt, Human
uggguggaauaaaucaguucug

SEQ ID NO: 205844 - RNA, 22 nt, Human
auggguuuauagguggacuuuu

SEQ ID NO: 205845 - RNA, 22 nt, Human
ugcaaggcacccacucugcuuu

SEQ ID NO: 205846 - RNA, 22 nt, Human
gaggagagaagcuaacggugcu

SEQ ID NO: 205847 - RNA, 22 nt, Human
cagggagcucugggccggacuc

SEQ ID NO: 205848 - RNA, 22 nt, Human
acagaguauuggaaaggcagug

SEQ ID NO: 205849 - RNA, 22 nt, Human
gauucuugggccuucugaaguu

SEQ ID NO: 205850 - RNA, 22 nt, Human
cugcaagguauauguuaucaua

SEQ ID NO: 205851 - RNA, 22 nt, Human
guuguuuuauaauugauugcaa

SEQ ID NO: 205852 - RNA, 22 nt, Human
acauuucucuugaugucucuau

SEQ ID NO: 205853 - RNA, 22 nt, Human
ucagagacuguaggagcagccu

SEQ ID NO: 205854 - RNA, 16 nt, Human
ccucugggccugcaag

SEQ ID NO: 205855 - RNA, 20 nt, Human
uucuggcaaacagaguucuu

SEQ ID NO: 205856 - RNA, 22 nt, Human
cccaaggcagggauuuucugcu

SEQ ID NO: 205857 - RNA, 22 nt, Human
gugcagggcccuccuaacaucu

SEQ ID NO: 205858 - RNA, 22 nt, Human
cagggcuagugacaccccaguc

SEQ ID NO: 205859 - RNA, 22 nt, Human
cuggauuuaauuaacuguugcu

SEQ ID NO: 205860 - RNA, 17 nt, Human
cucuuuauaaagaguua

SEQ ID NO: 205861 - RNA, 22 nt, Human
gcagcugucgcuaggagcugug

SEQ ID NO: 205862 - RNA, 18 nt, Human
acuguucucuccugcccu

SEQ ID NO: 205863 - RNA, 22 nt, Human
uccugggaggcaggaccccuuu

SEQ ID NO: 205864 - RNA, 22 nt, Human
acucauugaaacuuaagaucua

SEQ ID NO: 205865 - RNA, 22 nt, Human
uccaggaccucccaggcuagag

SEQ ID NO: 205866 - RNA, 22 nt, Human
cuguggcucaauugccuacuga

SEQ ID NO: 205867 - RNA, 22 nt, Human
ucuuuagagcacgggaaaaaca

SEQ ID NO: 205868 - RNA, 22 nt, Human
gccagcugaagggaagcuccug

SEQ ID NO: 205869 - RNA, 22 nt, Human
ugcacagcgggugucugucagg

SEQ ID NO: 205870 - RNA, 22 nt, Human
caggcccucaggcaagggcucu

SEQ ID NO: 205871 - RNA, 22 nt, Human
cugcuccuccccaucaggcagc

SEQ ID NO: 205872 - RNA, 18 nt, Human
cugggcucgagagauccu

SEQ ID NO: 205873 - RNA, 22 nt, Human
agugauuucaucauuuuaucaa

SEQ ID NO: 205874 - RNA, 22 nt, Human
uauuacaauuuacauugcacuu

SEQ ID NO: 205875 - RNA, 22 nt, Human
acagcuggaguguuggugaggu

SEQ ID NO: 205876 - RNA, 22 nt, Human
gccaggcuggugucacaacucu

SEQ ID NO: 205877 - RNA, 22 nt, Human
caggggaagaugccaagggaga

SEQ ID NO: 205878 - RNA, 22 nt, Human
ggccuucugccuuucagcaaug

SEQ ID NO: 205879 - RNA, 22 nt, Human
cacccacauggaaauucacagu

SEQ ID NO: 205880 - RNA, 22 nt, Human
cagcugccugucuggaggcaau

SEQ ID NO: 205881 - RNA, 22 nt, Human
gucugcccuuggcucagccaua

SEQ ID NO: 205882 - RNA, 22 nt, Human
uugagauggagccucagucuug

SEQ ID NO: 205883 - RNA, 21 nt, Human
guucaaauggguagauucaca

SEQ ID NO: 205884 - RNA, 22 nt, Human
caggccacgccccggcguguga

SEQ ID NO: 205885 - RNA, 22 nt, Human
ucacacaugaguaaauacaggg

SEQ ID NO: 205886 - RNA, 22 nt, Human
ugcugggccuuuaccuccaggg

SEQ ID NO: 205887 - RNA, 22 nt, Human
gucuagaaauagguuucagaaa

SEQ ID NO: 205888 - RNA, 22 nt, Human
ugccacagacaggacagaacag

SEQ ID NO: 205889 - RNA, 22 nt, Human
auuucuggauuuuggaugcugc

SEQ ID NO: 205890 - RNA, 22 nt, Human
aguugcagacgcagagauguug

SEQ ID NO: 205891 - RNA, 20 nt, Human
acacuugacaccagaaaugg

SEQ ID NO: 205892 - RNA, 20 nt, Human
accuccuggaagcaggugcc

SEQ ID NO: 205893 - RNA, 21 nt, Human
ucagagaacccggcaggcaag

SEQ ID NO: 205894 - RNA, 22 nt, Human
gcagcugguuaaugggagaauu

SEQ ID NO: 205895 - RNA, 22 nt, Human
caaaugcauaguuuauaagaag

SEQ ID NO: 205896 - RNA, 22 nt, Human
uucuuuauggaauggugauagu

SEQ ID NO: 205897 - RNA, 22 nt, Human
ugcagggaaaguguuggcagca

SEQ ID NO: 205898 - RNA, 22 nt, Human
uggcacagacagaucaggaguc

SEQ ID NO: 205899 - RNA, 23 nt, Human
gcagacagagcagacuaagacaa

SEQ ID NO: 205900 - RNA, 19 nt, Human
uaacuggugccuucaguca

SEQ ID NO: 205901 - RNA, 22 nt, Human
caggucuuuucuacugguggag

SEQ ID NO: 205902 - RNA, 19 nt, Human
ucuccaggugccccaaaca

SEQ ID NO: 205903 - RNA, 22 nt, Human
gcuggggagcaagaguagugag

SEQ ID NO: 205904 - RNA, 20 nt, Human
agcuaacccuacuuucuuug

SEQ ID NO: 205905 - RNA, 22 nt, Human
agggagcugcucugcuuccgug

SEQ ID NO: 205906 - RNA, 22 nt, Human
gaaugaguagaguauaaacaaa

SEQ ID NO: 205907 - RNA, 22 nt, Human
aagaacuguaucaagauguagu

SEQ ID NO: 205908 - RNA, 22 nt, Human
ucauguguugcacugaggaccu

SEQ ID NO: 205909 - RNA, 22 nt, Human
uauacacaaacaagggguuaag

SEQ ID NO: 205910 - RNA, 22 nt, Human
agggcaguguggugggacugac

SEQ ID NO: 205911 - RNA, 22 nt, Human
gcucuggguucugauuuaugag

SEQ ID NO: 205912 - RNA, 22 nt, Human
agagcacuuucgagagccggag

SEQ ID NO: 205913 - RNA, 21 nt, Human
agcugcaagagcaacaucuuu

SEQ ID NO: 205914 - RNA, 22 nt, Human
uccaggcuccccugcgugcucc

SEQ ID NO: 205915 - RNA, 22 nt, Human
aaaaaauuccauucugugccuu

SEQ ID NO: 205916 - RNA, 22 nt, Human
ugcagggauuauguagggguug

SEQ ID NO: 205917 - RNA, 22 nt, Human
auacagaaguuuuccacuuauu

SEQ ID NO: 205918 - RNA, 22 nt, Human
gauacacuggagcuuccugaca

SEQ ID NO: 205919 - RNA, 22 nt, Human
uuagugcaauucagagaacaau

SEQ ID NO: 205920 - RNA, 22 nt, Human
gcucugggauuaccagccuuag

SEQ ID NO: 205921 - RNA, 22 nt, Human
aggggcuccaaggaaguuuggg

SEQ ID NO: 205922 - RNA, 22 nt, Human
aggaagccuggggcugcccucg

SEQ ID NO: 205923 - RNA, 22 nt, Human
aaaagagcaaacauguaauagu

SEQ ID NO: 205924 - RNA, 22 nt, Human
ugucuuuaauucuacauaucuc

SEQ ID NO: 205925 - RNA, 22 nt, Human
caauaacugcugaggagaagca

SEQ ID NO: 205926 - RNA, 22 nt, Human
cagaugagaguggccaggguuc

SEQ ID NO: 205927 - RNA, 22 nt, Human
cugucucugauaagcucgaggg

SEQ ID NO: 205928 - RNA, 22 nt, Human
cuugaaugaaaccaacugauga

SEQ ID NO: 205929 - RNA, 22 nt, Human
cagcuugggaguuugguuuuau

SEQ ID NO: 205930 - RNA, 20 nt, Human
caaaagcaaugaaguuauga

SEQ ID NO: 205931 - RNA, 22 nt, Human
aacaaguaaguuuauauauauu

SEQ ID NO: 205932 - RNA, 22 nt, Human
caggccugacccugagcuucac

SEQ ID NO: 205933 - RNA, 22 nt, Human
ugaucauuaucaaacuggucau

SEQ ID NO: 205934 - RNA, 22 nt, Human
agaguaaauaggagaugacagc

SEQ ID NO: 205935 - RNA, 22 nt, Human
acagagcaugcucaguguguga

SEQ ID NO: 205936 - RNA, 22 nt, Human
cuggcccugguaaggacaccca

SEQ ID NO: 205937 - RNA, 22 nt, Human
uccagcagugcucaggacucac

SEQ ID NO: 205938 - RNA, 22 nt, Human
ucaucuuuccucaaaagaucca

SEQ ID NO: 205939 - RNA, 22 nt, Human
ccucacugcuauguguuugcuc

SEQ ID NO: 205940 - RNA, 22 nt, Human
uuagcauucucugugugcauaa

SEQ ID NO: 205941 - RNA, 20 nt, Human
uuccagagaucugcauuuua

SEQ ID NO: 205942 - RNA, 22 nt, Human
aaauuagaagugcucaggaaua

SEQ ID NO: 205943 - RNA, 22 nt, Human
uauucacuuugggagagccauu

SEQ ID NO: 205944 - RNA, 22 nt, Human
aucaggaucacagaaacuuuua

SEQ ID NO: 205945 - RNA, 22 nt, Human
cauccaaacucucauuaucugu

SEQ ID NO: 205946 - RNA, 22 nt, Human
uaggguacaugugcacaacaug

SEQ ID NO: 205947 - RNA, 22 nt, Human
agaaugcuuccuuugaaacuga

SEQ ID NO: 205948 - RNA, 22 nt, Human
uauauauaugcacacacaccua

SEQ ID NO: 205949 - RNA, 22 nt, Human
cccugcagagccagcccugacc

SEQ ID NO: 205950 - RNA, 22 nt, Human
cucaggagguuuccugucuagg

SEQ ID NO: 205951 - RNA, 22 nt, Human
auauacaggugguauguguaaa

SEQ ID NO: 205952 - RNA, 19 nt, Human
uagaaugcccacuuaaaaa

SEQ ID NO: 205953 - RNA, 22 nt, Human
cuuugccuccuagagcacguuc

SEQ ID NO: 205954 - RNA, 22 nt, Human
aucugaagaggucauggcugac

SEQ ID NO: 205955 - RNA, 22 nt, Human
gagcccuggcagucugggaugg

SEQ ID NO: 205956 - RNA, 19 nt, Human
ucaggacugacuugaaguc

SEQ ID NO: 205957 - RNA, 22 nt, Human
ucucugguuauuaacuaacucc

SEQ ID NO: 205958 - RNA, 22 nt, Human
cugccaaaaggugcaccugcug

SEQ ID NO: 205959 - RNA, 22 nt, Human
acauagaacuucccagugagca

SEQ ID NO: 205960 - RNA, 22 nt, Human
ucuuaguuguuugcugucuaac

SEQ ID NO: 205961 - RNA, 22 nt, Human
aagaaacuggaauauagagagc

SEQ ID NO: 205962 - RNA, 22 nt, Human
ugcugagguuucgucugcuugc

SEQ ID NO: 205963 - RNA, 22 nt, Human
cagagccagcccacuguucccg

SEQ ID NO: 205964 - RNA, 22 nt, Human
aucaagcagugaaaaaugcuag

SEQ ID NO: 205965 - RNA, 22 nt, Human
gggcucuguggaugugagagcu

SEQ ID NO: 205966 - RNA, 22 nt, Human
uccuguuucaacccuuacacug

SEQ ID NO: 205967 - RNA, 21 nt, Human
caaaagagacugauucuugga

SEQ ID NO: 205968 - RNA, 22 nt, Human
aaauguuucuacuugugagcau

SEQ ID NO: 205969 - RNA, 22 nt, Human
auaguugguccaugaaaaaagu

SEQ ID NO: 205970 - RNA, 22 nt, Human
gcauucuuuccacgaggaggua

SEQ ID NO: 205971 - RNA, 22 nt, Human
auauaucaugaguaaaacuuga

SEQ ID NO: 205972 - RNA, 22 nt, Human
uuauuguagcacuuuggcagug

SEQ ID NO: 205973 - RNA, 22 nt, Human
cagggcuggcucaugaaaaguu

SEQ ID NO: 205974 - RNA, 22 nt, Human
ucagguguauugaugucuguga

SEQ ID NO: 205975 - RNA, 22 nt, Human
cugaggagaacaaugagaucaa

SEQ ID NO: 205976 - RNA, 22 nt, Human
acaaaugagaauguagacagag

SEQ ID NO: 205977 - RNA, 22 nt, Human
cugcuguguuucacaccucugg

SEQ ID NO: 205978 - RNA, 22 nt, Human
ggugaaauguagucuugugaga

SEQ ID NO: 205979 - RNA, 22 nt, Human
cagaagaggacuggguagcuca

SEQ ID NO: 205980 - RNA, 22 nt, Human
cccauggcaauaaggucacagg

SEQ ID NO: 205981 - RNA, 22 nt, Human
ugcuuuauucaggguuuacccc

SEQ ID NO: 205982 - RNA, 19 nt, Human
gcaggacucccagcuccuc

SEQ ID NO: 205983 - RNA, 22 nt, Human
ccauuuguaccauuucuuugua

SEQ ID NO: 205984 - RNA, 22 nt, Human
uucugagaaugcuucuggaauc

SEQ ID NO: 205985 - RNA, 22 nt, Human
uuaguuaaaauucugcugacau

SEQ ID NO: 205986 - RNA, 22 nt, Human
agcuuuaugcuuccuacaagcu

SEQ ID NO: 205987 - RNA, 22 nt, Human
agcugcagaucaauaggcucac

SEQ ID NO: 205988 - RNA, 17 nt, Human
agacacugagccaagua

SEQ ID NO: 205989 - RNA, 22 nt, Human
ucacuccucauugcugcccauu

SEQ ID NO: 205990 - RNA, 22 nt, Human
agcugugugcccaugguggagg

SEQ ID NO: 205991 - RNA, 22 nt, Human
ggccucugguucguggugaccu

SEQ ID NO: 205992 - RNA, 22 nt, Human
ugagaagcugcuugugcuguau

SEQ ID NO: 205993 - RNA, 22 nt, Human
uuucucaaggugucauguauuu

SEQ ID NO: 205994 - RNA, 22 nt, Human
uauuuaaaauaagccccagugg

SEQ ID NO: 205995 - RNA, 22 nt, Human
ggcucccugccuguccucaguc

SEQ ID NO: 205996 - RNA, 22 nt, Human
uacuucaaacaaugguacaaac

SEQ ID NO: 205997 - RNA, 22 nt, Human
ucuggcugcugcgugagugcuu

SEQ ID NO: 205998 - RNA, 22 nt, Human
acauggcacccagaucucaaaa

SEQ ID NO: 205999 - RNA, 22 nt, Human
uuuugcuguuauaugcuauuau

SEQ ID NO: 206000 - RNA, 22 nt, Human
uuuuaugugugaaaugcugucu

SEQ ID NO: 206001 - RNA, 22 nt, Human
agacccuugcagucugguuguc

SEQ ID NO: 206002 - RNA, 22 nt, Human
ucuucagacuguuguucuuuug

SEQ ID NO: 206003 - RNA, 18 nt, Human
uguagagccagguuugcc

SEQ ID NO: 206004 - RNA, 22 nt, Human
aggcuuagaaauucagcugagu

SEQ ID NO: 206005 - RNA, 22 nt, Human
aagcugucagugucaggcuaaa

SEQ ID NO: 206006 - RNA, 22 nt, Human
uuguggcagaccaugagucuaa

SEQ ID NO: 206007 - RNA, 22 nt, Human
uucaggauucuuucagacuggg

SEQ ID NO: 206008 - RNA, 22 nt, Human
ugaaugauacagaauuauguag

SEQ ID NO: 206009 - RNA, 21 nt, Human
accaguuuggggggcuuccug

SEQ ID NO: 206010 - RNA, 20 nt, Human
cagcacagagcuuggcucua

SEQ ID NO: 206011 - RNA, 22 nt, Human
ccugucaguugcugucagggau

SEQ ID NO: 206012 - RNA, 22 nt, Human
cuggcuucugggccagggcaga

SEQ ID NO: 206013 - RNA, 22 nt, Human
uccuucuuucaccucauaguca

SEQ ID NO: 206014 - RNA, 22 nt, Human
gccaggucuggguagcagagga

SEQ ID NO: 206015 - RNA, 22 nt, Human
uggagggaacaaaggaguccca

SEQ ID NO: 206016 - RNA, 22 nt, Human
aggagccaaauuuuagacucug

SEQ ID NO: 206017 - RNA, 22 nt, Human
caggcagaguuagugauuuagg

SEQ ID NO: 206018 - RNA, 22 nt, Human
gccaugcuugguaugcugugag

SEQ ID NO: 206019 - RNA, 22 nt, Human
uguuugcuuacuuguaugcugc

SEQ ID NO: 206020 - RNA, 22 nt, Human
gucagccugcacucagggagcg

SEQ ID NO: 206021 - RNA, 21 nt, Human
uggcucaguugcugggcacag

SEQ ID NO: 206022 - RNA, 22 nt, Human
cuggacccuguuucccuagguc

SEQ ID NO: 206023 - RNA, 22 nt, Human
augccccagugugugcuuccuu

SEQ ID NO: 206024 - RNA, 22 nt, Human
ggcaggcagaggcugagacagg

SEQ ID NO: 206025 - RNA, 22 nt, Human
uucauucauguauugucuaugg

SEQ ID NO: 206026 - RNA, 22 nt, Human
ucacagaaguugaauuugcaug

SEQ ID NO: 206027 - RNA, 19 nt, Human
ccuguucuuggcugaggcu

SEQ ID NO: 206028 - RNA, 22 nt, Human
aaugucaaacagagcagagcua

SEQ ID NO: 206029 - RNA, 22 nt, Human
aguggcagggcuggcugcugca

SEQ ID NO: 206030 - RNA, 22 nt, Human
gaaaagagaacaucugaggauc

SEQ ID NO: 206031 - RNA, 22 nt, Human
aguggcaguaacauuccacaau

SEQ ID NO: 206032 - RNA, 22 nt, Human
uccacaucucucgccaaccaau

SEQ ID NO: 206033 - RNA, 22 nt, Human
auuuaagacugacuucaccagu

SEQ ID NO: 206034 - RNA, 22 nt, Human
gcggcaggaagagcgcagcccc

SEQ ID NO: 206035 - RNA, 22 nt, Human
caggaaugacugcagauggggc

SEQ ID NO: 206036 - RNA, 22 nt, Human
aucucugcaucccucaagguug

SEQ ID NO: 206037 - RNA, 22 nt, Human
cgcaggugaacuguucugcagu

SEQ ID NO: 206038 - RNA, 23 nt, Human
cuguccuguaguucacguuggcc

SEQ ID NO: 206039 - RNA, 22 nt, Human
cccaggaguuugaguucagcau

SEQ ID NO: 206040 - RNA, 20 nt, Human
uuucaguuaucuugaccuuc

SEQ ID NO: 206041 - RNA, 22 nt, Human
gcacaauaauuuuuuuaagagg

SEQ ID NO: 206042 - RNA, 22 nt, Human
ccugugggcuugaguguagggu

SEQ ID NO: 206043 - RNA, 22 nt, Human
uaguuugcgaaauuccugccuc

SEQ ID NO: 206044 - RNA, 22 nt, Human
caguaacagugaucaccugugg

SEQ ID NO: 206045 - RNA, 22 nt, Human
gcagaagcugggcagcgaggug

SEQ ID NO: 206046 - RNA, 17 nt, Human
uucagaagcauuuuggc

SEQ ID NO: 206047 - RNA, 22 nt, Human
uugcccugaagaacgucccaga

SEQ ID NO: 206048 - RNA, 22 nt, Human
auugugauuagagaauauagag

SEQ ID NO: 206049 - RNA, 22 nt, Human
aaaagaguguuucaacuuuggc

SEQ ID NO: 206050 - RNA, 22 nt, Human
agacagaccauggcuauucaga

SEQ ID NO: 206051 - RNA, 22 nt, Human
uuauacacaauucuuuuacuac

SEQ ID NO: 206052 - RNA, 22 nt, Human
acucucugucuaaaugcaguuu

SEQ ID NO: 206053 - RNA, 22 nt, Human
uucagaaauaaaauaucccaac

SEQ ID NO: 206054 - RNA, 22 nt, Human
ucaggugggcguuccggugcgg

SEQ ID NO: 206055 - RNA, 22 nt, Human
uacaaagucacauugaaaugaa

SEQ ID NO: 206056 - RNA, 22 nt, Human
gaaaaggccuccccauaggaau

SEQ ID NO: 206057 - RNA, 22 nt, Human
ugaguuauauauacuggcucug

SEQ ID NO: 206058 - RNA, 22 nt, Human
gggccacuucuagugccucaga

SEQ ID NO: 206059 - RNA, 22 nt, Human
gcaggggaguccacucuaugca

SEQ ID NO: 206060 - RNA, 22 nt, Human
auaaaaguuuccaaucaugccu

SEQ ID NO: 206061 - RNA, 22 nt, Human
gccugagcuuuaauuuucuugu

SEQ ID NO: 206062 - RNA, 23 nt, Human
gagaaaccucgguaagcaggagg

SEQ ID NO: 206063 - RNA, 22 nt, Human
aaaauguguuuaugcauuucgu

SEQ ID NO: 206064 - RNA, 22 nt, Human
acugugcacaauucuaaguccu

SEQ ID NO: 206065 - RNA, 22 nt, Human
ugacagagagguaaguuaugaa

SEQ ID NO: 206066 - RNA, 20 nt, Human
ugcagcugguuucacaggga

SEQ ID NO: 206067 - RNA, 22 nt, Human
uggcuuccagagcugcuccacc

SEQ ID NO: 206068 - RNA, 22 nt, Human
ugucuccaacucacuguauacu

SEQ ID NO: 206069 - RNA, 22 nt, Human
cucucugggggccaugccaaga

SEQ ID NO: 206070 - RNA, 22 nt, Human
auuuuuaugacaaaccauccuc

SEQ ID NO: 206071 - RNA, 21 nt, Human
agccaggcaagcacccccacu

SEQ ID NO: 206072 - RNA, 22 nt, Human
gcucccucugcucaggcacuug

SEQ ID NO: 206073 - RNA, 23 nt, Human
acagacaacacugaugagagaaa

SEQ ID NO: 206074 - RNA, 22 nt, Human
ucacagagaaaagcuaucacaa

SEQ ID NO: 206075 - RNA, 22 nt, Human
uugggcuuuaauuccagagagg

SEQ ID NO: 206076 - RNA, 22 nt, Human
cagagccaucccagccuguggu

SEQ ID NO: 206077 - RNA, 22 nt, Human
cuuagcuucucugcaucugugu

SEQ ID NO: 206078 - RNA, 22 nt, Human
uagaaccucauaagaaucgaaa

SEQ ID NO: 206079 - RNA, 20 nt, Human
ccagagcugauggcugcccg

SEQ ID NO: 206080 - RNA, 19 nt, Human
ugugauaguugaaccugcc

SEQ ID NO: 206081 - RNA, 22 nt, Human
ugaaggcagugaguuuguguuu

SEQ ID NO: 206082 - RNA, 22 nt, Human
caguucuggaggcuccacaucu

SEQ ID NO: 206083 - RNA, 22 nt, Human
ggcaggugaucuagagucaaua

SEQ ID NO: 206084 - RNA, 22 nt, Human
ucaggccugcaaggagaguccc

SEQ ID NO: 206085 - RNA, 22 nt, Human
uggucgaccaguuggaaaguaa

SEQ ID NO: 206086 - RNA, 22 nt, Human
aaugcuuauaccuaaugaucuu

SEQ ID NO: 206087 - RNA, 22 nt, Human
gucugcuguucagagauguugc

SEQ ID NO: 206088 - RNA, 22 nt, Human
cacagaacauccuuagcucaug

SEQ ID NO: 206089 - RNA, 23 nt, Human
aaauaccugaauuagauauuauc

SEQ ID NO: 206090 - RNA, 22 nt, Human
cuggucuguccgcaggucaccu

SEQ ID NO: 206091 - RNA, 22 nt, Human
acucuggcaagcuuccacuucc

SEQ ID NO: 206092 - RNA, 22 nt, Human
uacaugaauguuucaauauugu

SEQ ID NO: 206093 - RNA, 23 nt, Human
cuggccuccgacacuggccaaga

SEQ ID NO: 206094 - RNA, 22 nt, Human
aguggcuggagccccaggcugg

SEQ ID NO: 206095 - RNA, 23 nt, Human
acugauuaacaugugugauauuc

SEQ ID NO: 206096 - RNA, 22 nt, Human
ccagccuuacugcccuucagug

SEQ ID NO: 206097 - RNA, 22 nt, Human
uuggaaaaugaggcacagagag

SEQ ID NO: 206098 - RNA, 22 nt, Human
uaccugaauuaccaaaagcuuu

SEQ ID NO: 206099 - RNA, 22 nt, Human
uacaggagcacaaaagaguuga

SEQ ID NO: 206100 - RNA, 22 nt, Human
caggaguguuugcuacaguuuc

SEQ ID NO: 206101 - RNA, 22 nt, Human
aguguauuaguuguccagcagu

SEQ ID NO: 206102 - RNA, 20 nt, Human
agguuccagccacaaccagc

SEQ ID NO: 206103 - RNA, 22 nt, Human
gggagccuugggagugccagcc

SEQ ID NO: 206104 - RNA, 22 nt, Human
cuuauuuugcugaugacccagg

SEQ ID NO: 206105 - RNA, 21 nt, Human
agcagaggcagaauguaugca

SEQ ID NO: 206106 - RNA, 22 nt, Human
cauguuaacuaagauuaacuau

SEQ ID NO: 206107 - RNA, 22 nt, Human
uuccuauagaaagcuguguaga

SEQ ID NO: 206108 - RNA, 22 nt, Human
uggaaaggacaguugcugauag

SEQ ID NO: 206109 - RNA, 22 nt, Human
ucucaggcacugggugccaacu

SEQ ID NO: 206110 - RNA, 19 nt, Human
uuuggacagaguguccagg

SEQ ID NO: 206111 - RNA, 22 nt, Human
gggcuucuugagcugccggccc

SEQ ID NO: 206112 - RNA, 20 nt, Human
caaaugaagcuguuggccuc

SEQ ID NO: 206113 - RNA, 22 nt, Human
ugcaggugugguuccucagcca

SEQ ID NO: 206114 - RNA, 22 nt, Human
aggcagcauuugaauccagguc

SEQ ID NO: 206115 - RNA, 22 nt, Human
guccaggccugccucugaggag

SEQ ID NO: 206116 - RNA, 20 nt, Human
ucacagaaugccugaagaag

SEQ ID NO: 206117 - RNA, 22 nt, Human
uaacuugguuggugggcaggag

SEQ ID NO: 206118 - RNA, 22 nt, Human
uuauuuguaaagguccauagua

SEQ ID NO: 206119 - RNA, 22 nt, Human
agaugaaaauacgugacuuuaa

SEQ ID NO: 206120 - RNA, 22 nt, Human
ugauuguuuuaguucccugaug

SEQ ID NO: 206121 - RNA, 22 nt, Human
uuagaaaggaaucuucauuuca

SEQ ID NO: 206122 - RNA, 22 nt, Human
uucucugaaggccaugcucacu

SEQ ID NO: 206123 - RNA, 22 nt, Human
uuacagugacaguugcuaugau

SEQ ID NO: 206124 - RNA, 22 nt, Human
ugaaacagaguggauacaguga

SEQ ID NO: 206125 - RNA, 19 nt, Human
uggucccauacugcuggcc

SEQ ID NO: 206126 - RNA, 22 nt, Human
agcccagagacaaugcucagua

SEQ ID NO: 206127 - RNA, 22 nt, Human
aggaccaguaugagagcaucug

SEQ ID NO: 206128 - RNA, 22 nt, Human
acucaggcacucagcccucgcc

SEQ ID NO: 206129 - RNA, 22 nt, Human
cuggcccagucucagaguguca

SEQ ID NO: 206130 - RNA, 20 nt, Human
acaacaaacuugcuuaagga

SEQ ID NO: 206131 - RNA, 20 nt, Human
uaugugauuuucucaucaau

SEQ ID NO: 206132 - RNA, 19 nt, Human
ugcagaagacacaguggug

SEQ ID NO: 206133 - RNA, 21 nt, Human
gcagaugggagucaucaggcu

SEQ ID NO: 206134 - RNA, 20 nt, Human
guuuuucuugggcgagcuau

SEQ ID NO: 206135 - RNA, 22 nt, Human
guguccucuuauugcucuuggc

SEQ ID NO: 206136 - RNA, 22 nt, Human
cuuuggaaaagcauaccaagga

SEQ ID NO: 206137 - RNA, 22 nt, Human
uugcaauuaguuacaaaagugg

SEQ ID NO: 206138 - RNA, 22 nt, Human
ccucuguguccuggucauugaa

SEQ ID NO: 206139 - RNA, 22 nt, Human
agaaacaucgcuuaguccucau

SEQ ID NO: 206140 - RNA, 22 nt, Human
uguacacaaccuacagucugcu

SEQ ID NO: 206141 - RNA, 22 nt, Human
gccugccuguuggcugaggugc

SEQ ID NO: 206142 - RNA, 17 nt, Human
aguuuugauauaauggc

SEQ ID NO: 206143 - RNA, 22 nt, Human
uagcuuuccuuguugccugugc

SEQ ID NO: 206144 - RNA, 22 nt, Human
agugcauucugucaucuugguu

SEQ ID NO: 206145 - RNA, 22 nt, Human
ucucagucuuugcaaggaugcu

SEQ ID NO: 206146 - RNA, 22 nt, Human
ugcagggcccucauuccugucc

SEQ ID NO: 206147 - RNA, 22 nt, Human
uucuccucuguuggccuucccu

SEQ ID NO: 206148 - RNA, 21 nt, Human
ucuuuuccuuucugugugcaa

SEQ ID NO: 206149 - RNA, 22 nt, Human
ccagcccuucccaacuggccag

SEQ ID NO: 206150 - RNA, 22 nt, Human
uccaggagagguguggggacug

SEQ ID NO: 206151 - RNA, 22 nt, Human
cucucccagucaggcucaggau

SEQ ID NO: 206152 - RNA, 22 nt, Human
ggagcuggcuacagagaacucc

SEQ ID NO: 206153 - RNA, 22 nt, Human
ugucagguugguuuucagagaa

SEQ ID NO: 206154 - RNA, 22 nt, Human
ucaggcuugcgauggaagucac

SEQ ID NO: 206155 - RNA, 22 nt, Human
aauaauuacccaucuuuuugua

SEQ ID NO: 206156 - RNA, 22 nt, Human
cuucagcucuugguaaauguuu

SEQ ID NO: 206157 - RNA, 22 nt, Human
cucuuagaaagaaacacacugg

SEQ ID NO: 206158 - RNA, 22 nt, Human
cauccacuagaaugacagaguu

SEQ ID NO: 206159 - RNA, 22 nt, Human
agcaccaggaaagaaggggcca

SEQ ID NO: 206160 - RNA, 22 nt, Human
ccaggaaguaugacccaacaga

SEQ ID NO: 206161 - RNA, 22 nt, Human
aaagaacuuauccuagaauuug

SEQ ID NO: 206162 - RNA, 18 nt, Human
gugccaggaggcgcagcc

SEQ ID NO: 206163 - RNA, 22 nt, Human
ugccuggcccugacagcccugg

SEQ ID NO: 206164 - RNA, 22 nt, Human
uuagaagugguaaguagaaaga

SEQ ID NO: 206165 - RNA, 22 nt, Human
uagcuuuaagacauggugaaug

SEQ ID NO: 206166 - RNA, 22 nt, Human
aacagaaaucauuuagggcucu

SEQ ID NO: 206167 - RNA, 22 nt, Human
cuccuggcuaugacuacauuuc

SEQ ID NO: 206168 - RNA, 22 nt, Human
caaagaagagauuuacagagcu

SEQ ID NO: 206169 - RNA, 22 nt, Human
caggauggccccggggcugugc

SEQ ID NO: 206170 - RNA, 22 nt, Human
ccaguccugugugacccugcac

SEQ ID NO: 206171 - RNA, 22 nt, Human
cuuuguugugccugagugcacc

SEQ ID NO: 206172 - RNA, 22 nt, Human
caggcacaguguugcuguucaa

SEQ ID NO: 206173 - RNA, 22 nt, Human
aguucaggcauaaggcaugaac

SEQ ID NO: 206174 - RNA, 22 nt, Human
aagcuacaauguguuuuugaaa

SEQ ID NO: 206175 - RNA, 22 nt, Human
uuccuguguacguguuucgcug

SEQ ID NO: 206176 - RNA, 22 nt, Human
uuaggcugggcuacaacaacug

SEQ ID NO: 206177 - RNA, 23 nt, Human
ucuuuuuaagagaucuagugacg

SEQ ID NO: 206178 - RNA, 22 nt, Human
aacuuucuuggaugucucaaca

SEQ ID NO: 206179 - RNA, 22 nt, Human
uaucuagauaguuuagccaucu

SEQ ID NO: 206180 - RNA, 19 nt, Human
ccugugcuaggagcugacc

SEQ ID NO: 206181 - RNA, 22 nt, Human
uccugccuucauacugcuguau

SEQ ID NO: 206182 - RNA, 23 nt, Human
aagguguucuguauuuaacucag

SEQ ID NO: 206183 - RNA, 22 nt, Human
acugcagguggauggcacuuua

SEQ ID NO: 206184 - RNA, 22 nt, Human
uaacacauaagcugagaccaug

SEQ ID NO: 206185 - RNA, 22 nt, Human
guucugggaagguggaccuguu

SEQ ID NO: 206186 - RNA, 22 nt, Human
agcuguggcagcagccguggca

SEQ ID NO: 206187 - RNA, 22 nt, Human
ucugugcagucagggcucaguc

SEQ ID NO: 206188 - RNA, 22 nt, Human
ucccaggcagcuucuuucauca

SEQ ID NO: 206189 - RNA, 20 nt, Human
agccuggcaaacacccccag

SEQ ID NO: 206190 - RNA, 22 nt, Human
ugaaaaacugaauaguugagua

SEQ ID NO: 206191 - RNA, 22 nt, Human
aacuucugggcuguccaaaacu

SEQ ID NO: 206192 - RNA, 22 nt, Human
ucugaggggguguuuauaagcu

SEQ ID NO: 206193 - RNA, 22 nt, Human
ugauuuacacaccuaugauuua

SEQ ID NO: 206194 - RNA, 22 nt, Human
acaagaauguagauuaguuaag

SEQ ID NO: 206195 - RNA, 22 nt, Human
cacugggcuuuguaguuagcau

SEQ ID NO: 206196 - RNA, 22 nt, Human
uguggcagcugcugcaggagcu

SEQ ID NO: 206197 - RNA, 22 nt, Human
acuuuccuagacuucagugaca

SEQ ID NO: 206198 - RNA, 14 nt, Human
gcaggcagaucacc

SEQ ID NO: 206199 - RNA, 22 nt, Human
ccugccucccagagguccucua

SEQ ID NO: 206200 - RNA, 22 nt, Human
aaagcugggggcccuggucuag

SEQ ID NO: 206201 - RNA, 22 nt, Human
uuuuaagaaauguaugacuguc

SEQ ID NO: 206202 - RNA, 22 nt, Human
uggucccuaaagaugucuacau

SEQ ID NO: 206203 - RNA, 22 nt, Human
gaagaagacauggaacaauagu

SEQ ID NO: 206204 - RNA, 22 nt, Human
auucaugugccacuggugaaca

SEQ ID NO: 206205 - RNA, 18 nt, Human
ggguccuguucuuggaag

SEQ ID NO: 206206 - RNA, 22 nt, Human
auuugcuuucagguauaaaagg

SEQ ID NO: 206207 - RNA, 22 nt, Human
auagcaauuugcccaauuaccu

SEQ ID NO: 206208 - RNA, 22 nt, Human
uauuuguauguguguacauaua

SEQ ID NO: 206209 - RNA, 22 nt, Human
ugcuggcuccaaccuggcaucu

SEQ ID NO: 206210 - RNA, 22 nt, Human
auugacaaaucugaacauacgg

SEQ ID NO: 206211 - RNA, 22 nt, Human
uguccucacaggaaugaacuuu

SEQ ID NO: 206212 - RNA, 22 nt, Human
agaucagacuuugugacuagga

SEQ ID NO: 206213 - RNA, 22 nt, Human
ucugggcuuuacacugugcuua

SEQ ID NO: 206214 - RNA, 22 nt, Human
auguggaucuguuauucuagau

SEQ ID NO: 206215 - RNA, 22 nt, Human
uccagggacaguauagaggauc

SEQ ID NO: 206216 - RNA, 22 nt, Human
ccucaugguacuuacuguagcu

SEQ ID NO: 206217 - RNA, 22 nt, Human
uaacacugguauuucauuuagu

SEQ ID NO: 206218 - RNA, 22 nt, Human
gcugguggcagagacaucaggu

SEQ ID NO: 206219 - RNA, 19 nt, Human
cugagccucaguuuccuag

SEQ ID NO: 206220 - RNA, 22 nt, Human
gccuggcugcugguucugagga

SEQ ID NO: 206221 - RNA, 22 nt, Human
acuguucaagcaaaugacauug

SEQ ID NO: 206222 - RNA, 22 nt, Human
uuucaaacugcccagcacaccu

SEQ ID NO: 206223 - RNA, 22 nt, Human
cuggaucuaaagguggauguag

SEQ ID NO: 206224 - RNA, 19 nt, Human
uucacauuuuuguggcacu

SEQ ID NO: 206225 - RNA, 22 nt, Human
uaaauguuaugcccaucaucca

SEQ ID NO: 206226 - RNA, 19 nt, Human
ucucuggaugacagacacu

SEQ ID NO: 206227 - RNA, 21 nt, Human
uauacaugugugcauacgugu

SEQ ID NO: 206228 - RNA, 22 nt, Human
augucagauccucagaaagucu

SEQ ID NO: 206229 - RNA, 22 nt, Human
aaacucaagucuaugaacaagg

SEQ ID NO: 206230 - RNA, 22 nt, Human
aauaagauuacugguugucuga

SEQ ID NO: 206231 - RNA, 22 nt, Human
gccugagaaggauaggaagcga

SEQ ID NO: 206232 - RNA, 22 nt, Human
gaagccacagagauuguggggg

SEQ ID NO: 206233 - RNA, 22 nt, Human
aguaaaaucaccaucucuuugu

SEQ ID NO: 206234 - RNA, 22 nt, Human
aaucgcuugguaauuuuaaaag

SEQ ID NO: 206235 - RNA, 22 nt, Human
cuuacagugaucaacacaaaga

SEQ ID NO: 206236 - RNA, 22 nt, Human
auuaauuuccaggcacugugcu

SEQ ID NO: 206237 - RNA, 22 nt, Human
aaggccaggucccugcagugca

SEQ ID NO: 206238 - RNA, 22 nt, Human
ggaaagaaagugugaacaacuu

SEQ ID NO: 206239 - RNA, 22 nt, Human
agucuccacaacagcccugaua

SEQ ID NO: 206240 - RNA, 21 nt, Human
agauggcucccaggucucugg

SEQ ID NO: 206241 - RNA, 22 nt, Human
cuucuucaagagaaugggagac

SEQ ID NO: 206242 - RNA, 22 nt, Human
accagcucuggacaggcauuuc

SEQ ID NO: 206243 - RNA, 21 nt, Human
ucucaggcgagaauucuuuua

SEQ ID NO: 206244 - RNA, 22 nt, Human
aaagccaucugcugguucgcau

SEQ ID NO: 206245 - RNA, 22 nt, Human
augguuuauugcuuuaaugaaa

SEQ ID NO: 206246 - RNA, 22 nt, Human
cugccagggcauccuguggugg

SEQ ID NO: 206247 - RNA, 22 nt, Human
accugggaagaucuuugaagcu

SEQ ID NO: 206248 - RNA, 22 nt, Human
ggcaggaggaagaguuagcacc

SEQ ID NO: 206249 - RNA, 22 nt, Human
aagcaggcgagggccuggagca

SEQ ID NO: 206250 - RNA, 22 nt, Human
aaguagugugcuccagcgguga

SEQ ID NO: 206251 - RNA, 22 nt, Human
uuuuauaaagagagucaguugg

SEQ ID NO: 206252 - RNA, 22 nt, Human
ugucugggagggacagggcuac

SEQ ID NO: 206253 - RNA, 22 nt, Human
aguguucuuguuucuaagcaaa

SEQ ID NO: 206254 - RNA, 22 nt, Human
cucuuuggccagaaaauguuuu

SEQ ID NO: 206255 - RNA, 22 nt, Human
cuucuucagcacaauauugaug

SEQ ID NO: 206256 - RNA, 22 nt, Human
uuucucaaccucaacacuauuu

SEQ ID NO: 206257 - RNA, 22 nt, Human
uuuccagugaauuagucuguuu

SEQ ID NO: 206258 - RNA, 16 nt, Human
acagugucucaagcac

SEQ ID NO: 206259 - RNA, 22 nt, Human
guguccugcacagcaccuugca

SEQ ID NO: 206260 - RNA, 22 nt, Human
ccagggcagccaacccagaugc

SEQ ID NO: 206261 - RNA, 19 nt, Human
cagucccaaauucuuguca

SEQ ID NO: 206262 - RNA, 22 nt, Human
ucacacauucuagguauguuga

SEQ ID NO: 206263 - RNA, 22 nt, Human
gcacccaggccggcgacugcag

SEQ ID NO: 206264 - RNA, 22 nt, Human
caaagcugacgaggucagcauc

SEQ ID NO: 206265 - RNA, 22 nt, Human
augcaauauagggaagauagau

SEQ ID NO: 206266 - RNA, 22 nt, Human
agucugucagucauucuaacaa

SEQ ID NO: 206267 - RNA, 22 nt, Human
uucuggaaagcauuugaggccc

SEQ ID NO: 206268 - RNA, 22 nt, Human
ucuguauauauuaaugaaauuc

SEQ ID NO: 206269 - RNA, 22 nt, Human
caugugugugagggaaacaugu

SEQ ID NO: 206270 - RNA, 21 nt, Human
uucuggguuguuaaucugaac

SEQ ID NO: 206271 - RNA, 22 nt, Human
aucauguguaauuucaagcuac

SEQ ID NO: 206272 - RNA, 22 nt, Human
auugaugagcauuacucucuaa

SEQ ID NO: 206273 - RNA, 22 nt, Human
aacuguuggaggauuauuuugc

SEQ ID NO: 206274 - RNA, 22 nt, Human
gugcacaaucuucauauggcgu

SEQ ID NO: 206275 - RNA, 22 nt, Human
ucugagaauggagcuaaaaauc

SEQ ID NO: 206276 - RNA, 22 nt, Human
cccacacacuggcugcugccaa

SEQ ID NO: 206277 - RNA, 22 nt, Human
uggcaggagacacauggcauag

SEQ ID NO: 206278 - RNA, 22 nt, Human
ucccagcaagaaaggggguggc

SEQ ID NO: 206279 - RNA, 22 nt, Human
cccaggagagggaaccaaaugu

SEQ ID NO: 206280 - RNA, 22 nt, Human
gggcccugggauucagagcaag

SEQ ID NO: 206281 - RNA, 22 nt, Human
gcugcuccgucugagcucuggu

SEQ ID NO: 206282 - RNA, 22 nt, Human
uguacauuuagagcucaauaga

SEQ ID NO: 206283 - RNA, 22 nt, Human
aagaauaagaggauuuagaaca

SEQ ID NO: 206284 - RNA, 22 nt, Human
ccucaggcugucuuccuucugg

SEQ ID NO: 206285 - RNA, 22 nt, Human
uuucuaaggaaaguaccuggga

SEQ ID NO: 206286 - RNA, 22 nt, Human
ugcccagcagggagcuaccugg

SEQ ID NO: 206287 - RNA, 22 nt, Human
aagaugcacaauguggcaauua

SEQ ID NO: 206288 - RNA, 22 nt, Human
gcaaauaauauacuuugaucuc

SEQ ID NO: 206289 - RNA, 22 nt, Human
uuuuauucauagggauggagag

SEQ ID NO: 206290 - RNA, 22 nt, Human
gaaguggggaagcaacaggaga

SEQ ID NO: 206291 - RNA, 22 nt, Human
gcugggucucucccugguccug

SEQ ID NO: 206292 - RNA, 22 nt, Human
gguaggaguauuuugcagcagu

SEQ ID NO: 206293 - RNA, 22 nt, Human
gggaagccaugcucagagguac

SEQ ID NO: 206294 - RNA, 22 nt, Human
uaguccagccuuggguguagcc

SEQ ID NO: 206295 - RNA, 22 nt, Human
gaauacauguuguuucccugga

SEQ ID NO: 206296 - RNA, 20 nt, Human
cugcuugggacacugccaga

SEQ ID NO: 206297 - RNA, 22 nt, Human
gccuggcugagguggggaggca

SEQ ID NO: 206298 - RNA, 22 nt, Human
uuuauauguuuguacaauuaag

SEQ ID NO: 206299 - RNA, 22 nt, Human
ccaggugucuguggccagcccu

SEQ ID NO: 206300 - RNA, 19 nt, Human
acuggcagcuguagucugu

SEQ ID NO: 206301 - RNA, 22 nt, Human
caccagcuccaccagggcaggu

SEQ ID NO: 206302 - RNA, 20 nt, Human
ucccaaaauucuacuuuauc

SEQ ID NO: 206303 - RNA, 22 nt, Human
ccaacaguccagaugagauggu

SEQ ID NO: 206304 - RNA, 22 nt, Human
agcagccuugcaggggucgcac

SEQ ID NO: 206305 - RNA, 22 nt, Human
ugcagggccuucuagaccaugg

SEQ ID NO: 206306 - RNA, 22 nt, Human
ucagagaauucucagaugacuc

SEQ ID NO: 206307 - RNA, 22 nt, Human
caguaaguauucgagucuccau

SEQ ID NO: 206308 - RNA, 22 nt, Human
gaggcuccucauucaguaugcu

SEQ ID NO: 206309 - RNA, 22 nt, Human
agcuccugcccaggaaggcucu

SEQ ID NO: 206310 - RNA, 22 nt, Human
ugucagcauuuaaggaguaagg

SEQ ID NO: 206311 - RNA, 22 nt, Human
cauauauuauggacugcagaau

SEQ ID NO: 206312 - RNA, 22 nt, Human
ucugcaggauggaugcucagaa

SEQ ID NO: 206313 - RNA, 22 nt, Human
ugagacaguaucgccccaaggc

SEQ ID NO: 206314 - RNA, 22 nt, Human
auuuccauuuucagccauuacu

SEQ ID NO: 206315 - RNA, 22 nt, Human
auuuauauuuugggagcuccug

SEQ ID NO: 206316 - RNA, 22 nt, Human
agagccaggcaggcaauguuga

SEQ ID NO: 206317 - RNA, 22 nt, Human
aagaaguuaaauaaauggacca

SEQ ID NO: 206318 - RNA, 22 nt, Human
uguccauggauagagcugcucg

SEQ ID NO: 206319 - RNA, 22 nt, Human
cugcugcccuagacccaguccu

SEQ ID NO: 206320 - RNA, 22 nt, Human
aggcuuccucgugccuuagaua

SEQ ID NO: 206321 - RNA, 22 nt, Human
agacugaaauagugcacaccaa

SEQ ID NO: 206322 - RNA, 22 nt, Human
cucaaauauguggucagaaagc

SEQ ID NO: 206323 - RNA, 22 nt, Human
cccagaaggucgaggcugcagu

SEQ ID NO: 206324 - RNA, 22 nt, Human
uguaaagagaaggcuuauaaag

SEQ ID NO: 206325 - RNA, 19 nt, Human
aaucuagaaauauguguuc

SEQ ID NO: 206326 - RNA, 22 nt, Human
aggcugaugcuggcugaggcug

SEQ ID NO: 206327 - RNA, 22 nt, Human
uccagccuucucaaggcuggcu

SEQ ID NO: 206328 - RNA, 22 nt, Human
agaaaccucacagcaauucuga

SEQ ID NO: 206329 - RNA, 22 nt, Human
guccaguguguuuaucuuggau

SEQ ID NO: 206330 - RNA, 22 nt, Human
cugggcucaaauccuggcccug

SEQ ID NO: 206331 - RNA, 22 nt, Human
acagaugaggaagagucagcca

SEQ ID NO: 206332 - RNA, 22 nt, Human
caugacaaaucagaggggcuug

SEQ ID NO: 206333 - RNA, 22 nt, Human
acugugcaugaaccgaaacaaa

SEQ ID NO: 206334 - RNA, 22 nt, Human
aaaugcuugcaacaucccaggu

SEQ ID NO: 206335 - RNA, 22 nt, Human
uaaauacuuuuacuccacugau

SEQ ID NO: 206336 - RNA, 22 nt, Human
gaaccuuuuuccaaguaaacaa

SEQ ID NO: 206337 - RNA, 22 nt, Human
gggcuccugccuccuggcaccu

SEQ ID NO: 206338 - RNA, 18 nt, Human
agcaugagagaggcugug

SEQ ID NO: 206339 - RNA, 19 nt, Human
gaugcucauucagguggaa

SEQ ID NO: 206340 - RNA, 22 nt, Human
uaauaucuacuucauagaguuu

SEQ ID NO: 206341 - RNA, 22 nt, Human
aaggguugaagauaaauaaggu

SEQ ID NO: 206342 - RNA, 22 nt, Human
agucccuucucaaagugugcgg

SEQ ID NO: 206343 - RNA, 22 nt, Human
gugggugugauaagaccaaggg

SEQ ID NO: 206344 - RNA, 22 nt, Human
uggaaggccuguuguguccuag

SEQ ID NO: 206345 - RNA, 22 nt, Human
agguaugccaauuaggucaagu

SEQ ID NO: 206346 - RNA, 22 nt, Human
agagcacaggguuuugugccgg

SEQ ID NO: 206347 - RNA, 22 nt, Human
ucucuuaggagaaauucauaaa

SEQ ID NO: 206348 - RNA, 22 nt, Human
acugaaagauaaaucaguuagc

SEQ ID NO: 206349 - RNA, 22 nt, Human
ggccuagggaguggccaugccu

SEQ ID NO: 206350 - RNA, 22 nt, Human
gaaagugcuuuugagugugugc

SEQ ID NO: 206351 - RNA, 22 nt, Human
ucaaaauuucagcacuagcccu

SEQ ID NO: 206352 - RNA, 22 nt, Human
auuaaauguuccuuaaauuaua

SEQ ID NO: 206353 - RNA, 19 nt, Human
uucuuacaacacccuggga

SEQ ID NO: 206354 - RNA, 19 nt, Human
uaaguguuggugaauuucu

SEQ ID NO: 206355 - RNA, 22 nt, Human
aagaacaugaagucacaaaugc

SEQ ID NO: 206356 - RNA, 22 nt, Human
agagaugcugacguuuacauuu

SEQ ID NO: 206357 - RNA, 21 nt, Human
acauuacagggugaugugucu

SEQ ID NO: 206358 - RNA, 22 nt, Human
aacacuucucaucacugcaagc

SEQ ID NO: 206359 - RNA, 22 nt, Human
ugccuugcuuuggcggaggcug

SEQ ID NO: 206360 - RNA, 22 nt, Human
gagcccucuucccuagugaucg

SEQ ID NO: 206361 - RNA, 22 nt, Human
auuuacaguuuagcauuucaag

SEQ ID NO: 206362 - RNA, 22 nt, Human
uggcuucuuugugacagcucuu

SEQ ID NO: 206363 - RNA, 22 nt, Human
gcccagguuggagagcaguggc

SEQ ID NO: 206364 - RNA, 20 nt, Human
uacaggagugaguggguggg

SEQ ID NO: 206365 - RNA, 22 nt, Human
ucauagaaauaucacgucuuuu

SEQ ID NO: 206366 - RNA, 22 nt, Human
cugugugugcuacaggcuucca

SEQ ID NO: 206367 - RNA, 22 nt, Human
gacaggcuuugagucccagaac

SEQ ID NO: 206368 - RNA, 22 nt, Human
acuguggcucagggaaugcaug

SEQ ID NO: 206369 - RNA, 22 nt, Human
ucagaacagcucucagauaucc

SEQ ID NO: 206370 - RNA, 22 nt, Human
caaaagaagcucuuggggcuag

SEQ ID NO: 206371 - RNA, 22 nt, Human
ugaaauaacuuuugggugaguu

SEQ ID NO: 206372 - RNA, 22 nt, Human
uauugcauaaaaucagguuaga

SEQ ID NO: 206373 - RNA, 22 nt, Human
aggugcaucucguagcucuucu

SEQ ID NO: 206374 - RNA, 22 nt, Human
guguuuacagauaaagugagcu

SEQ ID NO: 206375 - RNA, 22 nt, Human
uggcuggcugucaguaggcugu

SEQ ID NO: 206376 - RNA, 22 nt, Human
gcugcccugugguccagcaggu

SEQ ID NO: 206377 - RNA, 22 nt, Human
cagggcaguaacgggaacaucu

SEQ ID NO: 206378 - RNA, 22 nt, Human
auaguacagcauuuuuccugag

SEQ ID NO: 206379 - RNA, 22 nt, Human
acacagcuagugaguggcagag

SEQ ID NO: 206380 - RNA, 22 nt, Human
aguccaggaaaauaagcuaggu

SEQ ID NO: 206381 - RNA, 22 nt, Human
uccagccccuccugagccaagc

SEQ ID NO: 206382 - RNA, 22 nt, Human
gugauaacucaggcagagaaua

SEQ ID NO: 206383 - RNA, 22 nt, Human
agcuagaauauugaucugaaau

SEQ ID NO: 206384 - RNA, 22 nt, Human
uccagaggcucugagggagagu

SEQ ID NO: 206385 - RNA, 22 nt, Human
aggcaggucuguaucuagucuc

SEQ ID NO: 206386 - RNA, 20 nt, Human
ucagagcugcaggagagaaa

SEQ ID NO: 206387 - RNA, 22 nt, Human
auuggaaaugcuacaaguuaga

SEQ ID NO: 206388 - RNA, 22 nt, Human
guugaguggguuaggaugcuga

SEQ ID NO: 206389 - RNA, 22 nt, Human
accugcaagcauuacacuucua

SEQ ID NO: 206390 - RNA, 22 nt, Human
cugggugaguauaggaaaggga

SEQ ID NO: 206391 - RNA, 22 nt, Human
ccagcuggcccagcugugcucc

SEQ ID NO: 206392 - RNA, 22 nt, Human
ucauugaagugacugaaagauu

SEQ ID NO: 206393 - RNA, 20 nt, Human
auacacauauucuugcaacu

SEQ ID NO: 206394 - RNA, 22 nt, Human
cucccucccuacgugagcucac

SEQ ID NO: 206395 - RNA, 22 nt, Human
aagacauuggcauugacuguaa

SEQ ID NO: 206396 - RNA, 22 nt, Human
accccagguccagguuacagag

SEQ ID NO: 206397 - RNA, 22 nt, Human
aggagaggcucuaacucugugu

SEQ ID NO: 206398 - RNA, 22 nt, Human
agaggcugaaugaugucaucau

SEQ ID NO: 206399 - RNA, 22 nt, Human
acucaggcuucaggcacagcug

SEQ ID NO: 206400 - RNA, 22 nt, Human
uggaggcauuugauguucauaa

SEQ ID NO: 206401 - RNA, 22 nt, Human
gaaagcacaguucaugagacaa

SEQ ID NO: 206402 - RNA, 22 nt, Human
auguacaagcuguuuuacugca

SEQ ID NO: 206403 - RNA, 22 nt, Human
ugcagggaauccagucuagggu

SEQ ID NO: 206404 - RNA, 19 nt, Human
uggagcagggcccuuguuu

SEQ ID NO: 206405 - RNA, 22 nt, Human
ccuagaacacaaccuauauuag

SEQ ID NO: 206406 - RNA, 22 nt, Human
acaguuuauguaaagcugccaa

SEQ ID NO: 206407 - RNA, 22 nt, Human
gagugcuugcauauuuauuguc

SEQ ID NO: 206408 - RNA, 22 nt, Human
uauaugcagauuuucaucaucg

SEQ ID NO: 206409 - RNA, 22 nt, Human
gggcagcugccagaggccaugg

SEQ ID NO: 206410 - RNA, 22 nt, Human
ggguccaggcguggcccagaug

SEQ ID NO: 206411 - RNA, 22 nt, Human
aagugauuugcaugcuuaauuc

SEQ ID NO: 206412 - RNA, 22 nt, Human
agagccuggcucccagcuaccg

SEQ ID NO: 206413 - RNA, 22 nt, Human
cuuauucaaugcuggaaauguu

SEQ ID NO: 206414 - RNA, 23 nt, Human
auugccagacggccccugcucgc

SEQ ID NO: 206415 - RNA, 22 nt, Human
agccaugucacauauggucauc

SEQ ID NO: 206416 - RNA, 22 nt, Human
ggcugcccucggggucgcaggc

SEQ ID NO: 206417 - RNA, 22 nt, Human
ccugcagaggucaggccagaaa

SEQ ID NO: 206418 - RNA, 22 nt, Human
uaacacaugguucugucaggaa

SEQ ID NO: 206419 - RNA, 22 nt, Human
gaaaggcuugcuuuugcucggu

SEQ ID NO: 206420 - RNA, 20 nt, Human
agggccuguugcaagcguuu

SEQ ID NO: 206421 - RNA, 22 nt, Human
cuuaaauucuuaaugcccucau

SEQ ID NO: 206422 - RNA, 22 nt, Human
aaauuaguacauugcaaagucc

SEQ ID NO: 206423 - RNA, 22 nt, Human
gaaagugccagaauaggaggcc

SEQ ID NO: 206424 - RNA, 22 nt, Human
uuuggcaagugggaaauuagua

SEQ ID NO: 206425 - RNA, 22 nt, Human
gaggaaaaugcaacaggaaugc

SEQ ID NO: 206426 - RNA, 22 nt, Human
gaaggcuuuuuggguaauugua

SEQ ID NO: 206427 - RNA, 21 nt, Human
agacuguggauuuugacaugu

SEQ ID NO: 206428 - RNA, 22 nt, Human
gccagagcugagugagguucuu

SEQ ID NO: 206429 - RNA, 22 nt, Human
acaugauuuuaguaucauaaua

SEQ ID NO: 206430 - RNA, 22 nt, Human
ucuuuucugccacagccugagc

SEQ ID NO: 206431 - RNA, 22 nt, Human
gaggcaggcacuguuaucagca

SEQ ID NO: 206432 - RNA, 22 nt, Human
gugugccaggaacuggcugcug

SEQ ID NO: 206433 - RNA, 22 nt, Human
uguagaaauuaguaagaucaac

SEQ ID NO: 206434 - RNA, 22 nt, Human
gcugagggaggcugaacugagu

SEQ ID NO: 206435 - RNA, 22 nt, Human
uccuaggccuggccugguggau

SEQ ID NO: 206436 - RNA, 22 nt, Human
aagcugaggauacaugaagccu

SEQ ID NO: 206437 - RNA, 16 nt, Human
uucagagcggcucaua

SEQ ID NO: 206438 - RNA, 22 nt, Human
aacagugauaucaagacagaca

SEQ ID NO: 206439 - RNA, 22 nt, Human
aucuuagagagucguguuuugu

SEQ ID NO: 206440 - RNA, 22 nt, Human
ggccuuugcguccacgccgcuu

SEQ ID NO: 206441 - RNA, 22 nt, Human
agguucaaaugcaagagaugcu

SEQ ID NO: 206442 - RNA, 22 nt, Human
ccuccaguacuccaguccagcg

SEQ ID NO: 206443 - RNA, 22 nt, Human
gaauacaagccugccaccugga

SEQ ID NO: 206444 - RNA, 22 nt, Human
ggcugcaggcagaggcugucug

SEQ ID NO: 206445 - RNA, 22 nt, Human
cagcagagaaauuaaacuucug

SEQ ID NO: 206446 - RNA, 22 nt, Human
uugcaaaugugaguuuagacug

SEQ ID NO: 206447 - RNA, 22 nt, Human
gcagagccccucaagccagccu

SEQ ID NO: 206448 - RNA, 22 nt, Human
uuugaaagaaaccagugaguga

SEQ ID NO: 206449 - RNA, 22 nt, Human
auuaaauacugcaggcuaagca

SEQ ID NO: 206450 - RNA, 21 nt, Human
ccagaagcugcuugcaggcua

SEQ ID NO: 206451 - RNA, 22 nt, Human
gcuuucuguagguaguuacugu

SEQ ID NO: 206452 - RNA, 23 nt, Human
aaucuagaaugaccuacucaucu

SEQ ID NO: 206453 - RNA, 22 nt, Human
cagcgcaggcgugugaaggcgc

SEQ ID NO: 206454 - RNA, 22 nt, Human
cggcuucucgggucggauuccg

SEQ ID NO: 206455 - RNA, 16 nt, Human
cccaaggagcuccagg

SEQ ID NO: 206456 - RNA, 20 nt, Human
cuggacuugcugcucaccug

SEQ ID NO: 206457 - RNA, 22 nt, Human
ugcugggcucaaccuccagagc

SEQ ID NO: 206458 - RNA, 22 nt, Human
ugcucaggucguucugccccuu

SEQ ID NO: 206459 - RNA, 22 nt, Human
uuuuagcacuaagugauaugcu

SEQ ID NO: 206460 - RNA, 22 nt, Human
uuuggacuuagccugcagaauu

SEQ ID NO: 206461 - RNA, 22 nt, Human
ucacagaacacaaaugccacuu

SEQ ID NO: 206462 - RNA, 19 nt, Human
ggccccucucacaggaguu

SEQ ID NO: 206463 - RNA, 22 nt, Human
caagagcugaggcuggagaggu

SEQ ID NO: 206464 - RNA, 22 nt, Human
gagccagguuggaggcugcagu

SEQ ID NO: 206465 - RNA, 22 nt, Human
aaagugauuuaaguaccucagg

SEQ ID NO: 206466 - RNA, 23 nt, Human
ucuauacauacugcagccucugg

SEQ ID NO: 206467 - RNA, 22 nt, Human
acauacauauguuuaaaugcau

SEQ ID NO: 206468 - RNA, 22 nt, Human
auggaguucuuuaaauucacag

SEQ ID NO: 206469 - RNA, 22 nt, Human
gccugggagggcagcagugugg

SEQ ID NO: 206470 - RNA, 22 nt, Human
uuagccuuagaagcuuagcaaa

SEQ ID NO: 206471 - RNA, 22 nt, Human
auucagcaguuccugcuucagu

SEQ ID NO: 206472 - RNA, 22 nt, Human
gcagagcugggauuuguacugg

SEQ ID NO: 206473 - RNA, 22 nt, Human
aagacagagggaagcaaugaug

SEQ ID NO: 206474 - RNA, 22 nt, Human
cacaucuacugauauuccagga

SEQ ID NO: 206475 - RNA, 22 nt, Human
cuggagggcuggacuaaggaaa

SEQ ID NO: 206476 - RNA, 22 nt, Human
ugagcccuaagggucaagcagg

SEQ ID NO: 206477 - RNA, 22 nt, Human
gcuccaggcugcucugucccau

SEQ ID NO: 206478 - RNA, 22 nt, Human
cuuccuggcucggugccucacc

SEQ ID NO: 206479 - RNA, 22 nt, Human
cuggcugguuuuuaaagcuagg

SEQ ID NO: 206480 - RNA, 22 nt, Human
acugaaaaagacaucuugguaa

SEQ ID NO: 206481 - RNA, 22 nt, Human
cagucagaaggaagaugcuuaa

SEQ ID NO: 206482 - RNA, 22 nt, Human
cagagcucagagcugccaggca

SEQ ID NO: 206483 - RNA, 21 nt, Human
caggccccaggccuggggugc

SEQ ID NO: 206484 - RNA, 22 nt, Human
ugaacuuuuauuugaugacagg

SEQ ID NO: 206485 - RNA, 22 nt, Human
caaaugcauagaaagaugaaac

SEQ ID NO: 206486 - RNA, 22 nt, Human
ucagagcuucaccuguuacauu

SEQ ID NO: 206487 - RNA, 22 nt, Human
uuuguuuagaugguaaaucagu

SEQ ID NO: 206488 - RNA, 22 nt, Human
cuggcaugcuaauacagccugu

SEQ ID NO: 206489 - RNA, 22 nt, Human
ucccacaccugucuauuccuag

SEQ ID NO: 206490 - RNA, 22 nt, Human
aggaggacucucugagccagcc

SEQ ID NO: 206491 - RNA, 22 nt, Human
ucugucuucaucagcaugugau

SEQ ID NO: 206492 - RNA, 19 nt, Human
gcaucagagcagaaggggu

SEQ ID NO: 206493 - RNA, 22 nt, Human
acacauguuuacagucuucagu

SEQ ID NO: 206494 - RNA, 22 nt, Human
agaaucuuguuucuuguguguu

SEQ ID NO: 206495 - RNA, 20 nt, Human
ggccucugaggacaaggaga

SEQ ID NO: 206496 - RNA, 22 nt, Human
gcugaggccaguuuaaugagga

SEQ ID NO: 206497 - RNA, 22 nt, Human
guuauugacauguauuaagcac

SEQ ID NO: 206498 - RNA, 22 nt, Human
ccuccagcgcgauccacuccgg

SEQ ID NO: 206499 - RNA, 22 nt, Human
auuccugguggcagaaacauga

SEQ ID NO: 206500 - RNA, 22 nt, Human
gagucagaauguccuccugcgg

SEQ ID NO: 206501 - RNA, 22 nt, Human
uuagaacaccauucuauauuac

SEQ ID NO: 206502 - RNA, 22 nt, Human
uccagccaacugccuagggagc

SEQ ID NO: 206503 - RNA, 22 nt, Human
gaugauucuguguuuggaaugc

SEQ ID NO: 206504 - RNA, 22 nt, Human
caugucugaguagagugugauu

SEQ ID NO: 206505 - RNA, 20 nt, Human
uaguccaguaggggggcuuu

SEQ ID NO: 206506 - RNA, 22 nt, Human
gagagggccagggugagaacua

SEQ ID NO: 206507 - RNA, 22 nt, Human
gagcuggcacagaaggaucuua

SEQ ID NO: 206508 - RNA, 22 nt, Human
guauuuuucauuccaagugaga

SEQ ID NO: 206509 - RNA, 22 nt, Human
ucugagggacaauuuugauggu

SEQ ID NO: 206510 - RNA, 22 nt, Human
uucagccuguucaugcuguugc

SEQ ID NO: 206511 - RNA, 22 nt, Human
cugguacaaaaugcugauauca

SEQ ID NO: 206512 - RNA, 22 nt, Human
gaaacauuguguucuacagauu

SEQ ID NO: 206513 - RNA, 22 nt, Human
cuuugaaagcucccaggacuua

SEQ ID NO: 206514 - RNA, 22 nt, Human
gugaggcagaaguucccuuuua

SEQ ID NO: 206515 - RNA, 15 nt, Human
caggagaggaagguu

SEQ ID NO: 206516 - RNA, 22 nt, Human
ucagggcugacugcuacucucc

SEQ ID NO: 206517 - RNA, 22 nt, Human
uccuuugguucucuaagaugcu

SEQ ID NO: 206518 - RNA, 22 nt, Human
aucaggaaugaauacuuuugga

SEQ ID NO: 206519 - RNA, 22 nt, Human
ugcagaggcgccgugggugggg

SEQ ID NO: 206520 - RNA, 22 nt, Human
uagguuuaggagugaaggugaa

SEQ ID NO: 206521 - RNA, 22 nt, Human
auuuacagacguggauuagugc

SEQ ID NO: 206522 - RNA, 22 nt, Human
uuguacaaauaggaaccucuga

SEQ ID NO: 206523 - RNA, 22 nt, Human
uugcaaaucagaaguauagauu

SEQ ID NO: 206524 - RNA, 19 nt, Human
gcuggccacgccccaguug

SEQ ID NO: 206525 - RNA, 21 nt, Human
cagaggcagguccugggacgg

SEQ ID NO: 206526 - RNA, 22 nt, Human
guucccaggcccugggcucucc

SEQ ID NO: 206527 - RNA, 22 nt, Human
cuccaggaguggccuggacacc

SEQ ID NO: 206528 - RNA, 22 nt, Human
cuccauggcuuucgcaucugca

SEQ ID NO: 206529 - RNA, 22 nt, Human
caguggaagacucagcucuccc

SEQ ID NO: 206530 - RNA, 22 nt, Human
cuccugguucagagagcugaga

SEQ ID NO: 206531 - RNA, 22 nt, Human
cugaauuacugaaggucaacuu

SEQ ID NO: 206532 - RNA, 22 nt, Human
cuugaaugguaugagaguaauu

SEQ ID NO: 206533 - RNA, 22 nt, Human
caguuaacugagcucugugaga

SEQ ID NO: 206534 - RNA, 22 nt, Human
gagcccugauuugcagcauuug

SEQ ID NO: 206535 - RNA, 22 nt, Human
cuccuggcacugucuugaccca

SEQ ID NO: 206536 - RNA, 22 nt, Human
acagccuguuugaucuggugcu

SEQ ID NO: 206537 - RNA, 22 nt, Human
cugucagggggccuggccauca

SEQ ID NO: 206538 - RNA, 22 nt, Human
augcaacaaaugcuacgaaucg

SEQ ID NO: 206539 - RNA, 22 nt, Human
uuggauguuugaaaucacguac

SEQ ID NO: 206540 - RNA, 22 nt, Human
ggcccagcacagugcuuggggg

SEQ ID NO: 206541 - RNA, 22 nt, Human
uccuugagauuaauuaaucacc

SEQ ID NO: 206542 - RNA, 22 nt, Human
agcucugacauugauucucagc

SEQ ID NO: 206543 - RNA, 22 nt, Human
cuggugagacgguugacaggag

SEQ ID NO: 206544 - RNA, 22 nt, Human
uacaagcucacaaauuuuuaag

SEQ ID NO: 206545 - RNA, 22 nt, Human
aucagagccuuaugcuucucau

SEQ ID NO: 206546 - RNA, 22 nt, Human
uacauucagaagaauggacacg

SEQ ID NO: 206547 - RNA, 22 nt, Human
agcagccauagauagcaugcaa

SEQ ID NO: 206548 - RNA, 22 nt, Human
uccaggcccugggaugggagca

SEQ ID NO: 206549 - RNA, 22 nt, Human
aguguccucuauuaugacuuua

SEQ ID NO: 206550 - RNA, 22 nt, Human
uacauguacauugggcauuaau

SEQ ID NO: 206551 - RNA, 22 nt, Human
aguggcagcugucaugcccuag

SEQ ID NO: 206552 - RNA, 22 nt, Human
acagguggccccgagggagugg

SEQ ID NO: 206553 - RNA, 22 nt, Human
acagucuacuugagcuuguaua

SEQ ID NO: 206554 - RNA, 22 nt, Human
gaggcaagaaaggacuuucuag

SEQ ID NO: 206555 - RNA, 22 nt, Human
ugggguccagugccaccccaag

SEQ ID NO: 206556 - RNA, 22 nt, Human
aucuaagacaaugagugagacu

SEQ ID NO: 206557 - RNA, 22 nt, Human
gcugguucaccuggcuccuccc

SEQ ID NO: 206558 - RNA, 22 nt, Human
gucugcccucacgccagcuggg

SEQ ID NO: 206559 - RNA, 22 nt, Human
cuggcucaauuuguacugcugu

SEQ ID NO: 206560 - RNA, 22 nt, Human
gugcugaggauacagcugugaa

SEQ ID NO: 206561 - RNA, 22 nt, Human
cugggcagccucacacaauguu

SEQ ID NO: 206562 - RNA, 22 nt, Human
ucagaggguggcugggagcauc

SEQ ID NO: 206563 - RNA, 22 nt, Human
aaggcugacucaacagggggcc

SEQ ID NO: 206564 - RNA, 21 nt, Human
aggcucagcagguguauaaag

SEQ ID NO: 206565 - RNA, 22 nt, Human
guauacauagaugaugaacaag

SEQ ID NO: 206566 - RNA, 22 nt, Human
gaggcuguaacuugggcacugg

SEQ ID NO: 206567 - RNA, 22 nt, Human
guuuacauugcuguuugugucu

SEQ ID NO: 206568 - RNA, 22 nt, Human
uuuuagugccugauuaaugggu

SEQ ID NO: 206569 - RNA, 22 nt, Human
cuguaucuguguuggaugaguu

SEQ ID NO: 206570 - RNA, 22 nt, Human
aagagccaggacagauccagcu

SEQ ID NO: 206571 - RNA, 22 nt, Human
aagauuuucagugccuaaaaca

SEQ ID NO: 206572 - RNA, 22 nt, Human
ccuggcagcuccuccccggcgg

SEQ ID NO: 206573 - RNA, 22 nt, Human
cagaggguugucaggcgccuug

SEQ ID NO: 206574 - RNA, 22 nt, Human
cuggauccaacagaguuggguu

SEQ ID NO: 206575 - RNA, 20 nt, Human
gcauuagaguacuauaugcu

SEQ ID NO: 206576 - RNA, 22 nt, Human
auauacguauauuccaaagggu

SEQ ID NO: 206577 - RNA, 22 nt, Human
uucuccagaccuugugacuaug

SEQ ID NO: 206578 - RNA, 23 nt, Human
agaugaaagcuucccaucacagu

SEQ ID NO: 206579 - RNA, 22 nt, Human
gauccucuuuuccuaggaaggu

SEQ ID NO: 206580 - RNA, 22 nt, Human
cccaggcacucuuggucauuuu

SEQ ID NO: 206581 - RNA, 22 nt, Human
gcccagcagaucucagugucuc

SEQ ID NO: 206582 - RNA, 22 nt, Human
caggcccugaggauucggcggg

SEQ ID NO: 206583 - RNA, 22 nt, Human
aggcucaguucuguggugagcc

SEQ ID NO: 206584 - RNA, 22 nt, Human
uaaaugucaaugugauuuauaa

SEQ ID NO: 206585 - RNA, 22 nt, Human
ccugccaggcuuucagguuugg

SEQ ID NO: 206586 - RNA, 22 nt, Human
gagcugugauuggugucucacu

SEQ ID NO: 206587 - RNA, 22 nt, Human
agucacacacugucaguucugc

SEQ ID NO: 206588 - RNA, 22 nt, Human
aggcugcccugccgccaguggg

SEQ ID NO: 206589 - RNA, 22 nt, Human
uucucagaggagucgggagcug

SEQ ID NO: 206590 - RNA, 22 nt, Human
ggccugaggccaccagcagccc

SEQ ID NO: 206591 - RNA, 22 nt, Human
uuccaggaagcaguuagcagcc

SEQ ID NO: 206592 - RNA, 22 nt, Human
auguccaauuucagagucucau

SEQ ID NO: 206593 - RNA, 22 nt, Human
caaauuuaaguuagaaagcaau

SEQ ID NO: 206594 - RNA, 22 nt, Human
cccaugcugaguggccugagau

SEQ ID NO: 206595 - RNA, 18 nt, Human
agaggaugcaucuaagag

SEQ ID NO: 206596 - RNA, 22 nt, Human
uaauuuuguauugccauuguag

SEQ ID NO: 206597 - RNA, 22 nt, Human
ucagcauguucuuaggucacag

SEQ ID NO: 206598 - RNA, 22 nt, Human
uucaggugucaaggauaggcug

SEQ ID NO: 206599 - RNA, 22 nt, Human
aggccagcucuacccuuggacu

SEQ ID NO: 206600 - RNA, 22 nt, Human
uucuuugggauuguagcugucu

SEQ ID NO: 206601 - RNA, 22 nt, Human
cggccaggcacaguggcccacg

SEQ ID NO: 206602 - RNA, 22 nt, Human
ucacuggggagcacugacaugu

SEQ ID NO: 206603 - RNA, 15 nt, Human
auacacaugagggag

SEQ ID NO: 206604 - RNA, 19 nt, Human
auacuaggucaugauaauc

SEQ ID NO: 206605 - RNA, 22 nt, Human
ggguccuggaaucugcauuuua

SEQ ID NO: 206606 - RNA, 22 nt, Human
gcaauacaguagguuuauuggu

SEQ ID NO: 206607 - RNA, 22 nt, Human
auuacaguggguaaacagaauu

SEQ ID NO: 206608 - RNA, 22 nt, Human
ugcauaaagugccauaguauua

SEQ ID NO: 206609 - RNA, 22 nt, Human
uggaaagguaggauuucaagac

SEQ ID NO: 206610 - RNA, 22 nt, Human
uugguacaugcagauauuuagu

SEQ ID NO: 206611 - RNA, 22 nt, Human
ugugcugggagauagagggagg

SEQ ID NO: 206612 - RNA, 22 nt, Human
gggauaggagauugggaguguu

SEQ ID NO: 206613 - RNA, 22 nt, Human
ugcaauaacuacuuuaauguug

SEQ ID NO: 206614 - RNA, 22 nt, Human
gguuuaaaagccaugcaugggg

SEQ ID NO: 206615 - RNA, 22 nt, Human
agguggcaaggggcgccucucu

SEQ ID NO: 206616 - RNA, 22 nt, Human
cuggugguucaggagaauggcu

SEQ ID NO: 206617 - RNA, 22 nt, Human
acuccugggugcugaccagcgu

SEQ ID NO: 206618 - RNA, 22 nt, Human
uucucacaguaccuaacaugua

SEQ ID NO: 206619 - RNA, 22 nt, Human
uuguuacuugcauguagacuaa

SEQ ID NO: 206620 - RNA, 22 nt, Human
ucagcaggcccauccuccaggc

SEQ ID NO: 206621 - RNA, 22 nt, Human
uccugggcuucacagacucugu

SEQ ID NO: 206622 - RNA, 22 nt, Human
aggcuggaugugccucaccgag

SEQ ID NO: 206623 - RNA, 22 nt, Human
ucagcaggugcuuuguuuacuc

SEQ ID NO: 206624 - RNA, 22 nt, Human
ccucagagacaguaacuggaau

SEQ ID NO: 206625 - RNA, 22 nt, Human
ucagagguaaaaacucacugua

SEQ ID NO: 206626 - RNA, 22 nt, Human
aagacacuaagcuuucaggaua

SEQ ID NO: 206627 - RNA, 22 nt, Human
gaagauaauuccuacuuauaac

SEQ ID NO: 206628 - RNA, 22 nt, Human
aaggagcugggagggacacaug

SEQ ID NO: 206629 - RNA, 22 nt, Human
cagccaggcccccgagucguug

SEQ ID NO: 206630 - RNA, 22 nt, Human
auccuggacaguuuccccuauu

SEQ ID NO: 206631 - RNA, 22 nt, Human
cagccaagaaagcagugcucca

SEQ ID NO: 206632 - RNA, 23 nt, Human
cuccuugguaugccaugcccagc

SEQ ID NO: 206633 - RNA, 22 nt, Human
gccagcagggcggagccaucua

SEQ ID NO: 206634 - RNA, 22 nt, Human
gcuggcucaagugugcuuccca

SEQ ID NO: 206635 - RNA, 22 nt, Human
caugccauuucuucucuuuaug

SEQ ID NO: 206636 - RNA, 22 nt, Human
ggccuuccuucccagccuacug

SEQ ID NO: 206637 - RNA, 22 nt, Human
ggggugggagugccauccuuga

SEQ ID NO: 206638 - RNA, 22 nt, Human
ggcucuucuguggcagccaagg

SEQ ID NO: 206639 - RNA, 22 nt, Human
aguguccucaucuguaaaauga

SEQ ID NO: 206640 - RNA, 22 nt, Human
ucuuuucuucuuaaugguuaau

SEQ ID NO: 206641 - RNA, 22 nt, Human
uccuggcucuaaguccugagug

SEQ ID NO: 206642 - RNA, 22 nt, Human
uugcagagccaugaggcuggcu

SEQ ID NO: 206643 - RNA, 22 nt, Human
gcauggcuuacagaggcugcag

SEQ ID NO: 206644 - RNA, 22 nt, Human
ugaauagauuuuuaacauauaa

SEQ ID NO: 206645 - RNA, 22 nt, Human
cugccugcugccuguggagggu

SEQ ID NO: 206646 - RNA, 22 nt, Human
aagcacugggaggaggcugaga

SEQ ID NO: 206647 - RNA, 20 nt, Human
ucucuguaaaucuucuuuua

SEQ ID NO: 206648 - RNA, 22 nt, Human
gccucagacacugccugggugu

SEQ ID NO: 206649 - RNA, 22 nt, Human
gaggucuggaccaagucgcccc

SEQ ID NO: 206650 - RNA, 22 nt, Human
ggguuccuccaguuccuagagc

SEQ ID NO: 206651 - RNA, 22 nt, Human
uacauuccacaagcauugcuuu

SEQ ID NO: 206652 - RNA, 22 nt, Human
uucuccccugacccugaugagg

SEQ ID NO: 206653 - RNA, 22 nt, Human
cauuacauuucaaaauguuucc

SEQ ID NO: 206654 - RNA, 21 nt, Human
ggcuugucaccauagcuacug

SEQ ID NO: 206655 - RNA, 22 nt, Human
aaaugcugaguguuuagagauc

SEQ ID NO: 206656 - RNA, 22 nt, Human
guaggcagggcuguggggagaa

SEQ ID NO: 206657 - RNA, 22 nt, Human
cucuguggcuacacaaaccucc

SEQ ID NO: 206658 - RNA, 22 nt, Human
caggcauaaucucaucuuguuu

SEQ ID NO: 206659 - RNA, 22 nt, Human
ugugugcuaauguaugcucuaa

SEQ ID NO: 206660 - RNA, 22 nt, Human
agcagacaccaggaguaaagaa

SEQ ID NO: 206661 - RNA, 22 nt, Human
auuuccuagccucucuugcagu

SEQ ID NO: 206662 - RNA, 22 nt, Human
ucuauugcagauggaugcccuc

SEQ ID NO: 206663 - RNA, 22 nt, Human
gcugccuucuucugacucuauu

SEQ ID NO: 206664 - RNA, 22 nt, Human
gcauccaggacuauaugaugau

SEQ ID NO: 206665 - RNA, 20 nt, Human
cagcugccuggcucugggau

SEQ ID NO: 206666 - RNA, 22 nt, Human
aaauaauugaguuggucaauau

SEQ ID NO: 206667 - RNA, 22 nt, Human
agcuuucguuccuuagacacau

SEQ ID NO: 206668 - RNA, 22 nt, Human
ugacaggugauugugaacuaag

SEQ ID NO: 206669 - RNA, 22 nt, Human
cagaguggagaaagcauuuagu

SEQ ID NO: 206670 - RNA, 22 nt, Human
ccaggccuagccccugagggua

SEQ ID NO: 206671 - RNA, 22 nt, Human
acaguuaauaugugacagaacu

SEQ ID NO: 206672 - RNA, 22 nt, Human
uagucagucuuacauauuugaa

SEQ ID NO: 206673 - RNA, 22 nt, Human
cccuggcaaaaucccugguaca

SEQ ID NO: 206674 - RNA, 22 nt, Human
ugucaacaccaaagccucccag

SEQ ID NO: 206675 - RNA, 22 nt, Human
aaauguaccuugauaguuuggu

SEQ ID NO: 206676 - RNA, 21 nt, Human
aggagccagccugucagucua

SEQ ID NO: 206677 - RNA, 22 nt, Human
aggguggcaccuggaagggaug

SEQ ID NO: 206678 - RNA, 22 nt, Human
ccugagagugagugccaccuua

SEQ ID NO: 206679 - RNA, 20 nt, Human
acaaaguauugaggacaagu

SEQ ID NO: 206680 - RNA, 22 nt, Human
ugucuuuagaccucucuggccu

SEQ ID NO: 206681 - RNA, 22 nt, Human
uguacaaauucaguucuagggu

SEQ ID NO: 206682 - RNA, 22 nt, Human
aagccuuuuccaccuaauagag

SEQ ID NO: 206683 - RNA, 22 nt, Human
gcagcaggcauggccgcccugg

SEQ ID NO: 206684 - RNA, 22 nt, Human
aaaaagacuuccaacucaggag

SEQ ID NO: 206685 - RNA, 19 nt, Human
cuggugaggguuauugaua

SEQ ID NO: 206686 - RNA, 22 nt, Human
agucagacauaauucuaacauu

SEQ ID NO: 206687 - RNA, 22 nt, Human
ucaacuaaggcacaaucucuaa

SEQ ID NO: 206688 - RNA, 17 nt, Human
ugaggcaaccaucacua

SEQ ID NO: 206689 - RNA, 22 nt, Human
ccuguucacugcacaguuuccg

SEQ ID NO: 206690 - RNA, 22 nt, Human
agaaucauuagagagaaaacuu

SEQ ID NO: 206691 - RNA, 22 nt, Human
agcagcaggcuagggaacugcu

SEQ ID NO: 206692 - RNA, 22 nt, Human
uucggcauauuaauggugggug

SEQ ID NO: 206693 - RNA, 22 nt, Human
ccugugaggucaucugugguaa

SEQ ID NO: 206694 - RNA, 22 nt, Human
uugcaaaguucccuacacaugu

SEQ ID NO: 206695 - RNA, 22 nt, Human
cuggaaauuggagaugauguuu

SEQ ID NO: 206696 - RNA, 20 nt, Human
uguuaaaggacacuugcuuu

SEQ ID NO: 206697 - RNA, 22 nt, Human
caggcaagcacggugaaccugg

SEQ ID NO: 206698 - RNA, 22 nt, Human
cuucuuaaagauuacacaauga

SEQ ID NO: 206699 - RNA, 22 nt, Human
cagaggaggccaccgcauaggc

SEQ ID NO: 206700 - RNA, 22 nt, Human
cccagcagccuggauguucuuu

SEQ ID NO: 206701 - RNA, 22 nt, Human
gcugagcacaccuaggguagag

SEQ ID NO: 206702 - RNA, 19 nt, Human
ggcugucuacgaaccaguc

SEQ ID NO: 206703 - RNA, 22 nt, Human
caggcuggagugcagugucgcc

SEQ ID NO: 206704 - RNA, 22 nt, Human
uagaaucugaaaguggcuguga

SEQ ID NO: 206705 - RNA, 22 nt, Human
gcagcuccuucaaucucaccau

SEQ ID NO: 206706 - RNA, 19 nt, Human
uaggaauguagaauccuag

SEQ ID NO: 206707 - RNA, 22 nt, Human
ccaguucuuucugugugcaaca

SEQ ID NO: 206708 - RNA, 22 nt, Human
ucagcagggcugugguguggcu

SEQ ID NO: 206709 - RNA, 22 nt, Human
cccaggcuagaaaggccaacaa

SEQ ID NO: 206710 - RNA, 15 nt, Human
uccaggcauucauuc

SEQ ID NO: 206711 - RNA, 20 nt, Human
ugccuggccuuucucugccc

SEQ ID NO: 206712 - RNA, 22 nt, Human
uacugugcaaaaaugaauauug

SEQ ID NO: 206713 - RNA, 22 nt, Human
agggccagcugaugagaaugag

SEQ ID NO: 206714 - RNA, 22 nt, Human
uaagcacuuuauaugcuuuauc

SEQ ID NO: 206715 - RNA, 22 nt, Human
uauuuucaccauguaucccugu

SEQ ID NO: 206716 - RNA, 22 nt, Human
uugggacauguaagcuggaagu

SEQ ID NO: 206717 - RNA, 22 nt, Human
uaaagacaaacccacuaggguu

SEQ ID NO: 206718 - RNA, 22 nt, Human
uggaaacuaacaacagagcaga

SEQ ID NO: 206719 - RNA, 22 nt, Human
cccugccuuguuggagccuaug

SEQ ID NO: 206720 - RNA, 22 nt, Human
ucucugagggagauggccugcc

SEQ ID NO: 206721 - RNA, 22 nt, Human
aguuuaugucuuuacuucagcu

SEQ ID NO: 206722 - RNA, 22 nt, Human
acaaggacgucacuuccacggu

SEQ ID NO: 206723 - RNA, 21 nt, Human
cacugguagauggcccgcagg

SEQ ID NO: 206724 - RNA, 22 nt, Human
uuuguucuaacuucugcagaca

SEQ ID NO: 206725 - RNA, 22 nt, Human
auuucuguggcuucauucuccu

SEQ ID NO: 206726 - RNA, 22 nt, Human
acuguaaaaugagauauguaua

SEQ ID NO: 206727 - RNA, 22 nt, Human
aagcugugaagagcaagugagg

SEQ ID NO: 206728 - RNA, 22 nt, Human
cugggcaauaugcugggccugg

SEQ ID NO: 206729 - RNA, 19 nt, Human
ccaguccucuuugggccug

SEQ ID NO: 206730 - RNA, 22 nt, Human
aggucagaugggagaugggaug

SEQ ID NO: 206731 - RNA, 22 nt, Human
gucaccucucaucacaugcuac

SEQ ID NO: 206732 - RNA, 22 nt, Human
uagacacuguaugagcugggug

SEQ ID NO: 206733 - RNA, 22 nt, Human
guacacauagguuacugauuaa

SEQ ID NO: 206734 - RNA, 22 nt, Human
ucgcuugaacccaggaagugga

SEQ ID NO: 206735 - RNA, 22 nt, Human
ccagguggacuugauuugaaua

SEQ ID NO: 206736 - RNA, 21 nt, Human
agaggcaggcauuaaguacac

SEQ ID NO: 206737 - RNA, 22 nt, Human
cagcagcaugaauucgagccac

SEQ ID NO: 206738 - RNA, 22 nt, Human
caggcaggagacauuugguugg

SEQ ID NO: 206739 - RNA, 22 nt, Human
cucuggccgcagcucagcucug

SEQ ID NO: 206740 - RNA, 22 nt, Human
aggccuggccuuuauguucaag

SEQ ID NO: 206741 - RNA, 22 nt, Human
ugcuggagaacugcucuguguu

SEQ ID NO: 206742 - RNA, 22 nt, Human
ggcaguggguuccccaaggcac

SEQ ID NO: 206743 - RNA, 22 nt, Human
ccucagucuccgugcucaccuu

SEQ ID NO: 206744 - RNA, 22 nt, Human
acaauguaggaguaugacagua

SEQ ID NO: 206745 - RNA, 22 nt, Human
aagccaguggcuucucccugcu

SEQ ID NO: 206746 - RNA, 22 nt, Human
gggauccauccgugcagcagag

SEQ ID NO: 206747 - RNA, 22 nt, Human
gcugcccugacuccagcagccu

SEQ ID NO: 206748 - RNA, 22 nt, Human
caauucauguuaaacagaagca

SEQ ID NO: 206749 - RNA, 19 nt, Human
uuuacaaguucuuuguaug

SEQ ID NO: 206750 - RNA, 22 nt, Human
acaguccuagcugcaaagaagu

SEQ ID NO: 206751 - RNA, 22 nt, Human
gaaucaaaucaaguucuuuuga

SEQ ID NO: 206752 - RNA, 22 nt, Human
guaacauuuacaguuccuagag

SEQ ID NO: 206753 - RNA, 22 nt, Human
ugaaaugagauaauuuaagugc

SEQ ID NO: 206754 - RNA, 22 nt, Human
ccugcuguagggccccuggggc

SEQ ID NO: 206755 - RNA, 20 nt, Human
aaagucuuaugguuaauuuu

SEQ ID NO: 206756 - RNA, 22 nt, Human
agccucugcacuucuuacaggu

SEQ ID NO: 206757 - RNA, 21 nt, Human
ugggagagcguugcuguccuc

SEQ ID NO: 206758 - RNA, 22 nt, Human
uuagaaccaccuggagagcuuu

SEQ ID NO: 206759 - RNA, 22 nt, Human
cuggaucuguccccuuuuuguu

SEQ ID NO: 206760 - RNA, 22 nt, Human
aggcuucuaggguuggcagcgg

SEQ ID NO: 206761 - RNA, 22 nt, Human
caggaaaucacucugauuuugg

SEQ ID NO: 206762 - RNA, 18 nt, Human
aaguuccacaagagaucu

SEQ ID NO: 206763 - RNA, 22 nt, Human
cuguauuuguccucuauuuauu

SEQ ID NO: 206764 - RNA, 22 nt, Human
uagaugaaggcugagcaccugu

SEQ ID NO: 206765 - RNA, 22 nt, Human
guuugccuuuuagauaggaaug

SEQ ID NO: 206766 - RNA, 21 nt, Human
cucugcugucuaccagcuguu

SEQ ID NO: 206767 - RNA, 22 nt, Human
agggcagagaucugagugggca

SEQ ID NO: 206768 - RNA, 22 nt, Human
ccagcccuguaaggaugaggca

SEQ ID NO: 206769 - RNA, 22 nt, Human
cugugcaguggggcucuggguu

SEQ ID NO: 206770 - RNA, 22 nt, Human
ugauaaacauuuuaggaacuaa

SEQ ID NO: 206771 - RNA, 22 nt, Human
gugggaguggggaagcagagug

SEQ ID NO: 206772 - RNA, 22 nt, Human
acucuuuacuuaaacucuaagu

SEQ ID NO: 206773 - RNA, 22 nt, Human
gcugggucagaaucucccugug

SEQ ID NO: 206774 - RNA, 22 nt, Human
uuugaagacauuugaauacuuu

SEQ ID NO: 206775 - RNA, 22 nt, Human
cauuuaguuuugcaguagcagg

SEQ ID NO: 206776 - RNA, 22 nt, Human
ugccuguguugauuacuuuguc

SEQ ID NO: 206777 - RNA, 22 nt, Human
gacagacagagaaugggcuuga

SEQ ID NO: 206778 - RNA, 22 nt, Human
aggauuaaaguauauuuuugag

SEQ ID NO: 206779 - RNA, 22 nt, Human
uggaccugaagaauaggaagua

SEQ ID NO: 206780 - RNA, 22 nt, Human
ucaaaccugcugucuuguucau

SEQ ID NO: 206781 - RNA, 22 nt, Human
aacagcuguauacuguagcugu

SEQ ID NO: 206782 - RNA, 22 nt, Human
gcucugagccgggggccugucc

SEQ ID NO: 206783 - RNA, 22 nt, Human
ggcuguggggggagccugcccg

SEQ ID NO: 206784 - RNA, 22 nt, Human
aaaauuuugcccuauccuucau

SEQ ID NO: 206785 - RNA, 22 nt, Human
uaguccuugcugggcacagagu

SEQ ID NO: 206786 - RNA, 22 nt, Human
gcuucuuuggcaacccugacau

SEQ ID NO: 206787 - RNA, 22 nt, Human
acucacagucccuguaggagug

SEQ ID NO: 206788 - RNA, 22 nt, Human
agcagguggccacgaggaggag

SEQ ID NO: 206789 - RNA, 22 nt, Human
ggucuacauugagagagcugcu

SEQ ID NO: 206790 - RNA, 22 nt, Human
uucuuucugaauacaguugagu

SEQ ID NO: 206791 - RNA, 23 nt, Human
cuggcuccgaagacuccaggauc

SEQ ID NO: 206792 - RNA, 22 nt, Human
cagcccucaucucagcuucuuu

SEQ ID NO: 206793 - RNA, 20 nt, Human
ugccuuagagauaaaggcuu

SEQ ID NO: 206794 - RNA, 19 nt, Human
agcuccaggccuggaugcu

SEQ ID NO: 206795 - RNA, 22 nt, Human
ucuggcuccacaccucacugca

SEQ ID NO: 206796 - RNA, 22 nt, Human
ucauuuauauuguauucuguag

SEQ ID NO: 206797 - RNA, 22 nt, Human
cccacccugggaagcuaggcag

SEQ ID NO: 206798 - RNA, 22 nt, Human
ggcuuuaucaaaugagacccug

SEQ ID NO: 206799 - RNA, 22 nt, Human
acagcaggauuuggcgauguug

SEQ ID NO: 206800 - RNA, 22 nt, Human
aaggggcacaauuguacccaag

SEQ ID NO: 206801 - RNA, 22 nt, Human
agaaacugacaggaaaugaauu

SEQ ID NO: 206802 - RNA, 22 nt, Human
gagcugugaaaagugccugggg

SEQ ID NO: 206803 - RNA, 22 nt, Human
ugaucacaagucugaagaauga

SEQ ID NO: 206804 - RNA, 22 nt, Human
gcaggagccagggauuccagga

SEQ ID NO: 206805 - RNA, 22 nt, Human
uagggcaguuucauguuaucuu

SEQ ID NO: 206806 - RNA, 22 nt, Human
accagcuguuaucuguaguauc

SEQ ID NO: 206807 - RNA, 22 nt, Human
aucccagauagugacccucagg

SEQ ID NO: 206808 - RNA, 22 nt, Human
aucuugauuccauuaucuuugu

SEQ ID NO: 206809 - RNA, 22 nt, Human
aguguuaaugguguauauuagg

SEQ ID NO: 206810 - RNA, 17 nt, Human
gcaaaggugaggagaga

SEQ ID NO: 206811 - RNA, 22 nt, Human
uagcaacugcucuauucuagga

SEQ ID NO: 206812 - RNA, 22 nt, Human
uccucuccaugucucacgccac

SEQ ID NO: 206813 - RNA, 22 nt, Human
agacagcagaaacuagagcacu

SEQ ID NO: 206814 - RNA, 22 nt, Human
uuauccaagcagaagcugcaca

SEQ ID NO: 206815 - RNA, 22 nt, Human
uuuguuaaauauuuauugagug

SEQ ID NO: 206816 - RNA, 22 nt, Human
aggcugucucagccugcuugca

SEQ ID NO: 206817 - RNA, 22 nt, Human
guccaugcuuaaauaccuuaaa

SEQ ID NO: 206818 - RNA, 22 nt, Human
gcucagcuaucaguguuccuga

SEQ ID NO: 206819 - RNA, 22 nt, Human
aauaauauuugaagcuucaaag

SEQ ID NO: 206820 - RNA, 22 nt, Human
uguccagggauggggucaggga

SEQ ID NO: 206821 - RNA, 22 nt, Human
auccuucuaccuaggacuauuu

SEQ ID NO: 206822 - RNA, 21 nt, Human
ccaggcuccugaggcugguca

SEQ ID NO: 206823 - RNA, 22 nt, Human
gcaacacagaucuucuuuguug

SEQ ID NO: 206824 - RNA, 22 nt, Human
uacugucuuuuccuaaaugggu

SEQ ID NO: 206825 - RNA, 18 nt, Human
gauguaaaauaguagcuu

SEQ ID NO: 206826 - RNA, 22 nt, Human
uaagauaaggaacauucuguga

SEQ ID NO: 206827 - RNA, 22 nt, Human
cccaguguuccuugaggggcug

SEQ ID NO: 206828 - RNA, 22 nt, Human
accuagaguagucaaauucaua

SEQ ID NO: 206829 - RNA, 22 nt, Human
caugcagggagcagaggagaca

SEQ ID NO: 206830 - RNA, 22 nt, Human
gucuuuauuugagauugucauu

SEQ ID NO: 206831 - RNA, 22 nt, Human
uaaggcaaagaaccauaguaau

SEQ ID NO: 206832 - RNA, 22 nt, Human
augccuggacuguaucccagau

SEQ ID NO: 206833 - RNA, 22 nt, Human
uccuucuuugacaaguggcaga

SEQ ID NO: 206834 - RNA, 22 nt, Human
agaaggcuuaaaacauggaaua

SEQ ID NO: 206835 - RNA, 22 nt, Human
uagauuugugcaagaagggauu

SEQ ID NO: 206836 - RNA, 22 nt, Human
cccagccuggugcacugugggg

SEQ ID NO: 206837 - RNA, 22 nt, Human
guguugaugacauuuuagaaac

SEQ ID NO: 206838 - RNA, 22 nt, Human
uugcaauugcuauggagagcgu

SEQ ID NO: 206839 - RNA, 22 nt, Human
ggcuguagguuggugcuggaca

SEQ ID NO: 206840 - RNA, 22 nt, Human
acucuggcugccuugugagcau

SEQ ID NO: 206841 - RNA, 22 nt, Human
agcuggccuccgggugccuggg

SEQ ID NO: 206842 - RNA, 22 nt, Human
guuccucaugaguaccccuuaa

SEQ ID NO: 206843 - RNA, 22 nt, Human
uuaguguguuauauaccaagcu

SEQ ID NO: 206844 - RNA, 22 nt, Human
acuccaggauguagaaucagag

SEQ ID NO: 206845 - RNA, 22 nt, Human
ccucuuugacuauaguaguuaa

SEQ ID NO: 206846 - RNA, 22 nt, Human
cuggggacucauucagagcaua

SEQ ID NO: 206847 - RNA, 22 nt, Human
uagucagauauaugacuuacgu

SEQ ID NO: 206848 - RNA, 22 nt, Human
acccuggacuggggcugaggcu

SEQ ID NO: 206849 - RNA, 23 nt, Human
agcaggaaaccgagggugauguu

SEQ ID NO: 206850 - RNA, 22 nt, Human
acaugucuaaguacucaacaaa

SEQ ID NO: 206851 - RNA, 22 nt, Human
aggcuuuaauuaucuacaggag

SEQ ID NO: 206852 - RNA, 21 nt, Human
gccuccagccagauggccucc

SEQ ID NO: 206853 - RNA, 22 nt, Human
uccugcagcugcagaccugggg

SEQ ID NO: 206854 - RNA, 22 nt, Human
agcugagauuaugcucuucuca

SEQ ID NO: 206855 - RNA, 22 nt, Human
auagagcuauaagaauuuugug

SEQ ID NO: 206856 - RNA, 22 nt, Human
uuucucuguucucuaacuguaa

SEQ ID NO: 206857 - RNA, 23 nt, Human
ggagaugcuuaagagugguugag

SEQ ID NO: 206858 - RNA, 20 nt, Human
aggagccauugacugcagca

SEQ ID NO: 206859 - RNA, 22 nt, Human
ggcaggcaucaucaguugauca

SEQ ID NO: 206860 - RNA, 22 nt, Human
ccugcucuuauagcuguuucca

SEQ ID NO: 206861 - RNA, 22 nt, Human
gucuuugccacacuucuguaca

SEQ ID NO: 206862 - RNA, 22 nt, Human
ggcugagguguggggaacuaua

SEQ ID NO: 206863 - RNA, 22 nt, Human
ccaggaagguguuuaacuagag

SEQ ID NO: 206864 - RNA, 22 nt, Human
ugugcagcaaaauagaaucuuu

SEQ ID NO: 206865 - RNA, 22 nt, Human
uacaguguuucccccaggauag

SEQ ID NO: 206866 - RNA, 22 nt, Human
cauuucacaaauggccacauca

SEQ ID NO: 206867 - RNA, 19 nt, Human
gauagcugaugaccaucau

SEQ ID NO: 206868 - RNA, 22 nt, Human
agagggcugcugcacagugcuc

SEQ ID NO: 206869 - RNA, 22 nt, Human
ugggugcaggaugagugcuggc

SEQ ID NO: 206870 - RNA, 22 nt, Human
uuacagagguauguaugucucu

SEQ ID NO: 206871 - RNA, 22 nt, Human
ggaugaggaagauuacugagaa

SEQ ID NO: 206872 - RNA, 22 nt, Human
aagaaguuagguguaacaauau

SEQ ID NO: 206873 - RNA, 21 nt, Human
uggcacagcaagugggcucau

SEQ ID NO: 206874 - RNA, 22 nt, Human
gaaggugcaguggcuggaggcu

SEQ ID NO: 206875 - RNA, 22 nt, Human
agaaaucugacugcugugcaca

SEQ ID NO: 206876 - RNA, 22 nt, Human
agcuucaggaacaggcagccug

SEQ ID NO: 206877 - RNA, 22 nt, Human
aaagagcauggaaaguucagga

SEQ ID NO: 206878 - RNA, 21 nt, Human
ucagggcagcugcucuucaga

SEQ ID NO: 206879 - RNA, 22 nt, Human
gcaggggcuacucugagcuucc

SEQ ID NO: 206880 - RNA, 22 nt, Human
ggcaggcuccaagcauccuaug

SEQ ID NO: 206881 - RNA, 22 nt, Human
agagcuggaaucagaccucagg

SEQ ID NO: 206882 - RNA, 22 nt, Human
acaacugucuucuucaugcucc

SEQ ID NO: 206883 - RNA, 22 nt, Human
uccauuuggcacucuauuucca

SEQ ID NO: 206884 - RNA, 22 nt, Human
aacaaagaugggugggaaagag

SEQ ID NO: 206885 - RNA, 22 nt, Human
aauaacagagucuucaagauag

SEQ ID NO: 206886 - RNA, 21 nt, Human
gcauguguggugugcuccaca

SEQ ID NO: 206887 - RNA, 21 nt, Human
gcucuguacguuggugccuuc

SEQ ID NO: 206888 - RNA, 22 nt, Human
agcaacaggaaauagcugauua

SEQ ID NO: 206889 - RNA, 22 nt, Human
gcucugagacaguagagauggc

SEQ ID NO: 206890 - RNA, 22 nt, Human
uaagaaacaugauacuuuuccu

SEQ ID NO: 206891 - RNA, 22 nt, Human
aaucugguuugacaacuuuugu

SEQ ID NO: 206892 - RNA, 22 nt, Human
cagagccaggugguguuggggc

SEQ ID NO: 206893 - RNA, 22 nt, Human
ccugccagucacuaugucaccu

SEQ ID NO: 206894 - RNA, 22 nt, Human
uacaaggaaaaucuugaaguac

SEQ ID NO: 206895 - RNA, 22 nt, Human
gacccuggugggcacuggcacc

SEQ ID NO: 206896 - RNA, 23 nt, Human
uuucacauuaauguuuagcagga

SEQ ID NO: 206897 - RNA, 22 nt, Human
caugcugugguaaaucacugaa

SEQ ID NO: 206898 - RNA, 22 nt, Human
uccuggagccaaugugcugcug

SEQ ID NO: 206899 - RNA, 22 nt, Human
gagagggccgggggccagcucc

SEQ ID NO: 206900 - RNA, 20 nt, Human
gggcuggcucaacuggaucc

SEQ ID NO: 206901 - RNA, 22 nt, Human
gaccagcuacuuguacaguuca

SEQ ID NO: 206902 - RNA, 22 nt, Human
gugcaaagcuuaacauucugca

SEQ ID NO: 206903 - RNA, 22 nt, Human
gauguguccuuuucuccaucca

SEQ ID NO: 206904 - RNA, 22 nt, Human
uggugcugugauacgaggcacu

SEQ ID NO: 206905 - RNA, 19 nt, Human
cuccuggcucugucauuuu

SEQ ID NO: 206906 - RNA, 22 nt, Human
agacacugaaucagagggacau

SEQ ID NO: 206907 - RNA, 22 nt, Human
cacagcuaccugcaugccugcu

SEQ ID NO: 206908 - RNA, 21 nt, Human
aaggucuguaaagugacagga

SEQ ID NO: 206909 - RNA, 22 nt, Human
acaggugugcggaaagcuguga

SEQ ID NO: 206910 - RNA, 22 nt, Human
gcuuuagaaaugaguaaauuag

SEQ ID NO: 206911 - RNA, 19 nt, Human
ccuggccagacuucugccc

SEQ ID NO: 206912 - RNA, 22 nt, Human
cagaggagaauugcgggaucau

SEQ ID NO: 206913 - RNA, 22 nt, Human
acugauuaaaaacagacauuua

SEQ ID NO: 206914 - RNA, 17 nt, Human
ccagggaggggccgcgc

SEQ ID NO: 206915 - RNA, 22 nt, Human
ugggccucuguuuccucaucug

SEQ ID NO: 206916 - RNA, 22 nt, Human
ucugaggagugacccucuugca

SEQ ID NO: 206917 - RNA, 22 nt, Human
ugaguaaagggccagauaguaa

SEQ ID NO: 206918 - RNA, 19 nt, Human
uccaggcugagagucagcu

SEQ ID NO: 206919 - RNA, 22 nt, Human
aucaucaucaacaagaaacauu

SEQ ID NO: 206920 - RNA, 22 nt, Human
ccuuaccugauugcuggcaucc

SEQ ID NO: 206921 - RNA, 19 nt, Human
ucugcagaaggcauacaug

SEQ ID NO: 206922 - RNA, 22 nt, Human
uauccacacucaaggggagggg

SEQ ID NO: 206923 - RNA, 22 nt, Human
ucaggcagcuccaggaauggua

SEQ ID NO: 206924 - RNA, 22 nt, Human
augcauacagauuuaaaauuuu

SEQ ID NO: 206925 - RNA, 22 nt, Human
cucagggauggugaagcaccca

SEQ ID NO: 206926 - RNA, 22 nt, Human
agugcagauuuuuagucagcuu

SEQ ID NO: 206927 - RNA, 19 nt, Human
uccagaagucccugagcgg

SEQ ID NO: 206928 - RNA, 22 nt, Human
ucuuaaacuuugcuguaauucu

SEQ ID NO: 206929 - RNA, 22 nt, Human
cagcccagcgcaaacaacuggc

SEQ ID NO: 206930 - RNA, 22 nt, Human
cugaggcaccuacagucucggg

SEQ ID NO: 206931 - RNA, 22 nt, Human
uguaucuguaaucccagaucaa

SEQ ID NO: 206932 - RNA, 22 nt, Human
gaaugaauagguguccagaugg

SEQ ID NO: 206933 - RNA, 22 nt, Human
gaaacaauacuuguccucacua

SEQ ID NO: 206934 - RNA, 16 nt, Human
gcaggcagaucacaug

SEQ ID NO: 206935 - RNA, 22 nt, Human
acagagagaauuggguuuacag

SEQ ID NO: 206936 - RNA, 19 nt, Human
ugaucuggaaggaaccagg

SEQ ID NO: 206937 - RNA, 22 nt, Human
ggcugggagccccacagaguca

SEQ ID NO: 206938 - RNA, 22 nt, Human
ggcuggguacccuguuuccccu

SEQ ID NO: 206939 - RNA, 22 nt, Human
gcauggcauuugaagguagaag

SEQ ID NO: 206940 - RNA, 20 nt, Human
ugcacagggugggaagcaac

SEQ ID NO: 206941 - RNA, 22 nt, Human
uggcuucugcauauuuuuagag

SEQ ID NO: 206942 - RNA, 22 nt, Human
uacagaggcuggguuuucaggg

SEQ ID NO: 206943 - RNA, 22 nt, Human
uccugccagcuggggcugcuuc

SEQ ID NO: 206944 - RNA, 20 nt, Human
aagggcagagggaacagacu

SEQ ID NO: 206945 - RNA, 22 nt, Human
agcuggggcauuuauccacuaa

SEQ ID NO: 206946 - RNA, 22 nt, Human
ccugacaggagaagcgcagcau

SEQ ID NO: 206947 - RNA, 22 nt, Human
aacugaaacggugaucuuuuaa

SEQ ID NO: 206948 - RNA, 19 nt, Human
cccagucuagguccuagga

SEQ ID NO: 206949 - RNA, 19 nt, Human
uggggccuccugucccugg

SEQ ID NO: 206950 - RNA, 22 nt, Human
agccaguggaauucccaggggu

SEQ ID NO: 206951 - RNA, 22 nt, Human
agcuucagcuugcagcugugau

SEQ ID NO: 206952 - RNA, 22 nt, Human
cggcuggggcuguccccaugac

SEQ ID NO: 206953 - RNA, 22 nt, Human
uaaggccaauuaacaaccaggg

SEQ ID NO: 206954 - RNA, 21 nt, Human
gcagugcagcuuggaggguag

SEQ ID NO: 206955 - RNA, 22 nt, Human
ucucucuauaugucaacagggg

SEQ ID NO: 206956 - RNA, 22 nt, Human
uguccaggcucccuuggugcug

SEQ ID NO: 206957 - RNA, 22 nt, Human
ucucuggcuggcaccccaggga

SEQ ID NO: 206958 - RNA, 22 nt, Human
cacaagauggucacauaagugc

SEQ ID NO: 206959 - RNA, 23 nt, Human
auucagaauuguguguuuguaua

SEQ ID NO: 206960 - RNA, 19 nt, Human
uccugggcugggccagguc

SEQ ID NO: 206961 - RNA, 22 nt, Human
uggcagggccuaccccaauauc

SEQ ID NO: 206962 - RNA, 22 nt, Human
ccuggagccccucuggccagcc

SEQ ID NO: 206963 - RNA, 22 nt, Human
uggcucagugacauuccuccca

SEQ ID NO: 206964 - RNA, 22 nt, Human
cagggcuggauuucauuucuag

SEQ ID NO: 206965 - RNA, 22 nt, Human
gcgcaagccacacagccugggg

SEQ ID NO: 206966 - RNA, 22 nt, Human
uuaaaaugaauauugauuagca

SEQ ID NO: 206967 - RNA, 22 nt, Human
uaaagacaauuucgagcuguag

SEQ ID NO: 206968 - RNA, 22 nt, Human
uugucuguaaagacggccacca

SEQ ID NO: 206969 - RNA, 22 nt, Human
gugggcuccccuggcaugucca

SEQ ID NO: 206970 - RNA, 17 nt, Human
uuucagauucacuuucu

SEQ ID NO: 206971 - RNA, 22 nt, Human
ucuucauuuuauagcaucugug

SEQ ID NO: 206972 - RNA, 22 nt, Human
accuugaugccuuuccaagaug

SEQ ID NO: 206973 - RNA, 22 nt, Human
ccucaggguggcaucagaucuu

SEQ ID NO: 206974 - RNA, 22 nt, Human
cucuucccagcuccacgagagg

SEQ ID NO: 206975 - RNA, 21 nt, Human
uaagccaccaugugaaaccag

SEQ ID NO: 206976 - RNA, 22 nt, Human
aaggugucggcagagccgcuuc

SEQ ID NO: 206977 - RNA, 22 nt, Human
ugucaguuaccuagcacaagaa

SEQ ID NO: 206978 - RNA, 22 nt, Human
ggccuugcagccacagaacaca

SEQ ID NO: 206979 - RNA, 22 nt, Human
gucaggauuugaacucaggucu

SEQ ID NO: 206980 - RNA, 22 nt, Human
gaaaucuacgauuagugaaaau

SEQ ID NO: 206981 - RNA, 22 nt, Human
aaugacagagcacugaacuugg

SEQ ID NO: 206982 - RNA, 22 nt, Human
acaggaugauaaaggauggcca

SEQ ID NO: 206983 - RNA, 22 nt, Human
gugaagcagggaaggaaaggau

SEQ ID NO: 206984 - RNA, 22 nt, Human
gggcucaugauguaggcuggua

SEQ ID NO: 206985 - RNA, 22 nt, Human
ucccuggguucccguggaagug

SEQ ID NO: 206986 - RNA, 22 nt, Human
gaguccuuuugugccacaggga

SEQ ID NO: 206987 - RNA, 20 nt, Human
ugagaaggggucagcuguac

SEQ ID NO: 206988 - RNA, 22 nt, Human
ucugagggcuguacuaugcacg

SEQ ID NO: 206989 - RNA, 22 nt, Human
uuugcugaccccauucugaguc

SEQ ID NO: 206990 - RNA, 22 nt, Human
uggagaagucaaagugaacagg

SEQ ID NO: 206991 - RNA, 22 nt, Human
gccagcccagcuccaggggaaa

SEQ ID NO: 206992 - RNA, 22 nt, Human
caauuauauuuagaaugauaca

SEQ ID NO: 206993 - RNA, 22 nt, Human
uuucauggcuaggacuagagug

SEQ ID NO: 206994 - RNA, 22 nt, Human
gaaaucaaggcuacauucaggu

SEQ ID NO: 206995 - RNA, 22 nt, Human
guuuccuauggcugcugcagga

SEQ ID NO: 206996 - RNA, 22 nt, Human
uccuggguagagaccugaugaa

SEQ ID NO: 206997 - RNA, 22 nt, Human
ggcuuggaaauugcaggacaca

SEQ ID NO: 206998 - RNA, 22 nt, Human
uggggaaaggaaaguuaaccug

SEQ ID NO: 206999 - RNA, 22 nt, Human
cccagacagucaagaggccugc

SEQ ID NO: 207000 - RNA, 22 nt, Human
ggaauguucuggucugguucau

SEQ ID NO: 207001 - RNA, 22 nt, Human
uccccagcauugagggucucuc

SEQ ID NO: 207002 - RNA, 22 nt, Human
aaagccaguucuuagagaaagc

SEQ ID NO: 207003 - RNA, 22 nt, Human
uccucagacacccugcuggcuu

SEQ ID NO: 207004 - RNA, 22 nt, Human
uuguuucaaauauuucagaaua

SEQ ID NO: 207005 - RNA, 22 nt, Human
cagcacagaguauuuuauugau

SEQ ID NO: 207006 - RNA, 22 nt, Human
acagccagguaaaggcauggca

SEQ ID NO: 207007 - RNA, 22 nt, Human
aauacaguagguaauaguucau

SEQ ID NO: 207008 - RNA, 19 nt, Human
ccaggccuccugggagguc

SEQ ID NO: 207009 - RNA, 22 nt, Human
ccuagggauguguuagccagau

SEQ ID NO: 207010 - RNA, 17 nt, Human
agcaaaaguaucaaagc

SEQ ID NO: 207011 - RNA, 22 nt, Human
gaucauuugcaggaaacauuaa

SEQ ID NO: 207012 - RNA, 18 nt, Human
aagaaucucugacucuuu

SEQ ID NO: 207013 - RNA, 22 nt, Human
cacuggaauagcauugauucuu

SEQ ID NO: 207014 - RNA, 22 nt, Human
uuuauuguugggucuuaagcug

SEQ ID NO: 207015 - RNA, 22 nt, Human
gccaggggacgcggagcgacga

SEQ ID NO: 207016 - RNA, 22 nt, Human
agcuuugugacuuugagcuagu

SEQ ID NO: 207017 - RNA, 22 nt, Human
caauagaaggcacagauaggua

SEQ ID NO: 207018 - RNA, 22 nt, Human
aauauggcuuguuacuauguuu

SEQ ID NO: 207019 - RNA, 22 nt, Human
ugucauuuucugguuaguuaau

SEQ ID NO: 207020 - RNA, 22 nt, Human
uccuggccucugagucaagaac

SEQ ID NO: 207021 - RNA, 22 nt, Human
aagaauuuuccagcaugucagu

SEQ ID NO: 207022 - RNA, 22 nt, Human
ggcucacgcaauuaucccggcc

SEQ ID NO: 207023 - RNA, 22 nt, Human
uuaaagagggaaagacuucaga

SEQ ID NO: 207024 - RNA, 22 nt, Human
ugcaggagcccuugggcucugg

SEQ ID NO: 207025 - RNA, 22 nt, Human
ugggagagauaggcuucuggac

SEQ ID NO: 207026 - RNA, 22 nt, Human
acaauuugaggcuacucaauug

SEQ ID NO: 207027 - RNA, 22 nt, Human
acaucaguccaccacugcaguu

SEQ ID NO: 207028 - RNA, 22 nt, Human
ucccagccauuccuuuaggugu

SEQ ID NO: 207029 - RNA, 22 nt, Human
ucucuguaagcugccuucucgu

SEQ ID NO: 207030 - RNA, 22 nt, Human
cauucauccacuguuggaaauu

SEQ ID NO: 207031 - RNA, 22 nt, Human
ugaggccaaugacccugggcag

SEQ ID NO: 207032 - RNA, 22 nt, Human
ccuggcagaaagaguuacaccu

SEQ ID NO: 207033 - RNA, 22 nt, Human
aggagguggcugaacuugaggg

SEQ ID NO: 207034 - RNA, 22 nt, Human
ccagccacugggccacugccag

SEQ ID NO: 207035 - RNA, 22 nt, Human
uaugaagauugcggucuggaau

SEQ ID NO: 207036 - RNA, 22 nt, Human
ggcaccaggcugggcauaggcc

SEQ ID NO: 207037 - RNA, 22 nt, Human
uccugugauauuguuuguuaua

SEQ ID NO: 207038 - RNA, 22 nt, Human
aacauaauguggccaaagucac

SEQ ID NO: 207039 - RNA, 22 nt, Human
cugaggcacuaacaaggacaag

SEQ ID NO: 207040 - RNA, 22 nt, Human
ucuggaggcaggcugccaggau

SEQ ID NO: 207041 - RNA, 21 nt, Human
ggccagcucggaaggucccau

SEQ ID NO: 207042 - RNA, 22 nt, Human
aggagccaguggaguuccugcc

SEQ ID NO: 207043 - RNA, 22 nt, Human
auacuacauuugaaaauugcag

SEQ ID NO: 207044 - RNA, 22 nt, Human
cucugggucaccaucggggauu

SEQ ID NO: 207045 - RNA, 22 nt, Human
aucugaaaagcuuuaaugagcu

SEQ ID NO: 207046 - RNA, 22 nt, Human
aaacaucuauuaugugcugagc

SEQ ID NO: 207047 - RNA, 22 nt, Human
gucuccagccauucucugauca

SEQ ID NO: 207048 - RNA, 18 nt, Human
ccaggccaugaaccucug

SEQ ID NO: 207049 - RNA, 22 nt, Human
uaggugucuugucacuaccguu

SEQ ID NO: 207050 - RNA, 22 nt, Human
aaauccuaaugacaaguuuagu

SEQ ID NO: 207051 - RNA, 22 nt, Human
cuuuggaaaguaagcagcuaga

SEQ ID NO: 207052 - RNA, 22 nt, Human
augcaagacauaaauaaucuuu

SEQ ID NO: 207053 - RNA, 22 nt, Human
uucaguaugauuccuccaguag

SEQ ID NO: 207054 - RNA, 22 nt, Human
ggagaggcuuggcccagccugg

SEQ ID NO: 207055 - RNA, 22 nt, Human
ugacagggagguggaauaagua

SEQ ID NO: 207056 - RNA, 22 nt, Human
guuauucuaccacuauguacag

SEQ ID NO: 207057 - RNA, 22 nt, Human
uacuacaagggcccuaaaaggu

SEQ ID NO: 207058 - RNA, 23 nt, Human
cucagaggccuguccaggguggu

SEQ ID NO: 207059 - RNA, 22 nt, Human
ccucuggggucuagcaauagca

SEQ ID NO: 207060 - RNA, 22 nt, Human
gugagcuggaauaguggagaaa

SEQ ID NO: 207061 - RNA, 22 nt, Human
gcucagcuacuuacagguggcu

SEQ ID NO: 207062 - RNA, 22 nt, Human
gaggcagugucgguggcaggau

SEQ ID NO: 207063 - RNA, 20 nt, Human
ggcugcugguuuggcucugu

SEQ ID NO: 207064 - RNA, 22 nt, Human
acucuguaucccucucaaauug

SEQ ID NO: 207065 - RNA, 22 nt, Human
guucugggagaucuugagcuuc

SEQ ID NO: 207066 - RNA, 22 nt, Human
gcacauggcggccagcagguga

SEQ ID NO: 207067 - RNA, 22 nt, Human
gucuuuggauguaagauaaagu

SEQ ID NO: 207068 - RNA, 20 nt, Human
ccugucucacguuccgcccc

SEQ ID NO: 207069 - RNA, 19 nt, Human
uuuuggcuggagugaucug

SEQ ID NO: 207070 - RNA, 23 nt, Human
gaagcccucauugguucuccaga

SEQ ID NO: 207071 - RNA, 22 nt, Human
ggugagaaagggauuccuguuc

SEQ ID NO: 207072 - RNA, 22 nt, Human
aggccuggcaugagaccugaga

SEQ ID NO: 207073 - RNA, 22 nt, Human
ucuaggaaauuguuacuauauu

SEQ ID NO: 207074 - RNA, 18 nt, Human
gcccagaggucugggccc

SEQ ID NO: 207075 - RNA, 22 nt, Human
aaagcagagaucauggcuugua

SEQ ID NO: 207076 - RNA, 22 nt, Human
uucaucuggaauuuauguuaua

SEQ ID NO: 207077 - RNA, 22 nt, Human
uacaccauucccagguggauuu

SEQ ID NO: 207078 - RNA, 22 nt, Human
ccugugacgugucuccuggcac

SEQ ID NO: 207079 - RNA, 22 nt, Human
ucugcccucgaggagcuugugu

SEQ ID NO: 207080 - RNA, 22 nt, Human
uccaggcccacucgguggggcu

SEQ ID NO: 207081 - RNA, 22 nt, Human
caccagcgacugugaccagcaa

SEQ ID NO: 207082 - RNA, 22 nt, Human
gcaggugguuaaggucccaugu

SEQ ID NO: 207083 - RNA, 22 nt, Human
ugacagaacagguugggagcaa

SEQ ID NO: 207084 - RNA, 23 nt, Human
uguguauguaucuaugcauaggu

SEQ ID NO: 207085 - RNA, 19 nt, Human
gguggcucagggcccagcc

SEQ ID NO: 207086 - RNA, 22 nt, Human
aacauugccaugguuaauuuua

SEQ ID NO: 207087 - RNA, 22 nt, Human
caugaauauuuaguauuuacuu

SEQ ID NO: 207088 - RNA, 22 nt, Human
uagcuuccagaauuuaauguca

SEQ ID NO: 207089 - RNA, 22 nt, Human
ucauauaccugcaugugcaugu

SEQ ID NO: 207090 - RNA, 22 nt, Human
aauguuaaaaccuucagugcuu

SEQ ID NO: 207091 - RNA, 22 nt, Human
agguuuauuaaguaaauagagc

SEQ ID NO: 207092 - RNA, 22 nt, Human
aaaagcagaccacgcuuugugg

SEQ ID NO: 207093 - RNA, 23 nt, Human
aggauaaacuaaacucauuuugg

SEQ ID NO: 207094 - RNA, 22 nt, Human
auuagagcuguuagugaagugc

SEQ ID NO: 207095 - RNA, 22 nt, Human
aauucccaccuucucucuuuug

SEQ ID NO: 207096 - RNA, 22 nt, Human
agcccagguugaggcugcagug

SEQ ID NO: 207097 - RNA, 22 nt, Human
cugaggcucccucgggucugcu

SEQ ID NO: 207098 - RNA, 23 nt, Human
agcccugcugagacccagcuccc

SEQ ID NO: 207099 - RNA, 22 nt, Human
ucuuuggaugcguuacuuuuac

SEQ ID NO: 207100 - RNA, 22 nt, Human
augauucuggugagaaugagga

SEQ ID NO: 207101 - RNA, 22 nt, Human
ugcaaauugcgauuuuuauuag

SEQ ID NO: 207102 - RNA, 21 nt, Human
aaacuagaguguggcaaagcu

SEQ ID NO: 207103 - RNA, 22 nt, Human
ccacccagccagaugcaggaag

SEQ ID NO: 207104 - RNA, 22 nt, Human
acaaugucucauauucguguuc

SEQ ID NO: 207105 - RNA, 22 nt, Human
gcagcuuucuuuuugcaugucu

SEQ ID NO: 207106 - RNA, 22 nt, Human
auugaaagauauacuguucuca

SEQ ID NO: 207107 - RNA, 22 nt, Human
aaggcuggucagauguggugaa

SEQ ID NO: 207108 - RNA, 22 nt, Human
gucccuggggaaucagcuggag

SEQ ID NO: 207109 - RNA, 23 nt, Human
uggacagcagcagcagugucacc

SEQ ID NO: 207110 - RNA, 22 nt, Human
ugaggcuuagagaauuaaguga

SEQ ID NO: 207111 - RNA, 22 nt, Human
ggucccaaggaggaugaggcua

SEQ ID NO: 207112 - RNA, 22 nt, Human
uaauacauguauuccagagagu

SEQ ID NO: 207113 - RNA, 22 nt, Human
acagcaaucugagagacauagu

SEQ ID NO: 207114 - RNA, 22 nt, Human
cugugaaugcuaguaagagugc

SEQ ID NO: 207115 - RNA, 22 nt, Human
cuuccugcaacaccuguguugc

SEQ ID NO: 207116 - RNA, 22 nt, Human
gcugagcuagcuaucucagucu

SEQ ID NO: 207117 - RNA, 22 nt, Human
acuugaaacaucuuuaaaugua

SEQ ID NO: 207118 - RNA, 22 nt, Human
cagggccucauggccggggugc

SEQ ID NO: 207119 - RNA, 22 nt, Human
ugcucagacuuaagaagaucag

SEQ ID NO: 207120 - RNA, 22 nt, Human
caacagaggaguggccugaucc

SEQ ID NO: 207121 - RNA, 22 nt, Human
aucugaagggaaguggaaggca

SEQ ID NO: 207122 - RNA, 22 nt, Human
ggagcugucuguagggcacagg

SEQ ID NO: 207123 - RNA, 22 nt, Human
agagaauucuggugcuaacaag

SEQ ID NO: 207124 - RNA, 22 nt, Human
aggagacauaacuaugaugaga

SEQ ID NO: 207125 - RNA, 22 nt, Human
cuccuuccccuacucagcaucc

SEQ ID NO: 207126 - RNA, 22 nt, Human
ugccuccaccauugcucacuuu

SEQ ID NO: 207127 - RNA, 22 nt, Human
gcuacagugauaggaaacacau

SEQ ID NO: 207128 - RNA, 21 nt, Human
uggcugaguggaugcaugaau

SEQ ID NO: 207129 - RNA, 22 nt, Human
uggagaaggggcagggucucca

SEQ ID NO: 207130 - RNA, 23 nt, Human
uuggaauauauuguuugacauag

SEQ ID NO: 207131 - RNA, 22 nt, Human
agcagcaccuguccucgcugcu

SEQ ID NO: 207132 - RNA, 22 nt, Human
ucuggggaauguucauuucuga

SEQ ID NO: 207133 - RNA, 22 nt, Human
uccucuggaaccucacccuugc

SEQ ID NO: 207134 - RNA, 22 nt, Human
ucuucuggaugagagcggaggc

SEQ ID NO: 207135 - RNA, 22 nt, Human
aggcuccugcaggugaggugcu

SEQ ID NO: 207136 - RNA, 22 nt, Human
aagggugguguaggagaucaaa

SEQ ID NO: 207137 - RNA, 22 nt, Human
ggcuccagaugucuccuggcaa

SEQ ID NO: 207138 - RNA, 22 nt, Human
uauaucagcaaagcauuuaaaa

SEQ ID NO: 207139 - RNA, 22 nt, Human
uuccagugaaacaugaggugug

SEQ ID NO: 207140 - RNA, 22 nt, Human
aguggcuuaucugggacagcua

SEQ ID NO: 207141 - RNA, 22 nt, Human
acagugcuuuuguuccucuccu

SEQ ID NO: 207142 - RNA, 20 nt, Human
aaaguguaagcauauaauua

SEQ ID NO: 207143 - RNA, 22 nt, Human
guaaaacugucuaaugguauau

SEQ ID NO: 207144 - RNA, 22 nt, Human
uuuaaacaaauaggauugccua

SEQ ID NO: 207145 - RNA, 22 nt, Human
acaucucaugaaugauaaauca

SEQ ID NO: 207146 - RNA, 22 nt, Human
uagauuugccugggaaagcuca

SEQ ID NO: 207147 - RNA, 22 nt, Human
uggggcagccacauagacaaca

SEQ ID NO: 207148 - RNA, 22 nt, Human
ccucucccgggugccgcugggc

SEQ ID NO: 207149 - RNA, 22 nt, Human
uaguguuccagaagcaaacaag

SEQ ID NO: 207150 - RNA, 20 nt, Human
ucucaggcccccuccuugcu

SEQ ID NO: 207151 - RNA, 22 nt, Human
ucaggcuguuagccaccuccuc

SEQ ID NO: 207152 - RNA, 22 nt, Human
uuuugaaagaguccugcuacag

SEQ ID NO: 207153 - RNA, 20 nt, Human
acaugcaguggucauuucag

SEQ ID NO: 207154 - RNA, 22 nt, Human
accuuauuuugaaauagauugu

SEQ ID NO: 207155 - RNA, 22 nt, Human
uuuaaaagggguauuaagucca

SEQ ID NO: 207156 - RNA, 22 nt, Human
cuuuccuaguaguuacagaaug

SEQ ID NO: 207157 - RNA, 22 nt, Human
uggauuaguuuaacaauguggc

SEQ ID NO: 207158 - RNA, 22 nt, Human
ccugagagggggcccuagaaau

SEQ ID NO: 207159 - RNA, 22 nt, Human
uggaugugagaaggaucaggcu

SEQ ID NO: 207160 - RNA, 22 nt, Human
ggcccugcugaguggaguggag

SEQ ID NO: 207161 - RNA, 22 nt, Human
cccaggagacauauagaaggac

SEQ ID NO: 207162 - RNA, 19 nt, Human
gaguccugugcuccuuguu

SEQ ID NO: 207163 - RNA, 22 nt, Human
uucagagauggaaggcagaaug

SEQ ID NO: 207164 - RNA, 22 nt, Human
aaggcaguaaaaucuaccuugc

SEQ ID NO: 207165 - RNA, 22 nt, Human
cuguacagaagcuagagcaaau

SEQ ID NO: 207166 - RNA, 22 nt, Human
uagccauuuuuauuaaugcugg

SEQ ID NO: 207167 - RNA, 22 nt, Human
uucugcauuuaaaauauuacua

SEQ ID NO: 207168 - RNA, 22 nt, Human
ccucucuguguggccucuccau

SEQ ID NO: 207169 - RNA, 22 nt, Human
gagcccagcucuaccucagacu

SEQ ID NO: 207170 - RNA, 20 nt, Human
uauuuugcaauuaugguuca

SEQ ID NO: 207171 - RNA, 22 nt, Human
uugcauuguaggauguuagaag

SEQ ID NO: 207172 - RNA, 19 nt, Human
aucugccuguuaucacaua

SEQ ID NO: 207173 - RNA, 22 nt, Human
ucagcuuugcaaguuagaaaau

SEQ ID NO: 207174 - RNA, 20 nt, Human
aggcucagauacccagggaa

SEQ ID NO: 207175 - RNA, 22 nt, Human
cucuuccucucaugcggucaua

SEQ ID NO: 207176 - RNA, 22 nt, Human
gcugggucuggaugcucaggug

SEQ ID NO: 207177 - RNA, 22 nt, Human
auuucccuccagggaaagcuua

SEQ ID NO: 207178 - RNA, 21 nt, Human
gacauccaugugaguggcagu

SEQ ID NO: 207179 - RNA, 22 nt, Human
ucuuugguugcacugcaggugu

SEQ ID NO: 207180 - RNA, 22 nt, Human
uggggucccacucagcuccccu

SEQ ID NO: 207181 - RNA, 22 nt, Human
uucaaaccuaucuaagaaauag

SEQ ID NO: 207182 - RNA, 22 nt, Human
acugugcaaaugacaggcacac

SEQ ID NO: 207183 - RNA, 22 nt, Human
uccuuuggagcuugacugguag

SEQ ID NO: 207184 - RNA, 22 nt, Human
agggccucuaccauccaagguu

SEQ ID NO: 207185 - RNA, 22 nt, Human
aaaggacuggauauuaaagagu

SEQ ID NO: 207186 - RNA, 22 nt, Human
agguccaucguggaugaacugc

SEQ ID NO: 207187 - RNA, 22 nt, Human
ggugcauggaaagaguaaguaa

SEQ ID NO: 207188 - RNA, 22 nt, Human
gagcacagggaauagacagaua

SEQ ID NO: 207189 - RNA, 22 nt, Human
ucuccccagcugagcugcccuu

SEQ ID NO: 207190 - RNA, 22 nt, Human
uguuuacuuuccuucucacagg

SEQ ID NO: 207191 - RNA, 22 nt, Human
ucacuguugaccuggaaguggg

SEQ ID NO: 207192 - RNA, 22 nt, Human
agaaggggcccaaggaugucag

SEQ ID NO: 207193 - RNA, 21 nt, Human
ugcuauuuaauuuuucuguuc

SEQ ID NO: 207194 - RNA, 22 nt, Human
aaucaaaaccuacagagguaau

SEQ ID NO: 207195 - RNA, 22 nt, Human
auacaugauacuuaguacguag

SEQ ID NO: 207196 - RNA, 21 nt, Human
cucugggccauuuucuuccac

SEQ ID NO: 207197 - RNA, 22 nt, Human
ccauccugaauggucucagcca

SEQ ID NO: 207198 - RNA, 22 nt, Human
ugccaggggaccuagggauguc

SEQ ID NO: 207199 - RNA, 22 nt, Human
gacugucuuguuucuaagauga

SEQ ID NO: 207200 - RNA, 22 nt, Human
agagaaggucacuaaggaccca

SEQ ID NO: 207201 - RNA, 22 nt, Human
ucuggcccaucuucugccacca

SEQ ID NO: 207202 - RNA, 22 nt, Human
gaaguacaguuuuaucuagcca

SEQ ID NO: 207203 - RNA, 22 nt, Human
augcaauaguaauucuagucug

SEQ ID NO: 207204 - RNA, 22 nt, Human
ggcacagcaagaagggaaauga

SEQ ID NO: 207205 - RNA, 22 nt, Human
uugcuaggauucauucuauacu

SEQ ID NO: 207206 - RNA, 22 nt, Human
ucagaggagccaaaguucugag

SEQ ID NO: 207207 - RNA, 22 nt, Human
ucuccagguucagucgauggaa

SEQ ID NO: 207208 - RNA, 22 nt, Human
uggucaggggcuucugagcugu

SEQ ID NO: 207209 - RNA, 20 nt, Human
acacacuuugaucuugagcc

SEQ ID NO: 207210 - RNA, 23 nt, Human
ucuccuccuagauacagucaugg

SEQ ID NO: 207211 - RNA, 22 nt, Human
guacuaagucaggagaagaauu

SEQ ID NO: 207212 - RNA, 17 nt, Human
uccagagcacagagcuc

SEQ ID NO: 207213 - RNA, 22 nt, Human
uugagaagaggcuuuguaggaa

SEQ ID NO: 207214 - RNA, 22 nt, Human
ugggcagagucguggggaauag

SEQ ID NO: 207215 - RNA, 22 nt, Human
cuguagguuugcucugaccugg

SEQ ID NO: 207216 - RNA, 22 nt, Human
ugagccuggccugcagagacca

SEQ ID NO: 207217 - RNA, 22 nt, Human
aagaaauguagagccuaguaaa

SEQ ID NO: 207218 - RNA, 22 nt, Human
ugggagaagcagugggacagua

SEQ ID NO: 207219 - RNA, 22 nt, Human
cacaucugacuuccagugcagg

SEQ ID NO: 207220 - RNA, 22 nt, Human
uucuauguggcaucaagcucag

SEQ ID NO: 207221 - RNA, 22 nt, Human
ugcugagguuucugacuaugga

SEQ ID NO: 207222 - RNA, 22 nt, Human
uuuguacauccuaauucugagu

SEQ ID NO: 207223 - RNA, 22 nt, Human
cuggagugaagucuggcagcuu

SEQ ID NO: 207224 - RNA, 22 nt, Human
ucagcuuugccaccagcuguaa

SEQ ID NO: 207225 - RNA, 22 nt, Human
ucagugcauuaauaauaucagu

SEQ ID NO: 207226 - RNA, 22 nt, Human
auggcccaagugcccugaccug

SEQ ID NO: 207227 - RNA, 22 nt, Human
caaaggaagcuccuugauggcg

SEQ ID NO: 207228 - RNA, 22 nt, Human
cuccuuccugguuagcaccuua

SEQ ID NO: 207229 - RNA, 22 nt, Human
ucucaggcuguguguggaggac

SEQ ID NO: 207230 - RNA, 22 nt, Human
aaaguccuuuuugccaugcaag

SEQ ID NO: 207231 - RNA, 22 nt, Human
gucuuuauauuuacuaaagaau

SEQ ID NO: 207232 - RNA, 22 nt, Human
guuacaaaggacugggggccac

SEQ ID NO: 207233 - RNA, 22 nt, Human
ucagaggaggcauuuaaacaga

SEQ ID NO: 207234 - RNA, 22 nt, Human
ugaggcuuagagaagaugggau

SEQ ID NO: 207235 - RNA, 22 nt, Human
gggcugagccacagcuuuuguu

SEQ ID NO: 207236 - RNA, 22 nt, Human
uccuucucugguuuuuacugua

SEQ ID NO: 207237 - RNA, 22 nt, Human
ugucauuuacuccauacccuca

SEQ ID NO: 207238 - RNA, 22 nt, Human
acauuuugcccuuauuugcuga

SEQ ID NO: 207239 - RNA, 22 nt, Human
ugagcagggagcugggcugagc

SEQ ID NO: 207240 - RNA, 22 nt, Human
uaauuaacauacaaaacagcug

SEQ ID NO: 207241 - RNA, 22 nt, Human
cagcacaauuuucaggagucca

SEQ ID NO: 207242 - RNA, 22 nt, Human
ugccugugaucagcugaguuca

SEQ ID NO: 207243 - RNA, 22 nt, Human
acagguggcuuauuggcugauu

SEQ ID NO: 207244 - RNA, 22 nt, Human
cauguucuaauauugugacaua

SEQ ID NO: 207245 - RNA, 22 nt, Human
ugcacagagagaugagacacgu

SEQ ID NO: 207246 - RNA, 21 nt, Human
aaaaggaggcaggugaacagc

SEQ ID NO: 207247 - RNA, 22 nt, Human
ggaggaagcccucggugcccca

SEQ ID NO: 207248 - RNA, 22 nt, Human
cucuagaaggucucccugccag

SEQ ID NO: 207249 - RNA, 22 nt, Human
aggaauguuaguucuguauaca

SEQ ID NO: 207250 - RNA, 22 nt, Human
cacaccagcauggucucagugu

SEQ ID NO: 207251 - RNA, 18 nt, Human
uaggccaguauacuuuuc

SEQ ID NO: 207252 - RNA, 22 nt, Human
gaauacaugauuaaaguuugau

SEQ ID NO: 207253 - RNA, 21 nt, Human
gggcagaggggccuccugggu

SEQ ID NO: 207254 - RNA, 22 nt, Human
agugauuuuaucaauuuacuca

SEQ ID NO: 207255 - RNA, 22 nt, Human
caauuagaggaggaagcucaua

SEQ ID NO: 207256 - RNA, 22 nt, Human
gggacagacccaugggccaggu

SEQ ID NO: 207257 - RNA, 22 nt, Human
uccuggcaaagauguugguguu

SEQ ID NO: 207258 - RNA, 22 nt, Human
cuccaaucugggcaacagagca

SEQ ID NO: 207259 - RNA, 19 nt, Human
ccuggcugugaagccugca

SEQ ID NO: 207260 - RNA, 22 nt, Human
augccagaccauccaguuggga

SEQ ID NO: 207261 - RNA, 22 nt, Human
cuuccuccgaagaaguugcugg

SEQ ID NO: 207262 - RNA, 20 nt, Human
ucauacacaugagcaugcag

SEQ ID NO: 207263 - RNA, 23 nt, Human
ugcacuucuccauagaugcaucu

SEQ ID NO: 207264 - RNA, 22 nt, Human
uagaaaugaauguuuaaaaguc

SEQ ID NO: 207265 - RNA, 22 nt, Human
ucacagaaggcaucacagaaga

SEQ ID NO: 207266 - RNA, 22 nt, Human
accuucaagauugugggucaau

SEQ ID NO: 207267 - RNA, 22 nt, Human
gaggaggcuaucagcaaucagg

SEQ ID NO: 207268 - RNA, 22 nt, Human
ucagagugaggcccagcaaucu

SEQ ID NO: 207269 - RNA, 22 nt, Human
aguggcagccgagcaggagaug

SEQ ID NO: 207270 - RNA, 22 nt, Human
auuccacauaggccuucaugac

SEQ ID NO: 207271 - RNA, 22 nt, Human
acacuuuacagaauguuuugau

SEQ ID NO: 207272 - RNA, 22 nt, Human
gcagagaacccagcagauuggc

SEQ ID NO: 207273 - RNA, 22 nt, Human
auuugauuagcuguguaauuuu

SEQ ID NO: 207274 - RNA, 22 nt, Human
uucuuuauagcuauuggaugag

SEQ ID NO: 207275 - RNA, 22 nt, Human
cucagcucugacaggaggcauc

SEQ ID NO: 207276 - RNA, 22 nt, Human
acaaguaccaaaugcucaagua

SEQ ID NO: 207277 - RNA, 22 nt, Human
caggcugacaacugagcauuuu

SEQ ID NO: 207278 - RNA, 23 nt, Human
caugacaaaggaucucaugggcc

SEQ ID NO: 207279 - RNA, 22 nt, Human
auuuggaacuuauaauaaguuu

SEQ ID NO: 207280 - RNA, 22 nt, Human
agccagggacgcugcaggcuac

SEQ ID NO: 207281 - RNA, 22 nt, Human
cacauuucuuauggauguuggc

SEQ ID NO: 207282 - RNA, 22 nt, Human
uagcuuuaggaugguucucuug

SEQ ID NO: 207283 - RNA, 18 nt, Human
gaugggguccaggcauag

SEQ ID NO: 207284 - RNA, 22 nt, Human
ggcagaguggagugcggccucc

SEQ ID NO: 207285 - RNA, 22 nt, Human
gcucagaggaugcuccuuuaug

SEQ ID NO: 207286 - RNA, 22 nt, Human
ucagaacagugccuggcacuaa

SEQ ID NO: 207287 - RNA, 22 nt, Human
acuuccagaggguguggaaaua

SEQ ID NO: 207288 - RNA, 22 nt, Human
aagcauguacaaugagugucuc

SEQ ID NO: 207289 - RNA, 22 nt, Human
ugaguucuaguggcugcagauu

SEQ ID NO: 207290 - RNA, 22 nt, Human
guaagccuggaauuuuugacuu

SEQ ID NO: 207291 - RNA, 23 nt, Human
aaacuugcuauggcugaaaucau

SEQ ID NO: 207292 - RNA, 22 nt, Human
ugaaguucacugagaguucacc

SEQ ID NO: 207293 - RNA, 22 nt, Human
agcccuggcagagccagguagu

SEQ ID NO: 207294 - RNA, 20 nt, Human
agcacauuaaacauacuccu

SEQ ID NO: 207295 - RNA, 22 nt, Human
acuguaagguaaggauaaaacc

SEQ ID NO: 207296 - RNA, 22 nt, Human
caacauguguuagacaauagac

SEQ ID NO: 207297 - RNA, 22 nt, Human
cagagacaaccugguagagaaa

SEQ ID NO: 207298 - RNA, 22 nt, Human
ccugagagagaagcgaccuggu

SEQ ID NO: 207299 - RNA, 22 nt, Human
uggcagaauuucuagcagauuc

SEQ ID NO: 207300 - RNA, 22 nt, Human
uucaccccaaauucccagugga

SEQ ID NO: 207301 - RNA, 22 nt, Human
agucacauggcagagagaaguu

SEQ ID NO: 207302 - RNA, 22 nt, Human
cuuuggaaaaauaccuggcaua

SEQ ID NO: 207303 - RNA, 22 nt, Human
ugcaggcugggaagagggacaa

SEQ ID NO: 207304 - RNA, 21 nt, Human
caauuacagauggcucagggg

SEQ ID NO: 207305 - RNA, 22 nt, Human
agagcugcaauuucauguggug

SEQ ID NO: 207306 - RNA, 22 nt, Human
uucuauguaguagcagagccaa

SEQ ID NO: 207307 - RNA, 22 nt, Human
ucuuccagcccuucuaauggua

SEQ ID NO: 207308 - RNA, 22 nt, Human
gagggcugaugcuuacuuauuu

SEQ ID NO: 207309 - RNA, 22 nt, Human
gacacagggacgugcucugccu

SEQ ID NO: 207310 - RNA, 23 nt, Human
guauuucagcauucucaguuaaa

SEQ ID NO: 207311 - RNA, 22 nt, Human
agagucaaguagggcaugggcu

SEQ ID NO: 207312 - RNA, 22 nt, Human
ugagucuagguagagaaaugca

SEQ ID NO: 207313 - RNA, 22 nt, Human
cuaauuauguuguuauaaucaa

SEQ ID NO: 207314 - RNA, 22 nt, Human
uugcuuuauuggguuuacugcc

SEQ ID NO: 207315 - RNA, 22 nt, Human
ccaucagacaauucuuucucuu

SEQ ID NO: 207316 - RNA, 23 nt, Human
auaauaauuauggcagcaaagug

SEQ ID NO: 207317 - RNA, 22 nt, Human
uaagacuucauuaguaauaugg

SEQ ID NO: 207318 - RNA, 22 nt, Human
aacaggcuccaugaacaacgug

SEQ ID NO: 207319 - RNA, 22 nt, Human
uggaaucuugcgggcacauggc

SEQ ID NO: 207320 - RNA, 20 nt, Human
cuagaagugccucaucuaga

SEQ ID NO: 207321 - RNA, 22 nt, Human
uucuucaaagaugucuguugga

SEQ ID NO: 207322 - RNA, 22 nt, Human
auccugggcaaaguaugcuguc

SEQ ID NO: 207323 - RNA, 23 nt, Human
gcuucccagacaauacugcuucc

SEQ ID NO: 207324 - RNA, 22 nt, Human
guguccaucucuguaugcugcu

SEQ ID NO: 207325 - RNA, 22 nt, Human
gaggcugggaaguccaagauca

SEQ ID NO: 207326 - RNA, 21 nt, Human
cauucacagucuggcucuuga

SEQ ID NO: 207327 - RNA, 22 nt, Human
cauuuaagagaaauauuuaguu

SEQ ID NO: 207328 - RNA, 22 nt, Human
ucugggagaguagauaaaggaa

SEQ ID NO: 207329 - RNA, 22 nt, Human
cauguguguccaugugacuaag

SEQ ID NO: 207330 - RNA, 22 nt, Human
agagccuguacuuuucugugaa

SEQ ID NO: 207331 - RNA, 22 nt, Human
ggagucugucaccuguuucucu

SEQ ID NO: 207332 - RNA, 22 nt, Human
agaagccaugguaugcaacuac

SEQ ID NO: 207333 - RNA, 22 nt, Human
gccacaugucaugugcucagua

SEQ ID NO: 207334 - RNA, 22 nt, Human
uguaaagacagauaaaacagca

SEQ ID NO: 207335 - RNA, 22 nt, Human
caguuuuugccauuaagaguaa

SEQ ID NO: 207336 - RNA, 22 nt, Human
gaguguguucuuuaugcuguga

SEQ ID NO: 207337 - RNA, 22 nt, Human
cagauggaacacagaaaggaga

SEQ ID NO: 207338 - RNA, 22 nt, Human
ucccugcaguaguggcuaagau

SEQ ID NO: 207339 - RNA, 22 nt, Human
augauauuuuaguaaagugaua

SEQ ID NO: 207340 - RNA, 22 nt, Human
ugcagcuucuuguccugugauu

SEQ ID NO: 207341 - RNA, 22 nt, Human
ugggaagacuccucaggaggcg

SEQ ID NO: 207342 - RNA, 22 nt, Human
auauacaaagggcaaccucgcu

SEQ ID NO: 207343 - RNA, 22 nt, Human
uauuaaagggaaguuaugcaug

SEQ ID NO: 207344 - RNA, 22 nt, Human
ucugggcacugcugagccugua

SEQ ID NO: 207345 - RNA, 22 nt, Human
cugcccucuagaggaggacuga

SEQ ID NO: 207346 - RNA, 22 nt, Human
agaaccuuggugagucuaaccu

SEQ ID NO: 207347 - RNA, 22 nt, Human
cugcagagcaaguaacauccuc

SEQ ID NO: 207348 - RNA, 22 nt, Human
cauagugacucaugccuauaau

SEQ ID NO: 207349 - RNA, 22 nt, Human
aaggucugaguuuugccaggcc

SEQ ID NO: 207350 - RNA, 22 nt, Human
ucugggugacccugggcaaggc

SEQ ID NO: 207351 - RNA, 22 nt, Human
gcuccuguuuguuuguuccuga

SEQ ID NO: 207352 - RNA, 22 nt, Human
gccagggugagggcugagaggu

SEQ ID NO: 207353 - RNA, 22 nt, Human
ucuguuuuugaggcuaucuucu

SEQ ID NO: 207354 - RNA, 22 nt, Human
aggaagugcuaagagaacauca

SEQ ID NO: 207355 - RNA, 22 nt, Human
ccagguggacaaggcuuucaca

SEQ ID NO: 207356 - RNA, 22 nt, Human
aaacagucugaugccaucugcc

SEQ ID NO: 207357 - RNA, 22 nt, Human
ucucugggagccaggaugacac

SEQ ID NO: 207358 - RNA, 21 nt, Human
uacagugagguguuaggaugu

SEQ ID NO: 207359 - RNA, 22 nt, Human
aaaaguauccacagcucaggag

SEQ ID NO: 207360 - RNA, 22 nt, Human
gaggggcucuuuaauaguaaca

SEQ ID NO: 207361 - RNA, 22 nt, Human
uugcagggcaaauggucagaua

SEQ ID NO: 207362 - RNA, 22 nt, Human
cuuaaaaucuggcaguuagcua

SEQ ID NO: 207363 - RNA, 22 nt, Human
aguuugccccgucacccuggug

SEQ ID NO: 207364 - RNA, 22 nt, Human
uuuucuguaagaggacuuuaau

SEQ ID NO: 207365 - RNA, 22 nt, Human
ccagggcaucacauccaguguu

SEQ ID NO: 207366 - RNA, 22 nt, Human
uuccauaauaggcuuaagugaa

SEQ ID NO: 207367 - RNA, 22 nt, Human
agagguauuagauuugcauagg

SEQ ID NO: 207368 - RNA, 22 nt, Human
aguauuuagagacacaagaugg

SEQ ID NO: 207369 - RNA, 22 nt, Human
uccuugggucagugagugaggu

SEQ ID NO: 207370 - RNA, 22 nt, Human
aagcacaucauguuguucagac

SEQ ID NO: 207371 - RNA, 22 nt, Human
acucagagucuguuugguaccu

SEQ ID NO: 207372 - RNA, 21 nt, Human
uccugccuuaguccagagcag

SEQ ID NO: 207373 - RNA, 22 nt, Human
uuuucaucucugcuuuguaccu

SEQ ID NO: 207374 - RNA, 22 nt, Human
ggggcagcuaccggaaguaggg

SEQ ID NO: 207375 - RNA, 22 nt, Human
ccaggacuuuaaguccagcacu

SEQ ID NO: 207376 - RNA, 22 nt, Human
augauggaggccgugauggacg

SEQ ID NO: 207377 - RNA, 22 nt, Human
cagaaagcucuuucaaucuugc

SEQ ID NO: 207378 - RNA, 22 nt, Human
aaguuccuaaagucagggguca

SEQ ID NO: 207379 - RNA, 22 nt, Human
ugcuccagaaaaacuugagacu

SEQ ID NO: 207380 - RNA, 22 nt, Human
uucuggaaguguuagaaucugg

SEQ ID NO: 207381 - RNA, 22 nt, Human
gaaggggguugcagucuagggu

SEQ ID NO: 207382 - RNA, 22 nt, Human
agagaacagacagaugcaauga

SEQ ID NO: 207383 - RNA, 21 nt, Human
cacaccaggcaugucuugagc

SEQ ID NO: 207384 - RNA, 22 nt, Human
uuauauuguguaauaagugaag

SEQ ID NO: 207385 - RNA, 22 nt, Human
aggcacagccucccccaacucc

SEQ ID NO: 207386 - RNA, 22 nt, Human
gggaagauaguguugagggccc

SEQ ID NO: 207387 - RNA, 22 nt, Human
uccaugcagaggagcugguggc

SEQ ID NO: 207388 - RNA, 22 nt, Human
agccuggaauuaaggaaaugca

SEQ ID NO: 207389 - RNA, 22 nt, Human
ccugggcaaaugccagagacaa

SEQ ID NO: 207390 - RNA, 22 nt, Human
aaugaaacuaguagaaucuuug

SEQ ID NO: 207391 - RNA, 22 nt, Human
cagggcaaagucuucuagaacc

SEQ ID NO: 207392 - RNA, 22 nt, Human
gcccagcagcugguggagaagg

SEQ ID NO: 207393 - RNA, 22 nt, Human
caggcuccacaggggaauccgg

SEQ ID NO: 207394 - RNA, 22 nt, Human
cugaaauuauuguuuaaucaaa

SEQ ID NO: 207395 - RNA, 22 nt, Human
aaucuuuuaggggauccugagg

SEQ ID NO: 207396 - RNA, 22 nt, Human
auguacauaaaauguauaauga

SEQ ID NO: 207397 - RNA, 22 nt, Human
gccccagccaaggugacacgaa

SEQ ID NO: 207398 - RNA, 22 nt, Human
uggggccagguggcugcagguc

SEQ ID NO: 207399 - RNA, 18 nt, Human
gcagggacacagggucac

SEQ ID NO: 207400 - RNA, 22 nt, Human
auguuuaaaggguugagaaaua

SEQ ID NO: 207401 - RNA, 22 nt, Human
uaaggcuuggacuucuccaacc

SEQ ID NO: 207402 - RNA, 22 nt, Human
ucuccuggcccugucgccaucu

SEQ ID NO: 207403 - RNA, 22 nt, Human
aguuacaguguucuauuacucu

SEQ ID NO: 207404 - RNA, 22 nt, Human
uuagacaggauguaugaaagcu

SEQ ID NO: 207405 - RNA, 18 nt, Human
aucugcuggcaggucugg

SEQ ID NO: 207406 - RNA, 23 nt, Human
ugcagggcaaguuagagacccca

SEQ ID NO: 207407 - RNA, 22 nt, Human
ccagaggagcauggccuugaga

SEQ ID NO: 207408 - RNA, 19 nt, Human
auagaaccugcaguuucaa

SEQ ID NO: 207409 - RNA, 22 nt, Human
gaagaagguggcccagggguag

SEQ ID NO: 207410 - RNA, 22 nt, Human
uuccuucuaauuuuacaccuga

SEQ ID NO: 207411 - RNA, 22 nt, Human
agaaggcugagacugggaugaa

SEQ ID NO: 207412 - RNA, 20 nt, Human
ggcagagggccugggagaag

SEQ ID NO: 207413 - RNA, 22 nt, Human
aggcucagauucacauuugguu

SEQ ID NO: 207414 - RNA, 22 nt, Human
cugcagagaccuaggucagguu

SEQ ID NO: 207415 - RNA, 22 nt, Human
agugcuuuauguuguugugcaa

SEQ ID NO: 207416 - RNA, 22 nt, Human
augaagucucuuuuucaugaga

SEQ ID NO: 207417 - RNA, 22 nt, Human
gggcuggaucuccugcaggcag

SEQ ID NO: 207418 - RNA, 22 nt, Human
gcagccacucucauuccacgug

SEQ ID NO: 207419 - RNA, 19 nt, Human
cagagagaccaaggcgcca

SEQ ID NO: 207420 - RNA, 23 nt, Human
aaaugacuaaauguucuuauaga

SEQ ID NO: 207421 - RNA, 22 nt, Human
ccuggcacagauccuucauaca

SEQ ID NO: 207422 - RNA, 22 nt, Human
uugcaaaugaccauugccacau

SEQ ID NO: 207423 - RNA, 22 nt, Human
cacccagggcugugccugccca

SEQ ID NO: 207424 - RNA, 22 nt, Human
agcagcaggauuuucguuggga

SEQ ID NO: 207425 - RNA, 22 nt, Human
ggaggccaccugaccugcuguu

SEQ ID NO: 207426 - RNA, 21 nt, Human
ucucugggcccuccugugggg

SEQ ID NO: 207427 - RNA, 22 nt, Human
acucaggccuccuucuguccuu

SEQ ID NO: 207428 - RNA, 19 nt, Human
agagaugcuaagagucuuu

SEQ ID NO: 207429 - RNA, 22 nt, Human
ucacugcuuucaaaaauuauug

SEQ ID NO: 207430 - RNA, 22 nt, Human
guagccauuggcaaugaagccu

SEQ ID NO: 207431 - RNA, 22 nt, Human
augggaguccaacaucaaggac

SEQ ID NO: 207432 - RNA, 22 nt, Human
aaauauuauugcuuaaggggag

SEQ ID NO: 207433 - RNA, 22 nt, Human
cagauuuaggucacuagaauuu

SEQ ID NO: 207434 - RNA, 22 nt, Human
ucugagagcuguagaagccuau

SEQ ID NO: 207435 - RNA, 22 nt, Human
gccaggcagccacccucugcga

SEQ ID NO: 207436 - RNA, 22 nt, Human
guauuuuuagguaaggaaagua

SEQ ID NO: 207437 - RNA, 22 nt, Human
ggggccagcaauguugaggaau

SEQ ID NO: 207438 - RNA, 22 nt, Human
aagaaagggagaaggauggugu

SEQ ID NO: 207439 - RNA, 22 nt, Human
cuuagaacauucugccugggaa

SEQ ID NO: 207440 - RNA, 19 nt, Human
uccagcagugcuugaaauc

SEQ ID NO: 207441 - RNA, 22 nt, Human
uuggcuucuggcagucuggacg

SEQ ID NO: 207442 - RNA, 22 nt, Human
ugugaaaagcaggcuacuuucu

SEQ ID NO: 207443 - RNA, 22 nt, Human
ugcugggugguugcuccucccg

SEQ ID NO: 207444 - RNA, 22 nt, Human
auucaaguccagcuucucuaca

SEQ ID NO: 207445 - RNA, 22 nt, Human
caccagcuugggcuguggaaau

SEQ ID NO: 207446 - RNA, 22 nt, Human
aguauucagcaaacgugaacag

SEQ ID NO: 207447 - RNA, 22 nt, Human
uucauucauucaugaauguuaa

SEQ ID NO: 207448 - RNA, 22 nt, Human
ucacaugagucacuaucuuaau

SEQ ID NO: 207449 - RNA, 22 nt, Human
ggcauagcggcucagcguccag

SEQ ID NO: 207450 - RNA, 22 nt, Human
ugcaucuuacguuuugaaaggg

SEQ ID NO: 207451 - RNA, 22 nt, Human
gggcuggcuaagacuuuucugu

SEQ ID NO: 207452 - RNA, 19 nt, Human
uuuuccuucuauauguuuc

SEQ ID NO: 207453 - RNA, 22 nt, Human
gaagacacuaaggcccagggag

SEQ ID NO: 207454 - RNA, 22 nt, Human
ugggucccaaacuccuagaggu

SEQ ID NO: 207455 - RNA, 22 nt, Human
aggaggcagucugucccuuagc

SEQ ID NO: 207456 - RNA, 19 nt, Human
ggaaggccacggcaggcuu

SEQ ID NO: 207457 - RNA, 22 nt, Human
gaaggccauuuuuagguagaau

SEQ ID NO: 207458 - RNA, 22 nt, Human
uacauuucagagcuccucucug

SEQ ID NO: 207459 - RNA, 22 nt, Human
uugguaaauuauuucuuccaau

SEQ ID NO: 207460 - RNA, 22 nt, Human
ggcuccagcccuggcucuucac

SEQ ID NO: 207461 - RNA, 22 nt, Human
ccagcaggagaugccugugucu

SEQ ID NO: 207462 - RNA, 22 nt, Human
ugagguaaauucuggcccaaac

SEQ ID NO: 207463 - RNA, 21 nt, Human
agagccugagaucuuccagca

SEQ ID NO: 207464 - RNA, 22 nt, Human
agggucagagaucggccaugug

SEQ ID NO: 207465 - RNA, 22 nt, Human
cccacagguggaagccucggaa

SEQ ID NO: 207466 - RNA, 22 nt, Human
agacugggguucuggcaaggag

SEQ ID NO: 207467 - RNA, 22 nt, Human
uggcagggaauacagauguuua

SEQ ID NO: 207468 - RNA, 22 nt, Human
gcccaggaaagauagggccuca

SEQ ID NO: 207469 - RNA, 22 nt, Human
ggguuccaaugaugagcaagag

SEQ ID NO: 207470 - RNA, 22 nt, Human
gcagaggcacagccccagauga

SEQ ID NO: 207471 - RNA, 22 nt, Human
agguggcucugacagcucuggu

SEQ ID NO: 207472 - RNA, 22 nt, Human
cagaacagaaguaaaauuuacc

SEQ ID NO: 207473 - RNA, 22 nt, Human
ugucauuuggacuuugguauua

SEQ ID NO: 207474 - RNA, 22 nt, Human
caaggccaaagggccacuguca

SEQ ID NO: 207475 - RNA, 22 nt, Human
aaacuucagugaaugacuuaug

SEQ ID NO: 207476 - RNA, 22 nt, Human
uccuggaguuuguaaggugagc

SEQ ID NO: 207477 - RNA, 22 nt, Human
caggcacgggggcauggccucu

SEQ ID NO: 207478 - RNA, 22 nt, Human
ugauuucucauauuguucaaaa

SEQ ID NO: 207479 - RNA, 22 nt, Human
gcaggccugguuuacaugguag

SEQ ID NO: 207480 - RNA, 22 nt, Human
gaaacacauaugaacaguugau

SEQ ID NO: 207481 - RNA, 20 nt, Human
ggcagggcaucaacagcucu

SEQ ID NO: 207482 - RNA, 22 nt, Human
aaaguguuaacacuggcuacuu

SEQ ID NO: 207483 - RNA, 22 nt, Human
auccugugcaaugacugcaucu

SEQ ID NO: 207484 - RNA, 21 nt, Human
aacuuuagaaagacugggaag

SEQ ID NO: 207485 - RNA, 22 nt, Human
caggaacacaaugagucucaaa

SEQ ID NO: 207486 - RNA, 22 nt, Human
caugagcauuuuggucuaguuu

SEQ ID NO: 207487 - RNA, 22 nt, Human
uuuaaauuuguguuuagagggu

SEQ ID NO: 207488 - RNA, 22 nt, Human
ucaagaaggaguuauuuauuca

SEQ ID NO: 207489 - RNA, 22 nt, Human
ugguccuggucaucugggcugg

SEQ ID NO: 207490 - RNA, 22 nt, Human
uacaagcugacccugaagauga

SEQ ID NO: 207491 - RNA, 22 nt, Human
gcuggcuggaugguugguucgc

SEQ ID NO: 207492 - RNA, 22 nt, Human
uucuacauauauuuuucucacu

SEQ ID NO: 207493 - RNA, 22 nt, Human
gaaugagggagauguuggugca

SEQ ID NO: 207494 - RNA, 22 nt, Human
cacugucugcuucgacucuuca

SEQ ID NO: 207495 - RNA, 22 nt, Human
uccaggcuaauuuugcauuguu

SEQ ID NO: 207496 - RNA, 22 nt, Human
gucucuuuuauggugaguugau

SEQ ID NO: 207497 - RNA, 22 nt, Human
caagcagggauacugcagggag

SEQ ID NO: 207498 - RNA, 22 nt, Human
cgcaggugaaagaggcugggca

SEQ ID NO: 207499 - RNA, 22 nt, Human
cccagcuucugagggggccuug

SEQ ID NO: 207500 - RNA, 22 nt, Human
uugaauaguuuuggauagcaua

SEQ ID NO: 207501 - RNA, 22 nt, Human
uaguggagaggauguggagaaa

SEQ ID NO: 207502 - RNA, 22 nt, Human
aagaugcagcuuuacaauaagg

SEQ ID NO: 207503 - RNA, 22 nt, Human
gaugcagcagccagcuucugaa

SEQ ID NO: 207504 - RNA, 22 nt, Human
ugcaucaaccuaauaucagcuc

SEQ ID NO: 207505 - RNA, 21 nt, Human
agugacucugaaccacuugaa

SEQ ID NO: 207506 - RNA, 22 nt, Human
uggaaugaauuuggcuuccucc

SEQ ID NO: 207507 - RNA, 22 nt, Human
caggaagccuuccuugucugcu

SEQ ID NO: 207508 - RNA, 22 nt, Human
uuacuugaaaaccaccaguauu

SEQ ID NO: 207509 - RNA, 22 nt, Human
guauaagguauguaaacuauuu

SEQ ID NO: 207510 - RNA, 22 nt, Human
auggaacaagaacucagauuua

SEQ ID NO: 207511 - RNA, 20 nt, Human
cugcaaaaugacauuaggaa

SEQ ID NO: 207512 - RNA, 22 nt, Human
guauacagauacuuagacgugc

SEQ ID NO: 207513 - RNA, 23 nt, Human
ucucagugaaucucagaauucgc

SEQ ID NO: 207514 - RNA, 22 nt, Human
guauagguuuggcucucuccag

SEQ ID NO: 207515 - RNA, 22 nt, Human
ggaggcagaacuucccgucagu

SEQ ID NO: 207516 - RNA, 22 nt, Human
agggcugcugcuccgggcccag

SEQ ID NO: 207517 - RNA, 22 nt, Human
ggcuuucuaugaacucaaaggc

SEQ ID NO: 207518 - RNA, 22 nt, Human
aauuagaagcuguuagcaaaau

SEQ ID NO: 207519 - RNA, 22 nt, Human
augggggccugaacaggcaaaa

SEQ ID NO: 207520 - RNA, 22 nt, Human
ccugcccaggagucucucugug

SEQ ID NO: 207521 - RNA, 22 nt, Human
aggcuuccuggaggaagaggua

SEQ ID NO: 207522 - RNA, 22 nt, Human
gaaaggcuuaaauuguaagggc

SEQ ID NO: 207523 - RNA, 17 nt, Human
ucucaggcacguguggc

SEQ ID NO: 207524 - RNA, 22 nt, Human
cuuuccagaccuccuuguagcu

SEQ ID NO: 207525 - RNA, 22 nt, Human
acugagcaggguuccgcaugga

SEQ ID NO: 207526 - RNA, 22 nt, Human
cuccugucccggggaccgccga

SEQ ID NO: 207527 - RNA, 22 nt, Human
aaaggagaaaacauacaggacu

SEQ ID NO: 207528 - RNA, 22 nt, Human
uaggaaaagcacaggauguucu

SEQ ID NO: 207529 - RNA, 22 nt, Human
gcugagggaccauguuucagga

SEQ ID NO: 207530 - RNA, 20 nt, Human
auuugcaucugaauaacuua

SEQ ID NO: 207531 - RNA, 22 nt, Human
gcucucagcccacugaggggaa

SEQ ID NO: 207532 - RNA, 22 nt, Human
ugucuucagcagucaucugggg

SEQ ID NO: 207533 - RNA, 22 nt, Human
aaacaagucacuuuaucuugaa

SEQ ID NO: 207534 - RNA, 22 nt, Human
ccuggcaggcaagaggaaggga

SEQ ID NO: 207535 - RNA, 22 nt, Human
aacagcuuuuuuggucagcauu

SEQ ID NO: 207536 - RNA, 22 nt, Human
augagagguuucgucagaggaa

SEQ ID NO: 207537 - RNA, 22 nt, Human
ugcaguuuuggccauugaaggc

SEQ ID NO: 207538 - RNA, 22 nt, Human
caacaucaguccucaugagaca

SEQ ID NO: 207539 - RNA, 22 nt, Human
aagcucagagguagauaauguu

SEQ ID NO: 207540 - RNA, 22 nt, Human
ucaugucagcuguugaugugca

SEQ ID NO: 207541 - RNA, 22 nt, Human
caugcagcaggaucucauuccc

SEQ ID NO: 207542 - RNA, 22 nt, Human
cagcacguugaaguagaguaag

SEQ ID NO: 207543 - RNA, 22 nt, Human
ccugagaaauagcaucauuuuu

SEQ ID NO: 207544 - RNA, 22 nt, Human
gaugcugacugaccaaaaggau

SEQ ID NO: 207545 - RNA, 22 nt, Human
uagacagauguuuucuggcugu

SEQ ID NO: 207546 - RNA, 22 nt, Human
ugcugcuguaucaugccuucau

SEQ ID NO: 207547 - RNA, 17 nt, Human
gucuggaguggccuuca

SEQ ID NO: 207548 - RNA, 22 nt, Human
ugcaaacaggagaguaaguaua

SEQ ID NO: 207549 - RNA, 22 nt, Human
uauucagaguguagcaaauaga

SEQ ID NO: 207550 - RNA, 19 nt, Human
uucugggcauucauauuua

SEQ ID NO: 207551 - RNA, 20 nt, Human
gaacuugggcaaguggcuua

SEQ ID NO: 207552 - RNA, 22 nt, Human
ugcugcucacacacagugaaug

SEQ ID NO: 207553 - RNA, 18 nt, Human
ggcaugugagugcugagg

SEQ ID NO: 207554 - RNA, 22 nt, Human
ggcugcaggaugcccagccgug

SEQ ID NO: 207555 - RNA, 20 nt, Human
ugguccaggaccuggugucc

SEQ ID NO: 207556 - RNA, 22 nt, Human
acugaacauaugcaagaccauu

SEQ ID NO: 207557 - RNA, 19 nt, Human
uaucaaucacggcaucuuu

SEQ ID NO: 207558 - RNA, 22 nt, Human
ccugggucuccuccugcuggcu

SEQ ID NO: 207559 - RNA, 22 nt, Human
uggagcagggcaucacugugcg

SEQ ID NO: 207560 - RNA, 22 nt, Human
caucaaaucugacuuuucuucc

SEQ ID NO: 207561 - RNA, 22 nt, Human
aaguauauuuagcugagcuugu

SEQ ID NO: 207562 - RNA, 22 nt, Human
cacauuccugagcuucgaccug

SEQ ID NO: 207563 - RNA, 22 nt, Human
agccagccccugacuguguccu

SEQ ID NO: 207564 - RNA, 22 nt, Human
uguauuuucugaagauaaucaa

SEQ ID NO: 207565 - RNA, 22 nt, Human
aucuaaacuauaguaccuaguc

SEQ ID NO: 207566 - RNA, 22 nt, Human
gcuucccacagcuggacugggg

SEQ ID NO: 207567 - RNA, 22 nt, Human
ucugggcuggcuuuaugcugac

SEQ ID NO: 207568 - RNA, 22 nt, Human
cagcuucuucaguccuggagcu

SEQ ID NO: 207569 - RNA, 21 nt, Human
aaacagagcugaguaauagau

SEQ ID NO: 207570 - RNA, 22 nt, Human
aacugcaagaguaaaugucuag

SEQ ID NO: 207571 - RNA, 22 nt, Human
aggcuggauuuauggggacuuc

SEQ ID NO: 207572 - RNA, 22 nt, Human
aaaagagagcugaggagcucca

SEQ ID NO: 207573 - RNA, 22 nt, Human
aaaaauguuaucuacuguccga

SEQ ID NO: 207574 - RNA, 22 nt, Human
ugagaugcugcuguaacaaaua

SEQ ID NO: 207575 - RNA, 22 nt, Human
aaggcugagacagcacaggucc

SEQ ID NO: 207576 - RNA, 20 nt, Human
ggaaaaaugcaugcucaaga

SEQ ID NO: 207577 - RNA, 22 nt, Human
gaggccugggagccuguccucc

SEQ ID NO: 207578 - RNA, 22 nt, Human
aggcugagcggggucccagagc

SEQ ID NO: 207579 - RNA, 22 nt, Human
cccagccaagugaucugaccgc

SEQ ID NO: 207580 - RNA, 22 nt, Human
gcagacaggcccaguggaggga

SEQ ID NO: 207581 - RNA, 22 nt, Human
ugucugugacagaccuuugcua

SEQ ID NO: 207582 - RNA, 22 nt, Human
ucuggcuccguguccgcuccca

SEQ ID NO: 207583 - RNA, 22 nt, Human
caggaacuggaacccuggccga

SEQ ID NO: 207584 - RNA, 22 nt, Human
aaucuuuaaggacucagucucu

SEQ ID NO: 207585 - RNA, 21 nt, Human
auucaguuugacaucuagcag

SEQ ID NO: 207586 - RNA, 22 nt, Human
aauggcaaaaggauaacaagga

SEQ ID NO: 207587 - RNA, 22 nt, Human
aggcacaguggcucacaccugu

SEQ ID NO: 207588 - RNA, 22 nt, Human
augaauugaggaaaacagucgu

SEQ ID NO: 207589 - RNA, 22 nt, Human
gcucucucuuggggauucagca

SEQ ID NO: 207590 - RNA, 22 nt, Human
acaggcaguugagguuugugug

SEQ ID NO: 207591 - RNA, 22 nt, Human
uuaagauuuguagagaaaaagc

SEQ ID NO: 207592 - RNA, 22 nt, Human
aggcucuguuugcugugguacc

SEQ ID NO: 207593 - RNA, 22 nt, Human
uacacuuguucaaacagcaaaa

SEQ ID NO: 207594 - RNA, 22 nt, Human
augaggcagguggaggcugcca

SEQ ID NO: 207595 - RNA, 22 nt, Human
ccagggagccuggugugucagc

SEQ ID NO: 207596 - RNA, 22 nt, Human
uuuaggaucaaugagaaagucu

SEQ ID NO: 207597 - RNA, 21 nt, Human
auaucacaaacauauggucug

SEQ ID NO: 207598 - RNA, 22 nt, Human
cagagcaguccuugucaaucag

SEQ ID NO: 207599 - RNA, 22 nt, Human
uacuguacugucuuuuuugcug

SEQ ID NO: 207600 - RNA, 22 nt, Human
cuggucagagcaacugcucaca

SEQ ID NO: 207601 - RNA, 22 nt, Human
aagcagguuaugaaauauagaa

SEQ ID NO: 207602 - RNA, 22 nt, Human
aacaguuugcuuuaagaggcac

SEQ ID NO: 207603 - RNA, 22 nt, Human
cuuagaacauacuuagugugau

SEQ ID NO: 207604 - RNA, 22 nt, Human
uuggggaagaguugacuuugga

SEQ ID NO: 207605 - RNA, 22 nt, Human
caaguccauccuacugccuucu

SEQ ID NO: 207606 - RNA, 22 nt, Human
agagucuuggcauucaugcguu

SEQ ID NO: 207607 - RNA, 22 nt, Human
auacauucaaaggaaggauaga

SEQ ID NO: 207608 - RNA, 22 nt, Human
ugcagcuguuacggacccuguc

SEQ ID NO: 207609 - RNA, 22 nt, Human
cccagcaguacccaagcccuug

SEQ ID NO: 207610 - RNA, 22 nt, Human
ugcacaccucuccaccacucuc

SEQ ID NO: 207611 - RNA, 22 nt, Human
ugagacacucucgggcacauuu

SEQ ID NO: 207612 - RNA, 22 nt, Human
acacaugugucugcaugcagug

SEQ ID NO: 207613 - RNA, 22 nt, Human
gcugacagcaaggggcugcccu

SEQ ID NO: 207614 - RNA, 22 nt, Human
ggcagaggaaggaugaauucac

SEQ ID NO: 207615 - RNA, 22 nt, Human
agaaaauuacuccagagacaag

SEQ ID NO: 207616 - RNA, 22 nt, Human
uggcaaagaugguucucaccau

SEQ ID NO: 207617 - RNA, 22 nt, Human
ccuggcucugcagccacuccag

SEQ ID NO: 207618 - RNA, 20 nt, Human
ucucccugcccaucucagau

SEQ ID NO: 207619 - RNA, 22 nt, Human
auacaguaauugcauaggcuuc

SEQ ID NO: 207620 - RNA, 20 nt, Human
gauggauuucaacaccuuuc

SEQ ID NO: 207621 - RNA, 22 nt, Human
aaaggugacacucugccagcug

SEQ ID NO: 207622 - RNA, 22 nt, Human
gcuaaauaaucuucuucugaca

SEQ ID NO: 207623 - RNA, 23 nt, Human
acuuucccauagcauggcuuccu

SEQ ID NO: 207624 - RNA, 22 nt, Human
uaucuagauauuuggauaaaug

SEQ ID NO: 207625 - RNA, 22 nt, Human
aagaagcacuuuccuacauguu

SEQ ID NO: 207626 - RNA, 22 nt, Human
gcuccaguggacugggggaggc

SEQ ID NO: 207627 - RNA, 22 nt, Human
uuacagcagugggaaggaguca

SEQ ID NO: 207628 - RNA, 22 nt, Human
uugcaaguuccuuaugagaauc

SEQ ID NO: 207629 - RNA, 22 nt, Human
gaggcagccucaguggaccucg

SEQ ID NO: 207630 - RNA, 23 nt, Human
gcaagcaaggcaggguaaagaga

SEQ ID NO: 207631 - RNA, 22 nt, Human
aguuuguaaguucauuaugagu

SEQ ID NO: 207632 - RNA, 22 nt, Human
uaacaguaaaguaaguuagcuu

SEQ ID NO: 207633 - RNA, 21 nt, Human
ugucagcucccuguccugugu

SEQ ID NO: 207634 - RNA, 18 nt, Human
uaaguaaggucauauggg

SEQ ID NO: 207635 - RNA, 22 nt, Human
gcuggccucgcaggcaggaugu

SEQ ID NO: 207636 - RNA, 22 nt, Human
aaaguacuuacaguaugcuugg

SEQ ID NO: 207637 - RNA, 22 nt, Human
ggagcugggaacuauguaguau

SEQ ID NO: 207638 - RNA, 22 nt, Human
aaguguuuaugguuauuguuaa

SEQ ID NO: 207639 - RNA, 22 nt, Human
gcgacuguacagaauugccccu

SEQ ID NO: 207640 - RNA, 22 nt, Human
ucagcagaggagugucuugccc

SEQ ID NO: 207641 - RNA, 22 nt, Human
cucuuaaagcuuccaguuucaa

SEQ ID NO: 207642 - RNA, 22 nt, Human
ccagcaggaaagugacguuuga

SEQ ID NO: 207643 - RNA, 22 nt, Human
aggccuugccaaugagagaacu

SEQ ID NO: 207644 - RNA, 22 nt, Human
ucagaaagacgaaacagauggg

SEQ ID NO: 207645 - RNA, 20 nt, Human
uuucagagugucuuuccauu

SEQ ID NO: 207646 - RNA, 22 nt, Human
agcacccucagccuuauccaga

SEQ ID NO: 207647 - RNA, 22 nt, Human
agagcugaauuuggguggugga

SEQ ID NO: 207648 - RNA, 22 nt, Human
ugccaaguggagcucaggaauc

SEQ ID NO: 207649 - RNA, 22 nt, Human
acugcagagguggggugcagag

SEQ ID NO: 207650 - RNA, 22 nt, Human
ccuggcucuucagagguuccua

SEQ ID NO: 207651 - RNA, 22 nt, Human
ugcugcagauugcagauuaacu

SEQ ID NO: 207652 - RNA, 22 nt, Human
guugcugggagcagggauccug

SEQ ID NO: 207653 - RNA, 21 nt, Human
acaggcuacaugcaggagcug

SEQ ID NO: 207654 - RNA, 22 nt, Human
cuggcuagcaccucagcucaga

SEQ ID NO: 207655 - RNA, 22 nt, Human
gcucaggaaggcucaaccagga

SEQ ID NO: 207656 - RNA, 22 nt, Human
ugcugggcccagggagccucug

SEQ ID NO: 207657 - RNA, 22 nt, Human
auggcauuguuuauagauugca

SEQ ID NO: 207658 - RNA, 22 nt, Human
gcacacagcuagauuaccauuc

SEQ ID NO: 207659 - RNA, 22 nt, Human
ucagaggacaagcucccuggug

SEQ ID NO: 207660 - RNA, 22 nt, Human
ugcuuuauuggaaccucauccu

SEQ ID NO: 207661 - RNA, 22 nt, Human
cagcaccauuugcagccucuuu

SEQ ID NO: 207662 - RNA, 22 nt, Human
cugugcugaacaauucugcauu

SEQ ID NO: 207663 - RNA, 22 nt, Human
aggggcggccugccugaagcag

SEQ ID NO: 207664 - RNA, 22 nt, Human
cugccaggcacgugcagcauca

SEQ ID NO: 207665 - RNA, 22 nt, Human
gcugggaagagaugcacaugau

SEQ ID NO: 207666 - RNA, 22 nt, Human
augucuguggcaauuguugaug

SEQ ID NO: 207667 - RNA, 20 nt, Human
aggaggaaaaaaugacgagc

SEQ ID NO: 207668 - RNA, 22 nt, Human
gagagcccucacuccuucccug

SEQ ID NO: 207669 - RNA, 22 nt, Human
gcugggagggaggcuauacccu

SEQ ID NO: 207670 - RNA, 22 nt, Human
auucuuauuuaaauagagucug

SEQ ID NO: 207671 - RNA, 22 nt, Human
aaacaaugacaacacagcugcg

SEQ ID NO: 207672 - RNA, 22 nt, Human
cuucuagagcuggagcaaaugu

SEQ ID NO: 207673 - RNA, 22 nt, Human
aagugucuucugauggggugug

SEQ ID NO: 207674 - RNA, 22 nt, Human
ucuggagaagcagugagaguca

SEQ ID NO: 207675 - RNA, 22 nt, Human
uguccaaugcccuuuccacaug

SEQ ID NO: 207676 - RNA, 22 nt, Human
acucagaggcuggaaaucaaag

SEQ ID NO: 207677 - RNA, 22 nt, Human
ucagacagaggagcucgugcag

SEQ ID NO: 207678 - RNA, 22 nt, Human
uguuuacauggagguuuucagc

SEQ ID NO: 207679 - RNA, 23 nt, Human
uuuuccagaaucgacucuguaga

SEQ ID NO: 207680 - RNA, 22 nt, Human
auagcaaauauuuuaaugagca

SEQ ID NO: 207681 - RNA, 20 nt, Human
auauuucagguagugugccc

SEQ ID NO: 207682 - RNA, 22 nt, Human
ccucucucuuguagucccugcc

SEQ ID NO: 207683 - RNA, 22 nt, Human
ccuguucaagggaugauugacc

SEQ ID NO: 207684 - RNA, 23 nt, Human
ucagagaaugguaugcuuuuccu

SEQ ID NO: 207685 - RNA, 22 nt, Human
gugugcagaggcaggaggugcu

SEQ ID NO: 207686 - RNA, 22 nt, Human
ugcauguguuugccacagugag

SEQ ID NO: 207687 - RNA, 22 nt, Human
cuccaggcucguccaagaucga

SEQ ID NO: 207688 - RNA, 21 nt, Human
gugcaugcgccgcugagaugc

SEQ ID NO: 207689 - RNA, 22 nt, Human
ucucccagaggaucccagugga

SEQ ID NO: 207690 - RNA, 19 nt, Human
ggcucucccuugagagagc

SEQ ID NO: 207691 - RNA, 22 nt, Human
caaagcagaagguucuguggua

SEQ ID NO: 207692 - RNA, 22 nt, Human
cccaggguggaugcaagcagca

SEQ ID NO: 207693 - RNA, 22 nt, Human
uccuggcccaaucugcccauga

SEQ ID NO: 207694 - RNA, 18 nt, Human
gagcugagaagaggaugc

SEQ ID NO: 207695 - RNA, 22 nt, Human
cugagggagaagugaucucuac

SEQ ID NO: 207696 - RNA, 22 nt, Human
gcuggagaccucagagaaccca

SEQ ID NO: 207697 - RNA, 23 nt, Human
ccuccugggcacaggccugaugg

SEQ ID NO: 207698 - RNA, 22 nt, Human
acuuagaauauguucaagauuu

SEQ ID NO: 207699 - RNA, 22 nt, Human
uugaauuauauguauguccuuu

SEQ ID NO: 207700 - RNA, 22 nt, Human
aagaguuuuuggagugugaguu

SEQ ID NO: 207701 - RNA, 22 nt, Human
uccauauaaugggauuccuuau

SEQ ID NO: 207702 - RNA, 22 nt, Human
cagagacacuuaacaggaaugg

SEQ ID NO: 207703 - RNA, 22 nt, Human
agaaaaaucuuggcgcuugucu

SEQ ID NO: 207704 - RNA, 22 nt, Human
uaguggaggguguagcugcugg

SEQ ID NO: 207705 - RNA, 22 nt, Human
gaagugacagaagggaugggca

SEQ ID NO: 207706 - RNA, 20 nt, Human
uaucuuacuuuagucauuug

SEQ ID NO: 207707 - RNA, 22 nt, Human
gggaaacuagaagcaggguuau

SEQ ID NO: 207708 - RNA, 22 nt, Human
cagccucuuuccacaucaggca

SEQ ID NO: 207709 - RNA, 23 nt, Human
uagauccuauggcugugugcaga

SEQ ID NO: 207710 - RNA, 22 nt, Human
ugagcaccaggcaccacagcuc

SEQ ID NO: 207711 - RNA, 22 nt, Human
guuagaauaaaaggucagagag

SEQ ID NO: 207712 - RNA, 22 nt, Human
ucagacaggccucuccagccuc

SEQ ID NO: 207713 - RNA, 22 nt, Human
ccaggcucagcgcgcacgucug

SEQ ID NO: 207714 - RNA, 22 nt, Human
ucucaucuucauaucugaaaga

SEQ ID NO: 207715 - RNA, 22 nt, Human
aauuacugaugccuguguucca

SEQ ID NO: 207716 - RNA, 22 nt, Human
uguccuggaucaugccucugaa

SEQ ID NO: 207717 - RNA, 22 nt, Human
aacuggaaggauugcagauguc

SEQ ID NO: 207718 - RNA, 22 nt, Human
cacugcccaggaccugccaccc

SEQ ID NO: 207719 - RNA, 22 nt, Human
agugacagggaaaaugacacug

SEQ ID NO: 207720 - RNA, 22 nt, Human
guagggcauagagauguuggca

SEQ ID NO: 207721 - RNA, 18 nt, Human
gccagugcccuggcucac

SEQ ID NO: 207722 - RNA, 22 nt, Human
ugcugcaggaauucucaaggga

SEQ ID NO: 207723 - RNA, 22 nt, Human
uaaaggaacugcugcuauggaa

SEQ ID NO: 207724 - RNA, 22 nt, Human
ccuguacagugaaugaauguga

SEQ ID NO: 207725 - RNA, 22 nt, Human
cugagagaaucaugcugcaggu

SEQ ID NO: 207726 - RNA, 22 nt, Human
uaggaaauugccaauauaugac

SEQ ID NO: 207727 - RNA, 22 nt, Human
ugcauuuuuaacaaggcuaauu

SEQ ID NO: 207728 - RNA, 22 nt, Human
uagaaacaucagcuaaccaaaa

SEQ ID NO: 207729 - RNA, 22 nt, Human
cuccuuccaacaagagaaagag

SEQ ID NO: 207730 - RNA, 17 nt, Human
uccuuucuuuaccuguu

SEQ ID NO: 207731 - RNA, 22 nt, Human
acauuucuucccuuuagcagaa

SEQ ID NO: 207732 - RNA, 22 nt, Human
acugcccauuaaaggugcuuug

SEQ ID NO: 207733 - RNA, 22 nt, Human
aguguagaaggagaaauggauc

SEQ ID NO: 207734 - RNA, 22 nt, Human
acuccaaaaccugcggcuuggu

SEQ ID NO: 207735 - RNA, 22 nt, Human
ccaggcucugagccucacucuu

SEQ ID NO: 207736 - RNA, 22 nt, Human
aaaauuguaggaacugaaucaa

SEQ ID NO: 207737 - RNA, 22 nt, Human
gguggagcuggaccaggagagg

SEQ ID NO: 207738 - RNA, 22 nt, Human
uuguuuugcuaaagggucauca

SEQ ID NO: 207739 - RNA, 22 nt, Human
uagggcuccacucccagagauu

SEQ ID NO: 207740 - RNA, 22 nt, Human
ccuccugggacucauuagcacc

SEQ ID NO: 207741 - RNA, 22 nt, Human
gcguccagggaaggcccagcug

SEQ ID NO: 207742 - RNA, 22 nt, Human
gccaggcugaggcucuggaaga

SEQ ID NO: 207743 - RNA, 22 nt, Human
uuucagaaauuguuauuauucu

SEQ ID NO: 207744 - RNA, 22 nt, Human
ugccucugguuaucugguaccu

SEQ ID NO: 207745 - RNA, 22 nt, Human
ggaucugggguagagcaguggg

SEQ ID NO: 207746 - RNA, 22 nt, Human
caugacaauauguucuuucauu

SEQ ID NO: 207747 - RNA, 22 nt, Human
ccuagagugauugagagcauca

SEQ ID NO: 207748 - RNA, 22 nt, Human
agacagacguagugugagagua

SEQ ID NO: 207749 - RNA, 22 nt, Human
cauaaugucugacacaguaaga

SEQ ID NO: 207750 - RNA, 22 nt, Human
cucucagggacccagccagccu

SEQ ID NO: 207751 - RNA, 22 nt, Human
gcugacucagaugcagcuggau

SEQ ID NO: 207752 - RNA, 20 nt, Human
aaaagcagccagagauggua

SEQ ID NO: 207753 - RNA, 22 nt, Human
cagaggcagugggguugcuccu

SEQ ID NO: 207754 - RNA, 22 nt, Human
caucuguaggugacacaugagu

SEQ ID NO: 207755 - RNA, 19 nt, Human
ggccugaggccacagaucc

SEQ ID NO: 207756 - RNA, 22 nt, Human
augauugcagcccuacagcugu

SEQ ID NO: 207757 - RNA, 22 nt, Human
ggucuggcaggugaggacucag

SEQ ID NO: 207758 - RNA, 22 nt, Human
aguuguauacacuuaggcagau

SEQ ID NO: 207759 - RNA, 22 nt, Human
ugaaggcagcaugcacacuagu

SEQ ID NO: 207760 - RNA, 20 nt, Human
acuccagguggcaugaggac

SEQ ID NO: 207761 - RNA, 22 nt, Human
aaauacauuuacagucguggcu

SEQ ID NO: 207762 - RNA, 22 nt, Human
uccauuuuucaugacuccucaa

SEQ ID NO: 207763 - RNA, 22 nt, Human
uucucaggguagaggugacacu

SEQ ID NO: 207764 - RNA, 23 nt, Human
ugagcccaggaggucaaggcugc

SEQ ID NO: 207765 - RNA, 22 nt, Human
uaaugauauuucccauuucucu

SEQ ID NO: 207766 - RNA, 22 nt, Human
ggcagccauggacacuggcuag

SEQ ID NO: 207767 - RNA, 22 nt, Human
ugugagcuuaggacagggcuau

SEQ ID NO: 207768 - RNA, 22 nt, Human
cggggcagaaaguugucuuuug

SEQ ID NO: 207769 - RNA, 22 nt, Human
cuggaagaacuccaguucugug

SEQ ID NO: 207770 - RNA, 22 nt, Human
gcuggcagggugguugagagag

SEQ ID NO: 207771 - RNA, 22 nt, Human
auacuuucugaccaauuaauug

SEQ ID NO: 207772 - RNA, 22 nt, Human
guccuggaguggcauggcaugg

SEQ ID NO: 207773 - RNA, 22 nt, Human
agccccucuguggcucugccuc

SEQ ID NO: 207774 - RNA, 20 nt, Human
caccuggcugacugucucca

SEQ ID NO: 207775 - RNA, 22 nt, Human
uuuagaauuggcuagugggaau

SEQ ID NO: 207776 - RNA, 23 nt, Human
uugaaaaauauagucccauuguc

SEQ ID NO: 207777 - RNA, 22 nt, Human
cacagcugaaguagccaugugg

SEQ ID NO: 207778 - RNA, 22 nt, Human
uguguauguaagcaugugcaua

SEQ ID NO: 207779 - RNA, 20 nt, Human
aggcugaguucuaugcacuu

SEQ ID NO: 207780 - RNA, 22 nt, Human
cauaaaagguagcaguuugaaa

SEQ ID NO: 207781 - RNA, 22 nt, Human
auuacaauaauacaugcucauu

SEQ ID NO: 207782 - RNA, 22 nt, Human
aagaugaaucaguauguguccu

SEQ ID NO: 207783 - RNA, 22 nt, Human
gucagcaggguccccuugagug

SEQ ID NO: 207784 - RNA, 22 nt, Human
ccagcuuuuagugggcuuauua

SEQ ID NO: 207785 - RNA, 22 nt, Human
accaggagccacaggaggagcc

SEQ ID NO: 207786 - RNA, 21 nt, Human
ucaggcugucugcugguucca

SEQ ID NO: 207787 - RNA, 22 nt, Human
gcaggcugcccucuuguguuga

SEQ ID NO: 207788 - RNA, 22 nt, Human
uauccacacugggauguuuuga

SEQ ID NO: 207789 - RNA, 22 nt, Human
agcuccaagguugaggagugag

SEQ ID NO: 207790 - RNA, 22 nt, Human
aauuagaagggaguuauugaua

SEQ ID NO: 207791 - RNA, 22 nt, Human
gccugccuucggugcgcagcgg

SEQ ID NO: 207792 - RNA, 22 nt, Human
cccaggcuggggcuccuccagc

SEQ ID NO: 207793 - RNA, 22 nt, Human
aggagcaaaugaugagacagca

SEQ ID NO: 207794 - RNA, 22 nt, Human
gcuguucagaugcgauucagga

SEQ ID NO: 207795 - RNA, 17 nt, Human
gcugagaaggggaagag

SEQ ID NO: 207796 - RNA, 22 nt, Human
agcacagagguggaaguguaua

SEQ ID NO: 207797 - RNA, 22 nt, Human
aucuuuuaugagcguucugaca

SEQ ID NO: 207798 - RNA, 22 nt, Human
aagagaugauggcagccagagg

SEQ ID NO: 207799 - RNA, 22 nt, Human
ggcugucucugugacugccacc

SEQ ID NO: 207800 - RNA, 22 nt, Human
cuugagaagcauuaagagguag

SEQ ID NO: 207801 - RNA, 22 nt, Human
gagcaaacaucagugaugucug

SEQ ID NO: 207802 - RNA, 22 nt, Human
aaacaugcuggauuuagaauau

SEQ ID NO: 207803 - RNA, 19 nt, Human
accaggaguaucagagcug

SEQ ID NO: 207804 - RNA, 22 nt, Human
aguaucagaugugauuaaaggg

SEQ ID NO: 207805 - RNA, 22 nt, Human
gaccucagcuguggggaugcug

SEQ ID NO: 207806 - RNA, 22 nt, Human
ggaggugaucagaguuuugagg

SEQ ID NO: 207807 - RNA, 22 nt, Human
uuuaugagcaaugcugagggga

SEQ ID NO: 207808 - RNA, 22 nt, Human
aaagaaaccuaucagccacaug

SEQ ID NO: 207809 - RNA, 20 nt, Human
gcucaggugacagucaggag

SEQ ID NO: 207810 - RNA, 22 nt, Human
gaggcuggggucugccuuucug

SEQ ID NO: 207811 - RNA, 22 nt, Human
ugaaauaauaucuggaucaauc

SEQ ID NO: 207812 - RNA, 22 nt, Human
gauugucacucccuauauggua

SEQ ID NO: 207813 - RNA, 22 nt, Human
aggcuucuccacauaaaguuac

SEQ ID NO: 207814 - RNA, 22 nt, Human
gaaaaguauguuuauuuugacu

SEQ ID NO: 207815 - RNA, 22 nt, Human
ucacugcucuccaauguggagu

SEQ ID NO: 207816 - RNA, 22 nt, Human
uuugcauuguaauauuuaguuc

SEQ ID NO: 207817 - RNA, 22 nt, Human
gaggacagugugaucugccagc

SEQ ID NO: 207818 - RNA, 22 nt, Human
aaaguuuuagcuguccaguucc

SEQ ID NO: 207819 - RNA, 22 nt, Human
caccaggcugcccaggacaggg

SEQ ID NO: 207820 - RNA, 22 nt, Human
ggcagcaugggugccuuuguga

SEQ ID NO: 207821 - RNA, 23 nt, Human
ucuuuucaaugguucuuuaugug

SEQ ID NO: 207822 - RNA, 22 nt, Human
gugcuccauugucuagaacugg

SEQ ID NO: 207823 - RNA, 22 nt, Human
ccugugcauugaguuugcaccc

SEQ ID NO: 207824 - RNA, 22 nt, Human
cugcuguccaaccugcacucgc

SEQ ID NO: 207825 - RNA, 22 nt, Human
caguccagagcccaccagagga

SEQ ID NO: 207826 - RNA, 22 nt, Human
uccugggagaguuugauucauu

SEQ ID NO: 207827 - RNA, 22 nt, Human
cucuucaauagauuguugaggg

SEQ ID NO: 207828 - RNA, 20 nt, Human
cagaaagcauguuccagggc

SEQ ID NO: 207829 - RNA, 22 nt, Human
agagcugaauucaagugcuggc

SEQ ID NO: 207830 - RNA, 22 nt, Human
augcagaaggagccaugcuugc

SEQ ID NO: 207831 - RNA, 22 nt, Human
accucagagaccucucaggugc

SEQ ID NO: 207832 - RNA, 22 nt, Human
uggaagcaucacuucuugccug

SEQ ID NO: 207833 - RNA, 22 nt, Human
gaugggcguggcgcguuuggug

SEQ ID NO: 207834 - RNA, 22 nt, Human
gccagggggucagcaggcacuu

SEQ ID NO: 207835 - RNA, 22 nt, Human
cuugcuuuccaaaugacucacu

SEQ ID NO: 207836 - RNA, 22 nt, Human
aauccauuaaaaacaagcgcau

SEQ ID NO: 207837 - RNA, 23 nt, Human
gggaccugguaggaggugauugg

SEQ ID NO: 207838 - RNA, 22 nt, Human
ucuggcucaggagcuguguuca

SEQ ID NO: 207839 - RNA, 22 nt, Human
ccaguuucuuaaguaggaagaa

SEQ ID NO: 207840 - RNA, 22 nt, Human
ucuguagucucugauauaucug

SEQ ID NO: 207841 - RNA, 22 nt, Human
acucuuauggaaauuuuaacua

SEQ ID NO: 207842 - RNA, 22 nt, Human
guuucgucaggcuuauucuauc

SEQ ID NO: 207843 - RNA, 23 nt, Human
uuuuauugauauguagcuguugu

SEQ ID NO: 207844 - RNA, 22 nt, Human
auucagagauuguuauucagac

SEQ ID NO: 207845 - RNA, 22 nt, Human
cagcucuucagugccugagaua

SEQ ID NO: 207846 - RNA, 22 nt, Human
acagaugaggaauuuauuuggu

SEQ ID NO: 207847 - RNA, 22 nt, Human
accauguguuuuacacauggua

SEQ ID NO: 207848 - RNA, 22 nt, Human
ugcccuguggggauuuccagcc

SEQ ID NO: 207849 - RNA, 22 nt, Human
gcagugcugaucccauggcaga

SEQ ID NO: 207850 - RNA, 22 nt, Human
agcuccagagccacauccauca

SEQ ID NO: 207851 - RNA, 22 nt, Human
ucacacagauugguagagcuga

SEQ ID NO: 207852 - RNA, 18 nt, Human
ugagcaggggcugaccuu

SEQ ID NO: 207853 - RNA, 17 nt, Human
uaaauacacaaggguau

SEQ ID NO: 207854 - RNA, 22 nt, Human
gcugggcaacggaagagagaaa

SEQ ID NO: 207855 - RNA, 22 nt, Human
auucuaagucuuguucacauuc

SEQ ID NO: 207856 - RNA, 22 nt, Human
acugugugcuggacaugauguu

SEQ ID NO: 207857 - RNA, 22 nt, Human
gggcuccaucacaggcuccauc

SEQ ID NO: 207858 - RNA, 22 nt, Human
ugucaacugugaugucaacacu

SEQ ID NO: 207859 - RNA, 22 nt, Human
ucucugucugcacccaaucaau

SEQ ID NO: 207860 - RNA, 22 nt, Human
uaagcaaucuaaaagccuuacc

SEQ ID NO: 207861 - RNA, 15 nt, Human
agacagacaguggga

SEQ ID NO: 207862 - RNA, 22 nt, Human
gacacagacaguuagagguaau

SEQ ID NO: 207863 - RNA, 22 nt, Human
ggaggggaacuaaucccgugac

SEQ ID NO: 207864 - RNA, 22 nt, Human
uaggcucauuaaguccccaggg

SEQ ID NO: 207865 - RNA, 22 nt, Human
ccuguucacgguguguuguuag

SEQ ID NO: 207866 - RNA, 22 nt, Human
caaugucaaggagaccaaaacg

SEQ ID NO: 207867 - RNA, 22 nt, Human
ccuuggcccuagccucaggcaa

SEQ ID NO: 207868 - RNA, 22 nt, Human
agccuggccugggcaggcacau

SEQ ID NO: 207869 - RNA, 22 nt, Human
aagacauuguggagauguugcu

SEQ ID NO: 207870 - RNA, 22 nt, Human
aguuagaauauaauuauguuaa

SEQ ID NO: 207871 - RNA, 22 nt, Human
caguuuccugaagagaaagaau

SEQ ID NO: 207872 - RNA, 22 nt, Human
acaauaacuucuguuuccuugc

SEQ ID NO: 207873 - RNA, 22 nt, Human
uuguacagaaacugcauuugga

SEQ ID NO: 207874 - RNA, 21 nt, Human
caagacauaugaguacucugg

SEQ ID NO: 207875 - RNA, 22 nt, Human
gaaaggcuaugaguuugguaua

SEQ ID NO: 207876 - RNA, 22 nt, Human
gauugcugccagcguguccgug

SEQ ID NO: 207877 - RNA, 22 nt, Human
ccagcuggggaaguggggcaua

SEQ ID NO: 207878 - RNA, 22 nt, Human
ggaggcagaauagagugugggu

SEQ ID NO: 207879 - RNA, 22 nt, Human
agugcaggcucgcuugugaggc

SEQ ID NO: 207880 - RNA, 18 nt, Human
uaggagagaauuuauuua

SEQ ID NO: 207881 - RNA, 22 nt, Human
gauaaacaugaaguucugugua

SEQ ID NO: 207882 - RNA, 22 nt, Human
ucaaugagcuggggacguguac

SEQ ID NO: 207883 - RNA, 22 nt, Human
ucaggaagugccuaggcuggcc

SEQ ID NO: 207884 - RNA, 21 nt, Human
auuccacuuuuccuucaggga

SEQ ID NO: 207885 - RNA, 22 nt, Human
uauguuacucacauguucuugc

SEQ ID NO: 207886 - RNA, 22 nt, Human
guggcaggucccauuggagcag

SEQ ID NO: 207887 - RNA, 20 nt, Human
caaguguuauugugcauuua

SEQ ID NO: 207888 - RNA, 22 nt, Human
uagaacuugauagacaguacaa

SEQ ID NO: 207889 - RNA, 22 nt, Human
agcuuucucucagccaggcugc

SEQ ID NO: 207890 - RNA, 22 nt, Human
aaagaacaaaugauauaugguu

SEQ ID NO: 207891 - RNA, 22 nt, Human
cucaggcugguuuggguuguuu

SEQ ID NO: 207892 - RNA, 22 nt, Human
gaacuguguacauuguagauaa

SEQ ID NO: 207893 - RNA, 22 nt, Human
uuuggaaagugugauuucaagg

SEQ ID NO: 207894 - RNA, 22 nt, Human
uguggggacugaguggaggcuu

SEQ ID NO: 207895 - RNA, 22 nt, Human
gcagaggccuagguggaaggcc

SEQ ID NO: 207896 - RNA, 18 nt, Human
guuucaugcaugugaaac

SEQ ID NO: 207897 - RNA, 20 nt, Human
auuagcucaggugaggucau

SEQ ID NO: 207898 - RNA, 17 nt, Human
guccuacccauggucua

SEQ ID NO: 207899 - RNA, 22 nt, Human
uuccugagaaauuuguaccugg

SEQ ID NO: 207900 - RNA, 22 nt, Human
caggaagcugugaaggagacgg

SEQ ID NO: 207901 - RNA, 22 nt, Human
gaaggcuuccuggaggaggugg

SEQ ID NO: 207902 - RNA, 22 nt, Human
acacauuucuaaauuuuuaccg

SEQ ID NO: 207903 - RNA, 22 nt, Human
ugcugaggcagaugucugugac

SEQ ID NO: 207904 - RNA, 22 nt, Human
cagugcuguugggcccagagag

SEQ ID NO: 207905 - RNA, 22 nt, Human
aaaguguugggauuacaggugu

SEQ ID NO: 207906 - RNA, 23 nt, Human
uugagaacaggugugagaauggc

SEQ ID NO: 207907 - RNA, 22 nt, Human
uccuggauggagcugcccucgc

SEQ ID NO: 207908 - RNA, 22 nt, Human
gcuuguuugugccucugcagaa

SEQ ID NO: 207909 - RNA, 18 nt, Human
uccaaagccagagaaguu

SEQ ID NO: 207910 - RNA, 22 nt, Human
aggaaggaagagacaccauuug

SEQ ID NO: 207911 - RNA, 22 nt, Human
cccagugucauucuaagggagg

SEQ ID NO: 207912 - RNA, 20 nt, Human
ggguccugacuuggucuccu

SEQ ID NO: 207913 - RNA, 23 nt, Human
agguucaggagauggaggaacaa

SEQ ID NO: 207914 - RNA, 22 nt, Human
uaggcugggccugccuuccagg

SEQ ID NO: 207915 - RNA, 21 nt, Human
ucucuguauccauggguucca

SEQ ID NO: 207916 - RNA, 22 nt, Human
uauguuuguuaucacaacuagg

SEQ ID NO: 207917 - RNA, 22 nt, Human
auauugcaauagaugcaucauu

SEQ ID NO: 207918 - RNA, 22 nt, Human
cccaggcucuuaugugacuugc

SEQ ID NO: 207919 - RNA, 22 nt, Human
cucaggaggugguagaggcccu

SEQ ID NO: 207920 - RNA, 22 nt, Human
gaacuggguccuugagucuaga

SEQ ID NO: 207921 - RNA, 22 nt, Human
uugcaggguacauucuuagaau

SEQ ID NO: 207922 - RNA, 22 nt, Human
ugccuugcagguuuuaaauaca

SEQ ID NO: 207923 - RNA, 22 nt, Human
augacaugauugccauuugaua

SEQ ID NO: 207924 - RNA, 22 nt, Human
agguggcaggaggucagagaaa

SEQ ID NO: 207925 - RNA, 22 nt, Human
ugucugugauuuaggccagggc

SEQ ID NO: 207926 - RNA, 22 nt, Human
uuuaaagagaaugugaaggagu

SEQ ID NO: 207927 - RNA, 22 nt, Human
ugcagguguagaguugggcucc

SEQ ID NO: 207928 - RNA, 22 nt, Human
gagcugggacuuggaauccaca

SEQ ID NO: 207929 - RNA, 22 nt, Human
cccagaugcagguucaagagua

SEQ ID NO: 207930 - RNA, 22 nt, Human
aguggaguugaguugauggauu

SEQ ID NO: 207931 - RNA, 22 nt, Human
gugcccugaucgcuaggcuccc

SEQ ID NO: 207932 - RNA, 17 nt, Human
ucacugggccugcuccc

SEQ ID NO: 207933 - RNA, 22 nt, Human
uaaggcuuuggucaccauggag

SEQ ID NO: 207934 - RNA, 22 nt, Human
gggcucagccuccucacuucga

SEQ ID NO: 207935 - RNA, 22 nt, Human
cagucacuggaauagcugagga

SEQ ID NO: 207936 - RNA, 22 nt, Human
gugcagauccugauugcaguuc

SEQ ID NO: 207937 - RNA, 22 nt, Human
ucagcugccccaguggccccag

SEQ ID NO: 207938 - RNA, 22 nt, Human
acuauuagcauaucaugaaugg

SEQ ID NO: 207939 - RNA, 16 nt, Human
accuccagucaagggu

SEQ ID NO: 207940 - RNA, 22 nt, Human
ucagguggagaccuccuuggcc

SEQ ID NO: 207941 - RNA, 22 nt, Human
ugaggaugacgauggcaauggc

SEQ ID NO: 207942 - RNA, 22 nt, Human
uucuuuaaaauagugagaaaga

SEQ ID NO: 207943 - RNA, 22 nt, Human
gaugccuggcacccagcaagga

SEQ ID NO: 207944 - RNA, 22 nt, Human
agagagccugaguggcagcuau

SEQ ID NO: 207945 - RNA, 22 nt, Human
gucaucuucucucagcccaggc

SEQ ID NO: 207946 - RNA, 22 nt, Human
aggcacugaaagguggccagag

SEQ ID NO: 207947 - RNA, 22 nt, Human
auauuuuggcaaaugucuagau

SEQ ID NO: 207948 - RNA, 22 nt, Human
agggggcugccaaggaauguaa

SEQ ID NO: 207949 - RNA, 22 nt, Human
aggcaaaagaaugucauaaaug

SEQ ID NO: 207950 - RNA, 21 nt, Human
aagaaagauaauuaaggaccc

SEQ ID NO: 207951 - RNA, 22 nt, Human
aggucagcugcugauaggcagc

SEQ ID NO: 207952 - RNA, 22 nt, Human
ccaccagcuuugccacccugcu

SEQ ID NO: 207953 - RNA, 22 nt, Human
ucuguucagaaauggaagugcc

SEQ ID NO: 207954 - RNA, 22 nt, Human
uggagcagcucuagcgggcgcc

SEQ ID NO: 207955 - RNA, 22 nt, Human
ucugagacaacuuagcccucga

SEQ ID NO: 207956 - RNA, 22 nt, Human
gcugucuucacuuccugguuuc

SEQ ID NO: 207957 - RNA, 22 nt, Human
acagggagccccagcauuucca

SEQ ID NO: 207958 - RNA, 22 nt, Human
ugggagcugggguuggacgucu

SEQ ID NO: 207959 - RNA, 22 nt, Human
caccagcuaauuaaaacagcag

SEQ ID NO: 207960 - RNA, 22 nt, Human
ccuggcuuauuuuuauagcagu

SEQ ID NO: 207961 - RNA, 22 nt, Human
auuccacagccgauaccaugac

SEQ ID NO: 207962 - RNA, 22 nt, Human
uaauuauuugaagacauuagag

SEQ ID NO: 207963 - RNA, 22 nt, Human
ugccaggaggggacaccuccuc

SEQ ID NO: 207964 - RNA, 23 nt, Human
caugccaguuugugcaggcagau

SEQ ID NO: 207965 - RNA, 22 nt, Human
uauguacuacacuagaacauuu

SEQ ID NO: 207966 - RNA, 22 nt, Human
aaagagucaaaggcaugucucu

SEQ ID NO: 207967 - RNA, 22 nt, Human
acagcuaacuuaaacuaaccua

SEQ ID NO: 207968 - RNA, 22 nt, Human
aaucacaucucauucaacagcc

SEQ ID NO: 207969 - RNA, 22 nt, Human
ugcuggaggcaguggaggugcc

SEQ ID NO: 207970 - RNA, 22 nt, Human
cagauuuagaguggggcuugga

SEQ ID NO: 207971 - RNA, 22 nt, Human
gagcagugggaaggaacagggu

SEQ ID NO: 207972 - RNA, 22 nt, Human
uugcagggcaucgcguacuucu

SEQ ID NO: 207973 - RNA, 22 nt, Human
cuccagggaggagcacggguuc

SEQ ID NO: 207974 - RNA, 22 nt, Human
uuuacaguaagguggaugguac

SEQ ID NO: 207975 - RNA, 22 nt, Human
auuaauauugguucauuagcug

SEQ ID NO: 207976 - RNA, 22 nt, Human
ggauggagguucucagaugcuc

SEQ ID NO: 207977 - RNA, 22 nt, Human
uugcuuugguagcagcuauaga

SEQ ID NO: 207978 - RNA, 22 nt, Human
ucugagccacagauguccuguu

SEQ ID NO: 207979 - RNA, 22 nt, Human
ucugccugaaccacucuuggag

SEQ ID NO: 207980 - RNA, 22 nt, Human
ugucagcaucauuuguugaagg

SEQ ID NO: 207981 - RNA, 22 nt, Human
ugcuccaggccgccuggggcug

SEQ ID NO: 207982 - RNA, 22 nt, Human
uuccugugcuuaauucucacug

SEQ ID NO: 207983 - RNA, 22 nt, Human
cagagaggauggauuccauagc

SEQ ID NO: 207984 - RNA, 19 nt, Human
ugcaggaggacugagcaga

SEQ ID NO: 207985 - RNA, 22 nt, Human
auucagcaaacauuuauuaucu

SEQ ID NO: 207986 - RNA, 22 nt, Human
gaagcuuugagagcagaagccc

SEQ ID NO: 207987 - RNA, 16 nt, Human
ccugggcucuguugga

SEQ ID NO: 207988 - RNA, 22 nt, Human
ggccuugccucaauagcuccac

SEQ ID NO: 207989 - RNA, 22 nt, Human
ucuuucuguaagcuccauggaa

SEQ ID NO: 207990 - RNA, 22 nt, Human
uaauaagcguagaagguauauc

SEQ ID NO: 207991 - RNA, 22 nt, Human
aucauucuauuguugagcugcc

SEQ ID NO: 207992 - RNA, 22 nt, Human
cucauaaggagcucacaaccua

SEQ ID NO: 207993 - RNA, 22 nt, Human
uaucucuagcgcacagaagaaa

SEQ ID NO: 207994 - RNA, 22 nt, Human
uggaggaaguugcuggaaguca

SEQ ID NO: 207995 - RNA, 22 nt, Human
aagacaauuugauacuaguugc

SEQ ID NO: 207996 - RNA, 19 nt, Human
ggagccagcuguggaaggc

SEQ ID NO: 207997 - RNA, 22 nt, Human
cagugcucauagcuguuccucc

SEQ ID NO: 207998 - RNA, 22 nt, Human
aggcucuggcaacagcuggugu

SEQ ID NO: 207999 - RNA, 22 nt, Human
cagugcuguguuugcugccugg

SEQ ID NO: 208000 - RNA, 22 nt, Human
gaggcucagagggagcaugguc

SEQ ID NO: 208001 - RNA, 17 nt, Human
cugggccuccccugucc

SEQ ID NO: 208002 - RNA, 22 nt, Human
cauauuuauagaucuggcauuu

SEQ ID NO: 208003 - RNA, 22 nt, Human
aaggacaggcacagugguggag

SEQ ID NO: 208004 - RNA, 22 nt, Human
gcugcccugccucagacuccuc

SEQ ID NO: 208005 - RNA, 22 nt, Human
auuuuuucagauugaguguuaa

SEQ ID NO: 208006 - RNA, 22 nt, Human
cucuccagucaggaacucugac

SEQ ID NO: 208007 - RNA, 22 nt, Human
gcuccaggaagggaaaucucca

SEQ ID NO: 208008 - RNA, 22 nt, Human
guucugccuguggcuucugugg

SEQ ID NO: 208009 - RNA, 22 nt, Human
agaagccauagucugggaggca

SEQ ID NO: 208010 - RNA, 22 nt, Human
ugucauguaaagaguaaauggu

SEQ ID NO: 208011 - RNA, 22 nt, Human
ugagaggucaaagggcauggag

SEQ ID NO: 208012 - RNA, 22 nt, Human
caauagcuauguaaccugaaga

SEQ ID NO: 208013 - RNA, 22 nt, Human
uucucuggaacugaaacaagau

SEQ ID NO: 208014 - RNA, 22 nt, Human
cuagggccaaaggcugugaugc

SEQ ID NO: 208015 - RNA, 22 nt, Human
cacaucucagggcuacaggcag

SEQ ID NO: 208016 - RNA, 22 nt, Human
ugccuuuuccagcuuccagagg

SEQ ID NO: 208017 - RNA, 22 nt, Human
ggaccugaacauaaaacgaggc

SEQ ID NO: 208018 - RNA, 19 nt, Human
uccagcugguaugcccaga

SEQ ID NO: 208019 - RNA, 18 nt, Human
ccugccagucuggagcag

SEQ ID NO: 208020 - RNA, 20 nt, Human
gggcuuggaggacucgaggg

SEQ ID NO: 208021 - RNA, 22 nt, Human
augcuaauguuuguggaagaua

SEQ ID NO: 208022 - RNA, 22 nt, Human
uuguauuggcaaagaacuugag

SEQ ID NO: 208023 - RNA, 22 nt, Human
ugugccugugacagcgaccugg

SEQ ID NO: 208024 - RNA, 21 nt, Human
cugagcuggggugaagguugc

SEQ ID NO: 208025 - RNA, 22 nt, Human
cuggaaaaugaagaagcagagg

SEQ ID NO: 208026 - RNA, 22 nt, Human
uggcaguuuacagaguucugaa

SEQ ID NO: 208027 - RNA, 22 nt, Human
ccaggccuuccaguacgcagaa

SEQ ID NO: 208028 - RNA, 23 nt, Human
uugaaagguagcuggcagcuaga

SEQ ID NO: 208029 - RNA, 18 nt, Human
cugugcagcaaacugagc

SEQ ID NO: 208030 - RNA, 22 nt, Human
aguggcugcuggaguggagaug

SEQ ID NO: 208031 - RNA, 23 nt, Human
aggacaguggaauuuagggauug

SEQ ID NO: 208032 - RNA, 22 nt, Human
cauaguuuuagguagaaacugg

SEQ ID NO: 208033 - RNA, 22 nt, Human
acauuugagucauauuugcuua

SEQ ID NO: 208034 - RNA, 22 nt, Human
agugacuacuggauuuguuucu

SEQ ID NO: 208035 - RNA, 22 nt, Human
aucacaucgaggagcaaucaga

SEQ ID NO: 208036 - RNA, 22 nt, Human
agugaggggauucaggcaaggu

SEQ ID NO: 208037 - RNA, 22 nt, Human
auuugcauaaggaugcuacugu

SEQ ID NO: 208038 - RNA, 19 nt, Human
acagccuguugguggggcu

SEQ ID NO: 208039 - RNA, 22 nt, Human
uguacagucugcagcuugcugu

SEQ ID NO: 208040 - RNA, 23 nt, Human
agggcccaagccuggacagcagg

SEQ ID NO: 208041 - RNA, 22 nt, Human
ucaaaggagacacaaggagaaa

SEQ ID NO: 208042 - RNA, 22 nt, Human
gaccaggcuaguucagagcuuc

SEQ ID NO: 208043 - RNA, 22 nt, Human
cccaguccuaaagcagacgcca

SEQ ID NO: 208044 - RNA, 22 nt, Human
aaaaucucauuaucaggaaggg

SEQ ID NO: 208045 - RNA, 22 nt, Human
auuuugauaaucauguuagaga

SEQ ID NO: 208046 - RNA, 22 nt, Human
aaggcauguguccucagagaga

SEQ ID NO: 208047 - RNA, 22 nt, Human
gccugugucauguaguagcuuc

SEQ ID NO: 208048 - RNA, 21 nt, Human
ucugggcuuucuuauaaggca

SEQ ID NO: 208049 - RNA, 22 nt, Human
ggaaaagacagguuaacuguga

SEQ ID NO: 208050 - RNA, 22 nt, Human
guucuucagcauuagaagucau

SEQ ID NO: 208051 - RNA, 22 nt, Human
ccagggcauccucacaucgcag

SEQ ID NO: 208052 - RNA, 22 nt, Human
ggacaggcugcaucugagcaug

SEQ ID NO: 208053 - RNA, 22 nt, Human
acaguggaauggugggccugca

SEQ ID NO: 208054 - RNA, 22 nt, Human
uccucuggcccagcugccucug

SEQ ID NO: 208055 - RNA, 22 nt, Human
caguggcugguuagggacagga

SEQ ID NO: 208056 - RNA, 22 nt, Human
cagagggcuguguaaggauguu

SEQ ID NO: 208057 - RNA, 22 nt, Human
aaggggcucuugucaggcgcag

SEQ ID NO: 208058 - RNA, 22 nt, Human
cagaaaauaaaguuucuacgca

SEQ ID NO: 208059 - RNA, 22 nt, Human
cucucagacugaagggccugug

SEQ ID NO: 208060 - RNA, 22 nt, Human
cuguccugcaguugggggcagg

SEQ ID NO: 208061 - RNA, 22 nt, Human
acucugggauuguuucugguau

SEQ ID NO: 208062 - RNA, 22 nt, Human
ggcaggaggugaguggcgggug

SEQ ID NO: 208063 - RNA, 22 nt, Human
cacaggagguuaggaagugguc

SEQ ID NO: 208064 - RNA, 22 nt, Human
agcagcuuaucuuggagaggca

SEQ ID NO: 208065 - RNA, 21 nt, Human
uuucugaaggcaacaucuauc

SEQ ID NO: 208066 - RNA, 22 nt, Human
caggugguuaugaggaagguga

SEQ ID NO: 208067 - RNA, 22 nt, Human
ugagaggcgcucacucucaggu

SEQ ID NO: 208068 - RNA, 22 nt, Human
ucucauuguccaauugaauuua

SEQ ID NO: 208069 - RNA, 22 nt, Human
cagcuacaggacgggcaucugc

SEQ ID NO: 208070 - RNA, 22 nt, Human
ugaggaguaugguggggucauu

SEQ ID NO: 208071 - RNA, 22 nt, Human
ucucaggaucuaauacauggua

SEQ ID NO: 208072 - RNA, 22 nt, Human
cccaguuuucugauugaagagc

SEQ ID NO: 208073 - RNA, 18 nt, Human
ugcagccuguagucuugu

SEQ ID NO: 208074 - RNA, 23 nt, Human
agcuccagcugacgugggcagcc

SEQ ID NO: 208075 - RNA, 22 nt, Human
gcaggcaggaaggacuaaguaa

SEQ ID NO: 208076 - RNA, 22 nt, Human
uuauguaccugaauuaguaaag

SEQ ID NO: 208077 - RNA, 22 nt, Human
uggcucagucauggaugaguaa

SEQ ID NO: 208078 - RNA, 22 nt, Human
ugaugagggaacugguucauac

SEQ ID NO: 208079 - RNA, 22 nt, Human
cccaagccuuucaaaacucaga

SEQ ID NO: 208080 - RNA, 22 nt, Human
ccuggugggcaggagugagacc

SEQ ID NO: 208081 - RNA, 22 nt, Human
uugagggauugcaccagaagag

SEQ ID NO: 208082 - RNA, 22 nt, Human
gguuuuaaccauucacaaguga

SEQ ID NO: 208083 - RNA, 22 nt, Human
uucaacucuucaagaucacauc

SEQ ID NO: 208084 - RNA, 22 nt, Human
cagcauggugccagugagucca

SEQ ID NO: 208085 - RNA, 22 nt, Human
aggacaagacaaggaccagaga

SEQ ID NO: 208086 - RNA, 22 nt, Human
agagguauuagguaauucagua

SEQ ID NO: 208087 - RNA, 22 nt, Human
cuaaaugacuuccagugguuau

SEQ ID NO: 208088 - RNA, 22 nt, Human
cacaggcucuccagggccugga

SEQ ID NO: 208089 - RNA, 22 nt, Human
caagaagugucagcuuuuuaaa

SEQ ID NO: 208090 - RNA, 22 nt, Human
gucaauauagguuucaaacaug

SEQ ID NO: 208091 - RNA, 18 nt, Human
ggcggguguuuuauucac

SEQ ID NO: 208092 - RNA, 22 nt, Human
aauagauacuacuuagauguag

SEQ ID NO: 208093 - RNA, 22 nt, Human
gcuucuaucccuccacugcacu

SEQ ID NO: 208094 - RNA, 22 nt, Human
uucucaggacuccugccugcuu

SEQ ID NO: 208095 - RNA, 22 nt, Human
gaagcuaaaccacagcuaagaa

SEQ ID NO: 208096 - RNA, 22 nt, Human
cagaggaagcuggguguggagu

SEQ ID NO: 208097 - RNA, 22 nt, Human
cagacaggcuagccagacucac

SEQ ID NO: 208098 - RNA, 22 nt, Human
aauagcuugccuaauccucaug

SEQ ID NO: 208099 - RNA, 22 nt, Human
cauuugaaauucuuagaacaaa

SEQ ID NO: 208100 - RNA, 22 nt, Human
ccagcuuuucagaaucugccug

SEQ ID NO: 208101 - RNA, 22 nt, Human
ucugagcugugaguugcuuagg

SEQ ID NO: 208102 - RNA, 22 nt, Human
gagguucacaggcuaucacagu

SEQ ID NO: 208103 - RNA, 22 nt, Human
cauaacauguacauauaaaugc

SEQ ID NO: 208104 - RNA, 22 nt, Human
ugcuuuauaucucucuucuuag

SEQ ID NO: 208105 - RNA, 22 nt, Human
aggguucugccagugucuugag

SEQ ID NO: 208106 - RNA, 22 nt, Human
ucuuagaaguucauguuccagc

SEQ ID NO: 208107 - RNA, 22 nt, Human
agggacucccugggccgacacg

SEQ ID NO: 208108 - RNA, 22 nt, Human
agcaaggaaaguaggcacggaa

SEQ ID NO: 208109 - RNA, 17 nt, Human
aaacugaaaaauucacu

SEQ ID NO: 208110 - RNA, 19 nt, Human
caggaugaucccaugacac

SEQ ID NO: 208111 - RNA, 22 nt, Human
aagagcaggcugcuguggagua

SEQ ID NO: 208112 - RNA, 22 nt, Human
ggggcagccuccaggaaagcug

SEQ ID NO: 208113 - RNA, 20 nt, Human
agccaggguucuggaugcac

SEQ ID NO: 208114 - RNA, 22 nt, Human
ugugggagaaggaagcaagcug

SEQ ID NO: 208115 - RNA, 22 nt, Human
aaagaguucuuguagcuuugag

SEQ ID NO: 208116 - RNA, 22 nt, Human
cccugaggaccaggaaggaggg

SEQ ID NO: 208117 - RNA, 17 nt, Human
acuccuggucugaaggg

SEQ ID NO: 208118 - RNA, 22 nt, Human
uggccucaaucuguccuccagc

SEQ ID NO: 208119 - RNA, 22 nt, Human
cuugagaaucuucucugaagag

SEQ ID NO: 208120 - RNA, 22 nt, Human
acacaugaccuccgcagcagca

SEQ ID NO: 208121 - RNA, 22 nt, Human
gggaccaggucagggcucugac

SEQ ID NO: 208122 - RNA, 22 nt, Human
auuuuagagaaacaaacguagg

SEQ ID NO: 208123 - RNA, 22 nt, Human
ggaggugggagccuccaguggu

SEQ ID NO: 208124 - RNA, 22 nt, Human
uguccucagauaugucuacucu

SEQ ID NO: 208125 - RNA, 22 nt, Human
uugcagcuucuaccacuguuuc

SEQ ID NO: 208126 - RNA, 22 nt, Human
ucccugcauuugggagaguguc

SEQ ID NO: 208127 - RNA, 22 nt, Human
ccagguggauaagguuucugga

SEQ ID NO: 208128 - RNA, 22 nt, Human
aguuuuguaauucucaaaaaua

SEQ ID NO: 208129 - RNA, 22 nt, Human
cagggccucauccucagagauu

SEQ ID NO: 208130 - RNA, 22 nt, Human
acugucuuuauuagaaucuuau

SEQ ID NO: 208131 - RNA, 22 nt, Human
uaaaugucuguuaacaugaaug

SEQ ID NO: 208132 - RNA, 22 nt, Human
ggaagccccagcauggccuugg

SEQ ID NO: 208133 - RNA, 22 nt, Human
ucucuguguucccuguuuucuc

SEQ ID NO: 208134 - RNA, 22 nt, Human
agauuuuaguguagaggacuug

SEQ ID NO: 208135 - RNA, 22 nt, Human
cuucugggcagaaguuuugaga

SEQ ID NO: 208136 - RNA, 20 nt, Human
ugauuucucuucuauuccuu

SEQ ID NO: 208137 - RNA, 22 nt, Human
cagcaagacaguuuccuaagug

SEQ ID NO: 208138 - RNA, 22 nt, Human
gcauuagaagggaccucugggg

SEQ ID NO: 208139 - RNA, 22 nt, Human
cuggaagggaaaucucuuggca

SEQ ID NO: 208140 - RNA, 22 nt, Human
gguccagguauguggugugaau

SEQ ID NO: 208141 - RNA, 22 nt, Human
uuggaacagaaacagacaaaua

SEQ ID NO: 208142 - RNA, 22 nt, Human
acuauacauaaaacauuugggu

SEQ ID NO: 208143 - RNA, 22 nt, Human
ucugcaccuuucuuaaaaaucg

SEQ ID NO: 208144 - RNA, 22 nt, Human
ccucugaggugagcccagcugg

SEQ ID NO: 208145 - RNA, 22 nt, Human
ugggccugggcuggacagccug

SEQ ID NO: 208146 - RNA, 19 nt, Human
aauagauuaauuauccucu

SEQ ID NO: 208147 - RNA, 22 nt, Human
uccuggcucucuacaaaccaga

SEQ ID NO: 208148 - RNA, 22 nt, Human
auucuacacaaagcaagaagac

SEQ ID NO: 208149 - RNA, 22 nt, Human
cacaguuugggucuccggggca

SEQ ID NO: 208150 - RNA, 22 nt, Human
cuuuccaaugucacuaugaauc

SEQ ID NO: 208151 - RNA, 22 nt, Human
uuggcuuccaggggcuuuuaca

SEQ ID NO: 208152 - RNA, 22 nt, Human
uacuuucuuucugauccuuaug

SEQ ID NO: 208153 - RNA, 22 nt, Human
ccuugaaauguucucacugggg

SEQ ID NO: 208154 - RNA, 22 nt, Human
gaaauuaaccaccuuuggcuuu

SEQ ID NO: 208155 - RNA, 22 nt, Human
ugaggccagggauuccaucauu

SEQ ID NO: 208156 - RNA, 22 nt, Human
ggcugcagagcugggugggccu

SEQ ID NO: 208157 - RNA, 20 nt, Human
agagcugggaagcucccuau

SEQ ID NO: 208158 - RNA, 22 nt, Human
ugcaccagagcagggugcccaa

SEQ ID NO: 208159 - RNA, 22 nt, Human
uguuuccuaagugucucugaag

SEQ ID NO: 208160 - RNA, 22 nt, Human
ggauggcagucugcaugagaaa

SEQ ID NO: 208161 - RNA, 22 nt, Human
gccaccugccaacuugcuggaa

SEQ ID NO: 208162 - RNA, 22 nt, Human
auucugaugccuggguacugcc

SEQ ID NO: 208163 - RNA, 22 nt, Human
uauggaaaguguuuucuucugu

SEQ ID NO: 208164 - RNA, 22 nt, Human
cccaugcaucccucuccugggc

SEQ ID NO: 208165 - RNA, 22 nt, Human
aaugaaaauuggacccuagaac

SEQ ID NO: 208166 - RNA, 22 nt, Human
ucuuagaaugucaacugauguu

SEQ ID NO: 208167 - RNA, 22 nt, Human
auggcaagcaagcugaagagau

SEQ ID NO: 208168 - RNA, 18 nt, Human
acagacaaaauggaaaug

SEQ ID NO: 208169 - RNA, 22 nt, Human
uuugaagacauauuguuacaua

SEQ ID NO: 208170 - RNA, 22 nt, Human
cucuuuggauagaauuacaaag

SEQ ID NO: 208171 - RNA, 22 nt, Human
uuauucagucugucuagggagu

SEQ ID NO: 208172 - RNA, 19 nt, Human
uaccagccuccugccugau

SEQ ID NO: 208173 - RNA, 22 nt, Human
uggaagccaggcccgcuccuaa

SEQ ID NO: 208174 - RNA, 22 nt, Human
ugagcaguggcuccugcuggac

SEQ ID NO: 208175 - RNA, 20 nt, Human
gcuguucacauuauuaguag

SEQ ID NO: 208176 - RNA, 22 nt, Human
agauaucuggaaaaaauguaug

SEQ ID NO: 208177 - RNA, 23 nt, Human
uggcaggugguuagauguuuugu

SEQ ID NO: 208178 - RNA, 22 nt, Human
cugggagagguggugggaagua

SEQ ID NO: 208179 - RNA, 22 nt, Human
ucugccuugccgaauuccaggc

SEQ ID NO: 208180 - RNA, 21 nt, Human
acugccuggggugcuggccaa

SEQ ID NO: 208181 - RNA, 22 nt, Human
aaugcacauauauuuccuuauu

SEQ ID NO: 208182 - RNA, 22 nt, Human
cagcuuuauugagguauaauug

SEQ ID NO: 208183 - RNA, 22 nt, Human
aagcacuggguauagcaaugau

SEQ ID NO: 208184 - RNA, 22 nt, Human
ugcagggccccucugcaugagu

SEQ ID NO: 208185 - RNA, 22 nt, Human
agugcaggagccuggccagagc

SEQ ID NO: 208186 - RNA, 22 nt, Human
cuccugaggggacaggacucau

SEQ ID NO: 208187 - RNA, 22 nt, Human
uaugcacacaucgcagcaggaa

SEQ ID NO: 208188 - RNA, 22 nt, Human
cagggucccaggagcugcuuuc

SEQ ID NO: 208189 - RNA, 22 nt, Human
uauaagcaugcuucauauggau

SEQ ID NO: 208190 - RNA, 22 nt, Human
acuaucucuuuugucugcagcu

SEQ ID NO: 208191 - RNA, 22 nt, Human
gagguucagcugcugccuggua

SEQ ID NO: 208192 - RNA, 22 nt, Human
cacaggaaauauuaggagggau

SEQ ID NO: 208193 - RNA, 22 nt, Human
uugcagggccuuggcuucuucc

SEQ ID NO: 208194 - RNA, 22 nt, Human
cuccagaggaugcaggugaggg

SEQ ID NO: 208195 - RNA, 20 nt, Human
ucuccuggugacaguaccca

SEQ ID NO: 208196 - RNA, 22 nt, Human
auagcaaaaaugaacaaagcuu

SEQ ID NO: 208197 - RNA, 22 nt, Human
ucuguucaugaaauaucuuuuu

SEQ ID NO: 208198 - RNA, 22 nt, Human
gaggcugguuugccuuuuggca

SEQ ID NO: 208199 - RNA, 22 nt, Human
ugaaccuuuugcuaagaaguua

SEQ ID NO: 208200 - RNA, 22 nt, Human
cucuagaacagugcugagccuu

SEQ ID NO: 208201 - RNA, 22 nt, Human
agugcucccuagaguugugcaa

SEQ ID NO: 208202 - RNA, 22 nt, Human
ugcaaauuugagcagacuguuc

SEQ ID NO: 208203 - RNA, 22 nt, Human
ccagggccugagggcgacgccc

SEQ ID NO: 208204 - RNA, 22 nt, Human
aaugugcagaugaauaaacaaa

SEQ ID NO: 208205 - RNA, 22 nt, Human
gggcaagcacagcgagcgugcg

SEQ ID NO: 208206 - RNA, 20 nt, Human
gaaucuuacuacauucucuc

SEQ ID NO: 208207 - RNA, 22 nt, Human
agucaggggaucuagacuugaa

SEQ ID NO: 208208 - RNA, 22 nt, Human
uguuuucacaaugaugucagau

SEQ ID NO: 208209 - RNA, 22 nt, Human
ugcacuccaggcugggugacag

SEQ ID NO: 208210 - RNA, 22 nt, Human
gggcuucuauucuggcacaaga

SEQ ID NO: 208211 - RNA, 22 nt, Human
acuugaauuuaguuuuuccuaa

SEQ ID NO: 208212 - RNA, 22 nt, Human
agagcccucucauuggcuuauu

SEQ ID NO: 208213 - RNA, 22 nt, Human
aggacccugaggucuccuguga

SEQ ID NO: 208214 - RNA, 22 nt, Human
ucccagcagggccgaccagccu

SEQ ID NO: 208215 - RNA, 20 nt, Human
gucucagaauggauuugcau

SEQ ID NO: 208216 - RNA, 22 nt, Human
aggcugagccacggggcuggcu

SEQ ID NO: 208217 - RNA, 22 nt, Human
ucggagcuguagaugaaacccu

SEQ ID NO: 208218 - RNA, 22 nt, Human
ucucagugcagagaggcuaucu

SEQ ID NO: 208219 - RNA, 22 nt, Human
uuuaucugaaaaaacucuugga

SEQ ID NO: 208220 - RNA, 22 nt, Human
aucugucuuuuauucaugagcu

SEQ ID NO: 208221 - RNA, 22 nt, Human
ccagcagggcagugcccuggac

SEQ ID NO: 208222 - RNA, 22 nt, Human
uggcagguuggccuuugguuca

SEQ ID NO: 208223 - RNA, 22 nt, Human
uucuguuacaagugaaaaaaug

SEQ ID NO: 208224 - RNA, 22 nt, Human
gcugccaguuccuucuuacucc

SEQ ID NO: 208225 - RNA, 22 nt, Human
acagagccacuuuggugccuac

SEQ ID NO: 208226 - RNA, 22 nt, Human
uugcugaaaacaguggguauug

SEQ ID NO: 208227 - RNA, 22 nt, Human
aagagcaggacagaaucagaac

SEQ ID NO: 208228 - RNA, 22 nt, Human
ggaaggaaauuggggcaguugu

SEQ ID NO: 208229 - RNA, 22 nt, Human
uucuccugggagggguugccca

SEQ ID NO: 208230 - RNA, 23 nt, Human
agcuuugugaaagcagacauggg

SEQ ID NO: 208231 - RNA, 22 nt, Human
ugcuaaauaaguggaauagaca

SEQ ID NO: 208232 - RNA, 22 nt, Human
aggcaggcacuccggaaguguc

SEQ ID NO: 208233 - RNA, 22 nt, Human
ccuggguggcugccugccuuuc

SEQ ID NO: 208234 - RNA, 22 nt, Human
uaaaugcaagggaaaggcaaga

SEQ ID NO: 208235 - RNA, 22 nt, Human
ucagcacuuuuuaaagcagcau

SEQ ID NO: 208236 - RNA, 22 nt, Human
uuuacagaugaggaaacugaga

SEQ ID NO: 208237 - RNA, 22 nt, Human
caugugugagugagcagucuuc

SEQ ID NO: 208238 - RNA, 22 nt, Human
cacauaauugaacgugaugagu

SEQ ID NO: 208239 - RNA, 22 nt, Human
gacacaggggggcgcuagaaga

SEQ ID NO: 208240 - RNA, 22 nt, Human
gucaacauuuacugcccuggcc

SEQ ID NO: 208241 - RNA, 22 nt, Human
guggagcuggcccaagaagcug

SEQ ID NO: 208242 - RNA, 22 nt, Human
gucugcccggccuuccuccacc

SEQ ID NO: 208243 - RNA, 22 nt, Human
acauaugucuauuucauguaaa

SEQ ID NO: 208244 - RNA, 22 nt, Human
auuuaucucuggaaacuaagca

SEQ ID NO: 208245 - RNA, 22 nt, Human
gucauucagagaugcagguaga

SEQ ID NO: 208246 - RNA, 22 nt, Human
ccagagggcaaaaugaagcuua

SEQ ID NO: 208247 - RNA, 22 nt, Human
caucuuuuggccuauucugagg

SEQ ID NO: 208248 - RNA, 23 nt, Human
aggcaaggguguaaaggaaauga

SEQ ID NO: 208249 - RNA, 22 nt, Human
aauacuggcugucaaagaugga

SEQ ID NO: 208250 - RNA, 22 nt, Human
cagcccuggccucuucgcuuuc

SEQ ID NO: 208251 - RNA, 22 nt, Human
uacaagaaaguccaguggguuu

SEQ ID NO: 208252 - RNA, 22 nt, Human
caaagugagagaauggcagaaa

SEQ ID NO: 208253 - RNA, 22 nt, Human
accuccccugacucgaaaccca

SEQ ID NO: 208254 - RNA, 22 nt, Human
aucugcaggaaugugugcagag

SEQ ID NO: 208255 - RNA, 22 nt, Human
auggacaggcuuauaacagcaa

SEQ ID NO: 208256 - RNA, 22 nt, Human
aagcugccuugcugaggagaaa

SEQ ID NO: 208257 - RNA, 22 nt, Human
uuuaauauccaguggauacaaa

SEQ ID NO: 208258 - RNA, 18 nt, Human
ccgggcuuuggugacaca

SEQ ID NO: 208259 - RNA, 22 nt, Human
ggucuccaaagcuuaggacuac

SEQ ID NO: 208260 - RNA, 22 nt, Human
uaaaccuuauuugaauaccaac

SEQ ID NO: 208261 - RNA, 22 nt, Human
acucuggggcgcuacuccaacu

SEQ ID NO: 208262 - RNA, 22 nt, Human
uaguccaggacaaucuucauau

SEQ ID NO: 208263 - RNA, 22 nt, Human
cagggcccagucccugcuguca

SEQ ID NO: 208264 - RNA, 22 nt, Human
uaucuguauucugacagucacu

SEQ ID NO: 208265 - RNA, 22 nt, Human
guacacauauauuaaaaauugu

SEQ ID NO: 208266 - RNA, 22 nt, Human
ccuggggagagaaagcccagcc

SEQ ID NO: 208267 - RNA, 22 nt, Human
ggucuccuugggaaagcaggaa

SEQ ID NO: 208268 - RNA, 22 nt, Human
augcagaagacugaaaagcuga

SEQ ID NO: 208269 - RNA, 22 nt, Human
auagauuugaauuuaagacuug

SEQ ID NO: 208270 - RNA, 22 nt, Human
caguuuuaugucgaauguauac

SEQ ID NO: 208271 - RNA, 22 nt, Human
uucuaaaauaaguuuaucuggu

SEQ ID NO: 208272 - RNA, 22 nt, Human
ccagagcaugaagggcaaugac

SEQ ID NO: 208273 - RNA, 21 nt, Human
caaggcuuaaacauuaaucua

SEQ ID NO: 208274 - RNA, 22 nt, Human
ccagaggcagacuuacacucca

SEQ ID NO: 208275 - RNA, 16 nt, Human
uucuagaaaagaaggu

SEQ ID NO: 208276 - RNA, 22 nt, Human
ccucugagaacaccuggcgucc

SEQ ID NO: 208277 - RNA, 22 nt, Human
ucacagaagggaaagaugccaa

SEQ ID NO: 208278 - RNA, 22 nt, Human
guguggcaccuccuuuccagcu

SEQ ID NO: 208279 - RNA, 22 nt, Human
auggcugcuuacaaaaacugug

SEQ ID NO: 208280 - RNA, 22 nt, Human
ccuguucacuuugacuucucca

SEQ ID NO: 208281 - RNA, 22 nt, Human
ugcugggcuggggccucagacc

SEQ ID NO: 208282 - RNA, 22 nt, Human
auauuuucuggaacuaugccug

SEQ ID NO: 208283 - RNA, 22 nt, Human
cugcgugucucugucucauggc

SEQ ID NO: 208284 - RNA, 18 nt, Human
gcuccuggagucugacuc

SEQ ID NO: 208285 - RNA, 22 nt, Human
auuuaaauuuucugauggagag

SEQ ID NO: 208286 - RNA, 22 nt, Human
cugggacaguucagguagggca

SEQ ID NO: 208287 - RNA, 22 nt, Human
uguggccuugcagccuggaggu

SEQ ID NO: 208288 - RNA, 22 nt, Human
agcugaaaggguguuggagugu

SEQ ID NO: 208289 - RNA, 22 nt, Human
aaguauucauaaggacauaugu

SEQ ID NO: 208290 - RNA, 22 nt, Human
ucucuccuguguucugauguuu

SEQ ID NO: 208291 - RNA, 21 nt, Human
acuguucaucuguucagaagc

SEQ ID NO: 208292 - RNA, 22 nt, Human
auuguauucaguuacaggucuu

SEQ ID NO: 208293 - RNA, 22 nt, Human
caaaugaauauuuccauggguu

SEQ ID NO: 208294 - RNA, 22 nt, Human
gaggcuuugguuauaaaagauc

SEQ ID NO: 208295 - RNA, 22 nt, Human
cucaggauggaagccuacagga

SEQ ID NO: 208296 - RNA, 22 nt, Human
gcccauggucagggaggcaggg

SEQ ID NO: 208297 - RNA, 21 nt, Human
agcgucaauaucgucaacagg

SEQ ID NO: 208298 - RNA, 19 nt, Human
gcaugcagaguaagaaggu

SEQ ID NO: 208299 - RNA, 22 nt, Human
gcucagaguuaauuggaugggu

SEQ ID NO: 208300 - RNA, 22 nt, Human
ugggcuccggcggccucaggcu

SEQ ID NO: 208301 - RNA, 22 nt, Human
gcuccuggcaggcagugugugu

SEQ ID NO: 208302 - RNA, 22 nt, Human
ugggaguacuaugugauaggau

SEQ ID NO: 208303 - RNA, 22 nt, Human
aguggcuagaucaugagugagc

SEQ ID NO: 208304 - RNA, 22 nt, Human
gggcuccaaaaucuaugucuuc

SEQ ID NO: 208305 - RNA, 22 nt, Human
cuuagggaaucuuagagcugga

SEQ ID NO: 208306 - RNA, 22 nt, Human
agccucuggcccuagacugcuu

SEQ ID NO: 208307 - RNA, 22 nt, Human
ccuggcccuggaauagggcagg

SEQ ID NO: 208308 - RNA, 22 nt, Human
gucagaucuuuggggaugcugu

SEQ ID NO: 208309 - RNA, 22 nt, Human
cuuguauugcaaacuggccagg

SEQ ID NO: 208310 - RNA, 22 nt, Human
agcagaugaaucccagauaaag

SEQ ID NO: 208311 - RNA, 22 nt, Human
cuguugucuccucucagauuau

SEQ ID NO: 208312 - RNA, 22 nt, Human
uacagugcuagaaccugcugua

SEQ ID NO: 208313 - RNA, 22 nt, Human
auucugucuuuuuauacaucua

SEQ ID NO: 208314 - RNA, 18 nt, Human
gccagagggaagcaggug

SEQ ID NO: 208315 - RNA, 18 nt, Human
gauauauaggaggaaagu

SEQ ID NO: 208316 - RNA, 22 nt, Human
ucagggcauucaagaggccugg

SEQ ID NO: 208317 - RNA, 22 nt, Human
ggcacagggggcugaggacuag

SEQ ID NO: 208318 - RNA, 18 nt, Human
auccugggccagucuuuc

SEQ ID NO: 208319 - RNA, 22 nt, Human
cagagcugcucaugguggccag

SEQ ID NO: 208320 - RNA, 22 nt, Human
auggaugaaggcgaggaugagg

SEQ ID NO: 208321 - RNA, 22 nt, Human
gcaggcagagagggguuuccag

SEQ ID NO: 208322 - RNA, 20 nt, Human
gggguuggcuggcacaggga

SEQ ID NO: 208323 - RNA, 22 nt, Human
ucccuggggauguuggccugcc

SEQ ID NO: 208324 - RNA, 22 nt, Human
uccaaauauucaucuacuucug

SEQ ID NO: 208325 - RNA, 22 nt, Human
acauggugugcugagaaugaca

SEQ ID NO: 208326 - RNA, 22 nt, Human
acgaugcuggauuaucucaagg

SEQ ID NO: 208327 - RNA, 22 nt, Human
agaaucuacauuuuaacaagau

SEQ ID NO: 208328 - RNA, 22 nt, Human
ugcuggaauaauuucauguuaa

SEQ ID NO: 208329 - RNA, 22 nt, Human
agguaaggcuguaagcuaagcc

SEQ ID NO: 208330 - RNA, 21 nt, Human
ccugagccuguuuauccagaa

SEQ ID NO: 208331 - RNA, 22 nt, Human
ucaggcagaguuaauuugcucc

SEQ ID NO: 208332 - RNA, 22 nt, Human
aggccuggguguucaccagaag

SEQ ID NO: 208333 - RNA, 18 nt, Human
ucugcccugccauucacu

SEQ ID NO: 208334 - RNA, 22 nt, Human
uacacgugcaaauucaauguau

SEQ ID NO: 208335 - RNA, 22 nt, Human
gagcuagcuucuuccagguuuc

SEQ ID NO: 208336 - RNA, 22 nt, Human
gcugagcagguuugaugcuuuu

SEQ ID NO: 208337 - RNA, 22 nt, Human
ugaaggagcucaggagauaguc

SEQ ID NO: 208338 - RNA, 22 nt, Human
uggaaucucugguaucugggga

SEQ ID NO: 208339 - RNA, 22 nt, Human
uaaagcauguuucaguaagguu

SEQ ID NO: 208340 - RNA, 22 nt, Human
auacuuuggucacuauuauugg

SEQ ID NO: 208341 - RNA, 22 nt, Human
cagcugaagcucuugucaaagg

SEQ ID NO: 208342 - RNA, 22 nt, Human
ucagggagccuggacuucaagg

SEQ ID NO: 208343 - RNA, 22 nt, Human
gagcugaauugaagcaaggagc

SEQ ID NO: 208344 - RNA, 22 nt, Human
guuggugaguuucugaucacaa

SEQ ID NO: 208345 - RNA, 23 nt, Human
uuuauuuauuuaggcugagggau

SEQ ID NO: 208346 - RNA, 22 nt, Human
caguuucuacgaaggucaaccc

SEQ ID NO: 208347 - RNA, 20 nt, Human
gcucugggagggaugugaug

SEQ ID NO: 208348 - RNA, 22 nt, Human
acugagaacucaagagaaaagg

SEQ ID NO: 208349 - RNA, 22 nt, Human
aaacagcucaagaaguuacucu

SEQ ID NO: 208350 - RNA, 22 nt, Human
acaggucuggucugggugggac

SEQ ID NO: 208351 - RNA, 22 nt, Human
aacauuaauuacagucaaacau

SEQ ID NO: 208352 - RNA, 20 nt, Human
uucugggcagccauguacuu

SEQ ID NO: 208353 - RNA, 22 nt, Human
agaguguguuccccaagaaaga

SEQ ID NO: 208354 - RNA, 22 nt, Human
aauguuuucauuauccuaacug

SEQ ID NO: 208355 - RNA, 22 nt, Human
cugagggacccugugaguaccu

SEQ ID NO: 208356 - RNA, 22 nt, Human
acagcaugagagaugaacauuc

SEQ ID NO: 208357 - RNA, 22 nt, Human
uucucuucccacuuucuguauu

SEQ ID NO: 208358 - RNA, 22 nt, Human
ggguaggaugguagaagggacc

SEQ ID NO: 208359 - RNA, 20 nt, Human
cuguggugagcaggagagua

SEQ ID NO: 208360 - RNA, 21 nt, Human
gcagagaaugaacuuuggcuu

SEQ ID NO: 208361 - RNA, 22 nt, Human
augccaaauucuacuuucagca

SEQ ID NO: 208362 - RNA, 22 nt, Human
uacuuucauggguuuucuuuau

SEQ ID NO: 208363 - RNA, 22 nt, Human
aggcuucuggaauccaguuucu

SEQ ID NO: 208364 - RNA, 22 nt, Human
aguggcugauguaggcaguggg

SEQ ID NO: 208365 - RNA, 22 nt, Human
uguaaagauuagauuacaugaa

SEQ ID NO: 208366 - RNA, 22 nt, Human
ccugccugucccucaguccaca

SEQ ID NO: 208367 - RNA, 22 nt, Human
acaugauuaaaagauuuuaaag

SEQ ID NO: 208368 - RNA, 22 nt, Human
cagcccugucuaugacugauga

SEQ ID NO: 208369 - RNA, 22 nt, Human
uguuugaaaaguggagauuuau

SEQ ID NO: 208370 - RNA, 22 nt, Human
ccugaagaugcuguggccuggu

SEQ ID NO: 208371 - RNA, 22 nt, Human
acugaacuuggugaaugccaca

SEQ ID NO: 208372 - RNA, 22 nt, Human
ccugguugugaguugaguugag

SEQ ID NO: 208373 - RNA, 22 nt, Human
ucagcauaucuugagcuucaug

SEQ ID NO: 208374 - RNA, 23 nt, Human
ucuggcuuccaguggguucaacc

SEQ ID NO: 208375 - RNA, 22 nt, Human
caguauguucuuccaggacaga

SEQ ID NO: 208376 - RNA, 22 nt, Human
cccugaggaugucuccuuccug

SEQ ID NO: 208377 - RNA, 22 nt, Human
uugccuggcuuguagauggggg

SEQ ID NO: 208378 - RNA, 22 nt, Human
cccuggccuccaggcaguccug

SEQ ID NO: 208379 - RNA, 22 nt, Human
aaagacuaaccaguugucaaaa

SEQ ID NO: 208380 - RNA, 22 nt, Human
ccacugcccaccccgacgucua

SEQ ID NO: 208381 - RNA, 22 nt, Human
cugccacuuucacccagugcuc

SEQ ID NO: 208382 - RNA, 22 nt, Human
ucccagccuuucuuucuccagc

SEQ ID NO: 208383 - RNA, 22 nt, Human
gcaagaugguuauaaaaaaugu

SEQ ID NO: 208384 - RNA, 22 nt, Human
gagucuggugauggucauuguc

SEQ ID NO: 208385 - RNA, 22 nt, Human
ggaagggguuaggggucccuga

SEQ ID NO: 208386 - RNA, 22 nt, Human
aaaagagugacugauaaguaua

SEQ ID NO: 208387 - RNA, 22 nt, Human
agguucuccuuaucaaugaaga

SEQ ID NO: 208388 - RNA, 22 nt, Human
gagcccugcugggccuugucuc

SEQ ID NO: 208389 - RNA, 21 nt, Human
uggaacuggugaaaaccuccu

SEQ ID NO: 208390 - RNA, 22 nt, Human
caggguuauacagcugaacaaa

SEQ ID NO: 208391 - RNA, 22 nt, Human
caucuugugaggaccuucuugc

SEQ ID NO: 208392 - RNA, 22 nt, Human
ccuguucaccauggucacgugc

SEQ ID NO: 208393 - RNA, 22 nt, Human
ugucaaacugugacuucuaaug

SEQ ID NO: 208394 - RNA, 19 nt, Human
cccagaggaaugccuggaa

SEQ ID NO: 208395 - RNA, 22 nt, Human
gggcugcuguguuccugaggca

SEQ ID NO: 208396 - RNA, 22 nt, Human
cagagguguacagagggaggcc

SEQ ID NO: 208397 - RNA, 22 nt, Human
uauacacauuuuuaccuauagu

SEQ ID NO: 208398 - RNA, 22 nt, Human
aagaaacuguugcgugacagcg

SEQ ID NO: 208399 - RNA, 22 nt, Human
uggcuucuugucuaauuuguua

SEQ ID NO: 208400 - RNA, 22 nt, Human
agcuaaggacuggaggguuucu

SEQ ID NO: 208401 - RNA, 22 nt, Human
gugccugcuaccugacuuguuu

SEQ ID NO: 208402 - RNA, 22 nt, Human
acagucuaggccuaggucaaaa

SEQ ID NO: 208403 - RNA, 20 nt, Human
ucucaggguucagcaaagua

SEQ ID NO: 208404 - RNA, 22 nt, Human
aggaggggcauagaaauguaau

SEQ ID NO: 208405 - RNA, 22 nt, Human
gacagaggcaagaccagaagcc

SEQ ID NO: 208406 - RNA, 22 nt, Human
ccucugggcuggaaaauuaaug

SEQ ID NO: 208407 - RNA, 22 nt, Human
uugcccagagucacccagcuca

SEQ ID NO: 208408 - RNA, 22 nt, Human
aaaugcugcagcuaguguguuu

SEQ ID NO: 208409 - RNA, 22 nt, Human
agagcccagaaaguaugucaua

SEQ ID NO: 208410 - RNA, 22 nt, Human
cagggaggaugggcuguuuugc

SEQ ID NO: 208411 - RNA, 22 nt, Human
uuacauucuuaucucaguuauu

SEQ ID NO: 208412 - RNA, 22 nt, Human
gccugcagccccucugcaguag

SEQ ID NO: 208413 - RNA, 22 nt, Human
uucuccaguuucucccuucagu

SEQ ID NO: 208414 - RNA, 22 nt, Human
ugggccacggggguggagagcu

SEQ ID NO: 208415 - RNA, 23 nt, Human
ugagcugguauuguccaucucca

SEQ ID NO: 208416 - RNA, 22 nt, Human
uucauauuaugauuugaaaugc

SEQ ID NO: 208417 - RNA, 20 nt, Human
guacauuuucaggaggggau

SEQ ID NO: 208418 - RNA, 22 nt, Human
aaucaagagcugacuauauuuu

SEQ ID NO: 208419 - RNA, 22 nt, Human
guguccugagugaggccuggcc

SEQ ID NO: 208420 - RNA, 22 nt, Human
cuggcugggagcgagcugcuca

SEQ ID NO: 208421 - RNA, 22 nt, Human
acauguuuaaguuuguuauaug

SEQ ID NO: 208422 - RNA, 22 nt, Human
acacacgugcucaacacgcucc

SEQ ID NO: 208423 - RNA, 22 nt, Human
aggcuucagaugaccuuagcau

SEQ ID NO: 208424 - RNA, 22 nt, Human
gcucuggccagacccucagugg

SEQ ID NO: 208425 - RNA, 22 nt, Human
ggggcggggcucugagaagcau

SEQ ID NO: 208426 - RNA, 22 nt, Human
cuuauguauaauguuccacaua

SEQ ID NO: 208427 - RNA, 22 nt, Human
aucuccucgcaggccagaacac

SEQ ID NO: 208428 - RNA, 22 nt, Human
uuucacaugcagcagggaagug

SEQ ID NO: 208429 - RNA, 22 nt, Human
uggauuauuguaagacaaagua

SEQ ID NO: 208430 - RNA, 22 nt, Human
ccagagcuccagggcuacagaa

SEQ ID NO: 208431 - RNA, 22 nt, Human
ucccuguuuuauauccuaacaa

SEQ ID NO: 208432 - RNA, 18 nt, Human
acccucuggcuucugagc

SEQ ID NO: 208433 - RNA, 22 nt, Human
caugagaaguggccuucaaaaa

SEQ ID NO: 208434 - RNA, 22 nt, Human
auaaacagccugcccaaauugg

SEQ ID NO: 208435 - RNA, 21 nt, Human
uucacagaugggaaaacugag

SEQ ID NO: 208436 - RNA, 22 nt, Human
gcuuuugugagauuaagcuacu

SEQ ID NO: 208437 - RNA, 22 nt, Human
uuucaguuguccuguuaauagc

SEQ ID NO: 208438 - RNA, 22 nt, Human
augacuaagugcauuuuaauug

SEQ ID NO: 208439 - RNA, 22 nt, Human
ugcccacauucaaaaggugaug

SEQ ID NO: 208440 - RNA, 22 nt, Human
agucuuacaugagaaagaaccu

SEQ ID NO: 208441 - RNA, 22 nt, Human
agugcugagugauugcaaagga

SEQ ID NO: 208442 - RNA, 21 nt, Human
uccugcaggaggccugagagg

SEQ ID NO: 208443 - RNA, 22 nt, Human
cuucuuaaugacagauuaaaau

SEQ ID NO: 208444 - RNA, 22 nt, Human
aguuuacucuggugacaauuua

SEQ ID NO: 208445 - RNA, 22 nt, Human
ucugggauagggccagaacaug

SEQ ID NO: 208446 - RNA, 22 nt, Human
uugggaaagggauuaugaguag

SEQ ID NO: 208447 - RNA, 22 nt, Human
cacugagcaagucaguacagca

SEQ ID NO: 208448 - RNA, 20 nt, Human
cucaggauugucuagccccu

SEQ ID NO: 208449 - RNA, 22 nt, Human
ucaggcaggaagccccugcaca

SEQ ID NO: 208450 - RNA, 22 nt, Human
ucaauucaguccaacaguaauu

SEQ ID NO: 208451 - RNA, 22 nt, Human
cccaggaggcagauguugcagu

SEQ ID NO: 208452 - RNA, 22 nt, Human
cugugaugacaggcagggccaa

SEQ ID NO: 208453 - RNA, 22 nt, Human
ucuuugaugugguuaauuauga

SEQ ID NO: 208454 - RNA, 22 nt, Human
cagcuggcaaguggagcagggu

SEQ ID NO: 208455 - RNA, 23 nt, Human
aguuggaccuggguaagaaaaug

SEQ ID NO: 208456 - RNA, 22 nt, Human
gagagggugccuggaagccagg

SEQ ID NO: 208457 - RNA, 22 nt, Human
uaguucaggaagagaaacaaca

SEQ ID NO: 208458 - RNA, 22 nt, Human
gacagacacaauugauccauga

SEQ ID NO: 208459 - RNA, 22 nt, Human
augguauuaagaacaauuccaa

SEQ ID NO: 208460 - RNA, 22 nt, Human
ugcagaguaaaagcagaugcua

SEQ ID NO: 208461 - RNA, 21 nt, Human
ccuggcagaagccugauaugc

SEQ ID NO: 208462 - RNA, 22 nt, Human
ucuuuggaaaugcuuugagaau

SEQ ID NO: 208463 - RNA, 22 nt, Human
ucacuggggccaugugagggac

SEQ ID NO: 208464 - RNA, 22 nt, Human
aggcuugguuuauagaaguaau

SEQ ID NO: 208465 - RNA, 22 nt, Human
uagacuuuucaaaaucuagacc

SEQ ID NO: 208466 - RNA, 22 nt, Human
uacaguucuuugaaggaucuag

SEQ ID NO: 208467 - RNA, 22 nt, Human
ggcugaggcggcgaugcccuug

SEQ ID NO: 208468 - RNA, 22 nt, Human
aauuuccagaccccauccacag

SEQ ID NO: 208469 - RNA, 22 nt, Human
cagcuaggagaaaagguguuuu

SEQ ID NO: 208470 - RNA, 22 nt, Human
agcagggcacuggaaggcacug

SEQ ID NO: 208471 - RNA, 22 nt, Human
cugaggcuuggaggggucuggu

SEQ ID NO: 208472 - RNA, 22 nt, Human
agagcacggccaccauuuacaa

SEQ ID NO: 208473 - RNA, 22 nt, Human
uacuguacauuccguuuguugc

SEQ ID NO: 208474 - RNA, 22 nt, Human
ccagugccuauccuucuccugu

SEQ ID NO: 208475 - RNA, 22 nt, Human
uaauuacaaagcaagcacaggg

SEQ ID NO: 208476 - RNA, 22 nt, Human
ucucaaauguaaagcaugauuu

SEQ ID NO: 208477 - RNA, 22 nt, Human
aggcacagguggacuucacagu

SEQ ID NO: 208478 - RNA, 22 nt, Human
agcagggcugcggccccaccac

SEQ ID NO: 208479 - RNA, 22 nt, Human
aucuccaguccugguuuccugg

SEQ ID NO: 208480 - RNA, 22 nt, Human
cagcugggccuccugagcccug

SEQ ID NO: 208481 - RNA, 22 nt, Human
acaaaggacugaaacuggcugu

SEQ ID NO: 208482 - RNA, 22 nt, Human
aggcucucagaucagccacauu

SEQ ID NO: 208483 - RNA, 22 nt, Human
uuuaucugugguaaauaacauu

SEQ ID NO: 208484 - RNA, 22 nt, Human
agaggaauuucuggaaggaggc

SEQ ID NO: 208485 - RNA, 22 nt, Human
ucaaagagcuauucaguugugg

SEQ ID NO: 208486 - RNA, 22 nt, Human
ugcagaggagucagccugggca

SEQ ID NO: 208487 - RNA, 22 nt, Human
gagaggggaccugugugucuag

SEQ ID NO: 208488 - RNA, 22 nt, Human
caugacauccugaagcugcaca

SEQ ID NO: 208489 - RNA, 22 nt, Human
caaggcaguuccccagagggcu

SEQ ID NO: 208490 - RNA, 22 nt, Human
uggcagagcaaaaagauagaau

SEQ ID NO: 208491 - RNA, 22 nt, Human
agaggcucugccgccucaggua

SEQ ID NO: 208492 - RNA, 22 nt, Human
ggcacagggugauguugcaguu

SEQ ID NO: 208493 - RNA, 23 nt, Human
uguaacaauuucauauacaugca

SEQ ID NO: 208494 - RNA, 22 nt, Human
gcaggaggagcauuaacugagc

SEQ ID NO: 208495 - RNA, 22 nt, Human
ccuguucuguggcucucaaagg

SEQ ID NO: 208496 - RNA, 22 nt, Human
ucagcuuucucagaggccuaac

SEQ ID NO: 208497 - RNA, 22 nt, Human
ccacaaaacugugugucaaaga

SEQ ID NO: 208498 - RNA, 22 nt, Human
agggacccauagagagaccagu

SEQ ID NO: 208499 - RNA, 22 nt, Human
uuucagacuccaaauucauaag

SEQ ID NO: 208500 - RNA, 22 nt, Human
caagaggcuaaacugggcuauu

SEQ ID NO: 208501 - RNA, 22 nt, Human
uacaguaccugccacguuguug

SEQ ID NO: 208502 - RNA, 22 nt, Human
uuugcucaguucucuguauuuu

SEQ ID NO: 208503 - RNA, 22 nt, Human
cuuagcaaggcugccuggagaa

SEQ ID NO: 208504 - RNA, 22 nt, Human
ucugguacuagaggagugcugg

SEQ ID NO: 208505 - RNA, 22 nt, Human
cuccaguggcacaaaugggugc

SEQ ID NO: 208506 - RNA, 22 nt, Human
ucugcucacauggcuccaugca

SEQ ID NO: 208507 - RNA, 22 nt, Human
uguuugugcugccuggugggca

SEQ ID NO: 208508 - RNA, 19 nt, Human
uuagaacauccucuaggga

SEQ ID NO: 208509 - RNA, 22 nt, Human
uuccaucuuucagcuuuguugg

SEQ ID NO: 208510 - RNA, 22 nt, Human
aacuucauguaauuuaaaacag

SEQ ID NO: 208511 - RNA, 22 nt, Human
ugggccucggagcacaggagac

SEQ ID NO: 208512 - RNA, 22 nt, Human
guuuguaaccagaacagagagu

SEQ ID NO: 208513 - RNA, 22 nt, Human
gcacagcccugagcgcaugucu

SEQ ID NO: 208514 - RNA, 22 nt, Human
ugcagcaagaccggauaugucg

SEQ ID NO: 208515 - RNA, 22 nt, Human
aucuuuggccacuugugcugca

SEQ ID NO: 208516 - RNA, 22 nt, Human
ucagagagaaauaguuuuugac

SEQ ID NO: 208517 - RNA, 22 nt, Human
aaggauuuuuggaaugagaugg

SEQ ID NO: 208518 - RNA, 22 nt, Human
aagggagcggggagacccuaug

SEQ ID NO: 208519 - RNA, 23 nt, Human
agguucccccgccaggacccugc

SEQ ID NO: 208520 - RNA, 22 nt, Human
gugcccaggcccaaggcaccac

SEQ ID NO: 208521 - RNA, 19 nt, Human
ucaacaguggugcugugga

SEQ ID NO: 208522 - RNA, 22 nt, Human
acagcaacuccugcuucugagu

SEQ ID NO: 208523 - RNA, 22 nt, Human
gaagaguauauuuagugaaauc

SEQ ID NO: 208524 - RNA, 22 nt, Human
uugaaucucuugaaucucuguu

SEQ ID NO: 208525 - RNA, 22 nt, Human
uguaauggagcuuagaguuauc

SEQ ID NO: 208526 - RNA, 22 nt, Human
uggacccaccccagggccugcu

SEQ ID NO: 208527 - RNA, 22 nt, Human
ugggacacagaaaaggcagguu

SEQ ID NO: 208528 - RNA, 22 nt, Human
uggauucugggcuguuugcauu

SEQ ID NO: 208529 - RNA, 22 nt, Human
ucucugggucucaguuuguaca

SEQ ID NO: 208530 - RNA, 20 nt, Human
ucacaucuggcagcugauga

SEQ ID NO: 208531 - RNA, 22 nt, Human
cacuggugccagagaacagaau

SEQ ID NO: 208532 - RNA, 22 nt, Human
uccuggagaauccugccaccug

SEQ ID NO: 208533 - RNA, 22 nt, Human
uugaaucuauaauuucaguauu

SEQ ID NO: 208534 - RNA, 22 nt, Human
ccucagagguguggcaucucug

SEQ ID NO: 208535 - RNA, 21 nt, Human
ucuguggcagcaugaugaggu

SEQ ID NO: 208536 - RNA, 22 nt, Human
aaugaaacuguauauagacugu

SEQ ID NO: 208537 - RNA, 23 nt, Human
gaagccacacaaaggucgccaag

SEQ ID NO: 208538 - RNA, 22 nt, Human
ucugggaacacacgucacuuca

SEQ ID NO: 208539 - RNA, 22 nt, Human
gcugaaaugggcacugaaggcc

SEQ ID NO: 208540 - RNA, 22 nt, Human
aggggcugccuggcuuggcacu

SEQ ID NO: 208541 - RNA, 22 nt, Human
cagagccaggccugcccucuuu

SEQ ID NO: 208542 - RNA, 22 nt, Human
ccaggcagcucugauuuauguc

SEQ ID NO: 208543 - RNA, 22 nt, Human
ggcuggcagcuucaucccagau

SEQ ID NO: 208544 - RNA, 22 nt, Human
guuuaagaggguuucauuccca

SEQ ID NO: 208545 - RNA, 21 nt, Human
ugaugaggucauagcacccuc

SEQ ID NO: 208546 - RNA, 22 nt, Human
cuugaaagauuuggccucugug

SEQ ID NO: 208547 - RNA, 22 nt, Human
uauuuccaaaagccuauuauga

SEQ ID NO: 208548 - RNA, 18 nt, Human
ucaaaauauuucugugga

SEQ ID NO: 208549 - RNA, 22 nt, Human
caaagcuggaaaaggaggcugg

SEQ ID NO: 208550 - RNA, 22 nt, Human
acuacacuccaauuuucuaggu

SEQ ID NO: 208551 - RNA, 22 nt, Human
ggcagccagcaaugagaaguuu

SEQ ID NO: 208552 - RNA, 22 nt, Human
caggguugcaugcaucuguggg

SEQ ID NO: 208553 - RNA, 20 nt, Human
cccaggcagagcuagcggca

SEQ ID NO: 208554 - RNA, 22 nt, Human
uugucucugccaugcuugaggg

SEQ ID NO: 208555 - RNA, 22 nt, Human
agagccuggaccugagcuacaa

SEQ ID NO: 208556 - RNA, 23 nt, Human
aguuuuucugcaugguucuguau

SEQ ID NO: 208557 - RNA, 20 nt, Human
agcagcauuguucuagagca

SEQ ID NO: 208558 - RNA, 22 nt, Human
uucacauaaugauacaaagcuu

SEQ ID NO: 208559 - RNA, 22 nt, Human
aaugcuggaagccucaguagau

SEQ ID NO: 208560 - RNA, 22 nt, Human
gagucuuaggcaaaaauaaugg

SEQ ID NO: 208561 - RNA, 21 nt, Human
ucucuggaauuagaccauguu

SEQ ID NO: 208562 - RNA, 22 nt, Human
aaggcagaaauucaacuacugg

SEQ ID NO: 208563 - RNA, 22 nt, Human
uuacaugaauacauaaccauuc

SEQ ID NO: 208564 - RNA, 22 nt, Human
ggcugagggucccagacccuaa

SEQ ID NO: 208565 - RNA, 22 nt, Human
aauauaaugcuguuuuaugcca

SEQ ID NO: 208566 - RNA, 22 nt, Human
ucuguacuuccuuuaaacuuua

SEQ ID NO: 208567 - RNA, 23 nt, Human
aucuuagcauagacuugaguccc

SEQ ID NO: 208568 - RNA, 22 nt, Human
uccaguguuuuucuucacaggu

SEQ ID NO: 208569 - RNA, 22 nt, Human
aggaggcacucacucucagggu

SEQ ID NO: 208570 - RNA, 16 nt, Human
gcuggagggagggguu

SEQ ID NO: 208571 - RNA, 20 nt, Human
ucuuauugucuugaggaguu

SEQ ID NO: 208572 - RNA, 22 nt, Human
ucucaggaaaaaucccuagcuu

SEQ ID NO: 208573 - RNA, 19 nt, Human
aggcugcccagucucugcc

SEQ ID NO: 208574 - RNA, 22 nt, Human
caggaagugugccugagcaccu

SEQ ID NO: 208575 - RNA, 22 nt, Human
augcaaaaacugcacuuacgcu

SEQ ID NO: 208576 - RNA, 22 nt, Human
ccuaggcccuaggcuuccauca

SEQ ID NO: 208577 - RNA, 22 nt, Human
ggcuucucgugccgaagcaaga

SEQ ID NO: 208578 - RNA, 22 nt, Human
ccugcaccacaaggcuucagag

SEQ ID NO: 208579 - RNA, 22 nt, Human
acugugccacaauucaccaggg

SEQ ID NO: 208580 - RNA, 22 nt, Human
aaacaguaaguucuaguauuau

SEQ ID NO: 208581 - RNA, 22 nt, Human
gaccaggagauuugagcuaggc

SEQ ID NO: 208582 - RNA, 22 nt, Human
cagggcaguuugugccuaugag

SEQ ID NO: 208583 - RNA, 22 nt, Human
cucugaagccccaaauaguccg

SEQ ID NO: 208584 - RNA, 22 nt, Human
uuguuucuccagucuaggaaaa

SEQ ID NO: 208585 - RNA, 22 nt, Human
ggagacucggguucuagccuug

SEQ ID NO: 208586 - RNA, 20 nt, Human
uuucuauggggccagcacau

SEQ ID NO: 208587 - RNA, 22 nt, Human
ugagacaguucugcagcugggu

SEQ ID NO: 208588 - RNA, 22 nt, Human
gcccccagcucucaagcucaaa

SEQ ID NO: 208589 - RNA, 22 nt, Human
ccucccuuuuggugucugcaua

SEQ ID NO: 208590 - RNA, 22 nt, Human
guguucauggaugucaauuuga

SEQ ID NO: 208591 - RNA, 22 nt, Human
aaugagucaaaacagcauauag

SEQ ID NO: 208592 - RNA, 22 nt, Human
caggcccagcccagcccuucga

SEQ ID NO: 208593 - RNA, 22 nt, Human
gggagggccaggcucacccagg

SEQ ID NO: 208594 - RNA, 22 nt, Human
cagcacuggggccacuggaguu

SEQ ID NO: 208595 - RNA, 22 nt, Human
uuucauguaaucauuuaggugg

SEQ ID NO: 208596 - RNA, 22 nt, Human
uagaaacccaggauuuguauuu

SEQ ID NO: 208597 - RNA, 20 nt, Human
cugcacugaacaugucugag

SEQ ID NO: 208598 - RNA, 22 nt, Human
cuggaaggcucugcugccuguc

SEQ ID NO: 208599 - RNA, 22 nt, Human
ucucaaggaaaagugauggcau

SEQ ID NO: 208600 - RNA, 22 nt, Human
acaggcacuuugacaugccauc

SEQ ID NO: 208601 - RNA, 22 nt, Human
gccugggagagggauagugcag

SEQ ID NO: 208602 - RNA, 22 nt, Human
uuucucaaaagacagaagugaa

SEQ ID NO: 208603 - RNA, 22 nt, Human
auucaguaggucuagaauaaga

SEQ ID NO: 208604 - RNA, 22 nt, Human
uucuagaaacacaugcaaacag

SEQ ID NO: 208605 - RNA, 22 nt, Human
uuacauaguuaaauaguacagc

SEQ ID NO: 208606 - RNA, 22 nt, Human
cuaugaccccagcaugaauaag

SEQ ID NO: 208607 - RNA, 22 nt, Human
ucaggcucuggguacaccugac

SEQ ID NO: 208608 - RNA, 22 nt, Human
ucagaggauagaaauacuuauu

SEQ ID NO: 208609 - RNA, 22 nt, Human
acucagaggggacugguguggu

SEQ ID NO: 208610 - RNA, 22 nt, Human
uacuguuuuuuagacucauggu

SEQ ID NO: 208611 - RNA, 22 nt, Human
gaacauaugcauguuuguuuug

SEQ ID NO: 208612 - RNA, 20 nt, Human
acuguucaagggccuggugg

SEQ ID NO: 208613 - RNA, 22 nt, Human
aagcugaaaaugagacucuaca

SEQ ID NO: 208614 - RNA, 22 nt, Human
gauacacuggccaaguggagga

SEQ ID NO: 208615 - RNA, 22 nt, Human
caucuuuaaaggggagacaccc

SEQ ID NO: 208616 - RNA, 18 nt, Human
ucaugagguagaggcugg

SEQ ID NO: 208617 - RNA, 22 nt, Human
cuuugaaaacuuaaauaacagc

SEQ ID NO: 208618 - RNA, 22 nt, Human
aaauacaaaaauuagccaggca

SEQ ID NO: 208619 - RNA, 22 nt, Human
ugcagcugugaaagggaaccaa

SEQ ID NO: 208620 - RNA, 22 nt, Human
cucuguaccuggcauagcaacc

SEQ ID NO: 208621 - RNA, 22 nt, Human
aagguuaaauagguauuuucca

SEQ ID NO: 208622 - RNA, 22 nt, Human
agguccaggagauuuggcaauu

SEQ ID NO: 208623 - RNA, 22 nt, Human
gcuggcagaauuucuucuugcu

SEQ ID NO: 208624 - RNA, 23 nt, Human
uuggaaauggggagaacagauuc

SEQ ID NO: 208625 - RNA, 22 nt, Human
uacuguacucaacaugugaguu

SEQ ID NO: 208626 - RNA, 19 nt, Human
uacauugcugguggggaug

SEQ ID NO: 208627 - RNA, 22 nt, Human
ucaggcucucagaccaacagca

SEQ ID NO: 208628 - RNA, 22 nt, Human
uucuuuucccaauauuuugcug

SEQ ID NO: 208629 - RNA, 22 nt, Human
auuacaguggacagcuaugcac

SEQ ID NO: 208630 - RNA, 20 nt, Human
uggacacagcccuguugagu

SEQ ID NO: 208631 - RNA, 22 nt, Human
gcugaaggcccggaggacaggg

SEQ ID NO: 208632 - RNA, 22 nt, Human
augcagaaagagaauguaaugu

SEQ ID NO: 208633 - RNA, 22 nt, Human
caggcuggacauuagauacaua

SEQ ID NO: 208634 - RNA, 22 nt, Human
ugucuccaugugauaguggccu

SEQ ID NO: 208635 - RNA, 22 nt, Human
uuucucagagcacggggaguga

SEQ ID NO: 208636 - RNA, 22 nt, Human
aggccaggaccauuagcccaga

SEQ ID NO: 208637 - RNA, 22 nt, Human
gcagggacgcagcacucuccgu

SEQ ID NO: 208638 - RNA, 22 nt, Human
acagauaaagaaacaaucacag

SEQ ID NO: 208639 - RNA, 22 nt, Human
ucccagggccgcaaacgaguuu

SEQ ID NO: 208640 - RNA, 23 nt, Human
acauacauggagauaaagugaug

SEQ ID NO: 208641 - RNA, 19 nt, Human
gcuggcuggaggagggaca

SEQ ID NO: 208642 - RNA, 22 nt, Human
aauagcauccuaaaacauacuu

SEQ ID NO: 208643 - RNA, 22 nt, Human
agucacauagcucugguuucuu

SEQ ID NO: 208644 - RNA, 20 nt, Human
cuuuaguuauuaacagcacu

SEQ ID NO: 208645 - RNA, 22 nt, Human
ucuggcuuucauuuguuuaaag

SEQ ID NO: 208646 - RNA, 20 nt, Human
aaaugcuuuugacacauauu

SEQ ID NO: 208647 - RNA, 22 nt, Human
augugcaacuuuucugucuuuu

SEQ ID NO: 208648 - RNA, 22 nt, Human
ucccugagugggcugguaguau

SEQ ID NO: 208649 - RNA, 22 nt, Human
acuuagaauuaaauauuuuugg

SEQ ID NO: 208650 - RNA, 23 nt, Human
uaauuagauguugauuccugaga

SEQ ID NO: 208651 - RNA, 21 nt, Human
cuuauucacuguuauuuauca

SEQ ID NO: 208652 - RNA, 22 nt, Human
uggaaucucuuuggggacugaa

SEQ ID NO: 208653 - RNA, 22 nt, Human
uccagagccugcgcacuggcug

SEQ ID NO: 208654 - RNA, 22 nt, Human
ccaggcuguaaacaccuucaaa

SEQ ID NO: 208655 - RNA, 22 nt, Human
caugauuuacuaaaauuuguuu

SEQ ID NO: 208656 - RNA, 22 nt, Human
aggcuccauucaugugaaggca

SEQ ID NO: 208657 - RNA, 22 nt, Human
aaaggaggccacauggcuagga

SEQ ID NO: 208658 - RNA, 22 nt, Human
gcugccagcucacucuccugag

SEQ ID NO: 208659 - RNA, 22 nt, Human
ugcagaggcuggcucgccgggu

SEQ ID NO: 208660 - RNA, 22 nt, Human
uuugcgucuaugugugagccuu

SEQ ID NO: 208661 - RNA, 22 nt, Human
agucugaaccagauggcaaggu

SEQ ID NO: 208662 - RNA, 22 nt, Human
guccaaggauggggucucccag

SEQ ID NO: 208663 - RNA, 22 nt, Human
ccuggcugugcauugccggccc

SEQ ID NO: 208664 - RNA, 22 nt, Human
ugugggcuguacugagggcagg

SEQ ID NO: 208665 - RNA, 22 nt, Human
ggcagcuggggcagugcccugu

SEQ ID NO: 208666 - RNA, 22 nt, Human
aaaggugacugcagcagcuauu

SEQ ID NO: 208667 - RNA, 22 nt, Human
caacuuuucugugaauuuaagu

SEQ ID NO: 208668 - RNA, 22 nt, Human
aggaggugcuagagaagauguu

SEQ ID NO: 208669 - RNA, 22 nt, Human
agccauguaugaggguuuccag

SEQ ID NO: 208670 - RNA, 22 nt, Human
cuacagccagaugcagaaaguu

SEQ ID NO: 208671 - RNA, 22 nt, Human
gcuguagguuuuuccaggaguu

SEQ ID NO: 208672 - RNA, 22 nt, Human
agccaggcuacuccuugcugac

SEQ ID NO: 208673 - RNA, 22 nt, Human
ggcuucuuuguaacgugccagc

SEQ ID NO: 208674 - RNA, 22 nt, Human
caggaggcaguggguguugucu

SEQ ID NO: 208675 - RNA, 19 nt, Human
ggucucagugcagcugcag

SEQ ID NO: 208676 - RNA, 20 nt, Human
ccugucuccucuuaccuggc

SEQ ID NO: 208677 - RNA, 22 nt, Human
gccaggguugccaaugggggca

SEQ ID NO: 208678 - RNA, 22 nt, Human
gcccagaguucaaggcugcagu

SEQ ID NO: 208679 - RNA, 19 nt, Human
guacagugguaagcuauga

SEQ ID NO: 208680 - RNA, 19 nt, Human
guggagcuaagaaaaggaa

SEQ ID NO: 208681 - RNA, 22 nt, Human
auggcugcucuggauggagucc

SEQ ID NO: 208682 - RNA, 22 nt, Human
gaauucauuagggaagcuaucu

SEQ ID NO: 208683 - RNA, 22 nt, Human
cacgccagccggacacugggcc

SEQ ID NO: 208684 - RNA, 22 nt, Human
cuccaggagggcuuccugugau

SEQ ID NO: 208685 - RNA, 22 nt, Human
ugaugucuaguacauacaagag

SEQ ID NO: 208686 - RNA, 17 nt, Human
gcuuccucaugcaguuc

SEQ ID NO: 208687 - RNA, 22 nt, Human
augccaggcuguuuggccucag

SEQ ID NO: 208688 - RNA, 20 nt, Human
aauauaauucucugaauuua

SEQ ID NO: 208689 - RNA, 22 nt, Human
aaaccauuagguuuuaucuacu

SEQ ID NO: 208690 - RNA, 22 nt, Human
caagcugguaucagcuagagcg

SEQ ID NO: 208691 - RNA, 22 nt, Human
gcaaauggagugaagagcugga

SEQ ID NO: 208692 - RNA, 22 nt, Human
auuugcuuuaagguauaaaagg

SEQ ID NO: 208693 - RNA, 22 nt, Human
cacagguggcuccaaguuagag

SEQ ID NO: 208694 - RNA, 22 nt, Human
ucugcagguaagcguucuugga

SEQ ID NO: 208695 - RNA, 22 nt, Human
cugccuggaaggagcaagggga

SEQ ID NO: 208696 - RNA, 22 nt, Human
gaggguggccuuuagagcccau

SEQ ID NO: 208697 - RNA, 22 nt, Human
gcuggguuuccagcaggcagga

SEQ ID NO: 208698 - RNA, 22 nt, Human
auuuuucucuuuccacugagau

SEQ ID NO: 208699 - RNA, 22 nt, Human
agacaauuguucuaaguaaaaa

SEQ ID NO: 208700 - RNA, 22 nt, Human
acagcucucccucagagaaaug

SEQ ID NO: 208701 - RNA, 22 nt, Human
cccacacucugagaaaugcuga

SEQ ID NO: 208702 - RNA, 22 nt, Human
agguggggaaaccagcgauccc

SEQ ID NO: 208703 - RNA, 22 nt, Human
ggggagcaauaguugaggugug

SEQ ID NO: 208704 - RNA, 19 nt, Human
gaauuuaucucuucagucc

SEQ ID NO: 208705 - RNA, 22 nt, Human
ccaggugggaggaaagcagaga

SEQ ID NO: 208706 - RNA, 22 nt, Human
ucagggaguguuggcaggauca

SEQ ID NO: 208707 - RNA, 22 nt, Human
cuagggacagaaagaggguaga

SEQ ID NO: 208708 - RNA, 22 nt, Human
ccuuggcuugugggcugcagcc

SEQ ID NO: 208709 - RNA, 22 nt, Human
aggcuggguaccugucauaugc

SEQ ID NO: 208710 - RNA, 22 nt, Human
aagggcccauucucucagaaaa

SEQ ID NO: 208711 - RNA, 22 nt, Human
uuugagaagauguaauguuaag

SEQ ID NO: 208712 - RNA, 22 nt, Human
aacagcauauuucauauauuga

SEQ ID NO: 208713 - RNA, 22 nt, Human
agagcccucuucacugccccuu

SEQ ID NO: 208714 - RNA, 22 nt, Human
cacaagaaauaagcugccuuuc

SEQ ID NO: 208715 - RNA, 18 nt, Human
guuuacauuacugaauag

SEQ ID NO: 208716 - RNA, 22 nt, Human
ucuccagucucaagacauugag

SEQ ID NO: 208717 - RNA, 22 nt, Human
ugggucuccugugccugggagg

SEQ ID NO: 208718 - RNA, 22 nt, Human
uguggcuguugaggaccccaag

SEQ ID NO: 208719 - RNA, 22 nt, Human
aagcugccuuccaugugaggaa

SEQ ID NO: 208720 - RNA, 22 nt, Human
gucucugugucugagagagccc

SEQ ID NO: 208721 - RNA, 21 nt, Human
gcucaggcucagguucagguu

SEQ ID NO: 208722 - RNA, 22 nt, Human
ucuuuaaugugauuguaauuau

SEQ ID NO: 208723 - RNA, 22 nt, Human
acuuuagaccaucuuccacagu

SEQ ID NO: 208724 - RNA, 22 nt, Human
gcccaggauaaugcugucccug

SEQ ID NO: 208725 - RNA, 22 nt, Human
ucuccagaguaaccuuggagca

SEQ ID NO: 208726 - RNA, 22 nt, Human
ugauucaauaggaauugaguag

SEQ ID NO: 208727 - RNA, 18 nt, Human
gccuggcugccaacccag

SEQ ID NO: 208728 - RNA, 22 nt, Human
acuaaagaugucuaaauauauu

SEQ ID NO: 208729 - RNA, 22 nt, Human
uccugagcaccuaugccauggc

SEQ ID NO: 208730 - RNA, 22 nt, Human
ggccaggcugcugggaccccgc

SEQ ID NO: 208731 - RNA, 22 nt, Human
cuuguuuuggaacagagugaau

SEQ ID NO: 208732 - RNA, 22 nt, Human
guacauaagaaauuacuacaga

SEQ ID NO: 208733 - RNA, 22 nt, Human
aaagucuuuauuuuguaucuuu

SEQ ID NO: 208734 - RNA, 22 nt, Human
agcugguuuaggaaaagguagg

SEQ ID NO: 208735 - RNA, 22 nt, Human
uuacauuaagccaauggauucu

SEQ ID NO: 208736 - RNA, 18 nt, Human
cugaggcccagagagggc

SEQ ID NO: 208737 - RNA, 22 nt, Human
uaaaggcaguuggaguugagga

SEQ ID NO: 208738 - RNA, 22 nt, Human
agcuccugugugaagccucccu

SEQ ID NO: 208739 - RNA, 22 nt, Human
uucucagggucuugugcaaggg

SEQ ID NO: 208740 - RNA, 22 nt, Human
caauuacauuuauugagcauuc

SEQ ID NO: 208741 - RNA, 22 nt, Human
guuacaaaggaagcuucacugc

SEQ ID NO: 208742 - RNA, 22 nt, Human
uugcauuuguuugaguagaaug

SEQ ID NO: 208743 - RNA, 22 nt, Human
guugaaagaucauguggcugcc

SEQ ID NO: 208744 - RNA, 22 nt, Human
uuuaugcagccucaguaucaga

SEQ ID NO: 208745 - RNA, 22 nt, Human
caucugcuguuccuuggacuca

SEQ ID NO: 208746 - RNA, 19 nt, Human
ucugccucuggucaggcuc

SEQ ID NO: 208747 - RNA, 22 nt, Human
caggaggagcauuagcgucuca

SEQ ID NO: 208748 - RNA, 22 nt, Human
ccuguggaggcugcucagcugg

SEQ ID NO: 208749 - RNA, 19 nt, Human
ucacauucagccuugcuga

SEQ ID NO: 208750 - RNA, 22 nt, Human
cuguuuaaccagaucucauauc

SEQ ID NO: 208751 - RNA, 23 nt, Human
uuguccagcugguuugggccaca

SEQ ID NO: 208752 - RNA, 22 nt, Human
acagacaucuauccauuuaauu

SEQ ID NO: 208753 - RNA, 23 nt, Human
caggugguagagaaaaauccaga

SEQ ID NO: 208754 - RNA, 22 nt, Human
ugcugucuuccaggauggugaa

SEQ ID NO: 208755 - RNA, 21 nt, Human
ugggccagaucugaguuucua

SEQ ID NO: 208756 - RNA, 22 nt, Human
augcucagggcacacucuggac

SEQ ID NO: 208757 - RNA, 22 nt, Human
gcccaggccggagagcagugcu

SEQ ID NO: 208758 - RNA, 22 nt, Human
uggcccugccgcacuauccuca

SEQ ID NO: 208759 - RNA, 22 nt, Human
auuuagaacuuuguuugccaau

SEQ ID NO: 208760 - RNA, 22 nt, Human
uuuucucuccagguggggugau

SEQ ID NO: 208761 - RNA, 22 nt, Human
auuagguugagguacucagagc

SEQ ID NO: 208762 - RNA, 22 nt, Human
aucugggcucgaauccuagcuc

SEQ ID NO: 208763 - RNA, 22 nt, Human
gccaggguggcagaaggcccca

SEQ ID NO: 208764 - RNA, 20 nt, Human
gcaaauggacacucagggaa

SEQ ID NO: 208765 - RNA, 18 nt, Human
aagucucugaaagcuuuu

SEQ ID NO: 208766 - RNA, 22 nt, Human
aacuugguaaauugugucagau

SEQ ID NO: 208767 - RNA, 22 nt, Human
acccuugguuuugcagagcugu

SEQ ID NO: 208768 - RNA, 19 nt, Human
ggaaccuuagagcuucagc

SEQ ID NO: 208769 - RNA, 22 nt, Human
ccucagcugcuucccuggagcc

SEQ ID NO: 208770 - RNA, 22 nt, Human
gaguugaucauuauuugguuuc

SEQ ID NO: 208771 - RNA, 22 nt, Human
augcuuuauuauuuugcaggga

SEQ ID NO: 208772 - RNA, 22 nt, Human
ucaggcuucacuccuguccaag

SEQ ID NO: 208773 - RNA, 22 nt, Human
ucuuaugaaaagcacuuagaac

SEQ ID NO: 208774 - RNA, 22 nt, Human
auauuuuuccaugugggacucu

SEQ ID NO: 208775 - RNA, 22 nt, Human
caaaaaacacagaugucugugu

SEQ ID NO: 208776 - RNA, 22 nt, Human
agucuuaugguuaaauagaugc

SEQ ID NO: 208777 - RNA, 22 nt, Human
caaugaaauugagauccagaga

SEQ ID NO: 208778 - RNA, 22 nt, Human
uggaagcaaaauauccuuuaau

SEQ ID NO: 208779 - RNA, 22 nt, Human
uaggaaacaaaguaaugcaacu

SEQ ID NO: 208780 - RNA, 22 nt, Human
gcagggcagagggagaaucucu

SEQ ID NO: 208781 - RNA, 22 nt, Human
gcuggguggaucggaggcucug

SEQ ID NO: 208782 - RNA, 22 nt, Human
agaaaggguucucugaggugcu

SEQ ID NO: 208783 - RNA, 22 nt, Human
uagaaaagauaacauucugugc

SEQ ID NO: 208784 - RNA, 22 nt, Human
uuauugcucuauuauggccuaa

SEQ ID NO: 208785 - RNA, 22 nt, Human
ccaggguuggucucucugaggu

SEQ ID NO: 208786 - RNA, 22 nt, Human
ccagagccagagaggugccugc

SEQ ID NO: 208787 - RNA, 23 nt, Human
cuagaauuuugcuaaaagacuag

SEQ ID NO: 208788 - RNA, 22 nt, Human
ggagcugaggcugaggccucac

SEQ ID NO: 208789 - RNA, 22 nt, Human
uaagauuacagugagaaauaaa

SEQ ID NO: 208790 - RNA, 22 nt, Human
agaagagaaauagugccacugu

SEQ ID NO: 208791 - RNA, 22 nt, Human
uuccaaagcugcuuuauuuagu

SEQ ID NO: 208792 - RNA, 22 nt, Human
ugaagaaaggugugggauacuc

SEQ ID NO: 208793 - RNA, 22 nt, Human
aaagcagcagaaucucucaggg

SEQ ID NO: 208794 - RNA, 22 nt, Human
ugugaaagcaagucuaguucuc

SEQ ID NO: 208795 - RNA, 22 nt, Human
aggucugguguugggccugaaa

SEQ ID NO: 208796 - RNA, 22 nt, Human
gaaguucuuuauagcaguguga

SEQ ID NO: 208797 - RNA, 22 nt, Human
gaaucucaguggaagcaggaag

SEQ ID NO: 208798 - RNA, 22 nt, Human
aaaagcaaggcagucugucuga

SEQ ID NO: 208799 - RNA, 22 nt, Human
gugcacagaaauugguaagacu

SEQ ID NO: 208800 - RNA, 22 nt, Human
uggcaggcugaguuggccuggu

SEQ ID NO: 208801 - RNA, 22 nt, Human
aauauuuuaggcuuuccaggcu

SEQ ID NO: 208802 - RNA, 22 nt, Human
uuuuugcuaauccccagccacu

SEQ ID NO: 208803 - RNA, 23 nt, Human
ccaguagcacaguuacccagugg

SEQ ID NO: 208804 - RNA, 19 nt, Human
uagaacugaggacuugcau

SEQ ID NO: 208805 - RNA, 22 nt, Human
ugacauguccaggugguccugu

SEQ ID NO: 208806 - RNA, 22 nt, Human
uauacagucuuuugcuauauuc

SEQ ID NO: 208807 - RNA, 22 nt, Human
gcaaagcaagcugucagccuca

SEQ ID NO: 208808 - RNA, 22 nt, Human
ugcaaacacuucaacgugcauc

SEQ ID NO: 208809 - RNA, 22 nt, Human
caggaaauaucuccuggcagag

SEQ ID NO: 208810 - RNA, 22 nt, Human
acauuaagaugugcuguaggau

SEQ ID NO: 208811 - RNA, 17 nt, Human
uugggagagaaagguau

SEQ ID NO: 208812 - RNA, 22 nt, Human
acaaguuagguuuuaauccaaa

SEQ ID NO: 208813 - RNA, 22 nt, Human
ugaugaaaaccagaacucucau

SEQ ID NO: 208814 - RNA, 22 nt, Human
acauucauuccaggucagucag

SEQ ID NO: 208815 - RNA, 17 nt, Human
ggaagaaaaggaucauc

SEQ ID NO: 208816 - RNA, 22 nt, Human
cagggcccauggcucagguagg

SEQ ID NO: 208817 - RNA, 22 nt, Human
aguuuuuccguggcuacgauaa

SEQ ID NO: 208818 - RNA, 20 nt, Human
uccuguccgcgccuugcguc

SEQ ID NO: 208819 - RNA, 22 nt, Human
agcagggcaguuaaaggguccu

SEQ ID NO: 208820 - RNA, 22 nt, Human
ugggccuccugcccuggccuag

SEQ ID NO: 208821 - RNA, 22 nt, Human
agcaggcacaagaaagggaggu

SEQ ID NO: 208822 - RNA, 22 nt, Human
cuacagugucgugugguuucug

SEQ ID NO: 208823 - RNA, 22 nt, Human
aguuguaucugaaugcauguag

SEQ ID NO: 208824 - RNA, 22 nt, Human
uggaggacaggacuggacagcc

SEQ ID NO: 208825 - RNA, 22 nt, Human
agagggggcagcggaccaguga

SEQ ID NO: 208826 - RNA, 22 nt, Human
cguggcugguggaccugagggc

SEQ ID NO: 208827 - RNA, 22 nt, Human
aggaggaagggaagacaaguaa

SEQ ID NO: 208828 - RNA, 22 nt, Human
uccucugagacaucagguugag

SEQ ID NO: 208829 - RNA, 22 nt, Human
gagaguggauggagcugcgaag

SEQ ID NO: 208830 - RNA, 22 nt, Human
agguuccaggucuggguuaugu

SEQ ID NO: 208831 - RNA, 22 nt, Human
agucucuuuguauaaauaggca

SEQ ID NO: 208832 - RNA, 22 nt, Human
agcauucaaguaauucacuugg

SEQ ID NO: 208833 - RNA, 22 nt, Human
caggcucccgcuccacugggca

SEQ ID NO: 208834 - RNA, 22 nt, Human
agacauuuugcauucccugaag

SEQ ID NO: 208835 - RNA, 22 nt, Human
agaaaacauuacauaggugugu

SEQ ID NO: 208836 - RNA, 22 nt, Human
gggugugucuuuugcuccugga

SEQ ID NO: 208837 - RNA, 22 nt, Human
ugcucauuugcccauuagcauc

SEQ ID NO: 208838 - RNA, 19 nt, Human
cacaucagcagggcugugg

SEQ ID NO: 208839 - RNA, 20 nt, Human
gacaggugcuaaagaggggc

SEQ ID NO: 208840 - RNA, 22 nt, Human
aaguagcauuuucaaaauguau

SEQ ID NO: 208841 - RNA, 22 nt, Human
gccucagagcuacacacacgca

SEQ ID NO: 208842 - RNA, 22 nt, Human
uccuguggcguuaucaugugau

SEQ ID NO: 208843 - RNA, 22 nt, Human
auauauaauacuugcugugggc

SEQ ID NO: 208844 - RNA, 22 nt, Human
gagagccagcucacuccagggc

SEQ ID NO: 208845 - RNA, 22 nt, Human
gauuuuauuagcccaaacuuug

SEQ ID NO: 208846 - RNA, 22 nt, Human
aaugaacacagcccucuacuuu

SEQ ID NO: 208847 - RNA, 22 nt, Human
ggcccugcaagguacccaggcc

SEQ ID NO: 208848 - RNA, 22 nt, Human
uuuaccaaauagauuaugucag

SEQ ID NO: 208849 - RNA, 22 nt, Human
ugaggggagcuagcaugccuug

SEQ ID NO: 208850 - RNA, 22 nt, Human
cagccagaaaguauguuaggga

SEQ ID NO: 208851 - RNA, 22 nt, Human
uuucucugugggcuuuaugcau

SEQ ID NO: 208852 - RNA, 22 nt, Human
ugaaucaauaguugcaaguauu

SEQ ID NO: 208853 - RNA, 19 nt, Human
uauauuuguugaauaaaaa

SEQ ID NO: 208854 - RNA, 22 nt, Human
aaauucaaugaucacuggcuca

SEQ ID NO: 208855 - RNA, 22 nt, Human
aagccugcuuuguuccacagca

SEQ ID NO: 208856 - RNA, 20 nt, Human
gcaagcuuauuagugauauu

SEQ ID NO: 208857 - RNA, 21 nt, Human
uggcugcaagcagcugccucc

SEQ ID NO: 208858 - RNA, 22 nt, Human
agcugccaggccccugagaacc

SEQ ID NO: 208859 - RNA, 18 nt, Human
gcuggcugcacuucugcu

SEQ ID NO: 208860 - RNA, 22 nt, Human
ugaacccaggagguugcaguga

SEQ ID NO: 208861 - RNA, 22 nt, Human
acuguucuccagcauggcugua

SEQ ID NO: 208862 - RNA, 21 nt, Human
aacaggucccccacgggcuuu

SEQ ID NO: 208863 - RNA, 22 nt, Human
acacaggaacucaagcucgcuu

SEQ ID NO: 208864 - RNA, 22 nt, Human
uuagucuucucauaguaaaacu

SEQ ID NO: 208865 - RNA, 22 nt, Human
acugagggagagucuuagguug

SEQ ID NO: 208866 - RNA, 22 nt, Human
agaagccaauccuugucucucu

SEQ ID NO: 208867 - RNA, 22 nt, Human
acagccuggccugaguuaaggc

SEQ ID NO: 208868 - RNA, 22 nt, Human
agaguuuguacuuuacccugag

SEQ ID NO: 208869 - RNA, 22 nt, Human
cauuagggacugaggaauaagg

SEQ ID NO: 208870 - RNA, 22 nt, Human
cacaguuugguauagaagugau

SEQ ID NO: 208871 - RNA, 22 nt, Human
ucagaggagcaaaagaggggau

SEQ ID NO: 208872 - RNA, 18 nt, Human
gcugcaggcccuccgagg

SEQ ID NO: 208873 - RNA, 22 nt, Human
gggaaagacccugagucuuauu

SEQ ID NO: 208874 - RNA, 22 nt, Human
uaggcagagguaugguaaggac

SEQ ID NO: 208875 - RNA, 22 nt, Human
cuguaacucugccaagaaggcu

SEQ ID NO: 208876 - RNA, 22 nt, Human
ccugugcacuaucugcauuuuu

SEQ ID NO: 208877 - RNA, 22 nt, Human
gucuccagagguuacauccugu

SEQ ID NO: 208878 - RNA, 22 nt, Human
cagguggggcgcccucaggcag

SEQ ID NO: 208879 - RNA, 22 nt, Human
ccacagcaccugcagccaguug

SEQ ID NO: 208880 - RNA, 22 nt, Human
aguccagguggaccuuggccag

SEQ ID NO: 208881 - RNA, 22 nt, Human
caccugccugcaggggcuccac

SEQ ID NO: 208882 - RNA, 17 nt, Human
cucacggaggaugaauc

SEQ ID NO: 208883 - RNA, 22 nt, Human
caugccauuuacuuggaggaga

SEQ ID NO: 208884 - RNA, 21 nt, Human
uauaacacacuucagcuucuc

SEQ ID NO: 208885 - RNA, 22 nt, Human
ucagugcauuguucauuguagg

SEQ ID NO: 208886 - RNA, 22 nt, Human
gagguucacuuccuggauccuu

SEQ ID NO: 208887 - RNA, 21 nt, Human
aagugguuuacauccagcugu

SEQ ID NO: 208888 - RNA, 22 nt, Human
aaaugauggaaaugaggcugaa

SEQ ID NO: 208889 - RNA, 22 nt, Human
caaagcguccugccuccauuug

SEQ ID NO: 208890 - RNA, 22 nt, Human
acaaauuuguguaguuauggca

SEQ ID NO: 208891 - RNA, 22 nt, Human
guucacuguacuggugaugguu

SEQ ID NO: 208892 - RNA, 21 nt, Human
ggagcuggggagcuggcccca

SEQ ID NO: 208893 - RNA, 22 nt, Human
ucagcugguguuucuucuccuu

SEQ ID NO: 208894 - RNA, 22 nt, Human
uuucuuccuaaauaugauuucc

SEQ ID NO: 208895 - RNA, 22 nt, Human
ccugugcccucugcauagcagc

SEQ ID NO: 208896 - RNA, 22 nt, Human
gcagauguucugugucucacaa

SEQ ID NO: 208897 - RNA, 22 nt, Human
cagagccagcaguggggacagg

SEQ ID NO: 208898 - RNA, 22 nt, Human
acuagaacuucuaacuaagguc

SEQ ID NO: 208899 - RNA, 22 nt, Human
aacaugauuuaguauaaugcag

SEQ ID NO: 208900 - RNA, 22 nt, Human
gcacacagggauuuuugaaugg

SEQ ID NO: 208901 - RNA, 22 nt, Human
gaauagcuugacaauuauuuuu

SEQ ID NO: 208902 - RNA, 22 nt, Human
acuugguggcgaacgaggguca

SEQ ID NO: 208903 - RNA, 22 nt, Human
uugguaauuguguuuauuaaau

SEQ ID NO: 208904 - RNA, 22 nt, Human
gcaagcaguuacccaggauucg

SEQ ID NO: 208905 - RNA, 18 nt, Human
cucaggccuuucccugug

SEQ ID NO: 208906 - RNA, 20 nt, Human
ggugcugauaagaaagaagu

SEQ ID NO: 208907 - RNA, 21 nt, Human
gcucucagcugccugcugguu

SEQ ID NO: 208908 - RNA, 22 nt, Human
uugguacaaugugcuagguagg

SEQ ID NO: 208909 - RNA, 22 nt, Human
cagaaguuggagcuuuccauca

SEQ ID NO: 208910 - RNA, 22 nt, Human
aucuuucuccauauacaucuuu

SEQ ID NO: 208911 - RNA, 20 nt, Human
ucaagacagacauggaguuu

SEQ ID NO: 208912 - RNA, 22 nt, Human
ugguccuggugcaagugcauuu

SEQ ID NO: 208913 - RNA, 22 nt, Human
gcugggcagccuggccgcugcc

SEQ ID NO: 208914 - RNA, 22 nt, Human
auggcuccauagcuucguuuag

SEQ ID NO: 208915 - RNA, 22 nt, Human
agggagccaggaacgcaggucg

SEQ ID NO: 208916 - RNA, 22 nt, Human
gucuuucuuaaacaacagaaca

SEQ ID NO: 208917 - RNA, 22 nt, Human
auuugugauaauuuguuacagc

SEQ ID NO: 208918 - RNA, 22 nt, Human
ugaggcaagaguuugauuagag

SEQ ID NO: 208919 - RNA, 22 nt, Human
uccucccuaaauccuagacugu

SEQ ID NO: 208920 - RNA, 22 nt, Human
caugauaauuguuaacaaagua

SEQ ID NO: 208921 - RNA, 22 nt, Human
auagcauauaaguuauaaaacu

SEQ ID NO: 208922 - RNA, 22 nt, Human
caugcaugccgggcugacagag

SEQ ID NO: 208923 - RNA, 22 nt, Human
uugagaggcuguugacauucug

SEQ ID NO: 208924 - RNA, 22 nt, Human
augucaaaugcugcaaacucau

SEQ ID NO: 208925 - RNA, 22 nt, Human
caggcagaaauuuuguuucauu

SEQ ID NO: 208926 - RNA, 20 nt, Human
aagcagaagcugcucucagc

SEQ ID NO: 208927 - RNA, 22 nt, Human
cccagggacagaugggcagcua

SEQ ID NO: 208928 - RNA, 22 nt, Human
ugauuuccuaggucuggagaag

SEQ ID NO: 208929 - RNA, 22 nt, Human
gccccucccagucaggagcacu

SEQ ID NO: 208930 - RNA, 22 nt, Human
auuuuaguuuuagcauccaugc

SEQ ID NO: 208931 - RNA, 22 nt, Human
cuagaaauucugauucaguagg

SEQ ID NO: 208932 - RNA, 22 nt, Human
aaauauaccaguugccugcauc

SEQ ID NO: 208933 - RNA, 22 nt, Human
agaaguuauccaccuuagaugc

SEQ ID NO: 208934 - RNA, 22 nt, Human
ucugagaggugaauucagcaaa

SEQ ID NO: 208935 - RNA, 22 nt, Human
cagcagcugcgugcccaggccg

SEQ ID NO: 208936 - RNA, 22 nt, Human
auguggauuugggagugaucag

SEQ ID NO: 208937 - RNA, 22 nt, Human
uacaaacuccgaaguuuguacc

SEQ ID NO: 208938 - RNA, 22 nt, Human
guuccucacguggacagaugau

SEQ ID NO: 208939 - RNA, 22 nt, Human
aaaugcagcagcuaauugaaaa

SEQ ID NO: 208940 - RNA, 23 nt, Human
agaggcacagcacuuggcuggcc

SEQ ID NO: 208941 - RNA, 22 nt, Human
gcaggugucuucagcaggauga

SEQ ID NO: 208942 - RNA, 23 nt, Human
ucugggcaccuuguugacaugau

SEQ ID NO: 208943 - RNA, 22 nt, Human
aacagcuauuagaacuucaugg

SEQ ID NO: 208944 - RNA, 22 nt, Human
aagggcucacccaacucacuuc

SEQ ID NO: 208945 - RNA, 22 nt, Human
ugcauuauaacugaauguuguu

SEQ ID NO: 208946 - RNA, 22 nt, Human
ugaaggcuugacugaggcagga

SEQ ID NO: 208947 - RNA, 22 nt, Human
agggaccagccugcccagggcu

SEQ ID NO: 208948 - RNA, 22 nt, Human
cucaguuucugacauuaaaauc

SEQ ID NO: 208949 - RNA, 22 nt, Human
ugcugagggcagaugaauuaga

SEQ ID NO: 208950 - RNA, 22 nt, Human
ucuuacccggcaacgugugucg

SEQ ID NO: 208951 - RNA, 21 nt, Human
ccuuggcuggcaucuagcacc

SEQ ID NO: 208952 - RNA, 22 nt, Human
uugcuucaguagcucuuuaaag

SEQ ID NO: 208953 - RNA, 22 nt, Human
cugccccaggccuccuuuucuu

SEQ ID NO: 208954 - RNA, 22 nt, Human
augaacaaugacuacauauuga

SEQ ID NO: 208955 - RNA, 19 nt, Human
uguccucacagagcauaac

SEQ ID NO: 208956 - RNA, 20 nt, Human
agguggcucuuccugggcuu

SEQ ID NO: 208957 - RNA, 22 nt, Human
uggcagagaugaagaguuguuu

SEQ ID NO: 208958 - RNA, 22 nt, Human
ggcucagcaaugaugagccccu

SEQ ID NO: 208959 - RNA, 22 nt, Human
caguucuuauuuggccaguguc

SEQ ID NO: 208960 - RNA, 21 nt, Human
ucaugcaggcagaguuuggua

SEQ ID NO: 208961 - RNA, 22 nt, Human
ucagcacuuggauuucagagau

SEQ ID NO: 208962 - RNA, 18 nt, Human
uuaguauaacugccugug

SEQ ID NO: 208963 - RNA, 22 nt, Human
cagccugagccuucuguagcaa

SEQ ID NO: 208964 - RNA, 22 nt, Human
aacauucaccucuaccuccuuc

SEQ ID NO: 208965 - RNA, 19 nt, Human
uccugcccaccagccaggg

SEQ ID NO: 208966 - RNA, 22 nt, Human
gcacaucuggagcucuguggaa

SEQ ID NO: 208967 - RNA, 17 nt, Human
ccagagaguaguuagga

SEQ ID NO: 208968 - RNA, 22 nt, Human
aaggauaaaaaccacuucuaau

SEQ ID NO: 208969 - RNA, 22 nt, Human
aucuuuagcauuacuuuauuca

SEQ ID NO: 208970 - RNA, 22 nt, Human
uugagaagaauguguugaguuu

SEQ ID NO: 208971 - RNA, 16 nt, Human
uaucuagaguugaggu

SEQ ID NO: 208972 - RNA, 22 nt, Human
gagacacaauuuccccauccua

SEQ ID NO: 208973 - RNA, 22 nt, Human
agauuuacucccugcuuccgcc

SEQ ID NO: 208974 - RNA, 22 nt, Human
aacauucaauugaggaaguuaa

SEQ ID NO: 208975 - RNA, 19 nt, Human
ucauaaaaaugguaaccca

SEQ ID NO: 208976 - RNA, 22 nt, Human
uacacaucucugucaguaguga

SEQ ID NO: 208977 - RNA, 22 nt, Human
aacauugcauucucuaugagau

SEQ ID NO: 208978 - RNA, 22 nt, Human
uucuuauucuugaaauguggga

SEQ ID NO: 208979 - RNA, 18 nt, Human
ucucuuuccucaguggag

SEQ ID NO: 208980 - RNA, 22 nt, Human
gcagcagaugugggcccagagc

SEQ ID NO: 208981 - RNA, 22 nt, Human
ucuacauuccuuuuauaauauc

SEQ ID NO: 208982 - RNA, 22 nt, Human
acccaggagccgugagagguua

SEQ ID NO: 208983 - RNA, 22 nt, Human
uggagcccaggagaggauaaac

SEQ ID NO: 208984 - RNA, 22 nt, Human
aucuuuggggcauccaggaaaa

SEQ ID NO: 208985 - RNA, 22 nt, Human
ggcuuuauguuuuucauguggu

SEQ ID NO: 208986 - RNA, 20 nt, Human
aguguacagacacuagaaau

SEQ ID NO: 208987 - RNA, 22 nt, Human
aacccuggagaaggcuuuggau

SEQ ID NO: 208988 - RNA, 22 nt, Human
cugcaggguuuuaacaauggac

SEQ ID NO: 208989 - RNA, 22 nt, Human
guuggccauuaauuggaggaca

SEQ ID NO: 208990 - RNA, 22 nt, Human
augggaggcaaagaucgcagaa

SEQ ID NO: 208991 - RNA, 23 nt, Human
ucagugcaaaaauaggauuuugg

SEQ ID NO: 208992 - RNA, 22 nt, Human
gccuccagcuggggcauuucag

SEQ ID NO: 208993 - RNA, 22 nt, Human
uagucagugcacagacacuugu

SEQ ID NO: 208994 - RNA, 22 nt, Human
ucccauauauguuuauauugga

SEQ ID NO: 208995 - RNA, 22 nt, Human
cagcacauaagccgaagacugu

SEQ ID NO: 208996 - RNA, 22 nt, Human
ccagagccuaagaucugauccu

SEQ ID NO: 208997 - RNA, 22 nt, Human
uucuccagacaggcagagggaa

SEQ ID NO: 208998 - RNA, 22 nt, Human
ugcuggguggacuuggcucuca

SEQ ID NO: 208999 - RNA, 22 nt, Human
agguggcaguuguggaaccauc

SEQ ID NO: 209000 - RNA, 22 nt, Human
cagcccaggcucagauguuggg

SEQ ID NO: 209001 - RNA, 22 nt, Human
cucagagccaguuagcaggugc

SEQ ID NO: 209002 - RNA, 22 nt, Human
guacaguaguaaaagugaauga

SEQ ID NO: 209003 - RNA, 22 nt, Human
uuucuguaaagaccaagccagc

SEQ ID NO: 209004 - RNA, 22 nt, Human
gcagauggcucagacacugggg

SEQ ID NO: 209005 - RNA, 22 nt, Human
aagccuucaguccguugcagag

SEQ ID NO: 209006 - RNA, 22 nt, Human
cucccuggcagccgcacuccug

SEQ ID NO: 209007 - RNA, 22 nt, Human
aaggcagcucagcucauggcag

SEQ ID NO: 209008 - RNA, 22 nt, Human
acccuccacaccagucuuauuu

SEQ ID NO: 209009 - RNA, 22 nt, Human
aucauuagaccaaacuagagcu

SEQ ID NO: 209010 - RNA, 22 nt, Human
cugggucugggccuccuggagu

SEQ ID NO: 209011 - RNA, 22 nt, Human
ccagggcagugggagaaggugc

SEQ ID NO: 209012 - RNA, 22 nt, Human
gaugagucauucacagucguga

SEQ ID NO: 209013 - RNA, 22 nt, Human
guauaaaguauaagcuuguuuu

SEQ ID NO: 209014 - RNA, 22 nt, Human
aauuuguuaaaagugagugaca

SEQ ID NO: 209015 - RNA, 22 nt, Human
acagauuuggaggccucacccc

SEQ ID NO: 209016 - RNA, 22 nt, Human
gggaaaucucguccucuauuua

SEQ ID NO: 209017 - RNA, 22 nt, Human
ugaugagggagauuugagccca

SEQ ID NO: 209018 - RNA, 19 nt, Human
uucauucucuuauuguugu

SEQ ID NO: 209019 - RNA, 23 nt, Human
uccauacucuaaacauguuauuu

SEQ ID NO: 209020 - RNA, 22 nt, Human
aaguguagauuauggagugucu

SEQ ID NO: 209021 - RNA, 22 nt, Human
cugggagcccugacuagccugg

SEQ ID NO: 209022 - RNA, 22 nt, Human
cagggacagagacugcaccuug

SEQ ID NO: 209023 - RNA, 22 nt, Human
gcagguguggaguggggugagc

SEQ ID NO: 209024 - RNA, 22 nt, Human
gaacauuugaugaugacauugg

SEQ ID NO: 209025 - RNA, 22 nt, Human
augcaacaguucauaguuuuau

SEQ ID NO: 209026 - RNA, 22 nt, Human
uuuacaauugguuuucucuaau

SEQ ID NO: 209027 - RNA, 22 nt, Human
agaggcugugcccaccaggcaa

SEQ ID NO: 209028 - RNA, 22 nt, Human
accagagcuuacaugcuagaaa

SEQ ID NO: 209029 - RNA, 22 nt, Human
guauacaacuauuguuggguaa

SEQ ID NO: 209030 - RNA, 22 nt, Human
ugaggcaggagaauggcgggaa

SEQ ID NO: 209031 - RNA, 22 nt, Human
gucacuguuuccuauuauauuu

SEQ ID NO: 209032 - RNA, 22 nt, Human
agcaagauuuuccuugaauguu

SEQ ID NO: 209033 - RNA, 20 nt, Human
ccagcacccucucagcugaa

SEQ ID NO: 209034 - RNA, 22 nt, Human
cagcaggaggugaguagcaggu

SEQ ID NO: 209035 - RNA, 22 nt, Human
uaaguucaagucuuggauauaa

SEQ ID NO: 209036 - RNA, 18 nt, Human
uggcucugccacucaccg

SEQ ID NO: 209037 - RNA, 22 nt, Human
ccagaccacccuggccaugcac

SEQ ID NO: 209038 - RNA, 22 nt, Human
ccuguaggauauuguagaauac

SEQ ID NO: 209039 - RNA, 22 nt, Human
gccacugucauacccuggcaau

SEQ ID NO: 209040 - RNA, 22 nt, Human
ggagcccugcugacaugggugu

SEQ ID NO: 209041 - RNA, 20 nt, Human
aggcuccuccaggaugugug

SEQ ID NO: 209042 - RNA, 22 nt, Human
aagccaguaaguuuuugucauu

SEQ ID NO: 209043 - RNA, 22 nt, Human
aaugucucaccguaaauguaac

SEQ ID NO: 209044 - RNA, 22 nt, Human
uugugguuaaccgcacauuuuu

SEQ ID NO: 209045 - RNA, 22 nt, Human
agaugcagauuuggauucagga

SEQ ID NO: 209046 - RNA, 22 nt, Human
caguuacauaaaugauaaaaug

SEQ ID NO: 209047 - RNA, 22 nt, Human
agguauuauuagcaucucuauu

SEQ ID NO: 209048 - RNA, 22 nt, Human
gggucuucugauauagguccag

SEQ ID NO: 209049 - RNA, 22 nt, Human
ccaggcuggaaucaauauucug

SEQ ID NO: 209050 - RNA, 19 nt, Human
ucucuggcaguucagagca

SEQ ID NO: 209051 - RNA, 22 nt, Human
ugagcccagaagcccacucggc

SEQ ID NO: 209052 - RNA, 18 nt, Human
agggagcaucugguugcc

SEQ ID NO: 209053 - RNA, 22 nt, Human
ugaaauuagugaaguuacaguu

SEQ ID NO: 209054 - RNA, 22 nt, Human
ucugggcuuggguagaaaucac

SEQ ID NO: 209055 - RNA, 22 nt, Human
acaggggugcauggugcauggu

SEQ ID NO: 209056 - RNA, 22 nt, Human
aggccaggauagcauggaucag

SEQ ID NO: 209057 - RNA, 22 nt, Human
aaagacauggaacuagagaugg

SEQ ID NO: 209058 - RNA, 22 nt, Human
uuccugugucccgggcacccug

SEQ ID NO: 209059 - RNA, 22 nt, Human
uacaaagucagaauaacaggug

SEQ ID NO: 209060 - RNA, 22 nt, Human
cccugaccaccagcuccauuug

SEQ ID NO: 209061 - RNA, 22 nt, Human
guugggaagcagauggaugagc

SEQ ID NO: 209062 - RNA, 22 nt, Human
uucuuuuuaucuucccauaaga

SEQ ID NO: 209063 - RNA, 17 nt, Human
cagugcagauaagugag

SEQ ID NO: 209064 - RNA, 22 nt, Human
ucccaauuaacagguaucaggc

SEQ ID NO: 209065 - RNA, 22 nt, Human
ucaaauuaguggaauaauaaug

SEQ ID NO: 209066 - RNA, 22 nt, Human
cauguugaauggccuugauuuu

SEQ ID NO: 209067 - RNA, 18 nt, Human
cccagccucuccuuucua

SEQ ID NO: 209068 - RNA, 22 nt, Human
agauuuaaauuugcuacaauuc

SEQ ID NO: 209069 - RNA, 20 nt, Human
agaaggcuccuuuugccaag

SEQ ID NO: 209070 - RNA, 22 nt, Human
agcuauggaacagaguggcugu

SEQ ID NO: 209071 - RNA, 22 nt, Human
aggaccagccuccaggucucuu

SEQ ID NO: 209072 - RNA, 22 nt, Human
uuugggaugcuagacaccucag

SEQ ID NO: 209073 - RNA, 22 nt, Human
gaaggagggagcggcgcggauu

SEQ ID NO: 209074 - RNA, 20 nt, Human
agauuaggggcuuucuucuu

SEQ ID NO: 209075 - RNA, 22 nt, Human
ucaggccaggagaucagauuga

SEQ ID NO: 209076 - RNA, 22 nt, Human
uauaugcagugugucauucaag

SEQ ID NO: 209077 - RNA, 22 nt, Human
ucugggugggcccgagaaaucu

SEQ ID NO: 209078 - RNA, 22 nt, Human
agugcuccuauggaucaguugu

SEQ ID NO: 209079 - RNA, 22 nt, Human
uggcugcaguucacaggagcaa

SEQ ID NO: 209080 - RNA, 22 nt, Human
gcuguggcugacauugcagaca

SEQ ID NO: 209081 - RNA, 22 nt, Human
cugggccucucagcucccgcgg

SEQ ID NO: 209082 - RNA, 22 nt, Human
augucgauaggagugccaucgg

SEQ ID NO: 209083 - RNA, 22 nt, Human
uaaggaggugcccacucucagg

SEQ ID NO: 209084 - RNA, 22 nt, Human
cucugaccauucccuugauuuu

SEQ ID NO: 209085 - RNA, 22 nt, Human
ugagaaauuacuucagugaugg

SEQ ID NO: 209086 - RNA, 22 nt, Human
ucauguuuuaguaaagugaagg

SEQ ID NO: 209087 - RNA, 22 nt, Human
uucugggagagaaagggccuug

SEQ ID NO: 209088 - RNA, 22 nt, Human
accucagaggccagggaucuag

SEQ ID NO: 209089 - RNA, 22 nt, Human
aagagacagagccauguuucua

SEQ ID NO: 209090 - RNA, 22 nt, Human
cagccuggagccacagcccagg

SEQ ID NO: 209091 - RNA, 22 nt, Human
gaggcccaguggagggccaugg

SEQ ID NO: 209092 - RNA, 22 nt, Human
gcaggcucccuugcagagcagg

SEQ ID NO: 209093 - RNA, 22 nt, Human
aggcgcagaaggccaggggccu

SEQ ID NO: 209094 - RNA, 22 nt, Human
uuucuucaauugcuaacaagga

SEQ ID NO: 209095 - RNA, 22 nt, Human
ggugcugagugagcuagaggcu

SEQ ID NO: 209096 - RNA, 22 nt, Human
cauagacaaagaucagaagagu

SEQ ID NO: 209097 - RNA, 22 nt, Human
uccaggcuagaagucacaggcc

SEQ ID NO: 209098 - RNA, 22 nt, Human
uggcauguauacuugaguagga

SEQ ID NO: 209099 - RNA, 22 nt, Human
uguugacugguaacuuuaaaca

SEQ ID NO: 209100 - RNA, 22 nt, Human
aguuauuucaguaacauaauag

SEQ ID NO: 209101 - RNA, 22 nt, Human
cugacaaaggcaaggcaggggg

SEQ ID NO: 209102 - RNA, 21 nt, Human
agcaggugcuguuggaggaaa

SEQ ID NO: 209103 - RNA, 22 nt, Human
uauuuuacaugacagguguuua

SEQ ID NO: 209104 - RNA, 22 nt, Human
aaacauucacauuugcuaguaa

SEQ ID NO: 209105 - RNA, 23 nt, Human
gccugggacugguagugugaccu

SEQ ID NO: 209106 - RNA, 22 nt, Human
gacauuuauuagaaaacuauca

SEQ ID NO: 209107 - RNA, 22 nt, Human
aggagucacucagggcuucauc

SEQ ID NO: 209108 - RNA, 22 nt, Human
agccuucaguaagggcuuagca

SEQ ID NO: 209109 - RNA, 22 nt, Human
ggacacagguaaauaccacuga

SEQ ID NO: 209110 - RNA, 22 nt, Human
ggucuagaucaagaacagaacu

SEQ ID NO: 209111 - RNA, 22 nt, Human
gaggcuccccaugaggccccag

SEQ ID NO: 209112 - RNA, 22 nt, Human
aguccugguucugauucugaca

SEQ ID NO: 209113 - RNA, 22 nt, Human
gcagguggggcugcuaccagaa

SEQ ID NO: 209114 - RNA, 22 nt, Human
uuucuagaugcggggcuugugc

SEQ ID NO: 209115 - RNA, 22 nt, Human
aggcuucugcugauauuucauu

SEQ ID NO: 209116 - RNA, 22 nt, Human
auaaauuaggaucugggguucc

SEQ ID NO: 209117 - RNA, 22 nt, Human
acauuugugcaacguauccaca

SEQ ID NO: 209118 - RNA, 22 nt, Human
ugccugggugcccucugcuccu

SEQ ID NO: 209119 - RNA, 21 nt, Human
ccugaaauucucacuagcuua

SEQ ID NO: 209120 - RNA, 22 nt, Human
ccaggcacucacggggcacugg

SEQ ID NO: 209121 - RNA, 22 nt, Human
agucuuaguaugguuuuagguu

SEQ ID NO: 209122 - RNA, 22 nt, Human
aaguuacaguuaugaaacucac

SEQ ID NO: 209123 - RNA, 22 nt, Human
ugcagggccaugguggcggcug

SEQ ID NO: 209124 - RNA, 22 nt, Human
accauacauuaaaugacuuuca

SEQ ID NO: 209125 - RNA, 22 nt, Human
agcucuggaauaaugaugugau

SEQ ID NO: 209126 - RNA, 20 nt, Human
uccuuuggccuuagagcugu

SEQ ID NO: 209127 - RNA, 22 nt, Human
cccuggcuuggcacucuccacu

SEQ ID NO: 209128 - RNA, 22 nt, Human
ccauuggagccaagaguuuuac

SEQ ID NO: 209129 - RNA, 22 nt, Human
uaaagugcugggauuauaggcc

SEQ ID NO: 209130 - RNA, 17 nt, Human
acagagcuacauauucu

SEQ ID NO: 209131 - RNA, 22 nt, Human
uggcccaggugcaagagacaga

SEQ ID NO: 209132 - RNA, 22 nt, Human
cuguuacuccuuuggcagauua

SEQ ID NO: 209133 - RNA, 22 nt, Human
aaacaguacucgauuuuuguag

SEQ ID NO: 209134 - RNA, 22 nt, Human
gcccccucuuuggagccagcca

SEQ ID NO: 209135 - RNA, 22 nt, Human
aucuuacacgauaacuguuagu

SEQ ID NO: 209136 - RNA, 22 nt, Human
ccagccagaaguccgggcuucu

SEQ ID NO: 209137 - RNA, 22 nt, Human
guugcuuuacagcuggugacag

SEQ ID NO: 209138 - RNA, 22 nt, Human
caggcagugucccaggaagcca

SEQ ID NO: 209139 - RNA, 22 nt, Human
ggccuggagucagggaaagcaa

SEQ ID NO: 209140 - RNA, 22 nt, Human
agcuagagcugagaagcacuug

SEQ ID NO: 209141 - RNA, 20 nt, Human
ucuuuagauuuaucuuaugu

SEQ ID NO: 209142 - RNA, 22 nt, Human
aaaaugcaugagaaugugcucg

SEQ ID NO: 209143 - RNA, 22 nt, Human
ccuggguccacccugugaagua

SEQ ID NO: 209144 - RNA, 22 nt, Human
uggcacaggagcacugcccugg

SEQ ID NO: 209145 - RNA, 17 nt, Human
cuggagcuguguaaccu

SEQ ID NO: 209146 - RNA, 22 nt, Human
cagcucugaggaacacuccuuu

SEQ ID NO: 209147 - RNA, 22 nt, Human
uuucuguuaggcaucauuuuaa

SEQ ID NO: 209148 - RNA, 22 nt, Human
ugggucccaggaaggaccagca

SEQ ID NO: 209149 - RNA, 22 nt, Human
uuccauauuagacuaugugggg

SEQ ID NO: 209150 - RNA, 22 nt, Human
caauucaaguugaguacagcuu

SEQ ID NO: 209151 - RNA, 22 nt, Human
agggacuauuuacccaucucac

SEQ ID NO: 209152 - RNA, 22 nt, Human
uuucuuuuacaguguggcuauu

SEQ ID NO: 209153 - RNA, 23 nt, Human
cagagcugauuaaacuuaaucuc

SEQ ID NO: 209154 - RNA, 22 nt, Human
aacccagagcuggaggagagua

SEQ ID NO: 209155 - RNA, 22 nt, Human
ccuccugcacuugcuuuccuuc

SEQ ID NO: 209156 - RNA, 22 nt, Human
ucugaccaggcucagccaaggc

SEQ ID NO: 209157 - RNA, 22 nt, Human
cucagugucuuauuguacacau

SEQ ID NO: 209158 - RNA, 22 nt, Human
acaguuuaucgauucaccuacc

SEQ ID NO: 209159 - RNA, 22 nt, Human
ucacacgugagguucuauccug

SEQ ID NO: 209160 - RNA, 22 nt, Human
ugugaccucaucuuaacuggaa

SEQ ID NO: 209161 - RNA, 22 nt, Human
ugcuggaggccugacuguguuu

SEQ ID NO: 209162 - RNA, 19 nt, Human
guccucucaacaacccggg

SEQ ID NO: 209163 - RNA, 22 nt, Human
ugcaaacaacuguuuaaugcug

SEQ ID NO: 209164 - RNA, 22 nt, Human
guaauuacaugaguacuguaag

SEQ ID NO: 209165 - RNA, 22 nt, Human
acacagauuucacuggaauaga

SEQ ID NO: 209166 - RNA, 22 nt, Human
uuuacagucugucuagcaaugu

SEQ ID NO: 209167 - RNA, 22 nt, Human
uauggcaagaugacauguucuc

SEQ ID NO: 209168 - RNA, 23 nt, Human
cuggcucuguagguggcauccuu

SEQ ID NO: 209169 - RNA, 22 nt, Human
ucuuccagaaucucagagggcu

SEQ ID NO: 209170 - RNA, 20 nt, Human
gucugcccaggccaccacgg

SEQ ID NO: 209171 - RNA, 22 nt, Human
guuagaaagugucugcuugggu

SEQ ID NO: 209172 - RNA, 22 nt, Human
ucugucuucuguagcuaauaau

SEQ ID NO: 209173 - RNA, 22 nt, Human
acaugugaggugugagugauac

SEQ ID NO: 209174 - RNA, 22 nt, Human
agcucagggcuccaggaccgcu

SEQ ID NO: 209175 - RNA, 22 nt, Human
cagcugcccugccuugcccuua

SEQ ID NO: 209176 - RNA, 22 nt, Human
cacacagguaagccucuuucaa

SEQ ID NO: 209177 - RNA, 22 nt, Human
cucugcugagccagagucccca

SEQ ID NO: 209178 - RNA, 22 nt, Human
ucacaggaggacugaaagauau

SEQ ID NO: 209179 - RNA, 22 nt, Human
cuucuucaguugcauguauugg

SEQ ID NO: 209180 - RNA, 22 nt, Human
aaauccuaaggagaauaugauu

SEQ ID NO: 209181 - RNA, 22 nt, Human
acaggaacgaauguacauuguu

SEQ ID NO: 209182 - RNA, 22 nt, Human
uccugggauuugcccuuuucuc

SEQ ID NO: 209183 - RNA, 20 nt, Human
ugccugggaaggcguggagg

SEQ ID NO: 209184 - RNA, 22 nt, Human
uguuaacauacugcuuucuaau

SEQ ID NO: 209185 - RNA, 22 nt, Human
augauuuuuucuaacacagucg

SEQ ID NO: 209186 - RNA, 22 nt, Human
gcccugagcacugcugcugggg

SEQ ID NO: 209187 - RNA, 22 nt, Human
uauguguccuguuaccggcagc

SEQ ID NO: 209188 - RNA, 22 nt, Human
gacagacaaauguuuuuaacuu

SEQ ID NO: 209189 - RNA, 22 nt, Human
uggccugauacuuccagaguuc

SEQ ID NO: 209190 - RNA, 22 nt, Human
agccuucagcaguucaggugcc

SEQ ID NO: 209191 - RNA, 22 nt, Human
cagugcagaacacauggaaaau

SEQ ID NO: 209192 - RNA, 22 nt, Human
cuggcuguggucacagguaacu

SEQ ID NO: 209193 - RNA, 22 nt, Human
augugucuuggaguuuuaaugu

SEQ ID NO: 209194 - RNA, 22 nt, Human
uccuugcauaucugaaaauguu

SEQ ID NO: 209195 - RNA, 22 nt, Human
guaucuuuccacaucuucagua

SEQ ID NO: 209196 - RNA, 23 nt, Human
aggcugcuuacugguaucagagc

SEQ ID NO: 209197 - RNA, 22 nt, Human
aaauucaguuuuaauaaucacu

SEQ ID NO: 209198 - RNA, 22 nt, Human
gcucugugguggggcagaguuu

SEQ ID NO: 209199 - RNA, 22 nt, Human
uuaaauuauuucuagugaggug

SEQ ID NO: 209200 - RNA, 22 nt, Human
ggcagggguccugguguugacu

SEQ ID NO: 209201 - RNA, 22 nt, Human
aauguaaacagcaagagaaggg

SEQ ID NO: 209202 - RNA, 22 nt, Human
gggaggagggugcuggcuaaac

SEQ ID NO: 209203 - RNA, 22 nt, Human
aaucugcacaauucaguuucag

SEQ ID NO: 209204 - RNA, 20 nt, Human
gggcuggcgcauggggaaag

SEQ ID NO: 209205 - RNA, 22 nt, Human
gcaguccuccugccucagccuc

SEQ ID NO: 209206 - RNA, 22 nt, Human
ggguugaggcggaugucggcgg

SEQ ID NO: 209207 - RNA, 22 nt, Human
auuagagaaauguugccaagau

SEQ ID NO: 209208 - RNA, 21 nt, Human
agaagccuggggaauguggcu

SEQ ID NO: 209209 - RNA, 22 nt, Human
ugguucauagccucacaggaua

SEQ ID NO: 209210 - RNA, 22 nt, Human
uacauauagacaguuacucuag

SEQ ID NO: 209211 - RNA, 20 nt, Human
gcucccagccugcagucccc

SEQ ID NO: 209212 - RNA, 22 nt, Human
aggagcccuccguugcuucauc

SEQ ID NO: 209213 - RNA, 20 nt, Human
ugugcccagcagaggcugcc

SEQ ID NO: 209214 - RNA, 22 nt, Human
cuuuaauuaggaaguauaauga

SEQ ID NO: 209215 - RNA, 22 nt, Human
uggcuugggugucucagcucuu

SEQ ID NO: 209216 - RNA, 22 nt, Human
cacaucuauagggacagcaaca

SEQ ID NO: 209217 - RNA, 22 nt, Human
guuucacugcaaacugacuuuu

SEQ ID NO: 209218 - RNA, 22 nt, Human
gcacacagaacauuuggauccu

SEQ ID NO: 209219 - RNA, 22 nt, Human
aacagccucagugagauuagga

SEQ ID NO: 209220 - RNA, 22 nt, Human
cauuuagagaagauuacaagga

SEQ ID NO: 209221 - RNA, 22 nt, Human
gugcaaaaguaauugugguuuu

SEQ ID NO: 209222 - RNA, 22 nt, Human
cuggauccaucgggucccgagu

SEQ ID NO: 209223 - RNA, 22 nt, Human
accaggcccaccgcaugcuccu

SEQ ID NO: 209224 - RNA, 22 nt, Human
cugauuccaaagccaaagcuau

SEQ ID NO: 209225 - RNA, 22 nt, Human
guacaaaugcagguuuguuaca

SEQ ID NO: 209226 - RNA, 22 nt, Human
ugcagggaaaacccaggaugcu

SEQ ID NO: 209227 - RNA, 23 nt, Human
agucacaucuuagcagccagguc

SEQ ID NO: 209228 - RNA, 22 nt, Human
cagcuacaaauacuuuuguaug

SEQ ID NO: 209229 - RNA, 22 nt, Human
agggcuccgggcaggcgaugga

SEQ ID NO: 209230 - RNA, 22 nt, Human
ugaugacaugugggcuguggcu

SEQ ID NO: 209231 - RNA, 22 nt, Human
uucacagacauugcagacugaa

SEQ ID NO: 209232 - RNA, 22 nt, Human
gucucagaguccuacuuauucc

SEQ ID NO: 209233 - RNA, 22 nt, Human
ucucucuuuuuaaucauguaau

SEQ ID NO: 209234 - RNA, 22 nt, Human
gggagggaagguaccuguguga

SEQ ID NO: 209235 - RNA, 22 nt, Human
gcugaaaugaaaacacaggucg

SEQ ID NO: 209236 - RNA, 22 nt, Human
agaacucuuuaucuguggaaug

SEQ ID NO: 209237 - RNA, 22 nt, Human
ugguuacauauccuuuggagcc

SEQ ID NO: 209238 - RNA, 22 nt, Human
ugucuuuacuuagaaguucagg

SEQ ID NO: 209239 - RNA, 22 nt, Human
gggcaacagagcgagggccugu

SEQ ID NO: 209240 - RNA, 22 nt, Human
caggaggcuuugggauccaagu

SEQ ID NO: 209241 - RNA, 22 nt, Human
augaguucaauuguuucaguca

SEQ ID NO: 209242 - RNA, 22 nt, Human
guguguccucuuaacuauuaug

SEQ ID NO: 209243 - RNA, 22 nt, Human
ccugugacccuuccagucuacu

SEQ ID NO: 209244 - RNA, 22 nt, Human
cuauuucugccuaaugaccugu

SEQ ID NO: 209245 - RNA, 14 nt, Human
gcaggcagaucacu

SEQ ID NO: 209246 - RNA, 22 nt, Human
auucacaaaaugauauagauac

SEQ ID NO: 209247 - RNA, 20 nt, Human
cuggcccaggaugauggcgc

SEQ ID NO: 209248 - RNA, 22 nt, Human
uuuuuccuagcgauuugucagc

SEQ ID NO: 209249 - RNA, 22 nt, Human
acagcuggacaggggagaguuu

SEQ ID NO: 209250 - RNA, 22 nt, Human
ucaaaguaagaauuuauuacaa

SEQ ID NO: 209251 - RNA, 22 nt, Human
acagagcucccagccaucuccu

SEQ ID NO: 209252 - RNA, 22 nt, Human
uugucgggcuuacgcagggcca

SEQ ID NO: 209253 - RNA, 22 nt, Human
aagcccugagcacugcagagaa

SEQ ID NO: 209254 - RNA, 22 nt, Human
cuccugugguacucccagggcc

SEQ ID NO: 209255 - RNA, 22 nt, Human
uaaaugcuuagauucauagaaa

SEQ ID NO: 209256 - RNA, 22 nt, Human
guuuaucauuauuauuagcaac

SEQ ID NO: 209257 - RNA, 20 nt, Human
aauuuuaucuccauccuuug

SEQ ID NO: 209258 - RNA, 22 nt, Human
cagagcagacguugagauuaag

SEQ ID NO: 209259 - RNA, 22 nt, Human
aguguauuaaguuaugaaguua

SEQ ID NO: 209260 - RNA, 22 nt, Human
gcugccuuccauaauguacgua

SEQ ID NO: 209261 - RNA, 22 nt, Human
acuacaauacucuuaguaaaag

SEQ ID NO: 209262 - RNA, 22 nt, Human
gaaagcugggaaauaaauauua

SEQ ID NO: 209263 - RNA, 22 nt, Human
aagggcucucugcauugaaauu

SEQ ID NO: 209264 - RNA, 21 nt, Human
cagaaguaaggguaacuucuc

SEQ ID NO: 209265 - RNA, 22 nt, Human
cugaggcugggcugaggguaua

SEQ ID NO: 209266 - RNA, 22 nt, Human
gaaacaugucugacaauuuacc

SEQ ID NO: 209267 - RNA, 22 nt, Human
agcugcaaccuuagcuauaggc

SEQ ID NO: 209268 - RNA, 19 nt, Human
agcacaguuuccacaugca

SEQ ID NO: 209269 - RNA, 19 nt, Human
ucuccagcuuugggcuuuu

SEQ ID NO: 209270 - RNA, 19 nt, Human
ucugaaguccagggcauac

SEQ ID NO: 209271 - RNA, 22 nt, Human
guacauuuaggauucauugaaa

SEQ ID NO: 209272 - RNA, 22 nt, Human
uacagugugacauuucuacaaa

SEQ ID NO: 209273 - RNA, 20 nt, Human
ugaguggccacugggucgca

SEQ ID NO: 209274 - RNA, 22 nt, Human
cacuguacugugaauaaggagg

SEQ ID NO: 209275 - RNA, 22 nt, Human
ggggaccugggcuucaaggguu

SEQ ID NO: 209276 - RNA, 22 nt, Human
aaaagcuagucaaugauguauu

SEQ ID NO: 209277 - RNA, 22 nt, Human
caggaaugauauucgaggagau

SEQ ID NO: 209278 - RNA, 22 nt, Human
ucauguuuggaguuugcucacu

SEQ ID NO: 209279 - RNA, 22 nt, Human
uucagauaaacuacaaauaauu

SEQ ID NO: 209280 - RNA, 19 nt, Human
gagcaggccacacaugugu

SEQ ID NO: 209281 - RNA, 22 nt, Human
gaaagcaguaaaugggucccau

SEQ ID NO: 209282 - RNA, 22 nt, Human
aaaaccacaaugacuuuugcag

SEQ ID NO: 209283 - RNA, 22 nt, Human
uccagcuggcccggccaugaau

SEQ ID NO: 209284 - RNA, 19 nt, Human
cugagcagcggcagcacuu

SEQ ID NO: 209285 - RNA, 22 nt, Human
ugucaggagccaccagcacucc

SEQ ID NO: 209286 - RNA, 22 nt, Human
cuggaagacucaauggccugcc

SEQ ID NO: 209287 - RNA, 23 nt, Human
acagcaagaggaccagaugugag

SEQ ID NO: 209288 - RNA, 22 nt, Human
accucagaacggcguucuugaa

SEQ ID NO: 209289 - RNA, 22 nt, Human
cagacagacagccguggccacc

SEQ ID NO: 209290 - RNA, 22 nt, Human
gcauuuuauaaagaguuauuug

SEQ ID NO: 209291 - RNA, 22 nt, Human
aauauaacacagauggccuguu

SEQ ID NO: 209292 - RNA, 22 nt, Human
ucaucuugcaguguguguucug

SEQ ID NO: 209293 - RNA, 23 nt, Human
uuucugaaguugagauggacuuu

SEQ ID NO: 209294 - RNA, 22 nt, Human
ugugauucucagaagagggaag

SEQ ID NO: 209295 - RNA, 19 nt, Human
uggcagaggacaaggacuu

SEQ ID NO: 209296 - RNA, 22 nt, Human
ugccuggcaucuagcccuggga

SEQ ID NO: 209297 - RNA, 18 nt, Human
guguggcugagaugaggc

SEQ ID NO: 209298 - RNA, 22 nt, Human
uugcucugaacccagggcacca

SEQ ID NO: 209299 - RNA, 22 nt, Human
cacacgagcccuggagccagca

SEQ ID NO: 209300 - RNA, 22 nt, Human
aagguggucuuacugaugguau

SEQ ID NO: 209301 - RNA, 22 nt, Human
gcaggagaacaaagcaagcugc

SEQ ID NO: 209302 - RNA, 22 nt, Human
agugugucugaucacuugugag

SEQ ID NO: 209303 - RNA, 22 nt, Human
ugauuuacucccacuuagagcc

SEQ ID NO: 209304 - RNA, 17 nt, Human
agccagguacaagucca

SEQ ID NO: 209305 - RNA, 22 nt, Human
ccagagcugcauccagcagguu

SEQ ID NO: 209306 - RNA, 22 nt, Human
uucccucuuuuccaacaguugu

SEQ ID NO: 209307 - RNA, 22 nt, Human
agucagaguucuuggggagaca

SEQ ID NO: 209308 - RNA, 22 nt, Human
auggcuugguugguuaaagcac

SEQ ID NO: 209309 - RNA, 22 nt, Human
gaaaguuugccucucucuugag

SEQ ID NO: 209310 - RNA, 22 nt, Human
ccccaggcagggccuaacagag

SEQ ID NO: 209311 - RNA, 22 nt, Human
gcaggggcugagcaccagcggg

SEQ ID NO: 209312 - RNA, 20 nt, Human
agcuccucaucacuggaggu

SEQ ID NO: 209313 - RNA, 18 nt, Human
uacuguggaucagggguu

SEQ ID NO: 209314 - RNA, 22 nt, Human
ugggagauaaagcaucuguucu

SEQ ID NO: 209315 - RNA, 22 nt, Human
ugcaucagaguuugcugcugcu

SEQ ID NO: 209316 - RNA, 22 nt, Human
auucucuguggugaugcuggug

SEQ ID NO: 209317 - RNA, 22 nt, Human
ucagaggacagcagcuaaauaa

SEQ ID NO: 209318 - RNA, 22 nt, Human
caggcuugugucucagcugcag

SEQ ID NO: 209319 - RNA, 22 nt, Human
auacaaaauauauacuggagac

SEQ ID NO: 209320 - RNA, 22 nt, Human
ucuggacuaacagcagccucag

SEQ ID NO: 209321 - RNA, 22 nt, Human
ugacauguauguuguuggcaug

SEQ ID NO: 209322 - RNA, 22 nt, Human
gagggaaaauaaaauugcagua

SEQ ID NO: 209323 - RNA, 22 nt, Human
uucaggauuguguuuuuccuga

SEQ ID NO: 209324 - RNA, 22 nt, Human
ccagaagagaucacaguucuug

SEQ ID NO: 209325 - RNA, 22 nt, Human
cuggcuccauccuugagcucug

SEQ ID NO: 209326 - RNA, 22 nt, Human
ccucuggccauucuuugaugga

SEQ ID NO: 209327 - RNA, 22 nt, Human
uaacacuguccaaagaauucca

SEQ ID NO: 209328 - RNA, 22 nt, Human
cuggagagggagcccuggcagu

SEQ ID NO: 209329 - RNA, 22 nt, Human
ugcuuaucguuuaguacauugc

SEQ ID NO: 209330 - RNA, 22 nt, Human
agggccuggugaccuggguccu

SEQ ID NO: 209331 - RNA, 22 nt, Human
cagggcagagggaaacuccuuu

SEQ ID NO: 209332 - RNA, 22 nt, Human
ugagcagauuuguucuaggggu

SEQ ID NO: 209333 - RNA, 23 nt, Human
ugaagugaaauuucacaagggac

SEQ ID NO: 209334 - RNA, 22 nt, Human
cacaucauguuaauucauuaca

SEQ ID NO: 209335 - RNA, 22 nt, Human
cuccagugcucaugccguugac

SEQ ID NO: 209336 - RNA, 22 nt, Human
cuccaggagguugcugcuuccu

SEQ ID NO: 209337 - RNA, 22 nt, Human
uugaggcauuacuguaaugaga

SEQ ID NO: 209338 - RNA, 22 nt, Human
cagaugcagcaaaaugacaggc

SEQ ID NO: 209339 - RNA, 22 nt, Human
uagggguguuucgagagagguu

SEQ ID NO: 209340 - RNA, 22 nt, Human
gcagggcuccccaggcccgagg

SEQ ID NO: 209341 - RNA, 22 nt, Human
auaagcaugauuaccgggagca

SEQ ID NO: 209342 - RNA, 22 nt, Human
cagagacaggagugcucccagu

SEQ ID NO: 209343 - RNA, 22 nt, Human
cuguggcugcguaggucuggca

SEQ ID NO: 209344 - RNA, 22 nt, Human
acaagauugauaagucugcccu

SEQ ID NO: 209345 - RNA, 22 nt, Human
uuggcagaaugggcagcuugag

SEQ ID NO: 209346 - RNA, 22 nt, Human
uaaccauauuuuccauuaaguu

SEQ ID NO: 209347 - RNA, 22 nt, Human
aauaauuauuugagagcagacc

SEQ ID NO: 209348 - RNA, 22 nt, Human
ccugggaaucugcauugucagc

SEQ ID NO: 209349 - RNA, 22 nt, Human
ccugugaggucuugcaugugaa

SEQ ID NO: 209350 - RNA, 19 nt, Human
gcaggcagcugggguaucc

SEQ ID NO: 209351 - RNA, 22 nt, Human
uuggcugguuucaagaaggcau

SEQ ID NO: 209352 - RNA, 18 nt, Human
aggcaugguggugcgcac

SEQ ID NO: 209353 - RNA, 22 nt, Human
cuaaacuuuuauaacauugaga

SEQ ID NO: 209354 - RNA, 23 nt, Human
uccaaauaccugucaccuugucu

SEQ ID NO: 209355 - RNA, 22 nt, Human
cucuuuccucagccacagucua

SEQ ID NO: 209356 - RNA, 22 nt, Human
uacaugcuggugacuguagaca

SEQ ID NO: 209357 - RNA, 22 nt, Human
cuuucacagcacaagccugccu

SEQ ID NO: 209358 - RNA, 22 nt, Human
caggagucucucuugagcccag

SEQ ID NO: 209359 - RNA, 22 nt, Human
uaaaguuuauuggcaccaccau

SEQ ID NO: 209360 - RNA, 21 nt, Human
uuagaagcuaaugcagcuggu

SEQ ID NO: 209361 - RNA, 22 nt, Human
uaucaucugcaaagcacaucua

SEQ ID NO: 209362 - RNA, 22 nt, Human
gucuucugaucugguuagccau

SEQ ID NO: 209363 - RNA, 22 nt, Human
aguucuuuugugaacauaugcu

SEQ ID NO: 209364 - RNA, 22 nt, Human
agaaagugaacguguucaguuu

SEQ ID NO: 209365 - RNA, 22 nt, Human
uguaggcauauucauagaguug

SEQ ID NO: 209366 - RNA, 21 nt, Human
ugccaggccugagcugggguc

SEQ ID NO: 209367 - RNA, 18 nt, Human
gacccagcagaugggcuu

SEQ ID NO: 209368 - RNA, 22 nt, Human
uugcaagacacuuggaagcaca

SEQ ID NO: 209369 - RNA, 22 nt, Human
cagcauuuggaggagaggcuuu

SEQ ID NO: 209370 - RNA, 22 nt, Human
auccaggcugcuuucuaugccc

SEQ ID NO: 209371 - RNA, 22 nt, Human
uucucauguaaaugccaucauc

SEQ ID NO: 209372 - RNA, 22 nt, Human
aauuguaacuacauugagaaca

SEQ ID NO: 209373 - RNA, 18 nt, Human
aguguucucguuuuauaa

SEQ ID NO: 209374 - RNA, 22 nt, Human
cugcuccaggauuucaggccag

SEQ ID NO: 209375 - RNA, 23 nt, Human
agaauuguaaauagaauauaccu

SEQ ID NO: 209376 - RNA, 22 nt, Human
ggcagccuccagggcacuggug

SEQ ID NO: 209377 - RNA, 22 nt, Human
ccugggcagugcuggaguugaa

SEQ ID NO: 209378 - RNA, 21 nt, Human
uggcugagccaggugugugga

SEQ ID NO: 209379 - RNA, 23 nt, Human
ggcuccuggauucaaauccugcc

SEQ ID NO: 209380 - RNA, 22 nt, Human
cagcuguuaccaaucuuagggc

SEQ ID NO: 209381 - RNA, 22 nt, Human
caggaagcugaugucuagucau

SEQ ID NO: 209382 - RNA, 22 nt, Human
caucaaaauuagacauuguuga

SEQ ID NO: 209383 - RNA, 22 nt, Human
agccuuagggauugagguugcu

SEQ ID NO: 209384 - RNA, 22 nt, Human
guugaaauccuaacccccuagu

SEQ ID NO: 209385 - RNA, 22 nt, Human
caguguccucagccagcagcua

SEQ ID NO: 209386 - RNA, 22 nt, Human
aagcacagcuggaacagcagga

SEQ ID NO: 209387 - RNA, 22 nt, Human
uccacauccauugcuugacuuu

SEQ ID NO: 209388 - RNA, 22 nt, Human
ccuuuggucaccuccacucuua

SEQ ID NO: 209389 - RNA, 22 nt, Human
ucaggccagcaccaucccuauc

SEQ ID NO: 209390 - RNA, 22 nt, Human
agagugcaaccgaaacaagcag

SEQ ID NO: 209391 - RNA, 22 nt, Human
gaggggucuuuuguugucaggg

SEQ ID NO: 209392 - RNA, 22 nt, Human
ucaugccauccacaucuguuuc

SEQ ID NO: 209393 - RNA, 22 nt, Human
aucucagaucuacagaucuaca

SEQ ID NO: 209394 - RNA, 22 nt, Human
guauucuuaaggauugagcaaa

SEQ ID NO: 209395 - RNA, 22 nt, Human
uggcuuuuguugguaccaccuu

SEQ ID NO: 209396 - RNA, 19 nt, Human
aaugacugaguacauuguc

SEQ ID NO: 209397 - RNA, 22 nt, Human
ccagagccggauugugaagugc

SEQ ID NO: 209398 - RNA, 22 nt, Human
gugaagaaggcaauacaaagaa

SEQ ID NO: 209399 - RNA, 20 nt, Human
accagagacuggggacaagu

SEQ ID NO: 209400 - RNA, 22 nt, Human
uuugagaagauaggggaauacu

SEQ ID NO: 209401 - RNA, 21 nt, Human
accuccuggcauccuguuccc

SEQ ID NO: 209402 - RNA, 22 nt, Human
acagacuguuugguucaugucu

SEQ ID NO: 209403 - RNA, 22 nt, Human
cugcaguguucuggaaugcauu

SEQ ID NO: 209404 - RNA, 17 nt, Human
caucaaagaaauuucca

SEQ ID NO: 209405 - RNA, 18 nt, Human
ccaaggccccugcugggg

SEQ ID NO: 209406 - RNA, 22 nt, Human
cuagagcuuucugcugguguug

SEQ ID NO: 209407 - RNA, 22 nt, Human
acuguaaauuuugguugcaggu

SEQ ID NO: 209408 - RNA, 22 nt, Human
ccauucugacuucauugccuca

SEQ ID NO: 209409 - RNA, 22 nt, Human
caaggcuucagugugacaaaac

SEQ ID NO: 209410 - RNA, 22 nt, Human
aaauaucuuaggaguauaugag

SEQ ID NO: 209411 - RNA, 22 nt, Human
uacagugcauagaggcaugaua

SEQ ID NO: 209412 - RNA, 22 nt, Human
aguuuccucaucuguaaaauga

SEQ ID NO: 209413 - RNA, 22 nt, Human
gacagcauccaagagggaggga

SEQ ID NO: 209414 - RNA, 22 nt, Human
agcagauggugucaugggaugg

SEQ ID NO: 209415 - RNA, 20 nt, Human
ugcaaacacagaguguauga

SEQ ID NO: 209416 - RNA, 22 nt, Human
guggcagaacuaugugauugcu

SEQ ID NO: 209417 - RNA, 22 nt, Human
ugcguacuguuuauacaugugu

SEQ ID NO: 209418 - RNA, 22 nt, Human
acauauguauauguacacaguc

SEQ ID NO: 209419 - RNA, 22 nt, Human
cuuuauggaaucaaagacugga

SEQ ID NO: 209420 - RNA, 21 nt, Human
cagaaacuugcuuugccuucu

SEQ ID NO: 209421 - RNA, 22 nt, Human
uuuuuauacuuugcucaagauu

SEQ ID NO: 209422 - RNA, 22 nt, Human
aaugcuuuagcagugauuagug

SEQ ID NO: 209423 - RNA, 22 nt, Human
gcaugcaggauagguugagcuc

SEQ ID NO: 209424 - RNA, 22 nt, Human
aaacaguuuauaacaugauacu

SEQ ID NO: 209425 - RNA, 22 nt, Human
acauaauagcauuucuaauuug

SEQ ID NO: 209426 - RNA, 22 nt, Human
uuggcuucuugugaaaucugag

SEQ ID NO: 209427 - RNA, 22 nt, Human
uguaccaggaggaggacaaauu

SEQ ID NO: 209428 - RNA, 22 nt, Human
agugcauuauauguuucaaugg

SEQ ID NO: 209429 - RNA, 22 nt, Human
uggcugaaucugcagcaggaag

SEQ ID NO: 209430 - RNA, 22 nt, Human
agagccaguuaagcacuuacag

SEQ ID NO: 209431 - RNA, 22 nt, Human
acacaguauugugacuauaacu

SEQ ID NO: 209432 - RNA, 22 nt, Human
acagcuuuaucucagggaucag

SEQ ID NO: 209433 - RNA, 22 nt, Human
gggugcagggucuccagcagcu

SEQ ID NO: 209434 - RNA, 22 nt, Human
acaguguccuuguggucccugu

SEQ ID NO: 209435 - RNA, 22 nt, Human
cacaguaucuuuugaguaagca

SEQ ID NO: 209436 - RNA, 22 nt, Human
aaauuaccauuguaaaguauuu

SEQ ID NO: 209437 - RNA, 22 nt, Human
cagagcccuaguccugauggcc

SEQ ID NO: 209438 - RNA, 22 nt, Human
auacaacagaaaaugauuauuc

SEQ ID NO: 209439 - RNA, 22 nt, Human
caguauguacucuuaucaugua

SEQ ID NO: 209440 - RNA, 22 nt, Human
uuuugccugagagugaaaauaa

SEQ ID NO: 209441 - RNA, 22 nt, Human
uuaaagaauagugccccuauug

SEQ ID NO: 209442 - RNA, 22 nt, Human
cuccucagaacagccuuggcug

SEQ ID NO: 209443 - RNA, 22 nt, Human
cuagauuugcaugccuacacca

SEQ ID NO: 209444 - RNA, 22 nt, Human
auccauuugccgugcuaugugc

SEQ ID NO: 209445 - RNA, 22 nt, Human
uggcuggcuguccagcugggca

SEQ ID NO: 209446 - RNA, 22 nt, Human
gagcugugccaaucugucuggg

SEQ ID NO: 209447 - RNA, 22 nt, Human
cugcaggaauucaaagugagcu

SEQ ID NO: 209448 - RNA, 22 nt, Human
uguaaacauaccagagccaagu

SEQ ID NO: 209449 - RNA, 22 nt, Human
agugcuuggcaaccuucugacc

SEQ ID NO: 209450 - RNA, 20 nt, Human
ucagacccuacauuccucag

SEQ ID NO: 209451 - RNA, 19 nt, Human
guagggacagugguucuga

SEQ ID NO: 209452 - RNA, 22 nt, Human
caggccuggcccccggcacacc

SEQ ID NO: 209453 - RNA, 22 nt, Human
ucacagcuuucagauuguuccc

SEQ ID NO: 209454 - RNA, 22 nt, Human
ugggaaaguguagccugcaggc

SEQ ID NO: 209455 - RNA, 23 nt, Human
ugagcugggccugcaggggucuc

SEQ ID NO: 209456 - RNA, 21 nt, Human
uuucuguccuuuccaucagcu

SEQ ID NO: 209457 - RNA, 22 nt, Human
uacaaagauaguguuagaguaa

SEQ ID NO: 209458 - RNA, 22 nt, Human
acugggcuguaaagagaggcaa

SEQ ID NO: 209459 - RNA, 22 nt, Human
cagacucucuuccaugcaucac

SEQ ID NO: 209460 - RNA, 22 nt, Human
caaagucagccagcuaguaggu

SEQ ID NO: 209461 - RNA, 22 nt, Human
agcugagcauuugauccaccuc

SEQ ID NO: 209462 - RNA, 22 nt, Human
uacaauuacucagcucugcugu

SEQ ID NO: 209463 - RNA, 22 nt, Human
cuuucauucuuagauauuagug

SEQ ID NO: 209464 - RNA, 22 nt, Human
augguuuacaauguuuucaguu

SEQ ID NO: 209465 - RNA, 22 nt, Human
ggcuuucugagucaaacacuga

SEQ ID NO: 209466 - RNA, 22 nt, Human
ucuagggagaguuguuaugggu

SEQ ID NO: 209467 - RNA, 22 nt, Human
guguguccaggcgggagucaag

SEQ ID NO: 209468 - RNA, 22 nt, Human
auaacagugaccucucagcacc

SEQ ID NO: 209469 - RNA, 22 nt, Human
acacccaggcuggcgugcagug

SEQ ID NO: 209470 - RNA, 22 nt, Human
gucuuucuaugcauagagcaga

SEQ ID NO: 209471 - RNA, 22 nt, Human
aggaggccauucucucaguagc

SEQ ID NO: 209472 - RNA, 22 nt, Human
augcaaaugucaccacuucuaa

SEQ ID NO: 209473 - RNA, 22 nt, Human
gaagagaaaggcaaggaguuuu

SEQ ID NO: 209474 - RNA, 22 nt, Human
uggccugggccggcagauauac

SEQ ID NO: 209475 - RNA, 22 nt, Human
ccaggaagacacaugcucaucc

SEQ ID NO: 209476 - RNA, 22 nt, Human
agcugaaagcuugacuggggcu

SEQ ID NO: 209477 - RNA, 22 nt, Human
caaggcuugaauucugaugggu

SEQ ID NO: 209478 - RNA, 22 nt, Human
uuuaaucauaagaaggaaaaua

SEQ ID NO: 209479 - RNA, 22 nt, Human
gcuccuucaggugguagcuguu

SEQ ID NO: 209480 - RNA, 21 nt, Human
acagagcauaaugguguggca

SEQ ID NO: 209481 - RNA, 22 nt, Human
auuauuauuguugauguuaggg

SEQ ID NO: 209482 - RNA, 22 nt, Human
uuggccagacugaggugcuggg

SEQ ID NO: 209483 - RNA, 22 nt, Human
aagacauguuuuaagaauauuu

SEQ ID NO: 209484 - RNA, 22 nt, Human
ucugggccuuggaguggggaga

SEQ ID NO: 209485 - RNA, 19 nt, Human
uguuucuuccuccaucuga

SEQ ID NO: 209486 - RNA, 22 nt, Human
cacauucaucaguguuguacug

SEQ ID NO: 209487 - RNA, 22 nt, Human
gcuggucccaauguguuuccuu

SEQ ID NO: 209488 - RNA, 22 nt, Human
aauguguuaguauugauuuguc

SEQ ID NO: 209489 - RNA, 22 nt, Human
uccuccagcccucuaggaaaau

SEQ ID NO: 209490 - RNA, 22 nt, Human
cacaugcuuagauuucagugga

SEQ ID NO: 209491 - RNA, 22 nt, Human
aaaggcuaugagauagaagaua

SEQ ID NO: 209492 - RNA, 22 nt, Human
auuuuccuuguggguuagcgaa

SEQ ID NO: 209493 - RNA, 22 nt, Human
acaguuauucuuuaugcaacca

SEQ ID NO: 209494 - RNA, 22 nt, Human
agcuaagacuuagugacuuagu

SEQ ID NO: 209495 - RNA, 22 nt, Human
aagucaggacuuaugcuaccug

SEQ ID NO: 209496 - RNA, 22 nt, Human
aagugagguuucugcuuucaga

SEQ ID NO: 209497 - RNA, 15 nt, Human
cagucccagggaccc

SEQ ID NO: 209498 - RNA, 22 nt, Human
uuauuagguuuacauaaagguu

SEQ ID NO: 209499 - RNA, 22 nt, Human
gcccagcacuaaaagcuuugcu

SEQ ID NO: 209500 - RNA, 22 nt, Human
uggcucaguagcagugugguca

SEQ ID NO: 209501 - RNA, 22 nt, Human
uuguacagauuuuccucggucu

SEQ ID NO: 209502 - RNA, 22 nt, Human
uccagcaguccaugugagacac

SEQ ID NO: 209503 - RNA, 22 nt, Human
acaguuaacuggagagcgaguu

SEQ ID NO: 209504 - RNA, 22 nt, Human
cauauaaauacaacauguguua

SEQ ID NO: 209505 - RNA, 22 nt, Human
guggcaggagugggccuugaag

SEQ ID NO: 209506 - RNA, 22 nt, Human
agggccuggaacugugggcagg

SEQ ID NO: 209507 - RNA, 22 nt, Human
aggagacauggaauagugaggc

SEQ ID NO: 209508 - RNA, 22 nt, Human
agacuccaaaaguuugguggaa

SEQ ID NO: 209509 - RNA, 22 nt, Human
uagguucagagaacugaaaaua

SEQ ID NO: 209510 - RNA, 22 nt, Human
agauuagguaugguuuaaguag

SEQ ID NO: 209511 - RNA, 22 nt, Human
gaguccaguuagugaggcuggg

SEQ ID NO: 209512 - RNA, 22 nt, Human
uggaauuuuguauuagcuuuga

SEQ ID NO: 209513 - RNA, 22 nt, Human
guaggaagcucugaggcuaguu

SEQ ID NO: 209514 - RNA, 22 nt, Human
cugcaggauuucaugggcugac

SEQ ID NO: 209515 - RNA, 22 nt, Human
uaguuaaaauaauggagauguu

SEQ ID NO: 209516 - RNA, 22 nt, Human
gggccaggucggugaaugguca

SEQ ID NO: 209517 - RNA, 22 nt, Human
ggcuacagaggccgugagccug

SEQ ID NO: 209518 - RNA, 22 nt, Human
auaguaaauuaucguggagaga

SEQ ID NO: 209519 - RNA, 23 nt, Human
ucuccaggccuuacuccaggccu

SEQ ID NO: 209520 - RNA, 22 nt, Human
uggucccauuguucugcccagg

SEQ ID NO: 209521 - RNA, 20 nt, Human
ucuuuguuaauuuuaucucc

SEQ ID NO: 209522 - RNA, 22 nt, Human
cggcuucuucaucaggucagca

SEQ ID NO: 209523 - RNA, 22 nt, Human
uacagaggguaauugaucaagg

SEQ ID NO: 209524 - RNA, 21 nt, Human
ccacauucucauucugacugc

SEQ ID NO: 209525 - RNA, 22 nt, Human
ugacacacuaggaaaagcauuu

SEQ ID NO: 209526 - RNA, 22 nt, Human
ggauggagaugaccauggugac

SEQ ID NO: 209527 - RNA, 22 nt, Human
aacuacagaaaagguaagcucu

SEQ ID NO: 209528 - RNA, 22 nt, Human
gcccugagugguaccugugggu

SEQ ID NO: 209529 - RNA, 22 nt, Human
ucaugccacuuacaaaauaaug

SEQ ID NO: 209530 - RNA, 22 nt, Human
aguauuugauacagucuucuag

SEQ ID NO: 209531 - RNA, 22 nt, Human
uaacugguuucauaucauuucc

SEQ ID NO: 209532 - RNA, 22 nt, Human
ugucacauugaauaugauuuau

SEQ ID NO: 209533 - RNA, 22 nt, Human
aaagcaaucagauucagauguc

SEQ ID NO: 209534 - RNA, 22 nt, Human
ugugcugagugaucccauuccu

SEQ ID NO: 209535 - RNA, 23 nt, Human
ugaaggccuggaggacgcguugu

SEQ ID NO: 209536 - RNA, 22 nt, Human
gacagcaaccucaugagaaacu

SEQ ID NO: 209537 - RNA, 22 nt, Human
ucugaaaguaucuggaucuuuu

SEQ ID NO: 209538 - RNA, 22 nt, Human
agagaugcgguuccaugguuau

SEQ ID NO: 209539 - RNA, 22 nt, Human
aaacaaguuuguagacuagcca

SEQ ID NO: 209540 - RNA, 22 nt, Human
ucagcuuugaucucaggcaauc

SEQ ID NO: 209541 - RNA, 19 nt, Human
gagcugagaguagcacugg

SEQ ID NO: 209542 - RNA, 22 nt, Human
uggcccagucagcaggagaggg

SEQ ID NO: 209543 - RNA, 22 nt, Human
agguggggaguauauguaauug

SEQ ID NO: 209544 - RNA, 22 nt, Human
aguuagaaaguaaaucauuuga

SEQ ID NO: 209545 - RNA, 22 nt, Human
gaggcagcugggauacaaggga

SEQ ID NO: 209546 - RNA, 22 nt, Human
uuugaaguguaugaaaauacag

SEQ ID NO: 209547 - RNA, 22 nt, Human
agugggcugagcuugcugggug

SEQ ID NO: 209548 - RNA, 22 nt, Human
cuucagugaauguugaguaagg

SEQ ID NO: 209549 - RNA, 22 nt, Human
aggaauguguguccaccgggga

SEQ ID NO: 209550 - RNA, 22 nt, Human
aaaguaaccuaguaauaguguc

SEQ ID NO: 209551 - RNA, 22 nt, Human
gcagcuggccccuuuccuuguu

SEQ ID NO: 209552 - RNA, 22 nt, Human
uacagugcuuuuugguggagaa

SEQ ID NO: 209553 - RNA, 22 nt, Human
cagaagucacccucagaauaac

SEQ ID NO: 209554 - RNA, 22 nt, Human
uuugggaacaaugaggaucuga

SEQ ID NO: 209555 - RNA, 22 nt, Human
cuguggcuguauuuggccagag

SEQ ID NO: 209556 - RNA, 22 nt, Human
gagcaaaauaaauucugacaaa

SEQ ID NO: 209557 - RNA, 22 nt, Human
uuucacuagaacguucuuguuu

SEQ ID NO: 209558 - RNA, 22 nt, Human
ccagcucugauuuugaccucca

SEQ ID NO: 209559 - RNA, 22 nt, Human
uaaaguguguauauacauaugg

SEQ ID NO: 209560 - RNA, 22 nt, Human
aguuucucuuugacaccaaaau

SEQ ID NO: 209561 - RNA, 22 nt, Human
uggagcugggaguccugggcug

SEQ ID NO: 209562 - RNA, 22 nt, Human
guguggggaggagagagcccuu

SEQ ID NO: 209563 - RNA, 22 nt, Human
aacagauauaggcagaacuuug

SEQ ID NO: 209564 - RNA, 22 nt, Human
auuguucauuguacaccuagua

SEQ ID NO: 209565 - RNA, 22 nt, Human
aggcagcugugaggacuggauu

SEQ ID NO: 209566 - RNA, 22 nt, Human
auucagagcacuggguagaauu

SEQ ID NO: 209567 - RNA, 22 nt, Human
ucuuccagauacuuccugacuu

SEQ ID NO: 209568 - RNA, 22 nt, Human
agaacauuugucgaucaauuug

SEQ ID NO: 209569 - RNA, 21 nt, Human
uggcucugcucagagcagucc

SEQ ID NO: 209570 - RNA, 22 nt, Human
cugugcaaugccuaaucacaaa

SEQ ID NO: 209571 - RNA, 22 nt, Human
ccaccagagggcagacugugau

SEQ ID NO: 209572 - RNA, 22 nt, Human
cuucccaaguaaauuuguauuu

SEQ ID NO: 209573 - RNA, 22 nt, Human
cagcccuuaagagucaucccuc

SEQ ID NO: 209574 - RNA, 22 nt, Human
uacaugugaucagaaagugaaa

SEQ ID NO: 209575 - RNA, 22 nt, Human
ucaguaacccugcuguucagag

SEQ ID NO: 209576 - RNA, 22 nt, Human
uugcugauuuccccuugagugu

SEQ ID NO: 209577 - RNA, 22 nt, Human
uccagaauacucugaaaucauu

SEQ ID NO: 209578 - RNA, 22 nt, Human
acacuaguauuucuauaaguga

SEQ ID NO: 209579 - RNA, 22 nt, Human
uuuaauuuguauuucuagaggg

SEQ ID NO: 209580 - RNA, 22 nt, Human
cuguacaggucaaugauaagau

SEQ ID NO: 209581 - RNA, 22 nt, Human
uucauacaguggcugcacucca

SEQ ID NO: 209582 - RNA, 23 nt, Human
augguuuaugucacacuuuugau

SEQ ID NO: 209583 - RNA, 22 nt, Human
aggaggccaggcccucaagccu

SEQ ID NO: 209584 - RNA, 23 nt, Human
ccaggccucucagagggugugcc

SEQ ID NO: 209585 - RNA, 20 nt, Human
uucaugcuggaggggcuggc

SEQ ID NO: 209586 - RNA, 22 nt, Human
auuccauuguguaaggauaucg

SEQ ID NO: 209587 - RNA, 22 nt, Human
cacaggcugggaagccuaggcc

SEQ ID NO: 209588 - RNA, 22 nt, Human
acagccaagucuucuauuucag

SEQ ID NO: 209589 - RNA, 22 nt, Human
ggcagcucugcuaauugagccu

SEQ ID NO: 209590 - RNA, 22 nt, Human
uuggaauuaaaaggagaacuuc

SEQ ID NO: 209591 - RNA, 22 nt, Human
aaaaugauauccugacuuuuau

SEQ ID NO: 209592 - RNA, 22 nt, Human
acaaaguuugugguauuccaag

SEQ ID NO: 209593 - RNA, 22 nt, Human
gcagcagguccgcaucaucauc

SEQ ID NO: 209594 - RNA, 22 nt, Human
cagcagcaacaacggaagccuu

SEQ ID NO: 209595 - RNA, 22 nt, Human
aacacagaucaaaauauuuccu

SEQ ID NO: 209596 - RNA, 16 nt, Human
cagccugcagugguca

SEQ ID NO: 209597 - RNA, 22 nt, Human
gaagcuaaugauuuauuuucug

SEQ ID NO: 209598 - RNA, 20 nt, Human
cugcaggguuagaggcucca

SEQ ID NO: 209599 - RNA, 22 nt, Human
uuacaaguuucuggcuucaucc

SEQ ID NO: 209600 - RNA, 21 nt, Human
gacaaugcagucuuuuuugga

SEQ ID NO: 209601 - RNA, 22 nt, Human
ugcagcugguaucccauggauu

SEQ ID NO: 209602 - RNA, 22 nt, Human
ccagagagcuacaaggcauaaa

SEQ ID NO: 209603 - RNA, 22 nt, Human
uacaacaguaaucaagguuuuu

SEQ ID NO: 209604 - RNA, 22 nt, Human
cuucucucccuggcacucagac

SEQ ID NO: 209605 - RNA, 22 nt, Human
aagucuggggagaaaaggcuaa

SEQ ID NO: 209606 - RNA, 22 nt, Human
ccucaggcuagcuacugucccu

SEQ ID NO: 209607 - RNA, 22 nt, Human
cugaaacuggucaauuaaucug

SEQ ID NO: 209608 - RNA, 21 nt, Human
accauucugcacaugcuguca

SEQ ID NO: 209609 - RNA, 22 nt, Human
aggaaagcucccaguagggcuc

SEQ ID NO: 209610 - RNA, 22 nt, Human
ucauuuggagccuuccuguuuu

SEQ ID NO: 209611 - RNA, 22 nt, Human
uuccugugguguuucccagaca

SEQ ID NO: 209612 - RNA, 22 nt, Human
aauauagauuuacucaagagaa

SEQ ID NO: 209613 - RNA, 22 nt, Human
aaucagcaaaugcuuacucagg

SEQ ID NO: 209614 - RNA, 22 nt, Human
ggccuugauguucuugggagau

SEQ ID NO: 209615 - RNA, 22 nt, Human
ccucagaggcagaugguaagaa

SEQ ID NO: 209616 - RNA, 22 nt, Human
guaagauuuaaaauagcaauug

SEQ ID NO: 209617 - RNA, 21 nt, Human
caaaugcuggcuggaugagga

SEQ ID NO: 209618 - RNA, 22 nt, Human
gccaggcaggccacgcuguguu

SEQ ID NO: 209619 - RNA, 22 nt, Human
cauuguuuugagaacaaccuga

SEQ ID NO: 209620 - RNA, 22 nt, Human
gccagucagcuggccaggcugg

SEQ ID NO: 209621 - RNA, 22 nt, Human
cucccuugcuucuggcauuuug

SEQ ID NO: 209622 - RNA, 22 nt, Human
caaaugcuaacuucuuuccaaa

SEQ ID NO: 209623 - RNA, 22 nt, Human
aaaucaugugcagagaucagga

SEQ ID NO: 209624 - RNA, 22 nt, Human
ggagccagggaagcugcuuccu

SEQ ID NO: 209625 - RNA, 22 nt, Human
aucucagagaaauuugaaugca

SEQ ID NO: 209626 - RNA, 22 nt, Human
caggacaaucucgucggguccu

SEQ ID NO: 209627 - RNA, 22 nt, Human
cagcaaaugaguggcagggcag

SEQ ID NO: 209628 - RNA, 22 nt, Human
agugauuugacucuuuuauugu

SEQ ID NO: 209629 - RNA, 22 nt, Human
uacaggaaggcucuggaggugc

SEQ ID NO: 209630 - RNA, 19 nt, Human
gccaggcucuuauucugug

SEQ ID NO: 209631 - RNA, 22 nt, Human
acuuucaauucccuuagcaacu

SEQ ID NO: 209632 - RNA, 22 nt, Human
caaggccaguuucuccuaguca

SEQ ID NO: 209633 - RNA, 22 nt, Human
cuguagcaguguuccagcauug

SEQ ID NO: 209634 - RNA, 22 nt, Human
ucagggcuuuggcuuuuacucu

SEQ ID NO: 209635 - RNA, 22 nt, Human
uccaugagcuagggauucauca

SEQ ID NO: 209636 - RNA, 22 nt, Human
auaaggcacacauagauagggu

SEQ ID NO: 209637 - RNA, 22 nt, Human
gaacagcaugcaugcaagacua

SEQ ID NO: 209638 - RNA, 22 nt, Human
cccagguccccaccugucugcu

SEQ ID NO: 209639 - RNA, 22 nt, Human
cuuuggaggaccuaugugcaau

SEQ ID NO: 209640 - RNA, 22 nt, Human
agucaguggauuuaccaugcgu

SEQ ID NO: 209641 - RNA, 22 nt, Human
aaagagcaagggcuuugaggcu

SEQ ID NO: 209642 - RNA, 22 nt, Human
auccagcuuugucuggucuucg

SEQ ID NO: 209643 - RNA, 14 nt, Human
acaggcagauuucu

SEQ ID NO: 209644 - RNA, 22 nt, Human
aacaguauugguugaacucaag

SEQ ID NO: 209645 - RNA, 19 nt, Human
acagagcucucugcuucug

SEQ ID NO: 209646 - RNA, 22 nt, Human
uucuagaaggcaggcugggcca

SEQ ID NO: 209647 - RNA, 22 nt, Human
auucaacuauguauagucuucu

SEQ ID NO: 209648 - RNA, 22 nt, Human
uaagaaucugcauuuuaacaag

SEQ ID NO: 209649 - RNA, 22 nt, Human
gaaucuaugccucauauagacc

SEQ ID NO: 209650 - RNA, 18 nt, Human
gaggccugagaaccaggu

SEQ ID NO: 209651 - RNA, 22 nt, Human
cccugguggggccagacuugcu

SEQ ID NO: 209652 - RNA, 22 nt, Human
gcccuguguguuugcacugauu

SEQ ID NO: 209653 - RNA, 18 nt, Human
ggcuguggacaagauuag

SEQ ID NO: 209654 - RNA, 17 nt, Human
uggcuucaggcugagca

SEQ ID NO: 209655 - RNA, 20 nt, Human
cuuuuucuccagcucugagc

SEQ ID NO: 209656 - RNA, 22 nt, Human
gaauuucaagcagugcaauguu

SEQ ID NO: 209657 - RNA, 22 nt, Human
uacaugugcuauuuguuuugua

SEQ ID NO: 209658 - RNA, 22 nt, Human
ggaagaaaugcucuucuaugcg

SEQ ID NO: 209659 - RNA, 22 nt, Human
cugacuguuugcugaaaggucu

SEQ ID NO: 209660 - RNA, 22 nt, Human
ggcccucccggugaugaagagc

SEQ ID NO: 209661 - RNA, 22 nt, Human
gaggucaucaccaauauaugcc

SEQ ID NO: 209662 - RNA, 20 nt, Human
ugagccagucaagcuacauu

SEQ ID NO: 209663 - RNA, 23 nt, Human
cacaugaccugaccuaggcuagg

SEQ ID NO: 209664 - RNA, 22 nt, Human
uaauucuucaggccuuuugucu

SEQ ID NO: 209665 - RNA, 22 nt, Human
aauccauucagaaauugggaau

SEQ ID NO: 209666 - RNA, 17 nt, Human
caggucugaggccaggc

SEQ ID NO: 209667 - RNA, 22 nt, Human
cuggaaggcagagguugcagug

SEQ ID NO: 209668 - RNA, 22 nt, Human
cccccacuaaguugagggcccu

SEQ ID NO: 209669 - RNA, 23 nt, Human
gagagcccauuggcagggguacc

SEQ ID NO: 209670 - RNA, 22 nt, Human
ucuugauuacaaauaacaucau

SEQ ID NO: 209671 - RNA, 22 nt, Human
cucccaagauaaauaaggcagu

SEQ ID NO: 209672 - RNA, 22 nt, Human
gugacagggagugauauagcag

SEQ ID NO: 209673 - RNA, 22 nt, Human
augcuaaugagcuaaggagucc

SEQ ID NO: 209674 - RNA, 22 nt, Human
ccagaaaaggagcugcaggaug

SEQ ID NO: 209675 - RNA, 22 nt, Human
gagaggccauggggugggaugc

SEQ ID NO: 209676 - RNA, 22 nt, Human
uacagagauacucuagaucaaa

SEQ ID NO: 209677 - RNA, 21 nt, Human
agaguggcaaaguguccaaga

SEQ ID NO: 209678 - RNA, 22 nt, Human
agcuuuauauguuguuucucca

SEQ ID NO: 209679 - RNA, 22 nt, Human
ucauguuaucuuggcucuggga

SEQ ID NO: 209680 - RNA, 22 nt, Human
ccuggccagcagccccuuccuc

SEQ ID NO: 209681 - RNA, 22 nt, Human
cccuggcacuagcgacggccau

SEQ ID NO: 209682 - RNA, 22 nt, Human
aucuuugcccagagacucagcc

SEQ ID NO: 209683 - RNA, 22 nt, Human
agacaggcuuugcuguauauca

SEQ ID NO: 209684 - RNA, 22 nt, Human
ugcuuuaucugacuuggcgcug

SEQ ID NO: 209685 - RNA, 22 nt, Human
auucucuggucauugagcauau

SEQ ID NO: 209686 - RNA, 22 nt, Human
ugagugaaaaauuugccuggag

SEQ ID NO: 209687 - RNA, 22 nt, Human
acacauuaaccuuugaaauucu

SEQ ID NO: 209688 - RNA, 22 nt, Human
ugggcccuuaugaagcucaaga

SEQ ID NO: 209689 - RNA, 22 nt, Human
uuagauacccaaguggaucugu

SEQ ID NO: 209690 - RNA, 22 nt, Human
cuggccuuuagccccagugucu

SEQ ID NO: 209691 - RNA, 22 nt, Human
agcucaggucauuccagggaug

SEQ ID NO: 209692 - RNA, 22 nt, Human
cuucccacuaaagcccuuguug

SEQ ID NO: 209693 - RNA, 22 nt, Human
aucauuucccuuuagaucacaa

SEQ ID NO: 209694 - RNA, 22 nt, Human
gacccuccuacuacccuggaaa

SEQ ID NO: 209695 - RNA, 22 nt, Human
aagcaucuaggugacugacaua

SEQ ID NO: 209696 - RNA, 22 nt, Human
cagauauauuuuauuuggucaa

SEQ ID NO: 209697 - RNA, 22 nt, Human
aauauaauuuuauuccuagagu

SEQ ID NO: 209698 - RNA, 22 nt, Human
ccuggacaaugagaugucaggg

SEQ ID NO: 209699 - RNA, 22 nt, Human
ggaucugggcucugccaaucag

SEQ ID NO: 209700 - RNA, 22 nt, Human
gccaggcaugggcuucugggcg

SEQ ID NO: 209701 - RNA, 22 nt, Human
ugaagagauuaaguugguuuug

SEQ ID NO: 209702 - RNA, 22 nt, Human
guccuucaaguaaccugggacc

SEQ ID NO: 209703 - RNA, 22 nt, Human
ggcucagguugggucacaugac

SEQ ID NO: 209704 - RNA, 22 nt, Human
gcuguucacauuuugggccaaa

SEQ ID NO: 209705 - RNA, 22 nt, Human
cagcugccuucugcgggaaguc

SEQ ID NO: 209706 - RNA, 22 nt, Human
caggcagagaggagcauuuaau

SEQ ID NO: 209707 - RNA, 22 nt, Human
uuucugaaaugcuggcuuugga

SEQ ID NO: 209708 - RNA, 23 nt, Human
agacagcuuagaguuugccucuc

SEQ ID NO: 209709 - RNA, 22 nt, Human
agagcuccugcauucuucccug

SEQ ID NO: 209710 - RNA, 22 nt, Human
uucucuuaucuggcauuauugg

SEQ ID NO: 209711 - RNA, 22 nt, Human
aagacauuuuagagauagggaa

SEQ ID NO: 209712 - RNA, 22 nt, Human
gugagauuugaguggggauaca

SEQ ID NO: 209713 - RNA, 22 nt, Human
ggagucuucagauagaguauuu

SEQ ID NO: 209714 - RNA, 22 nt, Human
gcagugaagccagaucugaaau

SEQ ID NO: 209715 - RNA, 22 nt, Human
cugagccuugaugucccuuguc

SEQ ID NO: 209716 - RNA, 21 nt, Human
cggcuucugcauuccagagcu

SEQ ID NO: 209717 - RNA, 22 nt, Human
acagaaagauaggcacaagguc

SEQ ID NO: 209718 - RNA, 22 nt, Human
agaucauagcacaaaagugaca

SEQ ID NO: 209719 - RNA, 22 nt, Human
ugucugggauguuggcagccac

SEQ ID NO: 209720 - RNA, 22 nt, Human
agagaucugugcuuacuacaag

SEQ ID NO: 209721 - RNA, 22 nt, Human
auaaauaucacuguugucccuc

SEQ ID NO: 209722 - RNA, 22 nt, Human
acagucaguaucccaggcaaau

SEQ ID NO: 209723 - RNA, 22 nt, Human
cacauuccccagagcuggggcu

SEQ ID NO: 209724 - RNA, 23 nt, Human
cagggaggagauacuguguaucu

SEQ ID NO: 209725 - RNA, 22 nt, Human
acuggaggggaaaaugguagua

SEQ ID NO: 209726 - RNA, 22 nt, Human
ugcauaaacagauacuucaugu

SEQ ID NO: 209727 - RNA, 22 nt, Human
aagucaagauaaaggugcuggc

SEQ ID NO: 209728 - RNA, 20 nt, Human
uuucuguagcucaguauuca

SEQ ID NO: 209729 - RNA, 22 nt, Human
acuaguuugaaaauaucugauu

SEQ ID NO: 209730 - RNA, 22 nt, Human
uggcucagugaagagauaacuu

SEQ ID NO: 209731 - RNA, 21 nt, Human
cagcaaaucauugggcagacu

SEQ ID NO: 209732 - RNA, 22 nt, Human
acugcccucccaucuauugcaa

SEQ ID NO: 209733 - RNA, 22 nt, Human
guuacaaagcacuucaagugaa

SEQ ID NO: 209734 - RNA, 19 nt, Human
acauggcucuccagucugg

SEQ ID NO: 209735 - RNA, 22 nt, Human
uaacacacugaaggugagaugg

SEQ ID NO: 209736 - RNA, 22 nt, Human
cugggaagauggugacagaauu

SEQ ID NO: 209737 - RNA, 21 nt, Human
uuucuggguggcugcauagug

SEQ ID NO: 209738 - RNA, 21 nt, Human
guccucagcugaugggagcug

SEQ ID NO: 209739 - RNA, 22 nt, Human
gaggccacgguuuuccuugggg

SEQ ID NO: 209740 - RNA, 22 nt, Human
ucccaggauguuuauggcuggu

SEQ ID NO: 209741 - RNA, 22 nt, Human
cccuggccccucacuccgaggc

SEQ ID NO: 209742 - RNA, 18 nt, Human
agguucugacaguccaaa

SEQ ID NO: 209743 - RNA, 22 nt, Human
ucugggagguaaccaugcugau

SEQ ID NO: 209744 - RNA, 18 nt, Human
uugugaaauauuggaguc

SEQ ID NO: 209745 - RNA, 22 nt, Human
uaugaacauugaagaggagccc

SEQ ID NO: 209746 - RNA, 22 nt, Human
auaaucaaaguccuaugacauc

SEQ ID NO: 209747 - RNA, 22 nt, Human
cugguccccagacugggcuuag

SEQ ID NO: 209748 - RNA, 22 nt, Human
ucaaugagguaaucagucaccc

SEQ ID NO: 209749 - RNA, 22 nt, Human
cuccuucccaugagugugggca

SEQ ID NO: 209750 - RNA, 22 nt, Human
uuccaggagccacacaggggcg

SEQ ID NO: 209751 - RNA, 22 nt, Human
ucuccaggugaaacuugcaggg

SEQ ID NO: 209752 - RNA, 22 nt, Human
cuagugagucugaaugaguugc

SEQ ID NO: 209753 - RNA, 17 nt, Human
ggacacagcucauggcu

SEQ ID NO: 209754 - RNA, 22 nt, Human
gagagcuggauucuggauaggu

SEQ ID NO: 209755 - RNA, 19 nt, Human
agugguagaugagcaggag

SEQ ID NO: 209756 - RNA, 22 nt, Human
uucaaaugcaaguuacuacuuu

SEQ ID NO: 209757 - RNA, 22 nt, Human
ugaaggaagaauaggcaguguu

SEQ ID NO: 209758 - RNA, 22 nt, Human
auuuuaauaagauucccaagua

SEQ ID NO: 209759 - RNA, 22 nt, Human
aucucccaaauuagccucuuga

SEQ ID NO: 209760 - RNA, 22 nt, Human
gagagcacggucuugggcaugg

SEQ ID NO: 209761 - RNA, 22 nt, Human
uaaauuguguguugcuagggga

SEQ ID NO: 209762 - RNA, 22 nt, Human
agagaagggguaaagaguccug

SEQ ID NO: 209763 - RNA, 22 nt, Human
aucuuugggauauuugugauua

SEQ ID NO: 209764 - RNA, 22 nt, Human
gccucccuguagaggccagccu

SEQ ID NO: 209765 - RNA, 22 nt, Human
caugcuuuuuucuaguauaaau

SEQ ID NO: 209766 - RNA, 22 nt, Human
uggccuuuguugauagcuaugc

SEQ ID NO: 209767 - RNA, 22 nt, Human
ugcaaacaauuuccuauaaagu

SEQ ID NO: 209768 - RNA, 22 nt, Human
cuggucacuccuccaccugcuu

SEQ ID NO: 209769 - RNA, 22 nt, Human
accaaccagggacuuggcuccc

SEQ ID NO: 209770 - RNA, 22 nt, Human
uaggguccaagccuuauaauua

SEQ ID NO: 209771 - RNA, 23 nt, Human
uucuccugaggaagcagggacug

SEQ ID NO: 209772 - RNA, 22 nt, Human
ggcagagacaccgaaugacucu

SEQ ID NO: 209773 - RNA, 22 nt, Human
ucuaaguaaaauuugucauuuc

SEQ ID NO: 209774 - RNA, 22 nt, Human
gcucaggaaacagcagggcuug

SEQ ID NO: 209775 - RNA, 22 nt, Human
aggucgaguuucggggcuacuu

SEQ ID NO: 209776 - RNA, 22 nt, Human
aucccauuuccuguuuugucaa

SEQ ID NO: 209777 - RNA, 21 nt, Human
aggcauggaaauggcacacug

SEQ ID NO: 209778 - RNA, 22 nt, Human
agaauccuggagaagcuguacc

SEQ ID NO: 209779 - RNA, 22 nt, Human
aacauguaaauaucauuguacu

SEQ ID NO: 209780 - RNA, 22 nt, Human
uccaggcuggagugcaguggca

SEQ ID NO: 209781 - RNA, 22 nt, Human
ugggggagagugcaagcaugaa

SEQ ID NO: 209782 - RNA, 22 nt, Human
cacguuaacagcuaacagauga

SEQ ID NO: 209783 - RNA, 22 nt, Human
gggaucuuguuuaauauuguuu

SEQ ID NO: 209784 - RNA, 22 nt, Human
agcuccugcuugacagaagagg

SEQ ID NO: 209785 - RNA, 22 nt, Human
aguaggcauugugaaacugcau

SEQ ID NO: 209786 - RNA, 18 nt, Human
accaggaagcuucuuguc

SEQ ID NO: 209787 - RNA, 22 nt, Human
ccagcaggagagaacauuuccc

SEQ ID NO: 209788 - RNA, 22 nt, Human
cacagcagggaugaauggagug

SEQ ID NO: 209789 - RNA, 22 nt, Human
cacaugugugcugaggacugug

SEQ ID NO: 209790 - RNA, 22 nt, Human
agcccagccacuauuaaauguu

SEQ ID NO: 209791 - RNA, 22 nt, Human
cuuguauagggaaagauaaauc

SEQ ID NO: 209792 - RNA, 22 nt, Human
auguuucuguccuacgagauaa

SEQ ID NO: 209793 - RNA, 22 nt, Human
uugaaugauuaaagucaucuga

SEQ ID NO: 209794 - RNA, 22 nt, Human
acauagaaauuuauuucuuaca

SEQ ID NO: 209795 - RNA, 22 nt, Human
guggcccacuuacgucaugugu

SEQ ID NO: 209796 - RNA, 22 nt, Human
cuucucggccguguggaugcgc

SEQ ID NO: 209797 - RNA, 22 nt, Human
ugcucugugugugguuauuucc

SEQ ID NO: 209798 - RNA, 22 nt, Human
acugagauuuacauguucuagu

SEQ ID NO: 209799 - RNA, 22 nt, Human
auaacacuaaauguauguaaca

SEQ ID NO: 209800 - RNA, 22 nt, Human
cagaugaggggcauauaacaau

SEQ ID NO: 209801 - RNA, 22 nt, Human
ccacaucuguucuuaguucuga

SEQ ID NO: 209802 - RNA, 22 nt, Human
acaagaauuauuucuaguuaac

SEQ ID NO: 209803 - RNA, 22 nt, Human
uccagccuccuauuuacccuaa

SEQ ID NO: 209804 - RNA, 22 nt, Human
augcacaagguagauuauuauu

SEQ ID NO: 209805 - RNA, 22 nt, Human
gagggauggugugagaggcuca

SEQ ID NO: 209806 - RNA, 22 nt, Human
ucccagaaucuccagugcuaca

SEQ ID NO: 209807 - RNA, 22 nt, Human
ccugggcuuacgaccucugacu

SEQ ID NO: 209808 - RNA, 22 nt, Human
gcagcuuuuuggaugucaguua

SEQ ID NO: 209809 - RNA, 22 nt, Human
aggccuugggccauagucuccu

SEQ ID NO: 209810 - RNA, 22 nt, Human
aaguccagaacuccugugauag

SEQ ID NO: 209811 - RNA, 22 nt, Human
cuccugcugaauggccaggagc

SEQ ID NO: 209812 - RNA, 22 nt, Human
ugcugaggcaguccuaacagga

SEQ ID NO: 209813 - RNA, 22 nt, Human
agcauuuucugagaguauagau

SEQ ID NO: 209814 - RNA, 22 nt, Human
uagcuccuacaaguacagcaaa

SEQ ID NO: 209815 - RNA, 22 nt, Human
gccaggaggcugcuguguaggc

SEQ ID NO: 209816 - RNA, 22 nt, Human
acagugaaaaguagcuaacaca

SEQ ID NO: 209817 - RNA, 22 nt, Human
uuccuguguccuauuucgacuu

SEQ ID NO: 209818 - RNA, 22 nt, Human
aauuaguucaauggaugauaga

SEQ ID NO: 209819 - RNA, 22 nt, Human
aggggaagagcccuuuacaugg

SEQ ID NO: 209820 - RNA, 22 nt, Human
cagucuggaucugugcugcugu

SEQ ID NO: 209821 - RNA, 22 nt, Human
ccugggcugcucauggggauga

SEQ ID NO: 209822 - RNA, 22 nt, Human
cagcugcuuacuagcuguguga

SEQ ID NO: 209823 - RNA, 19 nt, Human
cucucuccaguggcuggcu

SEQ ID NO: 209824 - RNA, 22 nt, Human
uuguguccucuaaucucaccac

SEQ ID NO: 209825 - RNA, 22 nt, Human
ugaguggguuaucaggaaaggu

SEQ ID NO: 209826 - RNA, 22 nt, Human
acagaauuaucaggaaauguua

SEQ ID NO: 209827 - RNA, 22 nt, Human
cagagacuggagugcaguggcg

SEQ ID NO: 209828 - RNA, 22 nt, Human
ucagcacuuugaagcagaagga

SEQ ID NO: 209829 - RNA, 22 nt, Human
uggcccaggcgaggugggcaga

SEQ ID NO: 209830 - RNA, 22 nt, Human
uauugcugccaggacccuaucc

SEQ ID NO: 209831 - RNA, 22 nt, Human
cuucuuaaugcauaaacugugu

SEQ ID NO: 209832 - RNA, 22 nt, Human
uggaagggaacagguggguguu

SEQ ID NO: 209833 - RNA, 22 nt, Human
uucaguuugaauucuguagaac

SEQ ID NO: 209834 - RNA, 22 nt, Human
uugggugguggggagaguucag

SEQ ID NO: 209835 - RNA, 22 nt, Human
ucagcuuauauuuuuaguguaa

SEQ ID NO: 209836 - RNA, 18 nt, Human
gcaaggcucaggccaggc

SEQ ID NO: 209837 - RNA, 22 nt, Human
gcaaauucuuaacuggacugug

SEQ ID NO: 209838 - RNA, 18 nt, Human
cucucugggugaggacaa

SEQ ID NO: 209839 - RNA, 22 nt, Human
agcagggccugagugaccuaac

SEQ ID NO: 209840 - RNA, 22 nt, Human
gcugaaauguuuaauuugggag

SEQ ID NO: 209841 - RNA, 22 nt, Human
ugugugacacauugauaugugc

SEQ ID NO: 209842 - RNA, 22 nt, Human
uaacugaauguauuacaacaga

SEQ ID NO: 209843 - RNA, 22 nt, Human
gcagcagggagcagggguguca

SEQ ID NO: 209844 - RNA, 22 nt, Human
uguggcugcagacacuggagcc

SEQ ID NO: 209845 - RNA, 22 nt, Human
ucugaagauuaccagcuaaaug

SEQ ID NO: 209846 - RNA, 22 nt, Human
ucagaggaucaugucccuacuc

SEQ ID NO: 209847 - RNA, 22 nt, Human
ucugggagcagcucagcagauu

SEQ ID NO: 209848 - RNA, 22 nt, Human
auguucuuuggaauuuaugaaa

SEQ ID NO: 209849 - RNA, 22 nt, Human
guagaaauuccauuuacuuuga

SEQ ID NO: 209850 - RNA, 22 nt, Human
uccuagaaagaugucuuuucac

SEQ ID NO: 209851 - RNA, 22 nt, Human
ucugcuggugaugaccucauaa

SEQ ID NO: 209852 - RNA, 22 nt, Human
aggcgcaggguuuggacccagg

SEQ ID NO: 209853 - RNA, 22 nt, Human
ccucuccaguuuuaacgugacc

SEQ ID NO: 209854 - RNA, 22 nt, Human
aggcaagugcauuagaagagca

SEQ ID NO: 209855 - RNA, 22 nt, Human
cuuuaguuauuuagacuacagu

SEQ ID NO: 209856 - RNA, 22 nt, Human
ugaugagggcaguucuuguugc

SEQ ID NO: 209857 - RNA, 22 nt, Human
caugucuguguacacaugcaca

SEQ ID NO: 209858 - RNA, 22 nt, Human
uugaggcagguccggguccuuc

SEQ ID NO: 209859 - RNA, 22 nt, Human
cauuaauauuguucuucuuuag

SEQ ID NO: 209860 - RNA, 22 nt, Human
uagggacccucccugcucuaac

SEQ ID NO: 209861 - RNA, 22 nt, Human
auuuuuuagccaagacucugca

SEQ ID NO: 209862 - RNA, 22 nt, Human
agccugugugcuuuggacaggg

SEQ ID NO: 209863 - RNA, 22 nt, Human
agggcagcugugagccacugug

SEQ ID NO: 209864 - RNA, 22 nt, Human
aggcccuguaagguguggagau

SEQ ID NO: 209865 - RNA, 22 nt, Human
uuccagaacaauguggacguau

SEQ ID NO: 209866 - RNA, 22 nt, Human
uccuggcuuccacaccugucau

SEQ ID NO: 209867 - RNA, 22 nt, Human
cuucacagucacccugcugugu

SEQ ID NO: 209868 - RNA, 22 nt, Human
agagucaaaauuuaccagaaug

SEQ ID NO: 209869 - RNA, 22 nt, Human
acacagaguccuuacugaggua

SEQ ID NO: 209870 - RNA, 22 nt, Human
agcugccaaguuucucaguuua

SEQ ID NO: 209871 - RNA, 21 nt, Human
aggaaaauugaggguuguugu

SEQ ID NO: 209872 - RNA, 22 nt, Human
auguuagugauaguaaauagug

SEQ ID NO: 209873 - RNA, 22 nt, Human
aaacuuuguagagaaugcuggc

SEQ ID NO: 209874 - RNA, 22 nt, Human
gcuguacauucugcacaggccc

SEQ ID NO: 209875 - RNA, 22 nt, Human
cuagagaaaccccaugagcuuu

SEQ ID NO: 209876 - RNA, 22 nt, Human
aacagcagcugaggagcugggc

SEQ ID NO: 209877 - RNA, 22 nt, Human
ucaggaucaggggccuuuccuu

SEQ ID NO: 209878 - RNA, 22 nt, Human
auuucaguguugguuagcaagc

SEQ ID NO: 209879 - RNA, 22 nt, Human
caggcucccgaaaucacccaug

SEQ ID NO: 209880 - RNA, 22 nt, Human
aauugcuuuacaagccguuuaa

SEQ ID NO: 209881 - RNA, 22 nt, Human
uuggucagcuaauaaggacagg

SEQ ID NO: 209882 - RNA, 22 nt, Human
caagauggaguccgggaaugug

SEQ ID NO: 209883 - RNA, 22 nt, Human
augguaaccagaagacuaugac

SEQ ID NO: 209884 - RNA, 22 nt, Human
gcagcaggugugcuuuuaauga

SEQ ID NO: 209885 - RNA, 22 nt, Human
agcugaggccacgagugaaggg

SEQ ID NO: 209886 - RNA, 22 nt, Human
gcagaaguggauucuacaauuu

SEQ ID NO: 209887 - RNA, 22 nt, Human
ucuccaggccuuucccaucuua

SEQ ID NO: 209888 - RNA, 22 nt, Human
caggcagcccugcaccaagugu

SEQ ID NO: 209889 - RNA, 22 nt, Human
cagggaugcuguuaaacauccu

SEQ ID NO: 209890 - RNA, 22 nt, Human
aggaggaggcuggaguacaccc

SEQ ID NO: 209891 - RNA, 20 nt, Human
cuggccagaacgccuacaca

SEQ ID NO: 209892 - RNA, 22 nt, Human
caggcugugggagucaggaccc

SEQ ID NO: 209893 - RNA, 22 nt, Human
agcugcagcguucauuuuucca

SEQ ID NO: 209894 - RNA, 22 nt, Human
ugcuuaaaggauaguuuaaacu

SEQ ID NO: 209895 - RNA, 22 nt, Human
cucuccaggggaacauuguucc

SEQ ID NO: 209896 - RNA, 22 nt, Human
uaacagagugaaaaucagcaca

SEQ ID NO: 209897 - RNA, 22 nt, Human
ugcagaagcagagaguugccaa

SEQ ID NO: 209898 - RNA, 22 nt, Human
uuccucagccaaggcugggauc

SEQ ID NO: 209899 - RNA, 22 nt, Human
cagauguaauuacucaagucaa

SEQ ID NO: 209900 - RNA, 22 nt, Human
uuauggaaaauacaauuauaag

SEQ ID NO: 209901 - RNA, 22 nt, Human
ccugugucaucagcuguggcua

SEQ ID NO: 209902 - RNA, 19 nt, Human
aggcagcaggccagggaug

SEQ ID NO: 209903 - RNA, 22 nt, Human
auucuuuauugcugaugguuau

SEQ ID NO: 209904 - RNA, 17 nt, Human
ccacagccuggcacuug

SEQ ID NO: 209905 - RNA, 22 nt, Human
gaugaucugcaagaacuacaug

SEQ ID NO: 209906 - RNA, 19 nt, Human
gguagaagggaaguguuuu

SEQ ID NO: 209907 - RNA, 22 nt, Human
gauggauacuauaggaggcaca

SEQ ID NO: 209908 - RNA, 22 nt, Human
guccagaguagucgaguauucu

SEQ ID NO: 209909 - RNA, 22 nt, Human
ucagauggcacacagagccugc

SEQ ID NO: 209910 - RNA, 22 nt, Human
uuauuuaggaggaaacugaggu

SEQ ID NO: 209911 - RNA, 22 nt, Human
ugcccauggaccaagcaagggg

SEQ ID NO: 209912 - RNA, 22 nt, Human
cagggccagcgcccaggcccag

SEQ ID NO: 209913 - RNA, 20 nt, Human
aauuagauguuuaaucaaua

SEQ ID NO: 209914 - RNA, 22 nt, Human
auccagggauaaaaguaagguu

SEQ ID NO: 209915 - RNA, 22 nt, Human
agggcccuagggaaugagacau

SEQ ID NO: 209916 - RNA, 22 nt, Human
acucuuauuuugaaguaauaau

SEQ ID NO: 209917 - RNA, 22 nt, Human
acagcuguguuuuauaaucagc

SEQ ID NO: 209918 - RNA, 22 nt, Human
accaggcacuccugaggucuga

SEQ ID NO: 209919 - RNA, 22 nt, Human
acaguacucuaaugaaaagugc

SEQ ID NO: 209920 - RNA, 22 nt, Human
gcauguguuagagugugcaugc

SEQ ID NO: 209921 - RNA, 22 nt, Human
agcugccucucuugagguuacg

SEQ ID NO: 209922 - RNA, 19 nt, Human
ugagacagggauucaggug

SEQ ID NO: 209923 - RNA, 23 nt, Human
uugaggcaaacucuuuucugaaa

SEQ ID NO: 209924 - RNA, 22 nt, Human
cugagcucagucccagcucuac

SEQ ID NO: 209925 - RNA, 22 nt, Human
gccugugcauagcagcggacuc

SEQ ID NO: 209926 - RNA, 22 nt, Human
gaagcagaacccacuccccaac

SEQ ID NO: 209927 - RNA, 19 nt, Human
agaagcccagaucccagcc

SEQ ID NO: 209928 - RNA, 22 nt, Human
ugaggcaguauucuccauucca

SEQ ID NO: 209929 - RNA, 22 nt, Human
ucuguggcuuucguguaagaug

SEQ ID NO: 209930 - RNA, 22 nt, Human
ugagucuucuuccgggauugcu

SEQ ID NO: 209931 - RNA, 22 nt, Human
ucaggggcagccggggaagcca

SEQ ID NO: 209932 - RNA, 22 nt, Human
caaaaguaauguaugcucaucg

SEQ ID NO: 209933 - RNA, 22 nt, Human
ugagggcugcuuccagagcuag

SEQ ID NO: 209934 - RNA, 22 nt, Human
ccuggcugggguagaagugagg

SEQ ID NO: 209935 - RNA, 22 nt, Human
uucacauugaaggugcuuucuu

SEQ ID NO: 209936 - RNA, 22 nt, Human
cagccaucaguaaagacagcuu

SEQ ID NO: 209937 - RNA, 22 nt, Human
uccauagaaugcaguguaaauu

SEQ ID NO: 209938 - RNA, 22 nt, Human
ugagagccagaagggccugagg

SEQ ID NO: 209939 - RNA, 22 nt, Human
uugugcagcuauaaagaaaugg

SEQ ID NO: 209940 - RNA, 22 nt, Human
uaauuuuaugacaguguauuuu

SEQ ID NO: 209941 - RNA, 22 nt, Human
aguuacaaacacuaucaguucu

SEQ ID NO: 209942 - RNA, 22 nt, Human
acauucuguuuccccaaagaga

SEQ ID NO: 209943 - RNA, 22 nt, Human
caaauacucuggauguguuugu

SEQ ID NO: 209944 - RNA, 20 nt, Human
agugauuuguuaguacauug

SEQ ID NO: 209945 - RNA, 22 nt, Human
auuauuagauucuuaauuguaa

SEQ ID NO: 209946 - RNA, 22 nt, Human
aggccaggaauccuugucccag

SEQ ID NO: 209947 - RNA, 22 nt, Human
agcugccugccaugccgcuggu

SEQ ID NO: 209948 - RNA, 22 nt, Human
gcugggcuguaguuugcugacc

SEQ ID NO: 209949 - RNA, 22 nt, Human
caugaguuuuuuaguucaugca

SEQ ID NO: 209950 - RNA, 22 nt, Human
uugguuuguucaccaucaagca

SEQ ID NO: 209951 - RNA, 22 nt, Human
acccugggagggagaaaucaga

SEQ ID NO: 209952 - RNA, 22 nt, Human
guguggcagggcguuugcagac

SEQ ID NO: 209953 - RNA, 22 nt, Human
accucagagggauguuacaggc

SEQ ID NO: 209954 - RNA, 22 nt, Human
uccuucagggggccgccugcac

SEQ ID NO: 209955 - RNA, 22 nt, Human
uccugagguggauugagcagag

SEQ ID NO: 209956 - RNA, 22 nt, Human
caaaauuagggagugagcugga

SEQ ID NO: 209957 - RNA, 22 nt, Human
uugcaaggagccacucugccug

SEQ ID NO: 209958 - RNA, 22 nt, Human
ccugugcaugccaggguacacc

SEQ ID NO: 209959 - RNA, 22 nt, Human
aaaaugagacacaugugacucc

SEQ ID NO: 209960 - RNA, 22 nt, Human
gggauuugugggauggccagug

SEQ ID NO: 209961 - RNA, 21 nt, Human
gugguucuagagaaacagaau

SEQ ID NO: 209962 - RNA, 19 nt, Human
cagccucaaucccucgggc

SEQ ID NO: 209963 - RNA, 22 nt, Human
gugcugagauuggagugagcag

SEQ ID NO: 209964 - RNA, 22 nt, Human
caguuacaugcucaugucauca

SEQ ID NO: 209965 - RNA, 22 nt, Human
ccagucagccaagcugcagcgg

SEQ ID NO: 209966 - RNA, 22 nt, Human
ucuggcuccuggcuccacugcc

SEQ ID NO: 209967 - RNA, 22 nt, Human
caucuuuaaaaugggaacaaca

SEQ ID NO: 209968 - RNA, 22 nt, Human
gacauuucuagcccauaaaacu

SEQ ID NO: 209969 - RNA, 22 nt, Human
uguggcuguggaugcuuuccag

SEQ ID NO: 209970 - RNA, 17 nt, Human
aaccagcuguccccucc

SEQ ID NO: 209971 - RNA, 22 nt, Human
agcuucccggcaggcacguccu

SEQ ID NO: 209972 - RNA, 22 nt, Human
auugcaaauaacuguacugaau

SEQ ID NO: 209973 - RNA, 22 nt, Human
auagcaauuaagcuccagaauu

SEQ ID NO: 209974 - RNA, 22 nt, Human
cugcugggucccccugcugauu

SEQ ID NO: 209975 - RNA, 22 nt, Human
agggcugcaccggggcuucgcg

SEQ ID NO: 209976 - RNA, 19 nt, Human
aggaaggaaccugagucug

SEQ ID NO: 209977 - RNA, 22 nt, Human
guccucuguguaggcugcagac

SEQ ID NO: 209978 - RNA, 22 nt, Human
aacuuucugucugagcugcaga

SEQ ID NO: 209979 - RNA, 22 nt, Human
aagccaaaggcuccagugaccu

SEQ ID NO: 209980 - RNA, 22 nt, Human
ugguggacaucccagggugaaa

SEQ ID NO: 209981 - RNA, 22 nt, Human
ugcagggagggcccagcaaucu

SEQ ID NO: 209982 - RNA, 22 nt, Human
ccacuuucugagggaacagcag

SEQ ID NO: 209983 - RNA, 22 nt, Human
cagaaauuggaauagagaaaua

SEQ ID NO: 209984 - RNA, 20 nt, Human
uuucacaucugucccuuuaa

SEQ ID NO: 209985 - RNA, 22 nt, Human
cucuccagguuagagcacuuau

SEQ ID NO: 209986 - RNA, 22 nt, Human
ugcaggaauauugaugaacuua

SEQ ID NO: 209987 - RNA, 20 nt, Human
auauaauaaauuuugguuac

SEQ ID NO: 209988 - RNA, 22 nt, Human
caagggcagauagcugguccaa

SEQ ID NO: 209989 - RNA, 22 nt, Human
ucugcucugagagggccaucag

SEQ ID NO: 209990 - RNA, 22 nt, Human
ggauuuacaaguuuaacucuca

SEQ ID NO: 209991 - RNA, 22 nt, Human
uacacagggagagauuggaaac

SEQ ID NO: 209992 - RNA, 22 nt, Human
uugccaggcucugguuccagcc

SEQ ID NO: 209993 - RNA, 22 nt, Human
uggauaaaaugacauuaccuga

SEQ ID NO: 209994 - RNA, 22 nt, Human
guguucauugcuagugaggugu

SEQ ID NO: 209995 - RNA, 21 nt, Human
ugucagagcuuguaggacauu

SEQ ID NO: 209996 - RNA, 22 nt, Human
uccucagagcauagcgcugucu

SEQ ID NO: 209997 - RNA, 22 nt, Human
uccauacacauuuauuuggccu

SEQ ID NO: 209998 - RNA, 22 nt, Human
uccacagggauguugaguucuu

SEQ ID NO: 209999 - RNA, 22 nt, Human
augcaggagagcauguuuaaga

SEQ ID NO: 210000 - RNA, 22 nt, Human
cagggcagaaggcacucuacuc

SEQ ID NO: 210001 - RNA, 22 nt, Human
aaucaggacccacucuacaguu

SEQ ID NO: 210002 - RNA, 21 nt, Human
cuugagaauuaacuguucauu

SEQ ID NO: 210003 - RNA, 22 nt, Human
uacccagcaaucccuagagguu

SEQ ID NO: 210004 - RNA, 21 nt, Human
uggagcugaauuuuuggcauc

SEQ ID NO: 210005 - RNA, 22 nt, Human
gugggcucaggccucugugggg

SEQ ID NO: 210006 - RNA, 22 nt, Human
gggccucaggccuugcucugug

SEQ ID NO: 210007 - RNA, 22 nt, Human
ucuccugggugcuuuaucagaa

SEQ ID NO: 210008 - RNA, 22 nt, Human
ugcuuuauagacaaggaaguag

SEQ ID NO: 210009 - RNA, 22 nt, Human
cagaggcacagcuucuuuuaau

SEQ ID NO: 210010 - RNA, 22 nt, Human
ucauuugugugagugauuugac

SEQ ID NO: 210011 - RNA, 22 nt, Human
aauauaguucugguauuguuaa

SEQ ID NO: 210012 - RNA, 22 nt, Human
agacugggauucucccugauca

SEQ ID NO: 210013 - RNA, 22 nt, Human
aggacaguggcaaggcaggaca

SEQ ID NO: 210014 - RNA, 22 nt, Human
uugacuucccagacuuguguuu

SEQ ID NO: 210015 - RNA, 22 nt, Human
ugccccagacucugcucaccuc

SEQ ID NO: 210016 - RNA, 21 nt, Human
ucucuuugggaacauuaauca

SEQ ID NO: 210017 - RNA, 22 nt, Human
uauugauucugucccaaguuga

SEQ ID NO: 210018 - RNA, 22 nt, Human
ugagucuuuccaaagccgucau

SEQ ID NO: 210019 - RNA, 22 nt, Human
gugaaacacccuccaaugcaca

SEQ ID NO: 210020 - RNA, 22 nt, Human
ggcuucuccccuuugagucuuc

SEQ ID NO: 210021 - RNA, 22 nt, Human
gaguuacacaaaauuucuauuu

SEQ ID NO: 210022 - RNA, 22 nt, Human
ucuuuauugcuacugguuuguc

SEQ ID NO: 210023 - RNA, 22 nt, Human
ucauggggugacagaagggagg

SEQ ID NO: 210024 - RNA, 22 nt, Human
ccugguuuaaugcucacuguug

SEQ ID NO: 210025 - RNA, 22 nt, Human
gaacuuuaccauuuagguaacu

SEQ ID NO: 210026 - RNA, 22 nt, Human
cuggagcuggcuuccuuccacu

SEQ ID NO: 210027 - RNA, 22 nt, Human
acugaauauauuccauugcaug

SEQ ID NO: 210028 - RNA, 22 nt, Human
ugucauuuccugaaugcugagu

SEQ ID NO: 210029 - RNA, 22 nt, Human
acccaggcuggaaugcaguggu

SEQ ID NO: 210030 - RNA, 22 nt, Human
ucuuuuauccuacauuuagcuc

SEQ ID NO: 210031 - RNA, 20 nt, Human
uaugauaauuacaaaauagu

SEQ ID NO: 210032 - RNA, 22 nt, Human
auauucacugagcauaaagcca

SEQ ID NO: 210033 - RNA, 22 nt, Human
aucuuuagagucaucugagugu

SEQ ID NO: 210034 - RNA, 22 nt, Human
auuucuuacauaacaaauuguu

SEQ ID NO: 210035 - RNA, 22 nt, Human
acaaauuguugcuucaugaaug

SEQ ID NO: 210036 - RNA, 22 nt, Human
uuauugagcaccuacuaugugu

SEQ ID NO: 210037 - RNA, 22 nt, Human
gcuguggcuuucuguuucuguu

SEQ ID NO: 210038 - RNA, 22 nt, Human
gccugggauucccagaggggca

SEQ ID NO: 210039 - RNA, 22 nt, Human
auucauuccaggucagucagac

SEQ ID NO: 210040 - RNA, 22 nt, Human
ccagggcacuuaggcccagccc

SEQ ID NO: 210041 - RNA, 22 nt, Human
gagcuacagaguuugguguuca

SEQ ID NO: 210042 - RNA, 22 nt, Human
aggcucaggugccucauucaca

SEQ ID NO: 210043 - RNA, 22 nt, Human
auuguauuuguacaagacaugu

SEQ ID NO: 210044 - RNA, 20 nt, Human
gaugaaaucacugggcagcc

SEQ ID NO: 210045 - RNA, 22 nt, Human
gagguaauuacuauguucagau

SEQ ID NO: 210046 - RNA, 22 nt, Human
uaggcuccaguguguggcgagu

SEQ ID NO: 210047 - RNA, 22 nt, Human
aaguaucugggagauuugcuuu

SEQ ID NO: 210048 - RNA, 22 nt, Human
uuguuuuuaaacaugugacuga

SEQ ID NO: 210049 - RNA, 22 nt, Human
cuaaaugucagaguagcuugca

SEQ ID NO: 210050 - RNA, 22 nt, Human
guggcauuuggaaagagcacua

SEQ ID NO: 210051 - RNA, 19 nt, Human
agggccugagcagauguug

SEQ ID NO: 210052 - RNA, 22 nt, Human
auaucaaacgaaguuauuuuaa

SEQ ID NO: 210053 - RNA, 22 nt, Human
cuacaguacuggaugcucagcc

SEQ ID NO: 210054 - RNA, 22 nt, Human
uagcagagcgggugcgaggcgg

SEQ ID NO: 210055 - RNA, 22 nt, Human
caggcugccgaggcugcagaau

SEQ ID NO: 210056 - RNA, 22 nt, Human
aauggcucugauguuguuguga

SEQ ID NO: 210057 - RNA, 22 nt, Human
uacagacagacuucccacccuc

SEQ ID NO: 210058 - RNA, 22 nt, Human
cugguucugauguucuuggcuu

SEQ ID NO: 210059 - RNA, 22 nt, Human
ugcuggagaggaaggugggguc

SEQ ID NO: 210060 - RNA, 22 nt, Human
uuauauuucugguagccuucag

SEQ ID NO: 210061 - RNA, 22 nt, Human
uuuuacaguuccaugcaaagcg

SEQ ID NO: 210062 - RNA, 22 nt, Human
ugcacccaugucuccacguaca

SEQ ID NO: 210063 - RNA, 22 nt, Human
ucagcugaaguggagaagcaga

SEQ ID NO: 210064 - RNA, 22 nt, Human
uaauuuuaacugugcuguuugg

SEQ ID NO: 210065 - RNA, 22 nt, Human
aagcaagacagaaguuacugcc

SEQ ID NO: 210066 - RNA, 20 nt, Human
guacacuucauguuucaccu

SEQ ID NO: 210067 - RNA, 22 nt, Human
ggcuccagggucucuccuugug

SEQ ID NO: 210068 - RNA, 19 nt, Human
uacauuccacacaaucucu

SEQ ID NO: 210069 - RNA, 22 nt, Human
uucagcaaacacgaugcuuguu

SEQ ID NO: 210070 - RNA, 22 nt, Human
gccagagccacuuuugggugau

SEQ ID NO: 210071 - RNA, 22 nt, Human
cacaauuagcagcucuuuauuu

SEQ ID NO: 210072 - RNA, 22 nt, Human
auauuaaugagcaaguaaguga

SEQ ID NO: 210073 - RNA, 22 nt, Human
gcacuucucgggggcgcugucu

SEQ ID NO: 210074 - RNA, 22 nt, Human
uucaggaugcagagguuguagu

SEQ ID NO: 210075 - RNA, 22 nt, Human
uggagaugggaaaaaggaggua

SEQ ID NO: 210076 - RNA, 22 nt, Human
ugggcagacuaaggucaaagcu

SEQ ID NO: 210077 - RNA, 22 nt, Human
cuucuugacuucugggugcccu

SEQ ID NO: 210078 - RNA, 22 nt, Human
uggcuggagcgcccuccucugc

SEQ ID NO: 210079 - RNA, 22 nt, Human
agcaagaugcauuauuucuuau

SEQ ID NO: 210080 - RNA, 22 nt, Human
agaugaagauaucugcaggggc

SEQ ID NO: 210081 - RNA, 22 nt, Human
aaucuugguugcaguauauccg

SEQ ID NO: 210082 - RNA, 22 nt, Human
uauauuuaaauccagguugaaa

SEQ ID NO: 210083 - RNA, 22 nt, Human
cggcuucuucgaggugucugcg

SEQ ID NO: 210084 - RNA, 22 nt, Human
cacaauuuggacuucacugguu

SEQ ID NO: 210085 - RNA, 22 nt, Human
agcugaaaauuagugauaguuu

SEQ ID NO: 210086 - RNA, 22 nt, Human
ugcacccauagcacacacuccu

SEQ ID NO: 210087 - RNA, 22 nt, Human
gugcugucguggaacugggcug

SEQ ID NO: 210088 - RNA, 22 nt, Human
uugccuuacugcauucaguaaa

SEQ ID NO: 210089 - RNA, 22 nt, Human
acaggcauauuucuagauuaca

SEQ ID NO: 210090 - RNA, 22 nt, Human
acaguuaauuguuguugggugu

SEQ ID NO: 210091 - RNA, 22 nt, Human
uggaaacuuggaacgucuucag

SEQ ID NO: 210092 - RNA, 22 nt, Human
ggcaaacagacuugaccaucuu

SEQ ID NO: 210093 - RNA, 22 nt, Human
cccagaggggucgucugagggg

SEQ ID NO: 210094 - RNA, 22 nt, Human
uuucucaguugugcgagcagca

SEQ ID NO: 210095 - RNA, 22 nt, Human
gggcagcaggcuccacguuccu

SEQ ID NO: 210096 - RNA, 22 nt, Human
gcagaggacagggauuuagauu

SEQ ID NO: 210097 - RNA, 22 nt, Human
ugcuucucagccugucuggaaa

SEQ ID NO: 210098 - RNA, 22 nt, Human
agcaaaauaagguaauuuauug

SEQ ID NO: 210099 - RNA, 22 nt, Human
ucuggguggugucuuccaagac

SEQ ID NO: 210100 - RNA, 22 nt, Human
agcuguggaguaggggguugga

SEQ ID NO: 210101 - RNA, 19 nt, Human
gggcaugcuggcucuagag

SEQ ID NO: 210102 - RNA, 22 nt, Human
aggcuggcuucccaagcguccu

SEQ ID NO: 210103 - RNA, 22 nt, Human
agcaggcaggaaggcagcacug

SEQ ID NO: 210104 - RNA, 19 nt, Human
ugagaugccuuccagcccu

SEQ ID NO: 210105 - RNA, 22 nt, Human
agugucuuacucccucaggcac

SEQ ID NO: 210106 - RNA, 22 nt, Human
cauuugaagacuuagaagagga

SEQ ID NO: 210107 - RNA, 22 nt, Human
uaugcaacagcauuauuacaau

SEQ ID NO: 210108 - RNA, 22 nt, Human
gauccuguuagaucccauuaga

SEQ ID NO: 210109 - RNA, 22 nt, Human
uauuaauaagugacuacuagcu

SEQ ID NO: 210110 - RNA, 22 nt, Human
ugaugauaugaaagaaucuuua

SEQ ID NO: 210111 - RNA, 22 nt, Human
uccagccugguugcgggcaucc

SEQ ID NO: 210112 - RNA, 22 nt, Human
cacacaugucucuccaugcucu

SEQ ID NO: 210113 - RNA, 22 nt, Human
uucccagaaugaauggauggag

SEQ ID NO: 210114 - RNA, 22 nt, Human
acaggacagucuaguaacagua

SEQ ID NO: 210115 - RNA, 22 nt, Human
acccaggggcgaagcuggccac

SEQ ID NO: 210116 - RNA, 22 nt, Human
ccugggucuggucacuaaguca

SEQ ID NO: 210117 - RNA, 22 nt, Human
guugcagauguggaacucgugc

SEQ ID NO: 210118 - RNA, 22 nt, Human
gcagggaccagggccagaucca

SEQ ID NO: 210119 - RNA, 22 nt, Human
ucuuuguuugccuuuaucaaga

SEQ ID NO: 210120 - RNA, 22 nt, Human
ccuuggcugaggagggagcuga

SEQ ID NO: 210121 - RNA, 22 nt, Human
gccaggcuggucuugaacuccu

SEQ ID NO: 210122 - RNA, 22 nt, Human
ccauccaggcugugggugagcu

SEQ ID NO: 210123 - RNA, 22 nt, Human
cggagcugcgccgggacacggg

SEQ ID NO: 210124 - RNA, 22 nt, Human
ggagcucagaagugagugaguu

SEQ ID NO: 210125 - RNA, 21 nt, Human
auggcuucucaggugcacuga

SEQ ID NO: 210126 - RNA, 22 nt, Human
ucauuucucccggccaaaaacu

SEQ ID NO: 210127 - RNA, 22 nt, Human
agaagcaaggucugucaguaua

SEQ ID NO: 210128 - RNA, 20 nt, Human
uacaaguacauuauaguuau

SEQ ID NO: 210129 - RNA, 22 nt, Human
uacagggacucccgcagagaua

SEQ ID NO: 210130 - RNA, 22 nt, Human
cagcccuguccaaugucugcuc

SEQ ID NO: 210131 - RNA, 22 nt, Human
uuacagugacucacauuaacaa

SEQ ID NO: 210132 - RNA, 22 nt, Human
caagauuuauauuuucacacaa

SEQ ID NO: 210133 - RNA, 22 nt, Human
gugcccugguccccagcauaua

SEQ ID NO: 210134 - RNA, 22 nt, Human
cuucugggagagcuuuugcuuc

SEQ ID NO: 210135 - RNA, 22 nt, Human
uucauucugcaguucucagcuc

SEQ ID NO: 210136 - RNA, 22 nt, Human
uauauuauaagcccuuucagaa

SEQ ID NO: 210137 - RNA, 22 nt, Human
caacagugauucugcaugagga

SEQ ID NO: 210138 - RNA, 22 nt, Human
gagcugagcuuaacuccuugaa

SEQ ID NO: 210139 - RNA, 22 nt, Human
acucagagauauggugguugau

SEQ ID NO: 210140 - RNA, 22 nt, Human
aucugagucucugacagcaugu

SEQ ID NO: 210141 - RNA, 22 nt, Human
uuguguccaaggcuauggugau

SEQ ID NO: 210142 - RNA, 22 nt, Human
uuccaggaagcucucggccucu

SEQ ID NO: 210143 - RNA, 22 nt, Human
guggcaguucugugucucuugu

SEQ ID NO: 210144 - RNA, 22 nt, Human
aacuucauuccuuuuuaugacu

SEQ ID NO: 210145 - RNA, 21 nt, Human
uucuccaggcaaccauuucag

SEQ ID NO: 210146 - RNA, 22 nt, Human
gcuguucaaaagccacaguuac

SEQ ID NO: 210147 - RNA, 22 nt, Human
ucuaugaaguucagagaucuau

SEQ ID NO: 210148 - RNA, 22 nt, Human
ucaggaagugcugaggcugcuu

SEQ ID NO: 210149 - RNA, 22 nt, Human
uuagcaauugauucucauaagc

SEQ ID NO: 210150 - RNA, 22 nt, Human
uccaggagauucauuaggucau

SEQ ID NO: 210151 - RNA, 22 nt, Human
gcuggcugguccagcaggggcu

SEQ ID NO: 210152 - RNA, 22 nt, Human
caaagcagaccuuuacccuuua

SEQ ID NO: 210153 - RNA, 22 nt, Human
gaguacuuaacuccaaauagga

SEQ ID NO: 210154 - RNA, 22 nt, Human
uguucuuuagcagaccauguug

SEQ ID NO: 210155 - RNA, 22 nt, Human
ggcugucuugggagcucccccg

SEQ ID NO: 210156 - RNA, 22 nt, Human
ugagcaccuacuguauuccagg

SEQ ID NO: 210157 - RNA, 22 nt, Human
cccaggcaguagaaagaagagg

SEQ ID NO: 210158 - RNA, 22 nt, Human
gcccugagcuagugugggcagg

SEQ ID NO: 210159 - RNA, 22 nt, Human
uggguccauggaacagaggugc

SEQ ID NO: 210160 - RNA, 22 nt, Human
uguaaacauauguauguaugua

SEQ ID NO: 210161 - RNA, 22 nt, Human
ucuuucccuguguuagccugua

SEQ ID NO: 210162 - RNA, 22 nt, Human
uccagccugaacuuuguccaga

SEQ ID NO: 210163 - RNA, 22 nt, Human
gguccucuccagcgccacagug

SEQ ID NO: 210164 - RNA, 22 nt, Human
uuacaaagauuauauucaguua

SEQ ID NO: 210165 - RNA, 22 nt, Human
guaaaacauguuuuaacuagga

SEQ ID NO: 210166 - RNA, 22 nt, Human
auacauguugagaaaauaucug

SEQ ID NO: 210167 - RNA, 22 nt, Human
ucucccucuuugucugcuuugg

SEQ ID NO: 210168 - RNA, 22 nt, Human
uggcaauguuagcaaagcauuu

SEQ ID NO: 210169 - RNA, 22 nt, Human
cagccaggauggagaacuguug

SEQ ID NO: 210170 - RNA, 22 nt, Human
aaaagguuuugaguacaaauau

SEQ ID NO: 210171 - RNA, 22 nt, Human
ugcuccuggcaucucugcgucc

SEQ ID NO: 210172 - RNA, 22 nt, Human
acuucccaacgugggccuccca

SEQ ID NO: 210173 - RNA, 22 nt, Human
cccaguggcccagcauguggug

SEQ ID NO: 210174 - RNA, 22 nt, Human
guuuuccacuggauuguuugga

SEQ ID NO: 210175 - RNA, 22 nt, Human
acccuggggucacccuucucug

SEQ ID NO: 210176 - RNA, 22 nt, Human
gcacagaagagcuuuggaauga

SEQ ID NO: 210177 - RNA, 22 nt, Human
aaggccaggccuagcacggagg

SEQ ID NO: 210178 - RNA, 22 nt, Human
cuggcuccaggucaugcacuca

SEQ ID NO: 210179 - RNA, 22 nt, Human
ucuucaaacugaaaauuuagaa

SEQ ID NO: 210180 - RNA, 22 nt, Human
agucaacauuugagaugcaaug

SEQ ID NO: 210181 - RNA, 22 nt, Human
uaguuuuuacugcgaguuauaa

SEQ ID NO: 210182 - RNA, 22 nt, Human
acuugcauuauauuuaucacaa

SEQ ID NO: 210183 - RNA, 22 nt, Human
cuuguauacaguguacacauug

SEQ ID NO: 210184 - RNA, 23 nt, Human
aaguucuuagguugauacuaaug

SEQ ID NO: 210185 - RNA, 22 nt, Human
ccagagagaaaauggagggcca

SEQ ID NO: 210186 - RNA, 22 nt, Human
guauacacugguaagauuuguc

SEQ ID NO: 210187 - RNA, 23 nt, Human
gccuggccaccccagggcugcuu

SEQ ID NO: 210188 - RNA, 22 nt, Human
aaugucagccugaaagcuauuc

SEQ ID NO: 210189 - RNA, 22 nt, Human
guccuggugcuggucauugucg

SEQ ID NO: 210190 - RNA, 18 nt, Human
ugacucacccugucagug

SEQ ID NO: 210191 - RNA, 22 nt, Human
cuaguugaagaggcugucauca

SEQ ID NO: 210192 - RNA, 22 nt, Human
ugguucaguugcacaggcuguu

SEQ ID NO: 210193 - RNA, 22 nt, Human
cuuuacaaagcaauuuugucuc

SEQ ID NO: 210194 - RNA, 22 nt, Human
gcagguguggguggcugccagg

SEQ ID NO: 210195 - RNA, 22 nt, Human
gccucccuggcccacagcagcg

SEQ ID NO: 210196 - RNA, 22 nt, Human
aauagcuuggacccauugcuuu

SEQ ID NO: 210197 - RNA, 22 nt, Human
agcagagcggggccuccggaag

SEQ ID NO: 210198 - RNA, 22 nt, Human
ugaguaaaagugaaucuuaugu

SEQ ID NO: 210199 - RNA, 22 nt, Human
auuuccauguccaaaaauuagu

SEQ ID NO: 210200 - RNA, 22 nt, Human
uggcagaguucgcugugccuuu

SEQ ID NO: 210201 - RNA, 22 nt, Human
gcugcagguuugucuagucugg

SEQ ID NO: 210202 - RNA, 22 nt, Human
agagugcucagaugcaugucuu

SEQ ID NO: 210203 - RNA, 22 nt, Human
cccaggcuccugcuguguugac

SEQ ID NO: 210204 - RNA, 22 nt, Human
uagaacuuauuagaaaggcuca

SEQ ID NO: 210205 - RNA, 22 nt, Human
cagcaugaugcucacacaaaac

SEQ ID NO: 210206 - RNA, 23 nt, Human
gcugugcacgagccacugccugu

SEQ ID NO: 210207 - RNA, 22 nt, Human
uguguacacagauaguaauggc

SEQ ID NO: 210208 - RNA, 21 nt, Human
aucugaaagguuaguguugag

SEQ ID NO: 210209 - RNA, 22 nt, Human
ugugucagcauccuuugggaca

SEQ ID NO: 210210 - RNA, 22 nt, Human
ggaaaagaaagggacugauugg

SEQ ID NO: 210211 - RNA, 22 nt, Human
uuagccauggacugaauugacu

SEQ ID NO: 210212 - RNA, 22 nt, Human
uaccagcucacacaaucuuugu

SEQ ID NO: 210213 - RNA, 22 nt, Human
gcucagagaauuuacugcugcc

SEQ ID NO: 210214 - RNA, 22 nt, Human
aaagaacuuaagaaauuaggcu

SEQ ID NO: 210215 - RNA, 22 nt, Human
cuagcuguguaaaccgagcugc

SEQ ID NO: 210216 - RNA, 22 nt, Human
uggcucagaaggcugccuucac

SEQ ID NO: 210217 - RNA, 22 nt, Human
ugguccugcaguaauagacauc

SEQ ID NO: 210218 - RNA, 22 nt, Human
acuacacugcccuggggaucaa

SEQ ID NO: 210219 - RNA, 20 nt, Human
gcucuuuguaagggaauuug

SEQ ID NO: 210220 - RNA, 22 nt, Human
cuuugcaaacugucacacuuuc

SEQ ID NO: 210221 - RNA, 22 nt, Human
acauaucuuucccucuccugaa

SEQ ID NO: 210222 - RNA, 22 nt, Human
aaagagucuggcacuguaccag

SEQ ID NO: 210223 - RNA, 21 nt, Human
cucuccagugguuccugauuc

SEQ ID NO: 210224 - RNA, 22 nt, Human
ugcuuugcaggaacccuaagca

SEQ ID NO: 210225 - RNA, 22 nt, Human
uccugggaggcugugccuggcu

SEQ ID NO: 210226 - RNA, 22 nt, Human
uacaauguugguaaaguaucau

SEQ ID NO: 210227 - RNA, 22 nt, Human
ggagagaaauugagguagcaag

SEQ ID NO: 210228 - RNA, 22 nt, Human
acaaaagcuuuuggaggguugu

SEQ ID NO: 210229 - RNA, 22 nt, Human
agagucugauauuuguaccaga

SEQ ID NO: 210230 - RNA, 22 nt, Human
caaauacugaguuuauuuucaa

SEQ ID NO: 210231 - RNA, 22 nt, Human
agggugugcuguugggucuuuc

SEQ ID NO: 210232 - RNA, 22 nt, Human
aucuuugguacuauucuuauca

SEQ ID NO: 210233 - RNA, 22 nt, Human
uaggaaauggcucaguuacugc

SEQ ID NO: 210234 - RNA, 22 nt, Human
uaggaaaugcugucuuauugua

SEQ ID NO: 210235 - RNA, 22 nt, Human
uggccuagagaagccaaaagau

SEQ ID NO: 210236 - RNA, 22 nt, Human
uggguaaacugggucuggagag

SEQ ID NO: 210237 - RNA, 22 nt, Human
aagacuugaccagguugaaggc

SEQ ID NO: 210238 - RNA, 22 nt, Human
acagaacaggcugagaaaaaca

SEQ ID NO: 210239 - RNA, 22 nt, Human
cuucuguguuaaaugagucuuu

SEQ ID NO: 210240 - RNA, 22 nt, Human
agcagcuggaacuaauaguggu

SEQ ID NO: 210241 - RNA, 22 nt, Human
gggccagugaacaaugagggaa

SEQ ID NO: 210242 - RNA, 22 nt, Human
gcuggaggcaguucagacacca

SEQ ID NO: 210243 - RNA, 22 nt, Human
augaaagcaagaagugaguuga

SEQ ID NO: 210244 - RNA, 22 nt, Human
cugugacuguguuggaugcaca

SEQ ID NO: 210245 - RNA, 22 nt, Human
auuuguucacaaucagggcagg

SEQ ID NO: 210246 - RNA, 22 nt, Human
ggacacagauaaucacacagau

SEQ ID NO: 210247 - RNA, 22 nt, Human
auuucacagcugcuguucaggu

SEQ ID NO: 210248 - RNA, 22 nt, Human
acagaauauuuuauuuagauca

SEQ ID NO: 210249 - RNA, 22 nt, Human
caggcaacguccuuagagaugc

SEQ ID NO: 210250 - RNA, 22 nt, Human
uccugcagagccgcccucaggu

SEQ ID NO: 210251 - RNA, 22 nt, Human
gggccagcucugugauguaggg

SEQ ID NO: 210252 - RNA, 22 nt, Human
gaggaggaggaaguggaaccca

SEQ ID NO: 210253 - RNA, 22 nt, Human
ucuauaaagggccagauaguag

SEQ ID NO: 210254 - RNA, 22 nt, Human
ugcuauuuuagacauacuuugu

SEQ ID NO: 210255 - RNA, 22 nt, Human
ucucccaggugggugccuggag

SEQ ID NO: 210256 - RNA, 22 nt, Human
cuggccuuucgugagagcuggg

SEQ ID NO: 210257 - RNA, 22 nt, Human
ucagaaguccaauuuucgcacc

SEQ ID NO: 210258 - RNA, 22 nt, Human
caucucaguguacagggagucu

SEQ ID NO: 210259 - RNA, 22 nt, Human
aguaaaauuaauggaucagaag

SEQ ID NO: 210260 - RNA, 22 nt, Human
guguucuuuugcuucacagaaa

SEQ ID NO: 210261 - RNA, 22 nt, Human
uuggaauugugaacuaagugau

SEQ ID NO: 210262 - RNA, 22 nt, Human
uuagaaacccagacucuuaggu

SEQ ID NO: 210263 - RNA, 22 nt, Human
cacagacccagaagggaugaag

SEQ ID NO: 210264 - RNA, 22 nt, Human
agcuuugaaguauuuggucucc

SEQ ID NO: 210265 - RNA, 22 nt, Human
auacuucucaugggcucugagc

SEQ ID NO: 210266 - RNA, 22 nt, Human
auucaacuuacaaaggagaaga

SEQ ID NO: 210267 - RNA, 22 nt, Human
ccugaggucaugguccaguguu

SEQ ID NO: 210268 - RNA, 22 nt, Human
uaacugugaaguaauuguggau

SEQ ID NO: 210269 - RNA, 22 nt, Human
uagaacuuagcacuagacuugu

SEQ ID NO: 210270 - RNA, 22 nt, Human
aggcaggcucuggguaugugca

SEQ ID NO: 210271 - RNA, 22 nt, Human
aucuacauaaaacgaauacaua

SEQ ID NO: 210272 - RNA, 22 nt, Human
gagguaucuuagagaguguaga

SEQ ID NO: 210273 - RNA, 22 nt, Human
agcggcugcuccgcaggcuggc

SEQ ID NO: 210274 - RNA, 22 nt, Human
caaaggcuucaucucagagcag

SEQ ID NO: 210275 - RNA, 20 nt, Human
uccagaggccacauccagug

SEQ ID NO: 210276 - RNA, 22 nt, Human
uauaaauuaaugugcccaugag

SEQ ID NO: 210277 - RNA, 22 nt, Human
cagggccugagggcugcucugc

SEQ ID NO: 210278 - RNA, 22 nt, Human
gcugggcuucacagagccuuua

SEQ ID NO: 210279 - RNA, 22 nt, Human
aguguagaugaaauuaaaccca

SEQ ID NO: 210280 - RNA, 22 nt, Human
agcccagcggagcgggcccggg

SEQ ID NO: 210281 - RNA, 22 nt, Human
aggagccaggaaaccugcucug

SEQ ID NO: 210282 - RNA, 22 nt, Human
cuugccugccacuacagcugaa

SEQ ID NO: 210283 - RNA, 22 nt, Human
ggucagaagugcaaaaucaguu

SEQ ID NO: 210284 - RNA, 22 nt, Human
acugggcuccaaggaccuggag

SEQ ID NO: 210285 - RNA, 22 nt, Human
accaggaagcaucccuuuguaa

SEQ ID NO: 210286 - RNA, 22 nt, Human
cauuuauugaguggccacagug

SEQ ID NO: 210287 - RNA, 22 nt, Human
augaacuaucaucaguuccacc

SEQ ID NO: 210288 - RNA, 22 nt, Human
augggcaguguauuggaaggaa

SEQ ID NO: 210289 - RNA, 20 nt, Human
uccagguaacaucucucugg

SEQ ID NO: 210290 - RNA, 22 nt, Human
agacacagcagugccugccuca

SEQ ID NO: 210291 - RNA, 22 nt, Human
uaggcuugcuucuccuccacag

SEQ ID NO: 210292 - RNA, 22 nt, Human
ucuggcuggcagugauggugug

SEQ ID NO: 210293 - RNA, 20 nt, Human
cugagcccccagccugcagg

SEQ ID NO: 210294 - RNA, 22 nt, Human
cugggcaguucgcuuucguuuu

SEQ ID NO: 210295 - RNA, 22 nt, Human
uguggcuggucuccgagcgucg

SEQ ID NO: 210296 - RNA, 22 nt, Human
aggcugugaguuuugucucaga

SEQ ID NO: 210297 - RNA, 20 nt, Human
gugcauuucaccuguacugu

SEQ ID NO: 210298 - RNA, 22 nt, Human
acccagggagugcuccuguucu

SEQ ID NO: 210299 - RNA, 22 nt, Human
uuucacauucagauauagacuu

SEQ ID NO: 210300 - RNA, 22 nt, Human
ucucugucccuaggagccuugc

SEQ ID NO: 210301 - RNA, 22 nt, Human
uucacacagaaucugaggagcu

SEQ ID NO: 210302 - RNA, 22 nt, Human
ucucucugccaacucacagcca

SEQ ID NO: 210303 - RNA, 22 nt, Human
augcaucuaugacuuagacauu

SEQ ID NO: 210304 - RNA, 22 nt, Human
agcugugccuugcugcacggug

SEQ ID NO: 210305 - RNA, 22 nt, Human
auccauugucuuguuggcuucu

SEQ ID NO: 210306 - RNA, 22 nt, Human
ugugaaaucaauuagcugcaga

SEQ ID NO: 210307 - RNA, 22 nt, Human
aaggguuggggaagagcaaauu

SEQ ID NO: 210308 - RNA, 22 nt, Human
cagcauuuucuuaauguaggug

SEQ ID NO: 210309 - RNA, 22 nt, Human
cugagccagagggagucggguc

SEQ ID NO: 210310 - RNA, 21 nt, Human
uguaaguuucaucugaauugg

SEQ ID NO: 210311 - RNA, 22 nt, Human
cggcagagugugugcgugcaug

SEQ ID NO: 210312 - RNA, 22 nt, Human
acuuuuaaggggccuugauuua

SEQ ID NO: 210313 - RNA, 22 nt, Human
acaggcagcccucucccugguu

SEQ ID NO: 210314 - RNA, 22 nt, Human
acccuggguauuucccaaacuu

SEQ ID NO: 210315 - RNA, 22 nt, Human
cacaauuccauggcauucuuug

SEQ ID NO: 210316 - RNA, 22 nt, Human
auuaacaugcagccagacacac

SEQ ID NO: 210317 - RNA, 22 nt, Human
augcuuuggccaaugagaagug

SEQ ID NO: 210318 - RNA, 22 nt, Human
gcaggguggauggcagggccag

SEQ ID NO: 210319 - RNA, 22 nt, Human
ucugggagguggcagggugcau

SEQ ID NO: 210320 - RNA, 22 nt, Human
ucuggggagugccuaaguggaa

SEQ ID NO: 210321 - RNA, 22 nt, Human
agcuggagcuucaagcagguaa

SEQ ID NO: 210322 - RNA, 22 nt, Human
gcucagagguuguucuuggguu

SEQ ID NO: 210323 - RNA, 22 nt, Human
ugaggggccgcccaagcacuuc

SEQ ID NO: 210324 - RNA, 22 nt, Human
gaggccugucgcuaggccucug

SEQ ID NO: 210325 - RNA, 22 nt, Human
gcugucuugcucacucuugcag

SEQ ID NO: 210326 - RNA, 18 nt, Human
cucaccauucugcccaau

SEQ ID NO: 210327 - RNA, 22 nt, Human
ccacugccagccgcccggaggc

SEQ ID NO: 210328 - RNA, 22 nt, Human
guuuccaaccccaccaaagugc

SEQ ID NO: 210329 - RNA, 22 nt, Human
aggagaggaaucauuauuacaa

SEQ ID NO: 210330 - RNA, 22 nt, Human
uaucuguugucuuuuacaugua

SEQ ID NO: 210331 - RNA, 19 nt, Human
ggcagcucuugucuucugc

SEQ ID NO: 210332 - RNA, 22 nt, Human
aaagggagcauggcugcaggga

SEQ ID NO: 210333 - RNA, 22 nt, Human
ccagcugggauuaagggaaaau

SEQ ID NO: 210334 - RNA, 22 nt, Human
gggagcucucccugaggccugg

SEQ ID NO: 210335 - RNA, 22 nt, Human
cuggauucaugccaggccaccc

SEQ ID NO: 210336 - RNA, 22 nt, Human
ccucacccacuacacucaaggg

SEQ ID NO: 210337 - RNA, 22 nt, Human
caacaguauugugggccaggua

SEQ ID NO: 210338 - RNA, 22 nt, Human
uaucacugaccuguaucaguug

SEQ ID NO: 210339 - RNA, 22 nt, Human
aaugauaugcaaauuaucauca

SEQ ID NO: 210340 - RNA, 22 nt, Human
gugaaauuguauuuggcauuga

SEQ ID NO: 210341 - RNA, 21 nt, Human
agaugcagugacccacugggg

SEQ ID NO: 210342 - RNA, 22 nt, Human
agcuggagaauaggaauuagug

SEQ ID NO: 210343 - RNA, 22 nt, Human
uuugcaaauaaauaagugcucg

SEQ ID NO: 210344 - RNA, 22 nt, Human
guagcacaugauuuugauaugu

SEQ ID NO: 210345 - RNA, 22 nt, Human
uaguuuugaggauuauauguga

SEQ ID NO: 210346 - RNA, 20 nt, Human
ucccuggggcccuacuuccu

SEQ ID NO: 210347 - RNA, 22 nt, Human
ucuacaagucaagucuaucaag

SEQ ID NO: 210348 - RNA, 22 nt, Human
aagggauguaaacaugaauaag

SEQ ID NO: 210349 - RNA, 22 nt, Human
cugagcagcaacccagagccuc

SEQ ID NO: 210350 - RNA, 22 nt, Human
aagaaaugugaauauugaauag

SEQ ID NO: 210351 - RNA, 18 nt, Human
ucuucaucuccugagcug

SEQ ID NO: 210352 - RNA, 22 nt, Human
aaucagacaguucuggauucaa

SEQ ID NO: 210353 - RNA, 22 nt, Human
cagcccuggcuagggcgagggc

SEQ ID NO: 210354 - RNA, 23 nt, Human
gaagucagcccuacagagagcag

SEQ ID NO: 210355 - RNA, 22 nt, Human
uagucuaagaaaucuuuacuuu

SEQ ID NO: 210356 - RNA, 22 nt, Human
aaacagugacugguacauaaua

SEQ ID NO: 210357 - RNA, 22 nt, Human
aguucccaaauuacaggccaca

SEQ ID NO: 210358 - RNA, 22 nt, Human
cgggaggaaaggcgaggcucug

SEQ ID NO: 210359 - RNA, 19 nt, Human
aggcuaguguuacaccugc

SEQ ID NO: 210360 - RNA, 22 nt, Human
aaauagaaaccaacaaggucag

SEQ ID NO: 210361 - RNA, 22 nt, Human
gcagccagcccuagucccacuu

SEQ ID NO: 210362 - RNA, 20 nt, Human
uucaggaauaagauagcagc

SEQ ID NO: 210363 - RNA, 22 nt, Human
acugggccgcgcugcagagggc

SEQ ID NO: 210364 - RNA, 22 nt, Human
aaccaccaccaucuaguuccaa

SEQ ID NO: 210365 - RNA, 22 nt, Human
ucagcagggcauacugagccua

SEQ ID NO: 210366 - RNA, 19 nt, Human
aggcugccucacccucccu

SEQ ID NO: 210367 - RNA, 22 nt, Human
ucagaguccaugguacuuaauu

SEQ ID NO: 210368 - RNA, 22 nt, Human
cucucugggaauauuuuauucu

SEQ ID NO: 210369 - RNA, 22 nt, Human
ugauagagcacuaaguagugua

SEQ ID NO: 210370 - RNA, 22 nt, Human
ugguccugagaauccuguccuc

SEQ ID NO: 210371 - RNA, 22 nt, Human
uagaguguuuuguuaggcagca

SEQ ID NO: 210372 - RNA, 22 nt, Human
cuuagagcuuaggcuagccauu

SEQ ID NO: 210373 - RNA, 23 nt, Human
cccagcagagaugaggagggguc

SEQ ID NO: 210374 - RNA, 22 nt, Human
aggagcugucagagugccagag

SEQ ID NO: 210375 - RNA, 22 nt, Human
ucucugaacuuccuggaaaggc

SEQ ID NO: 210376 - RNA, 23 nt, Human
uggaaacuuaagggggagauguc

SEQ ID NO: 210377 - RNA, 22 nt, Human
cucuccaggacuuuggcccaau

SEQ ID NO: 210378 - RNA, 21 nt, Human
agaagccaugugguggagaac

SEQ ID NO: 210379 - RNA, 22 nt, Human
ggcugccuagacuuggaauuuc

SEQ ID NO: 210380 - RNA, 22 nt, Human
aucuuucaaucaggaaaaaucu

SEQ ID NO: 210381 - RNA, 22 nt, Human
aauagacaagcacccugguaaa

SEQ ID NO: 210382 - RNA, 22 nt, Human
aggccagaaaugucagggagug

SEQ ID NO: 210383 - RNA, 21 nt, Human
agcuggcagugccuggaccuc

SEQ ID NO: 210384 - RNA, 22 nt, Human
agcugccuguccuaggccauca

SEQ ID NO: 210385 - RNA, 22 nt, Human
acaggugucugcaaguuacugg

SEQ ID NO: 210386 - RNA, 22 nt, Human
ugguccugagcaccagccugac

SEQ ID NO: 210387 - RNA, 22 nt, Human
uuuguguuuaugaaguuauucu

SEQ ID NO: 210388 - RNA, 22 nt, Human
cucuauuuauggcaucuuuaug

SEQ ID NO: 210389 - RNA, 22 nt, Human
gcaguguuuguguucucacaug

SEQ ID NO: 210390 - RNA, 22 nt, Human
ugccacuggggcuaggacuguu

SEQ ID NO: 210391 - RNA, 22 nt, Human
ugauuuaugcauuauacuguug

SEQ ID NO: 210392 - RNA, 22 nt, Human
uccuggcaguaauuugauguug

SEQ ID NO: 210393 - RNA, 22 nt, Human
aggcaggaacccugugugcgcc

SEQ ID NO: 210394 - RNA, 22 nt, Human
gcagagcugagcggcugcccgg

SEQ ID NO: 210395 - RNA, 22 nt, Human
ucuuugaauccuuuacaucuga

SEQ ID NO: 210396 - RNA, 22 nt, Human
ucagggcauccauugccuguug

SEQ ID NO: 210397 - RNA, 21 nt, Human
ccucuggcuugugcugugccc

SEQ ID NO: 210398 - RNA, 22 nt, Human
ccuuuguucauugccuucaguc

SEQ ID NO: 210399 - RNA, 22 nt, Human
acuuggcuucaagguuaagguc

SEQ ID NO: 210400 - RNA, 22 nt, Human
uaagucguggaugauucuucgg

SEQ ID NO: 210401 - RNA, 22 nt, Human
ggcagcucacugauuagcaauu

SEQ ID NO: 210402 - RNA, 22 nt, Human
gaaguuuagaguguuguaauuu

SEQ ID NO: 210403 - RNA, 22 nt, Human
gcuggcagguccaagauagagc

SEQ ID NO: 210404 - RNA, 22 nt, Human
cugagggccugaggaccuagau

SEQ ID NO: 210405 - RNA, 18 nt, Human
ggcugcucgcucuccccg

SEQ ID NO: 210406 - RNA, 22 nt, Human
auauuucagguuuugcaggccg

SEQ ID NO: 210407 - RNA, 22 nt, Human
uuucacauacaguguauaguag

SEQ ID NO: 210408 - RNA, 22 nt, Human
uacugugggauguugugauuag

SEQ ID NO: 210409 - RNA, 22 nt, Human
acaucucuucuuaaggcuccag

SEQ ID NO: 210410 - RNA, 22 nt, Human
ugucccuggacuccaggagcca

SEQ ID NO: 210411 - RNA, 22 nt, Human
agcagagcugcaguggccugcu

SEQ ID NO: 210412 - RNA, 22 nt, Human
cacaaggagguccugaggaagc

SEQ ID NO: 210413 - RNA, 22 nt, Human
gcucagagcacucagacucagc

SEQ ID NO: 210414 - RNA, 22 nt, Human
cuugaaaauaagaaagacuuuc

SEQ ID NO: 210415 - RNA, 22 nt, Human
caucugcucugucugccauguu

SEQ ID NO: 210416 - RNA, 22 nt, Human
ugagacagggucuugcucuguu

SEQ ID NO: 210417 - RNA, 22 nt, Human
gucuggccugccagcucuggug

SEQ ID NO: 210418 - RNA, 22 nt, Human
cucccuccaaauaagacucggg

SEQ ID NO: 210419 - RNA, 22 nt, Human
ugaaacaggaugcagaggagga

SEQ ID NO: 210420 - RNA, 22 nt, Human
auugaaucugcacuaguauuuu

SEQ ID NO: 210421 - RNA, 22 nt, Human
uagaacaugcucauguauaaau

SEQ ID NO: 210422 - RNA, 22 nt, Human
ggcugccugaggcugaggcccg

SEQ ID NO: 210423 - RNA, 20 nt, Human
agcaguccaaaagggcagac

SEQ ID NO: 210424 - RNA, 22 nt, Human
aacuugguaccaccuucugaag

SEQ ID NO: 210425 - RNA, 22 nt, Human
gccacuggcgcugugcagagug

SEQ ID NO: 210426 - RNA, 22 nt, Human
ucaaacaggacuacauucucau

SEQ ID NO: 210427 - RNA, 22 nt, Human
ucagugcagacuguaaguugga

SEQ ID NO: 210428 - RNA, 18 nt, Human
cccucuccugcuaguggg

SEQ ID NO: 210429 - RNA, 20 nt, Human
aggaggcaauguagauaagc

SEQ ID NO: 210430 - RNA, 22 nt, Human
ucuaaacaguuucacucuuaau

SEQ ID NO: 210431 - RNA, 22 nt, Human
aggcugaggagggauguugcuu

SEQ ID NO: 210432 - RNA, 22 nt, Human
cugggugucaggagacaugaug

SEQ ID NO: 210433 - RNA, 22 nt, Human
ucugaaagggcuaaauaauuug

SEQ ID NO: 210434 - RNA, 22 nt, Human
accucaagugauccacucaccu

SEQ ID NO: 210435 - RNA, 22 nt, Human
agccuggaguucccaggagaag

SEQ ID NO: 210436 - RNA, 22 nt, Human
acugggcuggggcucauucucc

SEQ ID NO: 210437 - RNA, 17 nt, Human
uuucuccuuccaucuca

SEQ ID NO: 210438 - RNA, 22 nt, Human
agcaguaagugaagacuaguuu

SEQ ID NO: 210439 - RNA, 21 nt, Human
ugaaugaucugguugccuuuu

SEQ ID NO: 210440 - RNA, 22 nt, Human
ugaggauggucccgaggacacu

SEQ ID NO: 210441 - RNA, 22 nt, Human
ugaaguuucacgcgucauucaa

SEQ ID NO: 210442 - RNA, 22 nt, Human
auucucuguacagaagguaccg

SEQ ID NO: 210443 - RNA, 22 nt, Human
auggaacagacagcugagacaa

SEQ ID NO: 210444 - RNA, 21 nt, Human
ggagaaggacaauguugagua

SEQ ID NO: 210445 - RNA, 22 nt, Human
ugcaacaaggccucauuucuug

SEQ ID NO: 210446 - RNA, 22 nt, Human
uuauguuugaguauaugacuca

SEQ ID NO: 210447 - RNA, 22 nt, Human
ucagccaguuuguuuauuccgg

SEQ ID NO: 210448 - RNA, 22 nt, Human
uucccagugauuaaggcagugg

SEQ ID NO: 210449 - RNA, 22 nt, Human
aauguggauccuuacagauacc

SEQ ID NO: 210450 - RNA, 22 nt, Human
acagcagaguggagaugagcac

SEQ ID NO: 210451 - RNA, 21 nt, Human
ucagcagcaucugccuagagu

SEQ ID NO: 210452 - RNA, 22 nt, Human
acccagagcugggcuuggcaaa

SEQ ID NO: 210453 - RNA, 22 nt, Human
uacaguaaccagucuacuuaga

SEQ ID NO: 210454 - RNA, 22 nt, Human
caggugguuguuuggauucuaa

SEQ ID NO: 210455 - RNA, 22 nt, Human
ucaaccagaguuuuucuuaaua

SEQ ID NO: 210456 - RNA, 23 nt, Human
aggcugccagaaauuggguaagg

SEQ ID NO: 210457 - RNA, 22 nt, Human
caggccaggcugcauuugcccc

SEQ ID NO: 210458 - RNA, 22 nt, Human
uacagauaacugaaugcagacu

SEQ ID NO: 210459 - RNA, 22 nt, Human
cccaggcucagacuggcuuguu

SEQ ID NO: 210460 - RNA, 22 nt, Human
uucuuagaagaaacaucuaaaa

SEQ ID NO: 210461 - RNA, 22 nt, Human
aaugagucaugaagauuagcaa

SEQ ID NO: 210462 - RNA, 22 nt, Human
cagaagcagaacacuagauuua

SEQ ID NO: 210463 - RNA, 22 nt, Human
uugauuuuaaaauagugacacu

SEQ ID NO: 210464 - RNA, 22 nt, Human
acaggcuguacuucuaaucauc

SEQ ID NO: 210465 - RNA, 22 nt, Human
uaacugugugaacgugaucauu

SEQ ID NO: 210466 - RNA, 22 nt, Human
uucuggcuacccuccuaauguu

SEQ ID NO: 210467 - RNA, 22 nt, Human
cuaauagagcuucggaacucug

SEQ ID NO: 210468 - RNA, 22 nt, Human
acugccuuauaauaugucaaca

SEQ ID NO: 210469 - RNA, 22 nt, Human
ccaugagcuuccuauauagggu

SEQ ID NO: 210470 - RNA, 22 nt, Human
cccaggaggaggaaaaagcucg

SEQ ID NO: 210471 - RNA, 22 nt, Human
uuccauaugaaaaagcuguugc

SEQ ID NO: 210472 - RNA, 22 nt, Human
gcucugggaacugacugccuuc

SEQ ID NO: 210473 - RNA, 22 nt, Human
ccugggcucacagccaaggcuc

SEQ ID NO: 210474 - RNA, 22 nt, Human
gauauauuuggaccagagcauu

SEQ ID NO: 210475 - RNA, 22 nt, Human
ugagaagcugcugacuuagccu

SEQ ID NO: 210476 - RNA, 22 nt, Human
ccuggcugagccuccaggaaga

SEQ ID NO: 210477 - RNA, 22 nt, Human
uccaggccuggcuccauucagu

SEQ ID NO: 210478 - RNA, 22 nt, Human
aaugugucccuuauuucacagg

SEQ ID NO: 210479 - RNA, 19 nt, Human
acuaaaaaugauguuugag

SEQ ID NO: 210480 - RNA, 22 nt, Human
cagugucuccagaugcuccaau

SEQ ID NO: 210481 - RNA, 22 nt, Human
gcaacacaauaucccaguacau

SEQ ID NO: 210482 - RNA, 22 nt, Human
uugucuguccaggcaccccaag

SEQ ID NO: 210483 - RNA, 19 nt, Human
uuuucucagcuucuagcgg

SEQ ID NO: 210484 - RNA, 22 nt, Human
uuuuccuacugauaaacaguua

SEQ ID NO: 210485 - RNA, 22 nt, Human
agcuucuuaaguuccugcagca

SEQ ID NO: 210486 - RNA, 22 nt, Human
agaggccggccgagcccauggg

SEQ ID NO: 210487 - RNA, 22 nt, Human
ggaggaagugcaguucuacuac

SEQ ID NO: 210488 - RNA, 22 nt, Human
gggagcugccaccaccccuggg

SEQ ID NO: 210489 - RNA, 22 nt, Human
gcagcugcuguggcaucaagcu

SEQ ID NO: 210490 - RNA, 22 nt, Human
cugagaggaugcugcaguggag

SEQ ID NO: 210491 - RNA, 22 nt, Human
agaaggcugaagaagauccguu

SEQ ID NO: 210492 - RNA, 22 nt, Human
agguuccaucaccugcagugga

SEQ ID NO: 210493 - RNA, 22 nt, Human
uagcugaugaauaauuauucuu

SEQ ID NO: 210494 - RNA, 22 nt, Human
agaaggcuggccauggugcccu

SEQ ID NO: 210495 - RNA, 22 nt, Human
uagcauuucacugaucuucacu

SEQ ID NO: 210496 - RNA, 23 nt, Human
gagugcagaauagacaugcagug

SEQ ID NO: 210497 - RNA, 22 nt, Human
gagcuggccucaggcacaggag

SEQ ID NO: 210498 - RNA, 22 nt, Human
ccucagccuuggccccaggcag

SEQ ID NO: 210499 - RNA, 22 nt, Human
uuauuucauauaauguuaucaa

SEQ ID NO: 210500 - RNA, 22 nt, Human
gugccaggcccagggagcgggg

SEQ ID NO: 210501 - RNA, 22 nt, Human
ucucugaagauauuuauuauua

SEQ ID NO: 210502 - RNA, 22 nt, Human
gcucucugaggugcuggcagag

SEQ ID NO: 210503 - RNA, 22 nt, Human
acaugacaccucuggcugggug

SEQ ID NO: 210504 - RNA, 22 nt, Human
gccuggagccucagcaaggagg

SEQ ID NO: 210505 - RNA, 22 nt, Human
uagaacuugaaugugaaaucag

SEQ ID NO: 210506 - RNA, 22 nt, Human
ucacauuuguguuuuauuagag

SEQ ID NO: 210507 - RNA, 23 nt, Human
uccugugaagccauguuuguugu

SEQ ID NO: 210508 - RNA, 22 nt, Human
uucauauaaauggaaucagaau

SEQ ID NO: 210509 - RNA, 21 nt, Human
cuuggaacggguagaacucac

SEQ ID NO: 210510 - RNA, 22 nt, Human
cagggaugagaaagcucucuaa

SEQ ID NO: 210511 - RNA, 21 nt, Human
ugguggaccagugcugggaga

SEQ ID NO: 210512 - RNA, 22 nt, Human
agugggggcuggcucugucugu

SEQ ID NO: 210513 - RNA, 22 nt, Human
uaauuucuucaucucugcagcu

SEQ ID NO: 210514 - RNA, 20 nt, Human
uauuuguauuugggaaaguu

SEQ ID NO: 210515 - RNA, 22 nt, Human
agugaggggcagcugagugggc

SEQ ID NO: 210516 - RNA, 19 nt, Human
aggcuaaagagucuugcgu

SEQ ID NO: 210517 - RNA, 22 nt, Human
auguauacgugcaggucacagg

SEQ ID NO: 210518 - RNA, 22 nt, Human
cugccuggugcggugcccaccc

SEQ ID NO: 210519 - RNA, 22 nt, Human
cccagcaugcacgcugacacuc

SEQ ID NO: 210520 - RNA, 22 nt, Human
ccugcccacugcccggucagcc

SEQ ID NO: 210521 - RNA, 21 nt, Human
uucucuggauaggccaguccu

SEQ ID NO: 210522 - RNA, 17 nt, Human
uagauuaaacacggcca

SEQ ID NO: 210523 - RNA, 22 nt, Human
gccugcagggccugggccuacc

SEQ ID NO: 210524 - RNA, 22 nt, Human
agcagaugggagauggagcugc

SEQ ID NO: 210525 - RNA, 22 nt, Human
gaaugcaugugaagcaaagaau

SEQ ID NO: 210526 - RNA, 22 nt, Human
gccuuacugagggcaauuuuga

SEQ ID NO: 210527 - RNA, 22 nt, Human
cugagccagcuggcaugugcua

SEQ ID NO: 210528 - RNA, 22 nt, Human
uccaggaggguuuucugccuuc

SEQ ID NO: 210529 - RNA, 22 nt, Human
uuccuccacgugacaggagcca

SEQ ID NO: 210530 - RNA, 22 nt, Human
uaaggccagcaugaaugcagca

SEQ ID NO: 210531 - RNA, 22 nt, Human
cucagcuaguaacguacauguc

SEQ ID NO: 210532 - RNA, 22 nt, Human
agugcuggauuacaggcgugag

SEQ ID NO: 210533 - RNA, 22 nt, Human
gagaagcaaucgugacaucucc

SEQ ID NO: 210534 - RNA, 22 nt, Human
uaaacauggauucugaucacag

SEQ ID NO: 210535 - RNA, 22 nt, Human
auacagugaauacuuacagugu

SEQ ID NO: 210536 - RNA, 22 nt, Human
aaggccagccugagagcuaaca

SEQ ID NO: 210537 - RNA, 21 nt, Human
aggugcuggcgccccaggaga

SEQ ID NO: 210538 - RNA, 22 nt, Human
uuccuccagaagcuguagggga

SEQ ID NO: 210539 - RNA, 22 nt, Human
cagauucugggcccagcuuguc

SEQ ID NO: 210540 - RNA, 21 nt, Human
aggcagaaagagcccaggcug

SEQ ID NO: 210541 - RNA, 22 nt, Human
uacagugagacuggcucaggga

SEQ ID NO: 210542 - RNA, 22 nt, Human
acccaggacucucuuccaguag

SEQ ID NO: 210543 - RNA, 22 nt, Human
gguggcagaggugcaucagccc

SEQ ID NO: 210544 - RNA, 22 nt, Human
uucaucuguagcaucuuccaau

SEQ ID NO: 210545 - RNA, 22 nt, Human
ucaggcugaccagguuuugcuc

SEQ ID NO: 210546 - RNA, 22 nt, Human
cccuucaggguuaaguagaggg

SEQ ID NO: 210547 - RNA, 22 nt, Human
ucugagagauacaaggaggcaa

SEQ ID NO: 210548 - RNA, 22 nt, Human
ucuugcaggcggcucagcaacc

SEQ ID NO: 210549 - RNA, 22 nt, Human
aggacaguguggaagagggugc

SEQ ID NO: 210550 - RNA, 22 nt, Human
gcauucuuuagacugagagaua

SEQ ID NO: 210551 - RNA, 22 nt, Human
agggagcugggccacacugauc

SEQ ID NO: 210552 - RNA, 22 nt, Human
gaggcagcugaagcuucaaaga

SEQ ID NO: 210553 - RNA, 19 nt, Human
uaacugguuaaaaagcuug

SEQ ID NO: 210554 - RNA, 22 nt, Human
ucuggcuucuccuagagcaaug

SEQ ID NO: 210555 - RNA, 22 nt, Human
uuuuauugguaaugauaaaagu

SEQ ID NO: 210556 - RNA, 22 nt, Human
uagacugugagcuccuugaggg

SEQ ID NO: 210557 - RNA, 22 nt, Human
gucuccugagccuugacugcaa

SEQ ID NO: 210558 - RNA, 22 nt, Human
caugccaagcauguucagaagu

SEQ ID NO: 210559 - RNA, 22 nt, Human
agcaggggcuccuccacagcca

SEQ ID NO: 210560 - RNA, 22 nt, Human
cagcagccacuagagggcucac

SEQ ID NO: 210561 - RNA, 22 nt, Human
uucuccaggccgcgcagggggc

SEQ ID NO: 210562 - RNA, 20 nt, Human
gcagagcuguucugugggga

SEQ ID NO: 210563 - RNA, 22 nt, Human
ucuccuccuuuuuucaacauag

SEQ ID NO: 210564 - RNA, 18 nt, Human
uucauguuggcuuaggga

SEQ ID NO: 210565 - RNA, 22 nt, Human
cauggccccaaaucccaugcau

SEQ ID NO: 210566 - RNA, 22 nt, Human
uggcagcaguggagguagaaag

SEQ ID NO: 210567 - RNA, 22 nt, Human
uuggaggacuaguuaagagacc

SEQ ID NO: 210568 - RNA, 22 nt, Human
caaagcaaggcucaguuugaac

SEQ ID NO: 210569 - RNA, 22 nt, Human
ccacaggauccaagggaaggca

SEQ ID NO: 210570 - RNA, 22 nt, Human
cugccaggccucaucccagcca

SEQ ID NO: 210571 - RNA, 22 nt, Human
gggcuuggcacaugggcucagc

SEQ ID NO: 210572 - RNA, 22 nt, Human
caggggccaggcugucugcugu

SEQ ID NO: 210573 - RNA, 22 nt, Human
ggccuccaggccuacucagggc

SEQ ID NO: 210574 - RNA, 22 nt, Human
cuuaaauuuucaucuacaagaa

SEQ ID NO: 210575 - RNA, 22 nt, Human
caaaauucugcauuucuaauaa

SEQ ID NO: 210576 - RNA, 22 nt, Human
uuuucuucggugcuggguugau

SEQ ID NO: 210577 - RNA, 22 nt, Human
ugcagucuguacauuuuaagaa

SEQ ID NO: 210578 - RNA, 22 nt, Human
uggaaucuuuaggaagcacaua

SEQ ID NO: 210579 - RNA, 22 nt, Human
ccacaggcggaguggcgggcag

SEQ ID NO: 210580 - RNA, 22 nt, Human
caggcuggaguuaccuuuaggg

SEQ ID NO: 210581 - RNA, 22 nt, Human
auguguccuuguucccauucca

SEQ ID NO: 210582 - RNA, 22 nt, Human
ggaaggcagaggugucgugggg

SEQ ID NO: 210583 - RNA, 22 nt, Human
gacccaggcucgugggacggcu

SEQ ID NO: 210584 - RNA, 22 nt, Human
uguuccucugaacuucuuccaa

SEQ ID NO: 210585 - RNA, 22 nt, Human
aguguuuauugugugccacaca

SEQ ID NO: 210586 - RNA, 21 nt, Human
aucugaaguuugagaggaaag

SEQ ID NO: 210587 - RNA, 22 nt, Human
uuuguacacugucuacuaugaa

SEQ ID NO: 210588 - RNA, 22 nt, Human
guucucaguggggagcaggguu

SEQ ID NO: 210589 - RNA, 22 nt, Human
uggguccuaaaugcagucacau

SEQ ID NO: 210590 - RNA, 22 nt, Human
aagagggaggugcgggugcaga

SEQ ID NO: 210591 - RNA, 22 nt, Human
cagggcugagucauauagccuu

SEQ ID NO: 210592 - RNA, 22 nt, Human
uuacaaugagacguucuuaucu

SEQ ID NO: 210593 - RNA, 22 nt, Human
ucuggcagaagugcugucagua

SEQ ID NO: 210594 - RNA, 22 nt, Human
ucccaagugucuuggaccaggg

SEQ ID NO: 210595 - RNA, 22 nt, Human
cuggaagacguuugaagccaug

SEQ ID NO: 210596 - RNA, 22 nt, Human
acccaggguuugagcucugcag

SEQ ID NO: 210597 - RNA, 22 nt, Human
ucagggcccagucugugcaucu

SEQ ID NO: 210598 - RNA, 22 nt, Human
cacugcccaccaaguggcuggu

SEQ ID NO: 210599 - RNA, 22 nt, Human
ccaggagagcaggcgugcagcu

SEQ ID NO: 210600 - RNA, 22 nt, Human
aacagauaaguauaucuaugua

SEQ ID NO: 210601 - RNA, 22 nt, Human
uaguauaauuguucuggaauca

SEQ ID NO: 210602 - RNA, 22 nt, Human
gucaggauuauaauccccaugg

SEQ ID NO: 210603 - RNA, 22 nt, Human
cguccucagaggccauccgaaa

SEQ ID NO: 210604 - RNA, 22 nt, Human
auuuuacauaaggaagguuuaa

SEQ ID NO: 210605 - RNA, 22 nt, Human
uaacauaacuuuuccuugaccc

SEQ ID NO: 210606 - RNA, 22 nt, Human
caggcccugcacagugguccug

SEQ ID NO: 210607 - RNA, 22 nt, Human
gcaguggcuaagcucgcaugca

SEQ ID NO: 210608 - RNA, 22 nt, Human
uggagguacauaaugagagggu

SEQ ID NO: 210609 - RNA, 22 nt, Human
aacuacagcaucuauacaaaua

SEQ ID NO: 210610 - RNA, 22 nt, Human
uuacugaaauaaugaaacacau

SEQ ID NO: 210611 - RNA, 22 nt, Human
gaccucaguauuguucaggaug

SEQ ID NO: 210612 - RNA, 22 nt, Human
uguagcuauagaggcuguaccu

SEQ ID NO: 210613 - RNA, 22 nt, Human
gcccucagcuugauguuguucu

SEQ ID NO: 210614 - RNA, 22 nt, Human
ugagucuuuuauccugggaaug

SEQ ID NO: 210615 - RNA, 22 nt, Human
auuauauaggacuugcccuucc

SEQ ID NO: 210616 - RNA, 22 nt, Human
uaucuacauucuuguaucuucu

SEQ ID NO: 210617 - RNA, 22 nt, Human
uaaaaccaggucuugggauuua

SEQ ID NO: 210618 - RNA, 22 nt, Human
aguggcuugcucugccucagcc

SEQ ID NO: 210619 - RNA, 22 nt, Human
uguccugggaaaucccuuaggc

SEQ ID NO: 210620 - RNA, 20 nt, Human
cagcuuuagaucuuugauua

SEQ ID NO: 210621 - RNA, 20 nt, Human
cagugaggaggugcuggggg

SEQ ID NO: 210622 - RNA, 22 nt, Human
ugacuuuagaauuuuauccaga

SEQ ID NO: 210623 - RNA, 22 nt, Human
ugguaugaccguggugcaagca

SEQ ID NO: 210624 - RNA, 22 nt, Human
ucucugcaacuacaucuuaggg

SEQ ID NO: 210625 - RNA, 22 nt, Human
ugaaagaagugucacauugcca

SEQ ID NO: 210626 - RNA, 18 nt, Human
uacaggaaaaguguuaca

SEQ ID NO: 210627 - RNA, 22 nt, Human
acacaugauaagaaaguuuaaa

SEQ ID NO: 210628 - RNA, 22 nt, Human
uuaguuagucccugguaccuuu

SEQ ID NO: 210629 - RNA, 22 nt, Human
ugagggaauauugauagauccg

SEQ ID NO: 210630 - RNA, 22 nt, Human
guuugucccacuucuggcagaa

SEQ ID NO: 210631 - RNA, 22 nt, Human
cuuccauaaucuuguuuauuua

SEQ ID NO: 210632 - RNA, 20 nt, Human
cugggucacuuggcugcucu

SEQ ID NO: 210633 - RNA, 22 nt, Human
aucuguaaagauaaucauaugu

SEQ ID NO: 210634 - RNA, 22 nt, Human
caaugcuucucauuagccaaug

SEQ ID NO: 210635 - RNA, 22 nt, Human
agggagcagggcuccuuugggu

SEQ ID NO: 210636 - RNA, 22 nt, Human
aagaggccacagcugacagcac

SEQ ID NO: 210637 - RNA, 22 nt, Human
gagaccaggaaguacagcagcc

SEQ ID NO: 210638 - RNA, 22 nt, Human
cauucauucuguaaguaacuau

SEQ ID NO: 210639 - RNA, 22 nt, Human
auuguacagaugaaccucacuc

SEQ ID NO: 210640 - RNA, 22 nt, Human
aaaguaguauaaaauucaugug

SEQ ID NO: 210641 - RNA, 22 nt, Human
accuguuuguguccauuaguga

SEQ ID NO: 210642 - RNA, 22 nt, Human
uugcuguaguguucugauguca

SEQ ID NO: 210643 - RNA, 22 nt, Human
gcccucagcauccucagggcca

SEQ ID NO: 210644 - RNA, 22 nt, Human
auggaaaucgaugucuaaguua

SEQ ID NO: 210645 - RNA, 22 nt, Human
ugaacauugucacauuccuagc

SEQ ID NO: 210646 - RNA, 22 nt, Human
uguuucuuuguagauauucuuu

SEQ ID NO: 210647 - RNA, 22 nt, Human
ugaagccacagagcaucugccu

SEQ ID NO: 210648 - RNA, 22 nt, Human
uaggggaagucucagaaugcag

SEQ ID NO: 210649 - RNA, 22 nt, Human
ugagcccagagaucugagcuau

SEQ ID NO: 210650 - RNA, 22 nt, Human
gugaaaaaugauuuguuaacug

SEQ ID NO: 210651 - RNA, 22 nt, Human
aauguguuacuguguaagagca

SEQ ID NO: 210652 - RNA, 22 nt, Human
aaucuuuugauucuagggcugu

SEQ ID NO: 210653 - RNA, 22 nt, Human
cacuggcccauaaaggccuggg

SEQ ID NO: 210654 - RNA, 22 nt, Human
aucaggaagccagucuaaugga

SEQ ID NO: 210655 - RNA, 22 nt, Human
cacagccuugagcgaggacaag

SEQ ID NO: 210656 - RNA, 22 nt, Human
ggguuccagucugaaacuacag

SEQ ID NO: 210657 - RNA, 22 nt, Human
ucgaggcagugcgcuggcuguu

SEQ ID NO: 210658 - RNA, 22 nt, Human
ccuggcucccugcacagggcuc

SEQ ID NO: 210659 - RNA, 22 nt, Human
augcucauuuuauugagaauga

SEQ ID NO: 210660 - RNA, 22 nt, Human
uaacugguauaucaguguacac

SEQ ID NO: 210661 - RNA, 21 nt, Human
gacacaaaggguaguaauggu

SEQ ID NO: 210662 - RNA, 17 nt, Human
gcuggcuucuccuugcu

SEQ ID NO: 210663 - RNA, 23 nt, Human
cuagggcaguauuucacagacac

SEQ ID NO: 210664 - RNA, 22 nt, Human
uuccagaacucaagaaaugccc

SEQ ID NO: 210665 - RNA, 17 nt, Human
ucugagaaugcuggagg

SEQ ID NO: 210666 - RNA, 22 nt, Human
gggcagguggcaaagccagagg

SEQ ID NO: 210667 - RNA, 22 nt, Human
agagcugggugguggugacuca

SEQ ID NO: 210668 - RNA, 22 nt, Human
ugccuggguugacucuuagcug

SEQ ID NO: 210669 - RNA, 22 nt, Human
uauauuugugugugauuuauga

SEQ ID NO: 210670 - RNA, 20 nt, Human
ggaaggcuguuuuuccacca

SEQ ID NO: 210671 - RNA, 22 nt, Human
uacaguaacauguuguacaagc

SEQ ID NO: 210672 - RNA, 20 nt, Human
gcuuggaccuucugcucugu

SEQ ID NO: 210673 - RNA, 22 nt, Human
ucaccaaguccauaugcaucau

SEQ ID NO: 210674 - RNA, 22 nt, Human
cagcaucuccugugcagaggga

SEQ ID NO: 210675 - RNA, 22 nt, Human
ugaaauagacacagugcuauac

SEQ ID NO: 210676 - RNA, 22 nt, Human
ucaggcagaccaccgugggcag

SEQ ID NO: 210677 - RNA, 22 nt, Human
cugcagcaucgccaccugccuc

SEQ ID NO: 210678 - RNA, 22 nt, Human
agaagcaggcagauuucagcuc

SEQ ID NO: 210679 - RNA, 22 nt, Human
uggacaggauagugcaguacgc

SEQ ID NO: 210680 - RNA, 22 nt, Human
agcuggcauuacaggagcaugc

SEQ ID NO: 210681 - RNA, 22 nt, Human
ucaucucagagagguauguuag

SEQ ID NO: 210682 - RNA, 22 nt, Human
cagcaagaggguaagguugaag

SEQ ID NO: 210683 - RNA, 22 nt, Human
ucccugggcaucacguugcuuc

SEQ ID NO: 210684 - RNA, 22 nt, Human
caagauuuuaucuccguuucug

SEQ ID NO: 210685 - RNA, 22 nt, Human
ggaggccaugggcagaaucuuu

SEQ ID NO: 210686 - RNA, 21 nt, Human
auaaacugcaucaaguuggug

SEQ ID NO: 210687 - RNA, 22 nt, Human
acagaggaagcauauagcacaa

SEQ ID NO: 210688 - RNA, 22 nt, Human
auguaacugaaggaaaugcaug

SEQ ID NO: 210689 - RNA, 22 nt, Human
ucuggcaggccuugucaaucug

SEQ ID NO: 210690 - RNA, 22 nt, Human
aaggaagauauaucaagcuuaa

SEQ ID NO: 210691 - RNA, 23 nt, Human
ugcuggcugaaacagccaaagga

SEQ ID NO: 210692 - RNA, 22 nt, Human
agacaaaugguaauuaugucua

SEQ ID NO: 210693 - RNA, 22 nt, Human
aggaaaggauuggcuucucugu

SEQ ID NO: 210694 - RNA, 22 nt, Human
gugcagguguuuuggcugccag

SEQ ID NO: 210695 - RNA, 22 nt, Human
aacuggauuuugaugagcaguu

SEQ ID NO: 210696 - RNA, 22 nt, Human
auuccuucuauucucugugggu

SEQ ID NO: 210697 - RNA, 22 nt, Human
cacccagagccugagagggaua

SEQ ID NO: 210698 - RNA, 21 nt, Human
cugcugcuggggucugggcag

SEQ ID NO: 210699 - RNA, 22 nt, Human
aacaaccaaaaagaugaaugua

SEQ ID NO: 210700 - RNA, 22 nt, Human
acuugaauaggugucaaggcca

SEQ ID NO: 210701 - RNA, 22 nt, Human
uguuuucuauuaccugagauug

SEQ ID NO: 210702 - RNA, 22 nt, Human
cagagcuuccugcugggcuucu

SEQ ID NO: 210703 - RNA, 21 nt, Human
ugaggccugccagucucagaa

SEQ ID NO: 210704 - RNA, 22 nt, Human
cccaggagguuggggcuacagu

SEQ ID NO: 210705 - RNA, 22 nt, Human
guuucaaagcacagcucacauu

SEQ ID NO: 210706 - RNA, 22 nt, Human
uccaggagucagacagauggug

SEQ ID NO: 210707 - RNA, 19 nt, Human
uuccugugcugcugugucc

SEQ ID NO: 210708 - RNA, 22 nt, Human
gaagccagauuuggggcauauc

SEQ ID NO: 210709 - RNA, 23 nt, Human
cuguggcugaguccuguuggagu

SEQ ID NO: 210710 - RNA, 23 nt, Human
ccugcagcugcuggggcuccacc

SEQ ID NO: 210711 - RNA, 22 nt, Human
ugggcuccucgucacucgcugu

SEQ ID NO: 210712 - RNA, 22 nt, Human
ugccauauuauugagcauauua

SEQ ID NO: 210713 - RNA, 22 nt, Human
aagaucagcucccgagucugag

SEQ ID NO: 210714 - RNA, 22 nt, Human
gagcagggcuuguccuccucau

SEQ ID NO: 210715 - RNA, 22 nt, Human
cagggagccugaauguuccagg

SEQ ID NO: 210716 - RNA, 22 nt, Human
ucucagcagggccauccugagc

SEQ ID NO: 210717 - RNA, 22 nt, Human
aggcaggugagucaaaacagac

SEQ ID NO: 210718 - RNA, 22 nt, Human
ugggccuccgcauggcccagcg

SEQ ID NO: 210719 - RNA, 17 nt, Human
cugucugcgcaugaggu

SEQ ID NO: 210720 - RNA, 22 nt, Human
augaacaguaugcaacaugauu

SEQ ID NO: 210721 - RNA, 22 nt, Human
agagauggccuuaggugggaau

SEQ ID NO: 210722 - RNA, 22 nt, Human
ccugcuggcugguagaguuccg

SEQ ID NO: 210723 - RNA, 22 nt, Human
ugggaggcagguaggugaugau

SEQ ID NO: 210724 - RNA, 22 nt, Human
caaggcuaagcuuuggcuuucu

SEQ ID NO: 210725 - RNA, 22 nt, Human
gccuagagaaaaagccucugca

SEQ ID NO: 210726 - RNA, 22 nt, Human
aaguacauauauuuaugauucu

SEQ ID NO: 210727 - RNA, 22 nt, Human
ccucugggagacugcuacugag

SEQ ID NO: 210728 - RNA, 22 nt, Human
uuccucaggcuucccuuugucc

SEQ ID NO: 210729 - RNA, 22 nt, Human
aagugaggccuaggcacugggu

SEQ ID NO: 210730 - RNA, 22 nt, Human
acagguguaauuugcccgaggu

SEQ ID NO: 210731 - RNA, 22 nt, Human
ggcaauuacguauuagucaugu

SEQ ID NO: 210732 - RNA, 21 nt, Human
uucuccuguuuugcaccacag

SEQ ID NO: 210733 - RNA, 22 nt, Human
uucucaggccccugccuggacu

SEQ ID NO: 210734 - RNA, 22 nt, Human
cccaggucccgccccagcucua

SEQ ID NO: 210735 - RNA, 22 nt, Human
aauggcagaggcaaagauggua

SEQ ID NO: 210736 - RNA, 22 nt, Human
agaaaucuuggagucuguggua

SEQ ID NO: 210737 - RNA, 22 nt, Human
uuagaacauagcaacagaauua

SEQ ID NO: 210738 - RNA, 22 nt, Human
agguccuggucuugagucuuaa

SEQ ID NO: 210739 - RNA, 22 nt, Human
auucucuggaagaagauaaaaa

SEQ ID NO: 210740 - RNA, 23 nt, Human
acuugauuauuguugauagauuc

SEQ ID NO: 210741 - RNA, 22 nt, Human
ccugaggacacacgcugcagga

SEQ ID NO: 210742 - RNA, 22 nt, Human
gauuuggcuuggaugauuaaac

SEQ ID NO: 210743 - RNA, 18 nt, Human
gaugggagcaagagaaga

SEQ ID NO: 210744 - RNA, 22 nt, Human
acaguuuggcgugauugauagu

SEQ ID NO: 210745 - RNA, 21 nt, Human
gggaucuuguacuggcgugga

SEQ ID NO: 210746 - RNA, 22 nt, Human
caaggcaggaagccugucuuau

SEQ ID NO: 210747 - RNA, 18 nt, Human
acuccccacaggcucugu

SEQ ID NO: 210748 - RNA, 22 nt, Human
uacuucauuauucuaguuuuga

SEQ ID NO: 210749 - RNA, 22 nt, Human
auuucuagauauggagaguggu

SEQ ID NO: 210750 - RNA, 22 nt, Human
aagaugcuuccacugcaguggc

SEQ ID NO: 210751 - RNA, 22 nt, Human
ggaagaugagaaguggggcucc

SEQ ID NO: 210752 - RNA, 22 nt, Human
caaagcaagggcugaagacucc

SEQ ID NO: 210753 - RNA, 22 nt, Human
gggcuguguaucaguuaucuau

SEQ ID NO: 210754 - RNA, 22 nt, Human
cggcugcuucugagccccggcg

SEQ ID NO: 210755 - RNA, 22 nt, Human
ccaggacacgauuuuuagucug

SEQ ID NO: 210756 - RNA, 18 nt, Human
agccucuggcagagagaa

SEQ ID NO: 210757 - RNA, 22 nt, Human
uccugggacaccccaauaugag

SEQ ID NO: 210758 - RNA, 22 nt, Human
aggucccugcagcagacugcca

SEQ ID NO: 210759 - RNA, 22 nt, Human
cuggcuccucuacacacccaaa

SEQ ID NO: 210760 - RNA, 22 nt, Human
ucuucacaugaccuucaugucu

SEQ ID NO: 210761 - RNA, 22 nt, Human
uccugggaugcauaaaauaugu

SEQ ID NO: 210762 - RNA, 22 nt, Human
agaggccagcaaccacaguaaa

SEQ ID NO: 210763 - RNA, 22 nt, Human
ggguucuuauaguaucagagcu

SEQ ID NO: 210764 - RNA, 22 nt, Human
cagagcucuauguucauggagg

SEQ ID NO: 210765 - RNA, 22 nt, Human
aaaggccucuguccuagugccu

SEQ ID NO: 210766 - RNA, 22 nt, Human
uucuggcucgauucucugaccg

SEQ ID NO: 210767 - RNA, 21 nt, Human
caucucaguggguugguggau

SEQ ID NO: 210768 - RNA, 22 nt, Human
acuccugggugcauuucugauu

SEQ ID NO: 210769 - RNA, 22 nt, Human
cuggaagcuuguuugccagucu

SEQ ID NO: 210770 - RNA, 22 nt, Human
uaggugucaggccuccuccagc

SEQ ID NO: 210771 - RNA, 22 nt, Human
uauccaauucaccauugauggg

SEQ ID NO: 210772 - RNA, 22 nt, Human
uagguggugugcgaagagcgug

SEQ ID NO: 210773 - RNA, 22 nt, Human
ggccagagagcagccaggauuc

SEQ ID NO: 210774 - RNA, 22 nt, Human
acuaaauagccucugguaguug

SEQ ID NO: 210775 - RNA, 22 nt, Human
guggggcaguggccugggagca

SEQ ID NO: 210776 - RNA, 22 nt, Human
gcaaggaagcagaguugcuauc

SEQ ID NO: 210777 - RNA, 22 nt, Human
ucaggaaggcacuugguguguu

SEQ ID NO: 210778 - RNA, 22 nt, Human
uugcaaucugcaaagcugugga

SEQ ID NO: 210779 - RNA, 22 nt, Human
uauauuaccugccugaucuaua

SEQ ID NO: 210780 - RNA, 22 nt, Human
ccuccuggugggcgcuucuggc

SEQ ID NO: 210781 - RNA, 22 nt, Human
uggaaaaucaggggacauugau

SEQ ID NO: 210782 - RNA, 22 nt, Human
acugggaggcaaagagcaagga

SEQ ID NO: 210783 - RNA, 22 nt, Human
gcuuccaguccucagaggcugg

SEQ ID NO: 210784 - RNA, 20 nt, Human
aguggggagucaggagugcc

SEQ ID NO: 210785 - RNA, 22 nt, Human
cuucacugugcuucaagcagcu

SEQ ID NO: 210786 - RNA, 22 nt, Human
auagaauccugcagcaagccuu

SEQ ID NO: 210787 - RNA, 22 nt, Human
ucagcuccucagagccucaguu

SEQ ID NO: 210788 - RNA, 22 nt, Human
accuuagaaaaucaaaauuaga

SEQ ID NO: 210789 - RNA, 22 nt, Human
ggccucagggucacucuguaga

SEQ ID NO: 210790 - RNA, 22 nt, Human
ccuucuccugccuuggguucau

SEQ ID NO: 210791 - RNA, 22 nt, Human
ucagaggagaccaaggggaaua

SEQ ID NO: 210792 - RNA, 22 nt, Human
ggacagcauaucagcagggcag

SEQ ID NO: 210793 - RNA, 22 nt, Human
cacccagcagcacuuaagacua

SEQ ID NO: 210794 - RNA, 22 nt, Human
cgugcccugcgcaagugcugcu

SEQ ID NO: 210795 - RNA, 22 nt, Human
gucuccagggacacacuagccg

SEQ ID NO: 210796 - RNA, 22 nt, Human
ucccuggccauuccucuaggcc

SEQ ID NO: 210797 - RNA, 22 nt, Human
uagaacuuucagaaauuccaaa

SEQ ID NO: 210798 - RNA, 22 nt, Human
auuuauugguuugcauggugaa

SEQ ID NO: 210799 - RNA, 22 nt, Human
caagaugaaauugugauauuuu

SEQ ID NO: 210800 - RNA, 18 nt, Human
gaggcagcuagcaauuuu

SEQ ID NO: 210801 - RNA, 23 nt, Human
ucagagagcuguugagagcugcc

SEQ ID NO: 210802 - RNA, 22 nt, Human
gaaaggcaucuucagucucuga

SEQ ID NO: 210803 - RNA, 22 nt, Human
ucuacgaagccaccauggagac

SEQ ID NO: 210804 - RNA, 22 nt, Human
cggggcaggagucccuguagag

SEQ ID NO: 210805 - RNA, 22 nt, Human
uccacaucuagguuugucaaca

SEQ ID NO: 210806 - RNA, 17 nt, Human
aggcuggccuucacagu

SEQ ID NO: 210807 - RNA, 21 nt, Human
ugggccugauucccaggguca

SEQ ID NO: 210808 - RNA, 22 nt, Human
cagaagcaagggccaaagucuu

SEQ ID NO: 210809 - RNA, 22 nt, Human
gcuucuauuauuuggagcugag

SEQ ID NO: 210810 - RNA, 22 nt, Human
uauggguguuaauggugagaga

SEQ ID NO: 210811 - RNA, 20 nt, Human
gcacaguuugggaaccaugg

SEQ ID NO: 210812 - RNA, 22 nt, Human
uccauauacaacuuaaucuuua

SEQ ID NO: 210813 - RNA, 22 nt, Human
uauugauaugcagaacugacuu

SEQ ID NO: 210814 - RNA, 22 nt, Human
ccagguguaagacaugguccua

SEQ ID NO: 210815 - RNA, 22 nt, Human
ugucaaaaugacuuuacuacag

SEQ ID NO: 210816 - RNA, 22 nt, Human
gcuucugcuguugaagccacca

SEQ ID NO: 210817 - RNA, 21 nt, Human
ugcuuuaugggaaaaauguca

SEQ ID NO: 210818 - RNA, 22 nt, Human
ucucaagcuaguguuuauagua

SEQ ID NO: 210819 - RNA, 22 nt, Human
agcugaggcauggacaggcugc

SEQ ID NO: 210820 - RNA, 22 nt, Human
caugacaaauaaaccuuugcca

SEQ ID NO: 210821 - RNA, 22 nt, Human
cugaggcaccggcaauguucug

SEQ ID NO: 210822 - RNA, 22 nt, Human
aucuguguaugugaccuuaucu

SEQ ID NO: 210823 - RNA, 22 nt, Human
cuuaggaguucacuugaauagu

SEQ ID NO: 210824 - RNA, 18 nt, Human
agagggaaucaguuggau

SEQ ID NO: 210825 - RNA, 21 nt, Human
aguuuugagaguggguagugu

SEQ ID NO: 210826 - RNA, 22 nt, Human
guccugagucaagugugggcag

SEQ ID NO: 210827 - RNA, 22 nt, Human
gagugucacuugaugcagggca

SEQ ID NO: 210828 - RNA, 22 nt, Human
gggggcuaccgucucuggagcu

SEQ ID NO: 210829 - RNA, 22 nt, Human
gaaauaguacagcauaguucuu

SEQ ID NO: 210830 - RNA, 22 nt, Human
aucauacacucacauaaacaga

SEQ ID NO: 210831 - RNA, 22 nt, Human
cugcugagguccuugcucagac

SEQ ID NO: 210832 - RNA, 22 nt, Human
gagaggcccugaagcccacaga

SEQ ID NO: 210833 - RNA, 22 nt, Human
aucagcaaggcaaucacugcag

SEQ ID NO: 210834 - RNA, 22 nt, Human
cacuuagagccagaugcauagu

SEQ ID NO: 210835 - RNA, 22 nt, Human
aaggccuuugccccgauacagg

SEQ ID NO: 210836 - RNA, 22 nt, Human
uccucagaaaccccugugaggu

SEQ ID NO: 210837 - RNA, 22 nt, Human
ccuguucacccuccaugcacag

SEQ ID NO: 210838 - RNA, 22 nt, Human
uacagcuaggcaaaaaugacau

SEQ ID NO: 210839 - RNA, 22 nt, Human
ugccugucagggggagugggaa

SEQ ID NO: 210840 - RNA, 22 nt, Human
agcagcuguuagaaacaggaag

SEQ ID NO: 210841 - RNA, 22 nt, Human
uguggcagaacugggacucaaa

SEQ ID NO: 210842 - RNA, 22 nt, Human
uaguuuacucaucuauaaaaug

SEQ ID NO: 210843 - RNA, 22 nt, Human
cgggcacacacuugacagguuc

SEQ ID NO: 210844 - RNA, 22 nt, Human
agugaugucacaaacuauggug

SEQ ID NO: 210845 - RNA, 22 nt, Human
cguagcucacgcccccucuccc

SEQ ID NO: 210846 - RNA, 22 nt, Human
cauauuuuaguugcugaacagc

SEQ ID NO: 210847 - RNA, 20 nt, Human
acucuguagguaaugagacu

SEQ ID NO: 210848 - RNA, 22 nt, Human
cccucucagucagagccagaua

SEQ ID NO: 210849 - RNA, 22 nt, Human
agccagucccuugagcgugccc

SEQ ID NO: 210850 - RNA, 22 nt, Human
uagaaaucuacuuagacuuucu

SEQ ID NO: 210851 - RNA, 22 nt, Human
agcaugaagacuucagagcuag

SEQ ID NO: 210852 - RNA, 22 nt, Human
ggaaggcuguucacuaacaugu

SEQ ID NO: 210853 - RNA, 22 nt, Human
uccaggccccugccugggccug

SEQ ID NO: 210854 - RNA, 22 nt, Human
uccugugucaauuccucauucu

SEQ ID NO: 210855 - RNA, 22 nt, Human
cugagccuguguuucucuggca

SEQ ID NO: 210856 - RNA, 22 nt, Human
uuauugaaggaacugaaauaaa

SEQ ID NO: 210857 - RNA, 22 nt, Human
uguagauguagacacaggucua

SEQ ID NO: 210858 - RNA, 22 nt, Human
augcaucuuaucaaaaauuaua

SEQ ID NO: 210859 - RNA, 20 nt, Human
uagaaucuggugauguaucg

SEQ ID NO: 210860 - RNA, 22 nt, Human
aaaugucuuucuucugcuacgu

SEQ ID NO: 210861 - RNA, 22 nt, Human
gaagauuaaaugaagugaccug

SEQ ID NO: 210862 - RNA, 22 nt, Human
uugaauaggacucagcagugau

SEQ ID NO: 210863 - RNA, 23 nt, Human
aaacaagucucucaauggcuugc

SEQ ID NO: 210864 - RNA, 22 nt, Human
ccagcuuucauaucaugaggua

SEQ ID NO: 210865 - RNA, 22 nt, Human
agggagcuucuggccucagccu

SEQ ID NO: 210866 - RNA, 23 nt, Human
uagacugcaggcuccuugagggc

SEQ ID NO: 210867 - RNA, 22 nt, Human
gaagcugcguguagccauacuu

SEQ ID NO: 210868 - RNA, 22 nt, Human
cugcccugacugaccuuuugaa

SEQ ID NO: 210869 - RNA, 22 nt, Human
ucuggaaggaacccuuagagga

SEQ ID NO: 210870 - RNA, 22 nt, Human
agccuucauaaucuugggcuuu

SEQ ID NO: 210871 - RNA, 21 nt, Human
uccuccuguagaggguccugg

SEQ ID NO: 210872 - RNA, 22 nt, Human
auuuaauuuacauuugacagag

SEQ ID NO: 210873 - RNA, 22 nt, Human
agcacagagaaacuaagacauu

SEQ ID NO: 210874 - RNA, 22 nt, Human
cuuuccuagaaauauauacuua

SEQ ID NO: 210875 - RNA, 22 nt, Human
ccucagagccuccagaaggaau

SEQ ID NO: 210876 - RNA, 22 nt, Human
ucuagaauagauucugcugauc

SEQ ID NO: 210877 - RNA, 22 nt, Human
ccguggaguugugcugaguaug

SEQ ID NO: 210878 - RNA, 22 nt, Human
aggcucugggaacagacgggug

SEQ ID NO: 210879 - RNA, 22 nt, Human
cacuuagucucaccaguucagu

SEQ ID NO: 210880 - RNA, 22 nt, Human
uucuuugaguuaguacagucca

SEQ ID NO: 210881 - RNA, 22 nt, Human
cacugccuccccaggcuccaca

SEQ ID NO: 210882 - RNA, 22 nt, Human
acaggcagggaccucuugaguu

SEQ ID NO: 210883 - RNA, 22 nt, Human
agcaccauuucucuaaagcacu

SEQ ID NO: 210884 - RNA, 22 nt, Human
ugcagcugaccagcaaguccug

SEQ ID NO: 210885 - RNA, 22 nt, Human
agucaaagaagaugguuccaaa

SEQ ID NO: 210886 - RNA, 22 nt, Human
uaugaauucucuuguguauagu

SEQ ID NO: 210887 - RNA, 22 nt, Human
uuuggaauuaugcuuaaaguuu

SEQ ID NO: 210888 - RNA, 19 nt, Human
ggguuguguggaagguauc

SEQ ID NO: 210889 - RNA, 22 nt, Human
aacauuucauaacuugacuuuu

SEQ ID NO: 210890 - RNA, 22 nt, Human
ccgaggcuccuccccgagucug

SEQ ID NO: 210891 - RNA, 22 nt, Human
caguucugagcuuucccagaag

SEQ ID NO: 210892 - RNA, 22 nt, Human
gucuucuuguuuugaaggaaau

SEQ ID NO: 210893 - RNA, 22 nt, Human
auucugauaugaacacacauau

SEQ ID NO: 210894 - RNA, 22 nt, Human
cagggguguuuuuggccaggag

SEQ ID NO: 210895 - RNA, 22 nt, Human
ugauuuucuccauuguaaauuc

SEQ ID NO: 210896 - RNA, 22 nt, Human
ggcagacuuuuucucugaaggg

SEQ ID NO: 210897 - RNA, 23 nt, Human
guggccuccccggaaugccucgc

SEQ ID NO: 210898 - RNA, 21 nt, Human
cuguccaaauuucauaacuuu

SEQ ID NO: 210899 - RNA, 22 nt, Human
gaucugaaauagcuacugcaga

SEQ ID NO: 210900 - RNA, 22 nt, Human
ucaguguuuccuagagcauaua

SEQ ID NO: 210901 - RNA, 22 nt, Human
cuggcuggcaaguagaacacaa

SEQ ID NO: 210902 - RNA, 22 nt, Human
uaauuauaaacugcaguaggua

SEQ ID NO: 210903 - RNA, 22 nt, Human
aguggagaccccacuucuacau

SEQ ID NO: 210904 - RNA, 22 nt, Human
uuaucuguugcuuaaugcgcau

SEQ ID NO: 210905 - RNA, 17 nt, Human
aagacaagacaaaugca

SEQ ID NO: 210906 - RNA, 17 nt, Human
auuuagcaaguagacag

SEQ ID NO: 210907 - RNA, 22 nt, Human
ccugccaggcgagucuaggcca

SEQ ID NO: 210908 - RNA, 22 nt, Human
acaaagauguuuaaagcauuua

SEQ ID NO: 210909 - RNA, 22 nt, Human
auuaacuguacuuucuaauuuu

SEQ ID NO: 210910 - RNA, 22 nt, Human
uucaaaugguuagacuguuagc

SEQ ID NO: 210911 - RNA, 15 nt, Human
ccaggcugggugagc

SEQ ID NO: 210912 - RNA, 22 nt, Human
aaugagauggcaaugacuuaaa

SEQ ID NO: 210913 - RNA, 22 nt, Human
auacuacacuaugcauggaugu

SEQ ID NO: 210914 - RNA, 22 nt, Human
gggcugagccauuugaaccuug

SEQ ID NO: 210915 - RNA, 22 nt, Human
ucauuucuccgaccugcugucc

SEQ ID NO: 210916 - RNA, 22 nt, Human
uggcaaggccacaggugcaguu

SEQ ID NO: 210917 - RNA, 22 nt, Human
acaucugauuacaugagaauau

SEQ ID NO: 210918 - RNA, 22 nt, Human
agcugagccagcagcaacagga

SEQ ID NO: 210919 - RNA, 22 nt, Human
augcauauguacccauguucug

SEQ ID NO: 210920 - RNA, 19 nt, Human
aaauaucagagagaugaua

SEQ ID NO: 210921 - RNA, 22 nt, Human
guacaaaaguuauugcgguuuu

SEQ ID NO: 210922 - RNA, 22 nt, Human
acaggcucaguucacuggauuu

SEQ ID NO: 210923 - RNA, 22 nt, Human
cagcagggaagcugugcuguuu

SEQ ID NO: 210924 - RNA, 22 nt, Human
cugcagguugagcagccagguu

SEQ ID NO: 210925 - RNA, 22 nt, Human
gcuuuauagcccuauuacauga

SEQ ID NO: 210926 - RNA, 22 nt, Human
ucaggugucuaucuaaccuggu

SEQ ID NO: 210927 - RNA, 22 nt, Human
gcacccagugggaugcuuagca

SEQ ID NO: 210928 - RNA, 22 nt, Human
gaccuggugcuagcuggugugu

SEQ ID NO: 210929 - RNA, 21 nt, Human
gcagaggaaugguauacauaa

SEQ ID NO: 210930 - RNA, 22 nt, Human
ugaauagagcugcaguggacau

SEQ ID NO: 210931 - RNA, 22 nt, Human
uacacaacugacaaccauucug

SEQ ID NO: 210932 - RNA, 22 nt, Human
gcagggauugucaaugcugcuc

SEQ ID NO: 210933 - RNA, 22 nt, Human
agcugggacucaacugucuggg

SEQ ID NO: 210934 - RNA, 22 nt, Human
gaggcucagagaagucauggua

SEQ ID NO: 210935 - RNA, 23 nt, Human
ggacacagagauaagugagacaa

SEQ ID NO: 210936 - RNA, 22 nt, Human
gacauuuguaugacacuuuaaa

SEQ ID NO: 210937 - RNA, 22 nt, Human
ucugaggcugaauggacuccgu

SEQ ID NO: 210938 - RNA, 21 nt, Human
aaugaugaaagaugacagagu

SEQ ID NO: 210939 - RNA, 22 nt, Human
gcacaugugagaguagaggccu

SEQ ID NO: 210940 - RNA, 22 nt, Human
cugaggccucuguucaccagaa

SEQ ID NO: 210941 - RNA, 22 nt, Human
uuagcuuucuuggagaauuaca

SEQ ID NO: 210942 - RNA, 22 nt, Human
aagcacagcagagccuugcuug

SEQ ID NO: 210943 - RNA, 22 nt, Human
aauccuuacugaaugagaaaaa

SEQ ID NO: 210944 - RNA, 20 nt, Human
aaaaauugauaucgcuuccu

SEQ ID NO: 210945 - RNA, 22 nt, Human
gacuuucugcuauacuuucugu

SEQ ID NO: 210946 - RNA, 22 nt, Human
cagcugggagcuccauuagaua

SEQ ID NO: 210947 - RNA, 22 nt, Human
ugaguccaccuuaguauauggg

SEQ ID NO: 210948 - RNA, 19 nt, Human
aggcugugagggaggacuc

SEQ ID NO: 210949 - RNA, 22 nt, Human
agucucuuaaugggcagaaagu

SEQ ID NO: 210950 - RNA, 22 nt, Human
cucagugguugagagccugggc

SEQ ID NO: 210951 - RNA, 22 nt, Human
cagcugagcucccaggccauca

SEQ ID NO: 210952 - RNA, 22 nt, Human
ucaccuaauugaagucaggagu

SEQ ID NO: 210953 - RNA, 22 nt, Human
ccaggcucugugugggcuagag

SEQ ID NO: 210954 - RNA, 22 nt, Human
cagagccaggucuaggagucuc

SEQ ID NO: 210955 - RNA, 22 nt, Human
cacugcccagcgucuuaggcac

SEQ ID NO: 210956 - RNA, 22 nt, Human
caggugagcucuaucuagggag

SEQ ID NO: 210957 - RNA, 22 nt, Human
uuugcagaagaaaacaugaaca

SEQ ID NO: 210958 - RNA, 22 nt, Human
gcagguggauuaucagaagugc

SEQ ID NO: 210959 - RNA, 22 nt, Human
cugcuguguuccuccugcaucu

SEQ ID NO: 210960 - RNA, 22 nt, Human
gaagcagucagcagcaccuuug

SEQ ID NO: 210961 - RNA, 22 nt, Human
ucguuaaaugcuaaaacugaca

SEQ ID NO: 210962 - RNA, 22 nt, Human
uaaggcauaaggccagaggcua

SEQ ID NO: 210963 - RNA, 22 nt, Human
aguuaacucugaaaagacauuu

SEQ ID NO: 210964 - RNA, 22 nt, Human
aaaugcuagggagaaacucucc

SEQ ID NO: 210965 - RNA, 22 nt, Human
gaagagguagcauuggcaggug

SEQ ID NO: 210966 - RNA, 22 nt, Human
auacaaagcuaaauaugguuuc

SEQ ID NO: 210967 - RNA, 22 nt, Human
uuguaauuaauggcagcaauua

SEQ ID NO: 210968 - RNA, 22 nt, Human
gagggccacguucagggcucuc

SEQ ID NO: 210969 - RNA, 22 nt, Human
uggaauguugauaaacauaggc

SEQ ID NO: 210970 - RNA, 22 nt, Human
cauuguuaauugguaucuuaca

SEQ ID NO: 210971 - RNA, 22 nt, Human
gccccagguugccugucccagg

SEQ ID NO: 210972 - RNA, 22 nt, Human
gucaggaugggcagccaaacua

SEQ ID NO: 210973 - RNA, 22 nt, Human
agaguuuguauuuuucagugaa

SEQ ID NO: 210974 - RNA, 17 nt, Human
cuuguuuuccacuggga

SEQ ID NO: 210975 - RNA, 22 nt, Human
acagggcagaaauguugcaucu

SEQ ID NO: 210976 - RNA, 22 nt, Human
uuuuggaacacagacauuagaa

SEQ ID NO: 210977 - RNA, 22 nt, Human
ucugaagaauaggauguugugu

SEQ ID NO: 210978 - RNA, 22 nt, Human
gcugugcaggggauuugguuau

SEQ ID NO: 210979 - RNA, 23 nt, Human
gcccaugcuguugggcccgagca

SEQ ID NO: 210980 - RNA, 22 nt, Human
caugcagggacuagagaacagg

SEQ ID NO: 210981 - RNA, 22 nt, Human
cagagcaggaauaggguguuga

SEQ ID NO: 210982 - RNA, 22 nt, Human
ucauuuggaagccugagagugu

SEQ ID NO: 210983 - RNA, 22 nt, Human
auuuaucaucagaccuuuuaaa

SEQ ID NO: 210984 - RNA, 22 nt, Human
cugcaggagggcuggggaagcc

SEQ ID NO: 210985 - RNA, 22 nt, Human
caugcagcggcguuugguuuaa

SEQ ID NO: 210986 - RNA, 22 nt, Human
aggccuccagccacaugccagu

SEQ ID NO: 210987 - RNA, 22 nt, Human
ccaggcucugcgcuggacaugg

SEQ ID NO: 210988 - RNA, 22 nt, Human
uaauguuaguauguaaucuuau

SEQ ID NO: 210989 - RNA, 22 nt, Human
gagacacacauucuggagagaa

SEQ ID NO: 210990 - RNA, 20 nt, Human
ucauccaggacaggaguggc

SEQ ID NO: 210991 - RNA, 22 nt, Human
gaaggccacaagagaaguuaag

SEQ ID NO: 210992 - RNA, 22 nt, Human
ugaaagaagccucccuuuggag

SEQ ID NO: 210993 - RNA, 22 nt, Human
gcucacuggccugaagaggacg

SEQ ID NO: 210994 - RNA, 22 nt, Human
uugauguaaagugauucauggg

SEQ ID NO: 210995 - RNA, 17 nt, Human
cugaggcccagggccca

SEQ ID NO: 210996 - RNA, 22 nt, Human
uauuuuaucugccagaguggag

SEQ ID NO: 210997 - RNA, 22 nt, Human
ugauggcucauguuuggggaug

SEQ ID NO: 210998 - RNA, 22 nt, Human
uugcaggguugacacugccugc

SEQ ID NO: 210999 - RNA, 22 nt, Human
agaaaauaauuucuuggcuggu

SEQ ID NO: 211000 - RNA, 22 nt, Human
uucuguuugugaacuggcugag

SEQ ID NO: 211001 - RNA, 22 nt, Human
guuacaauguucuucaguucug

SEQ ID NO: 211002 - RNA, 17 nt, Human
uaucaagaagucuggcc

SEQ ID NO: 211003 - RNA, 22 nt, Human
ucuucuuugaaucauagugacc

SEQ ID NO: 211004 - RNA, 21 nt, Human
cagaggccucaugcucugugc

SEQ ID NO: 211005 - RNA, 22 nt, Human
uugguaaaaucauagugguaac

SEQ ID NO: 211006 - RNA, 22 nt, Human
ccagccuucugagcugccugga

SEQ ID NO: 211007 - RNA, 22 nt, Human
aagccaguguggucugcccauu

SEQ ID NO: 211008 - RNA, 22 nt, Human
gcaggcuucucucuucccuacc

SEQ ID NO: 211009 - RNA, 22 nt, Human
uggcagagcccagacuccaguc

SEQ ID NO: 211010 - RNA, 22 nt, Human
cacaugaccacucuuuacuucu

SEQ ID NO: 211011 - RNA, 22 nt, Human
gaguggggucugggcaucaguc

SEQ ID NO: 211012 - RNA, 22 nt, Human
agucagagcaaacuggacagac

SEQ ID NO: 211013 - RNA, 22 nt, Human
acacagaguauuuagaaggggu

SEQ ID NO: 211014 - RNA, 18 nt, Human
cugcugugucgucugggc

SEQ ID NO: 211015 - RNA, 22 nt, Human
gagucuaaggaaaaauagagua

SEQ ID NO: 211016 - RNA, 22 nt, Human
agcagcagauuauggucuacau

SEQ ID NO: 211017 - RNA, 22 nt, Human
agcuugauaguggcuaucaagc

SEQ ID NO: 211018 - RNA, 22 nt, Human
acacagugccaaauugcaguua

SEQ ID NO: 211019 - RNA, 22 nt, Human
ucacaaauauuuuaacaguagg

SEQ ID NO: 211020 - RNA, 22 nt, Human
aggaaauaggaccagacaaagc

SEQ ID NO: 211021 - RNA, 22 nt, Human
uggcugaguaaguugugauaug

SEQ ID NO: 211022 - RNA, 22 nt, Human
acacaguucuuagcaggugucu

SEQ ID NO: 211023 - RNA, 22 nt, Human
gaaggcuacuucuccucagggc

SEQ ID NO: 211024 - RNA, 19 nt, Human
ugcccaggccucccaaaag

SEQ ID NO: 211025 - RNA, 19 nt, Human
uacaggaggccugcaaucu

SEQ ID NO: 211026 - RNA, 22 nt, Human
gcuccaggccacggcuucuugg

SEQ ID NO: 211027 - RNA, 22 nt, Human
ugccagaacagcucaucuggcc

SEQ ID NO: 211028 - RNA, 23 nt, Human
ggcacagaugcugagcaugugca

SEQ ID NO: 211029 - RNA, 22 nt, Human
guacuuuagaguaaaauagacc

SEQ ID NO: 211030 - RNA, 22 nt, Human
cccagcccugaccuauuggaaa

SEQ ID NO: 211031 - RNA, 22 nt, Human
aggcuguguuuaagugguaaug

SEQ ID NO: 211032 - RNA, 22 nt, Human
gagggcugaagauuguggcccc

SEQ ID NO: 211033 - RNA, 22 nt, Human
agggcagcagcuccuccuagcu

SEQ ID NO: 211034 - RNA, 22 nt, Human
uuuguuuagaaagagauuggug

SEQ ID NO: 211035 - RNA, 22 nt, Human
ccaccccugggugcagggagcg

SEQ ID NO: 211036 - RNA, 22 nt, Human
ugcauuuuacuuaccuguuagu

SEQ ID NO: 211037 - RNA, 22 nt, Human
uaggcaaguggaccagagguuu

SEQ ID NO: 211038 - RNA, 22 nt, Human
uaggaaaauaucucuuauuggg

SEQ ID NO: 211039 - RNA, 22 nt, Human
aucuccaguauccuaguauugu

SEQ ID NO: 211040 - RNA, 22 nt, Human
cagggcucagaagacagaccuc

SEQ ID NO: 211041 - RNA, 22 nt, Human
ugccaggcgugguggugcgcac

SEQ ID NO: 211042 - RNA, 22 nt, Human
acagggagaugggugaaagcgg

SEQ ID NO: 211043 - RNA, 22 nt, Human
ugugcccaucccucuggagugu

SEQ ID NO: 211044 - RNA, 22 nt, Human
acauuacagcaaguuuacguua

SEQ ID NO: 211045 - RNA, 22 nt, Human
aucuuuacaguguaagugcaga

SEQ ID NO: 211046 - RNA, 22 nt, Human
ugagaggagugauuguaaaauu

SEQ ID NO: 211047 - RNA, 22 nt, Human
cacaaaguguuagaugccacuc

SEQ ID NO: 211048 - RNA, 22 nt, Human
acuuucccucucagaacucuua

SEQ ID NO: 211049 - RNA, 22 nt, Human
cuguguccuuuuaguugcugug

SEQ ID NO: 211050 - RNA, 22 nt, Human
gucugggguacuuucaucugau

SEQ ID NO: 211051 - RNA, 22 nt, Human
ccaggagcauuaagagaacaua

SEQ ID NO: 211052 - RNA, 22 nt, Human
gagggagagugauggaccauug

SEQ ID NO: 211053 - RNA, 22 nt, Human
aggguccacuuggacauugauc

SEQ ID NO: 211054 - RNA, 22 nt, Human
uagaaaguagggaagguaggau

SEQ ID NO: 211055 - RNA, 22 nt, Human
ugagaucauugacuuguuccug

SEQ ID NO: 211056 - RNA, 22 nt, Human
gugacagagcugggauuugaag

SEQ ID NO: 211057 - RNA, 22 nt, Human
uucagaaaaagaccauugcaau

SEQ ID NO: 211058 - RNA, 22 nt, Human
uauuuagugauagaagcaagga

SEQ ID NO: 211059 - RNA, 22 nt, Human
cugccccuggugauggacgcca

SEQ ID NO: 211060 - RNA, 21 nt, Human
acagacaguccagagaaaaga

SEQ ID NO: 211061 - RNA, 22 nt, Human
gcuccccauugaucugcaggcu

SEQ ID NO: 211062 - RNA, 22 nt, Human
ccauggcuccuugcccuguagc

SEQ ID NO: 211063 - RNA, 22 nt, Human
uaaagugcaggcuacucagaag

SEQ ID NO: 211064 - RNA, 22 nt, Human
acagccuuuaaccauuucuucc

SEQ ID NO: 211065 - RNA, 21 nt, Human
aguguccuugaucuugccuug

SEQ ID NO: 211066 - RNA, 22 nt, Human
caaagugcuaggauuacaggcc

SEQ ID NO: 211067 - RNA, 20 nt, Human
uugauaggcagcuugucagg

SEQ ID NO: 211068 - RNA, 22 nt, Human
aaaaaugugaccacaggguguu

SEQ ID NO: 211069 - RNA, 22 nt, Human
uucagauguggcuuugucaggc

SEQ ID NO: 211070 - RNA, 22 nt, Human
aauucaaucuaagaaaugauca

SEQ ID NO: 211071 - RNA, 22 nt, Human
uuacaacagacacauauucuaa

SEQ ID NO: 211072 - RNA, 22 nt, Human
aaguaccucauaggguuauuuu

SEQ ID NO: 211073 - RNA, 20 nt, Human
cccagagguugcggcaggag

SEQ ID NO: 211074 - RNA, 22 nt, Human
ucuggcuguuuuagaugagcuc

SEQ ID NO: 211075 - RNA, 22 nt, Human
gggccugauuagcaggcuagcu

SEQ ID NO: 211076 - RNA, 22 nt, Human
guuagugugacugaggaaugca

SEQ ID NO: 211077 - RNA, 18 nt, Human
acaggcugugggaauggu

SEQ ID NO: 211078 - RNA, 22 nt, Human
ggagaagggccaauuccaugua

SEQ ID NO: 211079 - RNA, 22 nt, Human
gacagcagggaaaguccagacc

SEQ ID NO: 211080 - RNA, 22 nt, Human
augaggcagaaaaaagucggag

SEQ ID NO: 211081 - RNA, 22 nt, Human
gucaguaggaaccuagggucaa

SEQ ID NO: 211082 - RNA, 22 nt, Human
uguauguauguauguauuuggg

SEQ ID NO: 211083 - RNA, 22 nt, Human
uuauugacugaucagagaggga

SEQ ID NO: 211084 - RNA, 22 nt, Human
gcccaggaaauaaaagugggcu

SEQ ID NO: 211085 - RNA, 23 nt, Human
aggucuggacccuuggccccugc

SEQ ID NO: 211086 - RNA, 22 nt, Human
agggaagaagcugguaguaggu

SEQ ID NO: 211087 - RNA, 22 nt, Human
uucacagugccagggggcaggc

SEQ ID NO: 211088 - RNA, 22 nt, Human
ucucugagaagcugaggcuggg

SEQ ID NO: 211089 - RNA, 22 nt, Human
ugcugggcggugggcucauccc

SEQ ID NO: 211090 - RNA, 22 nt, Human
ccugggcuuucaaaaccagccu

SEQ ID NO: 211091 - RNA, 22 nt, Human
auggcagcagggcuugauuaug

SEQ ID NO: 211092 - RNA, 22 nt, Human
gccagccagaguggcugugugu

SEQ ID NO: 211093 - RNA, 22 nt, Human
ugcauuuaguuaugagaaaaac

SEQ ID NO: 211094 - RNA, 22 nt, Human
aaggugggcagaucacaagguc

SEQ ID NO: 211095 - RNA, 22 nt, Human
aaggccagccuuggaacccuga

SEQ ID NO: 211096 - RNA, 22 nt, Human
uggcugggagcuggaacugggc

SEQ ID NO: 211097 - RNA, 22 nt, Human
caggaagcaagugauuuucuug

SEQ ID NO: 211098 - RNA, 22 nt, Human
acaaauuuauugaagggcauau

SEQ ID NO: 211099 - RNA, 23 nt, Human
ucuggaugccaccacauacuaac

SEQ ID NO: 211100 - RNA, 22 nt, Human
cucuccagccacagaagcugcu

SEQ ID NO: 211101 - RNA, 22 nt, Human
gcagcuaccacccaggaaggac

SEQ ID NO: 211102 - RNA, 20 nt, Human
ggaaggcuugaaguuuacau

SEQ ID NO: 211103 - RNA, 22 nt, Human
gcagagcucuguucuuaucucc

SEQ ID NO: 211104 - RNA, 22 nt, Human
aacuuucuuucacagaaguauc

SEQ ID NO: 211105 - RNA, 22 nt, Human
cugaaaggcaguggguagugug

SEQ ID NO: 211106 - RNA, 22 nt, Human
gggagccagagucaccuagaga

SEQ ID NO: 211107 - RNA, 22 nt, Human
ucaggcugggcuccucucccca

SEQ ID NO: 211108 - RNA, 23 nt, Human
cacaccaggagccgucugggcca

SEQ ID NO: 211109 - RNA, 22 nt, Human
ccucagaccccacagggccugu

SEQ ID NO: 211110 - RNA, 22 nt, Human
gcccaggaaaugccccguggug

SEQ ID NO: 211111 - RNA, 22 nt, Human
ucugagcuuucuugugcucaag

SEQ ID NO: 211112 - RNA, 22 nt, Human
ucccaggcugggggccugaagu

SEQ ID NO: 211113 - RNA, 22 nt, Human
ggaugacaaggaaagcaaacca

SEQ ID NO: 211114 - RNA, 22 nt, Human
ccagggucucugcugccugaga

SEQ ID NO: 211115 - RNA, 22 nt, Human
agugcugaggaaggggcccauu

SEQ ID NO: 211116 - RNA, 22 nt, Human
ucucuuaauaaguaaauacuga

SEQ ID NO: 211117 - RNA, 22 nt, Human
aaggcaaugagggagauagagu

SEQ ID NO: 211118 - RNA, 22 nt, Human
gacaccaggaauaguucugucu

SEQ ID NO: 211119 - RNA, 22 nt, Human
ggucuuuucacagugguuugag

SEQ ID NO: 211120 - RNA, 22 nt, Human
uucaguguggugcacaguuuug

SEQ ID NO: 211121 - RNA, 22 nt, Human
augauucuuuuggauagaugau

SEQ ID NO: 211122 - RNA, 22 nt, Human
ccugccagauccccugagcuga

SEQ ID NO: 211123 - RNA, 22 nt, Human
gcagagcagcaaauggaaagga

SEQ ID NO: 211124 - RNA, 21 nt, Human
ccugugcuaucagcuuggguu

SEQ ID NO: 211125 - RNA, 22 nt, Human
cagagacagaaaauggaucuag

SEQ ID NO: 211126 - RNA, 22 nt, Human
auguucuuucagccagugcauc

SEQ ID NO: 211127 - RNA, 22 nt, Human
aguuuuugagaauuuacuaugu

SEQ ID NO: 211128 - RNA, 22 nt, Human
gccuuggagaucacugcucaug

SEQ ID NO: 211129 - RNA, 20 nt, Human
uggcccaguggggcagggug

SEQ ID NO: 211130 - RNA, 22 nt, Human
agccugggguuucaguuugcac

SEQ ID NO: 211131 - RNA, 22 nt, Human
ccggucccaggugccccgguga

SEQ ID NO: 211132 - RNA, 22 nt, Human
aguaaacaguuucuuagaagaa

SEQ ID NO: 211133 - RNA, 22 nt, Human
gaaaaggccuggggcaaagugu

SEQ ID NO: 211134 - RNA, 22 nt, Human
gugggugucaguaucuuuaacg

SEQ ID NO: 211135 - RNA, 22 nt, Human
aggccucauaguagaccugccc

SEQ ID NO: 211136 - RNA, 22 nt, Human
ucugaacagaaaagaugcacaa

SEQ ID NO: 211137 - RNA, 22 nt, Human
uuuauucagcagcagcaguggu

SEQ ID NO: 211138 - RNA, 22 nt, Human
ggaauguuuuagcuugacuuuu

SEQ ID NO: 211139 - RNA, 22 nt, Human
aauacagugaaagugagcaagg

SEQ ID NO: 211140 - RNA, 22 nt, Human
uggcagaguaggauggcccugu

SEQ ID NO: 211141 - RNA, 22 nt, Human
guuauucaacuugugucucuua

SEQ ID NO: 211142 - RNA, 22 nt, Human
acucuggcacuggguaccucag

SEQ ID NO: 211143 - RNA, 22 nt, Human
gccagagguucaacaacugucu

SEQ ID NO: 211144 - RNA, 22 nt, Human
uaguaacagcagcuucccugug

SEQ ID NO: 211145 - RNA, 22 nt, Human
gcucuguaaagaagagaaaugc

SEQ ID NO: 211146 - RNA, 22 nt, Human
uuuuggaaucugggaaaacagu

SEQ ID NO: 211147 - RNA, 22 nt, Human
auugcuugaauuaccauguaau

SEQ ID NO: 211148 - RNA, 22 nt, Human
agcagcaguguguggucauguu

SEQ ID NO: 211149 - RNA, 22 nt, Human
agaaagggagagccagcacacg

SEQ ID NO: 211150 - RNA, 21 nt, Human
ggccacaguuagggcucagga

SEQ ID NO: 211151 - RNA, 22 nt, Human
agucuucugcucugucacuaac

SEQ ID NO: 211152 - RNA, 22 nt, Human
ucauguuaucagacacagagua

SEQ ID NO: 211153 - RNA, 22 nt, Human
cuuauugaaagccccugugccu

SEQ ID NO: 211154 - RNA, 22 nt, Human
aaucuagagugcuaggucugug

SEQ ID NO: 211155 - RNA, 22 nt, Human
acuuuagaaaagcauccauaga

SEQ ID NO: 211156 - RNA, 22 nt, Human
gcacagugaugucagaauugga

SEQ ID NO: 211157 - RNA, 22 nt, Human
gggcucagacaucccuccugga

SEQ ID NO: 211158 - RNA, 22 nt, Human
ugaggaagaacaagaauuuaga

SEQ ID NO: 211159 - RNA, 22 nt, Human
ccagccccgggaaccuggccgu

SEQ ID NO: 211160 - RNA, 22 nt, Human
aaacacaagauggccucuucug

SEQ ID NO: 211161 - RNA, 20 nt, Human
uguuucuuuuaaugagcggc

SEQ ID NO: 211162 - RNA, 22 nt, Human
ggaaaaggccauuguuucucug

SEQ ID NO: 211163 - RNA, 22 nt, Human
uauuuauauucugccuucugcu

SEQ ID NO: 211164 - RNA, 22 nt, Human
aagcccuuuucaagauacaaca

SEQ ID NO: 211165 - RNA, 22 nt, Human
auaaacagaguaguugcuacug

SEQ ID NO: 211166 - RNA, 22 nt, Human
gguggcacacuggggagcucgg

SEQ ID NO: 211167 - RNA, 22 nt, Human
aauccaauccuacucagaaagu

SEQ ID NO: 211168 - RNA, 22 nt, Human
gccaccaggagcccaguccaaa

SEQ ID NO: 211169 - RNA, 22 nt, Human
aaaggacucagacugaagggag

SEQ ID NO: 211170 - RNA, 22 nt, Human
agggugagggucuggccuugag

SEQ ID NO: 211171 - RNA, 22 nt, Human
gcccacaguacgaggcucaggc

SEQ ID NO: 211172 - RNA, 21 nt, Human
ugaggaugugcagcagcagga

SEQ ID NO: 211173 - RNA, 22 nt, Human
uccuggcagcccgcaggugcug

SEQ ID NO: 211174 - RNA, 22 nt, Human
gaggcugcuuugaugacaggag

SEQ ID NO: 211175 - RNA, 22 nt, Human
uauuggaagugaacaccaggcu

SEQ ID NO: 211176 - RNA, 20 nt, Human
ucccagucagccagagugag

SEQ ID NO: 211177 - RNA, 22 nt, Human
cuugauuucagccuugugauau

SEQ ID NO: 211178 - RNA, 22 nt, Human
gugagucugugggugggaacug

SEQ ID NO: 211179 - RNA, 22 nt, Human
aagugaugcuacgacuuugaca

SEQ ID NO: 211180 - RNA, 21 nt, Human
uuacagcaauguuagcaggaa

SEQ ID NO: 211181 - RNA, 22 nt, Human
caagagcuacccugugccauau

SEQ ID NO: 211182 - RNA, 22 nt, Human
ugagugcuggcuaaauagaaaa

SEQ ID NO: 211183 - RNA, 22 nt, Human
ucagggccacgcggaggugacg

SEQ ID NO: 211184 - RNA, 22 nt, Human
uaugugucuuuaucuggcucuu

SEQ ID NO: 211185 - RNA, 22 nt, Human
ccugaggcuggcccuuccaucc

SEQ ID NO: 211186 - RNA, 22 nt, Human
guuuagaaugaaacuuuugagc

SEQ ID NO: 211187 - RNA, 22 nt, Human
agggaauggaugauggcagguu

SEQ ID NO: 211188 - RNA, 22 nt, Human
agugcaaaauucagaagcaauu

SEQ ID NO: 211189 - RNA, 22 nt, Human
ucaggcagagcuguggagcucu

SEQ ID NO: 211190 - RNA, 22 nt, Human
cauuuccagcuccugcaucaug

SEQ ID NO: 211191 - RNA, 22 nt, Human
accaggaguugggggugggacc

SEQ ID NO: 211192 - RNA, 22 nt, Human
uucuucagcuucuaccugcguc

SEQ ID NO: 211193 - RNA, 23 nt, Human
ugagucuacucaccacaacuggg

SEQ ID NO: 211194 - RNA, 22 nt, Human
ucuuucccgccagagcaugagu

SEQ ID NO: 211195 - RNA, 22 nt, Human
auuuaagaggcugcuagaguau

SEQ ID NO: 211196 - RNA, 22 nt, Human
aggcagaauguuggaaaggaag

SEQ ID NO: 211197 - RNA, 22 nt, Human
guauucuugguuaucaaaauac

SEQ ID NO: 211198 - RNA, 22 nt, Human
ucagagaaaugcugagcucaug

SEQ ID NO: 211199 - RNA, 22 nt, Human
aaguuauaucaucucauugacg

SEQ ID NO: 211200 - RNA, 22 nt, Human
agcccugcugccugaauuagcu

SEQ ID NO: 211201 - RNA, 22 nt, Human
acaguucaagucuuagacaaca

SEQ ID NO: 211202 - RNA, 22 nt, Human
gagcacaguaaagcagugucac

SEQ ID NO: 211203 - RNA, 22 nt, Human
gccagccccuuagggcucuccc

SEQ ID NO: 211204 - RNA, 22 nt, Human
cagcagccucuugugccugugg

SEQ ID NO: 211205 - RNA, 22 nt, Human
acugagcugugacaaugcuuaa

SEQ ID NO: 211206 - RNA, 22 nt, Human
uuugaaauguaucaguauaggu

SEQ ID NO: 211207 - RNA, 22 nt, Human
gcagcccaagccugagcauccu

SEQ ID NO: 211208 - RNA, 22 nt, Human
ggaagccaugagggacaguucu

SEQ ID NO: 211209 - RNA, 22 nt, Human
acacaagaauaaugaugaaggu

SEQ ID NO: 211210 - RNA, 22 nt, Human
uuacauguggagucugauugca

SEQ ID NO: 211211 - RNA, 22 nt, Human
ugggagcaguugugaagcucag

SEQ ID NO: 211212 - RNA, 22 nt, Human
auacacuuccaaauauugauua

SEQ ID NO: 211213 - RNA, 22 nt, Human
ccagaaagaaugaacugaaccc

SEQ ID NO: 211214 - RNA, 22 nt, Human
cuccucccaauugccaagugcu

SEQ ID NO: 211215 - RNA, 22 nt, Human
uccaggcagcccuuccugacuc

SEQ ID NO: 211216 - RNA, 22 nt, Human
guuauaaaugacugcaaaaguu

SEQ ID NO: 211217 - RNA, 22 nt, Human
ggcugcucaaggacucugaucg

SEQ ID NO: 211218 - RNA, 22 nt, Human
aagucacauucugagguauugg

SEQ ID NO: 211219 - RNA, 22 nt, Human
gggcagugacaaaggggaugaa

SEQ ID NO: 211220 - RNA, 22 nt, Human
gcugagaguccaggaaaacauc

SEQ ID NO: 211221 - RNA, 22 nt, Human
ucugccaguauucacggcccgu

SEQ ID NO: 211222 - RNA, 22 nt, Human
ugcaauacauacuuagacccag

SEQ ID NO: 211223 - RNA, 17 nt, Human
ccugagugggagaggaa

SEQ ID NO: 211224 - RNA, 22 nt, Human
uggaauuaauaggggauauaca

SEQ ID NO: 211225 - RNA, 22 nt, Human
uuccuggcauuaugggaggcug

SEQ ID NO: 211226 - RNA, 22 nt, Human
ccaggagcuauguacacacuau

SEQ ID NO: 211227 - RNA, 22 nt, Human
cagucuccaaaucagucugaau

SEQ ID NO: 211228 - RNA, 22 nt, Human
cauccagugggacagagaaacc

SEQ ID NO: 211229 - RNA, 22 nt, Human
uaugagaacaagaacaaucucc

SEQ ID NO: 211230 - RNA, 22 nt, Human
uuuacagucucuauagucaaaa

SEQ ID NO: 211231 - RNA, 22 nt, Human
agccaggauuggcugagccuua

SEQ ID NO: 211232 - RNA, 22 nt, Human
cgugacagggucuggcugguca

SEQ ID NO: 211233 - RNA, 22 nt, Human
agcagggacugagccaguggga

SEQ ID NO: 211234 - RNA, 21 nt, Human
acagcuggugcagggcgggga

SEQ ID NO: 211235 - RNA, 22 nt, Human
uuucauuggcucccugaugaau

SEQ ID NO: 211236 - RNA, 22 nt, Human
uagggcagauucgguggaguuu

SEQ ID NO: 211237 - RNA, 22 nt, Human
cucaggcucauaucccaucagc

SEQ ID NO: 211238 - RNA, 22 nt, Human
gcuaucuucauggaaauacagg

SEQ ID NO: 211239 - RNA, 22 nt, Human
ugacuugucucuuugggagaca

SEQ ID NO: 211240 - RNA, 22 nt, Human
aaaugguagguuuucuuaagaa

SEQ ID NO: 211241 - RNA, 22 nt, Human
agcaaguaguaccaaguagcuc

SEQ ID NO: 211242 - RNA, 22 nt, Human
cuuaggaacgcucugccuagug

SEQ ID NO: 211243 - RNA, 18 nt, Human
acauuucuaugcuucugg

SEQ ID NO: 211244 - RNA, 22 nt, Human
agaugccugccaguuauuuagc

SEQ ID NO: 211245 - RNA, 22 nt, Human
uuccuucugaagccuuuguguu

SEQ ID NO: 211246 - RNA, 22 nt, Human
cuuguuuaaauaagauagcagu

SEQ ID NO: 211247 - RNA, 22 nt, Human
gacagguguguguauauuaggg

SEQ ID NO: 211248 - RNA, 22 nt, Human
ccuggcucauuaugugccccca

SEQ ID NO: 211249 - RNA, 22 nt, Human
ggacagagggcaggagcccaga

SEQ ID NO: 211250 - RNA, 22 nt, Human
ccauucugccaugcuucaucua

SEQ ID NO: 211251 - RNA, 22 nt, Human
aagcccuggauuaaagaugcca

SEQ ID NO: 211252 - RNA, 22 nt, Human
guccagggaaauagcgacaggg

SEQ ID NO: 211253 - RNA, 22 nt, Human
gacagaguuguugauguaugcu

SEQ ID NO: 211254 - RNA, 22 nt, Human
caagauguuaaaaccacccuug

SEQ ID NO: 211255 - RNA, 22 nt, Human
caggcuccauuaaucauccugc

SEQ ID NO: 211256 - RNA, 22 nt, Human
ugugggaugguuuugccagaau

SEQ ID NO: 211257 - RNA, 22 nt, Human
ucucuggggccuuucuacauca

SEQ ID NO: 211258 - RNA, 22 nt, Human
gccuguuuuugcuucguuuaag

SEQ ID NO: 211259 - RNA, 22 nt, Human
uaaugucagcauaguuuauuuu

SEQ ID NO: 211260 - RNA, 22 nt, Human
agaauuagaggccauguacuug

SEQ ID NO: 211261 - RNA, 22 nt, Human
cuugcuucauuagugucuuagu

SEQ ID NO: 211262 - RNA, 22 nt, Human
augcccugcugcuggggcagug

SEQ ID NO: 211263 - RNA, 22 nt, Human
gacaagauuuagagucugcuaa

SEQ ID NO: 211264 - RNA, 22 nt, Human
aucuucugggcagugaaaauug

SEQ ID NO: 211265 - RNA, 22 nt, Human
uaauauauaccuuuguuaggaa

SEQ ID NO: 211266 - RNA, 22 nt, Human
ucaauucaauugaacaguuacu

SEQ ID NO: 211267 - RNA, 20 nt, Human
ucucaggccccaguuuucuu

SEQ ID NO: 211268 - RNA, 22 nt, Human
agaaggcagaugggacggagca

SEQ ID NO: 211269 - RNA, 22 nt, Human
ggugcugaauucuggaggaggc

SEQ ID NO: 211270 - RNA, 22 nt, Human
uggagaauucuauguugagggg

SEQ ID NO: 211271 - RNA, 22 nt, Human
uucauguagcuuagcagagagg

SEQ ID NO: 211272 - RNA, 22 nt, Human
ugccagucucacccuggguccu

SEQ ID NO: 211273 - RNA, 22 nt, Human
uugcaaaagccgaggcacucca

SEQ ID NO: 211274 - RNA, 22 nt, Human
auuucauagauuguaaaucccu

SEQ ID NO: 211275 - RNA, 22 nt, Human
gcagccaagaccccaagaacug

SEQ ID NO: 211276 - RNA, 22 nt, Human
cauaaucccaggcuugcauuca

SEQ ID NO: 211277 - RNA, 22 nt, Human
cugccagcuagcuccuaguuga

SEQ ID NO: 211278 - RNA, 22 nt, Human
ggccucugaggacagccuuggc

SEQ ID NO: 211279 - RNA, 22 nt, Human
agcacaggcuuuggugugaggg

SEQ ID NO: 211280 - RNA, 22 nt, Human
uggcugagaaugggaugaugcc

SEQ ID NO: 211281 - RNA, 22 nt, Human
agugugagcccuggaguggugc

SEQ ID NO: 211282 - RNA, 22 nt, Human
agucacaugagcacuaauuagg

SEQ ID NO: 211283 - RNA, 22 nt, Human
cucaggcugucuaauggauuag

SEQ ID NO: 211284 - RNA, 22 nt, Human
cucuggaguuagugaucugggc

SEQ ID NO: 211285 - RNA, 22 nt, Human
accacugucuacacauugacuc

SEQ ID NO: 211286 - RNA, 22 nt, Human
agggggugggaagucuagaauc

SEQ ID NO: 211287 - RNA, 22 nt, Human
cugcugugcuuguggccacccg

SEQ ID NO: 211288 - RNA, 22 nt, Human
uucuuugcccauguuuccuaag

SEQ ID NO: 211289 - RNA, 21 nt, Human
uucaucuggccguauuccagg

SEQ ID NO: 211290 - RNA, 18 nt, Human
acauuucuccuucugacc

SEQ ID NO: 211291 - RNA, 22 nt, Human
auccaaagaaugcuuagaccug

SEQ ID NO: 211292 - RNA, 22 nt, Human
gaagcuggcugaaguucagcua

SEQ ID NO: 211293 - RNA, 23 nt, Human
agggcugaugccauugcagcucu

SEQ ID NO: 211294 - RNA, 22 nt, Human
aauaguacaaucuacagacaua

SEQ ID NO: 211295 - RNA, 22 nt, Human
ggaagcuguuaucaucuguauc

SEQ ID NO: 211296 - RNA, 22 nt, Human
cuuggccugcaggcagcagcgc

SEQ ID NO: 211297 - RNA, 19 nt, Human
gccaggccuggaccugcag

SEQ ID NO: 211298 - RNA, 22 nt, Human
acucuggcagcagaaccagugu

SEQ ID NO: 211299 - RNA, 22 nt, Human
ucucugcaucccagggcucagc

SEQ ID NO: 211300 - RNA, 22 nt, Human
ucaggagggugacaggcccugg

SEQ ID NO: 211301 - RNA, 19 nt, Human
uagaaagaugauggguggg

SEQ ID NO: 211302 - RNA, 23 nt, Human
aaguacauauauuuagauaguga

SEQ ID NO: 211303 - RNA, 22 nt, Human
cugcaggacugaaagaugaggu

SEQ ID NO: 211304 - RNA, 22 nt, Human
gcaaggagcaccuuucuggaac

SEQ ID NO: 211305 - RNA, 22 nt, Human
acagaccucuagauuacauuug

SEQ ID NO: 211306 - RNA, 22 nt, Human
cagcagguggacacacucaccu

SEQ ID NO: 211307 - RNA, 22 nt, Human
ccuugagaggaaguuuguagaa

SEQ ID NO: 211308 - RNA, 22 nt, Human
gcucagaggcacgaccucuugg

SEQ ID NO: 211309 - RNA, 22 nt, Human
uuugugauuaauuuucaaccuc

SEQ ID NO: 211310 - RNA, 22 nt, Human
ggaaggcuuugaggggugcugg

SEQ ID NO: 211311 - RNA, 22 nt, Human
ugggaugucuuuaggggaagag

SEQ ID NO: 211312 - RNA, 22 nt, Human
agggcuccaggggcugggugac

SEQ ID NO: 211313 - RNA, 22 nt, Human
auguuucucacuguuucucuau

SEQ ID NO: 211314 - RNA, 22 nt, Human
cucuccaggagcucagagucua

SEQ ID NO: 211315 - RNA, 16 nt, Human
ucuuaguuguguggua

SEQ ID NO: 211316 - RNA, 22 nt, Human
uagguagaaauagauauuggua

SEQ ID NO: 211317 - RNA, 22 nt, Human
cugaggcuggggaagggaagug

SEQ ID NO: 211318 - RNA, 22 nt, Human
gugcaaaaguacuugcggauuu

SEQ ID NO: 211319 - RNA, 22 nt, Human
guuacaauguccuuacaugaaa

SEQ ID NO: 211320 - RNA, 22 nt, Human
aggguccauguuuccaguuaau

SEQ ID NO: 211321 - RNA, 22 nt, Human
acagguggagugguuagcaggc

SEQ ID NO: 211322 - RNA, 22 nt, Human
uggccuuccuggugacucauga

SEQ ID NO: 211323 - RNA, 20 nt, Human
cuccaaggcuugcaggaggc

SEQ ID NO: 211324 - RNA, 22 nt, Human
uauacauguuuuacauaaguga

SEQ ID NO: 211325 - RNA, 21 nt, Human
ugacuaauugugauaaagugc

SEQ ID NO: 211326 - RNA, 22 nt, Human
augcuuuuaacuccuuuauccc

SEQ ID NO: 211327 - RNA, 22 nt, Human
gcagagaaaguuuuguccucag

SEQ ID NO: 211328 - RNA, 22 nt, Human
cuuuagaauuucauguuugguc

SEQ ID NO: 211329 - RNA, 22 nt, Human
uucaggauggaguaccuuuuau

SEQ ID NO: 211330 - RNA, 22 nt, Human
aaggcuccgugacuggggcuga

SEQ ID NO: 211331 - RNA, 22 nt, Human
augaagauacaggcagggccau

SEQ ID NO: 211332 - RNA, 22 nt, Human
uuguacagggaaguaauacaag

SEQ ID NO: 211333 - RNA, 22 nt, Human
aaugauacauauguaucguuag

SEQ ID NO: 211334 - RNA, 22 nt, Human
gccugagaucagccaagccccu

SEQ ID NO: 211335 - RNA, 22 nt, Human
aggcaggauugcugacaacaau

SEQ ID NO: 211336 - RNA, 22 nt, Human
cugggccugguagggcuugaaa

SEQ ID NO: 211337 - RNA, 22 nt, Human
aaggcagcccuggcucagccug

SEQ ID NO: 211338 - RNA, 22 nt, Human
guuucuuagguaaauucuuuga

SEQ ID NO: 211339 - RNA, 22 nt, Human
acauggcaaaagggacuuuaca

SEQ ID NO: 211340 - RNA, 22 nt, Human
uuggaggaugucggcauauuua

SEQ ID NO: 211341 - RNA, 22 nt, Human
cugugcccagcucccugacugc

SEQ ID NO: 211342 - RNA, 22 nt, Human
aaaggcuucuauuggacguugc

SEQ ID NO: 211343 - RNA, 22 nt, Human
uuuuccuauaugcaaagaaugc

SEQ ID NO: 211344 - RNA, 22 nt, Human
gcucugagugaucagcugggaa

SEQ ID NO: 211345 - RNA, 22 nt, Human
caucaaaguugguauauuugca

SEQ ID NO: 211346 - RNA, 22 nt, Human
cucugagcuuugcagccccugg

SEQ ID NO: 211347 - RNA, 22 nt, Human
gcugcugggguggagaaacgcu

SEQ ID NO: 211348 - RNA, 22 nt, Human
ucuucuccaguucauccuacca

SEQ ID NO: 211349 - RNA, 22 nt, Human
cacaaggaccucagauggauga

SEQ ID NO: 211350 - RNA, 22 nt, Human
gguggauggacucucgggggcc

SEQ ID NO: 211351 - RNA, 22 nt, Human
aaggugaacugguaaugacaga

SEQ ID NO: 211352 - RNA, 22 nt, Human
caaaagcaguucuaucugaguu

SEQ ID NO: 211353 - RNA, 17 nt, Human
guccugggaggagagag

SEQ ID NO: 211354 - RNA, 22 nt, Human
ucuucccagaggaggugccagc

SEQ ID NO: 211355 - RNA, 22 nt, Human
aaagacacacagccagcaagug

SEQ ID NO: 211356 - RNA, 22 nt, Human
ugggcucuagacuuuagugugg

SEQ ID NO: 211357 - RNA, 22 nt, Human
ugcagggcagauaugacuguag

SEQ ID NO: 211358 - RNA, 22 nt, Human
uauguguuugacacccugcaag

SEQ ID NO: 211359 - RNA, 22 nt, Human
gugucccagcagcacauuggcu

SEQ ID NO: 211360 - RNA, 21 nt, Human
accuuagagagaaagccauca

SEQ ID NO: 211361 - RNA, 22 nt, Human
ucucaguguuguucugcagaug

SEQ ID NO: 211362 - RNA, 22 nt, Human
ggucagguagcucugacaggcc

SEQ ID NO: 211363 - RNA, 22 nt, Human
uugggcagggaaaggacaggca

SEQ ID NO: 211364 - RNA, 22 nt, Human
ugagaacuugugcuauugcaca

SEQ ID NO: 211365 - RNA, 22 nt, Human
uggcucuggagcuccugggccc

SEQ ID NO: 211366 - RNA, 22 nt, Human
ugcccagcgcccacauucuguc

SEQ ID NO: 211367 - RNA, 22 nt, Human
agacaaagacagcaucucaggu

SEQ ID NO: 211368 - RNA, 22 nt, Human
gucagcaaggugcaagcggcug

SEQ ID NO: 211369 - RNA, 22 nt, Human
uggcuucugucccugcuacauu

SEQ ID NO: 211370 - RNA, 22 nt, Human
aaacaugcauucaagaaaaucu

SEQ ID NO: 211371 - RNA, 22 nt, Human
ccaggcuccgcauagaccccac

SEQ ID NO: 211372 - RNA, 22 nt, Human
auagauguguguaaguacauaa

SEQ ID NO: 211373 - RNA, 22 nt, Human
uguguccucacuguaugcaagg

SEQ ID NO: 211374 - RNA, 22 nt, Human
uaccaugucuucaauaagucua

SEQ ID NO: 211375 - RNA, 22 nt, Human
uaauuauaacaguuacaucuua

SEQ ID NO: 211376 - RNA, 22 nt, Human
cuuagcuagugcucagcuguca

SEQ ID NO: 211377 - RNA, 22 nt, Human
aguaggcauuuaauaaacauga

SEQ ID NO: 211378 - RNA, 22 nt, Human
accugagaaugggggcaugugu

SEQ ID NO: 211379 - RNA, 22 nt, Human
aagcccuguaaauugcccuuaa

SEQ ID NO: 211380 - RNA, 22 nt, Human
gcagacucugagagugagugcc

SEQ ID NO: 211381 - RNA, 22 nt, Human
ccagagaaccaucugcuugagg

SEQ ID NO: 211382 - RNA, 22 nt, Human
gucugcccugagcucccagugc

SEQ ID NO: 211383 - RNA, 23 nt, Human
aagucagagccaagucaaugaga

SEQ ID NO: 211384 - RNA, 22 nt, Human
aaacugcaggucaugacccauu

SEQ ID NO: 211385 - RNA, 22 nt, Human
augagaaaguuaaucaucauga

SEQ ID NO: 211386 - RNA, 22 nt, Human
cuggaaaggguccucauucugu

SEQ ID NO: 211387 - RNA, 22 nt, Human
gagcugaacaucauggaaaggc

SEQ ID NO: 211388 - RNA, 22 nt, Human
aaguacaaucuuucuguaaagg

SEQ ID NO: 211389 - RNA, 22 nt, Human
cauuagaagguuuuaaaggaau

SEQ ID NO: 211390 - RNA, 22 nt, Human
ucucagagaaaugugucaccau

SEQ ID NO: 211391 - RNA, 22 nt, Human
gcaucuuucuguccauucagca

SEQ ID NO: 211392 - RNA, 22 nt, Human
uguuacuauuaguuugagcaua

SEQ ID NO: 211393 - RNA, 22 nt, Human
auugcaaagaaauacaugcuua

SEQ ID NO: 211394 - RNA, 22 nt, Human
gcccuucauuuauaguuggaau

SEQ ID NO: 211395 - RNA, 22 nt, Human
agaggaacccagacagggcuuu

SEQ ID NO: 211396 - RNA, 22 nt, Human
uuuucaagagaguguucuaugu

SEQ ID NO: 211397 - RNA, 22 nt, Human
acucacugcacuuugaaaugug

SEQ ID NO: 211398 - RNA, 22 nt, Human
gaaagugcagucagacaaggca

SEQ ID NO: 211399 - RNA, 22 nt, Human
gaaggucaccuccccucucugg

SEQ ID NO: 211400 - RNA, 23 nt, Human
ucucaggcaaaccaggacaaguu

SEQ ID NO: 211401 - RNA, 22 nt, Human
uguggaaaauuggaacguuccu

SEQ ID NO: 211402 - RNA, 22 nt, Human
uccaggaaugugugugggcuag

SEQ ID NO: 211403 - RNA, 22 nt, Human
cauggcaacaacucuuuauucc

SEQ ID NO: 211404 - RNA, 22 nt, Human
gcucuuugcacagcucugcccu

SEQ ID NO: 211405 - RNA, 22 nt, Human
ugcuuucaaaggcuuucuagau

SEQ ID NO: 211406 - RNA, 21 nt, Human
agcuguggcgaggggaacaug

SEQ ID NO: 211407 - RNA, 22 nt, Human
uagaaaucuuguuacuaugugu

SEQ ID NO: 211408 - RNA, 22 nt, Human
guuuacauauuuuaauugguga

SEQ ID NO: 211409 - RNA, 22 nt, Human
ggccucagaccggagcuggcca

SEQ ID NO: 211410 - RNA, 19 nt, Human
uguguccuagcagccaguc

SEQ ID NO: 211411 - RNA, 22 nt, Human
guugccuucuaugauucucagu

SEQ ID NO: 211412 - RNA, 22 nt, Human
gaggccagaaugagcugaaugc

SEQ ID NO: 211413 - RNA, 22 nt, Human
uacacuaauagccacacuaaug

SEQ ID NO: 211414 - RNA, 22 nt, Human
ucagggcacugucaccugauau

SEQ ID NO: 211415 - RNA, 22 nt, Human
ucucagagaugucaagagucua

SEQ ID NO: 211416 - RNA, 22 nt, Human
ugccucuuggagccuuuccucu

SEQ ID NO: 211417 - RNA, 20 nt, Human
aacacagauaccaaagguug

SEQ ID NO: 211418 - RNA, 20 nt, Human
cccagagccauagccagaca

SEQ ID NO: 211419 - RNA, 22 nt, Human
cuguaaaaugaaccuagucauc

SEQ ID NO: 211420 - RNA, 22 nt, Human
aguauacaguaaugacauaucu

SEQ ID NO: 211421 - RNA, 22 nt, Human
uggggugggcaugcgcuguccu

SEQ ID NO: 211422 - RNA, 22 nt, Human
ucacagagaaauguggcacaaa

SEQ ID NO: 211423 - RNA, 22 nt, Human
gagggguguggagccaucaguu

SEQ ID NO: 211424 - RNA, 22 nt, Human
auuaguguuguggcuucauggc

SEQ ID NO: 211425 - RNA, 22 nt, Human
acucaggcuagggaaaaagugg

SEQ ID NO: 211426 - RNA, 22 nt, Human
caggagcucacugucuaauggg

SEQ ID NO: 211427 - RNA, 22 nt, Human
cacaguuucugaacacuuugca

SEQ ID NO: 211428 - RNA, 22 nt, Human
agcuuuauucaugauuucaggg

SEQ ID NO: 211429 - RNA, 22 nt, Human
aagggcugcaauccaaaacacu

SEQ ID NO: 211430 - RNA, 22 nt, Human
ucugagcuucccucugaggcag

SEQ ID NO: 211431 - RNA, 23 nt, Human
ucugggccacuugucugcacuuc

SEQ ID NO: 211432 - RNA, 22 nt, Human
cuguucuaucauuaaaagcuau

SEQ ID NO: 211433 - RNA, 22 nt, Human
aguuucaguguugacagauggu

SEQ ID NO: 211434 - RNA, 18 nt, Human
acagaggcagacauguau

SEQ ID NO: 211435 - RNA, 22 nt, Human
agggcacagccuaaagccuaug

SEQ ID NO: 211436 - RNA, 21 nt, Human
cccaggaguccuauuuaaaug

SEQ ID NO: 211437 - RNA, 22 nt, Human
uggcccaaagcagcccagcagg

SEQ ID NO: 211438 - RNA, 18 nt, Human
uggcuucuauuuuacuca

SEQ ID NO: 211439 - RNA, 22 nt, Human
cugcugggggacacagguccgg

SEQ ID NO: 211440 - RNA, 22 nt, Human
acuuuguucuaauaguaucucu

SEQ ID NO: 211441 - RNA, 22 nt, Human
gcauuagauauccuugaaguua

SEQ ID NO: 211442 - RNA, 22 nt, Human
aggaaugucauagaauaaucau

SEQ ID NO: 211443 - RNA, 23 nt, Human
cugcuguguuggucucgauggga

SEQ ID NO: 211444 - RNA, 22 nt, Human
gacucugggcugagccagggcc

SEQ ID NO: 211445 - RNA, 22 nt, Human
uggacaggugagugacucaggg

SEQ ID NO: 211446 - RNA, 22 nt, Human
cagguucuggggcuccacugug

SEQ ID NO: 211447 - RNA, 22 nt, Human
aggcccugaccugggagaucua

SEQ ID NO: 211448 - RNA, 22 nt, Human
ucuuagaaacuguaucgauuag

SEQ ID NO: 211449 - RNA, 22 nt, Human
cugcagagaugaagaagguggc

SEQ ID NO: 211450 - RNA, 22 nt, Human
acucccugcaagauuuuccaug

SEQ ID NO: 211451 - RNA, 22 nt, Human
augcaaauuaacauauaguaga

SEQ ID NO: 211452 - RNA, 21 nt, Human
gcucuccagggccagcccagg

SEQ ID NO: 211453 - RNA, 22 nt, Human
aagcagaauuuaauagaaaggu

SEQ ID NO: 211454 - RNA, 22 nt, Human
uucuagaagaacuagccaggaa

SEQ ID NO: 211455 - RNA, 22 nt, Human
gggggcagaauguacucuuguc

SEQ ID NO: 211456 - RNA, 22 nt, Human
aucaggaaagaaaagcuuggcg

SEQ ID NO: 211457 - RNA, 22 nt, Human
aagcccuguuaggcacugggga

SEQ ID NO: 211458 - RNA, 22 nt, Human
aacagugcugcauucauugagc

SEQ ID NO: 211459 - RNA, 22 nt, Human
guuuaaguuucagaagcuaaga

SEQ ID NO: 211460 - RNA, 22 nt, Human
caugucuugcccugauuaguag

SEQ ID NO: 211461 - RNA, 22 nt, Human
acagcaggagccuucauaugcu

SEQ ID NO: 211462 - RNA, 22 nt, Human
ugaagcaaauuuuucucagagu

SEQ ID NO: 211463 - RNA, 22 nt, Human
uguccucacaugguggggagag

SEQ ID NO: 211464 - RNA, 22 nt, Human
acaauacucaugcucuuuuucu

SEQ ID NO: 211465 - RNA, 22 nt, Human
uaaacauuuguuauucuuguuu

SEQ ID NO: 211466 - RNA, 22 nt, Human
uaagacacauuggaguagauga

SEQ ID NO: 211467 - RNA, 22 nt, Human
gggccagcaguaucggaggcau

SEQ ID NO: 211468 - RNA, 22 nt, Human
ccugcccaucccguccuuggcc

SEQ ID NO: 211469 - RNA, 22 nt, Human
gaggcugcaggcaaugcugccc

SEQ ID NO: 211470 - RNA, 22 nt, Human
uguaugcacauauauagguaca

SEQ ID NO: 211471 - RNA, 22 nt, Human
ucaagaaggagacuccacugug

SEQ ID NO: 211472 - RNA, 22 nt, Human
acauucauggguuuuacauuau

SEQ ID NO: 211473 - RNA, 22 nt, Human
guuuccugcacacguguuauau

SEQ ID NO: 211474 - RNA, 22 nt, Human
acagacuggaggagaauaguuu

SEQ ID NO: 211475 - RNA, 22 nt, Human
auuauuaggacuacugggguug

SEQ ID NO: 211476 - RNA, 22 nt, Human
uggggccugaaagguucucgcc

SEQ ID NO: 211477 - RNA, 22 nt, Human
gcuccugucaucaaacaauccu

SEQ ID NO: 211478 - RNA, 22 nt, Human
cacaugaauucacauguauuuu

SEQ ID NO: 211479 - RNA, 22 nt, Human
ucugucauaagugcugaaguau

SEQ ID NO: 211480 - RNA, 22 nt, Human
gcaguggcaccgcuggcucugg

SEQ ID NO: 211481 - RNA, 20 nt, Human
aagucacuuaagaugggcag

SEQ ID NO: 211482 - RNA, 22 nt, Human
acugccuuccaccuauggauga

SEQ ID NO: 211483 - RNA, 22 nt, Human
cuacaugaauggguguauuacu

SEQ ID NO: 211484 - RNA, 22 nt, Human
acauguggguuuuauuuugcau

SEQ ID NO: 211485 - RNA, 22 nt, Human
ggaggccaugaggcucuaggug

SEQ ID NO: 211486 - RNA, 22 nt, Human
agaacagucguggugagagaaa

SEQ ID NO: 211487 - RNA, 22 nt, Human
ugaaggaaugagggaguggguc

SEQ ID NO: 211488 - RNA, 22 nt, Human
ugcaggaaguuuccugaacuuu

SEQ ID NO: 211489 - RNA, 22 nt, Human
cuacaggcucagggagcccucu

SEQ ID NO: 211490 - RNA, 22 nt, Human
auuagagcaguaauuguggcag

SEQ ID NO: 211491 - RNA, 22 nt, Human
guaacacuggcaccgucucaca

SEQ ID NO: 211492 - RNA, 22 nt, Human
acauucauugagcaacaacaau

SEQ ID NO: 211493 - RNA, 22 nt, Human
gggaggaaaugugcagcgaauu

SEQ ID NO: 211494 - RNA, 23 nt, Human
auccaugugagaauagacuagca

SEQ ID NO: 211495 - RNA, 20 nt, Human
acauaugaaugauagagcca

SEQ ID NO: 211496 - RNA, 22 nt, Human
ugggaucuuuugagauacugug

SEQ ID NO: 211497 - RNA, 22 nt, Human
gagggcugauaaaugcgcaugg

SEQ ID NO: 211498 - RNA, 22 nt, Human
cuaaagcucaacaggcacuauu

SEQ ID NO: 211499 - RNA, 22 nt, Human
uuauuagggugguuuauguucu

SEQ ID NO: 211500 - RNA, 20 nt, Human
caacagaggggucuggagua

SEQ ID NO: 211501 - RNA, 22 nt, Human
aaaauagaugaaaggaagucug

SEQ ID NO: 211502 - RNA, 22 nt, Human
ccuggcucagcagcucuuucuc

SEQ ID NO: 211503 - RNA, 18 nt, Human
uguuuauuuuucucuuac

SEQ ID NO: 211504 - RNA, 22 nt, Human
agagaaugcagggcuucggaca

SEQ ID NO: 211505 - RNA, 18 nt, Human
ugagaggcagguagagga

SEQ ID NO: 211506 - RNA, 22 nt, Human
gagcccuuuuccuagauacugu

SEQ ID NO: 211507 - RNA, 22 nt, Human
gcacagaaaugucuacacaugu

SEQ ID NO: 211508 - RNA, 22 nt, Human
cccugggcaccaggccugguaa

SEQ ID NO: 211509 - RNA, 21 nt, Human
ucuccagugcuucugccucuu

SEQ ID NO: 211510 - RNA, 22 nt, Human
aagccuuaaauguuucuaauau

SEQ ID NO: 211511 - RNA, 21 nt, Human
gcccuaggcuaccuggagcgc

SEQ ID NO: 211512 - RNA, 15 nt, Human
gcauguguaauaggc

SEQ ID NO: 211513 - RNA, 22 nt, Human
uucucaguuucauagcugagca

SEQ ID NO: 211514 - RNA, 22 nt, Human
guggcuuccaagacuaagucac

SEQ ID NO: 211515 - RNA, 22 nt, Human
gggaugagaguagggugugaaa

SEQ ID NO: 211516 - RNA, 20 nt, Human
uucuuaaagaccucacuuug

SEQ ID NO: 211517 - RNA, 22 nt, Human
ugcuucuccauugaugcuaagu

SEQ ID NO: 211518 - RNA, 22 nt, Human
caugauaacuucauuacacaau

SEQ ID NO: 211519 - RNA, 22 nt, Human
gguggcuggaggagcugaugga

SEQ ID NO: 211520 - RNA, 22 nt, Human
cacacauggcugccagggaggu

SEQ ID NO: 211521 - RNA, 19 nt, Human
agcuguggggccuagcacc

SEQ ID NO: 211522 - RNA, 22 nt, Human
cacuggugaguccagaagucau

SEQ ID NO: 211523 - RNA, 22 nt, Human
agaugggugccuucuuucuuua

SEQ ID NO: 211524 - RNA, 20 nt, Human
gaggcccagagaggugaagc

SEQ ID NO: 211525 - RNA, 18 nt, Human
cuccuggcugauggugag

SEQ ID NO: 211526 - RNA, 22 nt, Human
uauuuuacaaaugggaaugcug

SEQ ID NO: 211527 - RNA, 22 nt, Human
ccaggagacaaagaugacugcu

SEQ ID NO: 211528 - RNA, 22 nt, Human
gggcagcuccuguggaauccac

SEQ ID NO: 211529 - RNA, 22 nt, Human
agcaguuuuagggagacacauu

SEQ ID NO: 211530 - RNA, 22 nt, Human
acucuguacucuagaggaagug

SEQ ID NO: 211531 - RNA, 22 nt, Human
aaguaccaaguuuguuugacgc

SEQ ID NO: 211532 - RNA, 22 nt, Human
gugacccaggacacuguguauc

SEQ ID NO: 211533 - RNA, 22 nt, Human
guacaaaugagaguucuguuuu

SEQ ID NO: 211534 - RNA, 22 nt, Human
uagacacaagagaaggguauaa

SEQ ID NO: 211535 - RNA, 22 nt, Human
ucagagaguuuucacuagggug

SEQ ID NO: 211536 - RNA, 23 nt, Human
cauuucugggagauuuauaaaau

SEQ ID NO: 211537 - RNA, 22 nt, Human
agaggauucacugcagaagaca

SEQ ID NO: 211538 - RNA, 22 nt, Human
uucagaaugugaccuuauuugg

SEQ ID NO: 211539 - RNA, 22 nt, Human
ccugggcuuucggcggcuuccu

SEQ ID NO: 211540 - RNA, 22 nt, Human
uccugguaggcuaugucauguc

SEQ ID NO: 211541 - RNA, 22 nt, Human
acagaaaaugccagaagggugg

SEQ ID NO: 211542 - RNA, 22 nt, Human
ggagcuccuggcagugacagag

SEQ ID NO: 211543 - RNA, 22 nt, Human
gagucuuugguaaagucugcug

SEQ ID NO: 211544 - RNA, 22 nt, Human
uuagugcuucuguccaaauaua

SEQ ID NO: 211545 - RNA, 22 nt, Human
ggauggcaggacaaggacccag

SEQ ID NO: 211546 - RNA, 20 nt, Human
ugggugagaguguuugcucu

SEQ ID NO: 211547 - RNA, 22 nt, Human
gauaaacuggaaccauugccuc

SEQ ID NO: 211548 - RNA, 19 nt, Human
cacacccaugcuugccaag

SEQ ID NO: 211549 - RNA, 21 nt, Human
uaagacaguaugaauacuuuc

SEQ ID NO: 211550 - RNA, 22 nt, Human
aaggcugaggagggccugcagg

SEQ ID NO: 211551 - RNA, 22 nt, Human
cccagacauugcagggacuggu

SEQ ID NO: 211552 - RNA, 22 nt, Human
cucugcagaggcccaaggcuga

SEQ ID NO: 211553 - RNA, 22 nt, Human
ggcagugaugucaaacagugaa

SEQ ID NO: 211554 - RNA, 20 nt, Human
ugcugcugugagcgucccug

SEQ ID NO: 211555 - RNA, 22 nt, Human
cuucaagaagacagcagagcau

SEQ ID NO: 211556 - RNA, 22 nt, Human
aguguauucagaauguagcaaa

SEQ ID NO: 211557 - RNA, 22 nt, Human
ggccuugagcagggagaaacca

SEQ ID NO: 211558 - RNA, 22 nt, Human
caguucagcuagaagaaacaaa

SEQ ID NO: 211559 - RNA, 22 nt, Human
cacagggccuggggcagcugcu

SEQ ID NO: 211560 - RNA, 22 nt, Human
gagggccuacuggacaugucag

SEQ ID NO: 211561 - RNA, 22 nt, Human
augguacaauuuucauuugugg

SEQ ID NO: 211562 - RNA, 22 nt, Human
aacacuuuuuaguaaagauuga

SEQ ID NO: 211563 - RNA, 22 nt, Human
gauucugagcugguguuuuacg

SEQ ID NO: 211564 - RNA, 22 nt, Human
agcuccuccugugccaggccag

SEQ ID NO: 211565 - RNA, 22 nt, Human
uccaucauguucacagcuauau

SEQ ID NO: 211566 - RNA, 22 nt, Human
aggcugcuuccuuacguggcug

SEQ ID NO: 211567 - RNA, 22 nt, Human
ugaggccaggaucccaggcucu

SEQ ID NO: 211568 - RNA, 22 nt, Human
uccuggcaggguggcagcgggu

SEQ ID NO: 211569 - RNA, 22 nt, Human
agcaccugcacaguggaggaaa

SEQ ID NO: 211570 - RNA, 22 nt, Human
ucaggcaguagaauugcuugaa

SEQ ID NO: 211571 - RNA, 22 nt, Human
cagugagguggauggauggccu

SEQ ID NO: 211572 - RNA, 22 nt, Human
auuucuagguucacauguguuu

SEQ ID NO: 211573 - RNA, 22 nt, Human
ugaguucucacccauucuucuu

SEQ ID NO: 211574 - RNA, 22 nt, Human
uagggauguaaacauaguaauu

SEQ ID NO: 211575 - RNA, 22 nt, Human
ugcauguuaagaaaauauugag

SEQ ID NO: 211576 - RNA, 22 nt, Human
gcacaguuaaagggucauguga

SEQ ID NO: 211577 - RNA, 22 nt, Human
aggaaagaaguacauucucaug

SEQ ID NO: 211578 - RNA, 22 nt, Human
ccugagcucaagaaggugacca

SEQ ID NO: 211579 - RNA, 23 nt, Human
uggaggaaacacaucagaagacc

SEQ ID NO: 211580 - RNA, 23 nt, Human
cagucucuccccggacagcaaaa

SEQ ID NO: 211581 - RNA, 22 nt, Human
cuucauuggcuuccauagaugc

SEQ ID NO: 211582 - RNA, 22 nt, Human
uccuccugucuaccaguuccug

SEQ ID NO: 211583 - RNA, 22 nt, Human
ccagggaugcuuucccaggacu

SEQ ID NO: 211584 - RNA, 22 nt, Human
gggggcuggacuuucccacaca

SEQ ID NO: 211585 - RNA, 22 nt, Human
auuuguuccacacauauuuacu

SEQ ID NO: 211586 - RNA, 22 nt, Human
ucaguucuaacaguuuagaaca

SEQ ID NO: 211587 - RNA, 22 nt, Human
cuguuuaaugagguguaacaac

SEQ ID NO: 211588 - RNA, 18 nt, Human
ugggccugcauccuaguc

SEQ ID NO: 211589 - RNA, 20 nt, Human
uucuucucuaguuaucuuca

SEQ ID NO: 211590 - RNA, 22 nt, Human
ucugggcucacgagucuggaca

SEQ ID NO: 211591 - RNA, 22 nt, Human
gccuggcaggccugggccagca

SEQ ID NO: 211592 - RNA, 21 nt, Human
ugggcucuuuaacccaggcac

SEQ ID NO: 211593 - RNA, 22 nt, Human
cagacagaaggaaggccaacau

SEQ ID NO: 211594 - RNA, 22 nt, Human
cacuugaaaguaaugguugugc

SEQ ID NO: 211595 - RNA, 22 nt, Human
uuagagcuacggccuuuaaaaa

SEQ ID NO: 211596 - RNA, 22 nt, Human
ugggaccugaagcagguuggca

SEQ ID NO: 211597 - RNA, 22 nt, Human
cuggggaacaauuugccacacu

SEQ ID NO: 211598 - RNA, 22 nt, Human
ugcaguggaaagacucagacuu

SEQ ID NO: 211599 - RNA, 22 nt, Human
aggaaagcuuggcaaacuaaau

SEQ ID NO: 211600 - RNA, 22 nt, Human
aaaguauguuguggcuuuuaaa

SEQ ID NO: 211601 - RNA, 18 nt, Human
auggcagaugauaagugc

SEQ ID NO: 211602 - RNA, 22 nt, Human
aaagcacuucaggagcaguuug

SEQ ID NO: 211603 - RNA, 22 nt, Human
uccugagcugacacuuggggag

SEQ ID NO: 211604 - RNA, 22 nt, Human
aucuguggccaaaagacuguug

SEQ ID NO: 211605 - RNA, 22 nt, Human
aaaacacacuggaccaauuuaa

SEQ ID NO: 211606 - RNA, 22 nt, Human
aaagagcuuuagaaaucucaga

SEQ ID NO: 211607 - RNA, 22 nt, Human
gaggcuucuguaacccuguccu

SEQ ID NO: 211608 - RNA, 22 nt, Human
gaugaaggggcuggugcccucu

SEQ ID NO: 211609 - RNA, 22 nt, Human
uuucuguaauuggccaagucac

SEQ ID NO: 211610 - RNA, 22 nt, Human
uuuccaaauaaggucacauucu

SEQ ID NO: 211611 - RNA, 22 nt, Human
uaacacuguaaaccuagauguu

SEQ ID NO: 211612 - RNA, 22 nt, Human
uuggaaauugcaagugauuugc

SEQ ID NO: 211613 - RNA, 22 nt, Human
ggcacagagcccagcuuccuag

SEQ ID NO: 211614 - RNA, 22 nt, Human
uggcacaggaucucagcggcca

SEQ ID NO: 211615 - RNA, 16 nt, Human
uccuggccccuaugga

SEQ ID NO: 211616 - RNA, 22 nt, Human
ggcucuggagcacagacgucug

SEQ ID NO: 211617 - RNA, 22 nt, Human
ucugcccugcagggagcaguaa

SEQ ID NO: 211618 - RNA, 22 nt, Human
ugggccuggagcccuggagagu

SEQ ID NO: 211619 - RNA, 22 nt, Human
cuacagagaacucagcugcccu

SEQ ID NO: 211620 - RNA, 22 nt, Human
acauuuccuaacguauacacug

SEQ ID NO: 211621 - RNA, 22 nt, Human
uugcagcugugagcuuuacacg

SEQ ID NO: 211622 - RNA, 19 nt, Human
acagcagguguggggauaa

SEQ ID NO: 211623 - RNA, 22 nt, Human
agcaggcuaaucuugcugaaca

SEQ ID NO: 211624 - RNA, 22 nt, Human
cagugcaaugcagaugacacca

SEQ ID NO: 211625 - RNA, 22 nt, Human
gcaguguuaggaauaaaaauga

SEQ ID NO: 211626 - RNA, 22 nt, Human
acaguugagaugcaacuuuggg

SEQ ID NO: 211627 - RNA, 22 nt, Human
ugagagcaacacgcaguaguau

SEQ ID NO: 211628 - RNA, 22 nt, Human
ccagcuggcacuguggcugccc

SEQ ID NO: 211629 - RNA, 22 nt, Human
acagccagaucugagagaucuu

SEQ ID NO: 211630 - RNA, 22 nt, Human
auacaguauaacuaauaaaccc

SEQ ID NO: 211631 - RNA, 22 nt, Human
uaauagaauaguggaaacauug

SEQ ID NO: 211632 - RNA, 22 nt, Human
ucugcccugccauucacuggaa

SEQ ID NO: 211633 - RNA, 22 nt, Human
caggucucucccaagcuacaau

SEQ ID NO: 211634 - RNA, 22 nt, Human
cuagaaaaauacuuuauuguga

SEQ ID NO: 211635 - RNA, 22 nt, Human
gccaggcagagccccgugcagc

SEQ ID NO: 211636 - RNA, 22 nt, Human
uggccagaaccugcaguaggcc

SEQ ID NO: 211637 - RNA, 22 nt, Human
ucacagaauaaauugagaagac

SEQ ID NO: 211638 - RNA, 22 nt, Human
uggcacagaccuuaucuucucu

SEQ ID NO: 211639 - RNA, 17 nt, Human
aaacuggggucaggagc

SEQ ID NO: 211640 - RNA, 22 nt, Human
ucccacauaugcaauccugaau

SEQ ID NO: 211641 - RNA, 22 nt, Human
aucucauuuugguuucuacuua

SEQ ID NO: 211642 - RNA, 22 nt, Human
uuuggucaaauauuauccugag

SEQ ID NO: 211643 - RNA, 22 nt, Human
agagcaaagggacauggaagag

SEQ ID NO: 211644 - RNA, 22 nt, Human
uggagggcaucuguggucaggc

SEQ ID NO: 211645 - RNA, 22 nt, Human
cugguacaguguuacaaaaugg

SEQ ID NO: 211646 - RNA, 22 nt, Human
gaauacacgaauagagcauggu

SEQ ID NO: 211647 - RNA, 22 nt, Human
uccagguaauuuggaugcuagu

SEQ ID NO: 211648 - RNA, 22 nt, Human
cugcccugcccaggccuugggc

SEQ ID NO: 211649 - RNA, 22 nt, Human
ugcuuaaacccugaucaugugu

SEQ ID NO: 211650 - RNA, 22 nt, Human
cagguguauaaacucagugacu

SEQ ID NO: 211651 - RNA, 22 nt, Human
acagaagagcacauuuaguaug

SEQ ID NO: 211652 - RNA, 22 nt, Human
uggcuggcugucaaggaaagcc

SEQ ID NO: 211653 - RNA, 22 nt, Human
aggcuuucgaugaacgcuugcu

SEQ ID NO: 211654 - RNA, 22 nt, Human
cagagggcucuuggcugccugc

SEQ ID NO: 211655 - RNA, 22 nt, Human
cauugcaggagaguaaauaaaa

SEQ ID NO: 211656 - RNA, 22 nt, Human
uauucacaugaaaacaaauuuu

SEQ ID NO: 211657 - RNA, 19 nt, Human
aaaguguuuucuuuucugu

SEQ ID NO: 211658 - RNA, 22 nt, Human
auuuuccuucuaagaggaaggu

SEQ ID NO: 211659 - RNA, 22 nt, Human
cugaccaggguagaggugagag

SEQ ID NO: 211660 - RNA, 22 nt, Human
agagcugggacuuggacucaau

SEQ ID NO: 211661 - RNA, 22 nt, Human
uucaggagaaaguucaguacuu

SEQ ID NO: 211662 - RNA, 22 nt, Human
uggcgcaguuucucugcugccu

SEQ ID NO: 211663 - RNA, 23 nt, Human
uggcacagaggaccaugcuuugc

SEQ ID NO: 211664 - RNA, 22 nt, Human
ucuccugguacccuuccuagca

SEQ ID NO: 211665 - RNA, 23 nt, Human
uggccagguagaggagguaguga

SEQ ID NO: 211666 - RNA, 23 nt, Human
uaagugauuccaaguuucaggga

SEQ ID NO: 211667 - RNA, 22 nt, Human
cuggcaggcggagguugcagug

SEQ ID NO: 211668 - RNA, 22 nt, Human
uuauugcuauggugagagggau

SEQ ID NO: 211669 - RNA, 22 nt, Human
uuugagguuagcuagcagauca

SEQ ID NO: 211670 - RNA, 22 nt, Human
uccaggcccacucagcugaaau

SEQ ID NO: 211671 - RNA, 22 nt, Human
cccuggcugcuaccagguagcu

SEQ ID NO: 211672 - RNA, 22 nt, Human
uuuauuauucuguucucucuac

SEQ ID NO: 211673 - RNA, 22 nt, Human
uucacaauaggagcaugcaaau

SEQ ID NO: 211674 - RNA, 19 nt, Human
auucagugucucugacuuc

SEQ ID NO: 211675 - RNA, 22 nt, Human
agcuguguuauuagaaaccugc

SEQ ID NO: 211676 - RNA, 22 nt, Human
ucacagcauucgcaauggacag

SEQ ID NO: 211677 - RNA, 22 nt, Human
gaggggaguguccuccgggccc

SEQ ID NO: 211678 - RNA, 22 nt, Human
aggccagcauucucucuccagg

SEQ ID NO: 211679 - RNA, 22 nt, Human
cugccccugccaggcagcuguc

SEQ ID NO: 211680 - RNA, 22 nt, Human
cugaggggauguuuuugacgga

SEQ ID NO: 211681 - RNA, 22 nt, Human
uccucagacuucccuuugugua

SEQ ID NO: 211682 - RNA, 22 nt, Human
ggcccuguuagagcucccacaa

SEQ ID NO: 211683 - RNA, 22 nt, Human
uauuucuugagacucgucuucc

SEQ ID NO: 211684 - RNA, 22 nt, Human
agguuccagggauuaggaugug

SEQ ID NO: 211685 - RNA, 22 nt, Human
ggggcagggagguuaucgccga

SEQ ID NO: 211686 - RNA, 22 nt, Human
caaaaguaauuaugguuuuugc

SEQ ID NO: 211687 - RNA, 22 nt, Human
agggcccaugugggagcacuug

SEQ ID NO: 211688 - RNA, 22 nt, Human
aguuuuaaaugauggugguggu

SEQ ID NO: 211689 - RNA, 22 nt, Human
guucucuggagucccugggccc

SEQ ID NO: 211690 - RNA, 22 nt, Human
uuugcaaacuuuccucuggacc

SEQ ID NO: 211691 - RNA, 22 nt, Human
uggccuggggaagaccaugggc

SEQ ID NO: 211692 - RNA, 22 nt, Human
guccugugugagugcaccaccu

SEQ ID NO: 211693 - RNA, 22 nt, Human
cagggcaguaccgcccucuggc

SEQ ID NO: 211694 - RNA, 22 nt, Human
ugcaggugguccuuccucugcu

SEQ ID NO: 211695 - RNA, 22 nt, Human
augcuuuagugucaaguuuggg

SEQ ID NO: 211696 - RNA, 22 nt, Human
gaaacuuucaugaauauaagau

SEQ ID NO: 211697 - RNA, 22 nt, Human
cagcugagagacaaugagucau

SEQ ID NO: 211698 - RNA, 22 nt, Human
cagcagccugccuugggagcuu

SEQ ID NO: 211699 - RNA, 22 nt, Human
aaggcucuggguuucauaggug

SEQ ID NO: 211700 - RNA, 22 nt, Human
ggcucagacucccaggcccucu

SEQ ID NO: 211701 - RNA, 22 nt, Human
aggcucaggcaggaauggcgga

SEQ ID NO: 211702 - RNA, 22 nt, Human
acuaugaauagccagauaguga

SEQ ID NO: 211703 - RNA, 23 nt, Human
acagugucugcugcaagauaucu

SEQ ID NO: 211704 - RNA, 23 nt, Human
ccucagagaggcagagccacaug

SEQ ID NO: 211705 - RNA, 22 nt, Human
ugggacucacucuuuuggccag

SEQ ID NO: 211706 - RNA, 22 nt, Human
aaugccucuuggaagaagacuu

SEQ ID NO: 211707 - RNA, 22 nt, Human
uggcaggauuugcccggaagga

SEQ ID NO: 211708 - RNA, 22 nt, Human
ugucagggcuggacacagcugc

SEQ ID NO: 211709 - RNA, 22 nt, Human
acagagagaggcccgaggcugc

SEQ ID NO: 211710 - RNA, 23 nt, Human
acccaucucuccugucaugcaga

SEQ ID NO: 211711 - RNA, 22 nt, Human
ugaaagaagccuucgaggcucg

SEQ ID NO: 211712 - RNA, 22 nt, Human
gggaaacugaauucaggacucu

SEQ ID NO: 211713 - RNA, 22 nt, Human
gcuuuaaauggcuugcccaagu

SEQ ID NO: 211714 - RNA, 22 nt, Human
gguagaaauaaucuucaggcug

SEQ ID NO: 211715 - RNA, 22 nt, Human
ugguguuggagaugguugcauu

SEQ ID NO: 211716 - RNA, 22 nt, Human
gagcagcaaagggaggguaaau

SEQ ID NO: 211717 - RNA, 22 nt, Human
aagacagaccacgugacagggc

SEQ ID NO: 211718 - RNA, 22 nt, Human
agagguagagguugcagugagc

SEQ ID NO: 211719 - RNA, 22 nt, Human
auccucaguguuucugacaucu

SEQ ID NO: 211720 - RNA, 22 nt, Human
gugggccugaugcugccaugag

SEQ ID NO: 211721 - RNA, 22 nt, Human
ugucuuuuaccuaaugagcugg

SEQ ID NO: 211722 - RNA, 22 nt, Human
ggcgccagcgguaaguaagaca

SEQ ID NO: 211723 - RNA, 22 nt, Human
augauauuugcaaugugcuugc

SEQ ID NO: 211724 - RNA, 22 nt, Human
cagagcaguaaaucuggggcac

SEQ ID NO: 211725 - RNA, 18 nt, Human
uuuauauggauagagacc

SEQ ID NO: 211726 - RNA, 22 nt, Human
guuccugaagggacuggugcag

SEQ ID NO: 211727 - RNA, 22 nt, Human
auguucuucuaucuuuauuaaa

SEQ ID NO: 211728 - RNA, 22 nt, Human
uggggaugaaacccaggcaucu

SEQ ID NO: 211729 - RNA, 22 nt, Human
acagccugacuuuuguugucac

SEQ ID NO: 211730 - RNA, 22 nt, Human
uaacuuugaucacuugauaagg

SEQ ID NO: 211731 - RNA, 22 nt, Human
cuuacauacugagaaaauaucc

SEQ ID NO: 211732 - RNA, 21 nt, Human
cuacccucacucccauuccuc

SEQ ID NO: 211733 - RNA, 19 nt, Human
gagguggguccccgcagcc

SEQ ID NO: 211734 - RNA, 22 nt, Human
agguccuguccuuggucucuga

SEQ ID NO: 211735 - RNA, 22 nt, Human
agaccaagacuauaaugagagg

SEQ ID NO: 211736 - RNA, 22 nt, Human
gcugugcagguccccacugccu

SEQ ID NO: 211737 - RNA, 22 nt, Human
gauuaaguaacugaacacuuug

SEQ ID NO: 211738 - RNA, 22 nt, Human
acuaggaaggcauaugggcaga

SEQ ID NO: 211739 - RNA, 21 nt, Human
uauuuauuaauuuguaaggcu

SEQ ID NO: 211740 - RNA, 22 nt, Human
agggcuccuaugccccauggac

SEQ ID NO: 211741 - RNA, 21 nt, Human
ugcacuuugggggacaggcug

SEQ ID NO: 211742 - RNA, 22 nt, Human
guacacauuaugcuucucuaaa

SEQ ID NO: 211743 - RNA, 22 nt, Human
uucacaauagcuggcaucaucu

SEQ ID NO: 211744 - RNA, 22 nt, Human
acugugcaaugaguaauaaacu

SEQ ID NO: 211745 - RNA, 22 nt, Human
aagcaaaagguuacacuucugg

SEQ ID NO: 211746 - RNA, 22 nt, Human
aggcuucugauaccaugagaga

SEQ ID NO: 211747 - RNA, 22 nt, Human
aagagucuauuggaacuagaca

SEQ ID NO: 211748 - RNA, 22 nt, Human
aggugcugggcagcagucauug

SEQ ID NO: 211749 - RNA, 22 nt, Human
aaggucauuguugcauguucuc

SEQ ID NO: 211750 - RNA, 22 nt, Human
cuguguccauuuaucauuguca

SEQ ID NO: 211751 - RNA, 19 nt, Human
ugcuggagguugacagggu

SEQ ID NO: 211752 - RNA, 22 nt, Human
gccaggcaaauuaaggaaugca

SEQ ID NO: 211753 - RNA, 22 nt, Human
uuguucagaaauuuggacuccu

SEQ ID NO: 211754 - RNA, 22 nt, Human
uagcaaguaugauacuccauga

SEQ ID NO: 211755 - RNA, 22 nt, Human
aaugagauggaggacucuuaau

SEQ ID NO: 211756 - RNA, 22 nt, Human
aguuugauaaacaccagcuagu

SEQ ID NO: 211757 - RNA, 23 nt, Human
ugugaccccuaggaguggggacc

SEQ ID NO: 211758 - RNA, 22 nt, Human
agggcagcacaaggcauggacu

SEQ ID NO: 211759 - RNA, 22 nt, Human
ccaggucuggaaccaccagggc

SEQ ID NO: 211760 - RNA, 22 nt, Human
ugcugggcuggagcugccaggg

SEQ ID NO: 211761 - RNA, 22 nt, Human
auguggaggaaaugaguguaca

SEQ ID NO: 211762 - RNA, 22 nt, Human
ugcugaaaaguaaauaggccua

SEQ ID NO: 211763 - RNA, 22 nt, Human
ggaaaauacugauucaugccau

SEQ ID NO: 211764 - RNA, 22 nt, Human
auggcagcagcuuuagcugugg

SEQ ID NO: 211765 - RNA, 22 nt, Human
acacagauauuuugaauacaua

SEQ ID NO: 211766 - RNA, 22 nt, Human
ccacugagugagcagagcaggg

SEQ ID NO: 211767 - RNA, 22 nt, Human
aggacaguccgggguccuccac

SEQ ID NO: 211768 - RNA, 22 nt, Human
ugcugaaaacucaaccauugug

SEQ ID NO: 211769 - RNA, 22 nt, Human
gaggagcccagcaccaucacuu

SEQ ID NO: 211770 - RNA, 20 nt, Human
cagguauuacaucugcaccu

SEQ ID NO: 211771 - RNA, 22 nt, Human
gagcaggacgugggaaugggaa

SEQ ID NO: 211772 - RNA, 22 nt, Human
aaguauucuacaaagaaauuga

SEQ ID NO: 211773 - RNA, 22 nt, Human
ucugugcuagcacgcagcaagg

SEQ ID NO: 211774 - RNA, 22 nt, Human
cugggugcgugagcgcaugcgu

SEQ ID NO: 211775 - RNA, 22 nt, Human
uccugagguauaugcuuugcag

SEQ ID NO: 211776 - RNA, 21 nt, Human
aagggagauaggaaucaggcc

SEQ ID NO: 211777 - RNA, 22 nt, Human
agucacugucuugcaaagguca

SEQ ID NO: 211778 - RNA, 22 nt, Human
auggacagguacugcagugggu

SEQ ID NO: 211779 - RNA, 22 nt, Human
caggcuguggaucaggagccuu

SEQ ID NO: 211780 - RNA, 18 nt, Human
cagcugugcccuguuugg

SEQ ID NO: 211781 - RNA, 22 nt, Human
gaagcugaugaggaccagauug

SEQ ID NO: 211782 - RNA, 22 nt, Human
cagugccugucuuauucuuaca

SEQ ID NO: 211783 - RNA, 22 nt, Human
cuuuggaacuguaaggagaugg

SEQ ID NO: 211784 - RNA, 22 nt, Human
aguuuuauguucacagaaggau

SEQ ID NO: 211785 - RNA, 22 nt, Human
uggucuuugagagaaguugauu

SEQ ID NO: 211786 - RNA, 22 nt, Human
cugggcucagugucucacuccu

SEQ ID NO: 211787 - RNA, 22 nt, Human
uggcuccagauuuccugcugca

SEQ ID NO: 211788 - RNA, 22 nt, Human
uucugagauacaaaauuuacuu

SEQ ID NO: 211789 - RNA, 20 nt, Human
ucuggcaggugaacgagcug

SEQ ID NO: 211790 - RNA, 22 nt, Human
ccucuuugacaaguaccugccc

SEQ ID NO: 211791 - RNA, 22 nt, Human
ucugagugaguguaggccugac

SEQ ID NO: 211792 - RNA, 22 nt, Human
auuucucagugugaucaggccu

SEQ ID NO: 211793 - RNA, 22 nt, Human
caggccuggggcuggcuuccag

SEQ ID NO: 211794 - RNA, 21 nt, Human
uuccuccucuggagaagaaga

SEQ ID NO: 211795 - RNA, 22 nt, Human
ggcuuucugucugcgucugugu

SEQ ID NO: 211796 - RNA, 22 nt, Human
ccaggcuucugauuccaggcac

SEQ ID NO: 211797 - RNA, 22 nt, Human
aacacaaaaauucucaggggca

SEQ ID NO: 211798 - RNA, 22 nt, Human
uccuggaucagcgggggcaggc

SEQ ID NO: 211799 - RNA, 22 nt, Human
uguccucacacguagggaguaa

SEQ ID NO: 211800 - RNA, 23 nt, Human
uuguccugccgaucucugagaau

SEQ ID NO: 211801 - RNA, 22 nt, Human
uauucaaagugcgaggucaggg

SEQ ID NO: 211802 - RNA, 22 nt, Human
gucccccugaaagcagccgcag

SEQ ID NO: 211803 - RNA, 22 nt, Human
guuaaugugguagugcauaucu

SEQ ID NO: 211804 - RNA, 22 nt, Human
gggaccugccauugcucacagg

SEQ ID NO: 211805 - RNA, 22 nt, Human
gaggaguguauuccacaccacu

SEQ ID NO: 211806 - RNA, 22 nt, Human
acaauucuggguauuuauauag

SEQ ID NO: 211807 - RNA, 22 nt, Human
uccugggaugaggaaacaagga

SEQ ID NO: 211808 - RNA, 20 nt, Human
cuugguggcucugggaagug

SEQ ID NO: 211809 - RNA, 19 nt, Human
ccaaaagcaauuccaagua

SEQ ID NO: 211810 - RNA, 22 nt, Human
aggcgaagggaccagacgguag

SEQ ID NO: 211811 - RNA, 22 nt, Human
aaaggcuauucagggacuugcc

SEQ ID NO: 211812 - RNA, 22 nt, Human
aacaaugugaagugcuguucag

SEQ ID NO: 211813 - RNA, 22 nt, Human
cugcaggggcaguccacuuccu

SEQ ID NO: 211814 - RNA, 22 nt, Human
cucagaaguucagccuagagua

SEQ ID NO: 211815 - RNA, 22 nt, Human
ucagugcaucacagaacuuugu

SEQ ID NO: 211816 - RNA, 22 nt, Human
cagcuccugcagcugcugccgu

SEQ ID NO: 211817 - RNA, 22 nt, Human
agaagccacuggagguugagau

SEQ ID NO: 211818 - RNA, 22 nt, Human
gggaccagaggcugugcacaau

SEQ ID NO: 211819 - RNA, 22 nt, Human
uugcagcuguugcaaagucucu

SEQ ID NO: 211820 - RNA, 22 nt, Human
guuguacaggcagggaaacuga

SEQ ID NO: 211821 - RNA, 22 nt, Human
aagucucugacucacacaaugu

SEQ ID NO: 211822 - RNA, 22 nt, Human
uccaggaggugaggggaccaaa

SEQ ID NO: 211823 - RNA, 22 nt, Human
aagacccuauacucagugaccc

SEQ ID NO: 211824 - RNA, 22 nt, Human
ggcaggcauugcaacauguaca

SEQ ID NO: 211825 - RNA, 22 nt, Human
uaucucuguuccaagccuuauc

SEQ ID NO: 211826 - RNA, 22 nt, Human
ugauuaaaauuuaacuuaguua

SEQ ID NO: 211827 - RNA, 22 nt, Human
uuuguuaaaaugcagauucugu

SEQ ID NO: 211828 - RNA, 22 nt, Human
ucuuccagagccuccaucccua

SEQ ID NO: 211829 - RNA, 22 nt, Human
cauaacaguggcuucagcaagu

SEQ ID NO: 211830 - RNA, 22 nt, Human
aaaguucuggagaaaauaauga

SEQ ID NO: 211831 - RNA, 19 nt, Human
aggcagcauucuggggcuu

SEQ ID NO: 211832 - RNA, 20 nt, Human
agaucuuuucuauagaagug

SEQ ID NO: 211833 - RNA, 22 nt, Human
cagaagcauuccagcaaauagu

SEQ ID NO: 211834 - RNA, 22 nt, Human
aguacugucagcaggguguuga

SEQ ID NO: 211835 - RNA, 22 nt, Human
uacauguggccagaaauuugag

SEQ ID NO: 211836 - RNA, 22 nt, Human
uaggaggcuuaaagcugcucag

SEQ ID NO: 211837 - RNA, 22 nt, Human
uuuuuucagccugucugugcca

SEQ ID NO: 211838 - RNA, 22 nt, Human
ggugacgaauccauagcaucga

SEQ ID NO: 211839 - RNA, 22 nt, Human
uccuagagaguaauacaguuuu

SEQ ID NO: 211840 - RNA, 22 nt, Human
gauacauuccauuucuacuuaa

SEQ ID NO: 211841 - RNA, 22 nt, Human
uaucuacaguuaauaugucauc

SEQ ID NO: 211842 - RNA, 22 nt, Human
ugccuucacugagcuuauggga

SEQ ID NO: 211843 - RNA, 22 nt, Human
cuccuccuaaaugauucuuccu

SEQ ID NO: 211844 - RNA, 22 nt, Human
aaugacaauaaucauuaacuuu

SEQ ID NO: 211845 - RNA, 23 nt, Human
agacuggggcauaagaagauggc

SEQ ID NO: 211846 - RNA, 23 nt, Human
ucuggcuccauccuuggggaucc

SEQ ID NO: 211847 - RNA, 22 nt, Human
guggcuucugcggugugcgcag

SEQ ID NO: 211848 - RNA, 22 nt, Human
caucuugugaauuucugauucu

SEQ ID NO: 211849 - RNA, 23 nt, Human
cuacugccuugcacaggcuagau

SEQ ID NO: 211850 - RNA, 22 nt, Human
aagucagaaauuauucaggaau

SEQ ID NO: 211851 - RNA, 22 nt, Human
agccuuagagacuuaaaacagg

SEQ ID NO: 211852 - RNA, 22 nt, Human
ugguccuucuugaagagugagu

SEQ ID NO: 211853 - RNA, 22 nt, Human
ccucugaguccucccugguugc

SEQ ID NO: 211854 - RNA, 22 nt, Human
cucugggcacuguauggguucu

SEQ ID NO: 211855 - RNA, 22 nt, Human
gggcaugagagggcagcuggca

SEQ ID NO: 211856 - RNA, 22 nt, Human
agcugccccaugagaggcaggu

SEQ ID NO: 211857 - RNA, 22 nt, Human
gcaugcagaaaaugaacaacga

SEQ ID NO: 211858 - RNA, 22 nt, Human
uuacuaguauaugucaagcaac

SEQ ID NO: 211859 - RNA, 22 nt, Human
uuguuuaauccuuguacccaug

SEQ ID NO: 211860 - RNA, 22 nt, Human
gagaucuucaagguuuuagaua

SEQ ID NO: 211861 - RNA, 22 nt, Human
uagggaugcuuaguaggaccca

SEQ ID NO: 211862 - RNA, 22 nt, Human
aauuaacagagggcuuauuacu

SEQ ID NO: 211863 - RNA, 22 nt, Human
uugaaaaguuuugaaacacucu

SEQ ID NO: 211864 - RNA, 22 nt, Human
uucagugucaauuuuuaaauau

SEQ ID NO: 211865 - RNA, 22 nt, Human
cuguccccauuguuugaggguu

SEQ ID NO: 211866 - RNA, 21 nt, Human
auggaaaaacagguagagcau

SEQ ID NO: 211867 - RNA, 22 nt, Human
acaagagcauugcagguguguu

SEQ ID NO: 211868 - RNA, 22 nt, Human
ggaggccuugccugcaggcaca

SEQ ID NO: 211869 - RNA, 22 nt, Human
caggguccggcugccuggcugu

SEQ ID NO: 211870 - RNA, 22 nt, Human
aaaaaugaaacggcugguuggc

SEQ ID NO: 211871 - RNA, 22 nt, Human
cucagacccccagagcugcuaa

SEQ ID NO: 211872 - RNA, 22 nt, Human
ucuuaaaccacaaaauucagag

SEQ ID NO: 211873 - RNA, 22 nt, Human
agcuggagauucuggggacagu

SEQ ID NO: 211874 - RNA, 22 nt, Human
ucagacaguuugcagugugccu

SEQ ID NO: 211875 - RNA, 22 nt, Human
uuccuggugguggugacagcac

SEQ ID NO: 211876 - RNA, 22 nt, Human
uagcuauuuggaaaauuccaau

SEQ ID NO: 211877 - RNA, 22 nt, Human
ucaauuacuaaccaaauaaugu

SEQ ID NO: 211878 - RNA, 22 nt, Human
cuguacaucccgagagccagua

SEQ ID NO: 211879 - RNA, 22 nt, Human
uuacaaguauuuaagaugcugu

SEQ ID NO: 211880 - RNA, 22 nt, Human
uauuuguagaauggauuaaggg

SEQ ID NO: 211881 - RNA, 22 nt, Human
ugugggaagauguugcaggaga

SEQ ID NO: 211882 - RNA, 22 nt, Human
ucugucauuuuguaucuacaug

SEQ ID NO: 211883 - RNA, 22 nt, Human
agagcuggcugcugcggugcuu

SEQ ID NO: 211884 - RNA, 22 nt, Human
ccaaggagaaaugcugugcuuu

SEQ ID NO: 211885 - RNA, 22 nt, Human
cauuugugugggaacccaucag

SEQ ID NO: 211886 - RNA, 22 nt, Human
cagguccugccuugguuacccu

SEQ ID NO: 211887 - RNA, 22 nt, Human
gucaggauuauuuuauuaaaag

SEQ ID NO: 211888 - RNA, 22 nt, Human
uuggcuacaucgaggcuccagc

SEQ ID NO: 211889 - RNA, 22 nt, Human
ugauggcuaucccuggaagggc

SEQ ID NO: 211890 - RNA, 22 nt, Human
uuugacaaaggaaaaaugcaca

SEQ ID NO: 211891 - RNA, 22 nt, Human
cucuugggagugcucuggagaa

SEQ ID NO: 211892 - RNA, 22 nt, Human
cagcaacuggucauugcucucc

SEQ ID NO: 211893 - RNA, 23 nt, Human
ucuccagugucucuucauugagu

SEQ ID NO: 211894 - RNA, 22 nt, Human
uagaaagaacuucauguaaaac

SEQ ID NO: 211895 - RNA, 22 nt, Human
uuuaguucucccagucuugauu

SEQ ID NO: 211896 - RNA, 22 nt, Human
uggcagggaguugcaggauuuc

SEQ ID NO: 211897 - RNA, 22 nt, Human
uuacaguuuacauaagaauugu

SEQ ID NO: 211898 - RNA, 22 nt, Human
acauugaaagcauauuaucucc

SEQ ID NO: 211899 - RNA, 22 nt, Human
acauccagaucucagcauggcu

SEQ ID NO: 211900 - RNA, 22 nt, Human
cuuucagucaguuaacucagaa

SEQ ID NO: 211901 - RNA, 22 nt, Human
gccugcuucacggacaggccuc

SEQ ID NO: 211902 - RNA, 22 nt, Human
ggguccaguuucaucugagguu

SEQ ID NO: 211903 - RNA, 22 nt, Human
ucuuuauuuuaugcuugugcaa

SEQ ID NO: 211904 - RNA, 22 nt, Human
gcuguucauuagaaauagaaug

SEQ ID NO: 211905 - RNA, 22 nt, Human
ugcccucagccaccuccaaguu

SEQ ID NO: 211906 - RNA, 20 nt, Human
accagagcucucaguaugug

SEQ ID NO: 211907 - RNA, 22 nt, Human
cagaggcauacucccagucuug

SEQ ID NO: 211908 - RNA, 22 nt, Human
agugucaaugccaacaguauau

SEQ ID NO: 211909 - RNA, 22 nt, Human
uuuaauuguuguggguacauag

SEQ ID NO: 211910 - RNA, 22 nt, Human
agcacacaggacuugauucaug

SEQ ID NO: 211911 - RNA, 22 nt, Human
ggcgcucaguguugccccagag

SEQ ID NO: 211912 - RNA, 22 nt, Human
aggaauguguuucuaggcuguu

SEQ ID NO: 211913 - RNA, 22 nt, Human
auauuucagcuuuacuuaggaa

SEQ ID NO: 211914 - RNA, 21 nt, Human
uucuuucugaaucugaaguau

SEQ ID NO: 211915 - RNA, 22 nt, Human
ccagggugggaggcugaaggcg

SEQ ID NO: 211916 - RNA, 22 nt, Human
acuguguuaaauacagagaugg

SEQ ID NO: 211917 - RNA, 22 nt, Human
acuuaacagacauuauuuaccu

SEQ ID NO: 211918 - RNA, 22 nt, Human
gcccaguuucagcucugccuuu

SEQ ID NO: 211919 - RNA, 21 nt, Human
cuggagucauuuucugaguag

SEQ ID NO: 211920 - RNA, 22 nt, Human
gaauucugguccuguccaaggu

SEQ ID NO: 211921 - RNA, 22 nt, Human
uuucaggaaggugaggcacaug

SEQ ID NO: 211922 - RNA, 22 nt, Human
cggggcugcgcucuuccugccg

SEQ ID NO: 211923 - RNA, 22 nt, Human
uggcagguccacucacagaucu

SEQ ID NO: 211924 - RNA, 22 nt, Human
ucaacaaugggucuguaaugga

SEQ ID NO: 211925 - RNA, 22 nt, Human
guugacagaaaaauaacauagc

SEQ ID NO: 211926 - RNA, 22 nt, Human
uuuauuggauggauggauggau

SEQ ID NO: 211927 - RNA, 22 nt, Human
agaguggguuauaggcagacuu

SEQ ID NO: 211928 - RNA, 22 nt, Human
ucugcuguacuuuuggucuguu

SEQ ID NO: 211929 - RNA, 22 nt, Human
gggccccuuguaucucuggcuc

SEQ ID NO: 211930 - RNA, 22 nt, Human
uggaugagauuaaagugagguu

SEQ ID NO: 211931 - RNA, 22 nt, Human
cuagggaaggacaaccucuucc

SEQ ID NO: 211932 - RNA, 22 nt, Human
gaacucuugguggucauuagau

SEQ ID NO: 211933 - RNA, 22 nt, Human
auacagguggacuucaguuagu

SEQ ID NO: 211934 - RNA, 22 nt, Human
ccucagaggcaugguuagaaua

SEQ ID NO: 211935 - RNA, 22 nt, Human
acacagagcaaaucaugacaga

SEQ ID NO: 211936 - RNA, 22 nt, Human
cccagcucccauguucuccaau

SEQ ID NO: 211937 - RNA, 22 nt, Human
cuacacuuugguugacuuugug

SEQ ID NO: 211938 - RNA, 22 nt, Human
gggcuucucuuaugcuaacugg

SEQ ID NO: 211939 - RNA, 22 nt, Human
aguguugggucuuuagaauuua

SEQ ID NO: 211940 - RNA, 19 nt, Human
cagagccaggccuuuggcc

SEQ ID NO: 211941 - RNA, 22 nt, Human
cuguggugagcaacugacugaa

SEQ ID NO: 211942 - RNA, 20 nt, Human
gucaggauuaguaaacucug

SEQ ID NO: 211943 - RNA, 22 nt, Human
gccaggcagacaggucaucagg

SEQ ID NO: 211944 - RNA, 19 nt, Human
gccugggaugggcagaacu

SEQ ID NO: 211945 - RNA, 22 nt, Human
ugagguucaguucuuggccaca

SEQ ID NO: 211946 - RNA, 19 nt, Human
acccagggguuuaugugug

SEQ ID NO: 211947 - RNA, 22 nt, Human
uauuggucuuggaagguuuugu

SEQ ID NO: 211948 - RNA, 22 nt, Human
agauuacagcaugggaauggga

SEQ ID NO: 211949 - RNA, 22 nt, Human
cucucugugguggcugucccau

SEQ ID NO: 211950 - RNA, 22 nt, Human
uuuucuaacaucuaguaauuug

SEQ ID NO: 211951 - RNA, 22 nt, Human
ucuucucuguggccugguggug

SEQ ID NO: 211952 - RNA, 22 nt, Human
uagggcugaggcaacaagggag

SEQ ID NO: 211953 - RNA, 22 nt, Human
guccagaaagggcagugauuug

SEQ ID NO: 211954 - RNA, 22 nt, Human
aagugcuguacaguguguaaau

SEQ ID NO: 211955 - RNA, 22 nt, Human
agggguggagaguguugccagu

SEQ ID NO: 211956 - RNA, 22 nt, Human
uagccggguguugugucaugca

SEQ ID NO: 211957 - RNA, 22 nt, Human
ucuuggcucccuuguaggcccu

SEQ ID NO: 211958 - RNA, 22 nt, Human
aguggcaguggggcagggcccu

SEQ ID NO: 211959 - RNA, 22 nt, Human
ugucucagaguaucccugaacu

SEQ ID NO: 211960 - RNA, 18 nt, Human
ugaauagggguuugcaga

SEQ ID NO: 211961 - RNA, 22 nt, Human
gcagcaggagaguuuguccugc

SEQ ID NO: 211962 - RNA, 22 nt, Human
uuucucagccuccuugcuggag

SEQ ID NO: 211963 - RNA, 22 nt, Human
aaacugguagcaauuuaagggu

SEQ ID NO: 211964 - RNA, 22 nt, Human
gcuguggccgucagggaaaugg

SEQ ID NO: 211965 - RNA, 22 nt, Human
caagugucuucaaaggcuaaaa

SEQ ID NO: 211966 - RNA, 22 nt, Human
gagcucagcccaaagagcagug

SEQ ID NO: 211967 - RNA, 22 nt, Human
aaggcuauaucucaauacuauu

SEQ ID NO: 211968 - RNA, 22 nt, Human
gcagguguucucagaggaggcu

SEQ ID NO: 211969 - RNA, 23 nt, Human
uccaggagcaugcuggcuggcga

SEQ ID NO: 211970 - RNA, 22 nt, Human
uagcaagaggugaagguuucau

SEQ ID NO: 211971 - RNA, 17 nt, Human
ugacagacaucaugagc

SEQ ID NO: 211972 - RNA, 22 nt, Human
gaugugagugguagcugggauu

SEQ ID NO: 211973 - RNA, 22 nt, Human
auggcagcauaguggcaaguua

SEQ ID NO: 211974 - RNA, 22 nt, Human
uaggcuggggguaggaauugag

SEQ ID NO: 211975 - RNA, 22 nt, Human
uugauuucaaaauauaugcuug

SEQ ID NO: 211976 - RNA, 22 nt, Human
aaauucuaugucaauguuuauu

SEQ ID NO: 211977 - RNA, 22 nt, Human
cuuaauuuuuguaguagaugga

SEQ ID NO: 211978 - RNA, 22 nt, Human
uguuacaauauuaucaacugag

SEQ ID NO: 211979 - RNA, 22 nt, Human
aaagaucaaguaggcauggccu

SEQ ID NO: 211980 - RNA, 22 nt, Human
guugggguaccuugaggcuggg

SEQ ID NO: 211981 - RNA, 22 nt, Human
cucuccugguguggaggacagg

SEQ ID NO: 211982 - RNA, 22 nt, Human
aagugguugcuugugagucccc

SEQ ID NO: 211983 - RNA, 22 nt, Human
gcuugccuaucugguggucguu

SEQ ID NO: 211984 - RNA, 22 nt, Human
uuagauaauguagagauaugag

SEQ ID NO: 211985 - RNA, 22 nt, Human
aaauauaguaaaugcauaguuc

SEQ ID NO: 211986 - RNA, 19 nt, Human
guccuggcgccgccacacc

SEQ ID NO: 211987 - RNA, 22 nt, Human
ucagggcuggcuuuugcagagc

SEQ ID NO: 211988 - RNA, 22 nt, Human
gccacaggucggcuagaggguc

SEQ ID NO: 211989 - RNA, 22 nt, Human
ccagugccuaucuccucuggga

SEQ ID NO: 211990 - RNA, 18 nt, Human
aggucaggaaagcagagu

SEQ ID NO: 211991 - RNA, 22 nt, Human
uggcucagagagggagugugga

SEQ ID NO: 211992 - RNA, 22 nt, Human
gcaugcagagaauaccugugau

SEQ ID NO: 211993 - RNA, 22 nt, Human
auguggccagucauguaguaac

SEQ ID NO: 211994 - RNA, 20 nt, Human
agaaggcaggagacaaaagg

SEQ ID NO: 211995 - RNA, 22 nt, Human
ccuggcagucaggggaguccuu

SEQ ID NO: 211996 - RNA, 22 nt, Human
acagaaauuagcagugaguuua

SEQ ID NO: 211997 - RNA, 22 nt, Human
cuccaguggcaaguccgggcgg

SEQ ID NO: 211998 - RNA, 22 nt, Human
uguguaaaaucugauuaauacu

SEQ ID NO: 211999 - RNA, 22 nt, Human
uugaaugaauucuacuuccaga

SEQ ID NO: 212000 - RNA, 20 nt, Human
uggaagacacugaagggcca

SEQ ID NO: 212001 - RNA, 22 nt, Human
uagggcacagcuuagauaaaug

SEQ ID NO: 212002 - RNA, 18 nt, Human
cucuuucuuuggcacaaa

SEQ ID NO: 212003 - RNA, 22 nt, Human
ugcaugaacacaugugcaugua

SEQ ID NO: 212004 - RNA, 22 nt, Human
ccaggugugucaccauugccca

SEQ ID NO: 212005 - RNA, 22 nt, Human
aaauagcuucuaagccuuuuga

SEQ ID NO: 212006 - RNA, 22 nt, Human
guagggacaugccauuaucuca

SEQ ID NO: 212007 - RNA, 22 nt, Human
uuuuagaaucagguugucuggg

SEQ ID NO: 212008 - RNA, 23 nt, Human
ugggauagaauuucauggcugcu

SEQ ID NO: 212009 - RNA, 22 nt, Human
caugaauauacauccugauggc

SEQ ID NO: 212010 - RNA, 22 nt, Human
agggcccuccccgcucagggca

SEQ ID NO: 212011 - RNA, 22 nt, Human
gaagauugaaggcugggaauua

SEQ ID NO: 212012 - RNA, 22 nt, Human
gcacugguaucaccugagagcu

SEQ ID NO: 212013 - RNA, 22 nt, Human
aggcagcuuuaacugguaguag

SEQ ID NO: 212014 - RNA, 22 nt, Human
acagugcugucuaucucacuaa

SEQ ID NO: 212015 - RNA, 22 nt, Human
ccagcagagggucuuggccauu

SEQ ID NO: 212016 - RNA, 22 nt, Human
uguggccucuaagcucacgaag

SEQ ID NO: 212017 - RNA, 22 nt, Human
ucacuccucaggcuagcaucau

SEQ ID NO: 212018 - RNA, 22 nt, Human
uccaggccacauggauggcgau

SEQ ID NO: 212019 - RNA, 22 nt, Human
acuuccugcaaucguccacucc

SEQ ID NO: 212020 - RNA, 22 nt, Human
acaggacuagaugauaaaaugu

SEQ ID NO: 212021 - RNA, 22 nt, Human
uugaaacuaugaagacaaccau

SEQ ID NO: 212022 - RNA, 22 nt, Human
cacugggaaucugggaaagaga

SEQ ID NO: 212023 - RNA, 22 nt, Human
uccugggcagcgggacgcucag

SEQ ID NO: 212024 - RNA, 22 nt, Human
uuuacaaccucauauucugaug

SEQ ID NO: 212025 - RNA, 19 nt, Human
uccuggcauuuguaggaaa

SEQ ID NO: 212026 - RNA, 22 nt, Human
ccuucucucugaagaccccaaa

SEQ ID NO: 212027 - RNA, 22 nt, Human
guuaaacaauaacuggcacaca

SEQ ID NO: 212028 - RNA, 22 nt, Human
uucugucuguaaacuucucaau

SEQ ID NO: 212029 - RNA, 22 nt, Human
ucaggaaguauaaucagauuca

SEQ ID NO: 212030 - RNA, 22 nt, Human
ccugggcaauauagugaggccc

SEQ ID NO: 212031 - RNA, 22 nt, Human
uucaguuucccuaaagccaauu

SEQ ID NO: 212032 - RNA, 22 nt, Human
aaggaaguuuucuugguuccua

SEQ ID NO: 212033 - RNA, 22 nt, Human
auugauaucaguuugcugauug

SEQ ID NO: 212034 - RNA, 19 nt, Human
guccaguguuuuccaguca

SEQ ID NO: 212035 - RNA, 22 nt, Human
cauuccagaugaggccaggccc

SEQ ID NO: 212036 - RNA, 20 nt, Human
cugaggggucugacuuggac

SEQ ID NO: 212037 - RNA, 21 nt, Human
acuuuacaauuuacauaguga

SEQ ID NO: 212038 - RNA, 22 nt, Human
uuaacauuucuuuuccacucau

SEQ ID NO: 212039 - RNA, 22 nt, Human
gcugccuguggcccuucugggu

SEQ ID NO: 212040 - RNA, 22 nt, Human
gaaaugaugucugugcugccac

SEQ ID NO: 212041 - RNA, 22 nt, Human
ugucccagcugucucuguuuuu

SEQ ID NO: 212042 - RNA, 22 nt, Human
ccagugacuggcuuucuggugu

SEQ ID NO: 212043 - RNA, 22 nt, Human
guuagguagaaguuuacuuuga

SEQ ID NO: 212044 - RNA, 22 nt, Human
aaagacuuucaccuagcaaaga

SEQ ID NO: 212045 - RNA, 19 nt, Human
ggagaagcaucuagaaaua

SEQ ID NO: 212046 - RNA, 20 nt, Human
aaggaacucacccaugggcu

SEQ ID NO: 212047 - RNA, 22 nt, Human
gccuccaccgaacgcucucuug

SEQ ID NO: 212048 - RNA, 22 nt, Human
ggcccagacccaagaguggugg

SEQ ID NO: 212049 - RNA, 22 nt, Human
uuaaaaggguaagcagcaacuu

SEQ ID NO: 212050 - RNA, 22 nt, Human
gagagcugcagccgagaggggg

SEQ ID NO: 212051 - RNA, 22 nt, Human
uacacaguagaguauaaugcgu

SEQ ID NO: 212052 - RNA, 22 nt, Human
aagcaugggaaucccacagggu

SEQ ID NO: 212053 - RNA, 22 nt, Human
agucaguguucuggguuguaau

SEQ ID NO: 212054 - RNA, 22 nt, Human
uuucauugagacuauagacauc

SEQ ID NO: 212055 - RNA, 22 nt, Human
uuuauaguagcaugauuuauag

SEQ ID NO: 212056 - RNA, 22 nt, Human
uuuucucuacaaaauaaccagc

SEQ ID NO: 212057 - RNA, 22 nt, Human
uuaguguuagggccuguuaccu

SEQ ID NO: 212058 - RNA, 22 nt, Human
gugacccaugcagugguuuugg

SEQ ID NO: 212059 - RNA, 22 nt, Human
cacagcagaacuuaauuucaaa

SEQ ID NO: 212060 - RNA, 22 nt, Human
accuuagaaagugacaaacgaa

SEQ ID NO: 212061 - RNA, 22 nt, Human
uugcuuuauauucaagagagga

SEQ ID NO: 212062 - RNA, 22 nt, Human
cucuugcaugagauccaggagu

SEQ ID NO: 212063 - RNA, 22 nt, Human
ucucagggaguugaggcugccu

SEQ ID NO: 212064 - RNA, 22 nt, Human
cacaggcuuuuuuggcugaugu

SEQ ID NO: 212065 - RNA, 22 nt, Human
ucugagggauuugucccuuauc

SEQ ID NO: 212066 - RNA, 22 nt, Human
ucucuuccaguaagagucuuua

SEQ ID NO: 212067 - RNA, 21 nt, Human
cacuauuuauauaugccagcu

SEQ ID NO: 212068 - RNA, 22 nt, Human
ucccagggcuuuucucaugcuu

SEQ ID NO: 212069 - RNA, 22 nt, Human
uuuggcucuucccguaccauaa

SEQ ID NO: 212070 - RNA, 22 nt, Human
uccuguccugaggcuccaggcc

SEQ ID NO: 212071 - RNA, 22 nt, Human
ggcagaggaggggugaauuugc

SEQ ID NO: 212072 - RNA, 22 nt, Human
augaaacagaguacuuaauaua

SEQ ID NO: 212073 - RNA, 17 nt, Human
gcucagaguacacgugu

SEQ ID NO: 212074 - RNA, 18 nt, Human
uugauucauauuaaccau

SEQ ID NO: 212075 - RNA, 22 nt, Human
uugcaagaaauaaucgaauaga

SEQ ID NO: 212076 - RNA, 22 nt, Human
cauuuguaucauauguaucuua

SEQ ID NO: 212077 - RNA, 20 nt, Human
cauacacuauucuguauagu

SEQ ID NO: 212078 - RNA, 22 nt, Human
auccaggccugagucugguccu

SEQ ID NO: 212079 - RNA, 22 nt, Human
acaggcagguugagaaacauuu

SEQ ID NO: 212080 - RNA, 22 nt, Human
ucugggaaccagugcggcuggg

SEQ ID NO: 212081 - RNA, 22 nt, Human
cacccuggaaagaaggucuggg

SEQ ID NO: 212082 - RNA, 22 nt, Human
ucuuuuggaaaugaugugcagg

SEQ ID NO: 212083 - RNA, 22 nt, Human
ccaaggggccuuuagacacuau

SEQ ID NO: 212084 - RNA, 19 nt, Human
ggcaccuuucugcuguguc

SEQ ID NO: 212085 - RNA, 22 nt, Human
agcugggugcgguggcucaugc

SEQ ID NO: 212086 - RNA, 22 nt, Human
cccugugcugucaugcugggcg

SEQ ID NO: 212087 - RNA, 22 nt, Human
cuggcugucuuggaggaaggag

SEQ ID NO: 212088 - RNA, 22 nt, Human
cagggcucaccacugggauccu

SEQ ID NO: 212089 - RNA, 22 nt, Human
aaguggcucauguggcuucugc

SEQ ID NO: 212090 - RNA, 22 nt, Human
aaagcaauagguuaggucaaga

SEQ ID NO: 212091 - RNA, 22 nt, Human
ucacagaaguguguuucaggag

SEQ ID NO: 212092 - RNA, 22 nt, Human
gccuucucugugagcuccuagg

SEQ ID NO: 212093 - RNA, 22 nt, Human
auauaucuucauuaggucgaga

SEQ ID NO: 212094 - RNA, 22 nt, Human
ucucugugugccuucaucugcc

SEQ ID NO: 212095 - RNA, 22 nt, Human
acccugccaaggauggccccga

SEQ ID NO: 212096 - RNA, 22 nt, Human
uuuuuagauuacucagccacca

SEQ ID NO: 212097 - RNA, 18 nt, Human
ggcuccaggaccuaccca

SEQ ID NO: 212098 - RNA, 22 nt, Human
auuagggcuggaugcaaggaaa

SEQ ID NO: 212099 - RNA, 20 nt, Human
aggcucugccauugucccug

SEQ ID NO: 212100 - RNA, 22 nt, Human
uacaucuagccuuacaauuauu

SEQ ID NO: 212101 - RNA, 22 nt, Human
cccccagucugaacagcagcug

SEQ ID NO: 212102 - RNA, 22 nt, Human
ugugucugaacuaguugcucuc

SEQ ID NO: 212103 - RNA, 22 nt, Human
cagcugccuaugaccuagccuc

SEQ ID NO: 212104 - RNA, 22 nt, Human
ugggccucuggguuagucccua

SEQ ID NO: 212105 - RNA, 22 nt, Human
uuuucucuuguuaauguacuga

SEQ ID NO: 212106 - RNA, 22 nt, Human
auuuacagaaacuuaaucauag

SEQ ID NO: 212107 - RNA, 22 nt, Human
uuggugaauugagaccauuugu

SEQ ID NO: 212108 - RNA, 22 nt, Human
aucuccuaaaguuuccagaaga

SEQ ID NO: 212109 - RNA, 20 nt, Human
uccagcccucaugucgcuca

SEQ ID NO: 212110 - RNA, 22 nt, Human
uauauucacuuguguccaacca

SEQ ID NO: 212111 - RNA, 22 nt, Human
aguccauacauugagaauaaca

SEQ ID NO: 212112 - RNA, 22 nt, Human
ucucugaaggggagcuguuuaa

SEQ ID NO: 212113 - RNA, 22 nt, Human
ggcagcaaauauugucagcugu

SEQ ID NO: 212114 - RNA, 21 nt, Human
uagagcuuggcacagaguaga

SEQ ID NO: 212115 - RNA, 22 nt, Human
auucagacucuugagcaguccc

SEQ ID NO: 212116 - RNA, 21 nt, Human
cccaggucguggucuucccag

SEQ ID NO: 212117 - RNA, 22 nt, Human
cuguccccugugcuuucacuug

SEQ ID NO: 212118 - RNA, 22 nt, Human
acauauuuccaugcagcauguc

SEQ ID NO: 212119 - RNA, 17 nt, Human
uauacacagacagacug

SEQ ID NO: 212120 - RNA, 22 nt, Human
agcuucucaggagucugaggca

SEQ ID NO: 212121 - RNA, 20 nt, Human
guauauaaccauagugacua

SEQ ID NO: 212122 - RNA, 22 nt, Human
acagagacucaugaaagaugac

SEQ ID NO: 212123 - RNA, 22 nt, Human
uauacacaaggugugcauuugu

SEQ ID NO: 212124 - RNA, 22 nt, Human
aggaggugacagccugcaucug

SEQ ID NO: 212125 - RNA, 22 nt, Human
aauaaugagacagcuuauuuaa

SEQ ID NO: 212126 - RNA, 22 nt, Human
uuagcagcggucaguuuugaag

SEQ ID NO: 212127 - RNA, 22 nt, Human
auggcuuguucauugguaccug

SEQ ID NO: 212128 - RNA, 22 nt, Human
uucaacuagauuuauacaauuc

SEQ ID NO: 212129 - RNA, 22 nt, Human
uccaagaguaagaggacucuuu

SEQ ID NO: 212130 - RNA, 23 nt, Human
aaaggcuaucaaaguuuugcuga

SEQ ID NO: 212131 - RNA, 22 nt, Human
cugggcaggauacuucauggga

SEQ ID NO: 212132 - RNA, 22 nt, Human
agguccuguuucuucccugggg

SEQ ID NO: 212133 - RNA, 22 nt, Human
ggccagccuggggcucccagac

SEQ ID NO: 212134 - RNA, 21 nt, Human
cagaggccuaucacagacucc

SEQ ID NO: 212135 - RNA, 22 nt, Human
caugaauuuuaagacuguuuuu

SEQ ID NO: 212136 - RNA, 22 nt, Human
cauaauccauuugcacugcaga

SEQ ID NO: 212137 - RNA, 22 nt, Human
cuuuggaauaaucaagcucuga

SEQ ID NO: 212138 - RNA, 22 nt, Human
cagcucagacgcaggucgagca

SEQ ID NO: 212139 - RNA, 20 nt, Human
gcuguggccgugccagacuc

SEQ ID NO: 212140 - RNA, 22 nt, Human
ugcuuauuugaauuuauucuca

SEQ ID NO: 212141 - RNA, 22 nt, Human
gcuuuuacaagagccagagagg

SEQ ID NO: 212142 - RNA, 22 nt, Human
ggcugggcaggucugcacaggg

SEQ ID NO: 212143 - RNA, 22 nt, Human
caaggcaggccaguuucaaggc

SEQ ID NO: 212144 - RNA, 22 nt, Human
ggccaggagcaagccaggcucu

SEQ ID NO: 212145 - RNA, 22 nt, Human
ugggcacaggggaauggaugaa

SEQ ID NO: 212146 - RNA, 22 nt, Human
uuucuuaugugcagagugagua

SEQ ID NO: 212147 - RNA, 18 nt, Human
ccugagcccugcuuacuu

SEQ ID NO: 212148 - RNA, 22 nt, Human
ugucaagucucugaaugaaaug

SEQ ID NO: 212149 - RNA, 21 nt, Human
ucaaggaguuucucuuuucca

SEQ ID NO: 212150 - RNA, 23 nt, Human
uucauauguugcugaaaacagca

SEQ ID NO: 212151 - RNA, 22 nt, Human
ucaggcaggaagggaggacuug

SEQ ID NO: 212152 - RNA, 22 nt, Human
uucccaaaauauaacaguuaac

SEQ ID NO: 212153 - RNA, 22 nt, Human
ucuguuuugugucucucuggug

SEQ ID NO: 212154 - RNA, 22 nt, Human
cagcucuuugaguauuccauuu

SEQ ID NO: 212155 - RNA, 22 nt, Human
ugaggucugcagggcugugcau

SEQ ID NO: 212156 - RNA, 22 nt, Human
ucucaggcccacuguguugaaa

SEQ ID NO: 212157 - RNA, 22 nt, Human
cacauuuaauccuuuauaagua

SEQ ID NO: 212158 - RNA, 22 nt, Human
acaggcaagaggaaagcaagua

SEQ ID NO: 212159 - RNA, 22 nt, Human
uauuuuaaagugaagggucuug

SEQ ID NO: 212160 - RNA, 22 nt, Human
ccccacaguccgugaggagcca

SEQ ID NO: 212161 - RNA, 18 nt, Human
ccucuggguuuuguuccc

SEQ ID NO: 212162 - RNA, 22 nt, Human
uuccaggaggcacugacagagg

SEQ ID NO: 212163 - RNA, 22 nt, Human
aaagagcucuuacucuagugua

SEQ ID NO: 212164 - RNA, 22 nt, Human
ucucugugcaggaugcugaguu

SEQ ID NO: 212165 - RNA, 22 nt, Human
gccuuggcugccaagcugcuga

SEQ ID NO: 212166 - RNA, 22 nt, Human
ggaacaguagacgaucuccuuu

SEQ ID NO: 212167 - RNA, 22 nt, Human
guguuacugcuuuuaucuacca

SEQ ID NO: 212168 - RNA, 22 nt, Human
acaucucuccaaaggaaggugc

SEQ ID NO: 212169 - RNA, 22 nt, Human
gagccagagcuacaagugucug

SEQ ID NO: 212170 - RNA, 18 nt, Human
gccucuguugcuugccug

SEQ ID NO: 212171 - RNA, 22 nt, Human
aaguuacaagacuaaauggaag

SEQ ID NO: 212172 - RNA, 22 nt, Human
caggcuggagugcaauggcaca

SEQ ID NO: 212173 - RNA, 22 nt, Human
caggcuucagggaacgcagucu

SEQ ID NO: 212174 - RNA, 22 nt, Human
uguuuagcauaaagauuuucca

SEQ ID NO: 212175 - RNA, 22 nt, Human
ugggcuccagcaccugugcucu

SEQ ID NO: 212176 - RNA, 22 nt, Human
cuaaauguuuuaucuuccuggc

SEQ ID NO: 212177 - RNA, 22 nt, Human
augaaaacggaccagagcuauu

SEQ ID NO: 212178 - RNA, 22 nt, Human
ugacccauuggucccuagaucc

SEQ ID NO: 212179 - RNA, 22 nt, Human
ugaaggcuuucuccccucuggu

SEQ ID NO: 212180 - RNA, 22 nt, Human
agggccaccagggagucucagg

SEQ ID NO: 212181 - RNA, 22 nt, Human
guccugugggcccaccaugagc

SEQ ID NO: 212182 - RNA, 22 nt, Human
cucacccauaucuccaugacuc

SEQ ID NO: 212183 - RNA, 22 nt, Human
cccagcugaacuugcauuccaa

SEQ ID NO: 212184 - RNA, 22 nt, Human
caagcugaacacugucuucaag

SEQ ID NO: 212185 - RNA, 22 nt, Human
gucagcacuuuuccgaggcaga

SEQ ID NO: 212186 - RNA, 22 nt, Human
cuuccagguucugguugggaag

SEQ ID NO: 212187 - RNA, 22 nt, Human
ugucuucaucuccaugcacaga

SEQ ID NO: 212188 - RNA, 22 nt, Human
ugcauaaacuucucugguguga

SEQ ID NO: 212189 - RNA, 22 nt, Human
guggagcuggacccaggccucu

SEQ ID NO: 212190 - RNA, 22 nt, Human
ggccugacugaccugauucuaa

SEQ ID NO: 212191 - RNA, 22 nt, Human
uggcagagagacucuccuugau

SEQ ID NO: 212192 - RNA, 22 nt, Human
aagcuuuaaggaauuuuaugga

SEQ ID NO: 212193 - RNA, 20 nt, Human
accaauguuagcuuaguacu

SEQ ID NO: 212194 - RNA, 22 nt, Human
agcaauaugacauugcuacauc

SEQ ID NO: 212195 - RNA, 22 nt, Human
agaaaugaagcaggaguuauua

SEQ ID NO: 212196 - RNA, 23 nt, Human
uugagucuuauaggauugaggug

SEQ ID NO: 212197 - RNA, 22 nt, Human
aguggcuggacgacaaggguga

SEQ ID NO: 212198 - RNA, 22 nt, Human
cauagaaucauagcacauuuga

SEQ ID NO: 212199 - RNA, 22 nt, Human
uugaaugauccuaucuagcaca

SEQ ID NO: 212200 - RNA, 22 nt, Human
gcuggccugggcagaggcuaug

SEQ ID NO: 212201 - RNA, 22 nt, Human
acuggcaguagagggagcgcau

SEQ ID NO: 212202 - RNA, 22 nt, Human
gcagaauaauagaaaggcacac

SEQ ID NO: 212203 - RNA, 22 nt, Human
aggacaugaagaaagggcaagg

SEQ ID NO: 212204 - RNA, 22 nt, Human
cagaugaagaucauagaauagu

SEQ ID NO: 212205 - RNA, 22 nt, Human
gcugcccuucgucaucuauaaa

SEQ ID NO: 212206 - RNA, 22 nt, Human
uaauaguugugacuuuguaaag

SEQ ID NO: 212207 - RNA, 22 nt, Human
auugcaaaggucccauucaaga

SEQ ID NO: 212208 - RNA, 22 nt, Human
uccuggcagggaacuugucagc

SEQ ID NO: 212209 - RNA, 22 nt, Human
ccaggccaguguuugguccagg

SEQ ID NO: 212210 - RNA, 22 nt, Human
ugaaguuuucugguugauuaag

SEQ ID NO: 212211 - RNA, 22 nt, Human
uggaggcagucaaaugacugac

SEQ ID NO: 212212 - RNA, 22 nt, Human
uuuuauguaauccuuacugucg

SEQ ID NO: 212213 - RNA, 22 nt, Human
gucuuuggaaagacaaaguuca

SEQ ID NO: 212214 - RNA, 22 nt, Human
gaauacauaucagauguguuuc

SEQ ID NO: 212215 - RNA, 22 nt, Human
agaggggcucauauccugucau

SEQ ID NO: 212216 - RNA, 22 nt, Human
ugccaggcuaaguggaggacuu

SEQ ID NO: 212217 - RNA, 22 nt, Human
gcauucuuccugggcugggggc

SEQ ID NO: 212218 - RNA, 20 nt, Human
cugcccugcccuggguccug

SEQ ID NO: 212219 - RNA, 22 nt, Human
agaaucuuggaacucagaucac

SEQ ID NO: 212220 - RNA, 22 nt, Human
gcugccacgaucucugcuguag

SEQ ID NO: 212221 - RNA, 22 nt, Human
ugguggggauucccucccuggc

SEQ ID NO: 212222 - RNA, 22 nt, Human
gaaagguugggugaauggugga

SEQ ID NO: 212223 - RNA, 22 nt, Human
uucugggccaaucucuuaaucu

SEQ ID NO: 212224 - RNA, 22 nt, Human
uccugggucucuuccuuaguuc

SEQ ID NO: 212225 - RNA, 22 nt, Human
aaaguguuaugcaaaacucugu

SEQ ID NO: 212226 - RNA, 22 nt, Human
augagaaagaguuguaucuaga

SEQ ID NO: 212227 - RNA, 22 nt, Human
cugcaucacagcaggaggcaca

SEQ ID NO: 212228 - RNA, 22 nt, Human
acuuuuuacaggguguauacca

SEQ ID NO: 212229 - RNA, 22 nt, Human
ucugagguggacgauggagccu

SEQ ID NO: 212230 - RNA, 22 nt, Human
gucucagggcugagggcagugg

SEQ ID NO: 212231 - RNA, 22 nt, Human
uuguaauuugcaaauguauugu

SEQ ID NO: 212232 - RNA, 19 nt, Human
caguaucauugcacauagu

SEQ ID NO: 212233 - RNA, 22 nt, Human
uaacugguccugaacagcccag

SEQ ID NO: 212234 - RNA, 22 nt, Human
uguuuaauucaccaucauguuc

SEQ ID NO: 212235 - RNA, 22 nt, Human
gaguccuuuucucuguccacug

SEQ ID NO: 212236 - RNA, 22 nt, Human
ugcuugaacccaggaaguggag

SEQ ID NO: 212237 - RNA, 22 nt, Human
gagcuggcuccgccaugcugcu

SEQ ID NO: 212238 - RNA, 22 nt, Human
agcacuuuaagcaacagaucaa

SEQ ID NO: 212239 - RNA, 22 nt, Human
uuccugggggcagcagucuuga

SEQ ID NO: 212240 - RNA, 17 nt, Human
agugucagggcccuucc

SEQ ID NO: 212241 - RNA, 22 nt, Human
augaaaauguacauguguauaa

SEQ ID NO: 212242 - RNA, 22 nt, Human
cugagggagaagucacgggcag

SEQ ID NO: 212243 - RNA, 22 nt, Human
uacauguauguguacgugcaug

SEQ ID NO: 212244 - RNA, 22 nt, Human
uggcuggggccugaauccugca

SEQ ID NO: 212245 - RNA, 22 nt, Human
ggugucugcuucccuccagcug

SEQ ID NO: 212246 - RNA, 22 nt, Human
ugcaggcuggcagugcugaaau

SEQ ID NO: 212247 - RNA, 22 nt, Human
agucaguuaaccucacagcauc

SEQ ID NO: 212248 - RNA, 22 nt, Human
acagugugugcuuucccuuacg

SEQ ID NO: 212249 - RNA, 22 nt, Human
acagaugguuauugucauuucu

SEQ ID NO: 212250 - RNA, 22 nt, Human
uggcauuucaguauuuucauaa

SEQ ID NO: 212251 - RNA, 22 nt, Human
agccugauuuugauaauuauau

SEQ ID NO: 212252 - RNA, 22 nt, Human
ggcugcugcuguguaggccugu

SEQ ID NO: 212253 - RNA, 22 nt, Human
caagcugcuauagguugcuggg

SEQ ID NO: 212254 - RNA, 22 nt, Human
gugguaaucggauucuuaccgg

SEQ ID NO: 212255 - RNA, 22 nt, Human
cuggcugggagcucgccugcgg

SEQ ID NO: 212256 - RNA, 22 nt, Human
acuguucauccuuuuugaacaa

SEQ ID NO: 212257 - RNA, 22 nt, Human
aaagaguuggacuuucucaggc

SEQ ID NO: 212258 - RNA, 21 nt, Human
guucuauuuugcaaacuucug

SEQ ID NO: 212259 - RNA, 19 nt, Human
aggcuucuacccuguccag

SEQ ID NO: 212260 - RNA, 22 nt, Human
gagcucagcacuaaaaucaugu

SEQ ID NO: 212261 - RNA, 22 nt, Human
cuguccuguggugacagguaca

SEQ ID NO: 212262 - RNA, 22 nt, Human
ggcuuuauuauguggccaugug

SEQ ID NO: 212263 - RNA, 22 nt, Human
augugaaauauuaagccgagga

SEQ ID NO: 212264 - RNA, 22 nt, Human
ggaaagaacccuggauggcugg

SEQ ID NO: 212265 - RNA, 22 nt, Human
aauaggcagcuuagcaggggcu

SEQ ID NO: 212266 - RNA, 22 nt, Human
cagggaugugaugagcugagcc

SEQ ID NO: 212267 - RNA, 22 nt, Human
aguuacagugaccauuuauuua

SEQ ID NO: 212268 - RNA, 22 nt, Human
guuguaaguuuaaugucaauug

SEQ ID NO: 212269 - RNA, 22 nt, Human
gaaucucaaggcuugugaggau

SEQ ID NO: 212270 - RNA, 22 nt, Human
cacgguggcccacaggugcaag

SEQ ID NO: 212271 - RNA, 22 nt, Human
caggagaggcuguacguuucuc

SEQ ID NO: 212272 - RNA, 22 nt, Human
ucucugagcaugccauauugcu

SEQ ID NO: 212273 - RNA, 22 nt, Human
uggcuacucaacauguacucau

SEQ ID NO: 212274 - RNA, 20 nt, Human
agucacaguaucagucuuag

SEQ ID NO: 212275 - RNA, 22 nt, Human
uggaccugggguggccuccucu

SEQ ID NO: 212276 - RNA, 22 nt, Human
acuaaauaguuuugacagaaca

SEQ ID NO: 212277 - RNA, 22 nt, Human
uguguccucagggaagcagaga

SEQ ID NO: 212278 - RNA, 22 nt, Human
agcagggccaacaguaaacacc

SEQ ID NO: 212279 - RNA, 22 nt, Human
agccagacuuuaaaauagauga

SEQ ID NO: 212280 - RNA, 22 nt, Human
gccuccuccuucccgagggucu

SEQ ID NO: 212281 - RNA, 22 nt, Human
cagcccuggcgcccccagaucu

SEQ ID NO: 212282 - RNA, 22 nt, Human
aaaggauaagguuaucaauuuu

SEQ ID NO: 212283 - RNA, 22 nt, Human
ucacauguguuuucucaccaac

SEQ ID NO: 212284 - RNA, 22 nt, Human
ccugggcuuccacgagcagagg

SEQ ID NO: 212285 - RNA, 22 nt, Human
ucagaaguaggagacauucuug

SEQ ID NO: 212286 - RNA, 22 nt, Human
agaacaauguuaaauuauuaag

SEQ ID NO: 212287 - RNA, 22 nt, Human
aaguacuucuagauggauaauc

SEQ ID NO: 212288 - RNA, 22 nt, Human
uuaguugauguucuggagguag

SEQ ID NO: 212289 - RNA, 19 nt, Human
cucuggcuccugggcugcc

SEQ ID NO: 212290 - RNA, 22 nt, Human
aaaaaccuuucauugcaaaugu

SEQ ID NO: 212291 - RNA, 22 nt, Human
gcugcaccagcugcacccagua

SEQ ID NO: 212292 - RNA, 22 nt, Human
agcaacaggcauaauguguuga

SEQ ID NO: 212293 - RNA, 22 nt, Human
ucacauucucagcaucuauaca

SEQ ID NO: 212294 - RNA, 22 nt, Human
gacauggauacuugauaagggg

SEQ ID NO: 212295 - RNA, 22 nt, Human
ucaguuuaagaugacuaacaau

SEQ ID NO: 212296 - RNA, 22 nt, Human
uccugcacauuaguauuuuuua

SEQ ID NO: 212297 - RNA, 22 nt, Human
agaggguaacaagaggccugga

SEQ ID NO: 212298 - RNA, 22 nt, Human
ccugggagagucuguggucucc

SEQ ID NO: 212299 - RNA, 22 nt, Human
acacacagaaggaagccccacu

SEQ ID NO: 212300 - RNA, 22 nt, Human
aaggaaccauuugugugcaugg

SEQ ID NO: 212301 - RNA, 22 nt, Human
aauuauauuguggugugaaugu

SEQ ID NO: 212302 - RNA, 19 nt, Human
gcucaggcugugugugggg

SEQ ID NO: 212303 - RNA, 22 nt, Human
acaacagagcuggacugagagg

SEQ ID NO: 212304 - RNA, 22 nt, Human
ucagggaagaaaugggacuuua

SEQ ID NO: 212305 - RNA, 22 nt, Human
ccuucugauacugacaucauuu

SEQ ID NO: 212306 - RNA, 22 nt, Human
uagucuuucauuuggagcauuu

SEQ ID NO: 212307 - RNA, 19 nt, Human
gcaggucauuaggcuaggu

SEQ ID NO: 212308 - RNA, 22 nt, Human
aggcuucuucugccugucuuug

SEQ ID NO: 212309 - RNA, 22 nt, Human
aggcugggcaccguuuugaucc

SEQ ID NO: 212310 - RNA, 22 nt, Human
auuggucuccacuuguuuuaga

SEQ ID NO: 212311 - RNA, 19 nt, Human
ccaggagcaguggugagcu

SEQ ID NO: 212312 - RNA, 22 nt, Human
uacagaggggacauggaagaca

SEQ ID NO: 212313 - RNA, 20 nt, Human
gagcccaaguagggagaaau

SEQ ID NO: 212314 - RNA, 22 nt, Human
aucauaaaauugcaccauuucu

SEQ ID NO: 212315 - RNA, 23 nt, Human
aaguucuuuuagaugucuucgug

SEQ ID NO: 212316 - RNA, 22 nt, Human
cagagcugggcauggugaaagg

SEQ ID NO: 212317 - RNA, 21 nt, Human
ugcagauaauugaaagcugac

SEQ ID NO: 212318 - RNA, 22 nt, Human
guuucauuuacaucuguaggua

SEQ ID NO: 212319 - RNA, 22 nt, Human
uaccaaauguaaucauucuaau

SEQ ID NO: 212320 - RNA, 23 nt, Human
ugcugggguaguuuguggcacag

SEQ ID NO: 212321 - RNA, 22 nt, Human
auugucuuuaaaaauauacaac

SEQ ID NO: 212322 - RNA, 22 nt, Human
cucuccaguuauagcugauuug

SEQ ID NO: 212323 - RNA, 22 nt, Human
cagugaggaagcugucuggacc

SEQ ID NO: 212324 - RNA, 22 nt, Human
ucagacagggagucagaaaaua

SEQ ID NO: 212325 - RNA, 22 nt, Human
gcagaauuuaggaauuaggaaa

SEQ ID NO: 212326 - RNA, 22 nt, Human
agggauggaagacuugaagacc

SEQ ID NO: 212327 - RNA, 22 nt, Human
agguuucaugggagacaacuca

SEQ ID NO: 212328 - RNA, 22 nt, Human
uuucucuugcgauaugcuacac

SEQ ID NO: 212329 - RNA, 22 nt, Human
auuucucaguguacauuauguu

SEQ ID NO: 212330 - RNA, 22 nt, Human
ucuauuuacagaaagcagaauu

SEQ ID NO: 212331 - RNA, 22 nt, Human
auuuccugugucucuauuuaug

SEQ ID NO: 212332 - RNA, 22 nt, Human
gagccagcagccggcaccacca

SEQ ID NO: 212333 - RNA, 18 nt, Human
agugaguuguugaaagaa

SEQ ID NO: 212334 - RNA, 22 nt, Human
uuggccaguggaaagaggagga

SEQ ID NO: 212335 - RNA, 22 nt, Human
cagaaagcccuauguacagugg

SEQ ID NO: 212336 - RNA, 22 nt, Human
uugcaaaaacugcaauuacuuu

SEQ ID NO: 212337 - RNA, 22 nt, Human
uugccucccagcaugggcagcu

SEQ ID NO: 212338 - RNA, 22 nt, Human
gguggcugaaucaaaucaggcc

SEQ ID NO: 212339 - RNA, 22 nt, Human
acacauaugucauugaaaaauc

SEQ ID NO: 212340 - RNA, 22 nt, Human
caauaauauccugugcuguuug

SEQ ID NO: 212341 - RNA, 22 nt, Human
uacagaagcugagacacugaga

SEQ ID NO: 212342 - RNA, 22 nt, Human
acugggcucauaaugucauaga

SEQ ID NO: 212343 - RNA, 22 nt, Human
gcaccagagggggcucugcagg

SEQ ID NO: 212344 - RNA, 18 nt, Human
ggcacugcuguuccccuu

SEQ ID NO: 212345 - RNA, 22 nt, Human
cucuccagcagauguagucugu

SEQ ID NO: 212346 - RNA, 22 nt, Human
aggcugugggguucugcuuuca

SEQ ID NO: 212347 - RNA, 19 nt, Human
uccaugcccaggcaccaag

SEQ ID NO: 212348 - RNA, 22 nt, Human
gaacuguaguuaauacuacaca

SEQ ID NO: 212349 - RNA, 22 nt, Human
uuagcuuucagccuuucucacc

SEQ ID NO: 212350 - RNA, 22 nt, Human
ccaucagauuagcaaaauccag

SEQ ID NO: 212351 - RNA, 22 nt, Human
ccaggaagguaugggaagaaaa

SEQ ID NO: 212352 - RNA, 22 nt, Human
caggcuugcuagaggagccaaa

SEQ ID NO: 212353 - RNA, 22 nt, Human
aagcacagaaaaggagcaugga

SEQ ID NO: 212354 - RNA, 22 nt, Human
gucucagguauugaaugggaac

SEQ ID NO: 212355 - RNA, 22 nt, Human
ugggggugacuaucucgggaau

SEQ ID NO: 212356 - RNA, 22 nt, Human
accagcucagagcaggcuccug

SEQ ID NO: 212357 - RNA, 22 nt, Human
guccuggcuuaguucgcuguaa

SEQ ID NO: 212358 - RNA, 22 nt, Human
augcugagguuguuguccuauu

SEQ ID NO: 212359 - RNA, 22 nt, Human
cacagggaggcagccaugcucc

SEQ ID NO: 212360 - RNA, 22 nt, Human
uacaugcaugucacagaaugaa

SEQ ID NO: 212361 - RNA, 22 nt, Human
auauggaaugguaaucuacaau

SEQ ID NO: 212362 - RNA, 21 nt, Human
gacacaguaaucuuggggcuu

SEQ ID NO: 212363 - RNA, 22 nt, Human
cagaaguuuugcucucuugggu

SEQ ID NO: 212364 - RNA, 22 nt, Human
cccuccagagcuugaccugcug

SEQ ID NO: 212365 - RNA, 18 nt, Human
ccagcccugcagcaccug

SEQ ID NO: 212366 - RNA, 22 nt, Human
cacaauuuccuugcuucacuuu

SEQ ID NO: 212367 - RNA, 22 nt, Human
uuuaauuauaucugggcaguua

SEQ ID NO: 212368 - RNA, 22 nt, Human
ucccacugagccccugcuggug

SEQ ID NO: 212369 - RNA, 22 nt, Human
ggcagccuugagggaggccugg

SEQ ID NO: 212370 - RNA, 22 nt, Human
agggccagucguguauuacugu

SEQ ID NO: 212371 - RNA, 21 nt, Human
uacaaguugcuuuugaagucc

SEQ ID NO: 212372 - RNA, 22 nt, Human
uugauucagagaagauuggccc

SEQ ID NO: 212373 - RNA, 21 nt, Human
uugcacagaaaaccauagaga

SEQ ID NO: 212374 - RNA, 22 nt, Human
acagaugaaacccagcuaguug

SEQ ID NO: 212375 - RNA, 21 nt, Human
ggcaacagauauuuugcuuag

SEQ ID NO: 212376 - RNA, 22 nt, Human
acagagcuucccagccugagca

SEQ ID NO: 212377 - RNA, 22 nt, Human
augggacagguacuagaaaggg

SEQ ID NO: 212378 - RNA, 22 nt, Human
agaggaagcugagaugccucuu

SEQ ID NO: 212379 - RNA, 22 nt, Human
agaugaguaaauggagucuucc

SEQ ID NO: 212380 - RNA, 22 nt, Human
ucucuguaaggaagaauuagau

SEQ ID NO: 212381 - RNA, 22 nt, Human
caggcaagauuagagaugagca

SEQ ID NO: 212382 - RNA, 22 nt, Human
agagcagauggccagggggccu

SEQ ID NO: 212383 - RNA, 22 nt, Human
gaaaccagcuagaggcagaggg

SEQ ID NO: 212384 - RNA, 22 nt, Human
aagcaggcaucuuggaggucaa

SEQ ID NO: 212385 - RNA, 22 nt, Human
gagccuggauugaagugggugg

SEQ ID NO: 212386 - RNA, 22 nt, Human
gacaggcuuucucaggaugagc

SEQ ID NO: 212387 - RNA, 22 nt, Human
aagagcaucaaugacucgcagu

SEQ ID NO: 212388 - RNA, 22 nt, Human
gguuucaacuucaaccucucca

SEQ ID NO: 212389 - RNA, 22 nt, Human
caggaggaggguacaccaucag

SEQ ID NO: 212390 - RNA, 22 nt, Human
aaaagacaggugucugcggccc

SEQ ID NO: 212391 - RNA, 22 nt, Human
ugagccagguuaagacaggagc

SEQ ID NO: 212392 - RNA, 22 nt, Human
ucuccccaaccauggcacucac

SEQ ID NO: 212393 - RNA, 22 nt, Human
aaacaaauuucaagcugugaca

SEQ ID NO: 212394 - RNA, 22 nt, Human
acuguccuagaaccugcagcuc

SEQ ID NO: 212395 - RNA, 22 nt, Human
gguggaugcugacuguucugcu

SEQ ID NO: 212396 - RNA, 19 nt, Human
aucuagauuauugagaagg

SEQ ID NO: 212397 - RNA, 22 nt, Human
uggagcuguagccaccacccug

SEQ ID NO: 212398 - RNA, 22 nt, Human
uuucaugagauuccuccacauc

SEQ ID NO: 212399 - RNA, 22 nt, Human
uagcuuuaauaagcugcugaau

SEQ ID NO: 212400 - RNA, 19 nt, Human
uaaggccaaaaguaagugu

SEQ ID NO: 212401 - RNA, 22 nt, Human
aaggccugaacaugaggagaug

SEQ ID NO: 212402 - RNA, 22 nt, Human
aauguuuuguaugccucugagc

SEQ ID NO: 212403 - RNA, 22 nt, Human
caggagucccucuggccagcau

SEQ ID NO: 212404 - RNA, 21 nt, Human
agcugccuccacuucugaggc

SEQ ID NO: 212405 - RNA, 22 nt, Human
cucacauucacaggacagaagg

SEQ ID NO: 212406 - RNA, 19 nt, Human
caccccaguccucuuuccc

SEQ ID NO: 212407 - RNA, 19 nt, Human
cuggaccuggaggcccgga

SEQ ID NO: 212408 - RNA, 22 nt, Human
ggagagcugacaucaugauguu

SEQ ID NO: 212409 - RNA, 22 nt, Human
uuauuuuaccuuccucugagcu

SEQ ID NO: 212410 - RNA, 22 nt, Human
cacaggcucuucucacuugauu

SEQ ID NO: 212411 - RNA, 22 nt, Human
aaugucaauuaccagaacagaa

SEQ ID NO: 212412 - RNA, 22 nt, Human
cugaaggcauuuuugcugauuu

SEQ ID NO: 212413 - RNA, 22 nt, Human
cagcucccuauggugaggcgac

SEQ ID NO: 212414 - RNA, 22 nt, Human
cugccccagugccaggcaggug

SEQ ID NO: 212415 - RNA, 22 nt, Human
ucuuuucuccagaccugggauc

SEQ ID NO: 212416 - RNA, 22 nt, Human
ccuccugguccagcaucucuuu

SEQ ID NO: 212417 - RNA, 22 nt, Human
gccuuccuuacaccugcucagc

SEQ ID NO: 212418 - RNA, 19 nt, Human
uucuccagggacuuaggga

SEQ ID NO: 212419 - RNA, 22 nt, Human
ucacaucuguugauacagcauc

SEQ ID NO: 212420 - RNA, 22 nt, Human
gcaguggcaugaugugggcuca

SEQ ID NO: 212421 - RNA, 22 nt, Human
cugguuuugucagaagcuuuau

SEQ ID NO: 212422 - RNA, 22 nt, Human
acauuccaaaaacuagcagaua

SEQ ID NO: 212423 - RNA, 22 nt, Human
augugcccucuuagagucucug

SEQ ID NO: 212424 - RNA, 18 nt, Human
acccugggcaauucacuc

SEQ ID NO: 212425 - RNA, 22 nt, Human
gaggcagcugaaggagugacag

SEQ ID NO: 212426 - RNA, 21 nt, Human
uauacagaggggaacaggaga

SEQ ID NO: 212427 - RNA, 22 nt, Human
agucugugacucauuggaucuc

SEQ ID NO: 212428 - RNA, 22 nt, Human
auuuucagagacaucuggacuu

SEQ ID NO: 212429 - RNA, 22 nt, Human
agccaggaucacccggggcugu

SEQ ID NO: 212430 - RNA, 22 nt, Human
cuuuaagacucugcucuuggug

SEQ ID NO: 212431 - RNA, 22 nt, Human
ccagagcugagggagccugagc

SEQ ID NO: 212432 - RNA, 22 nt, Human
uugcuuccucuaguuucuugaa

SEQ ID NO: 212433 - RNA, 22 nt, Human
auaucacagguguuuaccugau

SEQ ID NO: 212434 - RNA, 19 nt, Human
ccagaguuggcagagcagg

SEQ ID NO: 212435 - RNA, 22 nt, Human
ugggaugagcuauauagaaagu

SEQ ID NO: 212436 - RNA, 22 nt, Human
aacuaguaaaagcaacaguaua

SEQ ID NO: 212437 - RNA, 22 nt, Human
auaacaugaccugugcuucaca

SEQ ID NO: 212438 - RNA, 22 nt, Human
ucauauaagagcuuuagaguca

SEQ ID NO: 212439 - RNA, 22 nt, Human
ccucaaaucuuuagaguuauuu

SEQ ID NO: 212440 - RNA, 22 nt, Human
ccagcucccgcaggcugcacag

SEQ ID NO: 212441 - RNA, 22 nt, Human
guuuagaaaauagugaagcaag

SEQ ID NO: 212442 - RNA, 22 nt, Human
cauguauaguuggaacuacauc

SEQ ID NO: 212443 - RNA, 22 nt, Human
ggaggcugagaaguccaagauc

SEQ ID NO: 212444 - RNA, 23 nt, Human
cacaggcagaaaucaagacggua

SEQ ID NO: 212445 - RNA, 22 nt, Human
uucuuucucaacaugaauguuu

SEQ ID NO: 212446 - RNA, 22 nt, Human
ucucugaggacuugggguugcc

SEQ ID NO: 212447 - RNA, 22 nt, Human
ccugagcuccaguagcagccag

SEQ ID NO: 212448 - RNA, 23 nt, Human
ggcucugaggauggagcuggugg

SEQ ID NO: 212449 - RNA, 22 nt, Human
acuaaauauuugagagguguag

SEQ ID NO: 212450 - RNA, 22 nt, Human
cacagaaauuauuaggaugcuu

SEQ ID NO: 212451 - RNA, 22 nt, Human
gcuuccuuccuuacauuggugg

SEQ ID NO: 212452 - RNA, 22 nt, Human
augcauugucugguuucauuuu

SEQ ID NO: 212453 - RNA, 22 nt, Human
aauguuaauucacagccaaaua

SEQ ID NO: 212454 - RNA, 22 nt, Human
auguuacacauaggcauaaaug

SEQ ID NO: 212455 - RNA, 22 nt, Human
uucauucuugggaucagagagu

SEQ ID NO: 212456 - RNA, 22 nt, Human
aggaaacucugagcggaccagc

SEQ ID NO: 212457 - RNA, 22 nt, Human
caucagaagaaagacaaaugau

SEQ ID NO: 212458 - RNA, 22 nt, Human
uccugcagguggaugauucucu

SEQ ID NO: 212459 - RNA, 22 nt, Human
uccaggucuggccugcuaggca

SEQ ID NO: 212460 - RNA, 22 nt, Human
acacaaguucuaaagauugcgc

SEQ ID NO: 212461 - RNA, 22 nt, Human
uuguuuuaguagguacacugag

SEQ ID NO: 212462 - RNA, 22 nt, Human
gagcugagggucuaggaggguu

SEQ ID NO: 212463 - RNA, 22 nt, Human
cuggaagggucuacuuagcaga

SEQ ID NO: 212464 - RNA, 20 nt, Human
uucacagaggacucagguca

SEQ ID NO: 212465 - RNA, 22 nt, Human
uugugucccuguaagacaaagc

SEQ ID NO: 212466 - RNA, 22 nt, Human
gaauauuuuuaaagggacuaau

SEQ ID NO: 212467 - RNA, 22 nt, Human
accugccucagugcagcuggau

SEQ ID NO: 212468 - RNA, 22 nt, Human
auggcuugauagaaagcuaguu

SEQ ID NO: 212469 - RNA, 22 nt, Human
ggaagagagggcugggccucaa

SEQ ID NO: 212470 - RNA, 17 nt, Human
aucuggaagcuagcuga

SEQ ID NO: 212471 - RNA, 22 nt, Human
ucaggauggagggaagcacaga

SEQ ID NO: 212472 - RNA, 22 nt, Human
agcugcugccucacuggucugu

SEQ ID NO: 212473 - RNA, 22 nt, Human
ggaggggagucucccaaagccg

SEQ ID NO: 212474 - RNA, 22 nt, Human
cucuguuacagcccccugccuc

SEQ ID NO: 212475 - RNA, 22 nt, Human
auaugaaaauguuuuagcugua

SEQ ID NO: 212476 - RNA, 22 nt, Human
ggcuuguccuucugguugucuu

SEQ ID NO: 212477 - RNA, 22 nt, Human
ugugggaggaacacagccagaa

SEQ ID NO: 212478 - RNA, 21 nt, Human
uuuucccacugaaagcuccca

SEQ ID NO: 212479 - RNA, 22 nt, Human
guaacacuuggcugcaaccugg

SEQ ID NO: 212480 - RNA, 17 nt, Human
aggcugcugggccaggg

SEQ ID NO: 212481 - RNA, 18 nt, Human
aggcaggugcuggaaguc

SEQ ID NO: 212482 - RNA, 22 nt, Human
acuguuaaaguaauuaauuguc

SEQ ID NO: 212483 - RNA, 22 nt, Human
cagcuugugucauucaucuugu

SEQ ID NO: 212484 - RNA, 22 nt, Human
ugaaggcauugaugaaggaauc

SEQ ID NO: 212485 - RNA, 22 nt, Human
aggaggcugcaacccugaggcc

SEQ ID NO: 212486 - RNA, 22 nt, Human
ggagccuguggccgucacgacu

SEQ ID NO: 212487 - RNA, 22 nt, Human
aaucaacauuguuuuaagucaa

SEQ ID NO: 212488 - RNA, 22 nt, Human
uguuaucugcacguagaguuuu

SEQ ID NO: 212489 - RNA, 23 nt, Human
ggguccagagacaggcaugggug

SEQ ID NO: 212490 - RNA, 21 nt, Human
uccuccuucaaguccuggccu

SEQ ID NO: 212491 - RNA, 18 nt, Human
uucuggguguuauguuua

SEQ ID NO: 212492 - RNA, 22 nt, Human
ucaagcaaauguccuuuuguuc

SEQ ID NO: 212493 - RNA, 22 nt, Human
auucuacaacccaauaauaauu

SEQ ID NO: 212494 - RNA, 22 nt, Human
gcuuccagacgaucauguaaga

SEQ ID NO: 212495 - RNA, 22 nt, Human
uguggcuguguccaccugcugc

SEQ ID NO: 212496 - RNA, 19 nt, Human
agccagaacuaguguuucu

SEQ ID NO: 212497 - RNA, 22 nt, Human
aaguccagacuccuuugcgugg

SEQ ID NO: 212498 - RNA, 22 nt, Human
ucucgacagccuggcacagugg

SEQ ID NO: 212499 - RNA, 22 nt, Human
aagggcaggugggcauuucugg

SEQ ID NO: 212500 - RNA, 22 nt, Human
ggagccagaguuuaauguggag

SEQ ID NO: 212501 - RNA, 22 nt, Human
ccagugcccagucucccugguc

SEQ ID NO: 212502 - RNA, 22 nt, Human
aagccaguguccagaaugggca

SEQ ID NO: 212503 - RNA, 22 nt, Human
ucuguugacuccuagcagccau

SEQ ID NO: 212504 - RNA, 22 nt, Human
gaauacaugauacaugaacugc

SEQ ID NO: 212505 - RNA, 22 nt, Human
ucucugaaugagauuacugccu

SEQ ID NO: 212506 - RNA, 22 nt, Human
gcugcaggagcuggagcugugg

SEQ ID NO: 212507 - RNA, 22 nt, Human
ucacgugagggaccugugucug

SEQ ID NO: 212508 - RNA, 22 nt, Human
uccauucuuuuuaccucucaga

SEQ ID NO: 212509 - RNA, 22 nt, Human
uuggaucuuaugaagguggcau

SEQ ID NO: 212510 - RNA, 21 nt, Human
agggagcugcgucuugaaaga

SEQ ID NO: 212511 - RNA, 22 nt, Human
gcagagaagaugcccaggcuuc

SEQ ID NO: 212512 - RNA, 22 nt, Human
gacagcagauacuuucauugaa

SEQ ID NO: 212513 - RNA, 22 nt, Human
uguaucauauggggaagcuuca

SEQ ID NO: 212514 - RNA, 22 nt, Human
uccaugccaggcagucgaugca

SEQ ID NO: 212515 - RNA, 22 nt, Human
uccuccaggucuaggguggcuu

SEQ ID NO: 212516 - RNA, 22 nt, Human
ugcucaaugucuuaugagacug

SEQ ID NO: 212517 - RNA, 22 nt, Human
caggauggugugagugugagga

SEQ ID NO: 212518 - RNA, 22 nt, Human
ggaacuugaaaaucaagguggu

SEQ ID NO: 212519 - RNA, 22 nt, Human
caagauaagaucauuuacacua

SEQ ID NO: 212520 - RNA, 22 nt, Human
uugauguacagaauuguucaca

SEQ ID NO: 212521 - RNA, 22 nt, Human
ugugggaaguuuggagggaaag

SEQ ID NO: 212522 - RNA, 22 nt, Human
ucauuuacauagaaacaauaua

SEQ ID NO: 212523 - RNA, 19 nt, Human
agcuuccauauucucuagu

SEQ ID NO: 212524 - RNA, 18 nt, Human
agcagguggauuuauugg

SEQ ID NO: 212525 - RNA, 22 nt, Human
cagcuguugugauuuccaggag

SEQ ID NO: 212526 - RNA, 19 nt, Human
gcucagagccaugggggcu

SEQ ID NO: 212527 - RNA, 22 nt, Human
aaguuuuauuggcuauagcacu

SEQ ID NO: 212528 - RNA, 22 nt, Human
aagggcagcugacagaugcuua

SEQ ID NO: 212529 - RNA, 22 nt, Human
acugagcucugaugagauuugg

SEQ ID NO: 212530 - RNA, 22 nt, Human
uuucgagggccuuaaguauucc

SEQ ID NO: 212531 - RNA, 22 nt, Human
aaugaaugaaccacauauaaca

SEQ ID NO: 212532 - RNA, 22 nt, Human
acucugaaugugcauguaaauc

SEQ ID NO: 212533 - RNA, 22 nt, Human
ucugaaagaaagauuuuguuuc

SEQ ID NO: 212534 - RNA, 22 nt, Human
cagcugcaggaacaaaaaugug

SEQ ID NO: 212535 - RNA, 22 nt, Human
ugaaagcagugccaugauuaug

SEQ ID NO: 212536 - RNA, 22 nt, Human
uucuuccucacacucucaccca

SEQ ID NO: 212537 - RNA, 18 nt, Human
ggccagcuccugaggcag

SEQ ID NO: 212538 - RNA, 22 nt, Human
ggccucucagggcagagacccu

SEQ ID NO: 212539 - RNA, 22 nt, Human
aacauguaaccagcauucaucu

SEQ ID NO: 212540 - RNA, 19 nt, Human
ggcucuggcggcuguagcc

SEQ ID NO: 212541 - RNA, 22 nt, Human
ggucuggccaauagacagcccc

SEQ ID NO: 212542 - RNA, 22 nt, Human
cuggcaggagcauucacagagg

SEQ ID NO: 212543 - RNA, 22 nt, Human
agauguggauccuaggguagaa

SEQ ID NO: 212544 - RNA, 22 nt, Human
ucugggucuuaguuuucuugau

SEQ ID NO: 212545 - RNA, 22 nt, Human
guugugcagucagacugccugg

SEQ ID NO: 212546 - RNA, 22 nt, Human
uuaguucuugggugaacuuuug

SEQ ID NO: 212547 - RNA, 22 nt, Human
caucagugcccuuggggaugcc

SEQ ID NO: 212548 - RNA, 22 nt, Human
gacagcuuagugaaaauguaaa

SEQ ID NO: 212549 - RNA, 22 nt, Human
guucaguuaugugaccucaaaa

SEQ ID NO: 212550 - RNA, 22 nt, Human
aggaacaggccucguuuucuau

SEQ ID NO: 212551 - RNA, 22 nt, Human
uauuucacucaguauaccauag

SEQ ID NO: 212552 - RNA, 22 nt, Human
ggcucuggugugaagcagccuc

SEQ ID NO: 212553 - RNA, 22 nt, Human
guccuggccucuggggguaugg

SEQ ID NO: 212554 - RNA, 20 nt, Human
cuuguacaugauaaagauuu

SEQ ID NO: 212555 - RNA, 22 nt, Human
aacuuucagaauccuaugcauu

SEQ ID NO: 212556 - RNA, 18 nt, Human
agaugaaagcaaaugaca

SEQ ID NO: 212557 - RNA, 22 nt, Human
ugaugaguaaauaagguugagu

SEQ ID NO: 212558 - RNA, 22 nt, Human
gcauggcauuaacaagauggaa

SEQ ID NO: 212559 - RNA, 22 nt, Human
auccucagcaucuagcaugaag

SEQ ID NO: 212560 - RNA, 18 nt, Human
gggaggccccagcaggag

SEQ ID NO: 212561 - RNA, 22 nt, Human
uagcuuggaauaaaaugagaau

SEQ ID NO: 212562 - RNA, 22 nt, Human
gccuggggaacuugauccuguc

SEQ ID NO: 212563 - RNA, 22 nt, Human
auuuaauaccacuuggugcuuu

SEQ ID NO: 212564 - RNA, 22 nt, Human
ggagccagaaaugcugugguug

SEQ ID NO: 212565 - RNA, 22 nt, Human
agucugucucugcuaaucacua

SEQ ID NO: 212566 - RNA, 23 nt, Human
ggcagccucugacucugcuuugc

SEQ ID NO: 212567 - RNA, 22 nt, Human
agagggcugccucagucagcua

SEQ ID NO: 212568 - RNA, 22 nt, Human
gaaaggccauuucugaggguuu

SEQ ID NO: 212569 - RNA, 19 nt, Human
ccccaggguaggcuagggg

SEQ ID NO: 212570 - RNA, 22 nt, Human
agacaggcagggcauggaaaaa

SEQ ID NO: 212571 - RNA, 22 nt, Human
uuuaguguagcauucagaguca

SEQ ID NO: 212572 - RNA, 22 nt, Human
uacuggcaauuucauauggugc

SEQ ID NO: 212573 - RNA, 22 nt, Human
auaaggcagucccuuaacaagg

SEQ ID NO: 212574 - RNA, 22 nt, Human
cccaggagccaucugucuuggc

SEQ ID NO: 212575 - RNA, 22 nt, Human
ugaggcacauccaggccagcuc

SEQ ID NO: 212576 - RNA, 22 nt, Human
auucaguguaguuauuaucuuu

SEQ ID NO: 212577 - RNA, 22 nt, Human
agcugccacauggugucacugu

SEQ ID NO: 212578 - RNA, 22 nt, Human
gcugccccagcugggggcugga

SEQ ID NO: 212579 - RNA, 22 nt, Human
uuuaaaaguuaucaucugucca

SEQ ID NO: 212580 - RNA, 22 nt, Human
ccugggaguggcacucacagca

SEQ ID NO: 212581 - RNA, 22 nt, Human
aucugggucacaguggcaucua

SEQ ID NO: 212582 - RNA, 22 nt, Human
cagaggggcugacacccuuggc

SEQ ID NO: 212583 - RNA, 22 nt, Human
gaggggaugcagagaggcuuau

SEQ ID NO: 212584 - RNA, 20 nt, Human
gcuuccaggagggcugauau

SEQ ID NO: 212585 - RNA, 22 nt, Human
aagcugcuggugacugggcuga

SEQ ID NO: 212586 - RNA, 22 nt, Human
gggaagggagggccuccaguca

SEQ ID NO: 212587 - RNA, 22 nt, Human
ccuggcagguuacaaccaguua

SEQ ID NO: 212588 - RNA, 22 nt, Human
uaacacugccaugcuggaguca

SEQ ID NO: 212589 - RNA, 22 nt, Human
gcucaaagaccagacagaggag

SEQ ID NO: 212590 - RNA, 22 nt, Human
caagauggacauaaggagagaa

SEQ ID NO: 212591 - RNA, 22 nt, Human
gccuguguggaugggccccugg

SEQ ID NO: 212592 - RNA, 22 nt, Human
ugcccagggauaagccuagaga

SEQ ID NO: 212593 - RNA, 22 nt, Human
gcaggcccagagucgcuggccu

SEQ ID NO: 212594 - RNA, 19 nt, Human
auuugcuugucugcucugc

SEQ ID NO: 212595 - RNA, 22 nt, Human
uuagcucuuuguagcuauuucu

SEQ ID NO: 212596 - RNA, 22 nt, Human
ucuguuuagacucaguugaaac

SEQ ID NO: 212597 - RNA, 22 nt, Human
acugccuucaaacagcgccacc

SEQ ID NO: 212598 - RNA, 22 nt, Human
aaugcuuugacuauaucuauaa

SEQ ID NO: 212599 - RNA, 22 nt, Human
gccuccugacuuacacugagcu

SEQ ID NO: 212600 - RNA, 22 nt, Human
uagaaucuccagcauugguugu

SEQ ID NO: 212601 - RNA, 23 nt, Human
agcaauaagaagggauacaugug

SEQ ID NO: 212602 - RNA, 22 nt, Human
gcuggcaggagaccauacccua

SEQ ID NO: 212603 - RNA, 21 nt, Human
acuguucauuugaugaacugg

SEQ ID NO: 212604 - RNA, 22 nt, Human
ucagggacgugagcucagaguc

SEQ ID NO: 212605 - RNA, 22 nt, Human
aucuggagcucugcacaccugg

SEQ ID NO: 212606 - RNA, 22 nt, Human
gaccuggguaaggggcugacaa

SEQ ID NO: 212607 - RNA, 22 nt, Human
cucuuaaauaacaucauugcuu

SEQ ID NO: 212608 - RNA, 22 nt, Human
acugagggcauaaaaguacugu

SEQ ID NO: 212609 - RNA, 18 nt, Human
ugguccaguucagauaua

SEQ ID NO: 212610 - RNA, 22 nt, Human
cagccacuggugccaggcuguu

SEQ ID NO: 212611 - RNA, 22 nt, Human
auuucuuucuggccacgguuuu

SEQ ID NO: 212612 - RNA, 22 nt, Human
gggagcagccugccucccaccu

SEQ ID NO: 212613 - RNA, 22 nt, Human
gguauuuauaugucugaagcug

SEQ ID NO: 212614 - RNA, 22 nt, Human
ugaguccauugauggauaguga

SEQ ID NO: 212615 - RNA, 22 nt, Human
agcagcagcucauucuuccugu

SEQ ID NO: 212616 - RNA, 22 nt, Human
uuacauaacgguaugaaaaaug

SEQ ID NO: 212617 - RNA, 19 nt, Human
aaccuuagcuucucaggcc

SEQ ID NO: 212618 - RNA, 22 nt, Human
cuccaugaauuugagcuuugug

SEQ ID NO: 212619 - RNA, 22 nt, Human
uccugccugcaaucccagcacu

SEQ ID NO: 212620 - RNA, 22 nt, Human
cugcagaacaauuccugcuguu

SEQ ID NO: 212621 - RNA, 22 nt, Human
caaggaaguuuuaggagaggaa

SEQ ID NO: 212622 - RNA, 22 nt, Human
aagggcucccugccugaggugg

SEQ ID NO: 212623 - RNA, 22 nt, Human
acuguggaugccaaaggggagg

SEQ ID NO: 212624 - RNA, 22 nt, Human
uuuggagagaugaaguucugug

SEQ ID NO: 212625 - RNA, 22 nt, Human
acaggaucgcccuguugcccag

SEQ ID NO: 212626 - RNA, 22 nt, Human
ugcuuuauguuaucagaagggu

SEQ ID NO: 212627 - RNA, 22 nt, Human
cucugccugugucgccaccaca

SEQ ID NO: 212628 - RNA, 22 nt, Human
cagaggcagaggucaucucugg

SEQ ID NO: 212629 - RNA, 22 nt, Human
acaauacaggcuucuggacuua

SEQ ID NO: 212630 - RNA, 22 nt, Human
gagaccuuaagagaugucagcu

SEQ ID NO: 212631 - RNA, 21 nt, Human
ucccacugccacagcuucagg

SEQ ID NO: 212632 - RNA, 22 nt, Human
agcuuuaucccuugcccaucga

SEQ ID NO: 212633 - RNA, 22 nt, Human
gugaauuaaauauagccagguc

SEQ ID NO: 212634 - RNA, 22 nt, Human
uguguucaaugacuucaucuuu

SEQ ID NO: 212635 - RNA, 22 nt, Human
caccaggaagugguggccuggg

SEQ ID NO: 212636 - RNA, 22 nt, Human
caggggcucccugggugccagu

SEQ ID NO: 212637 - RNA, 22 nt, Human
agauaagauaguccagcacaau

SEQ ID NO: 212638 - RNA, 22 nt, Human
cagcuucuccauucuucuggcu

SEQ ID NO: 212639 - RNA, 22 nt, Human
gguggcugaagcagucuucggg

SEQ ID NO: 212640 - RNA, 22 nt, Human
guggauggagcuggaagccauu

SEQ ID NO: 212641 - RNA, 22 nt, Human
gcugcaaaccugccaccuggug

SEQ ID NO: 212642 - RNA, 21 nt, Human
uuagcaagucuacccauuucu

SEQ ID NO: 212643 - RNA, 22 nt, Human
agcacaguuuucauugcagggu

SEQ ID NO: 212644 - RNA, 22 nt, Human
cagcuggcugcaugaugccaaa

SEQ ID NO: 212645 - RNA, 23 nt, Human
gacagagugagaccuugucuuac

SEQ ID NO: 212646 - RNA, 22 nt, Human
ugucacaucaggugguggcugu

SEQ ID NO: 212647 - RNA, 17 nt, Human
cucuguggagguguuua

SEQ ID NO: 212648 - RNA, 22 nt, Human
gcugcagggagcuggaaggcuc

SEQ ID NO: 212649 - RNA, 22 nt, Human
gugaauggggcaggaaggaugg

SEQ ID NO: 212650 - RNA, 22 nt, Human
cacauaaucaccaaguccuuuc

SEQ ID NO: 212651 - RNA, 22 nt, Human
gaauuacagaguuguuaaguca

SEQ ID NO: 212652 - RNA, 23 nt, Human
ggcaccaggccauggagcgggag

SEQ ID NO: 212653 - RNA, 22 nt, Human
uuccuacauuuguacaauaaga

SEQ ID NO: 212654 - RNA, 22 nt, Human
ugaaggcacuugccuaggggca

SEQ ID NO: 212655 - RNA, 22 nt, Human
uacuaaauaguuuaauuccuca

SEQ ID NO: 212656 - RNA, 22 nt, Human
ugaaaugcaacaguuauuuuug

SEQ ID NO: 212657 - RNA, 22 nt, Human
uuucacaacugcuuauuugaga

SEQ ID NO: 212658 - RNA, 23 nt, Human
cagugcugguucugccugugggg

SEQ ID NO: 212659 - RNA, 22 nt, Human
cagcccacgucagggccacuca

SEQ ID NO: 212660 - RNA, 22 nt, Human
aagugguuauuuugaucuagaa

SEQ ID NO: 212661 - RNA, 22 nt, Human
cagaagugauguugagcuaguc

SEQ ID NO: 212662 - RNA, 22 nt, Human
uccagcagccugacuucccucu

SEQ ID NO: 212663 - RNA, 22 nt, Human
uguuuccauggugacagcagcu

SEQ ID NO: 212664 - RNA, 22 nt, Human
uggcuucuuacuagggcucagu

SEQ ID NO: 212665 - RNA, 22 nt, Human
ugcuugaacaaggauaaauuug

SEQ ID NO: 212666 - RNA, 23 nt, Human
aaugauuucaugaugauagcagc

SEQ ID NO: 212667 - RNA, 22 nt, Human
uuuaagacuuagauuuauuggg

SEQ ID NO: 212668 - RNA, 22 nt, Human
cuguuagugaucaaagggagag

SEQ ID NO: 212669 - RNA, 22 nt, Human
gggaagagggagcuggaaugau

SEQ ID NO: 212670 - RNA, 22 nt, Human
guggaggaagggauucagacca

SEQ ID NO: 212671 - RNA, 22 nt, Human
ugaucuggaauucccuguggua

SEQ ID NO: 212672 - RNA, 22 nt, Human
ggcacagagcuccagccuuggc

SEQ ID NO: 212673 - RNA, 22 nt, Human
ccugagucuuucccauugcgcu

SEQ ID NO: 212674 - RNA, 22 nt, Human
gccacauuagcccucaccaucu

SEQ ID NO: 212675 - RNA, 18 nt, Human
cugcccagagcauuucau

SEQ ID NO: 212676 - RNA, 22 nt, Human
cugccuggaccggcagcccucc

SEQ ID NO: 212677 - RNA, 22 nt, Human
augaacaauaaaauagaucaca

SEQ ID NO: 212678 - RNA, 22 nt, Human
auacuucuagaaauacuaugca

SEQ ID NO: 212679 - RNA, 22 nt, Human
auaaaaugguaaacgaagcuga

SEQ ID NO: 212680 - RNA, 22 nt, Human
guuuacaguggcuucauuggau

SEQ ID NO: 212681 - RNA, 19 nt, Human
cugucccagacucugcucu

SEQ ID NO: 212682 - RNA, 22 nt, Human
uccuggggccagcacuggugga

SEQ ID NO: 212683 - RNA, 22 nt, Human
uccaggacagaguagaagcagc

SEQ ID NO: 212684 - RNA, 22 nt, Human
caauauauaggaacaacuuagg

SEQ ID NO: 212685 - RNA, 22 nt, Human
ucagguguagguuguucaguuu

SEQ ID NO: 212686 - RNA, 22 nt, Human
agcaugcuauauugauuguagu

SEQ ID NO: 212687 - RNA, 22 nt, Human
gaggggcacagcagcuguugca

SEQ ID NO: 212688 - RNA, 22 nt, Human
caugccagguuugaguaucuug

SEQ ID NO: 212689 - RNA, 22 nt, Human
acaaauggaagguguucucuuc

SEQ ID NO: 212690 - RNA, 22 nt, Human
uuucuaggcacagugucuuccc

SEQ ID NO: 212691 - RNA, 22 nt, Human
agauacauuaguaguuacuugu

SEQ ID NO: 212692 - RNA, 22 nt, Human
uucucuagcaaaaccagcuagu

SEQ ID NO: 212693 - RNA, 22 nt, Human
ugugccugucccgcauucuggu

SEQ ID NO: 212694 - RNA, 22 nt, Human
aggucaagggcaagagugaggu

SEQ ID NO: 212695 - RNA, 22 nt, Human
uuugaacugauaaucuucuguu

SEQ ID NO: 212696 - RNA, 22 nt, Human
uauuucugggaguucagaaauu

SEQ ID NO: 212697 - RNA, 21 nt, Human
aggcccagagucuugggggga

SEQ ID NO: 212698 - RNA, 23 nt, Human
agcugggaauuuucugaagcuuu

SEQ ID NO: 212699 - RNA, 16 nt, Human
aggcucagaggcugga

SEQ ID NO: 212700 - RNA, 22 nt, Human
aagcauguacucaagcaaaugu

SEQ ID NO: 212701 - RNA, 22 nt, Human
gggagcugcggucuugcgaaga

SEQ ID NO: 212702 - RNA, 22 nt, Human
acaauacuuaccaauguuuuug

SEQ ID NO: 212703 - RNA, 22 nt, Human
aaacccugcccuucccaagaug

SEQ ID NO: 212704 - RNA, 22 nt, Human
agcugcuugggaaccaucaauu

SEQ ID NO: 212705 - RNA, 22 nt, Human
cuuccaggugcuggccuggccu

SEQ ID NO: 212706 - RNA, 22 nt, Human
agcuuuaaaaauccaauaucca

SEQ ID NO: 212707 - RNA, 22 nt, Human
cucuuugguuaaucacacagau

SEQ ID NO: 212708 - RNA, 22 nt, Human
agaaguauaacuauuugcuuuc

SEQ ID NO: 212709 - RNA, 22 nt, Human
cccagaggugcuucagaggugc

SEQ ID NO: 212710 - RNA, 22 nt, Human
uuaggaaacaguagccuuugcu

SEQ ID NO: 212711 - RNA, 22 nt, Human
uguuuauaccugcaaccuguca

SEQ ID NO: 212712 - RNA, 22 nt, Human
aagaaaccaacccugccagcac

SEQ ID NO: 212713 - RNA, 22 nt, Human
ugaucuuuucuauuuaugguag

SEQ ID NO: 212714 - RNA, 22 nt, Human
aggagcucagcuaaguuggaga

SEQ ID NO: 212715 - RNA, 22 nt, Human
agucuguguacuggguuucugu

SEQ ID NO: 212716 - RNA, 22 nt, Human
uccuccccugcccaugaggagg

SEQ ID NO: 212717 - RNA, 22 nt, Human
ccagaggcuggcagccagcuga

SEQ ID NO: 212718 - RNA, 19 nt, Human
cugucugugcagagaugug

SEQ ID NO: 212719 - RNA, 22 nt, Human
uauugcugccauuuuccaaugu

SEQ ID NO: 212720 - RNA, 22 nt, Human
aagguggugaucaucuugaagg

SEQ ID NO: 212721 - RNA, 22 nt, Human
auacaacugcucucagauaagu

SEQ ID NO: 212722 - RNA, 22 nt, Human
uccccaggaguuuuacuuugca

SEQ ID NO: 212723 - RNA, 22 nt, Human
accucaagaauguauaacacag

SEQ ID NO: 212724 - RNA, 22 nt, Human
acacaccaugauuuauuuaccc

SEQ ID NO: 212725 - RNA, 22 nt, Human
aguugugcugugaugcaggaua

SEQ ID NO: 212726 - RNA, 22 nt, Human
uuuccuuugcccaauacauguc

SEQ ID NO: 212727 - RNA, 22 nt, Human
gaauuuucagguagcaauuuca

SEQ ID NO: 212728 - RNA, 22 nt, Human
aguuauuuacuccuuugucucu

SEQ ID NO: 212729 - RNA, 22 nt, Human
ggucuccauuccuucaucucac

SEQ ID NO: 212730 - RNA, 19 nt, Human
cccagagagaucucuugcc

SEQ ID NO: 212731 - RNA, 23 nt, Human
auagacccaagaguaaaggcauc

SEQ ID NO: 212732 - RNA, 22 nt, Human
uguacaaucugaugauguaugg

SEQ ID NO: 212733 - RNA, 22 nt, Human
agcaagaugcaaacauccgucc

SEQ ID NO: 212734 - RNA, 23 nt, Human
aaccuagacuacuuacuaugugg

SEQ ID NO: 212735 - RNA, 22 nt, Human
gcagcauccuuggccuccaccc

SEQ ID NO: 212736 - RNA, 22 nt, Human
cugggcuuuugagucacaaggg

SEQ ID NO: 212737 - RNA, 22 nt, Human
aacaacugaaaagcuuuuucug

SEQ ID NO: 212738 - RNA, 22 nt, Human
ccagaaguuccuaagcaucauu

SEQ ID NO: 212739 - RNA, 22 nt, Human
uuaggaaagcauuguguaaaag

SEQ ID NO: 212740 - RNA, 22 nt, Human
ucaggcuuugggaaugccacuu

SEQ ID NO: 212741 - RNA, 19 nt, Human
uccagccugcuguuucucu

SEQ ID NO: 212742 - RNA, 20 nt, Human
uuucaaaggcaccuaugaag

SEQ ID NO: 212743 - RNA, 23 nt, Human
aaauauucuuuuuuaguaagugc

SEQ ID NO: 212744 - RNA, 22 nt, Human
gauucaaaaauaagcuccuauu

SEQ ID NO: 212745 - RNA, 22 nt, Human
ccuucuucaccaguuuaccuga

SEQ ID NO: 212746 - RNA, 23 nt, Human
agauuuggaaagcugaguggcgu

SEQ ID NO: 212747 - RNA, 22 nt, Human
aaagcauuauucuguggaaaaa

SEQ ID NO: 212748 - RNA, 22 nt, Human
cucucgcgugugccuuuccgcu

SEQ ID NO: 212749 - RNA, 22 nt, Human
uuuagcuuuugugucagauaag

SEQ ID NO: 212750 - RNA, 22 nt, Human
ccauuaguaccucuggaaaauu

SEQ ID NO: 212751 - RNA, 22 nt, Human
ugguaaauauguccauucucuu

SEQ ID NO: 212752 - RNA, 22 nt, Human
ugaggccugcuuggaauugaau

SEQ ID NO: 212753 - RNA, 22 nt, Human
guccagaaggaggucaaguugg

SEQ ID NO: 212754 - RNA, 22 nt, Human
acagcagcugccuucaggcucu

SEQ ID NO: 212755 - RNA, 22 nt, Human
gaagauuucuuuaugaaagaug

SEQ ID NO: 212756 - RNA, 22 nt, Human
aaacaggcgcuuacuaagaaaa

SEQ ID NO: 212757 - RNA, 21 nt, Human
cugaauuaugugcuuaccuuu

SEQ ID NO: 212758 - RNA, 22 nt, Human
cagguucugaggauggugccug

SEQ ID NO: 212759 - RNA, 22 nt, Human
uaaggacauuagaaaugaugcu

SEQ ID NO: 212760 - RNA, 22 nt, Human
ggcccagcccgagucagccuuc

SEQ ID NO: 212761 - RNA, 22 nt, Human
agucuagggugggguccacagg

SEQ ID NO: 212762 - RNA, 22 nt, Human
uuacaguuacugguacuguuaa

SEQ ID NO: 212763 - RNA, 22 nt, Human
cuauuacauuucuggacauuca

SEQ ID NO: 212764 - RNA, 22 nt, Human
gggugaggagcugccagucaug

SEQ ID NO: 212765 - RNA, 20 nt, Human
aacagcacacauucgcauua

SEQ ID NO: 212766 - RNA, 22 nt, Human
aagacuacuuuuggcagugugu

SEQ ID NO: 212767 - RNA, 22 nt, Human
aggacaguggacacuagucccu

SEQ ID NO: 212768 - RNA, 22 nt, Human
uuugagaaaaccagaaagaucu

SEQ ID NO: 212769 - RNA, 19 nt, Human
uuucucugugcaccuuuuc

SEQ ID NO: 212770 - RNA, 20 nt, Human
uccagccccugcauguugcu

SEQ ID NO: 212771 - RNA, 22 nt, Human
ccuguggccugaauuugguaaa

SEQ ID NO: 212772 - RNA, 22 nt, Human
uuucugaagucuucuaacagau

SEQ ID NO: 212773 - RNA, 22 nt, Human
uuguaaaugaccuuuucuaauu

SEQ ID NO: 212774 - RNA, 22 nt, Human
gucugugggccaaauacagccc

SEQ ID NO: 212775 - RNA, 18 nt, Human
cuccagggaacucaguca

SEQ ID NO: 212776 - RNA, 22 nt, Human
ccaugccccaccaggacgcugc

SEQ ID NO: 212777 - RNA, 22 nt, Human
aucaggauagugguuaccuggg

SEQ ID NO: 212778 - RNA, 17 nt, Human
uccauuccuaaggcccu

SEQ ID NO: 212779 - RNA, 22 nt, Human
aggcugagaaagugggaagaug

SEQ ID NO: 212780 - RNA, 16 nt, Human
auuuccagauuaugca

SEQ ID NO: 212781 - RNA, 22 nt, Human
aggcugccuguuccaaucuccu

SEQ ID NO: 212782 - RNA, 21 nt, Human
gcugcaaauucuaacaauuau

SEQ ID NO: 212783 - RNA, 22 nt, Human
acagcugcucaccugugagccc

SEQ ID NO: 212784 - RNA, 22 nt, Human
aagggcaggcacccacccucac

SEQ ID NO: 212785 - RNA, 22 nt, Human
ucuuuccagaggaauuuuuaga

SEQ ID NO: 212786 - RNA, 19 nt, Human
aguccaugaauggaggaug

SEQ ID NO: 212787 - RNA, 22 nt, Human
uucugaaaauugggucauacuu

SEQ ID NO: 212788 - RNA, 22 nt, Human
auccaggcgaaugcagaaggcc

SEQ ID NO: 212789 - RNA, 22 nt, Human
uuaagauagaacccaguagucu

SEQ ID NO: 212790 - RNA, 22 nt, Human
auuuccaugaaguuuaguuaua

SEQ ID NO: 212791 - RNA, 22 nt, Human
ccaguauucgaucuggccaguu

SEQ ID NO: 212792 - RNA, 22 nt, Human
gcagggcuggguccugucucau

SEQ ID NO: 212793 - RNA, 22 nt, Human
ugacaggcguuuuucucuagua

SEQ ID NO: 212794 - RNA, 22 nt, Human
cagugaaauaguggacaucaaa

SEQ ID NO: 212795 - RNA, 22 nt, Human
caaaugaugcauggcuagugag

SEQ ID NO: 212796 - RNA, 22 nt, Human
ucaggugggcaguggguugagc

SEQ ID NO: 212797 - RNA, 22 nt, Human
ucugccuuuguggucgggagaa

SEQ ID NO: 212798 - RNA, 22 nt, Human
ccaccaagucccacuauaauuu

SEQ ID NO: 212799 - RNA, 22 nt, Human
ccacucccuuccgguccagggc

SEQ ID NO: 212800 - RNA, 22 nt, Human
ucugucucuuuguucugugagu

SEQ ID NO: 212801 - RNA, 22 nt, Human
aaaggcaggcuuucacaucuca

SEQ ID NO: 212802 - RNA, 22 nt, Human
aagaagcauucuuucauugguu

SEQ ID NO: 212803 - RNA, 22 nt, Human
agauggagaaugacaauuaagg

SEQ ID NO: 212804 - RNA, 22 nt, Human
acagaggccucguagguacaac

SEQ ID NO: 212805 - RNA, 22 nt, Human
ggugaguugggguucacagguc

SEQ ID NO: 212806 - RNA, 22 nt, Human
acagggcauuuccucuaugugu

SEQ ID NO: 212807 - RNA, 22 nt, Human
ccagauucauagaaacucauag

SEQ ID NO: 212808 - RNA, 22 nt, Human
aggagcuggccuagaaaggaga

SEQ ID NO: 212809 - RNA, 22 nt, Human
caugucuuauauccugucuuca

SEQ ID NO: 212810 - RNA, 22 nt, Human
uaucaauaucucagugugcuuc

SEQ ID NO: 212811 - RNA, 23 nt, Human
aacagcaggaugauagaggaggu

SEQ ID NO: 212812 - RNA, 22 nt, Human
gaggucaugcaaaauugaauca

SEQ ID NO: 212813 - RNA, 22 nt, Human
aagccauggcugcaucagccug

SEQ ID NO: 212814 - RNA, 22 nt, Human
aucuguucuucaaaauauuaca

SEQ ID NO: 212815 - RNA, 22 nt, Human
aucuaaacccuacuuucuuucu

SEQ ID NO: 212816 - RNA, 18 nt, Human
cugucaccgccaccacac

SEQ ID NO: 212817 - RNA, 22 nt, Human
uuauuguuuggguauaauuuga

SEQ ID NO: 212818 - RNA, 22 nt, Human
cuucuuaacuguauauacuaug

SEQ ID NO: 212819 - RNA, 22 nt, Human
agagcccaggcaggcauccagg

SEQ ID NO: 212820 - RNA, 22 nt, Human
guguuuguuuagugcagagaga

SEQ ID NO: 212821 - RNA, 22 nt, Human
ugagugcuuuaaauguuauuuu

SEQ ID NO: 212822 - RNA, 22 nt, Human
gucuggaaggaggagauggagc

SEQ ID NO: 212823 - RNA, 22 nt, Human
gcaaggcagcauccuuuugagg

SEQ ID NO: 212824 - RNA, 19 nt, Human
ccugggaggcggagguugc

SEQ ID NO: 212825 - RNA, 22 nt, Human
gagucuucugaguuauuggaua

SEQ ID NO: 212826 - RNA, 22 nt, Human
uguuacaagucuugagguacuu

SEQ ID NO: 212827 - RNA, 22 nt, Human
aggguaggaacugaguggaagg

SEQ ID NO: 212828 - RNA, 22 nt, Human
gagcacaggcuuugguggacac

SEQ ID NO: 212829 - RNA, 22 nt, Human
aagaaccuauaugcugaugaau

SEQ ID NO: 212830 - RNA, 22 nt, Human
aaggcugaguaaaacagagaac

SEQ ID NO: 212831 - RNA, 21 nt, Human
cuggaucugucaucgaguuuu

SEQ ID NO: 212832 - RNA, 22 nt, Human
ugucuggguuuugggucauauu

SEQ ID NO: 212833 - RNA, 17 nt, Human
uuccagcauguuacuaa

SEQ ID NO: 212834 - RNA, 21 nt, Human
cccuugccugcacuccucggc

SEQ ID NO: 212835 - RNA, 20 nt, Human
uuccuguauacaaagaguuc

SEQ ID NO: 212836 - RNA, 22 nt, Human
ugcagcccugugcacauccccu

SEQ ID NO: 212837 - RNA, 22 nt, Human
acuccuggggauccauuccuuu

SEQ ID NO: 212838 - RNA, 22 nt, Human
cugagcugcuuugcuuuugggg

SEQ ID NO: 212839 - RNA, 22 nt, Human
uuagcaauccuaggcuggauca

SEQ ID NO: 212840 - RNA, 22 nt, Human
acaguaacagucuauuucucag

SEQ ID NO: 212841 - RNA, 22 nt, Human
uuucacaaagcauagcacuuua

SEQ ID NO: 212842 - RNA, 22 nt, Human
acaagucuuuuucaugucuucu

SEQ ID NO: 212843 - RNA, 22 nt, Human
ggcccacacugacagcugagcu

SEQ ID NO: 212844 - RNA, 22 nt, Human
uugaucaaaucagcuacugagg

SEQ ID NO: 212845 - RNA, 22 nt, Human
cccagagguuccuuagggacca

SEQ ID NO: 212846 - RNA, 22 nt, Human
ucugggcacacaccaugcccac

SEQ ID NO: 212847 - RNA, 22 nt, Human
gccuguauuuauugagagugua

SEQ ID NO: 212848 - RNA, 22 nt, Human
agacaaauaacuuuuuaugucc

SEQ ID NO: 212849 - RNA, 22 nt, Human
ugagguggcuagggaggcacuc

SEQ ID NO: 212850 - RNA, 22 nt, Human
cuggcuccucaguauuccacuu

SEQ ID NO: 212851 - RNA, 22 nt, Human
gagugcuggaggugugaguggg

SEQ ID NO: 212852 - RNA, 22 nt, Human
ggaaggcuaauaaugcaagaaa

SEQ ID NO: 212853 - RNA, 22 nt, Human
cuggcacgcccacguaggcacu

SEQ ID NO: 212854 - RNA, 22 nt, Human
ggagguggccugaaaauguggc

SEQ ID NO: 212855 - RNA, 22 nt, Human
gucucagggacugcuucugggg

SEQ ID NO: 212856 - RNA, 21 nt, Human
acacacuacacauuccuaguu

SEQ ID NO: 212857 - RNA, 22 nt, Human
auggcuggcacuggccuggguu

SEQ ID NO: 212858 - RNA, 22 nt, Human
gaggcaacacauuuggaaagca

SEQ ID NO: 212859 - RNA, 22 nt, Human
ugcagguggacacgggagacgg

SEQ ID NO: 212860 - RNA, 22 nt, Human
acaaaggugagcagaagacaca

SEQ ID NO: 212861 - RNA, 22 nt, Human
ccagcuuuugcacuggacuggg

SEQ ID NO: 212862 - RNA, 22 nt, Human
agcuccaggugcaagucauggu

SEQ ID NO: 212863 - RNA, 22 nt, Human
auaagguaaggguauugucaga

SEQ ID NO: 212864 - RNA, 22 nt, Human
cacucugggggcugccgcugcc

SEQ ID NO: 212865 - RNA, 22 nt, Human
ucuccaggggcagggucuggag

SEQ ID NO: 212866 - RNA, 22 nt, Human
uuugaaagaauuuauguacuuu

SEQ ID NO: 212867 - RNA, 22 nt, Human
cuucagcaacuuuggaauguuu

SEQ ID NO: 212868 - RNA, 22 nt, Human
ugacauguguaaucagcuccgu

SEQ ID NO: 212869 - RNA, 22 nt, Human
agguggcugaagagugggugag

SEQ ID NO: 212870 - RNA, 22 nt, Human
agggcugagacuaaggccagau

SEQ ID NO: 212871 - RNA, 22 nt, Human
aagcuggccuguaccugcugag

SEQ ID NO: 212872 - RNA, 22 nt, Human
agaaggcacucacacuggcacg

SEQ ID NO: 212873 - RNA, 22 nt, Human
caggugguuccauguuucauga

SEQ ID NO: 212874 - RNA, 22 nt, Human
acaguaacaccuacucuguccc

SEQ ID NO: 212875 - RNA, 22 nt, Human
agcauuagaagaaaugauuaua

SEQ ID NO: 212876 - RNA, 22 nt, Human
aaucuagauucggaucaaaggg

SEQ ID NO: 212877 - RNA, 22 nt, Human
guuuagaacacggaaauacuga

SEQ ID NO: 212878 - RNA, 21 nt, Human
ucugggcccaugcugccucac

SEQ ID NO: 212879 - RNA, 22 nt, Human
agcccagcaaagggguuugaga

SEQ ID NO: 212880 - RNA, 22 nt, Human
ucccugccuccuggcagugcca

SEQ ID NO: 212881 - RNA, 22 nt, Human
accccaggaaguggaggucaug

SEQ ID NO: 212882 - RNA, 22 nt, Human
caguccuuauuccuauauuccu

SEQ ID NO: 212883 - RNA, 22 nt, Human
gauuaagagaaguuucuuaucg

SEQ ID NO: 212884 - RNA, 22 nt, Human
uguguucaagauuaguucuagu

SEQ ID NO: 212885 - RNA, 22 nt, Human
ccaaggccccuguggucuagcc

SEQ ID NO: 212886 - RNA, 22 nt, Human
gggacaugaggccauagugauu

SEQ ID NO: 212887 - RNA, 22 nt, Human
cuaaacauggcuuagaacacuc

SEQ ID NO: 212888 - RNA, 22 nt, Human
ucagcaggcagaaaucugcaga

SEQ ID NO: 212889 - RNA, 22 nt, Human
guccuggcuguguuugguuucu

SEQ ID NO: 212890 - RNA, 22 nt, Human
gucuguuagugauaacuguuuu

SEQ ID NO: 212891 - RNA, 22 nt, Human
gugagcugggugaaugguaggg

SEQ ID NO: 212892 - RNA, 22 nt, Human
aaaauucugucauuaaauugug

SEQ ID NO: 212893 - RNA, 19 nt, Human
aucauacauguuacacucu

SEQ ID NO: 212894 - RNA, 22 nt, Human
aaguaaaauguuuccuuuauua

SEQ ID NO: 212895 - RNA, 22 nt, Human
uauuuugagguauuuuugagcu

SEQ ID NO: 212896 - RNA, 18 nt, Human
uaucuuuuccagugguau

SEQ ID NO: 212897 - RNA, 22 nt, Human
guuggcuuugcucucuguccua

SEQ ID NO: 212898 - RNA, 22 nt, Human
uuuauuagugcuuguaucacug

SEQ ID NO: 212899 - RNA, 22 nt, Human
ugucucagaguguuguauuaga

SEQ ID NO: 212900 - RNA, 22 nt, Human
aggagccaggccccauggggcu

SEQ ID NO: 212901 - RNA, 22 nt, Human
caaaaguaauugugguuuuugc

SEQ ID NO: 212902 - RNA, 22 nt, Human
uguacagacuguauuuacaagu

SEQ ID NO: 212903 - RNA, 22 nt, Human
cagguggcuucucccuaggcca

SEQ ID NO: 212904 - RNA, 22 nt, Human
gaggugucguagauuauucuca

SEQ ID NO: 212905 - RNA, 22 nt, Human
ucuagagaaguuuccuuuugaa

SEQ ID NO: 212906 - RNA, 21 nt, Human
agguacaggucuugugagucu

SEQ ID NO: 212907 - RNA, 22 nt, Human
ucuaaaucccaacaugauauca

SEQ ID NO: 212908 - RNA, 22 nt, Human
gcagccagccccucugaccucu

SEQ ID NO: 212909 - RNA, 22 nt, Human
acacugaguuuuaccaggcaca

SEQ ID NO: 212910 - RNA, 22 nt, Human
ggcacagagcaggccacuaauc

SEQ ID NO: 212911 - RNA, 22 nt, Human
aaacaccagcacuguuuacaaa

SEQ ID NO: 212912 - RNA, 22 nt, Human
agguuucugcacugucacuggu

SEQ ID NO: 212913 - RNA, 22 nt, Human
ggagggcacaggaccagaaauc

SEQ ID NO: 212914 - RNA, 22 nt, Human
aagaugacccugagggcaauug

SEQ ID NO: 212915 - RNA, 22 nt, Human
caaguauauuugaacauguaaa

SEQ ID NO: 212916 - RNA, 22 nt, Human
cuggcuggccggaggcaucccu

SEQ ID NO: 212917 - RNA, 22 nt, Human
uggaauauacucagaacaggcu

SEQ ID NO: 212918 - RNA, 22 nt, Human
gagaaacugaauauuuaacggg

SEQ ID NO: 212919 - RNA, 22 nt, Human
aaauuauucaaaaagcuguguu

SEQ ID NO: 212920 - RNA, 22 nt, Human
aggcagagcuggguuuugaaau

SEQ ID NO: 212921 - RNA, 22 nt, Human
aggcaggaaaaucgcuugaacc

SEQ ID NO: 212922 - RNA, 22 nt, Human
caggagcaaauccaaaagaauu

SEQ ID NO: 212923 - RNA, 22 nt, Human
uaacaguuuugaguuuugcuuc

SEQ ID NO: 212924 - RNA, 22 nt, Human
ugcaggugugggcaggggagca

SEQ ID NO: 212925 - RNA, 22 nt, Human
cagggccugucacgacgcucau

SEQ ID NO: 212926 - RNA, 22 nt, Human
gccaggucaccucacucaucca

SEQ ID NO: 212927 - RNA, 22 nt, Human
uuaggaaaaucaugagagauga

SEQ ID NO: 212928 - RNA, 22 nt, Human
gcagggacagggcagggccuuu

SEQ ID NO: 212929 - RNA, 22 nt, Human
ucauggcagcccuuuacuagag

SEQ ID NO: 212930 - RNA, 22 nt, Human
cagacacagauaugcauauggc

SEQ ID NO: 212931 - RNA, 22 nt, Human
aaaucacuguuauugaucuuaa

SEQ ID NO: 212932 - RNA, 22 nt, Human
ccagaccuaaccagcuuuugua

SEQ ID NO: 212933 - RNA, 18 nt, Human
aacuguugaaauagcuug

SEQ ID NO: 212934 - RNA, 22 nt, Human
ggcuuuaugcacagcagauggu

SEQ ID NO: 212935 - RNA, 22 nt, Human
aucuuguuaaaaugcagauucu

SEQ ID NO: 212936 - RNA, 22 nt, Human
agagcauccaucggccaggacc

SEQ ID NO: 212937 - RNA, 22 nt, Human
guuacaaaggucauaaaagugu

SEQ ID NO: 212938 - RNA, 22 nt, Human
aacaguuugagcuuugaauuuc

SEQ ID NO: 212939 - RNA, 22 nt, Human
uuugacucccaaacugugauuu

SEQ ID NO: 212940 - RNA, 22 nt, Human
ucugggaugagaucagagacac

SEQ ID NO: 212941 - RNA, 23 nt, Human
agaggcugcaggguauugagaau

SEQ ID NO: 212942 - RNA, 22 nt, Human
uggcucccgcuugcaccuaaga

SEQ ID NO: 212943 - RNA, 19 nt, Human
cugaggcaaguggugguca

SEQ ID NO: 212944 - RNA, 22 nt, Human
acacaucucaggggacacucuc

SEQ ID NO: 212945 - RNA, 22 nt, Human
guucuucaucuuaaccaucugu

SEQ ID NO: 212946 - RNA, 22 nt, Human
agcagcucccuccucagccacc

SEQ ID NO: 212947 - RNA, 22 nt, Human
guaggggaugguucccuagaaa

SEQ ID NO: 212948 - RNA, 22 nt, Human
ggcagugagaggucuccugguc

SEQ ID NO: 212949 - RNA, 22 nt, Human
uagacaggagucaggcuagaau

SEQ ID NO: 212950 - RNA, 22 nt, Human
cuaaccuaguucaacaacuguc

SEQ ID NO: 212951 - RNA, 22 nt, Human
ggcucuggaaaguguccuugau

SEQ ID NO: 212952 - RNA, 23 nt, Human
ugcugugccuuugucugccucca

SEQ ID NO: 212953 - RNA, 22 nt, Human
agcagggcucacauuaguggau

SEQ ID NO: 212954 - RNA, 22 nt, Human
ggagaaaggcauagcagaaccu

SEQ ID NO: 212955 - RNA, 22 nt, Human
uucaguauacuucauaacauuu

SEQ ID NO: 212956 - RNA, 22 nt, Human
aggagagcaggccagccguccc

SEQ ID NO: 212957 - RNA, 22 nt, Human
ugagcaguaggucugaauagug

SEQ ID NO: 212958 - RNA, 22 nt, Human
ucccugggcuucuccagacuug

SEQ ID NO: 212959 - RNA, 22 nt, Human
ggugggcaacauuuggccugag

SEQ ID NO: 212960 - RNA, 22 nt, Human
uccagcucaaagugcuccuguc

SEQ ID NO: 212961 - RNA, 22 nt, Human
ccucugagccagcgucuucucu

SEQ ID NO: 212962 - RNA, 22 nt, Human
uaagauguacuuuuguccucac

SEQ ID NO: 212963 - RNA, 22 nt, Human
gcaaggcuuugugaauuuuaaa

SEQ ID NO: 212964 - RNA, 22 nt, Human
ccaggcucaggugcgagagaca

SEQ ID NO: 212965 - RNA, 22 nt, Human
uuagagauugucuaguauugug

SEQ ID NO: 212966 - RNA, 22 nt, Human
ggagucacacaggaagaaggac

SEQ ID NO: 212967 - RNA, 22 nt, Human
cacacuugcuucagagucaagu

SEQ ID NO: 212968 - RNA, 22 nt, Human
ccugggcagccugcucaaggac

SEQ ID NO: 212969 - RNA, 22 nt, Human
guauuagacugagaaauggagu

SEQ ID NO: 212970 - RNA, 22 nt, Human
agauacagccugccagguucuu

SEQ ID NO: 212971 - RNA, 22 nt, Human
aggcugaggggcgagggacccu

SEQ ID NO: 212972 - RNA, 22 nt, Human
uagggcugcuuuguauucugcu

SEQ ID NO: 212973 - RNA, 22 nt, Human
cacucugugauugcagcauucc

SEQ ID NO: 212974 - RNA, 22 nt, Human
gcaguagugucaguacagcaaa

SEQ ID NO: 212975 - RNA, 18 nt, Human
uccaaaaucauguauuuu

SEQ ID NO: 212976 - RNA, 22 nt, Human
auuugcugagcucaaagaaaag

SEQ ID NO: 212977 - RNA, 22 nt, Human
acagucuacaaagugaugugug

SEQ ID NO: 212978 - RNA, 22 nt, Human
ggcaaacaggagaguaaagaga

SEQ ID NO: 212979 - RNA, 22 nt, Human
cuaaacaaugaacaaagcacug

SEQ ID NO: 212980 - RNA, 22 nt, Human
aacucacacaaguauugccugc

SEQ ID NO: 212981 - RNA, 17 nt, Human
gaugaaaugaugcacac

SEQ ID NO: 212982 - RNA, 22 nt, Human
uccaggcaucuguauuuuuuaa

SEQ ID NO: 212983 - RNA, 22 nt, Human
acucagaguagaaaauagguuc

SEQ ID NO: 212984 - RNA, 20 nt, Human
uugaccugcaagucaucauu

SEQ ID NO: 212985 - RNA, 22 nt, Human
uuauuauuccccaagucauuau

SEQ ID NO: 212986 - RNA, 22 nt, Human
cccaggcagcccuucugacgca

SEQ ID NO: 212987 - RNA, 22 nt, Human
ucucuggcacucccuuauggcu

SEQ ID NO: 212988 - RNA, 22 nt, Human
uguguccucuuaccucugaccc

SEQ ID NO: 212989 - RNA, 22 nt, Human
caaaaugugagucccaccucaa

SEQ ID NO: 212990 - RNA, 22 nt, Human
uccuuccuggggucucugcugc

SEQ ID NO: 212991 - RNA, 22 nt, Human
cacaaaguuggacaacgcaccc

SEQ ID NO: 212992 - RNA, 22 nt, Human
uuuaguuauuguuacaguauga

SEQ ID NO: 212993 - RNA, 19 nt, Human
aggguuacccgcugccacc

SEQ ID NO: 212994 - RNA, 22 nt, Human
uucaggauggcggauguugggg

SEQ ID NO: 212995 - RNA, 22 nt, Human
auauuguuaguaauauuucgaa

SEQ ID NO: 212996 - RNA, 22 nt, Human
aggaagcucaaagccaugaugu

SEQ ID NO: 212997 - RNA, 22 nt, Human
aggccagguuccucaaucuuga

SEQ ID NO: 212998 - RNA, 23 nt, Human
uuggcaaagccuaugaaguccuc

SEQ ID NO: 212999 - RNA, 22 nt, Human
uaggaaguagauagguuguucu

SEQ ID NO: 213000 - RNA, 22 nt, Human
ugcagggcuacaggacuacaac

SEQ ID NO: 213001 - RNA, 22 nt, Human
cccaggcacagauuaucccaau

SEQ ID NO: 213002 - RNA, 22 nt, Human
cagcaagacaggauucccgugg

SEQ ID NO: 213003 - RNA, 22 nt, Human
caaaugcuggcccugcuacuua

SEQ ID NO: 213004 - RNA, 20 nt, Human
aggcugccuaaggcucugca

SEQ ID NO: 213005 - RNA, 22 nt, Human
uguuuuuuccuuaugcaaucug

SEQ ID NO: 213006 - RNA, 22 nt, Human
cagaccucaaagcugcagugcu

SEQ ID NO: 213007 - RNA, 22 nt, Human
ucacagaauaaauguacuggcc

SEQ ID NO: 213008 - RNA, 22 nt, Human
uucuguaguauucuuuugguca

SEQ ID NO: 213009 - RNA, 19 nt, Human
gguguccuagagauaagag

SEQ ID NO: 213010 - RNA, 23 nt, Human
uagaacaucggugucuuggagca

SEQ ID NO: 213011 - RNA, 21 nt, Human
ucugcccuccaggagcucaua

SEQ ID NO: 213012 - RNA, 22 nt, Human
caauuuuuaaacuaugaaguug

SEQ ID NO: 213013 - RNA, 22 nt, Human
uucacauuaagccuccuccuac

SEQ ID NO: 213014 - RNA, 22 nt, Human
gcuuuucuccuuagugucccug

SEQ ID NO: 213015 - RNA, 22 nt, Human
ucaggcccuucucccaggacuc

SEQ ID NO: 213016 - RNA, 20 nt, Human
cagaaagaagguagauuuuu

SEQ ID NO: 213017 - RNA, 22 nt, Human
cauuuguugguugcugucuuau

SEQ ID NO: 213018 - RNA, 22 nt, Human
ucagcaggggccguugggugga

SEQ ID NO: 213019 - RNA, 22 nt, Human
aacauagagacaggaagugcuu

SEQ ID NO: 213020 - RNA, 22 nt, Human
uuauuaagugcguacuguaugc

SEQ ID NO: 213021 - RNA, 22 nt, Human
agagaugcccuugaaaggauua

SEQ ID NO: 213022 - RNA, 22 nt, Human
ucaugauuuuucuuuacaguug

SEQ ID NO: 213023 - RNA, 22 nt, Human
cagugcucccgcugccgcugug

SEQ ID NO: 213024 - RNA, 22 nt, Human
ggccacagcagaugcuucagau

SEQ ID NO: 213025 - RNA, 22 nt, Human
uaagacacaguccgcacucucu

SEQ ID NO: 213026 - RNA, 21 nt, Human
caagccagaccaauagcagcc

SEQ ID NO: 213027 - RNA, 22 nt, Human
uuucucagucacaugaaccaau

SEQ ID NO: 213028 - RNA, 22 nt, Human
uuagugcucacguguuagaaag

SEQ ID NO: 213029 - RNA, 22 nt, Human
uaagaugguuguagauggacug

SEQ ID NO: 213030 - RNA, 22 nt, Human
agcccaggugagggguucgaaa

SEQ ID NO: 213031 - RNA, 22 nt, Human
ugucaaguuguggcaugucuaa

SEQ ID NO: 213032 - RNA, 22 nt, Human
aucuggauagguuguuuugcau

SEQ ID NO: 213033 - RNA, 22 nt, Human
caagauuuggcauucugaggag

SEQ ID NO: 213034 - RNA, 22 nt, Human
cagcagcugcaaauggaaacag

SEQ ID NO: 213035 - RNA, 22 nt, Human
cucugaggcuccaugcaggcuu

SEQ ID NO: 213036 - RNA, 22 nt, Human
cagucccagacauaguaaggga

SEQ ID NO: 213037 - RNA, 22 nt, Human
auucugcacuuccuuugcuucc

SEQ ID NO: 213038 - RNA, 22 nt, Human
ccugccagcccgcguucaugcc

SEQ ID NO: 213039 - RNA, 22 nt, Human
uuacuuuagaucauacugugug

SEQ ID NO: 213040 - RNA, 19 nt, Human
gcacacguugugcuugagc

SEQ ID NO: 213041 - RNA, 22 nt, Human
cagcugagcaucacuagucugg

SEQ ID NO: 213042 - RNA, 17 nt, Human
gccuucucugcccucac

SEQ ID NO: 213043 - RNA, 22 nt, Human
agcaaggcagcuuucacugcuu

SEQ ID NO: 213044 - RNA, 22 nt, Human
uuguccugugauuucagggccu

SEQ ID NO: 213045 - RNA, 22 nt, Human
ucagcagaccuguuauuuggau

SEQ ID NO: 213046 - RNA, 22 nt, Human
cuccagggaaaggggcguccgc

SEQ ID NO: 213047 - RNA, 22 nt, Human
gaaggcuggggcaucagugaaa

SEQ ID NO: 213048 - RNA, 22 nt, Human
aaauagcacagcagcugaggcu

SEQ ID NO: 213049 - RNA, 22 nt, Human
cuugagaaaggaacaggaagcu

SEQ ID NO: 213050 - RNA, 22 nt, Human
uguguacacaaguauauauaca

SEQ ID NO: 213051 - RNA, 22 nt, Human
aaggcucucugauggcagcagu

SEQ ID NO: 213052 - RNA, 22 nt, Human
uauguuauuuucauacaacaga

SEQ ID NO: 213053 - RNA, 22 nt, Human
ugcagagaucugggcgucggcu

SEQ ID NO: 213054 - RNA, 21 nt, Human
uccaggcugaugaugucaacu

SEQ ID NO: 213055 - RNA, 22 nt, Human
cugccagcaagcuacccuggca

SEQ ID NO: 213056 - RNA, 22 nt, Human
uuagugcuuggcacacaauaca

SEQ ID NO: 213057 - RNA, 22 nt, Human
ccagcuuuccaggguugacugg

SEQ ID NO: 213058 - RNA, 22 nt, Human
caggaucuuuuaaugucuccag

SEQ ID NO: 213059 - RNA, 22 nt, Human
uaccuagacaugaacacagaug

SEQ ID NO: 213060 - RNA, 22 nt, Human
acagcugugaagcaagcacucu

SEQ ID NO: 213061 - RNA, 23 nt, Human
uuagacaauccucaaaagguaau

SEQ ID NO: 213062 - RNA, 22 nt, Human
auuuuaucugcuuacuuucagg

SEQ ID NO: 213063 - RNA, 20 nt, Human
uuucuguaaggcauuaaucu

SEQ ID NO: 213064 - RNA, 23 nt, Human
ccuggggcacuugaguccucauc

SEQ ID NO: 213065 - RNA, 22 nt, Human
uccuggggcugcaaggccuguc

SEQ ID NO: 213066 - RNA, 22 nt, Human
gggcugaggcuaccacuggucu

SEQ ID NO: 213067 - RNA, 17 nt, Human
ccuuccucaucuccuuc

SEQ ID NO: 213068 - RNA, 22 nt, Human
cggcacagccgggcaaggcugg

SEQ ID NO: 213069 - RNA, 22 nt, Human
uuugaaagggacaaagucacug

SEQ ID NO: 213070 - RNA, 22 nt, Human
agucugugcuguuggugaggau

SEQ ID NO: 213071 - RNA, 22 nt, Human
uguagcucuccagccagcaagg

SEQ ID NO: 213072 - RNA, 22 nt, Human
aagcaacuaaggcaaggaaaug

SEQ ID NO: 213073 - RNA, 18 nt, Human
aagucuggcagcuuuccc

SEQ ID NO: 213074 - RNA, 22 nt, Human
agggaccuugauggguuuggga

SEQ ID NO: 213075 - RNA, 22 nt, Human
ccacccaugugacuaccucaug

SEQ ID NO: 213076 - RNA, 22 nt, Human
uuuaaucaggcaaagcauaaua

SEQ ID NO: 213077 - RNA, 23 nt, Human
cuguuaaauuccuuaagagcagg

SEQ ID NO: 213078 - RNA, 22 nt, Human
ucuguucaucucaugggagaau

SEQ ID NO: 213079 - RNA, 22 nt, Human
uggccagugggguugagcagga

SEQ ID NO: 213080 - RNA, 22 nt, Human
uaccagcaacuggaagucagau

SEQ ID NO: 213081 - RNA, 22 nt, Human
ccuguccccucacaaugccacu

SEQ ID NO: 213082 - RNA, 22 nt, Human
acaaugcaauuguaaggugugu

SEQ ID NO: 213083 - RNA, 22 nt, Human
cacagcuggggaagcugaggcc

SEQ ID NO: 213084 - RNA, 22 nt, Human
uuuccuccuagccuccagccgc

SEQ ID NO: 213085 - RNA, 22 nt, Human
cuguuacuggacgcacgcagcu

SEQ ID NO: 213086 - RNA, 22 nt, Human
ugggguccucucacuuggaggg

SEQ ID NO: 213087 - RNA, 22 nt, Human
caaaugaagggagcugaagucu

SEQ ID NO: 213088 - RNA, 21 nt, Human
agcuggcagauauggugucug

SEQ ID NO: 213089 - RNA, 22 nt, Human
aggaguccucaugucugugcga

SEQ ID NO: 213090 - RNA, 22 nt, Human
auucuuguuuaauuugcauccc

SEQ ID NO: 213091 - RNA, 22 nt, Human
ugcauacacaugugcacauacg

SEQ ID NO: 213092 - RNA, 22 nt, Human
gcagccuuuggaauuagagacu

SEQ ID NO: 213093 - RNA, 22 nt, Human
aaagucuuucucauuggccaug

SEQ ID NO: 213094 - RNA, 17 nt, Human
auccuucuguucuuucu

SEQ ID NO: 213095 - RNA, 22 nt, Human
ccugucacgaugacugcacucu

SEQ ID NO: 213096 - RNA, 22 nt, Human
auaacauuuugacaacugguga

SEQ ID NO: 213097 - RNA, 22 nt, Human
auagaaccacccagagccuuuu

SEQ ID NO: 213098 - RNA, 22 nt, Human
cuggcccaggcuccuggggcac

SEQ ID NO: 213099 - RNA, 22 nt, Human
aggaaucugggcccaacugugc

SEQ ID NO: 213100 - RNA, 22 nt, Human
agugucugcuuaucaguucuug

SEQ ID NO: 213101 - RNA, 22 nt, Human
gccuagguaccagcagagagcc

SEQ ID NO: 213102 - RNA, 22 nt, Human
uccccacacuuucacuccuggc

SEQ ID NO: 213103 - RNA, 22 nt, Human
ccuguggccgcgucgggcggcg

SEQ ID NO: 213104 - RNA, 22 nt, Human
augcuacaggaagacgucaggc

SEQ ID NO: 213105 - RNA, 22 nt, Human
auucuucaaagagugucaaagu

SEQ ID NO: 213106 - RNA, 19 nt, Human
gggagcaggaaagcugugg

SEQ ID NO: 213107 - RNA, 18 nt, Human
ucucuccaucuauuuguu

SEQ ID NO: 213108 - RNA, 22 nt, Human
acuccagguuuuuucacugaag

SEQ ID NO: 213109 - RNA, 22 nt, Human
uccaggcacgaggcccugugca

SEQ ID NO: 213110 - RNA, 22 nt, Human
caggcagcucugcuuuuccuaa

SEQ ID NO: 213111 - RNA, 22 nt, Human
agucugaagacucaugucugaa

SEQ ID NO: 213112 - RNA, 22 nt, Human
ggaaccuugcuagaugcugagg

SEQ ID NO: 213113 - RNA, 22 nt, Human
ucugucuuuagaggccugugcu

SEQ ID NO: 213114 - RNA, 23 nt, Human
ugcuguggauggcagguccuugc

SEQ ID NO: 213115 - RNA, 22 nt, Human
ucagggcaaaagggaaaccauu

SEQ ID NO: 213116 - RNA, 22 nt, Human
aguacaaaaugcagcaucauca

SEQ ID NO: 213117 - RNA, 22 nt, Human
guaaaauagaauaacguggcua

SEQ ID NO: 213118 - RNA, 22 nt, Human
caacauaugauuuuguauauaa

SEQ ID NO: 213119 - RNA, 22 nt, Human
aaaucucauuauuuauaccaua

SEQ ID NO: 213120 - RNA, 21 nt, Human
guccagagagccggcuccuga

SEQ ID NO: 213121 - RNA, 22 nt, Human
ccagagcugcagguaaaaugcu

SEQ ID NO: 213122 - RNA, 22 nt, Human
agguaaaaugagucuccauuau

SEQ ID NO: 213123 - RNA, 22 nt, Human
cuucacagccaacaugggcaca

SEQ ID NO: 213124 - RNA, 22 nt, Human
uacaggcugcagggcuagaggg

SEQ ID NO: 213125 - RNA, 22 nt, Human
aaggaagaagacucuuuacucc

SEQ ID NO: 213126 - RNA, 22 nt, Human
uggcagguuaugcgggccacau

SEQ ID NO: 213127 - RNA, 21 nt, Human
agucuuaggcacagcuguguc

SEQ ID NO: 213128 - RNA, 22 nt, Human
acuuggugaagucaggugauua

SEQ ID NO: 213129 - RNA, 22 nt, Human
uuugcugacuggaugcaguugg

SEQ ID NO: 213130 - RNA, 23 nt, Human
uugggcucaguggcaggaagagu

SEQ ID NO: 213131 - RNA, 22 nt, Human
ggagcucaguggggggacugug

SEQ ID NO: 213132 - RNA, 22 nt, Human
ucuccugcucagaacagccuca

SEQ ID NO: 213133 - RNA, 22 nt, Human
cugggagcccgcguccuggugg

SEQ ID NO: 213134 - RNA, 22 nt, Human
caccugaagauuuagagauuga

SEQ ID NO: 213135 - RNA, 18 nt, Human
ucuguguucugucauugc

SEQ ID NO: 213136 - RNA, 22 nt, Human
acccucagcuucuuggauuaau

SEQ ID NO: 213137 - RNA, 22 nt, Human
ggcugggcucgcugauuggcug

SEQ ID NO: 213138 - RNA, 22 nt, Human
auguuuaugcaaacaugugagu

SEQ ID NO: 213139 - RNA, 22 nt, Human
agaaagaggaugcagaucucau

SEQ ID NO: 213140 - RNA, 18 nt, Human
uuccuucugauguauaug

SEQ ID NO: 213141 - RNA, 22 nt, Human
caccagaguuguccaaaugauu

SEQ ID NO: 213142 - RNA, 22 nt, Human
uuucuacaacacuucugaaucu

SEQ ID NO: 213143 - RNA, 22 nt, Human
cuucuccgacaaccgacgccgg

SEQ ID NO: 213144 - RNA, 22 nt, Human
cuguggcuggcucaucauaggu

SEQ ID NO: 213145 - RNA, 22 nt, Human
uagcugaaggcuacagcagaac

SEQ ID NO: 213146 - RNA, 22 nt, Human
ucucugggguagggcccaggac

SEQ ID NO: 213147 - RNA, 22 nt, Human
augguacauaguuuaaauaagg

SEQ ID NO: 213148 - RNA, 20 nt, Human
ucucagcauaagaacccuuc

SEQ ID NO: 213149 - RNA, 22 nt, Human
ugggaaccaggacuggcugagg

SEQ ID NO: 213150 - RNA, 22 nt, Human
auuagaagaggcugacgaaugu

SEQ ID NO: 213151 - RNA, 22 nt, Human
acuggcagaggauagcacuaau

SEQ ID NO: 213152 - RNA, 22 nt, Human
agcagagacaugaaauaugcuu

SEQ ID NO: 213153 - RNA, 22 nt, Human
ucaggcagaauuaucaaaagau

SEQ ID NO: 213154 - RNA, 22 nt, Human
uucacauugguucuugauagcu

SEQ ID NO: 213155 - RNA, 22 nt, Human
agcacaggugaaacagucaggu

SEQ ID NO: 213156 - RNA, 22 nt, Human
gcuccaggagagggaagcagau

SEQ ID NO: 213157 - RNA, 20 nt, Human
ccugggcuccaggagccccg

SEQ ID NO: 213158 - RNA, 20 nt, Human
gccugcagagaaggucagag

SEQ ID NO: 213159 - RNA, 22 nt, Human
uucucuuuucaccaguugcuaa

SEQ ID NO: 213160 - RNA, 22 nt, Human
gggaacagggccugagcugggg

SEQ ID NO: 213161 - RNA, 22 nt, Human
uucuucugauugccuucugcaa

SEQ ID NO: 213162 - RNA, 22 nt, Human
uccuggcugaguucccaagucg

SEQ ID NO: 213163 - RNA, 22 nt, Human
gaggagacaguggagccgcuac

SEQ ID NO: 213164 - RNA, 22 nt, Human
ugucuucaugccugaaagaaga

SEQ ID NO: 213165 - RNA, 22 nt, Human
ugauucacagacuucacaaggc

SEQ ID NO: 213166 - RNA, 22 nt, Human
cacagcauucacagaaagacau

SEQ ID NO: 213167 - RNA, 22 nt, Human
aggaggaacucagaaagaaggu

SEQ ID NO: 213168 - RNA, 22 nt, Human
ucugggcugugguuccacuccg

SEQ ID NO: 213169 - RNA, 19 nt, Human
augagcaggcaagacaagc

SEQ ID NO: 213170 - RNA, 22 nt, Human
guucauguuugagaacaaggag

SEQ ID NO: 213171 - RNA, 22 nt, Human
aguguacauaguuaggaacauc

SEQ ID NO: 213172 - RNA, 21 nt, Human
uuugaaagcccuauguuuuca

SEQ ID NO: 213173 - RNA, 22 nt, Human
uuugucaaagaucagaugcuuu

SEQ ID NO: 213174 - RNA, 23 nt, Human
cugguaaaucacuaaaauuacaa

SEQ ID NO: 213175 - RNA, 22 nt, Human
aaguuucuguucauaucucuga

SEQ ID NO: 213176 - RNA, 22 nt, Human
agccuuagauuugggcaagaac

SEQ ID NO: 213177 - RNA, 22 nt, Human
agcugugaccuucaagagcuac

SEQ ID NO: 213178 - RNA, 23 nt, Human
ucagaauaauaaccuaguaacug

SEQ ID NO: 213179 - RNA, 22 nt, Human
aaagugcauuguuuguguuccu

SEQ ID NO: 213180 - RNA, 22 nt, Human
guuuauaagguaaaggagagag

SEQ ID NO: 213181 - RNA, 22 nt, Human
uuguccugcaaccucacauggc

SEQ ID NO: 213182 - RNA, 22 nt, Human
ggcuggaggagaauggguguga

SEQ ID NO: 213183 - RNA, 22 nt, Human
auaaacugguaggaaaacagua

SEQ ID NO: 213184 - RNA, 22 nt, Human
gcacaguaccugucacagaggc

SEQ ID NO: 213185 - RNA, 22 nt, Human
gaacauuuggcaugagaauuug

SEQ ID NO: 213186 - RNA, 22 nt, Human
ccugauuagggucuuucaaaug

SEQ ID NO: 213187 - RNA, 22 nt, Human
auguugaacuaggaucucuuga

SEQ ID NO: 213188 - RNA, 22 nt, Human
ccugagcuuuaaaagccaugua

SEQ ID NO: 213189 - RNA, 22 nt, Human
acggaaaacccugagcaaacuu

SEQ ID NO: 213190 - RNA, 20 nt, Human
caucuugaaggucuuccaca

SEQ ID NO: 213191 - RNA, 22 nt, Human
aaggccagagcguguccugccu

SEQ ID NO: 213192 - RNA, 22 nt, Human
aggcagggaccaguuguuuucu

SEQ ID NO: 213193 - RNA, 17 nt, Human
aguguggcccugguuaa

SEQ ID NO: 213194 - RNA, 22 nt, Human
aguaaguuccaguuucauuaug

SEQ ID NO: 213195 - RNA, 22 nt, Human
ugggaguccaagguuuuuauag

SEQ ID NO: 213196 - RNA, 22 nt, Human
ugcauuaaaaccaucgaccauc

SEQ ID NO: 213197 - RNA, 22 nt, Human
ggggagaccaucugaaggugau

SEQ ID NO: 213198 - RNA, 22 nt, Human
cccugagaagaucauugccacg

SEQ ID NO: 213199 - RNA, 22 nt, Human
ugagggaguuggguguauagga

SEQ ID NO: 213200 - RNA, 22 nt, Human
agccuugccugggaaacugggu

SEQ ID NO: 213201 - RNA, 22 nt, Human
uaacaagguaagccuggccaug

SEQ ID NO: 213202 - RNA, 22 nt, Human
caggcuccacuguaggcagcuc

SEQ ID NO: 213203 - RNA, 22 nt, Human
uucugccauugccaugagggcu

SEQ ID NO: 213204 - RNA, 22 nt, Human
ggaaagcuuuguuuuccucacc

SEQ ID NO: 213205 - RNA, 22 nt, Human
uuauuaguguugauauuaggau

SEQ ID NO: 213206 - RNA, 22 nt, Human
ucaggccacggcucacugagac

SEQ ID NO: 213207 - RNA, 22 nt, Human
aggagagagguuuuaaaugggg

SEQ ID NO: 213208 - RNA, 22 nt, Human
uggcuccuucauucuccugcca

SEQ ID NO: 213209 - RNA, 22 nt, Human
gaggcuucuguucacucacgcu

SEQ ID NO: 213210 - RNA, 19 nt, Human
ugagucacucuuacaguca

SEQ ID NO: 213211 - RNA, 21 nt, Human
caucacauuacucaaaguccu

SEQ ID NO: 213212 - RNA, 23 nt, Human
uauuacaauuggucuuauuaaga

SEQ ID NO: 213213 - RNA, 22 nt, Human
gucuccuggcugcagcuaagac

SEQ ID NO: 213214 - RNA, 22 nt, Human
ucucaaaguagcucccacagau

SEQ ID NO: 213215 - RNA, 22 nt, Human
cuauuuugccugccuagaaauc

SEQ ID NO: 213216 - RNA, 22 nt, Human
aaugcuuuaaauccuaguguaa

SEQ ID NO: 213217 - RNA, 22 nt, Human
agccucugggggagcugggagc

SEQ ID NO: 213218 - RNA, 22 nt, Human
aggccucuggagguggcagugu

SEQ ID NO: 213219 - RNA, 22 nt, Human
aggucugacucuuugccacaua

SEQ ID NO: 213220 - RNA, 22 nt, Human
uaggccacaaauaagauccugu

SEQ ID NO: 213221 - RNA, 22 nt, Human
aagccaugcaagccacaaggug

SEQ ID NO: 213222 - RNA, 22 nt, Human
agucuccacacuggcagaugcc

SEQ ID NO: 213223 - RNA, 22 nt, Human
ggcucagcuuggugcgcagaaa

SEQ ID NO: 213224 - RNA, 22 nt, Human
uugcaaauuaaagaggauagca

SEQ ID NO: 213225 - RNA, 22 nt, Human
uucaguguggaaugugaacugc

SEQ ID NO: 213226 - RNA, 22 nt, Human
gaggccagcuaguccaggaagu

SEQ ID NO: 213227 - RNA, 22 nt, Human
agcaggugaauuccuggaugug

SEQ ID NO: 213228 - RNA, 21 nt, Human
uuagcaaagcaaacacaugcu

SEQ ID NO: 213229 - RNA, 22 nt, Human
auggcccaaacugcaauuacuu

SEQ ID NO: 213230 - RNA, 19 nt, Human
caguuacaggcacuguggg

SEQ ID NO: 213231 - RNA, 22 nt, Human
cagaaacacuuguagagaaguu

SEQ ID NO: 213232 - RNA, 22 nt, Human
ucuagggaaccuauccuaugau

SEQ ID NO: 213233 - RNA, 22 nt, Human
ccugagauuucauugucuggcc

SEQ ID NO: 213234 - RNA, 22 nt, Human
uccugggagguaaaccagcauc

SEQ ID NO: 213235 - RNA, 22 nt, Human
acauguguggccgcuguagaca

SEQ ID NO: 213236 - RNA, 22 nt, Human
cagcugguacucaguucuuguc

SEQ ID NO: 213237 - RNA, 22 nt, Human
caugagauuugggaggggccag

SEQ ID NO: 213238 - RNA, 22 nt, Human
gcauggcugguguccugaggga

SEQ ID NO: 213239 - RNA, 22 nt, Human
gugcaggagguaacauagcaaa

SEQ ID NO: 213240 - RNA, 18 nt, Human
aauguccaguguucauau

SEQ ID NO: 213241 - RNA, 22 nt, Human
gguguugcaguugaagacuggu

SEQ ID NO: 213242 - RNA, 22 nt, Human
gcucaggagcucuugguggcgc

SEQ ID NO: 213243 - RNA, 22 nt, Human
aguauugugacucaaguauucu

SEQ ID NO: 213244 - RNA, 22 nt, Human
ugcauacauaaagugcuaucau

SEQ ID NO: 213245 - RNA, 22 nt, Human
gcugccuuagagggagugguuc

SEQ ID NO: 213246 - RNA, 22 nt, Human
uuugaaacaggugauucagcua

SEQ ID NO: 213247 - RNA, 22 nt, Human
cagagccacagccuccagauuu

SEQ ID NO: 213248 - RNA, 22 nt, Human
uccugugcuuuggaggauguuc

SEQ ID NO: 213249 - RNA, 22 nt, Human
uuccugguaaauuauguccagg

SEQ ID NO: 213250 - RNA, 19 nt, Human
aggcuggagacaccaggcc

SEQ ID NO: 213251 - RNA, 22 nt, Human
accaggcagcaccaaagccggu

SEQ ID NO: 213252 - RNA, 22 nt, Human
agagccagagaccuggguucac

SEQ ID NO: 213253 - RNA, 22 nt, Human
auaaagcauuuccccugugugg

SEQ ID NO: 213254 - RNA, 22 nt, Human
gagaagcaaucaguggccaccc

SEQ ID NO: 213255 - RNA, 22 nt, Human
uaaggcuuuauuuuuacaaugc

SEQ ID NO: 213256 - RNA, 19 nt, Human
uccucugaagguucuuuua

SEQ ID NO: 213257 - RNA, 22 nt, Human
gacaggcuucauccucagaguu

SEQ ID NO: 213258 - RNA, 22 nt, Human
cagagacccuucucaguggcca

SEQ ID NO: 213259 - RNA, 22 nt, Human
gugaggccgcacgccccggagu

SEQ ID NO: 213260 - RNA, 22 nt, Human
uccagcuguugauauucuaggu

SEQ ID NO: 213261 - RNA, 22 nt, Human
gcugucccgcugacuuccagcu

SEQ ID NO: 213262 - RNA, 22 nt, Human
gaggcagugaacaauuccugug

SEQ ID NO: 213263 - RNA, 20 nt, Human
ucuguagucuaugaggcuua

SEQ ID NO: 213264 - RNA, 22 nt, Human
acgagucugcucuugaaaaagu

SEQ ID NO: 213265 - RNA, 22 nt, Human
ucugucuuugucaggaccagag

SEQ ID NO: 213266 - RNA, 20 nt, Human
gcuaccagaacaaggccauu

SEQ ID NO: 213267 - RNA, 22 nt, Human
guccaucuagaauuuauuucua

SEQ ID NO: 213268 - RNA, 22 nt, Human
cucuggcugucccgaugagcag

SEQ ID NO: 213269 - RNA, 21 nt, Human
ugggcaccaaaaccuaggagu

SEQ ID NO: 213270 - RNA, 22 nt, Human
gaacauuuaugaugcaauaccu

SEQ ID NO: 213271 - RNA, 22 nt, Human
agcugcuacugcucugccagag

SEQ ID NO: 213272 - RNA, 22 nt, Human
ucucagagggaaaggccaauuu

SEQ ID NO: 213273 - RNA, 22 nt, Human
agcugugguucugggcagcgac

SEQ ID NO: 213274 - RNA, 22 nt, Human
aauucuugguccuaguguauaa

SEQ ID NO: 213275 - RNA, 22 nt, Human
ucucagguaaaaggguaucuac

SEQ ID NO: 213276 - RNA, 22 nt, Human
ggugggaaggggccagugugcg

SEQ ID NO: 213277 - RNA, 22 nt, Human
cccaggcagccccagaagcuug

SEQ ID NO: 213278 - RNA, 22 nt, Human
ugagucucauuaauuaugaaug

SEQ ID NO: 213279 - RNA, 22 nt, Human
cugggggcaauggucagagugu

SEQ ID NO: 213280 - RNA, 22 nt, Human
guuuacaugcagaaaaucaaug

SEQ ID NO: 213281 - RNA, 22 nt, Human
augcuuuuaugucacaugguca

SEQ ID NO: 213282 - RNA, 22 nt, Human
agcucccaauugacuugaacua

SEQ ID NO: 213283 - RNA, 22 nt, Human
cuagagcuguucugugcacuca

SEQ ID NO: 213284 - RNA, 22 nt, Human
cugggccaucucucugcaagug

SEQ ID NO: 213285 - RNA, 22 nt, Human
cagcuuuaccuuuaggaguaac

SEQ ID NO: 213286 - RNA, 21 nt, Human
aucuuuauuacgcagagaaga

SEQ ID NO: 213287 - RNA, 22 nt, Human
aaggcuucuuugcaggcuuuag

SEQ ID NO: 213288 - RNA, 22 nt, Human
ggguccagacuaugaagaacuu

SEQ ID NO: 213289 - RNA, 22 nt, Human
ucaggaagggcucagucugugc

SEQ ID NO: 213290 - RNA, 22 nt, Human
agaaguuaccacauacuucucu

SEQ ID NO: 213291 - RNA, 22 nt, Human
ugcccuugggauuuagguaagg

SEQ ID NO: 213292 - RNA, 22 nt, Human
cuggcucccaugagcucucacg

SEQ ID NO: 213293 - RNA, 22 nt, Human
gcccaggaaguugaggcugccg

SEQ ID NO: 213294 - RNA, 22 nt, Human
uacuccagacauucuguccucg

SEQ ID NO: 213295 - RNA, 22 nt, Human
gcuagaaaaugaaagauaauuu

SEQ ID NO: 213296 - RNA, 22 nt, Human
uagaaucugauuacccuaugaa

SEQ ID NO: 213297 - RNA, 22 nt, Human
guucuguacuccaagcucuucc

SEQ ID NO: 213298 - RNA, 22 nt, Human
ccccaccagcacccucucuauc

SEQ ID NO: 213299 - RNA, 22 nt, Human
uguuacucugggguugugguga

SEQ ID NO: 213300 - RNA, 22 nt, Human
cucaccccuguaauuccagcac

SEQ ID NO: 213301 - RNA, 22 nt, Human
uuugacucaguggacguacuag

SEQ ID NO: 213302 - RNA, 21 nt, Human
aggcuuggguaaaaaggucau

SEQ ID NO: 213303 - RNA, 22 nt, Human
agccauccuacuaccucagcau

SEQ ID NO: 213304 - RNA, 22 nt, Human
ucuggguggcagugauggcgug

SEQ ID NO: 213305 - RNA, 22 nt, Human
acaagucucaacagcagccagc

SEQ ID NO: 213306 - RNA, 17 nt, Human
ggcuucagggagcuggg

SEQ ID NO: 213307 - RNA, 22 nt, Human
gucuuuaugguaugaaaacuga

SEQ ID NO: 213308 - RNA, 22 nt, Human
gcuuagaagauugacccugguu

SEQ ID NO: 213309 - RNA, 22 nt, Human
agugcacaacaugcagguuugu

SEQ ID NO: 213310 - RNA, 22 nt, Human
aggcucugcagugcuggaggac

SEQ ID NO: 213311 - RNA, 22 nt, Human
guuagagcacauacuuugcaug

SEQ ID NO: 213312 - RNA, 22 nt, Human
uacagguaaaauuaucagaaac

SEQ ID NO: 213313 - RNA, 22 nt, Human
ucacuuuccucaucacgacuag

SEQ ID NO: 213314 - RNA, 22 nt, Human
ggcccaguguggguggauguug

SEQ ID NO: 213315 - RNA, 22 nt, Human
uaaggcaaagugauuucuuaaa

SEQ ID NO: 213316 - RNA, 22 nt, Human
aucuuuuuaucuguuuggaaca

SEQ ID NO: 213317 - RNA, 22 nt, Human
aaggaguuuggguagucauaca

SEQ ID NO: 213318 - RNA, 23 nt, Human
aauuacaaccaagaacuggaagg

SEQ ID NO: 213319 - RNA, 22 nt, Human
uccagagggcgauggcuggggg

SEQ ID NO: 213320 - RNA, 22 nt, Human
gcucagggaacuuuuugcaggc

SEQ ID NO: 213321 - RNA, 22 nt, Human
acagccaggcccagcacgcagg

SEQ ID NO: 213322 - RNA, 22 nt, Human
uugauucacaauuaccaagacu

SEQ ID NO: 213323 - RNA, 22 nt, Human
ugaguacucggagugcuuugga

SEQ ID NO: 213324 - RNA, 22 nt, Human
ccuggagaccugauggcagcgg

SEQ ID NO: 213325 - RNA, 22 nt, Human
gugcuugggggaaguaacagac

SEQ ID NO: 213326 - RNA, 22 nt, Human
agcaguuuuuauaacacuggaa

SEQ ID NO: 213327 - RNA, 22 nt, Human
uacccagcccaugccuaccuca

SEQ ID NO: 213328 - RNA, 22 nt, Human
aaugugucauuucccacaggug

SEQ ID NO: 213329 - RNA, 22 nt, Human
cuggggggcuacugacagagga

SEQ ID NO: 213330 - RNA, 22 nt, Human
aaucucagaaacugguggauuu

SEQ ID NO: 213331 - RNA, 22 nt, Human
ucucauuguagaaagacugauu

SEQ ID NO: 213332 - RNA, 22 nt, Human
caggacacuacagaugggaggg

SEQ ID NO: 213333 - RNA, 22 nt, Human
ugagucuccagcgaaguaggau

SEQ ID NO: 213334 - RNA, 23 nt, Human
agucugugcuuggugggagggcc

SEQ ID NO: 213335 - RNA, 22 nt, Human
gauuacugucuacuugggauag

SEQ ID NO: 213336 - RNA, 22 nt, Human
acacauguauggcacuuacauu

SEQ ID NO: 213337 - RNA, 19 nt, Human
aguuauuucuaaauuuacc

SEQ ID NO: 213338 - RNA, 22 nt, Human
acuguccuggagcucacacucu

SEQ ID NO: 213339 - RNA, 22 nt, Human
agacaaaccuuguuuuaugaug

SEQ ID NO: 213340 - RNA, 18 nt, Human
gcaacaguaucagcaggc

SEQ ID NO: 213341 - RNA, 22 nt, Human
cucucugaguggcuguacuuuc

SEQ ID NO: 213342 - RNA, 22 nt, Human
uggcugagguuaugcugguugu

SEQ ID NO: 213343 - RNA, 22 nt, Human
cagaguggcagucccaggccca

SEQ ID NO: 213344 - RNA, 22 nt, Human
ugggacacaaaccagaccagga

SEQ ID NO: 213345 - RNA, 22 nt, Human
aucugccuggcuccaggugagc

SEQ ID NO: 213346 - RNA, 22 nt, Human
uuugcugucagccgcuauuuuc

SEQ ID NO: 213347 - RNA, 17 nt, Human
cagugcagagcccuuuc

SEQ ID NO: 213348 - RNA, 22 nt, Human
cuguaggugauugcuauguuau

SEQ ID NO: 213349 - RNA, 22 nt, Human
aaguuucuuuauuagcuugucc

SEQ ID NO: 213350 - RNA, 22 nt, Human
ugauucaagauugguuagcugu

SEQ ID NO: 213351 - RNA, 22 nt, Human
aaggcugcuuuuaacaugcaua

SEQ ID NO: 213352 - RNA, 22 nt, Human
accagcaguuaugaggccagga

SEQ ID NO: 213353 - RNA, 22 nt, Human
ugcugggucagugagagcaggg

SEQ ID NO: 213354 - RNA, 22 nt, Human
uauguauucugaguacaaguuc

SEQ ID NO: 213355 - RNA, 22 nt, Human
aaagaagacagacauuucuuuc

SEQ ID NO: 213356 - RNA, 22 nt, Human
cucuuugggaugggcucugcug

SEQ ID NO: 213357 - RNA, 22 nt, Human
gaagcuuugucuugucuccugg

SEQ ID NO: 213358 - RNA, 22 nt, Human
agaucugaguggcugcauguaa

SEQ ID NO: 213359 - RNA, 22 nt, Human
gaaaacauccagagauagaccu

SEQ ID NO: 213360 - RNA, 20 nt, Human
gcugccuuguccugcuuggu

SEQ ID NO: 213361 - RNA, 22 nt, Human
gcauguguggaggagaugugcu

SEQ ID NO: 213362 - RNA, 18 nt, Human
cacaggaaggggaauauc

SEQ ID NO: 213363 - RNA, 22 nt, Human
aguugaauaauuagacauaucu

SEQ ID NO: 213364 - RNA, 22 nt, Human
aguggcagagguugacugcagu

SEQ ID NO: 213365 - RNA, 22 nt, Human
cccaggaggcagagcuugcagu

SEQ ID NO: 213366 - RNA, 22 nt, Human
aacaugcauauagguaaaugga

SEQ ID NO: 213367 - RNA, 22 nt, Human
gacacuuucucagguaaagcau

SEQ ID NO: 213368 - RNA, 22 nt, Human
gcucaggaucccaggggugugc

SEQ ID NO: 213369 - RNA, 22 nt, Human
augcaccacaucacuucugcuc

SEQ ID NO: 213370 - RNA, 22 nt, Human
agacugaauaacaagcaaauaa

SEQ ID NO: 213371 - RNA, 22 nt, Human
caucuuugcacccucaaaaccu

SEQ ID NO: 213372 - RNA, 22 nt, Human
uggccccauuuuacagaugaaa

SEQ ID NO: 213373 - RNA, 22 nt, Human
cagaggcugggaccucaggcau

SEQ ID NO: 213374 - RNA, 22 nt, Human
ucaccacugaacagaccuuugg

SEQ ID NO: 213375 - RNA, 22 nt, Human
aagcaucuccucaucauuuggg

SEQ ID NO: 213376 - RNA, 22 nt, Human
gucucugugcccccauuuccgu

SEQ ID NO: 213377 - RNA, 22 nt, Human
uuuugucuaagaacuuugcaaa

SEQ ID NO: 213378 - RNA, 22 nt, Human
gaggagaagcuauuggaaggac

SEQ ID NO: 213379 - RNA, 22 nt, Human
agaaaacauaggagacaggaaa

SEQ ID NO: 213380 - RNA, 22 nt, Human
uucagagaagcaaaggcagauu

SEQ ID NO: 213381 - RNA, 22 nt, Human
ucuggcaguuccuuguugauau

SEQ ID NO: 213382 - RNA, 22 nt, Human
ucuuuacaaucuaagcauaguu

SEQ ID NO: 213383 - RNA, 22 nt, Human
uuuguguuggaagaaaugcuac

SEQ ID NO: 213384 - RNA, 20 nt, Human
ccucaggaugagggugagca

SEQ ID NO: 213385 - RNA, 20 nt, Human
ggagaugccucucaguccau

SEQ ID NO: 213386 - RNA, 22 nt, Human
acaugaaaccugagucuaacuc

SEQ ID NO: 213387 - RNA, 22 nt, Human
cuuugaaauucuucagcugaag

SEQ ID NO: 213388 - RNA, 22 nt, Human
auuuugaagggaauugaaguuc

SEQ ID NO: 213389 - RNA, 22 nt, Human
aagaauauagauuuuuugaagu

SEQ ID NO: 213390 - RNA, 22 nt, Human
cagaauggcuuuuauggcucag

SEQ ID NO: 213391 - RNA, 22 nt, Human
gacacaggauuccuggcucugc

SEQ ID NO: 213392 - RNA, 22 nt, Human
aaggcagucugguuucaaagca

SEQ ID NO: 213393 - RNA, 22 nt, Human
cagggcucccugcagccucugu

SEQ ID NO: 213394 - RNA, 22 nt, Human
ugcuggcuuuuugugucaaaga

SEQ ID NO: 213395 - RNA, 22 nt, Human
auucauuuagagggauuaagca

SEQ ID NO: 213396 - RNA, 22 nt, Human
ucuguuggacauucaucugcag

SEQ ID NO: 213397 - RNA, 22 nt, Human
agacagacggcuuuauacacag

SEQ ID NO: 213398 - RNA, 22 nt, Human
uacaugaagaaaauuaagcagu

SEQ ID NO: 213399 - RNA, 22 nt, Human
gagcagagcuucucaaaguaaa

SEQ ID NO: 213400 - RNA, 22 nt, Human
gggcgcagccaauccuggcccu

SEQ ID NO: 213401 - RNA, 22 nt, Human
ugggagaacccagggucaggcu

SEQ ID NO: 213402 - RNA, 22 nt, Human
aucugguaugagguuuugcuuu

SEQ ID NO: 213403 - RNA, 22 nt, Human
uucuuucucuccacaaggcuug

SEQ ID NO: 213404 - RNA, 22 nt, Human
gagggggaaagucccuggaguc

SEQ ID NO: 213405 - RNA, 22 nt, Human
agggcugaugcaccauguagcc

SEQ ID NO: 213406 - RNA, 22 nt, Human
aucaugcauuguauugaguuga

SEQ ID NO: 213407 - RNA, 22 nt, Human
gagccucguggcggccacugcg

SEQ ID NO: 213408 - RNA, 22 nt, Human
aacauacagugagcaguggacu

SEQ ID NO: 213409 - RNA, 22 nt, Human
guguaaguaucuuuguaucuuu

SEQ ID NO: 213410 - RNA, 22 nt, Human
ugccuuaggguaccuggugcuu

SEQ ID NO: 213411 - RNA, 22 nt, Human
aggcuggagcaagggggcauau

SEQ ID NO: 213412 - RNA, 22 nt, Human
uuggcugccgagcgcaucccgg

SEQ ID NO: 213413 - RNA, 18 nt, Human
ucuguggcagcagugcac

SEQ ID NO: 213414 - RNA, 22 nt, Human
aauacuugucagaugaauaaga

SEQ ID NO: 213415 - RNA, 22 nt, Human
acaaagggggacugcagagggu

SEQ ID NO: 213416 - RNA, 22 nt, Human
acacugugacggaaauaaagaa

SEQ ID NO: 213417 - RNA, 18 nt, Human
guccacagcccucacagc

SEQ ID NO: 213418 - RNA, 22 nt, Human
aagaaucuuaauccagaaaccu

SEQ ID NO: 213419 - RNA, 22 nt, Human
aaagccuuuucuguuuaacaca

SEQ ID NO: 213420 - RNA, 22 nt, Human
ccaggcucugacauagauggga

SEQ ID NO: 213421 - RNA, 22 nt, Human
gcauuagagcccaucaccugua

SEQ ID NO: 213422 - RNA, 21 nt, Human
accaaaaccuauacuuucugu

SEQ ID NO: 213423 - RNA, 22 nt, Human
gccuucagcggccgcucgcugc

SEQ ID NO: 213424 - RNA, 22 nt, Human
ccuguggcuuccacgaccuaau

SEQ ID NO: 213425 - RNA, 22 nt, Human
aaacuagauuaccacugcuaga

SEQ ID NO: 213426 - RNA, 21 nt, Human
uggcuucugccaauguuaaga

SEQ ID NO: 213427 - RNA, 23 nt, Human
acagggcuggcagcugcaagacc

SEQ ID NO: 213428 - RNA, 22 nt, Human
aaaaguaauugcaauuuuguag

SEQ ID NO: 213429 - RNA, 22 nt, Human
uaggcugagcuuguagaucgua

SEQ ID NO: 213430 - RNA, 22 nt, Human
agaggcugugcagagggagugc

SEQ ID NO: 213431 - RNA, 22 nt, Human
cagagcaugaauaaaaguuaca

SEQ ID NO: 213432 - RNA, 22 nt, Human
gcaggcuguagacaccaaacua

SEQ ID NO: 213433 - RNA, 22 nt, Human
auacaucucuuugaagugcuuu

SEQ ID NO: 213434 - RNA, 22 nt, Human
uuuuauacacaugaacaugcag

SEQ ID NO: 213435 - RNA, 22 nt, Human
ggcccaggaugcaagaacugaa

SEQ ID NO: 213436 - RNA, 22 nt, Human
cagggcucaucugugugaccag

SEQ ID NO: 213437 - RNA, 18 nt, Human
uauauagagaaacccauu

SEQ ID NO: 213438 - RNA, 22 nt, Human
gggccagguggaccccagccuc

SEQ ID NO: 213439 - RNA, 19 nt, Human
ggcuggaguggccaucugu

SEQ ID NO: 213440 - RNA, 22 nt, Human
gagaaucuggguuuuggcuauc

SEQ ID NO: 213441 - RNA, 22 nt, Human
acaguuugagaaccacuagccu

SEQ ID NO: 213442 - RNA, 22 nt, Human
ucuacauuuucacaaggucucc

SEQ ID NO: 213443 - RNA, 20 nt, Human
acugccuugguucaguaggu

SEQ ID NO: 213444 - RNA, 22 nt, Human
cuggggcauugggagaggccug

SEQ ID NO: 213445 - RNA, 22 nt, Human
gggaccugcgccacucacuguc

SEQ ID NO: 213446 - RNA, 17 nt, Human
ccacagcugggugccuu

SEQ ID NO: 213447 - RNA, 22 nt, Human
aagaguggagcuggaaaguggg

SEQ ID NO: 213448 - RNA, 22 nt, Human
ugccagcacuucuggcugucug

SEQ ID NO: 213449 - RNA, 22 nt, Human
uauuauugacuauucagaaugu

SEQ ID NO: 213450 - RNA, 22 nt, Human
cuccugcaugguugugcuauug

SEQ ID NO: 213451 - RNA, 21 nt, Human
gccuggcuucacaggcacuga

SEQ ID NO: 213452 - RNA, 22 nt, Human
ugcauacacacauagguauggg

SEQ ID NO: 213453 - RNA, 22 nt, Human
agagcccagugacaucagcaca

SEQ ID NO: 213454 - RNA, 22 nt, Human
uggagcugagaaguggagcucu

SEQ ID NO: 213455 - RNA, 22 nt, Human
uuaacaugucuugacuucaucu

SEQ ID NO: 213456 - RNA, 22 nt, Human
augcaucaggcacuaggaauag

SEQ ID NO: 213457 - RNA, 21 nt, Human
aggcagcaggauccagggaca

SEQ ID NO: 213458 - RNA, 22 nt, Human
ugcugggcuguuccuguccaug

SEQ ID NO: 213459 - RNA, 18 nt, Human
caggccucuugaucuucc

SEQ ID NO: 213460 - RNA, 16 nt, Human
uucucuguuccuugug

SEQ ID NO: 213461 - RNA, 22 nt, Human
gucacagaucucuugagucaag

SEQ ID NO: 213462 - RNA, 22 nt, Human
cagugcccaagaugugccaugc

SEQ ID NO: 213463 - RNA, 22 nt, Human
uuuagcaagaugcccuggcuuu

SEQ ID NO: 213464 - RNA, 20 nt, Human
aaguuacauuguauuguacc

SEQ ID NO: 213465 - RNA, 22 nt, Human
aagacaauuuugaguaugcaca

SEQ ID NO: 213466 - RNA, 22 nt, Human
ucugagugauguugagucagaa

SEQ ID NO: 213467 - RNA, 22 nt, Human
uucaaauacauucuuugccacu

SEQ ID NO: 213468 - RNA, 22 nt, Human
uuucgucaauuguaacaaaugu

SEQ ID NO: 213469 - RNA, 22 nt, Human
ggcugggcuccgggagcaugcg

SEQ ID NO: 213470 - RNA, 23 nt, Human
ucccugagcuggagagacugcac

SEQ ID NO: 213471 - RNA, 22 nt, Human
uucauguaguguaaugucuuca

SEQ ID NO: 213472 - RNA, 22 nt, Human
ucaugcaaggcugaaacauggu

SEQ ID NO: 213473 - RNA, 22 nt, Human
uugggacagaaaaggagaagau

SEQ ID NO: 213474 - RNA, 22 nt, Human
caggaggcagcgcucucaggac

SEQ ID NO: 213475 - RNA, 22 nt, Human
gggccuggugcuucugacuccu

SEQ ID NO: 213476 - RNA, 22 nt, Human
uuguuuacaaguuacucagucu

SEQ ID NO: 213477 - RNA, 21 nt, Human
cugggcuuucucucaaagaca

SEQ ID NO: 213478 - RNA, 22 nt, Human
cagggauggcugucaggaugua

SEQ ID NO: 213479 - RNA, 22 nt, Human
gaggcugaacagguucucauga

SEQ ID NO: 213480 - RNA, 22 nt, Human
cugcagcugucucuacugggca

SEQ ID NO: 213481 - RNA, 22 nt, Human
uauuauuaaauggcagaauuuu

SEQ ID NO: 213482 - RNA, 22 nt, Human
uguaucuucaguuugucuuucc

SEQ ID NO: 213483 - RNA, 22 nt, Human
ggaggggcagccauggaacucc

SEQ ID NO: 213484 - RNA, 22 nt, Human
aggaggaggugggacacaguga

SEQ ID NO: 213485 - RNA, 22 nt, Human
gaacaaaucccuuccugucucc

SEQ ID NO: 213486 - RNA, 22 nt, Human
gugugcaggggcuugguggagc

SEQ ID NO: 213487 - RNA, 22 nt, Human
cauauccaauaugacuaguguu

SEQ ID NO: 213488 - RNA, 22 nt, Human
guccaugguugcuuucauguaa

SEQ ID NO: 213489 - RNA, 22 nt, Human
ugggcugaaaugcuguggacua

SEQ ID NO: 213490 - RNA, 20 nt, Human
uccaggagaacugggagccg

SEQ ID NO: 213491 - RNA, 22 nt, Human
cugagccagggccacacaugga

SEQ ID NO: 213492 - RNA, 23 nt, Human
ugauucagcaaguccacuucugg

SEQ ID NO: 213493 - RNA, 22 nt, Human
cagugagguggaguaguuccca

SEQ ID NO: 213494 - RNA, 22 nt, Human
ucccaggguuacagccagggca

SEQ ID NO: 213495 - RNA, 22 nt, Human
ucuauuuuguuuccagcucuac

SEQ ID NO: 213496 - RNA, 22 nt, Human
acacuuuagaaaaaagaauggu

SEQ ID NO: 213497 - RNA, 22 nt, Human
cugaacuuauugagugcuugcu

SEQ ID NO: 213498 - RNA, 22 nt, Human
aguuuacauauuugucggaguc

SEQ ID NO: 213499 - RNA, 22 nt, Human
augacaugaccugguagagaca

SEQ ID NO: 213500 - RNA, 22 nt, Human
agcaucagcagacucucagcua

SEQ ID NO: 213501 - RNA, 22 nt, Human
aacuuaaacccacucauguaga

SEQ ID NO: 213502 - RNA, 22 nt, Human
aaaaccacuuccuugcuauugg

SEQ ID NO: 213503 - RNA, 22 nt, Human
uagcaggcaucucagagauaau

SEQ ID NO: 213504 - RNA, 22 nt, Human
ugaaugugaugcuaaacauaug

SEQ ID NO: 213505 - RNA, 22 nt, Human
cuggugcacuacagccuggaac

SEQ ID NO: 213506 - RNA, 22 nt, Human
auuauucaacacuugagaaauu

SEQ ID NO: 213507 - RNA, 22 nt, Human
gcauggcaaauaucgagggcag

SEQ ID NO: 213508 - RNA, 21 nt, Human
uagggggcagugggaugcuua

SEQ ID NO: 213509 - RNA, 22 nt, Human
uucucaggucaccagggugcca

SEQ ID NO: 213510 - RNA, 22 nt, Human
aggaggcugaacuagggucugg

SEQ ID NO: 213511 - RNA, 22 nt, Human
gacaggauauuaugauagauuc

SEQ ID NO: 213512 - RNA, 19 nt, Human
ugcaaauguaggaagaaua

SEQ ID NO: 213513 - RNA, 22 nt, Human
gacuuucuuaggcccccuaaua

SEQ ID NO: 213514 - RNA, 22 nt, Human
acagauuuaggacuguagcgau

SEQ ID NO: 213515 - RNA, 22 nt, Human
uauguucaugucaaacaaaugc

SEQ ID NO: 213516 - RNA, 22 nt, Human
gugugggaggaaggugaacaga

SEQ ID NO: 213517 - RNA, 22 nt, Human
caggaagagguaucaccgagca

SEQ ID NO: 213518 - RNA, 22 nt, Human
agggagaguuugauguuuccuc

SEQ ID NO: 213519 - RNA, 22 nt, Human
aaaguucuuuuucuauaaaucc

SEQ ID NO: 213520 - RNA, 22 nt, Human
ggaggccaaagugugggcggcu

SEQ ID NO: 213521 - RNA, 21 nt, Human
uccaggagcacgggacuagga

SEQ ID NO: 213522 - RNA, 21 nt, Human
cugaggcaugcaggccugggc

SEQ ID NO: 213523 - RNA, 22 nt, Human
uuucucauggaacauagcuccu

SEQ ID NO: 213524 - RNA, 22 nt, Human
cugagcagaagggugcacgugc

SEQ ID NO: 213525 - RNA, 23 nt, Human
agggaaauacugcaauuuuugga

SEQ ID NO: 213526 - RNA, 22 nt, Human
cagaaauacccagcauuuggag

SEQ ID NO: 213527 - RNA, 22 nt, Human
aucuagaagccugagccaagau

SEQ ID NO: 213528 - RNA, 22 nt, Human
caggaagaaggguggugagucc

SEQ ID NO: 213529 - RNA, 22 nt, Human
uggcaaaguaauuggguuucuc

SEQ ID NO: 213530 - RNA, 22 nt, Human
ggacuggguaggagcccagggc

SEQ ID NO: 213531 - RNA, 20 nt, Human
aacaguaccauuuaucucag

SEQ ID NO: 213532 - RNA, 22 nt, Human
ucagaaguugaaggcucuuuuu

SEQ ID NO: 213533 - RNA, 22 nt, Human
gacagcaguccuggaguuccca

SEQ ID NO: 213534 - RNA, 22 nt, Human
uuauguacucugcaauguuuga

SEQ ID NO: 213535 - RNA, 22 nt, Human
uuucaguguaucuuccaaaagc

SEQ ID NO: 213536 - RNA, 22 nt, Human
ccuggcauucucuccagagaga

SEQ ID NO: 213537 - RNA, 22 nt, Human
cagggccucucaucccacgggc

SEQ ID NO: 213538 - RNA, 22 nt, Human
cagcccagagaaggggcccgug

SEQ ID NO: 213539 - RNA, 22 nt, Human
agaaaaagaaaguggauuuguc

SEQ ID NO: 213540 - RNA, 20 nt, Human
ucaggcuggugggcuuuccc

SEQ ID NO: 213541 - RNA, 22 nt, Human
aggcuaagugggugucagggcc

SEQ ID NO: 213542 - RNA, 22 nt, Human
cacagcccugcgccccaguuug

SEQ ID NO: 213543 - RNA, 22 nt, Human
agguucaaauuguugcaguuuc

SEQ ID NO: 213544 - RNA, 22 nt, Human
aaggaacuaacuauguagagau

SEQ ID NO: 213545 - RNA, 22 nt, Human
cugggcuuugaagccaggcugc

SEQ ID NO: 213546 - RNA, 22 nt, Human
cagauguaguagcuuuauugca

SEQ ID NO: 213547 - RNA, 22 nt, Human
acauuugaggauguuaagaaug

SEQ ID NO: 213548 - RNA, 22 nt, Human
uagaacaucagguugaauuugg

SEQ ID NO: 213549 - RNA, 22 nt, Human
augcugagaaacagacguguug

SEQ ID NO: 213550 - RNA, 22 nt, Human
uagcagggauacaaggucgccu

SEQ ID NO: 213551 - RNA, 18 nt, Human
ucugaaagcaccggugaa

SEQ ID NO: 213552 - RNA, 22 nt, Human
cagucacagugacaggaugugg

SEQ ID NO: 213553 - RNA, 22 nt, Human
ucagggaacaauguuauggcuu

SEQ ID NO: 213554 - RNA, 22 nt, Human
ugccaggcgauugcuaucagca

SEQ ID NO: 213555 - RNA, 22 nt, Human
gucaggaaaaauugauaauuuu

SEQ ID NO: 213556 - RNA, 22 nt, Human
gacuuucugaaggucucgcagu

SEQ ID NO: 213557 - RNA, 22 nt, Human
ucaaucaaagccagauguccuu

SEQ ID NO: 213558 - RNA, 22 nt, Human
ugcccuccuccugagcccaugu

SEQ ID NO: 213559 - RNA, 22 nt, Human
acacaaugcauauuuuuccaga

SEQ ID NO: 213560 - RNA, 22 nt, Human
cccaggcugccacgauuacugc

SEQ ID NO: 213561 - RNA, 22 nt, Human
gacagcaggugcuugggaaagg

SEQ ID NO: 213562 - RNA, 22 nt, Human
agauggcugggagcucuguuug

SEQ ID NO: 213563 - RNA, 22 nt, Human
aauuuggagagaaacaaguagg

SEQ ID NO: 213564 - RNA, 22 nt, Human
uaguuuuagcagcaaugggaug

SEQ ID NO: 213565 - RNA, 17 nt, Human
cucuguacaggaaagag

SEQ ID NO: 213566 - RNA, 17 nt, Human
cgggcauggagggcagg

SEQ ID NO: 213567 - RNA, 22 nt, Human
auuugcaaagguuaacagcagu

SEQ ID NO: 213568 - RNA, 22 nt, Human
auguaggauugagugauagagg

SEQ ID NO: 213569 - RNA, 22 nt, Human
ugccugccaugcagaaagcuga

SEQ ID NO: 213570 - RNA, 22 nt, Human
ucagacccugcgguguuuggau

SEQ ID NO: 213571 - RNA, 22 nt, Human
gagggcucugucuggaagggaa

SEQ ID NO: 213572 - RNA, 22 nt, Human
auugcuggcugccaucuugccc

SEQ ID NO: 213573 - RNA, 22 nt, Human
agguggcuaugaggaugcaguc

SEQ ID NO: 213574 - RNA, 22 nt, Human
ccugggagaacugcuggguugg

SEQ ID NO: 213575 - RNA, 22 nt, Human
auuauuuagaaaucgauugaaa

SEQ ID NO: 213576 - RNA, 22 nt, Human
gcacaauggaccgugugcucug

SEQ ID NO: 213577 - RNA, 22 nt, Human
auguccaguuucuacacacaua

SEQ ID NO: 213578 - RNA, 22 nt, Human
aggaaauaagggacaagacaaa

SEQ ID NO: 213579 - RNA, 22 nt, Human
acaucuagaagaucugggagau

SEQ ID NO: 213580 - RNA, 22 nt, Human
cuggagcuaggaaguccaagau

SEQ ID NO: 213581 - RNA, 22 nt, Human
aagagcuggcccaaucugagca

SEQ ID NO: 213582 - RNA, 22 nt, Human
gcaaacaagcugccugaagauu

SEQ ID NO: 213583 - RNA, 22 nt, Human
cugguuuagcuguaagguuccc

SEQ ID NO: 213584 - RNA, 22 nt, Human
uacuagaagcuguaauuuuuca

SEQ ID NO: 213585 - RNA, 22 nt, Human
uuaccugugucaguauaugaga

SEQ ID NO: 213586 - RNA, 20 nt, Human
uccugaggcuucgccagugu

SEQ ID NO: 213587 - RNA, 21 nt, Human
uucaacaaagggaauaaguuu

SEQ ID NO: 213588 - RNA, 22 nt, Human
ccugcuccugcuauucuucugg

SEQ ID NO: 213589 - RNA, 22 nt, Human
cagaacuggccuuucaucaguc

SEQ ID NO: 213590 - RNA, 22 nt, Human
uccuacaucagcucucaguagc

SEQ ID NO: 213591 - RNA, 22 nt, Human
uaaaucuuguggcaaugcuucu

SEQ ID NO: 213592 - RNA, 22 nt, Human
ggacaggccauauggaauacau

SEQ ID NO: 213593 - RNA, 22 nt, Human
uauacaguuaaguuucuucagu

SEQ ID NO: 213594 - RNA, 21 nt, Human
aggugcaggccucaagcccca

SEQ ID NO: 213595 - RNA, 22 nt, Human
ucucugaagagcucagacuagu

SEQ ID NO: 213596 - RNA, 22 nt, Human
uuccuggcuuuugggcuaauuc

SEQ ID NO: 213597 - RNA, 15 nt, Human
ggcagguggaucacu

SEQ ID NO: 213598 - RNA, 22 nt, Human
aggcuucugcuguauuaacacu

SEQ ID NO: 213599 - RNA, 22 nt, Human
ugggccacugcugcggaaggcg

SEQ ID NO: 213600 - RNA, 22 nt, Human
aaggugucauuguuuauggaga

SEQ ID NO: 213601 - RNA, 22 nt, Human
ucccucagacagauguguuccu

SEQ ID NO: 213602 - RNA, 22 nt, Human
ucuuguauguguauuuugcugu

SEQ ID NO: 213603 - RNA, 22 nt, Human
aggagccagcguuccucaggau

SEQ ID NO: 213604 - RNA, 22 nt, Human
agcugguggagccuuucuguuu

SEQ ID NO: 213605 - RNA, 22 nt, Human
ugcccugcggcuaucuagauga

SEQ ID NO: 213606 - RNA, 22 nt, Human
agggucucuacgcacuagaggg

SEQ ID NO: 213607 - RNA, 22 nt, Human
cuacuguaguggccuauuuacc

SEQ ID NO: 213608 - RNA, 22 nt, Human
caggcagauuugcugcccucca

SEQ ID NO: 213609 - RNA, 18 nt, Human
gcucugcagcugaggcuu

SEQ ID NO: 213610 - RNA, 22 nt, Human
agccaagggucagcugcacaga

SEQ ID NO: 213611 - RNA, 22 nt, Human
cagagacauccauuuuauaugc

SEQ ID NO: 213612 - RNA, 18 nt, Human
caggucugucugccuccc

SEQ ID NO: 213613 - RNA, 22 nt, Human
uaaucucuagcccaugcaaaga

SEQ ID NO: 213614 - RNA, 22 nt, Human
gccuggaguagcauggcaagcc

SEQ ID NO: 213615 - RNA, 19 nt, Human
ugacaagauaauagccuug

SEQ ID NO: 213616 - RNA, 22 nt, Human
ugucaucuuguccagccaggca

SEQ ID NO: 213617 - RNA, 22 nt, Human
agccaggcgggucuuugcuccu

SEQ ID NO: 213618 - RNA, 22 nt, Human
aagaaagcauuagacaggcauu

SEQ ID NO: 213619 - RNA, 22 nt, Human
uguuucuugagaguauuacccu

SEQ ID NO: 213620 - RNA, 22 nt, Human
aaagugcagaacuguucucacu

SEQ ID NO: 213621 - RNA, 20 nt, Human
acacacagagacaugcgcau

SEQ ID NO: 213622 - RNA, 20 nt, Human
ucugccuuagggggagccuc

SEQ ID NO: 213623 - RNA, 22 nt, Human
cagggcagaacauauagauagu

SEQ ID NO: 213624 - RNA, 22 nt, Human
gguuucaaugagaagugcuugu

SEQ ID NO: 213625 - RNA, 22 nt, Human
uuuauugaacacuugcacuggc

SEQ ID NO: 213626 - RNA, 22 nt, Human
ugugugcaggcacugugccaga

SEQ ID NO: 213627 - RNA, 22 nt, Human
uaaaggcuuuuacaggagugca

SEQ ID NO: 213628 - RNA, 22 nt, Human
gcugagcuagaaaaggaccaca

SEQ ID NO: 213629 - RNA, 22 nt, Human
auguacauacugcauuuucaaa

SEQ ID NO: 213630 - RNA, 22 nt, Human
uuugacuccagagcccauuuuu

SEQ ID NO: 213631 - RNA, 22 nt, Human
aucucuucuagcucugaaauua

SEQ ID NO: 213632 - RNA, 22 nt, Human
cugggucuggaggccaagggug

SEQ ID NO: 213633 - RNA, 22 nt, Human
aaaugucagaagcuuuacuucu

SEQ ID NO: 213634 - RNA, 22 nt, Human
caggcucacuguaaggucagcu

SEQ ID NO: 213635 - RNA, 22 nt, Human
cccagcaggugccaucacucug

SEQ ID NO: 213636 - RNA, 23 nt, Human
gcccugcugggaccuccugcuac

SEQ ID NO: 213637 - RNA, 22 nt, Human
accagagcccaucugcuccuag

SEQ ID NO: 213638 - RNA, 22 nt, Human
cucuaggggcuggucagcgucu

SEQ ID NO: 213639 - RNA, 18 nt, Human
agcaccagucacuaacag

SEQ ID NO: 213640 - RNA, 19 nt, Human
uagaaccuggauuucagga

SEQ ID NO: 213641 - RNA, 22 nt, Human
aguacaacauuagaguaucuua

SEQ ID NO: 213642 - RNA, 22 nt, Human
augaauauugaaugucuuauga

SEQ ID NO: 213643 - RNA, 22 nt, Human
uuacagcauuuaaugagaucug

SEQ ID NO: 213644 - RNA, 22 nt, Human
cacuagaaccaaugacauuucu

SEQ ID NO: 213645 - RNA, 22 nt, Human
gcuccaggaggaugaccuuccu

SEQ ID NO: 213646 - RNA, 22 nt, Human
gagcccuguaggaaucucucaa

SEQ ID NO: 213647 - RNA, 22 nt, Human
uuucuguuguuggugucuggcu

SEQ ID NO: 213648 - RNA, 22 nt, Human
ugagagccuaguagguggaaaa

SEQ ID NO: 213649 - RNA, 22 nt, Human
agaagccaaucagcucucugcu

SEQ ID NO: 213650 - RNA, 18 nt, Human
cagccucugauugguugc

SEQ ID NO: 213651 - RNA, 22 nt, Human
gggguccuggaggccagcugga

SEQ ID NO: 213652 - RNA, 22 nt, Human
aaagccagcaaggugaguuuca

SEQ ID NO: 213653 - RNA, 20 nt, Human
agugcuguggcugaauaaga

SEQ ID NO: 213654 - RNA, 22 nt, Human
gugcagcugcccaagccugagc

SEQ ID NO: 213655 - RNA, 22 nt, Human
ucccaaggugcucggcaacagg

SEQ ID NO: 213656 - RNA, 22 nt, Human
caguccugucuuuaugacuuca

SEQ ID NO: 213657 - RNA, 22 nt, Human
uagcacauaacuuagaauaguu

SEQ ID NO: 213658 - RNA, 22 nt, Human
uuagaacugaagaagauuaagg

SEQ ID NO: 213659 - RNA, 22 nt, Human
acauguguuuuccuacuuauga

SEQ ID NO: 213660 - RNA, 19 nt, Human
gcagccaggugcucuaccu

SEQ ID NO: 213661 - RNA, 22 nt, Human
uagauacauuuuucuuuccugu

SEQ ID NO: 213662 - RNA, 22 nt, Human
ugagaggugaggcaugaggcau

SEQ ID NO: 213663 - RNA, 22 nt, Human
uguuuuguccuuuucuauauac

SEQ ID NO: 213664 - RNA, 22 nt, Human
ugcuggguagaaguauuagucu

SEQ ID NO: 213665 - RNA, 22 nt, Human
gcugccucaggcaccuccuggc

SEQ ID NO: 213666 - RNA, 22 nt, Human
uagaaguugcucaauaaauguu

SEQ ID NO: 213667 - RNA, 22 nt, Human
uuccuagaaugguuagaaaaua

SEQ ID NO: 213668 - RNA, 22 nt, Human
gcagguaagagaggcuggcuuc

SEQ ID NO: 213669 - RNA, 22 nt, Human
uuucacauuggcuucuauuucu

SEQ ID NO: 213670 - RNA, 20 nt, Human
ccucucugcccugcaaggcc

SEQ ID NO: 213671 - RNA, 22 nt, Human
caggccaaagaucccauugaca

SEQ ID NO: 213672 - RNA, 22 nt, Human
ucugccugcaguguggcagggc

SEQ ID NO: 213673 - RNA, 22 nt, Human
uccacgugagcuucgugugcag

SEQ ID NO: 213674 - RNA, 22 nt, Human
gcagggaugcugaggcucagug

SEQ ID NO: 213675 - RNA, 22 nt, Human
aaacuuuguucgucugaugugg

SEQ ID NO: 213676 - RNA, 22 nt, Human
gcugugcugcgggaggauuccg

SEQ ID NO: 213677 - RNA, 22 nt, Human
aaguuugucgaaauuaucagca

SEQ ID NO: 213678 - RNA, 22 nt, Human
uguguucuuaaaagcagugaua

SEQ ID NO: 213679 - RNA, 22 nt, Human
agagagcaggacuucacugagc

SEQ ID NO: 213680 - RNA, 22 nt, Human
ucacagacucuugauugucuaa

SEQ ID NO: 213681 - RNA, 22 nt, Human
cuucuuugaaaaaggcagucag

SEQ ID NO: 213682 - RNA, 22 nt, Human
uguuucuugggugcucacauca

SEQ ID NO: 213683 - RNA, 22 nt, Human
ccuuuagagcaaacgccaccua

SEQ ID NO: 213684 - RNA, 22 nt, Human
aaacugcacaugaggcuggugc

SEQ ID NO: 213685 - RNA, 18 nt, Human
ucaugaggaaggagaaga

SEQ ID NO: 213686 - RNA, 23 nt, Human
aggacagcaaaccccgccucccc

SEQ ID NO: 213687 - RNA, 22 nt, Human
agcaccaggauauuguuggaga

SEQ ID NO: 213688 - RNA, 22 nt, Human
agucucagggccacccggggaa

SEQ ID NO: 213689 - RNA, 22 nt, Human
cuccugagaauuuucaguugga

SEQ ID NO: 213690 - RNA, 22 nt, Human
acacuguaggagaaaggaguuu

SEQ ID NO: 213691 - RNA, 22 nt, Human
ugcagguucugaccagccaacu

SEQ ID NO: 213692 - RNA, 19 nt, Human
acauauguggauauacaug

SEQ ID NO: 213693 - RNA, 22 nt, Human
cacacauuagagccaaugucag

SEQ ID NO: 213694 - RNA, 22 nt, Human
cagagccacuuggagaugagaa

SEQ ID NO: 213695 - RNA, 22 nt, Human
ucaaauuauuuaggauagugcu

SEQ ID NO: 213696 - RNA, 22 nt, Human
gggaagagugucgguugaagug

SEQ ID NO: 213697 - RNA, 22 nt, Human
aguggcaaugggaguggagaca

SEQ ID NO: 213698 - RNA, 22 nt, Human
cuguuuauggagguaaggcauc

SEQ ID NO: 213699 - RNA, 22 nt, Human
auuuaauuuucucaacagugcu

SEQ ID NO: 213700 - RNA, 22 nt, Human
augcagaaagcggcaaacaggu

SEQ ID NO: 213701 - RNA, 22 nt, Human
aucuccagugaggcagauucug

SEQ ID NO: 213702 - RNA, 22 nt, Human
acagccagaggagccaggcugg

SEQ ID NO: 213703 - RNA, 22 nt, Human
agcagggcuugccgcuuguccu

SEQ ID NO: 213704 - RNA, 22 nt, Human
cuagaacuacaucuuuuaauag

SEQ ID NO: 213705 - RNA, 22 nt, Human
cuggauguuuaugaaggaccca

SEQ ID NO: 213706 - RNA, 22 nt, Human
uaauguaaacacagagacagaa

SEQ ID NO: 213707 - RNA, 22 nt, Human
uuuucauuguaaaucaggaaac

SEQ ID NO: 213708 - RNA, 21 nt, Human
aggcugcuggcucaggguccu

SEQ ID NO: 213709 - RNA, 22 nt, Human
uuccuggccccauccaucuuca

SEQ ID NO: 213710 - RNA, 22 nt, Human
ucaauaaauagcuuggcucagc

SEQ ID NO: 213711 - RNA, 22 nt, Human
ucuggaugggaugaggcaacaa

SEQ ID NO: 213712 - RNA, 22 nt, Human
uuagaaguucaggucuguaauc

SEQ ID NO: 213713 - RNA, 22 nt, Human
uggccugguaccacauagauuu

SEQ ID NO: 213714 - RNA, 22 nt, Human
agggaccacauccccucugugg

SEQ ID NO: 213715 - RNA, 22 nt, Human
uacaaacuguccagcccagagg

SEQ ID NO: 213716 - RNA, 22 nt, Human
aagcagagccaccagcuuugga

SEQ ID NO: 213717 - RNA, 22 nt, Human
acauuuuaauaugcuuagugug

SEQ ID NO: 213718 - RNA, 22 nt, Human
agcuggguugacaagauggaaa

SEQ ID NO: 213719 - RNA, 22 nt, Human
uuauuuucuccucagaaagugg

SEQ ID NO: 213720 - RNA, 22 nt, Human
augccucugcucuugguccuca

SEQ ID NO: 213721 - RNA, 22 nt, Human
ugucuccugggucccuuccacc

SEQ ID NO: 213722 - RNA, 22 nt, Human
gcuaggcucggaagcagcaggg

SEQ ID NO: 213723 - RNA, 22 nt, Human
agaggccucuuugcaaguaggu

SEQ ID NO: 213724 - RNA, 22 nt, Human
gggagugguccuuuccuaucug

SEQ ID NO: 213725 - RNA, 22 nt, Human
uacacaucuggagaagcccugu

SEQ ID NO: 213726 - RNA, 22 nt, Human
gcucaguguuucugguagaaaa

SEQ ID NO: 213727 - RNA, 22 nt, Human
cugaagaggacgcagcagcaag

SEQ ID NO: 213728 - RNA, 22 nt, Human
cucugggcggcccaggccaacc

SEQ ID NO: 213729 - RNA, 22 nt, Human
cuccagugcacuggucuuuuca

SEQ ID NO: 213730 - RNA, 22 nt, Human
gcucaggcuucuucuauaaaga

SEQ ID NO: 213731 - RNA, 22 nt, Human
ugcucuucaccauuacaucaug

SEQ ID NO: 213732 - RNA, 21 nt, Human
cuguggacaggcuggggcaug

SEQ ID NO: 213733 - RNA, 22 nt, Human
cugcaccaucuggagcaccucc

SEQ ID NO: 213734 - RNA, 22 nt, Human
ucacaucugcaaaaucccuuuu

SEQ ID NO: 213735 - RNA, 23 nt, Human
aucugggcaucuggagugguccu

SEQ ID NO: 213736 - RNA, 22 nt, Human
gggcugagaauucagcuuuccu

SEQ ID NO: 213737 - RNA, 22 nt, Human
auuuccaguccuaaugaucugg

SEQ ID NO: 213738 - RNA, 22 nt, Human
caguggaaacuaugcugcugga

SEQ ID NO: 213739 - RNA, 18 nt, Human
ugagaaccauguucauuc

SEQ ID NO: 213740 - RNA, 22 nt, Human
ugugagcagagccugacaugag

SEQ ID NO: 213741 - RNA, 20 nt, Human
aaagcaguaugcaaguagag

SEQ ID NO: 213742 - RNA, 22 nt, Human
ggggacugaggcacugaaggug

SEQ ID NO: 213743 - RNA, 22 nt, Human
gccuggugaaaggcagagagcg

SEQ ID NO: 213744 - RNA, 22 nt, Human
ggcccaugacccuagccaacug

SEQ ID NO: 213745 - RNA, 22 nt, Human
agccacagagcaggagaccuuu

SEQ ID NO: 213746 - RNA, 22 nt, Human
ccuggggcucugcacagagcag

SEQ ID NO: 213747 - RNA, 22 nt, Human
acacagcaacuugcaguaugga

SEQ ID NO: 213748 - RNA, 22 nt, Human
acacagagcuggaacugcuuca

SEQ ID NO: 213749 - RNA, 20 nt, Human
cuuucucuaauuuauaagua

SEQ ID NO: 213750 - RNA, 22 nt, Human
aguuaaaugucaguagcuuaac

SEQ ID NO: 213751 - RNA, 22 nt, Human
uucuggaauccucaaaacauga

SEQ ID NO: 213752 - RNA, 22 nt, Human
ucucagagcaucauuuucuuag

SEQ ID NO: 213753 - RNA, 22 nt, Human
uaagauuauacuuaaagagaaa

SEQ ID NO: 213754 - RNA, 22 nt, Human
auaugcagagagcaugaauagg

SEQ ID NO: 213755 - RNA, 20 nt, Human
ucagcacagcugacaagguu

SEQ ID NO: 213756 - RNA, 22 nt, Human
ccucuggccuaggccgggagag

SEQ ID NO: 213757 - RNA, 22 nt, Human
ugucuccagaaagcaccaggag

SEQ ID NO: 213758 - RNA, 22 nt, Human
uuacaaagcguugagacaagua

SEQ ID NO: 213759 - RNA, 22 nt, Human
aauuaguucacguccugugcuu

SEQ ID NO: 213760 - RNA, 22 nt, Human
ucaagcaaguguuugguguaaa

SEQ ID NO: 213761 - RNA, 20 nt, Human
ucugggcuucccccagcucc

SEQ ID NO: 213762 - RNA, 22 nt, Human
gcccaagggcaucaaguucuac

SEQ ID NO: 213763 - RNA, 22 nt, Human
gagagcaggcucucgggggcca

SEQ ID NO: 213764 - RNA, 22 nt, Human
gagagcccugcuccuaucccag

SEQ ID NO: 213765 - RNA, 22 nt, Human
aagcaacuccuaggaggaaagg

SEQ ID NO: 213766 - RNA, 22 nt, Human
aagauuuagggccaguuuacau

SEQ ID NO: 213767 - RNA, 22 nt, Human
cacagguguaugaauaugucca

SEQ ID NO: 213768 - RNA, 22 nt, Human
ugcacauuuguuauuuugaggu

SEQ ID NO: 213769 - RNA, 22 nt, Human
cuugagaaugugagccacagau

SEQ ID NO: 213770 - RNA, 22 nt, Human
gugaggcagggaaagaggauaa

SEQ ID NO: 213771 - RNA, 22 nt, Human
uucccacauucuuuacauucau

SEQ ID NO: 213772 - RNA, 22 nt, Human
agcaggcacuaugccaggaucu

SEQ ID NO: 213773 - RNA, 22 nt, Human
ugccaggccacguagcuucaag

SEQ ID NO: 213774 - RNA, 22 nt, Human
cuauuucuaaaccuauaaguga

SEQ ID NO: 213775 - RNA, 23 nt, Human
uggcucucucagugcugcagagg

SEQ ID NO: 213776 - RNA, 22 nt, Human
uugggucuuauggcuggaguag

SEQ ID NO: 213777 - RNA, 22 nt, Human
gccuguuucccugacgcuuaca

SEQ ID NO: 213778 - RNA, 16 nt, Human
ucagggcagaauggca

SEQ ID NO: 213779 - RNA, 22 nt, Human
ggcaggugccuucugugcuagc

SEQ ID NO: 213780 - RNA, 22 nt, Human
aauaauuagugggacagagaac

SEQ ID NO: 213781 - RNA, 22 nt, Human
cagaaugcagaauguucauuuu

SEQ ID NO: 213782 - RNA, 17 nt, Human
ucugagaaaggagaauc

SEQ ID NO: 213783 - RNA, 22 nt, Human
uugccagggaacagggagaggc

SEQ ID NO: 213784 - RNA, 18 nt, Human
ugaggccagagugggcau

SEQ ID NO: 213785 - RNA, 22 nt, Human
uaauacugagccaccagguagg

SEQ ID NO: 213786 - RNA, 22 nt, Human
uuugcuuguucaagauuucugu

SEQ ID NO: 213787 - RNA, 22 nt, Human
augaaacugaaggacaaccaga

SEQ ID NO: 213788 - RNA, 22 nt, Human
agaugagggguagaaaggacuu

SEQ ID NO: 213789 - RNA, 22 nt, Human
auggcccaggccaggauccagc

SEQ ID NO: 213790 - RNA, 22 nt, Human
aaauuauucucauguguuucuu

SEQ ID NO: 213791 - RNA, 22 nt, Human
uccagcccagcuguccccuuca

SEQ ID NO: 213792 - RNA, 22 nt, Human
agaaggcagaaaguccagguau

SEQ ID NO: 213793 - RNA, 22 nt, Human
ugcccugcuguggcucugccca

SEQ ID NO: 213794 - RNA, 22 nt, Human
ugcugcucaaugagaugccauc

SEQ ID NO: 213795 - RNA, 22 nt, Human
uuugaacagggaauguuccaca

SEQ ID NO: 213796 - RNA, 22 nt, Human
auggagggugguaagacagaga

SEQ ID NO: 213797 - RNA, 22 nt, Human
gaagauuaaugagaaaccugcu

SEQ ID NO: 213798 - RNA, 22 nt, Human
aguuaacuaaauuaagagacaa

SEQ ID NO: 213799 - RNA, 22 nt, Human
gcaagcugugauuuaugugaau

SEQ ID NO: 213800 - RNA, 22 nt, Human
auucuucacauaagugcuguac

SEQ ID NO: 213801 - RNA, 22 nt, Human
acagcugggaaucagcugggga

SEQ ID NO: 213802 - RNA, 22 nt, Human
cagaaaccaaaugggaugggga

SEQ ID NO: 213803 - RNA, 22 nt, Human
agcugaaacuucccauuaauug

SEQ ID NO: 213804 - RNA, 22 nt, Human
accucacaagucucugucagcu

SEQ ID NO: 213805 - RNA, 21 nt, Human
gcuuccaagauggcaccuuga

SEQ ID NO: 213806 - RNA, 20 nt, Human
ggcagcucuagucgaggccc

SEQ ID NO: 213807 - RNA, 22 nt, Human
uucucaguauuacaugcuaaug

SEQ ID NO: 213808 - RNA, 22 nt, Human
gcaaggaggcugguggaggaag

SEQ ID NO: 213809 - RNA, 22 nt, Human
ugcuggagugagugguuucuua

SEQ ID NO: 213810 - RNA, 22 nt, Human
aauugcuucccaagggaggucu

SEQ ID NO: 213811 - RNA, 22 nt, Human
ucuuguuuggauuuugggcagu

SEQ ID NO: 213812 - RNA, 22 nt, Human
aacauuucagcaaauaagaaca

SEQ ID NO: 213813 - RNA, 22 nt, Human
caaggcuuucucauuauccuuu

SEQ ID NO: 213814 - RNA, 22 nt, Human
ucagaaaggccacauggugcag

SEQ ID NO: 213815 - RNA, 22 nt, Human
cuggcuucagcugccaucaaug

SEQ ID NO: 213816 - RNA, 21 nt, Human
cugaggcagcacagcuaguca

SEQ ID NO: 213817 - RNA, 22 nt, Human
aucuguacaagauuuuaugcgu

SEQ ID NO: 213818 - RNA, 22 nt, Human
ugccaggcaacugcccagccau

SEQ ID NO: 213819 - RNA, 19 nt, Human
aucugagauuauaaacaga

SEQ ID NO: 213820 - RNA, 22 nt, Human
acagguagugggcuagaucugg

SEQ ID NO: 213821 - RNA, 22 nt, Human
aagcucagugaugccuccaggg

SEQ ID NO: 213822 - RNA, 22 nt, Human
gcugcagggcucucacaggggg

SEQ ID NO: 213823 - RNA, 22 nt, Human
cucugagguuuccucacaagcu

SEQ ID NO: 213824 - RNA, 17 nt, Human
aggccucccuccaggcc

SEQ ID NO: 213825 - RNA, 22 nt, Human
acagcucuguugccagaucugc

SEQ ID NO: 213826 - RNA, 22 nt, Human
uggcacagcccggauucuauga

SEQ ID NO: 213827 - RNA, 21 nt, Human
ugggggugaggccuaggaauc

SEQ ID NO: 213828 - RNA, 22 nt, Human
guucuucagaggggaaagaacc

SEQ ID NO: 213829 - RNA, 22 nt, Human
agggccaggaacaccugaaggg

SEQ ID NO: 213830 - RNA, 22 nt, Human
cugaaggaagcagguggccugu

SEQ ID NO: 213831 - RNA, 22 nt, Human
caggcugccaaggcuggggagg

SEQ ID NO: 213832 - RNA, 22 nt, Human
gggaggcgccgaggguagcuaa

SEQ ID NO: 213833 - RNA, 22 nt, Human
uauaauuuggggaaaguggugu

SEQ ID NO: 213834 - RNA, 22 nt, Human
acguaauauaagaaaguguggu

SEQ ID NO: 213835 - RNA, 22 nt, Human
ccaggagcagauauggacauaa

SEQ ID NO: 213836 - RNA, 22 nt, Human
gcaggcugauagaggauuccau

SEQ ID NO: 213837 - RNA, 22 nt, Human
ggaucuguuuugccucugaggg

SEQ ID NO: 213838 - RNA, 22 nt, Human
ggcuggcagaagugugcuggcu

SEQ ID NO: 213839 - RNA, 22 nt, Human
cuucucucugcauaggcauggg

SEQ ID NO: 213840 - RNA, 22 nt, Human
aauaaaucaauccuauugguag

SEQ ID NO: 213841 - RNA, 22 nt, Human
gcagggcagcugaagcuaggug

SEQ ID NO: 213842 - RNA, 22 nt, Human
cccaggaggguggccucugccc

SEQ ID NO: 213843 - RNA, 22 nt, Human
uagacaggaaacauuaggaugg

SEQ ID NO: 213844 - RNA, 22 nt, Human
gaggccagcuacccaaggguca

SEQ ID NO: 213845 - RNA, 17 nt, Human
auacaguuuauuuuaca

SEQ ID NO: 213846 - RNA, 22 nt, Human
gaggccaaguuggagaccaggu

SEQ ID NO: 213847 - RNA, 17 nt, Human
cccugcacccuacucuc

SEQ ID NO: 213848 - RNA, 20 nt, Human
ugagauuuguauuauaaguc

SEQ ID NO: 213849 - RNA, 22 nt, Human
gcuggcuguaucaccuggccag

SEQ ID NO: 213850 - RNA, 22 nt, Human
ugcugugcaaaggugaugugag

SEQ ID NO: 213851 - RNA, 22 nt, Human
acagcuuuuuacuaauagauug

SEQ ID NO: 213852 - RNA, 22 nt, Human
gucaaacagccuccuguucuaa

SEQ ID NO: 213853 - RNA, 22 nt, Human
uggaaggaagccaaggaagguu

SEQ ID NO: 213854 - RNA, 22 nt, Human
guuaaagugaucuugucagguu

SEQ ID NO: 213855 - RNA, 22 nt, Human
agagccaggacugugucucacu

SEQ ID NO: 213856 - RNA, 22 nt, Human
ucaggagggcuaagacuguagc

SEQ ID NO: 213857 - RNA, 21 nt, Human
aaagauguuucuuuuccucac

SEQ ID NO: 213858 - RNA, 22 nt, Human
gucaggaucaaauugaaguuau

SEQ ID NO: 213859 - RNA, 22 nt, Human
aauguuauuucugcauaguagu

SEQ ID NO: 213860 - RNA, 22 nt, Human
uuuaauuuuccucuuccuggag

SEQ ID NO: 213861 - RNA, 22 nt, Human
uacagacaaagagcaugcggua

SEQ ID NO: 213862 - RNA, 22 nt, Human
uggcugcugcucacucagccuc

SEQ ID NO: 213863 - RNA, 22 nt, Human
uuucuuuaaaggaacucuguuu

SEQ ID NO: 213864 - RNA, 22 nt, Human
uugcucuccagaggcucacagc

SEQ ID NO: 213865 - RNA, 22 nt, Human
uuacuacagagagagcuccagu

SEQ ID NO: 213866 - RNA, 22 nt, Human
uuccuugagaugacugucuugu

SEQ ID NO: 213867 - RNA, 22 nt, Human
aagcugaaauaauaucuauguu

SEQ ID NO: 213868 - RNA, 22 nt, Human
auaagcauuucacagguguguu

SEQ ID NO: 213869 - RNA, 22 nt, Human
auaaagcuaagacuuacaugaa

SEQ ID NO: 213870 - RNA, 22 nt, Human
aguaugaauacagauuuucucu

SEQ ID NO: 213871 - RNA, 22 nt, Human
gcugccucccccauggcuggaa

SEQ ID NO: 213872 - RNA, 22 nt, Human
cuuccagaguugcguucucggu

SEQ ID NO: 213873 - RNA, 22 nt, Human
cugcagagcuugucuggaugug

SEQ ID NO: 213874 - RNA, 22 nt, Human
acauuuaaauaugccuuauauu

SEQ ID NO: 213875 - RNA, 22 nt, Human
aaacagugauguugaguguaaa

SEQ ID NO: 213876 - RNA, 22 nt, Human
gccaggcucucagugacugccc

SEQ ID NO: 213877 - RNA, 22 nt, Human
gcaggagguugagccaggacug

SEQ ID NO: 213878 - RNA, 22 nt, Human
uaccauuuacuugaaaauaaaa

SEQ ID NO: 213879 - RNA, 22 nt, Human
cugcugaaccuuugcuagauaa

SEQ ID NO: 213880 - RNA, 22 nt, Human
acuuucccacuuaauguauuua

SEQ ID NO: 213881 - RNA, 22 nt, Human
gcagggcaaacccagguguuca

SEQ ID NO: 213882 - RNA, 22 nt, Human
uccugagaaggcacagcuugca

SEQ ID NO: 213883 - RNA, 22 nt, Human
agggacuuguguccuauguaug

SEQ ID NO: 213884 - RNA, 22 nt, Human
guguccauguuguucaggguga

SEQ ID NO: 213885 - RNA, 22 nt, Human
gcauggcuauuaugaggcagaa

SEQ ID NO: 213886 - RNA, 22 nt, Human
gugagaguguuuggaaauagaa

SEQ ID NO: 213887 - RNA, 22 nt, Human
aaugauuuccccuacacagaag

SEQ ID NO: 213888 - RNA, 22 nt, Human
agauccacuauggugcugauga

SEQ ID NO: 213889 - RNA, 22 nt, Human
uuugcaauaguccuggccugua

SEQ ID NO: 213890 - RNA, 20 nt, Human
agccucugcccuucccacug

SEQ ID NO: 213891 - RNA, 22 nt, Human
cuuguccagauguuuguuaggu

SEQ ID NO: 213892 - RNA, 22 nt, Human
uaggcagcuuagguuagaagug

SEQ ID NO: 213893 - RNA, 22 nt, Human
aauauauagaaguacccguugu

SEQ ID NO: 213894 - RNA, 22 nt, Human
uucagcuugcugacugcggcag

SEQ ID NO: 213895 - RNA, 22 nt, Human
gcagucuauaaaucagcuuugc

SEQ ID NO: 213896 - RNA, 21 nt, Human
uguggcagagacaaugcuagu

SEQ ID NO: 213897 - RNA, 18 nt, Human
gggcucacacaggucauc

SEQ ID NO: 213898 - RNA, 22 nt, Human
cugugggaacacugaggacuuc

SEQ ID NO: 213899 - RNA, 22 nt, Human
uuuccaaguuguuaccuucuac

SEQ ID NO: 213900 - RNA, 23 nt, Human
agggguggucaguacccgcagug

SEQ ID NO: 213901 - RNA, 22 nt, Human
ccuccugguugcaaugaaaugg

SEQ ID NO: 213902 - RNA, 22 nt, Human
ugagcaggcucccacuucagug

SEQ ID NO: 213903 - RNA, 22 nt, Human
cugugggagcacuggggaccga

SEQ ID NO: 213904 - RNA, 22 nt, Human
ucuggcagugagcaacuugaca

SEQ ID NO: 213905 - RNA, 22 nt, Human
guggguggagacugggugcaag

SEQ ID NO: 213906 - RNA, 22 nt, Human
caaggcugagaaauucugcccu

SEQ ID NO: 213907 - RNA, 22 nt, Human
gaaggcuugauugaggaaugcc

SEQ ID NO: 213908 - RNA, 22 nt, Human
uggggaagacagcagacacugu

SEQ ID NO: 213909 - RNA, 22 nt, Human
uccaggagaaaacugacggugg

SEQ ID NO: 213910 - RNA, 22 nt, Human
acaggugugggcugggcucuga

SEQ ID NO: 213911 - RNA, 22 nt, Human
aaggucucuguugagaacauuu

SEQ ID NO: 213912 - RNA, 22 nt, Human
acacuaauuaagcugcuuuacu

SEQ ID NO: 213913 - RNA, 22 nt, Human
caggaaagguagucacaaugua

SEQ ID NO: 213914 - RNA, 22 nt, Human
ggcuucccuaaaccuuuccacu

SEQ ID NO: 213915 - RNA, 22 nt, Human
ugcuacagagccaggaagagug

SEQ ID NO: 213916 - RNA, 22 nt, Human
aaaaugacauuccagugauauu

SEQ ID NO: 213917 - RNA, 22 nt, Human
gagucaggaugcaaggggaugg

SEQ ID NO: 213918 - RNA, 22 nt, Human
gaggcaggcccugaaugaguca

SEQ ID NO: 213919 - RNA, 22 nt, Human
uguccaggaauugacccugcaa

SEQ ID NO: 213920 - RNA, 22 nt, Human
auagcacugguuuuucuugguu

SEQ ID NO: 213921 - RNA, 22 nt, Human
ccagagguccugcucacuggug

SEQ ID NO: 213922 - RNA, 22 nt, Human
agccugccucagacucaggaua

SEQ ID NO: 213923 - RNA, 22 nt, Human
augguuuauaggacagcucugu

SEQ ID NO: 213924 - RNA, 22 nt, Human
ugccugaugcaggaguaucaga

SEQ ID NO: 213925 - RNA, 22 nt, Human
ucauguacauguaagucagaaa

SEQ ID NO: 213926 - RNA, 22 nt, Human
aggcacuugcauugaugagguc

SEQ ID NO: 213927 - RNA, 22 nt, Human
ggguuaaacaugcuauaugagu

SEQ ID NO: 213928 - RNA, 22 nt, Human
auugaaaaugacauuugugccc

SEQ ID NO: 213929 - RNA, 22 nt, Human
aagcacaugaaaaugugaagcu

SEQ ID NO: 213930 - RNA, 21 nt, Human
gcagccagccgagaccaugcc

SEQ ID NO: 213931 - RNA, 22 nt, Human
uggcagaggcucugugauguug

SEQ ID NO: 213932 - RNA, 22 nt, Human
agggagguccaucccugcagag

SEQ ID NO: 213933 - RNA, 22 nt, Human
ugaacagugaucuacauguggc

SEQ ID NO: 213934 - RNA, 22 nt, Human
gagacagagaucuugcugaguc

SEQ ID NO: 213935 - RNA, 22 nt, Human
auaauaacaccugaauaggaaa

SEQ ID NO: 213936 - RNA, 21 nt, Human
uuggaacaagcagcaguuugc

SEQ ID NO: 213937 - RNA, 22 nt, Human
agaaggggagaagcuaccagga

SEQ ID NO: 213938 - RNA, 22 nt, Human
uugaaaacauuuauauuagaau

SEQ ID NO: 213939 - RNA, 22 nt, Human
cugcugugaguuuggaggucua

SEQ ID NO: 213940 - RNA, 22 nt, Human
ucugugcauuguaacaacuaaa

SEQ ID NO: 213941 - RNA, 22 nt, Human
cccagcagggucucugugucua

SEQ ID NO: 213942 - RNA, 22 nt, Human
gcagcagcucccuauccaggcu

SEQ ID NO: 213943 - RNA, 22 nt, Human
gcuguggccuggcgcagagcug

SEQ ID NO: 213944 - RNA, 22 nt, Human
auuagaagcgugaauccuuuca

SEQ ID NO: 213945 - RNA, 20 nt, Human
ucacuggccagaguagcccu

SEQ ID NO: 213946 - RNA, 22 nt, Human
ggcucugggaaauggucuuccu

SEQ ID NO: 213947 - RNA, 22 nt, Human
cuccccugagcauagacucugu

SEQ ID NO: 213948 - RNA, 22 nt, Human
ccagccccuauccucgcuccac

SEQ ID NO: 213949 - RNA, 22 nt, Human
auacaaguuaaugagaaugaca

SEQ ID NO: 213950 - RNA, 22 nt, Human
ugcauguggaccccuggugccu

SEQ ID NO: 213951 - RNA, 22 nt, Human
cuauuucaaggcccagauauga

SEQ ID NO: 213952 - RNA, 22 nt, Human
uuguauuuuuuccuggcggugg

SEQ ID NO: 213953 - RNA, 22 nt, Human
cagagcugcuucccaguuugug

SEQ ID NO: 213954 - RNA, 19 nt, Human
cugggaguucacugcugcc

SEQ ID NO: 213955 - RNA, 22 nt, Human
uggcccagggcacagcagggag

SEQ ID NO: 213956 - RNA, 22 nt, Human
agcagcagaggucagaaaggua

SEQ ID NO: 213957 - RNA, 22 nt, Human
uugggaaagccacaaauuggag

SEQ ID NO: 213958 - RNA, 22 nt, Human
ucuucauuccguagauauuuau

SEQ ID NO: 213959 - RNA, 22 nt, Human
cagcagcagauucagcgucugg

SEQ ID NO: 213960 - RNA, 22 nt, Human
cacaggaaucgucacuuagcgc

SEQ ID NO: 213961 - RNA, 22 nt, Human
aagcacagggacucaggaccgg

SEQ ID NO: 213962 - RNA, 22 nt, Human
aaauagcuuuucauaauucuca

SEQ ID NO: 213963 - RNA, 22 nt, Human
guggacagcuucuaggugccag

SEQ ID NO: 213964 - RNA, 22 nt, Human
acagaaauucaaacuggaauuu

SEQ ID NO: 213965 - RNA, 22 nt, Human
gcuccugucuuggggcacuggc

SEQ ID NO: 213966 - RNA, 22 nt, Human
aaagcauggcaugaagaacaug

SEQ ID NO: 213967 - RNA, 22 nt, Human
guuagggagucagguggcucuu

SEQ ID NO: 213968 - RNA, 22 nt, Human
cacgggcagugagcacagccug

SEQ ID NO: 213969 - RNA, 22 nt, Human
cucagagcccaggguacacccg

SEQ ID NO: 213970 - RNA, 22 nt, Human
cucuggcuucuaccuugcaguu

SEQ ID NO: 213971 - RNA, 22 nt, Human
gaagcuggggugcugagggcaa

SEQ ID NO: 213972 - RNA, 22 nt, Human
cacaugcauaccuauguguaua

SEQ ID NO: 213973 - RNA, 22 nt, Human
uggauugauaagagacaaguga

SEQ ID NO: 213974 - RNA, 22 nt, Human
uuccuggcauagagagggcaca

SEQ ID NO: 213975 - RNA, 18 nt, Human
augagaggugucagaaga

SEQ ID NO: 213976 - RNA, 22 nt, Human
cggcuucugcccauucaguccu

SEQ ID NO: 213977 - RNA, 22 nt, Human
gaaaggccacgugccaagauua

SEQ ID NO: 213978 - RNA, 22 nt, Human
cugugugugucugcagcauacu

SEQ ID NO: 213979 - RNA, 22 nt, Human
gccacagcggggccgcuagagc

SEQ ID NO: 213980 - RNA, 19 nt, Human
gggcacagccuccccccag

SEQ ID NO: 213981 - RNA, 22 nt, Human
auacacuugaccuggagugaag

SEQ ID NO: 213982 - RNA, 22 nt, Human
auuuauuggaugcuuacuuggg

SEQ ID NO: 213983 - RNA, 22 nt, Human
auuagauauuugcuguuggauu

SEQ ID NO: 213984 - RNA, 22 nt, Human
uagaaaccucagggaaaucuuu

SEQ ID NO: 213985 - RNA, 20 nt, Human
cuguggcaucugucauggug

SEQ ID NO: 213986 - RNA, 22 nt, Human
augggaggaagagaagaugucu

SEQ ID NO: 213987 - RNA, 22 nt, Human
acaguggagcucagaugaaaau

SEQ ID NO: 213988 - RNA, 22 nt, Human
uaccauuauucacaugaucuuu

SEQ ID NO: 213989 - RNA, 22 nt, Human
gaugcuggccuggccaucuggg

SEQ ID NO: 213990 - RNA, 22 nt, Human
uacauuuacagagccuucucug

SEQ ID NO: 213991 - RNA, 22 nt, Human
uuagaaacaaaauaguuauuug

SEQ ID NO: 213992 - RNA, 22 nt, Human
cucaggcugugccaccugugug

SEQ ID NO: 213993 - RNA, 22 nt, Human
ccagccacagcuuccagcuccu

SEQ ID NO: 213994 - RNA, 22 nt, Human
guugcacaguuccucaagcagg

SEQ ID NO: 213995 - RNA, 23 nt, Human
acacuuucaaauaugcacagagc

SEQ ID NO: 213996 - RNA, 22 nt, Human
aggcuuuaaguggccuacagcu

SEQ ID NO: 213997 - RNA, 22 nt, Human
auucucaaagccagagucaacg

SEQ ID NO: 213998 - RNA, 22 nt, Human
agcuucuuguagaacucaaaag

SEQ ID NO: 213999 - RNA, 22 nt, Human
uccuggcuuagguuuccagaac

SEQ ID NO: 214000 - RNA, 22 nt, Human
caaaggcugccacuguggcugu

SEQ ID NO: 214001 - RNA, 22 nt, Human
gggccaaggggagcuggaaggg

SEQ ID NO: 214002 - RNA, 22 nt, Human
uauugcauacuuaaauuuccgg

SEQ ID NO: 214003 - RNA, 22 nt, Human
auucucugugcagauuuaagac

SEQ ID NO: 214004 - RNA, 22 nt, Human
ucccuucacagaugcgauguuu

SEQ ID NO: 214005 - RNA, 22 nt, Human
gagcccugcgugucugggggca

SEQ ID NO: 214006 - RNA, 22 nt, Human
cagccacucggccauaaaggcu

SEQ ID NO: 214007 - RNA, 19 nt, Human
acccucugccacaagccuc

SEQ ID NO: 214008 - RNA, 22 nt, Human
uagcuuuuaguacuuaauggcu

SEQ ID NO: 214009 - RNA, 19 nt, Human
ugguacaaaccaagagaga

SEQ ID NO: 214010 - RNA, 22 nt, Human
ccaaggcaggggaucaaaguuu

SEQ ID NO: 214011 - RNA, 19 nt, Human
uagcccagagccuggcuac

SEQ ID NO: 214012 - RNA, 22 nt, Human
ccaucccuccuccaccagcuag

SEQ ID NO: 214013 - RNA, 22 nt, Human
cuguccuguggaccugaggacg

SEQ ID NO: 214014 - RNA, 22 nt, Human
gaaugaauucagcacauggaau

SEQ ID NO: 214015 - RNA, 19 nt, Human
gggagcugaggucuuuggu

SEQ ID NO: 214016 - RNA, 22 nt, Human
aggccauguggccccagagucu

SEQ ID NO: 214017 - RNA, 20 nt, Human
agccagccacuuccugcucc

SEQ ID NO: 214018 - RNA, 22 nt, Human
gguggcaggcuggcauuggcaa

SEQ ID NO: 214019 - RNA, 22 nt, Human
uggccugacuguccagccaggg

SEQ ID NO: 214020 - RNA, 22 nt, Human
aggcugagucaaguuaggguga

SEQ ID NO: 214021 - RNA, 22 nt, Human
uccaggccugccugguguuugc

SEQ ID NO: 214022 - RNA, 22 nt, Human
gauguacuuuaaaauacuucag

SEQ ID NO: 214023 - RNA, 22 nt, Human
ggcagggguucauuuugucuua

SEQ ID NO: 214024 - RNA, 22 nt, Human
cauggcagcaauuuuccugacu

SEQ ID NO: 214025 - RNA, 22 nt, Human
ucaguggauugacaugaaaaag

SEQ ID NO: 214026 - RNA, 22 nt, Human
acuuggcugggagaguugaaga

SEQ ID NO: 214027 - RNA, 22 nt, Human
agguggcagcaggagaugugga

SEQ ID NO: 214028 - RNA, 22 nt, Human
gcauccagucuuggcuccugga

SEQ ID NO: 214029 - RNA, 22 nt, Human
uccugaugauauugcucuuucu

SEQ ID NO: 214030 - RNA, 22 nt, Human
uugaccacugaaugguucugaa

SEQ ID NO: 214031 - RNA, 22 nt, Human
caggacagcugggccaccacca

SEQ ID NO: 214032 - RNA, 20 nt, Human
ugugccuggcuuuguccuga

SEQ ID NO: 214033 - RNA, 22 nt, Human
uuuccuuccuaaggugaagcaa

SEQ ID NO: 214034 - RNA, 22 nt, Human
aggcugaggcaagaggaucacu

SEQ ID NO: 214035 - RNA, 22 nt, Human
aggcuccugagaggcagaggcu

SEQ ID NO: 214036 - RNA, 22 nt, Human
cugcagaguggagccucggcug

SEQ ID NO: 214037 - RNA, 22 nt, Human
aggccaaauguguauaaaacau

SEQ ID NO: 214038 - RNA, 21 nt, Human
gcucagcaaaggugaggugca

SEQ ID NO: 214039 - RNA, 22 nt, Human
ccacaucuaucuuuaguaugaa

SEQ ID NO: 214040 - RNA, 22 nt, Human
augcaucuguaguguuauauga

SEQ ID NO: 214041 - RNA, 22 nt, Human
aagggcuccacuugaaucacac

SEQ ID NO: 214042 - RNA, 22 nt, Human
aaauggaagcuauuuaugauuc

SEQ ID NO: 214043 - RNA, 22 nt, Human
agcuguguuuccagaugguagc

SEQ ID NO: 214044 - RNA, 21 nt, Human
acuuggccaggcccccaccug

SEQ ID NO: 214045 - RNA, 21 nt, Human
ccuguggauuuuaaaauugga

SEQ ID NO: 214046 - RNA, 22 nt, Human
ucuuucugguuauguauagaga

SEQ ID NO: 214047 - RNA, 22 nt, Human
guggaacauguccauauacauu

SEQ ID NO: 214048 - RNA, 22 nt, Human
aguggcaguggcugggcagagc

SEQ ID NO: 214049 - RNA, 22 nt, Human
agaaggcagguuuuaaaauguc

SEQ ID NO: 214050 - RNA, 22 nt, Human
caggcuggaguacaauugugug

SEQ ID NO: 214051 - RNA, 22 nt, Human
gucuagagugcuuccuagucau

SEQ ID NO: 214052 - RNA, 22 nt, Human
uaugugaagagauuaaaaaaua

SEQ ID NO: 214053 - RNA, 22 nt, Human
uucucaggccuuugggauggga

SEQ ID NO: 214054 - RNA, 22 nt, Human
aacaauaggaccuuuauguucu

SEQ ID NO: 214055 - RNA, 22 nt, Human
uaguacaacucacuugauuuua

SEQ ID NO: 214056 - RNA, 22 nt, Human
uggcagcugaggggaggcuuug

SEQ ID NO: 214057 - RNA, 22 nt, Human
aagaaucauccugcaagagucu

SEQ ID NO: 214058 - RNA, 22 nt, Human
cuguggcuuuuccggggagccu

SEQ ID NO: 214059 - RNA, 23 nt, Human
ucuaaaauucaucauuuacguuc

SEQ ID NO: 214060 - RNA, 22 nt, Human
augcugaauugaugcgagggag

SEQ ID NO: 214061 - RNA, 22 nt, Human
aaggcuuuuguuccuauuuagu

SEQ ID NO: 214062 - RNA, 22 nt, Human
cuuuucaugagucuguuauggg

SEQ ID NO: 214063 - RNA, 22 nt, Human
gauguguccuaguacggguggg

SEQ ID NO: 214064 - RNA, 22 nt, Human
aaguuacaguuaggggugauga

SEQ ID NO: 214065 - RNA, 22 nt, Human
guucucugcgcucccggcccgg

SEQ ID NO: 214066 - RNA, 22 nt, Human
uauuucuguaugcauaaaagga

SEQ ID NO: 214067 - RNA, 22 nt, Human
caggagaggaggcuacuucuua

SEQ ID NO: 214068 - RNA, 22 nt, Human
uuuaugucccuucaaauguuua

SEQ ID NO: 214069 - RNA, 22 nt, Human
cagacucugaugcagccuugug

SEQ ID NO: 214070 - RNA, 22 nt, Human
gccgaggcucugcccagcugcu

SEQ ID NO: 214071 - RNA, 17 nt, Human
agccugccccaugcugc

SEQ ID NO: 214072 - RNA, 22 nt, Human
agaagucagccacagugggaga

SEQ ID NO: 214073 - RNA, 16 nt, Human
gacaaguggaggggcc

SEQ ID NO: 214074 - RNA, 21 nt, Human
guagggacagagaguugguga

SEQ ID NO: 214075 - RNA, 22 nt, Human
ccaggcugccgaggaaagaaag

SEQ ID NO: 214076 - RNA, 20 nt, Human
uuucaagucagcaauucuca

SEQ ID NO: 214077 - RNA, 23 nt, Human
aucuaaaguguuaaauagcuggg

SEQ ID NO: 214078 - RNA, 22 nt, Human
uggcccagcaguucugccccag

SEQ ID NO: 214079 - RNA, 22 nt, Human
auuccuugcacaucagauaguu

SEQ ID NO: 214080 - RNA, 22 nt, Human
cugagguaccuggagcaggucc

SEQ ID NO: 214081 - RNA, 22 nt, Human
ucaggaagcuacugccagcagc

SEQ ID NO: 214082 - RNA, 22 nt, Human
cccaggaacagggcucagaccc

SEQ ID NO: 214083 - RNA, 22 nt, Human
cugcagugaaaucaggaagcaa

SEQ ID NO: 214084 - RNA, 22 nt, Human
auuucuauaggaggacaguauu

SEQ ID NO: 214085 - RNA, 22 nt, Human
uggcucagcauucacuggucuu

SEQ ID NO: 214086 - RNA, 22 nt, Human
aacuuucuguuacguccccaga

SEQ ID NO: 214087 - RNA, 22 nt, Human
ugccaaauuagaguucccaggc

SEQ ID NO: 214088 - RNA, 22 nt, Human
aguuauaugugaaaacacguau

SEQ ID NO: 214089 - RNA, 22 nt, Human
uuggagaguuaauugacaguua

SEQ ID NO: 214090 - RNA, 22 nt, Human
ccucccagaugugcccaaugga

SEQ ID NO: 214091 - RNA, 22 nt, Human
uuggccuugucuggucuucucc

SEQ ID NO: 214092 - RNA, 22 nt, Human
ggcccagccggcgagucucgcg

SEQ ID NO: 214093 - RNA, 22 nt, Human
ucuagggaggcaauagcaaugu

SEQ ID NO: 214094 - RNA, 22 nt, Human
ccagcccuugaggucuguccau

SEQ ID NO: 214095 - RNA, 22 nt, Human
gcuggcuggcgggugcguccuc

SEQ ID NO: 214096 - RNA, 22 nt, Human
acagagcacugcccugugccgc

SEQ ID NO: 214097 - RNA, 22 nt, Human
cuccugugggucaccaauaggc

SEQ ID NO: 214098 - RNA, 22 nt, Human
ucaacaaauacuuaaagcagag

SEQ ID NO: 214099 - RNA, 22 nt, Human
uucugucaaauuugccauaugg

SEQ ID NO: 214100 - RNA, 22 nt, Human
cugacaagguugaauuguccca

SEQ ID NO: 214101 - RNA, 20 nt, Human
caauagaauguggagauaag

SEQ ID NO: 214102 - RNA, 22 nt, Human
ccucucaguauugaacuuuaua

SEQ ID NO: 214103 - RNA, 22 nt, Human
gaaacugaauauaagaaaggua

SEQ ID NO: 214104 - RNA, 17 nt, Human
cagggcugucugccuag

SEQ ID NO: 214105 - RNA, 22 nt, Human
auguggcacagcacaguaagag

SEQ ID NO: 214106 - RNA, 22 nt, Human
ggugagaggcagaggacagcuu

SEQ ID NO: 214107 - RNA, 22 nt, Human
caggaagcugccggugagcgag

SEQ ID NO: 214108 - RNA, 22 nt, Human
ccugugucagccccugccucca

SEQ ID NO: 214109 - RNA, 22 nt, Human
ccucaguuuucucaucuguaaa

SEQ ID NO: 214110 - RNA, 22 nt, Human
ucugaauuaaucaugccucuuu

SEQ ID NO: 214111 - RNA, 22 nt, Human
aaaggccauuacuugcuuuuag

SEQ ID NO: 214112 - RNA, 22 nt, Human
cagcacagugaccagacccacu

SEQ ID NO: 214113 - RNA, 22 nt, Human
ggcugaucaggugcaaaugcau

SEQ ID NO: 214114 - RNA, 22 nt, Human
ccucuguaguaagagaacauau

SEQ ID NO: 214115 - RNA, 22 nt, Human
uuccuggcuugucacaucuacg

SEQ ID NO: 214116 - RNA, 22 nt, Human
accaggaggccuggagcacaaa

SEQ ID NO: 214117 - RNA, 22 nt, Human
aggcucugcagaccccagcugu

SEQ ID NO: 214118 - RNA, 22 nt, Human
uagaaacauauaggauggcagg

SEQ ID NO: 214119 - RNA, 22 nt, Human
uggggcuggggaucuugagccu

SEQ ID NO: 214120 - RNA, 22 nt, Human
cagaagcugcagugaucuggga

SEQ ID NO: 214121 - RNA, 22 nt, Human
acaacauuauacauagaaagcu

SEQ ID NO: 214122 - RNA, 22 nt, Human
gaaaugcauggaucuuggcaga

SEQ ID NO: 214123 - RNA, 22 nt, Human
ucugggagccugaaagugaaug

SEQ ID NO: 214124 - RNA, 22 nt, Human
cuagagaaaaugauagcaggaa

SEQ ID NO: 214125 - RNA, 22 nt, Human
ucugggaacauuuugagggcaa

SEQ ID NO: 214126 - RNA, 19 nt, Human
agcagcagcuaccacuugu

SEQ ID NO: 214127 - RNA, 22 nt, Human
agcuccagcccuaguacagcug

SEQ ID NO: 214128 - RNA, 22 nt, Human
aguuucaauucuuuucacaaag

SEQ ID NO: 214129 - RNA, 20 nt, Human
cuguagagcacaaguggagg

SEQ ID NO: 214130 - RNA, 22 nt, Human
acuuuacaauauccugugacuu

SEQ ID NO: 214131 - RNA, 18 nt, Human
uacaucuauauaguguuu

SEQ ID NO: 214132 - RNA, 22 nt, Human
agggcuggcuaggugcguuccc

SEQ ID NO: 214133 - RNA, 18 nt, Human
ggagaagaacagaugugg

SEQ ID NO: 214134 - RNA, 22 nt, Human
ucuuugguauucacuugugaag

SEQ ID NO: 214135 - RNA, 15 nt, Human
uguggcuggcuccug

SEQ ID NO: 214136 - RNA, 22 nt, Human
acccaggcuggagugcaguagc

SEQ ID NO: 214137 - RNA, 22 nt, Human
uucuuggaaacugauuccuugu

SEQ ID NO: 214138 - RNA, 22 nt, Human
uucucuuagcacuuuguguuac

SEQ ID NO: 214139 - RNA, 22 nt, Human
acagaugaugugcacagauaga

SEQ ID NO: 214140 - RNA, 22 nt, Human
ucucugagcgcauuccuccggc

SEQ ID NO: 214141 - RNA, 22 nt, Human
auuuggcaacauuaauugaauc

SEQ ID NO: 214142 - RNA, 22 nt, Human
ugcuggcuggaucagagauugg

SEQ ID NO: 214143 - RNA, 22 nt, Human
guuauauugccaaguauauugu

SEQ ID NO: 214144 - RNA, 22 nt, Human
ucaucugagguuugaggcaguu

SEQ ID NO: 214145 - RNA, 22 nt, Human
agaugaguacagagcuguacuc

SEQ ID NO: 214146 - RNA, 22 nt, Human
cagagcaccagugggagacaag

SEQ ID NO: 214147 - RNA, 22 nt, Human
ugagcccauguagcacuuccau

SEQ ID NO: 214148 - RNA, 22 nt, Human
cagaaguugauccugcguuucc

SEQ ID NO: 214149 - RNA, 22 nt, Human
ggcagugaacagaaaugcagaa

SEQ ID NO: 214150 - RNA, 23 nt, Human
auuuacagcugugugagcaaguu

SEQ ID NO: 214151 - RNA, 22 nt, Human
gcacagaaguaaaauacaaguc

SEQ ID NO: 214152 - RNA, 22 nt, Human
caugcaaacacguaaacauuca

SEQ ID NO: 214153 - RNA, 22 nt, Human
acagggagugcaauucauauug

SEQ ID NO: 214154 - RNA, 22 nt, Human
cuggcuguguccacagaguaag

SEQ ID NO: 214155 - RNA, 22 nt, Human
uuuuuauaugaaggauagugcg

SEQ ID NO: 214156 - RNA, 22 nt, Human
gggaacuucagaaagucgcugc

SEQ ID NO: 214157 - RNA, 22 nt, Human
ucacaggcuugugaacauugca

SEQ ID NO: 214158 - RNA, 22 nt, Human
gccugcuggaggagccucaggg

SEQ ID NO: 214159 - RNA, 22 nt, Human
uuacaguaauguauuauuuaac

SEQ ID NO: 214160 - RNA, 22 nt, Human
gcaggucuagaagcugccucug

SEQ ID NO: 214161 - RNA, 22 nt, Human
ugccugugggugccaccacccu

SEQ ID NO: 214162 - RNA, 22 nt, Human
caggagcuuucuucccaaacuu

SEQ ID NO: 214163 - RNA, 22 nt, Human
caggcagcugacugucagauau

SEQ ID NO: 214164 - RNA, 22 nt, Human
ccugggaacagcagaguccugg

SEQ ID NO: 214165 - RNA, 22 nt, Human
agcugugcacacugugaaguag

SEQ ID NO: 214166 - RNA, 22 nt, Human
aggccagguggucaugcuugcu

SEQ ID NO: 214167 - RNA, 22 nt, Human
ucugccuuguugcaggcgcuau

SEQ ID NO: 214168 - RNA, 22 nt, Human
uuuuagaagugccuauccuaug

SEQ ID NO: 214169 - RNA, 22 nt, Human
ucauagaugugcugugcacaaa

SEQ ID NO: 214170 - RNA, 22 nt, Human
agugugagaacggacuaauaaa

SEQ ID NO: 214171 - RNA, 22 nt, Human
uuucuuaugggguaguccuuua

SEQ ID NO: 214172 - RNA, 22 nt, Human
auugggaugccggcugauaaga

SEQ ID NO: 214173 - RNA, 22 nt, Human
accuccccauuaggucacccac

SEQ ID NO: 214174 - RNA, 22 nt, Human
aucauaaagugcuaucugauug

SEQ ID NO: 214175 - RNA, 22 nt, Human
uaggugucuguccugggcugug

SEQ ID NO: 214176 - RNA, 22 nt, Human
cagcacuuggugccauugagug

SEQ ID NO: 214177 - RNA, 22 nt, Human
aaauuccagaaacucaguauau

SEQ ID NO: 214178 - RNA, 22 nt, Human
ucccagugggugacuggaggcu

SEQ ID NO: 214179 - RNA, 22 nt, Human
uugaaauauggauugaccuuga

SEQ ID NO: 214180 - RNA, 22 nt, Human
agaaguuuguuauguaaacaaa

SEQ ID NO: 214181 - RNA, 22 nt, Human
gcccccacaggcgggcucgggu

SEQ ID NO: 214182 - RNA, 22 nt, Human
ugcaugaacggaggguaagcug

SEQ ID NO: 214183 - RNA, 22 nt, Human
acacaaacagucuauagcacca

SEQ ID NO: 214184 - RNA, 22 nt, Human
acaguguggaaagucaacuuga

SEQ ID NO: 214185 - RNA, 23 nt, Human
ggagccuccggugugugagaggc

SEQ ID NO: 214186 - RNA, 22 nt, Human
uuugcaaaguccauugaaguua

SEQ ID NO: 214187 - RNA, 22 nt, Human
gaggaagcugcguggcauuuca

SEQ ID NO: 214188 - RNA, 22 nt, Human
caucaucugugcuggagagccu

SEQ ID NO: 214189 - RNA, 22 nt, Human
aagccagaucaaaguguccagg

SEQ ID NO: 214190 - RNA, 22 nt, Human
uuacuguagaagagaaugauuc

SEQ ID NO: 214191 - RNA, 22 nt, Human
cauggcuucuaagugauaacgu

SEQ ID NO: 214192 - RNA, 23 nt, Human
uuauugaggguguagauuggugu

SEQ ID NO: 214193 - RNA, 22 nt, Human
acuucauauggacagcaaacua

SEQ ID NO: 214194 - RNA, 22 nt, Human
uuauacacguuuauggagcuac

SEQ ID NO: 214195 - RNA, 22 nt, Human
uuuagaaugugacuguauuuga

SEQ ID NO: 214196 - RNA, 22 nt, Human
uguguucauuucucucugcugu

SEQ ID NO: 214197 - RNA, 22 nt, Human
agacagguagcaggacagauau

SEQ ID NO: 214198 - RNA, 22 nt, Human
ggggaagaggcgugauggaucc

SEQ ID NO: 214199 - RNA, 22 nt, Human
gugugcagucugcuaggcaggg

SEQ ID NO: 214200 - RNA, 20 nt, Human
cugcuuccaggcucaccccc

SEQ ID NO: 214201 - RNA, 22 nt, Human
ucaguauuccuggaaauacaag

SEQ ID NO: 214202 - RNA, 19 nt, Human
agcauccagucaugggauc

SEQ ID NO: 214203 - RNA, 22 nt, Human
aucuaagauguauugagcacuu

SEQ ID NO: 214204 - RNA, 22 nt, Human
agagaugcugcccgcagacgug

SEQ ID NO: 214205 - RNA, 22 nt, Human
uucuuucugucaugguguacug

SEQ ID NO: 214206 - RNA, 22 nt, Human
gaacuguucccucacaggcugg

SEQ ID NO: 214207 - RNA, 22 nt, Human
aaagcagaggugauaugacuua

SEQ ID NO: 214208 - RNA, 22 nt, Human
uaaaguguuuguaugcagauaa

SEQ ID NO: 214209 - RNA, 22 nt, Human
cucaaguaagaaacagaauugg

SEQ ID NO: 214210 - RNA, 22 nt, Human
cauucucaauaguagaugagua

SEQ ID NO: 214211 - RNA, 22 nt, Human
augcacaucacucugaagaaaa

SEQ ID NO: 214212 - RNA, 22 nt, Human
aggcugagccugggcguggugg

SEQ ID NO: 214213 - RNA, 22 nt, Human
uugcuuuauucacaucuauauu

SEQ ID NO: 214214 - RNA, 22 nt, Human
uuaaauagcucuuguagaagaa

SEQ ID NO: 214215 - RNA, 22 nt, Human
acucugggcuguuaggagcugu

SEQ ID NO: 214216 - RNA, 22 nt, Human
cuugccaaugguacaaacgauu

SEQ ID NO: 214217 - RNA, 22 nt, Human
uguacacaaugugcagguuugu

SEQ ID NO: 214218 - RNA, 22 nt, Human
ugcucagcuggugccagggucc

SEQ ID NO: 214219 - RNA, 22 nt, Human
cuccagcuuuagcucuccaggg

SEQ ID NO: 214220 - RNA, 22 nt, Human
cuucaaguugucugaggguggg

SEQ ID NO: 214221 - RNA, 19 nt, Human
agggaguuuauauuugcac

SEQ ID NO: 214222 - RNA, 22 nt, Human
cagggaugagagauggcacaga

SEQ ID NO: 214223 - RNA, 22 nt, Human
gagaacuucaggauuauucaag

SEQ ID NO: 214224 - RNA, 19 nt, Human
ugauucaucuaacugccuc

SEQ ID NO: 214225 - RNA, 22 nt, Human
uuacauuuuaguuaaccuguga

SEQ ID NO: 214226 - RNA, 22 nt, Human
uggggugccgacagggagggca

SEQ ID NO: 214227 - RNA, 22 nt, Human
ggccaguccccuaauccagggc

SEQ ID NO: 214228 - RNA, 22 nt, Human
gcucucuggguggugggcaaca

SEQ ID NO: 214229 - RNA, 22 nt, Human
ggguaccaagcugcuugggggc

SEQ ID NO: 214230 - RNA, 22 nt, Human
caacagagcaguugaucaggaa

SEQ ID NO: 214231 - RNA, 22 nt, Human
ggauuucuuccuuccucagaag

SEQ ID NO: 214232 - RNA, 22 nt, Human
aaggccaggaaauuaucccuau

SEQ ID NO: 214233 - RNA, 22 nt, Human
uggguagaaacaaggcuggacu

SEQ ID NO: 214234 - RNA, 16 nt, Human
cuguuacuugacuguu

SEQ ID NO: 214235 - RNA, 22 nt, Human
guagggacuuguuuuacuagua

SEQ ID NO: 214236 - RNA, 22 nt, Human
ugagcugauaggcugugagccu

SEQ ID NO: 214237 - RNA, 22 nt, Human
cugaggagucaguuccacucag

SEQ ID NO: 214238 - RNA, 22 nt, Human
aagagcagccuccaggggugga

SEQ ID NO: 214239 - RNA, 22 nt, Human
uggcacagaaaaaugcuccauu

SEQ ID NO: 214240 - RNA, 23 nt, Human
gggggccguccuggggauuauag

SEQ ID NO: 214241 - RNA, 22 nt, Human
caugcugaugaacuucuacuug

SEQ ID NO: 214242 - RNA, 20 nt, Human
ucaaagcacugccugucauc

SEQ ID NO: 214243 - RNA, 21 nt, Human
uggaucugugaucuggggcac

SEQ ID NO: 214244 - RNA, 22 nt, Human
guccagcccuugcagcuucuuu

SEQ ID NO: 214245 - RNA, 22 nt, Human
agucacaugggauuagaaccca

SEQ ID NO: 214246 - RNA, 22 nt, Human
cauuugaucuccugaauaaaca

SEQ ID NO: 214247 - RNA, 19 nt, Human
ucucagaauuggcaaucau

SEQ ID NO: 214248 - RNA, 22 nt, Human
augcaacaccccuauggaugga

SEQ ID NO: 214249 - RNA, 22 nt, Human
cuccaggacugaggacagagcu

SEQ ID NO: 214250 - RNA, 22 nt, Human
uccaaauauacagaaucuccuc

SEQ ID NO: 214251 - RNA, 22 nt, Human
accacugggcgggcagccugcu

SEQ ID NO: 214252 - RNA, 23 nt, Human
cucagcagccugcugcagauaag

SEQ ID NO: 214253 - RNA, 22 nt, Human
uaggggcagaagcggcggucca

SEQ ID NO: 214254 - RNA, 22 nt, Human
uuaaggcauucuccuacuaaua

SEQ ID NO: 214255 - RNA, 22 nt, Human
ucucagagaccugaacucccug

SEQ ID NO: 214256 - RNA, 22 nt, Human
ugauuucccucaucauaacaga

SEQ ID NO: 214257 - RNA, 22 nt, Human
gcuucaggcugaauuccuccua

SEQ ID NO: 214258 - RNA, 22 nt, Human
aagacauuccaaaguggcuaau

SEQ ID NO: 214259 - RNA, 22 nt, Human
cagcaggcguugggagaaagac

SEQ ID NO: 214260 - RNA, 22 nt, Human
ugcucuagcucauaggacucau

SEQ ID NO: 214261 - RNA, 22 nt, Human
gauucugaucuauaguguuaua

SEQ ID NO: 214262 - RNA, 22 nt, Human
aggugcuggcgccccaggagac

SEQ ID NO: 214263 - RNA, 22 nt, Human
agggccugugaauucucccugc

SEQ ID NO: 214264 - RNA, 22 nt, Human
auacagauguuaaagcaauuuc

SEQ ID NO: 214265 - RNA, 22 nt, Human
ucaggaugguccuuuaugagaa

SEQ ID NO: 214266 - RNA, 22 nt, Human
agaggccuuucuguugagugaa

SEQ ID NO: 214267 - RNA, 22 nt, Human
ugaggcucagaagugccaagug

SEQ ID NO: 214268 - RNA, 22 nt, Human
cagagcugguguuacaagucca

SEQ ID NO: 214269 - RNA, 23 nt, Human
agcuccagaacauagcacaggaa

SEQ ID NO: 214270 - RNA, 22 nt, Human
cugccugugccaaugcuccuuu

SEQ ID NO: 214271 - RNA, 22 nt, Human
gugcaggcaaaagggccaggcc

SEQ ID NO: 214272 - RNA, 22 nt, Human
aaugucaaagugcuuugcaaac

SEQ ID NO: 214273 - RNA, 22 nt, Human
uaguacaguggcauucaaacuu

SEQ ID NO: 214274 - RNA, 22 nt, Human
cucuggaaaaccacuagcagga

SEQ ID NO: 214275 - RNA, 21 nt, Human
cagagcucuuucugcuugcug

SEQ ID NO: 214276 - RNA, 22 nt, Human
guauaaaggcacagguuuucug

SEQ ID NO: 214277 - RNA, 22 nt, Human
ugccugggccuucccaccucug

SEQ ID NO: 214278 - RNA, 22 nt, Human
agugacuggugugaaguuaaau

SEQ ID NO: 214279 - RNA, 22 nt, Human
ggagcccuugcugaccuuccaa

SEQ ID NO: 214280 - RNA, 22 nt, Human
cauuguuucuggagggaucugu

SEQ ID NO: 214281 - RNA, 22 nt, Human
ccuucucuaccaugugaggaaa

SEQ ID NO: 214282 - RNA, 22 nt, Human
aagauucagccaaauuguucau

SEQ ID NO: 214283 - RNA, 22 nt, Human
cuuucaaagaccuuggcauggg

SEQ ID NO: 214284 - RNA, 22 nt, Human
ucacaugucagucuuaaacaga

SEQ ID NO: 214285 - RNA, 22 nt, Human
agaugcagaguugcuuaagcau

SEQ ID NO: 214286 - RNA, 22 nt, Human
cuauuuuaacuugauuaccucu

SEQ ID NO: 214287 - RNA, 22 nt, Human
ucuuugucugaacagggacauu

SEQ ID NO: 214288 - RNA, 22 nt, Human
uuggaacauccaggacagauau

SEQ ID NO: 214289 - RNA, 22 nt, Human
aggaagccaugguggacgucua

SEQ ID NO: 214290 - RNA, 22 nt, Human
uacaaugagcuguacaucucca

SEQ ID NO: 214291 - RNA, 20 nt, Human
cugcugcccugucagccucu

SEQ ID NO: 214292 - RNA, 23 nt, Human
ucaucuguaaguaucuguggagu

SEQ ID NO: 214293 - RNA, 22 nt, Human
cuucauuucaggcugaagaaua

SEQ ID NO: 214294 - RNA, 22 nt, Human
acuguucauauucuuagaaauu

SEQ ID NO: 214295 - RNA, 22 nt, Human
acacuaaugagaaaggaauuaa

SEQ ID NO: 214296 - RNA, 22 nt, Human
acauguuuacauuaggugauau

SEQ ID NO: 214297 - RNA, 22 nt, Human
auuagcaauugcccugugcaau

SEQ ID NO: 214298 - RNA, 22 nt, Human
guacaacaggauugauguacca

SEQ ID NO: 214299 - RNA, 22 nt, Human
cuuuuuguuguauaagcccuuu

SEQ ID NO: 214300 - RNA, 22 nt, Human
cagggcagccaggccccguggg

SEQ ID NO: 214301 - RNA, 22 nt, Human
auacacauguuauuguggaagc

SEQ ID NO: 214302 - RNA, 22 nt, Human
cccagagcugagucugauauau

SEQ ID NO: 214303 - RNA, 22 nt, Human
ucuucucucauguaggagggaa

SEQ ID NO: 214304 - RNA, 22 nt, Human
uccaggccccacugaagccccu

SEQ ID NO: 214305 - RNA, 22 nt, Human
ccaggggcucucagggugugug

SEQ ID NO: 214306 - RNA, 22 nt, Human
uuucuuuaauucucacagcaau

SEQ ID NO: 214307 - RNA, 22 nt, Human
cugguuuacccaagauuugcug

SEQ ID NO: 214308 - RNA, 22 nt, Human
uaaaagacauauaacuguagga

SEQ ID NO: 214309 - RNA, 22 nt, Human
gauggaagaaaaaugcaugucu

SEQ ID NO: 214310 - RNA, 22 nt, Human
gaacccaggcuuuugaggcugu

SEQ ID NO: 214311 - RNA, 22 nt, Human
ggagccugcgggagcucccauu

SEQ ID NO: 214312 - RNA, 22 nt, Human
ucugcagggucccagccucagc

SEQ ID NO: 214313 - RNA, 22 nt, Human
aaagacauauuucuaaguuuau

SEQ ID NO: 214314 - RNA, 22 nt, Human
aggcaccuugcgguccagugaa

SEQ ID NO: 214315 - RNA, 22 nt, Human
uguccaggugugucuaaagaga

SEQ ID NO: 214316 - RNA, 22 nt, Human
acuuuacaaacuccucacuguu

SEQ ID NO: 214317 - RNA, 19 nt, Human
aaugcauggaaguuggaga

SEQ ID NO: 214318 - RNA, 22 nt, Human
ugguggagccuaggcuaagucu

SEQ ID NO: 214319 - RNA, 22 nt, Human
gugaccagccagugcugucugu

SEQ ID NO: 214320 - RNA, 22 nt, Human
gcuuuggaaggggcugguggag

SEQ ID NO: 214321 - RNA, 22 nt, Human
auguguccaaggccacaauagc

SEQ ID NO: 214322 - RNA, 22 nt, Human
gcugagggcauguguggcgacu

SEQ ID NO: 214323 - RNA, 22 nt, Human
guccacagagggcugggcaggc

SEQ ID NO: 214324 - RNA, 20 nt, Human
aacuuguucuaccuguuuca

SEQ ID NO: 214325 - RNA, 22 nt, Human
uaacuuugauaagaaucaggga

SEQ ID NO: 214326 - RNA, 22 nt, Human
ugccuggguccaggccaagccu

SEQ ID NO: 214327 - RNA, 22 nt, Human
ggucucagcuggaguccuuggu

SEQ ID NO: 214328 - RNA, 22 nt, Human
gagaguccuuaguuugcaggua

SEQ ID NO: 214329 - RNA, 22 nt, Human
ugggcucagggaagcuuggccu

SEQ ID NO: 214330 - RNA, 23 nt, Human
uccuccaaucucauggcccuuaa

SEQ ID NO: 214331 - RNA, 22 nt, Human
cugggguggagauuggcaaucu

SEQ ID NO: 214332 - RNA, 22 nt, Human
ggguccagggccaguggcugag

SEQ ID NO: 214333 - RNA, 22 nt, Human
aauguacaaaccuucuuuguag

SEQ ID NO: 214334 - RNA, 22 nt, Human
uggcugccgacuggcucuuggc

SEQ ID NO: 214335 - RNA, 22 nt, Human
ugaggcucaagaaucugcauuu

SEQ ID NO: 214336 - RNA, 22 nt, Human
ugaaaggugacauuucuuggau

SEQ ID NO: 214337 - RNA, 22 nt, Human
ccuggcucaggcacgcauggcu

SEQ ID NO: 214338 - RNA, 22 nt, Human
aagucuuacagacaagcugaag

SEQ ID NO: 214339 - RNA, 22 nt, Human
gaagacaccuacugucauuucu

SEQ ID NO: 214340 - RNA, 23 nt, Human
uuguuucuuuguauugucucuau

SEQ ID NO: 214341 - RNA, 22 nt, Human
ugaugaauaaacuugagaguca

SEQ ID NO: 214342 - RNA, 22 nt, Human
caagauuuggcaacuuugucau

SEQ ID NO: 214343 - RNA, 22 nt, Human
ucuuuuauuaggcugaaauggg

SEQ ID NO: 214344 - RNA, 22 nt, Human
gcagcuuuaaucugaauaagua

SEQ ID NO: 214345 - RNA, 22 nt, Human
agggugcaaaagcaaggacagu

SEQ ID NO: 214346 - RNA, 21 nt, Human
acaugucucuaaucucaguga

SEQ ID NO: 214347 - RNA, 22 nt, Human
cacagguagaugccaugcagca

SEQ ID NO: 214348 - RNA, 22 nt, Human
aaguuuuccuguguccaagaug

SEQ ID NO: 214349 - RNA, 22 nt, Human
ggaaucagaugaggggcagagc

SEQ ID NO: 214350 - RNA, 22 nt, Human
uuguacaaguauuaugugaaca

SEQ ID NO: 214351 - RNA, 22 nt, Human
gcacagccagcaucugagggau

SEQ ID NO: 214352 - RNA, 22 nt, Human
aguauaauuagauaucaaaagu

SEQ ID NO: 214353 - RNA, 22 nt, Human
agauguggaaagaaguuagaag

SEQ ID NO: 214354 - RNA, 22 nt, Human
agagcccaucaguggcagugga

SEQ ID NO: 214355 - RNA, 22 nt, Human
ucucaggacuuugggaagcuca

SEQ ID NO: 214356 - RNA, 22 nt, Human
aaagugguuuuucagacuuuga

SEQ ID NO: 214357 - RNA, 22 nt, Human
cuuuacagcuuagugguaugga

SEQ ID NO: 214358 - RNA, 22 nt, Human
ucugcccuaauucagugcuuag

SEQ ID NO: 214359 - RNA, 22 nt, Human
caggaagcugagcugcacugca

SEQ ID NO: 214360 - RNA, 22 nt, Human
caucaaagggccuguggugcag

SEQ ID NO: 214361 - RNA, 22 nt, Human
ggucuccaaagcugcauugaug

SEQ ID NO: 214362 - RNA, 22 nt, Human
aucagagacaaaaccagcacuu

SEQ ID NO: 214363 - RNA, 22 nt, Human
ucugggauuuuauagacaugcu

SEQ ID NO: 214364 - RNA, 16 nt, Human
uccaggcauaucugag

SEQ ID NO: 214365 - RNA, 22 nt, Human
ccagcuggagccaagguggacu

SEQ ID NO: 214366 - RNA, 23 nt, Human
gaauacaaagcagaugguccagc

SEQ ID NO: 214367 - RNA, 22 nt, Human
aaacugccaaaagaccuuggau

SEQ ID NO: 214368 - RNA, 22 nt, Human
gcuacagacugagcauggcucu

SEQ ID NO: 214369 - RNA, 21 nt, Human
uaggagcugauggggaaguag

SEQ ID NO: 214370 - RNA, 22 nt, Human
uaggcagauguuaacaggaaaa

SEQ ID NO: 214371 - RNA, 22 nt, Human
aggccaggcgagacacccggcu

SEQ ID NO: 214372 - RNA, 22 nt, Human
uuuggcuagccaagaaacaaaa

SEQ ID NO: 214373 - RNA, 22 nt, Human
augaggucaucuugaaguaggg

SEQ ID NO: 214374 - RNA, 22 nt, Human
cugauaggauuuaguuucuguu

SEQ ID NO: 214375 - RNA, 22 nt, Human
ccaggcugugcuuuucauaaau

SEQ ID NO: 214376 - RNA, 22 nt, Human
gggugcugggaggcugacaucu

SEQ ID NO: 214377 - RNA, 23 nt, Human
uggagcugggcagcugggaaagu

SEQ ID NO: 214378 - RNA, 22 nt, Human
cagagucucugggaggcugggu

SEQ ID NO: 214379 - RNA, 22 nt, Human
cucugaagaugguaccagcuuu

SEQ ID NO: 214380 - RNA, 19 nt, Human
aggcaugggaagagaaguc

SEQ ID NO: 214381 - RNA, 22 nt, Human
guggcccucagcaguugccaag

SEQ ID NO: 214382 - RNA, 22 nt, Human
cugugccacugcccugccacgc

SEQ ID NO: 214383 - RNA, 22 nt, Human
cccuggugguacggcacuggca

SEQ ID NO: 214384 - RNA, 22 nt, Human
gguguccucacuauagcaaguc

SEQ ID NO: 214385 - RNA, 22 nt, Human
acugggccuggauuggcguguc

SEQ ID NO: 214386 - RNA, 17 nt, Human
ugaguggccgggggaca

SEQ ID NO: 214387 - RNA, 22 nt, Human
acaacaguagccuuuacaaggc

SEQ ID NO: 214388 - RNA, 22 nt, Human
aagcacaggaucuugaggagcg

SEQ ID NO: 214389 - RNA, 22 nt, Human
ucagggaagagagaucuccuag

SEQ ID NO: 214390 - RNA, 22 nt, Human
uuacugcaacauaauguagucu

SEQ ID NO: 214391 - RNA, 22 nt, Human
gcuggcugccugguuaugccuu

SEQ ID NO: 214392 - RNA, 22 nt, Human
ucugccuuucucaagggcaaaa

SEQ ID NO: 214393 - RNA, 22 nt, Human
aaggucuguauuagaguuucau

SEQ ID NO: 214394 - RNA, 22 nt, Human
cagucagaggucuucuaaaaca

SEQ ID NO: 214395 - RNA, 22 nt, Human
gccagugggacccgcugugggc

SEQ ID NO: 214396 - RNA, 22 nt, Human
acugccuggccuggccucacug

SEQ ID NO: 214397 - RNA, 22 nt, Human
aguggugaugacagcaguuucu

SEQ ID NO: 214398 - RNA, 22 nt, Human
aacagcaauagcacuauucauu

SEQ ID NO: 214399 - RNA, 16 nt, Human
acuuccaggggagccc

SEQ ID NO: 214400 - RNA, 22 nt, Human
aaagccauaucuauucuauucu

SEQ ID NO: 214401 - RNA, 22 nt, Human
gaacauuuauauuagauagcua

SEQ ID NO: 214402 - RNA, 22 nt, Human
aaacaguggccaauucuggaga

SEQ ID NO: 214403 - RNA, 22 nt, Human
ucaaggcuauuaauucugugag

SEQ ID NO: 214404 - RNA, 22 nt, Human
gcauccaggcugccccucugcg

SEQ ID NO: 214405 - RNA, 22 nt, Human
ugggcucucacacauguucuga

SEQ ID NO: 214406 - RNA, 22 nt, Human
agccucugcuggcccuggcacu

SEQ ID NO: 214407 - RNA, 22 nt, Human
cugggccugagcucugaagagu

SEQ ID NO: 214408 - RNA, 22 nt, Human
auaaaaguaggaccaacuuaca

SEQ ID NO: 214409 - RNA, 22 nt, Human
uuaaauauuuucagcaggguca

SEQ ID NO: 214410 - RNA, 22 nt, Human
aaguggcagaauaguggcagga

SEQ ID NO: 214411 - RNA, 22 nt, Human
ggcuccuguccuccuggagcuc

SEQ ID NO: 214412 - RNA, 22 nt, Human
aaaugauugucaaaguucuguu

SEQ ID NO: 214413 - RNA, 22 nt, Human
aaaagucugcucucauuucaga

SEQ ID NO: 214414 - RNA, 22 nt, Human
aaagacauggcaagagaugggg

SEQ ID NO: 214415 - RNA, 22 nt, Human
uucucuggcgcgcugugcuaug

SEQ ID NO: 214416 - RNA, 22 nt, Human
gcaggaguggagaccaugggga

SEQ ID NO: 214417 - RNA, 22 nt, Human
gcauucuugagguguggacuca

SEQ ID NO: 214418 - RNA, 22 nt, Human
cuccuggggcacuuagaagcaa

SEQ ID NO: 214419 - RNA, 23 nt, Human
ugugaagguggguccaagggcug

SEQ ID NO: 214420 - RNA, 22 nt, Human
cugagcagauguugcccagaag

SEQ ID NO: 214421 - RNA, 22 nt, Human
acagucaaucagaacagcaugu

SEQ ID NO: 214422 - RNA, 22 nt, Human
acaggccuagcuaaugcuuucc

SEQ ID NO: 214423 - RNA, 22 nt, Human
ugggccaguucuuuacucgucc

SEQ ID NO: 214424 - RNA, 18 nt, Human
cuucagugacagucuggc

SEQ ID NO: 214425 - RNA, 22 nt, Human
guacauuuugagguuaaaacaa

SEQ ID NO: 214426 - RNA, 22 nt, Human
aggccuguuccuuccugggcac

SEQ ID NO: 214427 - RNA, 22 nt, Human
cccagaggugacaucccauucu

SEQ ID NO: 214428 - RNA, 22 nt, Human
uuuauauagagauuugugcaug

SEQ ID NO: 214429 - RNA, 22 nt, Human
uucuuaaagaggcaaaacacag

SEQ ID NO: 214430 - RNA, 22 nt, Human
cucugcccucgcacaucugcca

SEQ ID NO: 214431 - RNA, 22 nt, Human
ugucuuuaaaauuaaacacauc

SEQ ID NO: 214432 - RNA, 22 nt, Human
ucacauuuguucuugaaucuaa

SEQ ID NO: 214433 - RNA, 21 nt, Human
ugacagguauuuaucuggaaa

SEQ ID NO: 214434 - RNA, 22 nt, Human
cugcaggagcaagccugggaga

SEQ ID NO: 214435 - RNA, 19 nt, Human
ucaaaugccaaugucacag

SEQ ID NO: 214436 - RNA, 22 nt, Human
gcuucacagaaucaauaguugg

SEQ ID NO: 214437 - RNA, 22 nt, Human
cauucucuugacaggacagccc

SEQ ID NO: 214438 - RNA, 22 nt, Human
gcucagaggguuuuggccaagu

SEQ ID NO: 214439 - RNA, 22 nt, Human
accaaucuccuauuuuguuuca

SEQ ID NO: 214440 - RNA, 22 nt, Human
agcuggaggauaacucacuucu

SEQ ID NO: 214441 - RNA, 22 nt, Human
aggcugaaaacgagauggcaau

SEQ ID NO: 214442 - RNA, 22 nt, Human
gcugaccauuaggaggacgaua

SEQ ID NO: 214443 - RNA, 19 nt, Human
aagcaagcuuugagugggu

SEQ ID NO: 214444 - RNA, 22 nt, Human
aauuacagucggagcagcacug

SEQ ID NO: 214445 - RNA, 22 nt, Human
uuugacaugcaaagcacuuuag

SEQ ID NO: 214446 - RNA, 22 nt, Human
uaauauauuucugcuaagcuca

SEQ ID NO: 214447 - RNA, 22 nt, Human
ccagcugucacucagaaaggcc

SEQ ID NO: 214448 - RNA, 22 nt, Human
uuuauuauccaguguugucaug

SEQ ID NO: 214449 - RNA, 22 nt, Human
agggccugacacccuugccagc

SEQ ID NO: 214450 - RNA, 22 nt, Human
cuccaggaaagucaggcuuaga

SEQ ID NO: 214451 - RNA, 22 nt, Human
acaguuuguguuggccaugggc

SEQ ID NO: 214452 - RNA, 22 nt, Human
auggccaagaucacagacuuca

SEQ ID NO: 214453 - RNA, 22 nt, Human
agcuggcuucucugcagacauu

SEQ ID NO: 214454 - RNA, 19 nt, Human
aggcaggugcagagguccc

SEQ ID NO: 214455 - RNA, 23 nt, Human
uuccugagugcuggagagagugc

SEQ ID NO: 214456 - RNA, 22 nt, Human
ucugccuuccccauaaucugau

SEQ ID NO: 214457 - RNA, 20 nt, Human
uuggaacaguggaucagcag

SEQ ID NO: 214458 - RNA, 22 nt, Human
gccauugggcuguaguuuuuug

SEQ ID NO: 214459 - RNA, 20 nt, Human
auuguuucauuuaauguaca

SEQ ID NO: 214460 - RNA, 22 nt, Human
agcagggcagugcuucagcucu

SEQ ID NO: 214461 - RNA, 18 nt, Human
ugucauaauauaucaccu

SEQ ID NO: 214462 - RNA, 22 nt, Human
cacaaggacuggauggaguggg

SEQ ID NO: 214463 - RNA, 22 nt, Human
uuauacaguuuauacuuagaau

SEQ ID NO: 214464 - RNA, 23 nt, Human
agucuuacugucccagaacaggg

SEQ ID NO: 214465 - RNA, 22 nt, Human
agggaggauaguagucaguuua

SEQ ID NO: 214466 - RNA, 22 nt, Human
gcguggcuccuaacagaucuga

SEQ ID NO: 214467 - RNA, 22 nt, Human
acccagggcucaagcguaggca

SEQ ID NO: 214468 - RNA, 22 nt, Human
gcucagcuugggagcgcccggu

SEQ ID NO: 214469 - RNA, 22 nt, Human
uucaguuccauuucaggugggu

SEQ ID NO: 214470 - RNA, 22 nt, Human
gcacacaguacuauaugcuaca

SEQ ID NO: 214471 - RNA, 22 nt, Human
gggaucugaguugucaggaagg

SEQ ID NO: 214472 - RNA, 22 nt, Human
ccagugcaccaagaggccuaga

SEQ ID NO: 214473 - RNA, 22 nt, Human
cacuuagauacuagaucacaaa

SEQ ID NO: 214474 - RNA, 22 nt, Human
cuguaaaacugcuuaaguaugc

SEQ ID NO: 214475 - RNA, 22 nt, Human
uacagaaauugccaccagcucu

SEQ ID NO: 214476 - RNA, 22 nt, Human
caguuaaauucuccaguuacca

SEQ ID NO: 214477 - RNA, 22 nt, Human
ggcuauuucauuuaguacuagg

SEQ ID NO: 214478 - RNA, 20 nt, Human
ucugcaccuccuuccaauca

SEQ ID NO: 214479 - RNA, 22 nt, Human
acaguaacucuuuuacccuccu

SEQ ID NO: 214480 - RNA, 19 nt, Human
gagguucacgcgcuggaug

SEQ ID NO: 214481 - RNA, 22 nt, Human
ugugcauguauugauuuguacc

SEQ ID NO: 214482 - RNA, 22 nt, Human
uagauaaauuagaaaguuuacu

SEQ ID NO: 214483 - RNA, 14 nt, Human
agcugcaagcaucc

SEQ ID NO: 214484 - RNA, 22 nt, Human
uucaguguuuguagagauaacu

SEQ ID NO: 214485 - RNA, 22 nt, Human
agaagucaaugaugagagugcu

SEQ ID NO: 214486 - RNA, 22 nt, Human
ccugcugucugcuguguuaagc

SEQ ID NO: 214487 - RNA, 22 nt, Human
gaguaggguuuccagguuagag

SEQ ID NO: 214488 - RNA, 22 nt, Human
cucuguccuaugcuugauagaa

SEQ ID NO: 214489 - RNA, 22 nt, Human
ucuguucauguugggcuuuucc

SEQ ID NO: 214490 - RNA, 22 nt, Human
aguccaggcaaguuguugugua

SEQ ID NO: 214491 - RNA, 22 nt, Human
ucaggaugaccacgagccucua

SEQ ID NO: 214492 - RNA, 22 nt, Human
agggcaguucagccacaggcuc

SEQ ID NO: 214493 - RNA, 22 nt, Human
agcucaggucucaggagguguc

SEQ ID NO: 214494 - RNA, 22 nt, Human
uguagaaagaauauguuucaua

SEQ ID NO: 214495 - RNA, 22 nt, Human
cugugugcuguuagggagcugc

SEQ ID NO: 214496 - RNA, 22 nt, Human
gcagugggaagguuggcacaug

SEQ ID NO: 214497 - RNA, 22 nt, Human
caaugauugcuauuuacauaaa

SEQ ID NO: 214498 - RNA, 19 nt, Human
ugucuggaagagcugcagg

SEQ ID NO: 214499 - RNA, 22 nt, Human
uguuuauagggucugucacuug

SEQ ID NO: 214500 - RNA, 21 nt, Human
uuuagggaggauauuuaacuu

SEQ ID NO: 214501 - RNA, 23 nt, Human
uggcugagguccagguaguuuca

SEQ ID NO: 214502 - RNA, 22 nt, Human
uucagacaguaagaaagagguu

SEQ ID NO: 214503 - RNA, 22 nt, Human
cuagggcaaugacucaaagcgg

SEQ ID NO: 214504 - RNA, 22 nt, Human
uuuaucuguuguacauuuaugc

SEQ ID NO: 214505 - RNA, 22 nt, Human
caggcagcucuaauggaaagug

SEQ ID NO: 214506 - RNA, 22 nt, Human
aggcagccuauggggagcucag

SEQ ID NO: 214507 - RNA, 22 nt, Human
cucagagcacuuuugaaagcuc

SEQ ID NO: 214508 - RNA, 22 nt, Human
aacagcuucaucacauggcaua

SEQ ID NO: 214509 - RNA, 22 nt, Human
augguauacaauuauggacugu

SEQ ID NO: 214510 - RNA, 22 nt, Human
agagccagcaagugaauaguga

SEQ ID NO: 214511 - RNA, 22 nt, Human
aacaggcucacucugacuucua

SEQ ID NO: 214512 - RNA, 22 nt, Human
cauaagaaauuuaacagaacuu

SEQ ID NO: 214513 - RNA, 22 nt, Human
gcccaggcuggagugcaguagc

SEQ ID NO: 214514 - RNA, 22 nt, Human
ccugcccugucacuggcuaggg

SEQ ID NO: 214515 - RNA, 22 nt, Human
ugagccaggcacugcuccugga

SEQ ID NO: 214516 - RNA, 22 nt, Human
augcaacagcugggaauaugua

SEQ ID NO: 214517 - RNA, 22 nt, Human
ccaguccauggauucccaaggu

SEQ ID NO: 214518 - RNA, 20 nt, Human
aggccaggaaauguaguucu

SEQ ID NO: 214519 - RNA, 22 nt, Human
uggcugagagucauccugugug

SEQ ID NO: 214520 - RNA, 22 nt, Human
uauacugaucacugaggucauc

SEQ ID NO: 214521 - RNA, 22 nt, Human
auuguggugucaguuauaggca

SEQ ID NO: 214522 - RNA, 22 nt, Human
auuagcagugccuugccugucu

SEQ ID NO: 214523 - RNA, 22 nt, Human
aaagugcaaggauuacaggcau

SEQ ID NO: 214524 - RNA, 22 nt, Human
gagcaguggugguguguuagag

SEQ ID NO: 214525 - RNA, 22 nt, Human
cugcccuguggcucugagucau

SEQ ID NO: 214526 - RNA, 19 nt, Human
ucccaagauuucuguauca

SEQ ID NO: 214527 - RNA, 22 nt, Human
uggaagaauguuugccuuauaa

SEQ ID NO: 214528 - RNA, 22 nt, Human
cagggagcggagucccaugccu

SEQ ID NO: 214529 - RNA, 22 nt, Human
cacagguguuuguuauacucag

SEQ ID NO: 214530 - RNA, 22 nt, Human
cagcagcaguggcugcagaaca

SEQ ID NO: 214531 - RNA, 22 nt, Human
gcugcuggaacaaaucacccca

SEQ ID NO: 214532 - RNA, 22 nt, Human
gcccaagcuccgccuccugucg

SEQ ID NO: 214533 - RNA, 22 nt, Human
gauucuuuagcccagaaaguua

SEQ ID NO: 214534 - RNA, 19 nt, Human
uuggggugaaugccagaca

SEQ ID NO: 214535 - RNA, 22 nt, Human
uggagcagugguccuggagaug

SEQ ID NO: 214536 - RNA, 19 nt, Human
ugcuggaacaucaguagcu

SEQ ID NO: 214537 - RNA, 22 nt, Human
aguacauacuucaaauguacuu

SEQ ID NO: 214538 - RNA, 22 nt, Human
agggcccucuggcaggccaggc

SEQ ID NO: 214539 - RNA, 22 nt, Human
auguggcugccaccugccugaa

SEQ ID NO: 214540 - RNA, 22 nt, Human
cuuccucucuugcccauaagag

SEQ ID NO: 214541 - RNA, 22 nt, Human
agcuacaguugcccucagcagg

SEQ ID NO: 214542 - RNA, 22 nt, Human
uauuugaaaguguacaaaaacu

SEQ ID NO: 214543 - RNA, 22 nt, Human
cauucccugucucuucaauccu

SEQ ID NO: 214544 - RNA, 22 nt, Human
ugacagggacaguggagaugga

SEQ ID NO: 214545 - RNA, 22 nt, Human
cugaccaacauggugaaaccuu

SEQ ID NO: 214546 - RNA, 22 nt, Human
cugagcacagaaauaagauauu

SEQ ID NO: 214547 - RNA, 21 nt, Human
gugcucugggcagcagagggc

SEQ ID NO: 214548 - RNA, 22 nt, Human
cucccaagcugugcugaacugu

SEQ ID NO: 214549 - RNA, 22 nt, Human
guaacagaaagucaugcucauu

SEQ ID NO: 214550 - RNA, 22 nt, Human
acuucaaacaauuaacagagaa

SEQ ID NO: 214551 - RNA, 22 nt, Human
acaucagagggcucacaugauc

SEQ ID NO: 214552 - RNA, 22 nt, Human
aggcucuuugagacuaccugga

SEQ ID NO: 214553 - RNA, 22 nt, Human
ggcaagauccaaggggcuagga

SEQ ID NO: 214554 - RNA, 22 nt, Human
cucccuggugacucccaaagcu

SEQ ID NO: 214555 - RNA, 22 nt, Human
ucugcuguucucaugcugauuu

SEQ ID NO: 214556 - RNA, 22 nt, Human
auccucagaccucagcaaagcc

SEQ ID NO: 214557 - RNA, 22 nt, Human
ggggaggcugaugugggcaaag

SEQ ID NO: 214558 - RNA, 22 nt, Human
cucccagaaaauucucagacaa

SEQ ID NO: 214559 - RNA, 22 nt, Human
cugggucuccggcagccucggg

SEQ ID NO: 214560 - RNA, 22 nt, Human
cuuccuggaugagcaggcugau

SEQ ID NO: 214561 - RNA, 22 nt, Human
uuuacuucugcauuuccccuag

SEQ ID NO: 214562 - RNA, 22 nt, Human
uagagcuagcuucaaaaugcga

SEQ ID NO: 214563 - RNA, 22 nt, Human
ugguuccaagauggcugccaca

SEQ ID NO: 214564 - RNA, 22 nt, Human
uagguauacagagauuucuggg

SEQ ID NO: 214565 - RNA, 23 nt, Human
aagaacugcgaauggagaaagua

SEQ ID NO: 214566 - RNA, 22 nt, Human
uucaacaaggcugucaaaaguu

SEQ ID NO: 214567 - RNA, 22 nt, Human
cuucugagauguuguuuuacag

SEQ ID NO: 214568 - RNA, 22 nt, Human
acucuggagauggaugucagga

SEQ ID NO: 214569 - RNA, 22 nt, Human
cugcugagaugccaggagcucu

SEQ ID NO: 214570 - RNA, 22 nt, Human
ucacaugucacaaaacacugcc

SEQ ID NO: 214571 - RNA, 22 nt, Human
gacccaggguggucaccugaaa

SEQ ID NO: 214572 - RNA, 22 nt, Human
gccccagccuaguuuucuuuca

SEQ ID NO: 214573 - RNA, 23 nt, Human
ccuggcuggauucucugcauuca

SEQ ID NO: 214574 - RNA, 22 nt, Human
gcccaggaguugguggcugcag

SEQ ID NO: 214575 - RNA, 22 nt, Human
cuguuacuucaaucuucucccg

SEQ ID NO: 214576 - RNA, 22 nt, Human
caggcugaggcaguaggguuug

SEQ ID NO: 214577 - RNA, 22 nt, Human
ugggucuccaguucagggcagg

SEQ ID NO: 214578 - RNA, 20 nt, Human
gagccugggaagucuaaggu

SEQ ID NO: 214579 - RNA, 17 nt, Human
ucuaggagagcagagcu

SEQ ID NO: 214580 - RNA, 22 nt, Human
auguguuuaccaggggaacaug

SEQ ID NO: 214581 - RNA, 22 nt, Human
auccauucuaugugaaaugucc

SEQ ID NO: 214582 - RNA, 22 nt, Human
auuuggaagaaaucugucacag

SEQ ID NO: 214583 - RNA, 22 nt, Human
aacuuucugaaaagcuugauca

SEQ ID NO: 214584 - RNA, 22 nt, Human
cugaaaagugucuguugaguua

SEQ ID NO: 214585 - RNA, 22 nt, Human
caucuuuguuuuggauauaauc

SEQ ID NO: 214586 - RNA, 22 nt, Human
cagagcccauccuauacucucc

SEQ ID NO: 214587 - RNA, 22 nt, Human
ucucagcaaggaaagaggcagg

SEQ ID NO: 214588 - RNA, 23 nt, Human
uugcagggauggaguucaaaaug

SEQ ID NO: 214589 - RNA, 22 nt, Human
ggccacgugaccucuggcuccu

SEQ ID NO: 214590 - RNA, 22 nt, Human
caugucccaaaugcaggcaaag

SEQ ID NO: 214591 - RNA, 22 nt, Human
caugaaaaauuuacuguuaaca

SEQ ID NO: 214592 - RNA, 22 nt, Human
ggggagaauaaaucagauuuua

SEQ ID NO: 214593 - RNA, 22 nt, Human
uacagaaagaccucucgggaaa

SEQ ID NO: 214594 - RNA, 22 nt, Human
cuggcaccaggcaugcugggag

SEQ ID NO: 214595 - RNA, 22 nt, Human
acagaagugucuuuuucauuca

SEQ ID NO: 214596 - RNA, 22 nt, Human
auggccuggccagagcucugcu

SEQ ID NO: 214597 - RNA, 22 nt, Human
ucugaggaauucugcagugaga

SEQ ID NO: 214598 - RNA, 22 nt, Human
acaugaaugcagccauaacacu

SEQ ID NO: 214599 - RNA, 22 nt, Human
augcaaaauuaccauucuguuc

SEQ ID NO: 214600 - RNA, 22 nt, Human
cagcccugaguuagcccacgga

SEQ ID NO: 214601 - RNA, 22 nt, Human
auaaaagucugcuuauuugggc

SEQ ID NO: 214602 - RNA, 22 nt, Human
agauuucaaugugagcauuagu

SEQ ID NO: 214603 - RNA, 22 nt, Human
cagccucucuguaucucaggau

SEQ ID NO: 214604 - RNA, 22 nt, Human
auauacuuccccauuauggggg

SEQ ID NO: 214605 - RNA, 22 nt, Human
uguggcagggauacugaggcag

SEQ ID NO: 214606 - RNA, 22 nt, Human
cccagaggguggagguugcagu

SEQ ID NO: 214607 - RNA, 22 nt, Human
cuauuguuauaauuguugacau

SEQ ID NO: 214608 - RNA, 22 nt, Human
ggagggaaugucuagcauucuu

SEQ ID NO: 214609 - RNA, 22 nt, Human
agcagcuugggucucuccugcu

SEQ ID NO: 214610 - RNA, 22 nt, Human
gggaccuggggacuccuuguuc

SEQ ID NO: 214611 - RNA, 22 nt, Human
ugggcugcugcggugcucuugg

SEQ ID NO: 214612 - RNA, 22 nt, Human
agucuggugguauuuuguagug

SEQ ID NO: 214613 - RNA, 22 nt, Human
ggugggagagcuugcuuugaug

SEQ ID NO: 214614 - RNA, 22 nt, Human
uggguccucuggagcagcagca

SEQ ID NO: 214615 - RNA, 22 nt, Human
cucuguguucagccuagcagaa

SEQ ID NO: 214616 - RNA, 22 nt, Human
gagcugugcuuauaccaauuca

SEQ ID NO: 214617 - RNA, 22 nt, Human
ucagccuggugauuccucuguc

SEQ ID NO: 214618 - RNA, 22 nt, Human
gcuggcuccucuguccucacgg

SEQ ID NO: 214619 - RNA, 22 nt, Human
gcagggcuuagaaaugguggcu

SEQ ID NO: 214620 - RNA, 19 nt, Human
ugcagccacgugagagacu

SEQ ID NO: 214621 - RNA, 21 nt, Human
ccaggaaggacugagcucccu

SEQ ID NO: 214622 - RNA, 22 nt, Human
cuggcuuccaccauggccccug

SEQ ID NO: 214623 - RNA, 22 nt, Human
gaggcagaaguugcagugagca

SEQ ID NO: 214624 - RNA, 22 nt, Human
gcagaggcucuuuaaugcuuag

SEQ ID NO: 214625 - RNA, 22 nt, Human
acagguggaggcuuuaggaggu

SEQ ID NO: 214626 - RNA, 22 nt, Human
cuggucccuguagguauuugac

SEQ ID NO: 214627 - RNA, 22 nt, Human
cugaggcacagugaacuucucc

SEQ ID NO: 214628 - RNA, 22 nt, Human
acaggcagcaaaaucagccuca

SEQ ID NO: 214629 - RNA, 22 nt, Human
ugugcaacaugagacagaacag

SEQ ID NO: 214630 - RNA, 22 nt, Human
guuauugagacauagaguuaug

SEQ ID NO: 214631 - RNA, 22 nt, Human
gaaagaagcuuuagauggcuau

SEQ ID NO: 214632 - RNA, 22 nt, Human
ucacaucuuggauuacaauuuu

SEQ ID NO: 214633 - RNA, 22 nt, Human
ccucgagcagcgaccccuccac

SEQ ID NO: 214634 - RNA, 22 nt, Human
gccucugcucucagguagccuc

SEQ ID NO: 214635 - RNA, 22 nt, Human
ugagauguaagguaugcuuacu

SEQ ID NO: 214636 - RNA, 22 nt, Human
cacuugaaugaaagagacuccu

SEQ ID NO: 214637 - RNA, 22 nt, Human
ccugguugagggagguguggac

SEQ ID NO: 214638 - RNA, 21 nt, Human
caaaaggauaggaaauuaggg

SEQ ID NO: 214639 - RNA, 22 nt, Human
uuauugagcacauaguaugugg

SEQ ID NO: 214640 - RNA, 22 nt, Human
agugugggcccccagguuagcc

SEQ ID NO: 214641 - RNA, 22 nt, Human
cuggagaccucuccugagagug

SEQ ID NO: 214642 - RNA, 22 nt, Human
augauauacuuccuagaacagu

SEQ ID NO: 214643 - RNA, 22 nt, Human
cagggaugaccagagggaugug

SEQ ID NO: 214644 - RNA, 22 nt, Human
aacuugaaaaccucaugaauug

SEQ ID NO: 214645 - RNA, 22 nt, Human
ggcuuuauuucacuguaccaua

SEQ ID NO: 214646 - RNA, 17 nt, Human
aaguccagccugcagcu

SEQ ID NO: 214647 - RNA, 22 nt, Human
aggcuuggaaaauuuacagugu

SEQ ID NO: 214648 - RNA, 22 nt, Human
uucugaauucaugagauuuggg

SEQ ID NO: 214649 - RNA, 22 nt, Human
ccaggagacccagggaaggagc

SEQ ID NO: 214650 - RNA, 22 nt, Human
caguccugugucccuugguggg

SEQ ID NO: 214651 - RNA, 22 nt, Human
gacaucauggagaggacaaaca

SEQ ID NO: 214652 - RNA, 22 nt, Human
aauaucacaggaggagaccaag

SEQ ID NO: 214653 - RNA, 19 nt, Human
gcuugggagagggagcuaa

SEQ ID NO: 214654 - RNA, 22 nt, Human
uguaaucauuacaguacaugga

SEQ ID NO: 214655 - RNA, 22 nt, Human
auggaaagugcauggaagucau

SEQ ID NO: 214656 - RNA, 22 nt, Human
uaccagccuuuuaacaugggcc

SEQ ID NO: 214657 - RNA, 22 nt, Human
uuagugcuaaauacucccacag

SEQ ID NO: 214658 - RNA, 22 nt, Human
aaguaucaaaugguagcauaug

SEQ ID NO: 214659 - RNA, 22 nt, Human
gccacucaugggaggugugcaa

SEQ ID NO: 214660 - RNA, 22 nt, Human
uuggcuuccugcacuugaguuu

SEQ ID NO: 214661 - RNA, 22 nt, Human
ccucaaauugcucagcgucuag

SEQ ID NO: 214662 - RNA, 22 nt, Human
cugugggcgccugucagccuca

SEQ ID NO: 214663 - RNA, 22 nt, Human
cuggaagggucagagugaugag

SEQ ID NO: 214664 - RNA, 22 nt, Human
uuuguuuagagaauugaagcag

SEQ ID NO: 214665 - RNA, 22 nt, Human
acagaauauuguaagugccacu

SEQ ID NO: 214666 - RNA, 22 nt, Human
gggugggguucaggaaucuuca

SEQ ID NO: 214667 - RNA, 22 nt, Human
ccuucugcucccuggccagggc

SEQ ID NO: 214668 - RNA, 22 nt, Human
augcacuacuagaugcaaaagu

SEQ ID NO: 214669 - RNA, 22 nt, Human
aacauuuguuucguuaugugaa

SEQ ID NO: 214670 - RNA, 22 nt, Human
cuccuccagcuuccaguggcuc

SEQ ID NO: 214671 - RNA, 22 nt, Human
ggcagggcagcgcugauuaggg

SEQ ID NO: 214672 - RNA, 22 nt, Human
gccauugaugugaaaguaagac

SEQ ID NO: 214673 - RNA, 22 nt, Human
uguauauaagcauuuacuuguu

SEQ ID NO: 214674 - RNA, 22 nt, Human
ggacauuucuauugagcuaaga

SEQ ID NO: 214675 - RNA, 22 nt, Human
uggaagccaaggucagaaggag

SEQ ID NO: 214676 - RNA, 22 nt, Human
gaauuacagccagaagaaugaa

SEQ ID NO: 214677 - RNA, 22 nt, Human
aggaggcuuuugcaggugccac

SEQ ID NO: 214678 - RNA, 22 nt, Human
uggugaggucauagagaacugu

SEQ ID NO: 214679 - RNA, 19 nt, Human
cagcaagaaugaaggcaua

SEQ ID NO: 214680 - RNA, 22 nt, Human
ugucauuaguuucagccauucu

SEQ ID NO: 214681 - RNA, 20 nt, Human
uauuaugaccuguguucugg

SEQ ID NO: 214682 - RNA, 22 nt, Human
aggcucugacgucacacguggc

SEQ ID NO: 214683 - RNA, 22 nt, Human
ugcucccaggcauucucuguug

SEQ ID NO: 214684 - RNA, 22 nt, Human
augucacaugguucuggggccu

SEQ ID NO: 214685 - RNA, 22 nt, Human
aggcucagccugggccuagagc

SEQ ID NO: 214686 - RNA, 22 nt, Human
auggcuauuuuagagaucaagg

SEQ ID NO: 214687 - RNA, 16 nt, Human
gcugggagggagaggu

SEQ ID NO: 214688 - RNA, 22 nt, Human
gggaaaggaucagugggaggcu

SEQ ID NO: 214689 - RNA, 22 nt, Human
uguccuggugcuucuugggauu

SEQ ID NO: 214690 - RNA, 21 nt, Human
cugcaucucauagaacauguc

SEQ ID NO: 214691 - RNA, 22 nt, Human
cagggcuccccgcaccgcagcc

SEQ ID NO: 214692 - RNA, 22 nt, Human
augauguugauaaauuacuuua

SEQ ID NO: 214693 - RNA, 22 nt, Human
ggcuucugucucaagcaccagc

SEQ ID NO: 214694 - RNA, 22 nt, Human
guacaugugcacaacaugcaug

SEQ ID NO: 214695 - RNA, 22 nt, Human
uucaucugcugguuuuuggcau

SEQ ID NO: 214696 - RNA, 22 nt, Human
ugucucugauaaguaguucagu

SEQ ID NO: 214697 - RNA, 21 nt, Human
cuguccaguaauuccuggcac

SEQ ID NO: 214698 - RNA, 20 nt, Human
gccucagccaacccaugggg

SEQ ID NO: 214699 - RNA, 22 nt, Human
aggaaacuggguaugguuauac

SEQ ID NO: 214700 - RNA, 19 nt, Human
auaaauaaaaagugggaga

SEQ ID NO: 214701 - RNA, 22 nt, Human
uaaguauguuagaaaaucaagu

SEQ ID NO: 214702 - RNA, 22 nt, Human
guugagaguuaagcgggcuaau

SEQ ID NO: 214703 - RNA, 20 nt, Human
uggcaggaggcagcagugga

SEQ ID NO: 214704 - RNA, 22 nt, Human
agcccugggucccaguccuggc

SEQ ID NO: 214705 - RNA, 22 nt, Human
aggcucccaugguguggcagga

SEQ ID NO: 214706 - RNA, 22 nt, Human
agcugggccugagcuggaagcu

SEQ ID NO: 214707 - RNA, 22 nt, Human
uaggccagauuguuauccaugg

SEQ ID NO: 214708 - RNA, 22 nt, Human
aagggcagcuauuaucgucauc

SEQ ID NO: 214709 - RNA, 22 nt, Human
cuagggagggauguuggcauga

SEQ ID NO: 214710 - RNA, 23 nt, Human
cuguggagcccuuuguugggaga

SEQ ID NO: 214711 - RNA, 22 nt, Human
guucuuuaaacugcugcucugu

SEQ ID NO: 214712 - RNA, 22 nt, Human
gacugguaaggaaauucacuaa

SEQ ID NO: 214713 - RNA, 18 nt, Human
gagaggcccggcugugcc

SEQ ID NO: 214714 - RNA, 22 nt, Human
acccucagacauauuccaucau

SEQ ID NO: 214715 - RNA, 22 nt, Human
aaaaccaggcuugcugugcucg

SEQ ID NO: 214716 - RNA, 22 nt, Human
uggcaggcaaguucagcuccac

SEQ ID NO: 214717 - RNA, 22 nt, Human
cauuugaaugagauugcuguaa

SEQ ID NO: 214718 - RNA, 22 nt, Human
caggagugcagguggugaggca

SEQ ID NO: 214719 - RNA, 22 nt, Human
uucuggcugaaaguuuauuuga

SEQ ID NO: 214720 - RNA, 22 nt, Human
ccaggcccaggguacugaccaa

SEQ ID NO: 214721 - RNA, 22 nt, Human
guccuucucaaauccuguguuu

SEQ ID NO: 214722 - RNA, 22 nt, Human
cuuucaaugugccugccuuggg

SEQ ID NO: 214723 - RNA, 22 nt, Human
ccugugggucacaugggugacu

SEQ ID NO: 214724 - RNA, 22 nt, Human
ugcauuaagguaauuguauaau

SEQ ID NO: 214725 - RNA, 22 nt, Human
acagggcagguggcuacugguc

SEQ ID NO: 214726 - RNA, 22 nt, Human
uaaggcuucuuggaauacugca

SEQ ID NO: 214727 - RNA, 22 nt, Human
gugccagggggcacugaacaga

SEQ ID NO: 214728 - RNA, 21 nt, Human
ccagugcuacagcugccugac

SEQ ID NO: 214729 - RNA, 22 nt, Human
uaugaacacuuauuggggaagg

SEQ ID NO: 214730 - RNA, 22 nt, Human
gucaacaauuccaguuuuuacu

SEQ ID NO: 214731 - RNA, 22 nt, Human
ggggccagcacugugccuuugu

SEQ ID NO: 214732 - RNA, 22 nt, Human
augagugugaaguuagcucagu

SEQ ID NO: 214733 - RNA, 22 nt, Human
cuggccugaucucaugcugucc

SEQ ID NO: 214734 - RNA, 22 nt, Human
uuagaacaucucucuucugcca

SEQ ID NO: 214735 - RNA, 22 nt, Human
ccuggcucugaaguccacauca

SEQ ID NO: 214736 - RNA, 22 nt, Human
uugacauuuugucauauugaca

SEQ ID NO: 214737 - RNA, 22 nt, Human
auggcagacgaggcagcagggg

SEQ ID NO: 214738 - RNA, 22 nt, Human
gaucggguggguucugccauca

SEQ ID NO: 214739 - RNA, 18 nt, Human
ugcuccaggcccaugggc

SEQ ID NO: 214740 - RNA, 22 nt, Human
ggacagacuuuacagccccggg

SEQ ID NO: 214741 - RNA, 22 nt, Human
aucuagaagucauggcuuucuu

SEQ ID NO: 214742 - RNA, 22 nt, Human
ucaauuacagugucaccuuaag

SEQ ID NO: 214743 - RNA, 21 nt, Human
uggccaaaaccauauuauuaa

SEQ ID NO: 214744 - RNA, 22 nt, Human
gcacaggaaaugacucauguua

SEQ ID NO: 214745 - RNA, 22 nt, Human
uaacaguauauuuaccaaaccu

SEQ ID NO: 214746 - RNA, 22 nt, Human
gagggcuccauuccccgugccc

SEQ ID NO: 214747 - RNA, 22 nt, Human
auuucuaguccuuguguaguca

SEQ ID NO: 214748 - RNA, 20 nt, Human
ucugagaagcaaacaauguu

SEQ ID NO: 214749 - RNA, 22 nt, Human
ucuuucuuuaucaccugauaug

SEQ ID NO: 214750 - RNA, 22 nt, Human
ucuagagauacauuggucauuu

SEQ ID NO: 214751 - RNA, 22 nt, Human
gaucugagaucuaaaccagagg

SEQ ID NO: 214752 - RNA, 22 nt, Human
cuggcaugaaauggcaucucau

SEQ ID NO: 214753 - RNA, 22 nt, Human
gagauggccagugccaggacaa

SEQ ID NO: 214754 - RNA, 22 nt, Human
aggcucugaugcaagcccaggg

SEQ ID NO: 214755 - RNA, 22 nt, Human
gaagacauuuguaacacuugca

SEQ ID NO: 214756 - RNA, 20 nt, Human
gcugccuguuucuguaagua

SEQ ID NO: 214757 - RNA, 22 nt, Human
aggcucucaauaugauccaguc

SEQ ID NO: 214758 - RNA, 21 nt, Human
aggcaugagcccugcauggac

SEQ ID NO: 214759 - RNA, 22 nt, Human
agcugagguugaagagugaacg

SEQ ID NO: 214760 - RNA, 22 nt, Human
acuggcaguuugagaaugcauu

SEQ ID NO: 214761 - RNA, 22 nt, Human
cuggcuuccugaguccauuacc

SEQ ID NO: 214762 - RNA, 22 nt, Human
agaagcuacugggauauuaauu

SEQ ID NO: 214763 - RNA, 22 nt, Human
uucacauuugaaaggaaagaua

SEQ ID NO: 214764 - RNA, 22 nt, Human
cugcuguggccagccaggucaa

SEQ ID NO: 214765 - RNA, 22 nt, Human
ggcacagcucaggucccagcuc

SEQ ID NO: 214766 - RNA, 23 nt, Human
ugcaggugauuaauccaguuuca

SEQ ID NO: 214767 - RNA, 22 nt, Human
cagcuuugcaggcuggucagug

SEQ ID NO: 214768 - RNA, 22 nt, Human
uguuuaaugaagaugguuuuuc

SEQ ID NO: 214769 - RNA, 22 nt, Human
aagagauguggaaucauuuaca

SEQ ID NO: 214770 - RNA, 22 nt, Human
gauaauuugauaccucaaucag

SEQ ID NO: 214771 - RNA, 19 nt, Human
gcccuccucacugagcucu

SEQ ID NO: 214772 - RNA, 22 nt, Human
aaggacagagagccauuccaga

SEQ ID NO: 214773 - RNA, 22 nt, Human
aagccaguauucaauggggcua

SEQ ID NO: 214774 - RNA, 22 nt, Human
caggaagcaucuggcuagcuaa

SEQ ID NO: 214775 - RNA, 22 nt, Human
ggcuucuggugggagcaugacu

SEQ ID NO: 214776 - RNA, 22 nt, Human
acucugggaucuugaaaagagu

SEQ ID NO: 214777 - RNA, 22 nt, Human
agaaaauuuaaagagacacaca

SEQ ID NO: 214778 - RNA, 22 nt, Human
ggugaccucaccuggucccacc

SEQ ID NO: 214779 - RNA, 22 nt, Human
cagcugugcuagaagccacgaa

SEQ ID NO: 214780 - RNA, 22 nt, Human
gggagcugccuuagaccggagg

SEQ ID NO: 214781 - RNA, 22 nt, Human
aaaaacacaaguggcuuggucu

SEQ ID NO: 214782 - RNA, 22 nt, Human
gaagaaucugaggacagucauu

SEQ ID NO: 214783 - RNA, 22 nt, Human
cacugguauuugaaaauagaug

SEQ ID NO: 214784 - RNA, 18 nt, Human
cuucaguggcugcucugc

SEQ ID NO: 214785 - RNA, 22 nt, Human
agacagcuccaagugucucugu

SEQ ID NO: 214786 - RNA, 22 nt, Human
cauucauuuaugaaauaucuau

SEQ ID NO: 214787 - RNA, 22 nt, Human
ggaagaaaguagaaaaccgugg

SEQ ID NO: 214788 - RNA, 22 nt, Human
cccuggagaucgggagaggaag

SEQ ID NO: 214789 - RNA, 22 nt, Human
uuuagcaucgaaguaaauuuag

SEQ ID NO: 214790 - RNA, 22 nt, Human
ucaggagugauaccauuuguca

SEQ ID NO: 214791 - RNA, 20 nt, Human
acacaaagcaauggaguaca

SEQ ID NO: 214792 - RNA, 22 nt, Human
ugaaggaaugaguauacuguuu

SEQ ID NO: 214793 - RNA, 22 nt, Human
uugagaagguggucauuugcaa

SEQ ID NO: 214794 - RNA, 22 nt, Human
ggguccagggacguuucugcag

SEQ ID NO: 214795 - RNA, 22 nt, Human
ggccugagcucuggggaggcaa

SEQ ID NO: 214796 - RNA, 22 nt, Human
uauuuuugccucucagauaaaa

SEQ ID NO: 214797 - RNA, 22 nt, Human
uguucacuuauguucucccauu

SEQ ID NO: 214798 - RNA, 22 nt, Human
aaauuuuaaggcuggaacuuaa

SEQ ID NO: 214799 - RNA, 22 nt, Human
caaagcaggaagaauauugaaa

SEQ ID NO: 214800 - RNA, 22 nt, Human
uccucagagcagcccuccgcau

SEQ ID NO: 214801 - RNA, 22 nt, Human
gcaagacaugucuaagguuuaa

SEQ ID NO: 214802 - RNA, 21 nt, Human
acccaggggaagcagaaacug

SEQ ID NO: 214803 - RNA, 18 nt, Human
uccgaggcaccauaaaaa

SEQ ID NO: 214804 - RNA, 22 nt, Human
agauuuauguggucacacucag

SEQ ID NO: 214805 - RNA, 22 nt, Human
aacuuucuggcuuuggggagag

SEQ ID NO: 214806 - RNA, 22 nt, Human
agugggagccagcagcuugggg

SEQ ID NO: 214807 - RNA, 22 nt, Human
ggguggagcuuggacaccagua

SEQ ID NO: 214808 - RNA, 22 nt, Human
gguuacucaagccugccuucuc

SEQ ID NO: 214809 - RNA, 22 nt, Human
ggugacggggcccagguuuccu

SEQ ID NO: 214810 - RNA, 22 nt, Human
gucucuggguuaagcagugcau

SEQ ID NO: 214811 - RNA, 22 nt, Human
uccugaagaugaaaagagaggu

SEQ ID NO: 214812 - RNA, 22 nt, Human
ugugucagaauuuuuguggcaa

SEQ ID NO: 214813 - RNA, 22 nt, Human
gagugaaaaaggaagggccaua

SEQ ID NO: 214814 - RNA, 22 nt, Human
ccuuccaagugcugcuuuuucc

SEQ ID NO: 214815 - RNA, 21 nt, Human
gacaggcaaggagucacuuag

SEQ ID NO: 214816 - RNA, 22 nt, Human
acauguguggacaugaaucuac

SEQ ID NO: 214817 - RNA, 22 nt, Human
ugucccagucaaggcugucauc

SEQ ID NO: 214818 - RNA, 22 nt, Human
cauucugcauuuggaaggggca

SEQ ID NO: 214819 - RNA, 22 nt, Human
ugcucagcgccaaagcugaugg

SEQ ID NO: 214820 - RNA, 22 nt, Human
ucuugcagaggcacugugucag

SEQ ID NO: 214821 - RNA, 22 nt, Human
cggcaggguugguuuucucuga

SEQ ID NO: 214822 - RNA, 20 nt, Human
agaaauauugaguucagagg

SEQ ID NO: 214823 - RNA, 22 nt, Human
acucuguagaguauaccaaugu

SEQ ID NO: 214824 - RNA, 22 nt, Human
ccugggucacucaggcaggcgg

SEQ ID NO: 214825 - RNA, 22 nt, Human
gaauugcuaauccaagugacug

SEQ ID NO: 214826 - RNA, 22 nt, Human
cuaauuguaagcuccuugaggg

SEQ ID NO: 214827 - RNA, 22 nt, Human
gagcaguuuuauuucaugagac

SEQ ID NO: 214828 - RNA, 22 nt, Human
cugugggagaaguugcuggagu

SEQ ID NO: 214829 - RNA, 22 nt, Human
aagcuguacuuagcauugacuc

SEQ ID NO: 214830 - RNA, 22 nt, Human
ugagcaggucaagacuccagcu

SEQ ID NO: 214831 - RNA, 18 nt, Human
aggcuugggcccagcagc

SEQ ID NO: 214832 - RNA, 22 nt, Human
uagcaaguagauacucauuuag

SEQ ID NO: 214833 - RNA, 22 nt, Human
aagucucuaagacugugccauc

SEQ ID NO: 214834 - RNA, 22 nt, Human
ugagccaggcuccaugccaccu

SEQ ID NO: 214835 - RNA, 22 nt, Human
cacagcuggugcacuagcucug

SEQ ID NO: 214836 - RNA, 18 nt, Human
ccccaaaagucacccugg

SEQ ID NO: 214837 - RNA, 23 nt, Human
uguggcugagaaauugacaacuu

SEQ ID NO: 214838 - RNA, 22 nt, Human
aauagacaauucuagccaacau

SEQ ID NO: 214839 - RNA, 22 nt, Human
uccuggggccaggcaccucugg

SEQ ID NO: 214840 - RNA, 22 nt, Human
uguuaggguccugugcaggggc

SEQ ID NO: 214841 - RNA, 22 nt, Human
acugucuucauaucugugucuc

SEQ ID NO: 214842 - RNA, 22 nt, Human
gggcagcuguaucugagcuuau

SEQ ID NO: 214843 - RNA, 20 nt, Human
aggcaguguagagaugagua

SEQ ID NO: 214844 - RNA, 22 nt, Human
agcaagaagggcaaggaaguuu

SEQ ID NO: 214845 - RNA, 22 nt, Human
aggggagcuugccuggucaccc

SEQ ID NO: 214846 - RNA, 22 nt, Human
gcaugugucuccccaguggagg

SEQ ID NO: 214847 - RNA, 22 nt, Human
caguggaaaucagagugagagu

SEQ ID NO: 214848 - RNA, 22 nt, Human
gcccuggaaucucuccauggga

SEQ ID NO: 214849 - RNA, 22 nt, Human
uucuauguguugacaagccuga

SEQ ID NO: 214850 - RNA, 22 nt, Human
gaaaacuuggaucucuagaaug

SEQ ID NO: 214851 - RNA, 22 nt, Human
caugcagccugugaacaguguc

SEQ ID NO: 214852 - RNA, 22 nt, Human
gcugcaggcgccugcggucucu

SEQ ID NO: 214853 - RNA, 22 nt, Human
acaacacagcaaaaccccaucu

SEQ ID NO: 214854 - RNA, 22 nt, Human
cuggagccggcgagccccagcc

SEQ ID NO: 214855 - RNA, 22 nt, Human
ggugaagguggaacgcagagca

SEQ ID NO: 214856 - RNA, 22 nt, Human
guggcugcagagggcacagcau

SEQ ID NO: 214857 - RNA, 18 nt, Human
ucuuggcagcaucuggca

SEQ ID NO: 214858 - RNA, 22 nt, Human
acagguggaaacaugguguugg

SEQ ID NO: 214859 - RNA, 22 nt, Human
gagguccagccaagcggcaagg

SEQ ID NO: 214860 - RNA, 22 nt, Human
gggggacaggaugaauaucugu

SEQ ID NO: 214861 - RNA, 22 nt, Human
ggcaggcauuagagauucccag

SEQ ID NO: 214862 - RNA, 22 nt, Human
ccucugggugacagacucuugg

SEQ ID NO: 214863 - RNA, 22 nt, Human
ggagggggaaacuuuggcugcc

SEQ ID NO: 214864 - RNA, 23 nt, Human
augaggcauuaaacaggcuuuuu

SEQ ID NO: 214865 - RNA, 22 nt, Human
agggagaagguccaugccuguc

SEQ ID NO: 214866 - RNA, 22 nt, Human
gaggucuuagaagaaaaaucau

SEQ ID NO: 214867 - RNA, 22 nt, Human
auguguccucuggcagguuuag

SEQ ID NO: 214868 - RNA, 22 nt, Human
agcugcaaagaugauuuguugu

SEQ ID NO: 214869 - RNA, 22 nt, Human
acugaggaacauauauaagaug

SEQ ID NO: 214870 - RNA, 22 nt, Human
cagagucagagcuccauggagu

SEQ ID NO: 214871 - RNA, 22 nt, Human
ccaguggaguuuuuauacccag

SEQ ID NO: 214872 - RNA, 22 nt, Human
ucuggacuugaaucagaguaga

SEQ ID NO: 214873 - RNA, 22 nt, Human
ucccaggguccucuucuggaau

SEQ ID NO: 214874 - RNA, 22 nt, Human
aaggagaguacaggaguuggua

SEQ ID NO: 214875 - RNA, 18 nt, Human
gagcagaggcucaacugg

SEQ ID NO: 214876 - RNA, 22 nt, Human
caaaugauccuugcaagcugug

SEQ ID NO: 214877 - RNA, 22 nt, Human
aguggccacuagaagcucagcu

SEQ ID NO: 214878 - RNA, 22 nt, Human
agacagcuguuccuucauguuu

SEQ ID NO: 214879 - RNA, 22 nt, Human
agcacauuuaaguaugaaauau

SEQ ID NO: 214880 - RNA, 22 nt, Human
aggcuggcugacuucugaagca

SEQ ID NO: 214881 - RNA, 22 nt, Human
aaagcauguucugggaauagua

SEQ ID NO: 214882 - RNA, 20 nt, Human
agaggaggauuauuuuauuc

SEQ ID NO: 214883 - RNA, 22 nt, Human
gaaggcugccaguggcccucuu

SEQ ID NO: 214884 - RNA, 17 nt, Human
ccugaaggcacuuccag

SEQ ID NO: 214885 - RNA, 22 nt, Human
aggcuccuucacagcacucgcc

SEQ ID NO: 214886 - RNA, 22 nt, Human
auggggaagcaauuggauuucc

SEQ ID NO: 214887 - RNA, 22 nt, Human
gguggccuuuuaugagcagggu

SEQ ID NO: 214888 - RNA, 22 nt, Human
cuuucgaucaagggucccuuca

SEQ ID NO: 214889 - RNA, 22 nt, Human
ucaggccccaucccagacuuau

SEQ ID NO: 214890 - RNA, 22 nt, Human
cuauuagacacaauuagugauu

SEQ ID NO: 214891 - RNA, 22 nt, Human
uuauuuauaucucugcaguuua

SEQ ID NO: 214892 - RNA, 22 nt, Human
aaggcagaaagggaugugagug

SEQ ID NO: 214893 - RNA, 22 nt, Human
agcucccauuaucuucugaaac

SEQ ID NO: 214894 - RNA, 22 nt, Human
accuccuggugcccaaguguuu

SEQ ID NO: 214895 - RNA, 23 nt, Human
aggcuuccuaucuuagagcuggg

SEQ ID NO: 214896 - RNA, 22 nt, Human
gcccagggugcuuagaacccau

SEQ ID NO: 214897 - RNA, 22 nt, Human
ugcucauugcugauuuacaugu

SEQ ID NO: 214898 - RNA, 22 nt, Human
agguggagaagagaugggcagu

SEQ ID NO: 214899 - RNA, 22 nt, Human
ggccagagaagucagacccuug

SEQ ID NO: 214900 - RNA, 22 nt, Human
ccugugugcugaugacgacaga

SEQ ID NO: 214901 - RNA, 22 nt, Human
ugagggcagagcacuggggagc

SEQ ID NO: 214902 - RNA, 22 nt, Human
uugaaaucuuccacagcccaag

SEQ ID NO: 214903 - RNA, 22 nt, Human
ucaggcugagaaaaucuggacc

SEQ ID NO: 214904 - RNA, 21 nt, Human
cauuucuauugaugagaaaag

SEQ ID NO: 214905 - RNA, 22 nt, Human
gacugggguaaggugaggaggu

SEQ ID NO: 214906 - RNA, 22 nt, Human
agcuuuauuaacucuccaggug

SEQ ID NO: 214907 - RNA, 22 nt, Human
gagaggcagaggccugaaaccg

SEQ ID NO: 214908 - RNA, 22 nt, Human
aagaacaugaguuaugaugauu

SEQ ID NO: 214909 - RNA, 22 nt, Human
gagggcucaacuacuacuaggc

SEQ ID NO: 214910 - RNA, 22 nt, Human
ggcauggcuggguucuggugag

SEQ ID NO: 214911 - RNA, 22 nt, Human
acuagaaccagaggaggcaggu

SEQ ID NO: 214912 - RNA, 22 nt, Human
ugcucuggaguggcuugugcac

SEQ ID NO: 214913 - RNA, 22 nt, Human
ucacaggcucuccaccaugagg

SEQ ID NO: 214914 - RNA, 22 nt, Human
ucugaaggcauccucacugcaa

SEQ ID NO: 214915 - RNA, 22 nt, Human
aauguugaggauaucagaaaau

SEQ ID NO: 214916 - RNA, 22 nt, Human
uagagacagaaaguagaauggu

SEQ ID NO: 214917 - RNA, 22 nt, Human
cucagucugucuugucuguguu

SEQ ID NO: 214918 - RNA, 23 nt, Human
agggccacugggaaggauuacug

SEQ ID NO: 214919 - RNA, 22 nt, Human
uuuagagaguguaaaaauauau

SEQ ID NO: 214920 - RNA, 22 nt, Human
gaauuuaagaggaugaaucugu

SEQ ID NO: 214921 - RNA, 19 nt, Human
cugaaaaacauucucagga

SEQ ID NO: 214922 - RNA, 22 nt, Human
ucugccuggaugauggcagggc

SEQ ID NO: 214923 - RNA, 22 nt, Human
ucuggcuuuauuuucaucaucu

SEQ ID NO: 214924 - RNA, 22 nt, Human
caggcauugugacgaguguucu

SEQ ID NO: 214925 - RNA, 20 nt, Human
acacuguucuucacacauuu

SEQ ID NO: 214926 - RNA, 22 nt, Human
agaaggcuccaaguagaguuug

SEQ ID NO: 214927 - RNA, 22 nt, Human
uucucagaugauucagauaaac

SEQ ID NO: 214928 - RNA, 22 nt, Human
uaugaaggauacaccucugauu

SEQ ID NO: 214929 - RNA, 22 nt, Human
agugcauuugggguaguggaag

SEQ ID NO: 214930 - RNA, 23 nt, Human
ucaguaccacagcugcaugaccu

SEQ ID NO: 214931 - RNA, 22 nt, Human
uagcaagaugaugaauuauuca

SEQ ID NO: 214932 - RNA, 22 nt, Human
guuuauuauacaacaaaagcua

SEQ ID NO: 214933 - RNA, 22 nt, Human
aagcugaaucugaaauagaauu

SEQ ID NO: 214934 - RNA, 22 nt, Human
uugugcaauuuaaaaucuuccu

SEQ ID NO: 214935 - RNA, 22 nt, Human
ccagaaguggcuuucucaggga

SEQ ID NO: 214936 - RNA, 22 nt, Human
gccaguuuccaccuaggcaauu

SEQ ID NO: 214937 - RNA, 22 nt, Human
aaaugucuguaggggcugcagg

SEQ ID NO: 214938 - RNA, 22 nt, Human
ugcaucuggccuuugcuggcua

SEQ ID NO: 214939 - RNA, 22 nt, Human
ucagcccugggacccagggaug

SEQ ID NO: 214940 - RNA, 22 nt, Human
augaggcuauuucauagauuuu

SEQ ID NO: 214941 - RNA, 22 nt, Human
ucuagagccaaagucuuggggg

SEQ ID NO: 214942 - RNA, 22 nt, Human
ucaacguuuguuaaaugaguau

SEQ ID NO: 214943 - RNA, 22 nt, Human
uuggagagaggcugcucaggcu

SEQ ID NO: 214944 - RNA, 22 nt, Human
uuccucagggcggaugggcagg

SEQ ID NO: 214945 - RNA, 22 nt, Human
gcagcuguacuggcagcauugu

SEQ ID NO: 214946 - RNA, 23 nt, Human
gguuccaggaacacagccugaug

SEQ ID NO: 214947 - RNA, 20 nt, Human
aggcccagugaauauauugc

SEQ ID NO: 214948 - RNA, 17 nt, Human
cucagagcaggacagaa

SEQ ID NO: 214949 - RNA, 22 nt, Human
ggucucagacuggcaggcagug

SEQ ID NO: 214950 - RNA, 22 nt, Human
ggcccucuguggcugccaugga

SEQ ID NO: 214951 - RNA, 22 nt, Human
ggggaggaagcucucaguucca

SEQ ID NO: 214952 - RNA, 22 nt, Human
uaggcugggaagaaagauucuc

SEQ ID NO: 214953 - RNA, 22 nt, Human
uaggaaagaaaugaguagugau

SEQ ID NO: 214954 - RNA, 22 nt, Human
aaagauuuaagaauaauuugug

SEQ ID NO: 214955 - RNA, 22 nt, Human
uuggcugcuauuuccauauuua

SEQ ID NO: 214956 - RNA, 22 nt, Human
ucugccucgcuaacagcagcca

SEQ ID NO: 214957 - RNA, 22 nt, Human
gcaagcagacauucagguaggu

SEQ ID NO: 214958 - RNA, 22 nt, Human
cagcugaguaugcauucaagca

SEQ ID NO: 214959 - RNA, 22 nt, Human
gacauuaauggcaaauuaauua

SEQ ID NO: 214960 - RNA, 22 nt, Human
cuucuucacacuggucugaagc

SEQ ID NO: 214961 - RNA, 22 nt, Human
gugcagcagggggaagacagug

SEQ ID NO: 214962 - RNA, 22 nt, Human
gaugcaaagaggaccuucagua

SEQ ID NO: 214963 - RNA, 22 nt, Human
caggaugaagggcaaaggcaag

SEQ ID NO: 214964 - RNA, 22 nt, Human
acuuagauuuccuuacugggug

SEQ ID NO: 214965 - RNA, 21 nt, Human
uggaccuguccuucucgcugu

SEQ ID NO: 214966 - RNA, 22 nt, Human
ccagaggugagggggauucuug

SEQ ID NO: 214967 - RNA, 22 nt, Human
uagcagcaauuucagaaguuug

SEQ ID NO: 214968 - RNA, 22 nt, Human
ugaagaaacagaccaagaggau

SEQ ID NO: 214969 - RNA, 20 nt, Human
ucaaaauaggugugggcgga

SEQ ID NO: 214970 - RNA, 22 nt, Human
uccucaguuuucuaguauggca

SEQ ID NO: 214971 - RNA, 22 nt, Human
uauaaaugcacuuuugaaauau

SEQ ID NO: 214972 - RNA, 22 nt, Human
uggccagugccugccagugcag

SEQ ID NO: 214973 - RNA, 22 nt, Human
uccugagcccuggggucagugu

SEQ ID NO: 214974 - RNA, 22 nt, Human
gcucagagagauuaaauaauuu

SEQ ID NO: 214975 - RNA, 22 nt, Human
aaguggcauguauaagaaagaa

SEQ ID NO: 214976 - RNA, 22 nt, Human
cuaaaauuaucaagauaauucc

SEQ ID NO: 214977 - RNA, 22 nt, Human
ggagggccaucuugggugugau

SEQ ID NO: 214978 - RNA, 23 nt, Human
uugaggagugcuuuuucuaucca

SEQ ID NO: 214979 - RNA, 22 nt, Human
aaggcuggaccuggaugaaucu

SEQ ID NO: 214980 - RNA, 22 nt, Human
ucuugagaaauaauuaaacaug

SEQ ID NO: 214981 - RNA, 22 nt, Human
accuuauuaaaaugaugaugua

SEQ ID NO: 214982 - RNA, 22 nt, Human
agugggugauaagaccaaggag

SEQ ID NO: 214983 - RNA, 22 nt, Human
gggcuacugagcuggaacuggg

SEQ ID NO: 214984 - RNA, 20 nt, Human
agaagccaagugacauguuu

SEQ ID NO: 214985 - RNA, 20 nt, Human
caggcaguuugugguuaggg

SEQ ID NO: 214986 - RNA, 22 nt, Human
aaacuuuuuuagguucauaggc

SEQ ID NO: 214987 - RNA, 23 nt, Human
ugcagcaggguggucuacuucuc

SEQ ID NO: 214988 - RNA, 22 nt, Human
gaaaauacaaauagccuugaaa

SEQ ID NO: 214989 - RNA, 22 nt, Human
aaacaguauuaucaauauauuu

SEQ ID NO: 214990 - RNA, 22 nt, Human
uucucagggucuggauggccug

SEQ ID NO: 214991 - RNA, 22 nt, Human
acagcagaguugaguaguugca

SEQ ID NO: 214992 - RNA, 22 nt, Human
ucugggaaguccucugucaugc

SEQ ID NO: 214993 - RNA, 22 nt, Human
aagggcugcauuugauguguca

SEQ ID NO: 214994 - RNA, 22 nt, Human
cuuguugcugaauucaggauuc

SEQ ID NO: 214995 - RNA, 22 nt, Human
accuuggaacugaaguguuuuu

SEQ ID NO: 214996 - RNA, 22 nt, Human
ccagggcagaaaaagagggaau

SEQ ID NO: 214997 - RNA, 22 nt, Human
uccuucaagugcaguaccugag

SEQ ID NO: 214998 - RNA, 22 nt, Human
aguaacaugaguuuuucuaaug

SEQ ID NO: 214999 - RNA, 22 nt, Human
aaaaaccauugucuucagucuc

SEQ ID NO: 215000 - RNA, 22 nt, Human
cugguccucuccagcaggcauu

SEQ ID NO: 215001 - RNA, 22 nt, Human
gcagaggauagcauaugaaccu

SEQ ID NO: 215002 - RNA, 22 nt, Human
gaggccuggagccgccuaggcg

SEQ ID NO: 215003 - RNA, 22 nt, Human
uggcacagugcuggauggugcu

SEQ ID NO: 215004 - RNA, 22 nt, Human
ggagaaggguauguguggcgga

SEQ ID NO: 215005 - RNA, 19 nt, Human
acuucuuuucaacacagga

SEQ ID NO: 215006 - RNA, 22 nt, Human
auuaguagcuguaauaacuggg

SEQ ID NO: 215007 - RNA, 22 nt, Human
ccuugccucauugugcuucucc

SEQ ID NO: 215008 - RNA, 22 nt, Human
uggaccugcguaggugcugggc

SEQ ID NO: 215009 - RNA, 22 nt, Human
agugaauuuaaaacacugagga

SEQ ID NO: 215010 - RNA, 21 nt, Human
gguugguguguccaguggcca

SEQ ID NO: 215011 - RNA, 22 nt, Human
uguaaaggguguuaaauuacuc

SEQ ID NO: 215012 - RNA, 22 nt, Human
gcugccuguccugaggaguccg

SEQ ID NO: 215013 - RNA, 21 nt, Human
cagcuccacuaaagcagcugu

SEQ ID NO: 215014 - RNA, 22 nt, Human
ucaggaagacaaucuuuggcuc

SEQ ID NO: 215015 - RNA, 22 nt, Human
caggcagugugacgcuaggguu

SEQ ID NO: 215016 - RNA, 22 nt, Human
ggcuuuauauuguuugagcaga

SEQ ID NO: 215017 - RNA, 22 nt, Human
aacauuuuuaagaccaagugcu

SEQ ID NO: 215018 - RNA, 17 nt, Human
ggccacagagcuugggg

SEQ ID NO: 215019 - RNA, 22 nt, Human
ucccucagucccuggacaggca

SEQ ID NO: 215020 - RNA, 20 nt, Human
auguuuuauaaaagaacggg

SEQ ID NO: 215021 - RNA, 22 nt, Human
aaaguccuguuugaaggaccug

SEQ ID NO: 215022 - RNA, 21 nt, Human
ucucacaauaugaugccagau

SEQ ID NO: 215023 - RNA, 22 nt, Human
guuucuuuuaaaauauguagac

SEQ ID NO: 215024 - RNA, 22 nt, Human
ugcccagccaguuuaugguaau

SEQ ID NO: 215025 - RNA, 17 nt, Human
cagcucuuccucccucu

SEQ ID NO: 215026 - RNA, 22 nt, Human
auaauaacuccuguugaagaac

SEQ ID NO: 215027 - RNA, 22 nt, Human
uggcauguuuaauguacuguau

SEQ ID NO: 215028 - RNA, 22 nt, Human
uugaauuagacuuugcuacagg

SEQ ID NO: 215029 - RNA, 22 nt, Human
acugugagugauuuccuucugg

SEQ ID NO: 215030 - RNA, 22 nt, Human
cacucugauuccacaaggcucc

SEQ ID NO: 215031 - RNA, 22 nt, Human
guuugcauguauuaagucaaua

SEQ ID NO: 215032 - RNA, 22 nt, Human
ucccugcacccuugcugggccc

SEQ ID NO: 215033 - RNA, 20 nt, Human
uuuauuggccuuucaggaac

SEQ ID NO: 215034 - RNA, 20 nt, Human
ccuguguggccagcugaggc

SEQ ID NO: 215035 - RNA, 19 nt, Human
cagaacagaggucauggcc

SEQ ID NO: 215036 - RNA, 22 nt, Human
uaccugcagcgggaauccauua

SEQ ID NO: 215037 - RNA, 22 nt, Human
cuccugugcaugcaucucccua

SEQ ID NO: 215038 - RNA, 22 nt, Human
aucaggauucaguaucuccagc

SEQ ID NO: 215039 - RNA, 22 nt, Human
agucuagauccccagugcuguc

SEQ ID NO: 215040 - RNA, 22 nt, Human
agcagguuguuuuguggccagg

SEQ ID NO: 215041 - RNA, 22 nt, Human
uuuaauuugaaaugaguaaccc

SEQ ID NO: 215042 - RNA, 22 nt, Human
uuccuggcucucuguugcacag

SEQ ID NO: 215043 - RNA, 22 nt, Human
gcuguggcugaagaugcaggga

SEQ ID NO: 215044 - RNA, 22 nt, Human
uccuuggcacacucggaucuga

SEQ ID NO: 215045 - RNA, 22 nt, Human
aaguauuucguucugaaaaagu

SEQ ID NO: 215046 - RNA, 22 nt, Human
gagucagaccgacugggcucau

SEQ ID NO: 215047 - RNA, 22 nt, Human
cuggucuggcuacccagcgaau

SEQ ID NO: 215048 - RNA, 22 nt, Human
acacauauauacauauuugugc

SEQ ID NO: 215049 - RNA, 22 nt, Human
ccugaaaugaguucugcucacu

SEQ ID NO: 215050 - RNA, 22 nt, Human
aggccuggugaaugaaguaucu

SEQ ID NO: 215051 - RNA, 21 nt, Human
uuuaauuugcauguaugacgc

SEQ ID NO: 215052 - RNA, 22 nt, Human
cuggacacacuggagucuggca

SEQ ID NO: 215053 - RNA, 22 nt, Human
ugcaggucucugcaaggccuau

SEQ ID NO: 215054 - RNA, 22 nt, Human
agcuccuugaagggcucuggga

SEQ ID NO: 215055 - RNA, 21 nt, Human
cagacccucuagaggccaccu

SEQ ID NO: 215056 - RNA, 22 nt, Human
auaagcucuggacagccacauu

SEQ ID NO: 215057 - RNA, 22 nt, Human
auggcccaaaaccuccucccuc

SEQ ID NO: 215058 - RNA, 22 nt, Human
ugacacaugcaccagucuuuaa

SEQ ID NO: 215059 - RNA, 22 nt, Human
aaggauucaagaaaugguguag

SEQ ID NO: 215060 - RNA, 22 nt, Human
uuacccagugaagccgaggcag

SEQ ID NO: 215061 - RNA, 22 nt, Human
aguaaacaggcaugauaguguu

SEQ ID NO: 215062 - RNA, 22 nt, Human
uucugaggcauagaggaugaga

SEQ ID NO: 215063 - RNA, 22 nt, Human
guauaucaccccaagcagcuga

SEQ ID NO: 215064 - RNA, 22 nt, Human
agacuacauaugccacaugaag

SEQ ID NO: 215065 - RNA, 22 nt, Human
ggaaaaacagucuuuauuauuu

SEQ ID NO: 215066 - RNA, 22 nt, Human
aagcagcaugcuaugcuggugg

SEQ ID NO: 215067 - RNA, 22 nt, Human
cagggaggcugucuuaugccug

SEQ ID NO: 215068 - RNA, 22 nt, Human
agaggacacaucuuuccucaaa

SEQ ID NO: 215069 - RNA, 22 nt, Human
uagauguuaagcuucuagaagg

SEQ ID NO: 215070 - RNA, 22 nt, Human
ccagacuggggcuccuugaggg

SEQ ID NO: 215071 - RNA, 22 nt, Human
aagacauucaugaagaagggau

SEQ ID NO: 215072 - RNA, 19 nt, Human
agcaaauacaucaaaauug

SEQ ID NO: 215073 - RNA, 22 nt, Human
ugucaguuaaaugagguacaag

SEQ ID NO: 215074 - RNA, 22 nt, Human
gcccuggauggcaggagccauc

SEQ ID NO: 215075 - RNA, 22 nt, Human
gagaggcugugugccauuguug

SEQ ID NO: 215076 - RNA, 22 nt, Human
gccagcaguauguccuggcagu

SEQ ID NO: 215077 - RNA, 22 nt, Human
acugagaagcucgcagugaugc

SEQ ID NO: 215078 - RNA, 22 nt, Human
auucuggacaaugagaaacugg

SEQ ID NO: 215079 - RNA, 22 nt, Human
aacuggaaugaaauuuacgaug

SEQ ID NO: 215080 - RNA, 22 nt, Human
caauagugucugcuuguuucua

SEQ ID NO: 215081 - RNA, 22 nt, Human
uuacaaagagugccagagugug

SEQ ID NO: 215082 - RNA, 22 nt, Human
uuuugccuaggguugacccguu

SEQ ID NO: 215083 - RNA, 22 nt, Human
acuuagaauuaguguagaauga

SEQ ID NO: 215084 - RNA, 22 nt, Human
ugcagagaagaggacaguucua

SEQ ID NO: 215085 - RNA, 22 nt, Human
ucuggaauaggacaaaaccaaa

SEQ ID NO: 215086 - RNA, 22 nt, Human
cuuccugggucagccuggaggu

SEQ ID NO: 215087 - RNA, 22 nt, Human
ggcugaaagguaguaguaggcu

SEQ ID NO: 215088 - RNA, 22 nt, Human
acccaggcuagagugcaguggu

SEQ ID NO: 215089 - RNA, 22 nt, Human
uggucuggggaccgaggguuac

SEQ ID NO: 215090 - RNA, 22 nt, Human
uguggggccaaagcccagccac

SEQ ID NO: 215091 - RNA, 22 nt, Human
gcaguggcuaggagucuggcgu

SEQ ID NO: 215092 - RNA, 22 nt, Human
gcuauuuuugagccauuuauaa

SEQ ID NO: 215093 - RNA, 22 nt, Human
cugaaauauuuuaaucucagga

SEQ ID NO: 215094 - RNA, 22 nt, Human
uugcugauucaugauuugagaa

SEQ ID NO: 215095 - RNA, 22 nt, Human
gcaccagggugcuguguucugg

SEQ ID NO: 215096 - RNA, 22 nt, Human
gguggggcucagcaaucugugu

SEQ ID NO: 215097 - RNA, 22 nt, Human
auguuauaguuauaaaaugagg

SEQ ID NO: 215098 - RNA, 22 nt, Human
gagcccucaaugaaucugcauu

SEQ ID NO: 215099 - RNA, 22 nt, Human
aagacccuaccccuggagagga

SEQ ID NO: 215100 - RNA, 22 nt, Human
uugcacagugguuuagagccug

SEQ ID NO: 215101 - RNA, 22 nt, Human
auguagaguagaauaguacaac

SEQ ID NO: 215102 - RNA, 22 nt, Human
cugaggccucacuguagucccu

SEQ ID NO: 215103 - RNA, 22 nt, Human
cugugcaaauaaagagcaacau

SEQ ID NO: 215104 - RNA, 22 nt, Human
uuucaugucauuccauuucaga

SEQ ID NO: 215105 - RNA, 21 nt, Human
cacaggugggucagugaggcc

SEQ ID NO: 215106 - RNA, 22 nt, Human
auuugucauauauaauacucuu

SEQ ID NO: 215107 - RNA, 22 nt, Human
aaauguguguauguacauauau

SEQ ID NO: 215108 - RNA, 22 nt, Human
gugguaaaaugugaaauggauu

SEQ ID NO: 215109 - RNA, 22 nt, Human
ugguccagcuugauucucuucu

SEQ ID NO: 215110 - RNA, 22 nt, Human
cagucugauguucgcaggugaa

SEQ ID NO: 215111 - RNA, 22 nt, Human
accaggcuccccuuggauccug

SEQ ID NO: 215112 - RNA, 21 nt, Human
ccacaauucuaguuacauaug

SEQ ID NO: 215113 - RNA, 22 nt, Human
cuccuucccuaccaucaauguu

SEQ ID NO: 215114 - RNA, 22 nt, Human
agcuucucagauggacuguuag

SEQ ID NO: 215115 - RNA, 22 nt, Human
uggcugcaggggugucugacau

SEQ ID NO: 215116 - RNA, 22 nt, Human
cugcacccaggccuggucccag

SEQ ID NO: 215117 - RNA, 22 nt, Human
gcacugccaucaaugcaugaca

SEQ ID NO: 215118 - RNA, 22 nt, Human
ucacacauguaagggcuuugga

SEQ ID NO: 215119 - RNA, 22 nt, Human
augagcaguuuuuaaguagcaa

SEQ ID NO: 215120 - RNA, 22 nt, Human
cacaggccugucucuuucuaac

SEQ ID NO: 215121 - RNA, 22 nt, Human
caggcuccuucccagggauggu

SEQ ID NO: 215122 - RNA, 20 nt, Human
guauuagguguuccucuuuc

SEQ ID NO: 215123 - RNA, 22 nt, Human
ggacccagguagggaggaagau

SEQ ID NO: 215124 - RNA, 22 nt, Human
uucuuuccuugccucagugaag

SEQ ID NO: 215125 - RNA, 22 nt, Human
acauuuaaugauccuacuguga

SEQ ID NO: 215126 - RNA, 23 nt, Human
gggaucuguaaaccuggagaacc

SEQ ID NO: 215127 - RNA, 22 nt, Human
ggcucccaggagggccuggagg

SEQ ID NO: 215128 - RNA, 22 nt, Human
ugggagagaauaaucaauaggu

SEQ ID NO: 215129 - RNA, 22 nt, Human
gaagauuaaauggcucccauau

SEQ ID NO: 215130 - RNA, 20 nt, Human
uggcaggaauagggccagag

SEQ ID NO: 215131 - RNA, 22 nt, Human
accugauguauagauucuagau

SEQ ID NO: 215132 - RNA, 22 nt, Human
aggagcucuugaugcuugaggg

SEQ ID NO: 215133 - RNA, 22 nt, Human
uggcucaguggcagccgcagcu

SEQ ID NO: 215134 - RNA, 22 nt, Human
acacacuguugcucauccaggc

SEQ ID NO: 215135 - RNA, 20 nt, Human
ccugucaucccagcauuuug

SEQ ID NO: 215136 - RNA, 22 nt, Human
ggcagguggaaguuggcagagc

SEQ ID NO: 215137 - RNA, 22 nt, Human
aucugccucuucuucauugcga

SEQ ID NO: 215138 - RNA, 19 nt, Human
gucucuggauuucaggucc

SEQ ID NO: 215139 - RNA, 22 nt, Human
uaagcauuaugguaaagaagua

SEQ ID NO: 215140 - RNA, 22 nt, Human
uagguagauacauguguuggcu

SEQ ID NO: 215141 - RNA, 20 nt, Human
uacaacaaguagagacauac

SEQ ID NO: 215142 - RNA, 22 nt, Human
agcagggcagcugaugcgcacg

SEQ ID NO: 215143 - RNA, 22 nt, Human
cagcacuugagcuuucauguaa

SEQ ID NO: 215144 - RNA, 19 nt, Human
aaagcagaggagcaucuga

SEQ ID NO: 215145 - RNA, 22 nt, Human
gggugggaaggcuaagggauug

SEQ ID NO: 215146 - RNA, 22 nt, Human
ccagggugggguccaggaacca

SEQ ID NO: 215147 - RNA, 22 nt, Human
agcuuagaauguguuaggaaag

SEQ ID NO: 215148 - RNA, 22 nt, Human
uuagguuuaagugacuggaauc

SEQ ID NO: 215149 - RNA, 22 nt, Human
ucagaguguuuuacuaaacaag

SEQ ID NO: 215150 - RNA, 22 nt, Human
aacuugaaccacagaagcugcc

SEQ ID NO: 215151 - RNA, 23 nt, Human
aggaaguuaaggcagacagacag

SEQ ID NO: 215152 - RNA, 22 nt, Human
uagugucagggagugauaaaug

SEQ ID NO: 215153 - RNA, 22 nt, Human
uagaaagcaugcaaguuugaug

SEQ ID NO: 215154 - RNA, 22 nt, Human
uccuuggaaauuucaucagaca

SEQ ID NO: 215155 - RNA, 19 nt, Human
cccuggcaggcaagccugg

SEQ ID NO: 215156 - RNA, 22 nt, Human
ucagugucaucacuuaauauaa

SEQ ID NO: 215157 - RNA, 22 nt, Human
ggaggccuggacuuccugaugg

SEQ ID NO: 215158 - RNA, 22 nt, Human
aggcuagggccauggcugguga

SEQ ID NO: 215159 - RNA, 22 nt, Human
auucugauaucuuauucuagcu

SEQ ID NO: 215160 - RNA, 22 nt, Human
gagcucuuccccaucuuacauc

SEQ ID NO: 215161 - RNA, 22 nt, Human
uaucuagauggauuuuagugaa

SEQ ID NO: 215162 - RNA, 22 nt, Human
uaggaaaugcuccauugcauaa

SEQ ID NO: 215163 - RNA, 20 nt, Human
caucuuuggcaggacuccuu

SEQ ID NO: 215164 - RNA, 22 nt, Human
ggucccagcugcucaagaggcu

SEQ ID NO: 215165 - RNA, 22 nt, Human
uagaauguagugcuucaagauu

SEQ ID NO: 215166 - RNA, 22 nt, Human
gaaauaacagcucuggaagagu

SEQ ID NO: 215167 - RNA, 22 nt, Human
auucacaugcccaagcagcacc

SEQ ID NO: 215168 - RNA, 21 nt, Human
ccagcccagccuccuucucuu

SEQ ID NO: 215169 - RNA, 22 nt, Human
uucuggcucuccccugcugggu

SEQ ID NO: 215170 - RNA, 22 nt, Human
ugagagaguaauugagugguaa

SEQ ID NO: 215171 - RNA, 22 nt, Human
cuguuauuuuauaauucaagaa

SEQ ID NO: 215172 - RNA, 18 nt, Human
gcagguguggagaagggg

SEQ ID NO: 215173 - RNA, 22 nt, Human
caagcauuuauuauaauuauca

SEQ ID NO: 215174 - RNA, 22 nt, Human
agggccugggauguccuccuag

SEQ ID NO: 215175 - RNA, 22 nt, Human
uuaguagaauguuauagcaauu

SEQ ID NO: 215176 - RNA, 22 nt, Human
acagcagcuuccugacuguacu

SEQ ID NO: 215177 - RNA, 22 nt, Human
uuggaucacucugaagccuuac

SEQ ID NO: 215178 - RNA, 22 nt, Human
uggcaaagcuagacauucccuc

SEQ ID NO: 215179 - RNA, 22 nt, Human
acaaaauuaugaagaggccuug

SEQ ID NO: 215180 - RNA, 22 nt, Human
uccuggagcuggugucuuuccc

SEQ ID NO: 215181 - RNA, 22 nt, Human
cuggggaacgcagcgagcagcg

SEQ ID NO: 215182 - RNA, 22 nt, Human
gcccugagugccuguguaagaa

SEQ ID NO: 215183 - RNA, 22 nt, Human
gccuguuuaaguauucugacau

SEQ ID NO: 215184 - RNA, 22 nt, Human
guugggaaggcaagaaguagaa

SEQ ID NO: 215185 - RNA, 22 nt, Human
uucaguuucuaaagauguuccu

SEQ ID NO: 215186 - RNA, 22 nt, Human
cagguauuaauaaauggagagu

SEQ ID NO: 215187 - RNA, 22 nt, Human
ucuucugugagaauucaagcaa

SEQ ID NO: 215188 - RNA, 22 nt, Human
cagccagaaagucuguuaggga

SEQ ID NO: 215189 - RNA, 22 nt, Human
caggagcugggucuggaagcag

SEQ ID NO: 215190 - RNA, 21 nt, Human
aaacugaccuugccugagaca

SEQ ID NO: 215191 - RNA, 22 nt, Human
aaaagacauaugugggcauucu

SEQ ID NO: 215192 - RNA, 22 nt, Human
uuauuucuacuauuuugccuga

SEQ ID NO: 215193 - RNA, 22 nt, Human
ggaccaguuucaaacuguacca

SEQ ID NO: 215194 - RNA, 22 nt, Human
aacaggcuuuuggaaaguuaca

SEQ ID NO: 215195 - RNA, 23 nt, Human
cagugcagggcaacucagacucc

SEQ ID NO: 215196 - RNA, 20 nt, Human
gccauccagccucccaggag

SEQ ID NO: 215197 - RNA, 22 nt, Human
ucaggcugccuaucagacugug

SEQ ID NO: 215198 - RNA, 22 nt, Human
aaauacauaaagguuguaccag

SEQ ID NO: 215199 - RNA, 22 nt, Human
acaggaagaaagugcaguagau

SEQ ID NO: 215200 - RNA, 22 nt, Human
gagcuacacugauucauuuguu

SEQ ID NO: 215201 - RNA, 22 nt, Human
uuacaagcuaauuguuucagcu

SEQ ID NO: 215202 - RNA, 22 nt, Human
gggccugucucacucccugguu

SEQ ID NO: 215203 - RNA, 22 nt, Human
gcuuuacugagaugacacaggg

SEQ ID NO: 215204 - RNA, 22 nt, Human
aguuugaagauuaugccagagu

SEQ ID NO: 215205 - RNA, 22 nt, Human
gugauaggcauuuaacucuaag

SEQ ID NO: 215206 - RNA, 22 nt, Human
aggaaugugacuauuuuuucag

SEQ ID NO: 215207 - RNA, 21 nt, Human
cuguggaagggaacuagaggg

SEQ ID NO: 215208 - RNA, 22 nt, Human
aggagggacaccaauauauguu

SEQ ID NO: 215209 - RNA, 22 nt, Human
uuacacagugcacaagcagagu

SEQ ID NO: 215210 - RNA, 23 nt, Human
acacguguguguacauagauagu

SEQ ID NO: 215211 - RNA, 22 nt, Human
gggcggggggagcuggaaugaa

SEQ ID NO: 215212 - RNA, 22 nt, Human
acuagaaacuaauggauuauua

SEQ ID NO: 215213 - RNA, 22 nt, Human
caaguccaagaucaagaagcca

SEQ ID NO: 215214 - RNA, 22 nt, Human
ccugccagggccuuggaagaaa

SEQ ID NO: 215215 - RNA, 20 nt, Human
cccaggaguuugcucuuacu

SEQ ID NO: 215216 - RNA, 22 nt, Human
uacaaagugaaauaauucugag

SEQ ID NO: 215217 - RNA, 22 nt, Human
gcucucuugguggcuguccugg

SEQ ID NO: 215218 - RNA, 22 nt, Human
aggagccugugccuggcacucc

SEQ ID NO: 215219 - RNA, 22 nt, Human
acuccagguuuucucucaaguu

SEQ ID NO: 215220 - RNA, 22 nt, Human
caguuacauauuuaguagguua

SEQ ID NO: 215221 - RNA, 22 nt, Human
cuuuacagccuccagaaggaac

SEQ ID NO: 215222 - RNA, 22 nt, Human
gcuuacaagaucgugcuccagu

SEQ ID NO: 215223 - RNA, 17 nt, Human
cagcccugccguuccca

SEQ ID NO: 215224 - RNA, 17 nt, Human
acagugucuaugaaaug

SEQ ID NO: 215225 - RNA, 22 nt, Human
ggcuuuaugcagggauagaaau

SEQ ID NO: 215226 - RNA, 22 nt, Human
aggccugccuggaucacacaga

SEQ ID NO: 215227 - RNA, 22 nt, Human
ucugugucugguugggccagua

SEQ ID NO: 215228 - RNA, 22 nt, Human
aaucaaagaaugggcuaguugg

SEQ ID NO: 215229 - RNA, 22 nt, Human
cuccugggcuucgaaggcuccc

SEQ ID NO: 215230 - RNA, 22 nt, Human
ucagaauaaacaugggcauggg

SEQ ID NO: 215231 - RNA, 20 nt, Human
cugucuugugggcuuccccu

SEQ ID NO: 215232 - RNA, 22 nt, Human
caggccuugggacccagacugg

SEQ ID NO: 215233 - RNA, 22 nt, Human
uuucugaggaauuaauacagaa

SEQ ID NO: 215234 - RNA, 22 nt, Human
uuugaaagacagaauauuuuug

SEQ ID NO: 215235 - RNA, 22 nt, Human
uugaagaggacuuugcagcugu

SEQ ID NO: 215236 - RNA, 22 nt, Human
ggccaagguguucugauaugcc

SEQ ID NO: 215237 - RNA, 22 nt, Human
cacaggaaucagcauuaauggc

SEQ ID NO: 215238 - RNA, 19 nt, Human
cucugccucuggcuguggc

SEQ ID NO: 215239 - RNA, 22 nt, Human
guucuucaggcugugcucuaga

SEQ ID NO: 215240 - RNA, 23 nt, Human
aggguccagggaucaccaggugu

SEQ ID NO: 215241 - RNA, 22 nt, Human
gccaggcugacucccccggccu

SEQ ID NO: 215242 - RNA, 16 nt, Human
cucuuugggcuuccag

SEQ ID NO: 215243 - RNA, 22 nt, Human
uauccaaaguggcauauuauag

SEQ ID NO: 215244 - RNA, 22 nt, Human
ucagaacagaagaaggaacacg

SEQ ID NO: 215245 - RNA, 22 nt, Human
agaaggcuggcccuggguggcc

SEQ ID NO: 215246 - RNA, 22 nt, Human
ucaacugguucuugaauguaua

SEQ ID NO: 215247 - RNA, 22 nt, Human
augcugagacuggagcagcugg

SEQ ID NO: 215248 - RNA, 22 nt, Human
guggggcuggaagauggguacu

SEQ ID NO: 215249 - RNA, 22 nt, Human
ucccaaguacuaccaaucuaau

SEQ ID NO: 215250 - RNA, 22 nt, Human
ucccugaugccuugauccgugg

SEQ ID NO: 215251 - RNA, 22 nt, Human
uuggcagaggggccaccugccc

SEQ ID NO: 215252 - RNA, 22 nt, Human
ccuggcucagaccccaguucug

SEQ ID NO: 215253 - RNA, 22 nt, Human
agugaauucuccacccaguagg

SEQ ID NO: 215254 - RNA, 21 nt, Human
uucaauacuauuucaauaguc

SEQ ID NO: 215255 - RNA, 22 nt, Human
auucacaauuagaaguagauaa

SEQ ID NO: 215256 - RNA, 22 nt, Human
ucucuguacaguacaugccgug

SEQ ID NO: 215257 - RNA, 22 nt, Human
gaaggccugugguagugagacg

SEQ ID NO: 215258 - RNA, 22 nt, Human
gaucuuugcaaacuuugucacu

SEQ ID NO: 215259 - RNA, 22 nt, Human
auguucauuagucaacauuucu

SEQ ID NO: 215260 - RNA, 22 nt, Human
uuagggcaaaguuucaacaguu

SEQ ID NO: 215261 - RNA, 22 nt, Human
uaggugcaggucacaagggaug

SEQ ID NO: 215262 - RNA, 22 nt, Human
acccaggaggcagagguugcag

SEQ ID NO: 215263 - RNA, 22 nt, Human
aggcccaguuauccuacuuguu

SEQ ID NO: 215264 - RNA, 22 nt, Human
caagggcauugcuugggaccuu

SEQ ID NO: 215265 - RNA, 22 nt, Human
ugauccauauguguuacuucuc

SEQ ID NO: 215266 - RNA, 22 nt, Human
ucacaucuaauucgguuagguu

SEQ ID NO: 215267 - RNA, 22 nt, Human
uagcuauuuagcccagauaagu

SEQ ID NO: 215268 - RNA, 22 nt, Human
acaagauuuugucugguagggu

SEQ ID NO: 215269 - RNA, 22 nt, Human
auggcagauggcuggagcaggu

SEQ ID NO: 215270 - RNA, 22 nt, Human
cagcauggagacaaagugggca

SEQ ID NO: 215271 - RNA, 22 nt, Human
cagguucuuaacuuguucuucc

SEQ ID NO: 215272 - RNA, 22 nt, Human
cugucuggaaugcaguacauag

SEQ ID NO: 215273 - RNA, 22 nt, Human
uacucaguuuaugauuucaagu

SEQ ID NO: 215274 - RNA, 22 nt, Human
uuucacagguacaaacacuccu

SEQ ID NO: 215275 - RNA, 22 nt, Human
gcagggccagugcagagaggaa

SEQ ID NO: 215276 - RNA, 22 nt, Human
uuuuaaacuccccuaguuggug

SEQ ID NO: 215277 - RNA, 22 nt, Human
ugaaauguagauuaggcauucu

SEQ ID NO: 215278 - RNA, 22 nt, Human
uuuuccucuguaugcgugagau

SEQ ID NO: 215279 - RNA, 22 nt, Human
ucagaugcuagggcugagcuau

SEQ ID NO: 215280 - RNA, 22 nt, Human
agcgugaauuaguugguacaca

SEQ ID NO: 215281 - RNA, 22 nt, Human
ugggagcagccaacauggccuu

SEQ ID NO: 215282 - RNA, 22 nt, Human
ugaaacaguagucuguggguuu

SEQ ID NO: 215283 - RNA, 22 nt, Human
acccagccuacaaagcucaccu

SEQ ID NO: 215284 - RNA, 22 nt, Human
uuacagaauguucuuccaacag

SEQ ID NO: 215285 - RNA, 22 nt, Human
uggcagagucucuccuuuccag

SEQ ID NO: 215286 - RNA, 22 nt, Human
gcccuggccuucaucucagaca

SEQ ID NO: 215287 - RNA, 22 nt, Human
aggcucagugauguaaaauaua

SEQ ID NO: 215288 - RNA, 22 nt, Human
cagaaaucuccaugucagacau

SEQ ID NO: 215289 - RNA, 22 nt, Human
uuguugccaaauguaaaauaug

SEQ ID NO: 215290 - RNA, 22 nt, Human
uucugaaauaggagauagcugu

SEQ ID NO: 215291 - RNA, 22 nt, Human
gggaacagcauaucugaagggu

SEQ ID NO: 215292 - RNA, 22 nt, Human
uccuccaaggcagggggagaga

SEQ ID NO: 215293 - RNA, 22 nt, Human
caaaagcagcaaguuuauaugu

SEQ ID NO: 215294 - RNA, 22 nt, Human
uugcaacuucucccaucacucu

SEQ ID NO: 215295 - RNA, 22 nt, Human
ucugugcuagaggaguuggcca

SEQ ID NO: 215296 - RNA, 17 nt, Human
agcuggguucucaggaa

SEQ ID NO: 215297 - RNA, 22 nt, Human
accugccuaucagcugccugcu

SEQ ID NO: 215298 - RNA, 22 nt, Human
acuaaaacaguggcuaguagac

SEQ ID NO: 215299 - RNA, 22 nt, Human
cugaggcaugaaugugggcuuu

SEQ ID NO: 215300 - RNA, 21 nt, Human
acagcagacaggcuuaggacc

SEQ ID NO: 215301 - RNA, 22 nt, Human
gggcuccaguuuggccaggaag

SEQ ID NO: 215302 - RNA, 22 nt, Human
agaauuuagcuccuuggucaua

SEQ ID NO: 215303 - RNA, 21 nt, Human
ggagggcagcccagacuggcu

SEQ ID NO: 215304 - RNA, 22 nt, Human
gacagcaaagcagagccaaggc

SEQ ID NO: 215305 - RNA, 18 nt, Human
cuuguucuucucuuggcg

SEQ ID NO: 215306 - RNA, 22 nt, Human
acacauguuuccaaaagcaccc

SEQ ID NO: 215307 - RNA, 22 nt, Human
gagcuacaggcagcugagcccu

SEQ ID NO: 215308 - RNA, 22 nt, Human
gcagcaggcacggucucgacau

SEQ ID NO: 215309 - RNA, 22 nt, Human
gauguacuugccuuaucuaucc

SEQ ID NO: 215310 - RNA, 21 nt, Human
gcugugcaggauugaaagcag

SEQ ID NO: 215311 - RNA, 22 nt, Human
gcaggcagguggcaucuuguga

SEQ ID NO: 215312 - RNA, 22 nt, Human
agguccagugcucuuggugguu

SEQ ID NO: 215313 - RNA, 22 nt, Human
aagucagaauaauguuucuuuu

SEQ ID NO: 215314 - RNA, 22 nt, Human
accaggcaugauguggagcaca

SEQ ID NO: 215315 - RNA, 22 nt, Human
uaaaggauuuuguauaauauaa

SEQ ID NO: 215316 - RNA, 16 nt, Human
cacauauauuuauaug

SEQ ID NO: 215317 - RNA, 18 nt, Human
ucaugucucacaggugau

SEQ ID NO: 215318 - RNA, 22 nt, Human
gggugcugaggaagacagcagg

SEQ ID NO: 215319 - RNA, 22 nt, Human
guacauuuacugaugaaaagua

SEQ ID NO: 215320 - RNA, 23 nt, Human
agcaccauuacaguuugauuggg

SEQ ID NO: 215321 - RNA, 22 nt, Human
cccugaugacacgggcaucagg

SEQ ID NO: 215322 - RNA, 22 nt, Human
uucaaagcaagacacaauuccu

SEQ ID NO: 215323 - RNA, 21 nt, Human
agugugugauaggcaggaaga

SEQ ID NO: 215324 - RNA, 18 nt, Human
ucaggagacacagacgca

SEQ ID NO: 215325 - RNA, 22 nt, Human
gggcaggugccagcucccuguc

SEQ ID NO: 215326 - RNA, 22 nt, Human
gagcaggccuggggugaggccu

SEQ ID NO: 215327 - RNA, 22 nt, Human
agguggcaugagacuguaccag

SEQ ID NO: 215328 - RNA, 17 nt, Human
ugaggccugcaucagug

SEQ ID NO: 215329 - RNA, 22 nt, Human
uguccagagucacagagcucaa

SEQ ID NO: 215330 - RNA, 22 nt, Human
uggcaagaaacugaggccugcu

SEQ ID NO: 215331 - RNA, 22 nt, Human
guggcuucaucaacugugcuua

SEQ ID NO: 215332 - RNA, 22 nt, Human
aguccuagcccuggauccauca

SEQ ID NO: 215333 - RNA, 22 nt, Human
uucugacauauccagucucagu

SEQ ID NO: 215334 - RNA, 22 nt, Human
gaaugauaaauggaagcagcau

SEQ ID NO: 215335 - RNA, 22 nt, Human
aagaugauaggacuugcuuaag

SEQ ID NO: 215336 - RNA, 22 nt, Human
ugcuugaagccuacauucguca

SEQ ID NO: 215337 - RNA, 22 nt, Human
aaaaugaugcuguaauuuggca

SEQ ID NO: 215338 - RNA, 22 nt, Human
acaaggcucuaauuucauugaa

SEQ ID NO: 215339 - RNA, 22 nt, Human
accaaggagccacauacaaccu

SEQ ID NO: 215340 - RNA, 22 nt, Human
uaaguguuguuuucaagagaua

SEQ ID NO: 215341 - RNA, 22 nt, Human
aaggcuuuugggaauuuucaac

SEQ ID NO: 215342 - RNA, 22 nt, Human
cuguucauggaaaaauaguugg

SEQ ID NO: 215343 - RNA, 22 nt, Human
uucccagagaaggaugaaaaag

SEQ ID NO: 215344 - RNA, 22 nt, Human
uaagaauuaucucauggauaau

SEQ ID NO: 215345 - RNA, 22 nt, Human
uauauaauuuguaaaagcaccu

SEQ ID NO: 215346 - RNA, 22 nt, Human
auugcuggcccagaugcuuuag

SEQ ID NO: 215347 - RNA, 22 nt, Human
ugucauuuucuaaucuguuguc

SEQ ID NO: 215348 - RNA, 22 nt, Human
uuaaaugacuuuuauuauucuc

SEQ ID NO: 215349 - RNA, 22 nt, Human
gcuuucugauugcgaaaacaaa

SEQ ID NO: 215350 - RNA, 22 nt, Human
ucucaaauuuauacagaguuca

SEQ ID NO: 215351 - RNA, 21 nt, Human
aggaaguggccagauugggaa

SEQ ID NO: 215352 - RNA, 22 nt, Human
cauccagaguccaaggcugggc

SEQ ID NO: 215353 - RNA, 20 nt, Human
acucaaaucaccugccucaa

SEQ ID NO: 215354 - RNA, 22 nt, Human
uucucuuuuugcaucucaaccu

SEQ ID NO: 215355 - RNA, 22 nt, Human
uagcaagacaacuuuucucagu

SEQ ID NO: 215356 - RNA, 22 nt, Human
gcagucuaucuugugauuuaac

SEQ ID NO: 215357 - RNA, 22 nt, Human
gcugcccucugugacccggccc

SEQ ID NO: 215358 - RNA, 22 nt, Human
cuuucuuccauagggcccaguc

SEQ ID NO: 215359 - RNA, 16 nt, Human
agagguuuacagccug

SEQ ID NO: 215360 - RNA, 22 nt, Human
ucuucagagauguaacauaugg

SEQ ID NO: 215361 - RNA, 22 nt, Human
guucagagugggaaugaucacu

SEQ ID NO: 215362 - RNA, 22 nt, Human
ugaaacacugcgauaaaauccu

SEQ ID NO: 215363 - RNA, 21 nt, Human
uucuccccagcgaauccucgg

SEQ ID NO: 215364 - RNA, 22 nt, Human
gaaagcagcuaagucuuaugau

SEQ ID NO: 215365 - RNA, 22 nt, Human
cugagcccaggcgggagcugag

SEQ ID NO: 215366 - RNA, 22 nt, Human
uauuucuuguuauucucguuga

SEQ ID NO: 215367 - RNA, 22 nt, Human
gggucagggcuggcugucguca

SEQ ID NO: 215368 - RNA, 19 nt, Human
gaggugucuuuccugagua

SEQ ID NO: 215369 - RNA, 22 nt, Human
ucagacaggcuggacagcuugc

SEQ ID NO: 215370 - RNA, 22 nt, Human
acacaggaagcaauuucagagc

SEQ ID NO: 215371 - RNA, 21 nt, Human
gcagcagaggcuugacagaca

SEQ ID NO: 215372 - RNA, 22 nt, Human
guccugugaugaguaccaggug

SEQ ID NO: 215373 - RNA, 22 nt, Human
aguuauguccucagcaaaucaa

SEQ ID NO: 215374 - RNA, 22 nt, Human
aggaagaaaugugacuucaaac

SEQ ID NO: 215375 - RNA, 22 nt, Human
ccuggcugcaguuuuugcagaa

SEQ ID NO: 215376 - RNA, 22 nt, Human
uagaguguuguaauugaaaagg

SEQ ID NO: 215377 - RNA, 20 nt, Human
ggagcuggcauccagccucu

SEQ ID NO: 215378 - RNA, 22 nt, Human
gucucugugguacguuucaucc

SEQ ID NO: 215379 - RNA, 18 nt, Human
uugaggaguucacugucu

SEQ ID NO: 215380 - RNA, 22 nt, Human
agucagagaauguuuucaugga

SEQ ID NO: 215381 - RNA, 22 nt, Human
aaagauuucagaagccugugcc

SEQ ID NO: 215382 - RNA, 22 nt, Human
guccagccaggccugucucugg

SEQ ID NO: 215383 - RNA, 22 nt, Human
ucuuaaaugacugauaagagga

SEQ ID NO: 215384 - RNA, 22 nt, Human
uacuuguggcaguuugaauuua

SEQ ID NO: 215385 - RNA, 22 nt, Human
uaauuauucuagucacauagca

SEQ ID NO: 215386 - RNA, 22 nt, Human
gugcuggcaccccucuccaguu

SEQ ID NO: 215387 - RNA, 22 nt, Human
cacagcccccuugacacucugg

SEQ ID NO: 215388 - RNA, 22 nt, Human
agccaugcucaguuccuggagc

SEQ ID NO: 215389 - RNA, 22 nt, Human
aaagccaggaggagggcgcucg

SEQ ID NO: 215390 - RNA, 23 nt, Human
ccucaaauguagccuuuuuccca

SEQ ID NO: 215391 - RNA, 22 nt, Human
ugucaaagacagaaggaaaugg

SEQ ID NO: 215392 - RNA, 22 nt, Human
ugcagggcuuccucuuggaguu

SEQ ID NO: 215393 - RNA, 22 nt, Human
caucaucuggcuuuuagaaaaa

SEQ ID NO: 215394 - RNA, 22 nt, Human
ucuguucuugcuuuucuccaac

SEQ ID NO: 215395 - RNA, 22 nt, Human
caaaauaccacgacuuguuuua

SEQ ID NO: 215396 - RNA, 22 nt, Human
gagcuuggaugucuuuuguuca

SEQ ID NO: 215397 - RNA, 22 nt, Human
aggaccugagaguuggaaaucc

SEQ ID NO: 215398 - RNA, 22 nt, Human
uggauucuaaugcacuucaaau

SEQ ID NO: 215399 - RNA, 22 nt, Human
ggcucugcccgcggcugcccac

SEQ ID NO: 215400 - RNA, 22 nt, Human
gauaaauugcacuuuuucuuac

SEQ ID NO: 215401 - RNA, 23 nt, Human
uaggaagacagcaaaagaaugga

SEQ ID NO: 215402 - RNA, 22 nt, Human
ucugccuuggcaaccacagcuu

SEQ ID NO: 215403 - RNA, 22 nt, Human
ugccuggggauugcucugggcc

SEQ ID NO: 215404 - RNA, 20 nt, Human
aauaaacuacugagagaugu

SEQ ID NO: 215405 - RNA, 22 nt, Human
ugucucugggugauucaguccu

SEQ ID NO: 215406 - RNA, 21 nt, Human
agggaaaaggcugagugaggg

SEQ ID NO: 215407 - RNA, 22 nt, Human
ucuggcucagggcucugaggga

SEQ ID NO: 215408 - RNA, 22 nt, Human
agagcccugacggggacagaug

SEQ ID NO: 215409 - RNA, 22 nt, Human
cagaaaaccugacucuagaacu

SEQ ID NO: 215410 - RNA, 22 nt, Human
uuaucuugguguuuuaguaauu

SEQ ID NO: 215411 - RNA, 22 nt, Human
augucagucuuucugucucaga

SEQ ID NO: 215412 - RNA, 22 nt, Human
agcccagccugauucuacaccc

SEQ ID NO: 215413 - RNA, 22 nt, Human
gaacuacaggugcagcaaguga

SEQ ID NO: 215414 - RNA, 22 nt, Human
acacuugaggaauguggugauu

SEQ ID NO: 215415 - RNA, 22 nt, Human
ugcaaaggggacagaguccacu

SEQ ID NO: 215416 - RNA, 22 nt, Human
gcuuucugguucucaaagcacu

SEQ ID NO: 215417 - RNA, 22 nt, Human
uccaggguugugggcuucagca

SEQ ID NO: 215418 - RNA, 22 nt, Human
caugguuugaugacuggaagga

SEQ ID NO: 215419 - RNA, 22 nt, Human
ugguaccauuucccaggagugu

SEQ ID NO: 215420 - RNA, 22 nt, Human
ucuuuagauguuuagaggaaga

SEQ ID NO: 215421 - RNA, 22 nt, Human
gcaggucuggagggcacugggg

SEQ ID NO: 215422 - RNA, 22 nt, Human
gguccaggaucaaggcaucacc

SEQ ID NO: 215423 - RNA, 22 nt, Human
acagcagaccccagugccaugg

SEQ ID NO: 215424 - RNA, 22 nt, Human
augcagggaccuuugcuuuggu

SEQ ID NO: 215425 - RNA, 21 nt, Human
acaaaggaagucucuuuuaag

SEQ ID NO: 215426 - RNA, 22 nt, Human
ugggcaaaggcuguaacccauc

SEQ ID NO: 215427 - RNA, 22 nt, Human
gggagcuggagcuggaagacuc

SEQ ID NO: 215428 - RNA, 22 nt, Human
gcaggcaggagcccaacugccu

SEQ ID NO: 215429 - RNA, 22 nt, Human
uggagcugagagccaggcuggc

SEQ ID NO: 215430 - RNA, 22 nt, Human
uggacacaucacugcagccacu

SEQ ID NO: 215431 - RNA, 22 nt, Human
ucaaaggguagcccagggaaga

SEQ ID NO: 215432 - RNA, 23 nt, Human
ggcagcucucaucugaugacuga

SEQ ID NO: 215433 - RNA, 22 nt, Human
gaggccugaggcugccuggagc

SEQ ID NO: 215434 - RNA, 18 nt, Human
uggcagugagguaggcau

SEQ ID NO: 215435 - RNA, 22 nt, Human
uuugggaauuguagcugucuug

SEQ ID NO: 215436 - RNA, 22 nt, Human
agcuuguuaaggaugcauauua

SEQ ID NO: 215437 - RNA, 22 nt, Human
cagcugugggccugacguggca

SEQ ID NO: 215438 - RNA, 20 nt, Human
gggcuagaccagggcagagg

SEQ ID NO: 215439 - RNA, 22 nt, Human
ucacauucuagaauguuaucgu

SEQ ID NO: 215440 - RNA, 22 nt, Human
cuucagaaauaacaacaauuac

SEQ ID NO: 215441 - RNA, 22 nt, Human
ucaucugucauccacaaagcug

SEQ ID NO: 215442 - RNA, 22 nt, Human
uggaggagaccgcauuuuauuu

SEQ ID NO: 215443 - RNA, 22 nt, Human
acaagagcccuuucagauugac

SEQ ID NO: 215444 - RNA, 22 nt, Human
cugagcauggccgguccauggu

SEQ ID NO: 215445 - RNA, 22 nt, Human
acccucagcuggagauugaauu

SEQ ID NO: 215446 - RNA, 22 nt, Human
gcacagaacccuaucuuucgga

SEQ ID NO: 215447 - RNA, 22 nt, Human
cucucuguauguguauauuuau

SEQ ID NO: 215448 - RNA, 22 nt, Human
ucagggggaggagacugccagu

SEQ ID NO: 215449 - RNA, 22 nt, Human
caaggcuuggagagaaugccau

SEQ ID NO: 215450 - RNA, 22 nt, Human
aguggcugccaagauauaauuc

SEQ ID NO: 215451 - RNA, 23 nt, Human
cugcauauggagguuagcaacuc

SEQ ID NO: 215452 - RNA, 22 nt, Human
uaccuggcuggggaauagccag

SEQ ID NO: 215453 - RNA, 22 nt, Human
caggcugcagugcaguggcuau

SEQ ID NO: 215454 - RNA, 22 nt, Human
ucacacauaaaaagaagacuag

SEQ ID NO: 215455 - RNA, 22 nt, Human
ucuggagccuuggaugggaaag

SEQ ID NO: 215456 - RNA, 22 nt, Human
cuggcuuucauuucaagcacgu

SEQ ID NO: 215457 - RNA, 18 nt, Human
cuccaaggucucuggcuu

SEQ ID NO: 215458 - RNA, 22 nt, Human
gacaggugcuaagggaccuggc

SEQ ID NO: 215459 - RNA, 22 nt, Human
uuuguuacauuaaaaaguaggu

SEQ ID NO: 215460 - RNA, 22 nt, Human
gaguucaguguuucuaguagug

SEQ ID NO: 215461 - RNA, 22 nt, Human
agcuccugauacaugcaggaau

SEQ ID NO: 215462 - RNA, 22 nt, Human
uaggugucuuucuguccuuguu

SEQ ID NO: 215463 - RNA, 22 nt, Human
gucaggaugagggaugaggagu

SEQ ID NO: 215464 - RNA, 22 nt, Human
ugagaaaacucaaagacagauc

SEQ ID NO: 215465 - RNA, 20 nt, Human
agguccuguuccuugucucc

SEQ ID NO: 215466 - RNA, 22 nt, Human
cuggagcuccagggucuccucu

SEQ ID NO: 215467 - RNA, 22 nt, Human
agcaaacauucagcagauuggc

SEQ ID NO: 215468 - RNA, 20 nt, Human
uccuggaggcuucauccaua

SEQ ID NO: 215469 - RNA, 22 nt, Human
aggagggaauaagaaagaguca

SEQ ID NO: 215470 - RNA, 17 nt, Human
aaaauucuguaaagagg

SEQ ID NO: 215471 - RNA, 22 nt, Human
aggcucagggacggggccccuu

SEQ ID NO: 215472 - RNA, 22 nt, Human
guccagccccugacucccaggc

SEQ ID NO: 215473 - RNA, 22 nt, Human
gaggagaggcuggacgcgguga

SEQ ID NO: 215474 - RNA, 22 nt, Human
aucauaagacccagccaguauu

SEQ ID NO: 215475 - RNA, 22 nt, Human
ugugugcacaaagaguacaugg

SEQ ID NO: 215476 - RNA, 22 nt, Human
augaggcaauagaauauugaau

SEQ ID NO: 215477 - RNA, 22 nt, Human
ucccaggcucuucaaggaagac

SEQ ID NO: 215478 - RNA, 22 nt, Human
acauauuaacugcacuacacua

SEQ ID NO: 215479 - RNA, 22 nt, Human
acacauauguggcaacuguaga

SEQ ID NO: 215480 - RNA, 22 nt, Human
ugaguggagacuguguguagag

SEQ ID NO: 215481 - RNA, 22 nt, Human
ucuuacgaauucuuagaggaca

SEQ ID NO: 215482 - RNA, 22 nt, Human
aggaugagauugcuguguugua

SEQ ID NO: 215483 - RNA, 22 nt, Human
uauaucuggauggacugcagaa

SEQ ID NO: 215484 - RNA, 22 nt, Human
cugcagaggucuugcugauggu

SEQ ID NO: 215485 - RNA, 22 nt, Human
ugcaaaaacagccuugaggccu

SEQ ID NO: 215486 - RNA, 22 nt, Human
auggcaggauacccaguccggc

SEQ ID NO: 215487 - RNA, 22 nt, Human
uggcccagugcuuaugcucuga

SEQ ID NO: 215488 - RNA, 22 nt, Human
gugggaagagccaauuggggua

SEQ ID NO: 215489 - RNA, 21 nt, Human
gccaagaacaagacagacaug

SEQ ID NO: 215490 - RNA, 22 nt, Human
uccaggaggcucugguugacgu

SEQ ID NO: 215491 - RNA, 22 nt, Human
ucauaaaaugcuccugauauug

SEQ ID NO: 215492 - RNA, 22 nt, Human
uggcucagagcagggacucugg

SEQ ID NO: 215493 - RNA, 22 nt, Human
acagccaaggaauuaggaaggg

SEQ ID NO: 215494 - RNA, 22 nt, Human
ucacugcgcugacugcuacgau

SEQ ID NO: 215495 - RNA, 22 nt, Human
uggggcagcagaccuuucuugg

SEQ ID NO: 215496 - RNA, 18 nt, Human
uuucacagauucaugacu

SEQ ID NO: 215497 - RNA, 22 nt, Human
ugggcaggcaagugaauaccuu

SEQ ID NO: 215498 - RNA, 22 nt, Human
uaguuacauaaaguggacuguu

SEQ ID NO: 215499 - RNA, 22 nt, Human
agggggcaucagguccuggcuc

SEQ ID NO: 215500 - RNA, 22 nt, Human
cagcaggauaugguggagagag

SEQ ID NO: 215501 - RNA, 22 nt, Human
uccuggcagguguauuggcugu

SEQ ID NO: 215502 - RNA, 22 nt, Human
uccuggcuaaugcugcugaugg

SEQ ID NO: 215503 - RNA, 18 nt, Human
acauacauucugucugca

SEQ ID NO: 215504 - RNA, 22 nt, Human
agaaggccaugucuugguacuu

SEQ ID NO: 215505 - RNA, 21 nt, Human
ggacagaggagaaggcacccu

SEQ ID NO: 215506 - RNA, 22 nt, Human
uccuggccuccguucucugcau

SEQ ID NO: 215507 - RNA, 22 nt, Human
ucucaaucaaacaugucugacu

SEQ ID NO: 215508 - RNA, 22 nt, Human
ucuuugaaguaucuuaaauggu

SEQ ID NO: 215509 - RNA, 22 nt, Human
cagaagucuuucuguuucaccu

SEQ ID NO: 215510 - RNA, 22 nt, Human
uacccucacgagacuucaaguc

SEQ ID NO: 215511 - RNA, 22 nt, Human
auggcugcagccggcccugcgc

SEQ ID NO: 215512 - RNA, 22 nt, Human
aagucagacagcugagcugccu

SEQ ID NO: 215513 - RNA, 22 nt, Human
cuccagggaugagacagaguag

SEQ ID NO: 215514 - RNA, 22 nt, Human
gaagaggcaauugaauaagcua

SEQ ID NO: 215515 - RNA, 22 nt, Human
gcaugugugucacuuuccugcc

SEQ ID NO: 215516 - RNA, 22 nt, Human
uauaacugagaagauacauagu

SEQ ID NO: 215517 - RNA, 22 nt, Human
gcucuaggaggugugcuuagaa

SEQ ID NO: 215518 - RNA, 22 nt, Human
aggccucuugucuuccucacau

SEQ ID NO: 215519 - RNA, 22 nt, Human
aaggcaguagguguuucaaacu

SEQ ID NO: 215520 - RNA, 22 nt, Human
agggcuccugaggcccuucugg

SEQ ID NO: 215521 - RNA, 22 nt, Human
cccacaggcccugcugccuuga

SEQ ID NO: 215522 - RNA, 22 nt, Human
aacacacgccuccuccaugggg

SEQ ID NO: 215523 - RNA, 23 nt, Human
uucaaaacuggaaaaucagaugc

SEQ ID NO: 215524 - RNA, 22 nt, Human
acuguuuucuuagcucccugcu

SEQ ID NO: 215525 - RNA, 22 nt, Human
ccaggagcaggagcuggacaga

SEQ ID NO: 215526 - RNA, 22 nt, Human
uucugucuucucgguuguuuac

SEQ ID NO: 215527 - RNA, 22 nt, Human
cauuggaaugcauuugaagaga

SEQ ID NO: 215528 - RNA, 22 nt, Human
augaaacagugaauuagucaag

SEQ ID NO: 215529 - RNA, 22 nt, Human
caggucuuuguugcagcaugga

SEQ ID NO: 215530 - RNA, 22 nt, Human
cccccucugccgggguccuuca

SEQ ID NO: 215531 - RNA, 22 nt, Human
ccucaaauaaguuuuauuuauc

SEQ ID NO: 215532 - RNA, 22 nt, Human
ugaggcucagugagcccugcag

SEQ ID NO: 215533 - RNA, 20 nt, Human
ccugccugccucggcucauu

SEQ ID NO: 215534 - RNA, 22 nt, Human
uagcgagguguuucuaggacug

SEQ ID NO: 215535 - RNA, 22 nt, Human
cccucucugacuucugaacuug

SEQ ID NO: 215536 - RNA, 22 nt, Human
ccucugggccuggaagggcagu

SEQ ID NO: 215537 - RNA, 22 nt, Human
uugaggagguaugacuagguac

SEQ ID NO: 215538 - RNA, 22 nt, Human
aggaagaaacugagcucugaca

SEQ ID NO: 215539 - RNA, 22 nt, Human
cagcugucucagggaggugauc

SEQ ID NO: 215540 - RNA, 22 nt, Human
gcccuaccucaguccagaucug

SEQ ID NO: 215541 - RNA, 19 nt, Human
ugcaagugucuuggacaag

SEQ ID NO: 215542 - RNA, 22 nt, Human
uuccaggaaaacaguuggaagu

SEQ ID NO: 215543 - RNA, 22 nt, Human
uuauuccaguaaucucuguaau

SEQ ID NO: 215544 - RNA, 22 nt, Human
aggcccauguucacuugcucag

SEQ ID NO: 215545 - RNA, 22 nt, Human
ucagaggauuggacuuuuaugu

SEQ ID NO: 215546 - RNA, 22 nt, Human
ggccagcagucacagggucaga

SEQ ID NO: 215547 - RNA, 16 nt, Human
gcacacacaucaauga

SEQ ID NO: 215548 - RNA, 22 nt, Human
gguguccucaugauuuucuaga

SEQ ID NO: 215549 - RNA, 22 nt, Human
gcccagcaggacagagugguuu

SEQ ID NO: 215550 - RNA, 22 nt, Human
uacccagaagauugucagcaaa

SEQ ID NO: 215551 - RNA, 22 nt, Human
aaacacaccuuuggaacuguga

SEQ ID NO: 215552 - RNA, 22 nt, Human
agucacagaaacccaggugugg

SEQ ID NO: 215553 - RNA, 22 nt, Human
gcucagaguuaaauauagugcu

SEQ ID NO: 215554 - RNA, 22 nt, Human
ggcuucucccuucuucugauug

SEQ ID NO: 215555 - RNA, 22 nt, Human
uaggagaggugaauggcacacu

SEQ ID NO: 215556 - RNA, 22 nt, Human
gacaggggucccucugggcugu

SEQ ID NO: 215557 - RNA, 22 nt, Human
ccaugcagugcuggagcugauu

SEQ ID NO: 215558 - RNA, 22 nt, Human
ucugaaucacagucauucagcu

SEQ ID NO: 215559 - RNA, 22 nt, Human
ucagggagggaccugaggcugg

SEQ ID NO: 215560 - RNA, 22 nt, Human
cuuauauuugucaacuuuacaa

SEQ ID NO: 215561 - RNA, 22 nt, Human
auauguuacucuuucaagcaga

SEQ ID NO: 215562 - RNA, 22 nt, Human
cgccugcucuguuuccaugugg

SEQ ID NO: 215563 - RNA, 22 nt, Human
uggcuucuuucuuuccaugugu

SEQ ID NO: 215564 - RNA, 22 nt, Human
gugagggcagaacccccaggcc

SEQ ID NO: 215565 - RNA, 22 nt, Human
caguggagagacuuuuacucuu

SEQ ID NO: 215566 - RNA, 22 nt, Human
ugguauguaauaaguguucuaa

SEQ ID NO: 215567 - RNA, 22 nt, Human
gcugggugucacggggcucgug

SEQ ID NO: 215568 - RNA, 22 nt, Human
caggcaggagccagggauucca

SEQ ID NO: 215569 - RNA, 22 nt, Human
ucaucuuaggugaugagacagu

SEQ ID NO: 215570 - RNA, 22 nt, Human
cacuuuauuauaaauuugagag

SEQ ID NO: 215571 - RNA, 19 nt, Human
gcagugucaugguaggagc

SEQ ID NO: 215572 - RNA, 22 nt, Human
auugucuucuggucuuaucuuu

SEQ ID NO: 215573 - RNA, 22 nt, Human
gcacccaggcuugggcagcaac

SEQ ID NO: 215574 - RNA, 22 nt, Human
ugaauccagagcuauuucgucc

SEQ ID NO: 215575 - RNA, 19 nt, Human
cccaggcuacauggagagg

SEQ ID NO: 215576 - RNA, 22 nt, Human
cucagcagcagggaagagguca

SEQ ID NO: 215577 - RNA, 22 nt, Human
uggcaggucaugaguggccacc

SEQ ID NO: 215578 - RNA, 22 nt, Human
gaacaguacuaagagcuuuaca

SEQ ID NO: 215579 - RNA, 23 nt, Human
acugagggccacuuccaucguga

SEQ ID NO: 215580 - RNA, 22 nt, Human
ucuuucugcacuuaguggggcu

SEQ ID NO: 215581 - RNA, 22 nt, Human
agcccugucucucacuccaggu

SEQ ID NO: 215582 - RNA, 22 nt, Human
caguuauaagacuaagcuauuc

SEQ ID NO: 215583 - RNA, 22 nt, Human
auaguacagauccauuaauuau

SEQ ID NO: 215584 - RNA, 22 nt, Human
gcaaacaugugcucauuuugug

SEQ ID NO: 215585 - RNA, 22 nt, Human
uaggcagauuccauauuuuggc

SEQ ID NO: 215586 - RNA, 22 nt, Human
ugggagcaggugugcuagggaa

SEQ ID NO: 215587 - RNA, 22 nt, Human
aguaaaauuguauuggaaaaca

SEQ ID NO: 215588 - RNA, 22 nt, Human
ggguccagcgacagcaggcuca

SEQ ID NO: 215589 - RNA, 22 nt, Human
agcccuugaguguaucucaaau

SEQ ID NO: 215590 - RNA, 22 nt, Human
gcccuccuuugcuucuccuagu

SEQ ID NO: 215591 - RNA, 22 nt, Human
gagcucaggagcaucagaagaa

SEQ ID NO: 215592 - RNA, 22 nt, Human
auauuaggaguuaaauguauua

SEQ ID NO: 215593 - RNA, 20 nt, Human
gaggcugcggacugcuggac

SEQ ID NO: 215594 - RNA, 22 nt, Human
uucuucaguuugguaaauguaa

SEQ ID NO: 215595 - RNA, 22 nt, Human
uuugcagcaaggagagagcauu

SEQ ID NO: 215596 - RNA, 22 nt, Human
cagugagggcccccuuccaggu

SEQ ID NO: 215597 - RNA, 22 nt, Human
uaggaaacuaauacagucugga

SEQ ID NO: 215598 - RNA, 22 nt, Human
aaguugaaucaguaacacaguu

SEQ ID NO: 215599 - RNA, 22 nt, Human
uacagcugcaaggguuucuggg

SEQ ID NO: 215600 - RNA, 22 nt, Human
agagcuggcugguagcccugau

SEQ ID NO: 215601 - RNA, 22 nt, Human
aacaguuuauguaaauguccag

SEQ ID NO: 215602 - RNA, 22 nt, Human
gcugcugucagcaggccuuguu

SEQ ID NO: 215603 - RNA, 22 nt, Human
uaugauguguaccuaagucacc

SEQ ID NO: 215604 - RNA, 22 nt, Human
gcaaauagaagauucuguugac

SEQ ID NO: 215605 - RNA, 19 nt, Human
ccuggguccacucagacua

SEQ ID NO: 215606 - RNA, 19 nt, Human
aggugcuggugaggguguu

SEQ ID NO: 215607 - RNA, 22 nt, Human
aaguggagccagggaaacugaa

SEQ ID NO: 215608 - RNA, 22 nt, Human
aacuguucacacugaugugacg

SEQ ID NO: 215609 - RNA, 22 nt, Human
ccuaauuaucucccaaagaucc

SEQ ID NO: 215610 - RNA, 22 nt, Human
cauguuucugagaaaaguagga

SEQ ID NO: 215611 - RNA, 23 nt, Human
ugccagaggcagucacaguggug

SEQ ID NO: 215612 - RNA, 22 nt, Human
uguagaaagcucuucugaaauc

SEQ ID NO: 215613 - RNA, 22 nt, Human
uucuaaacuucaauucuaaauu

SEQ ID NO: 215614 - RNA, 22 nt, Human
auuuggaaauguaagaaugcaa

SEQ ID NO: 215615 - RNA, 22 nt, Human
acugggagggucuugaagaggg

SEQ ID NO: 215616 - RNA, 22 nt, Human
gcagggccuuagcagcggcugc

SEQ ID NO: 215617 - RNA, 22 nt, Human
uugcaaaucacaagagcagagc

SEQ ID NO: 215618 - RNA, 22 nt, Human
acagcagggaauaugggaauug

SEQ ID NO: 215619 - RNA, 22 nt, Human
ucccucaucucacaugugugug

SEQ ID NO: 215620 - RNA, 22 nt, Human
cacuguacagcauuaacaaggc

SEQ ID NO: 215621 - RNA, 22 nt, Human
ucucucuugucaccccaucugc

SEQ ID NO: 215622 - RNA, 22 nt, Human
uuguuacuaagccuuuaaauag

SEQ ID NO: 215623 - RNA, 23 nt, Human
acuuugcagagccccuugaaaca

SEQ ID NO: 215624 - RNA, 22 nt, Human
aucauuccacauguaccacuag

SEQ ID NO: 215625 - RNA, 20 nt, Human
cugcccagccacugagggau

SEQ ID NO: 215626 - RNA, 21 nt, Human
ccuccaggagcagagcccuga

SEQ ID NO: 215627 - RNA, 20 nt, Human
ucagugcagauuguccaagu

SEQ ID NO: 215628 - RNA, 22 nt, Human
caugucacuuuaacaaauuagu

SEQ ID NO: 215629 - RNA, 22 nt, Human
aagcaggugugagccagugggc

SEQ ID NO: 215630 - RNA, 22 nt, Human
ucugcaggaugcaaaguguaca

SEQ ID NO: 215631 - RNA, 22 nt, Human
uccauauaccugcagccugguu

SEQ ID NO: 215632 - RNA, 22 nt, Human
uuccuaacaaacuucagugaau

SEQ ID NO: 215633 - RNA, 23 nt, Human
uguaaaagcauuugucagccugg

SEQ ID NO: 215634 - RNA, 22 nt, Human
acccaggguagagugcaguggc

SEQ ID NO: 215635 - RNA, 22 nt, Human
ccuggcaggccccuccuggauu

SEQ ID NO: 215636 - RNA, 22 nt, Human
uuagcuuuuaagugugcuacau

SEQ ID NO: 215637 - RNA, 22 nt, Human
caccagccagagugacagcucc

SEQ ID NO: 215638 - RNA, 22 nt, Human
aaaugcuucaccucauuaaacu

SEQ ID NO: 215639 - RNA, 22 nt, Human
ugcagcugggucugcccuggcu

SEQ ID NO: 215640 - RNA, 22 nt, Human
augaggcaugugaggagaaggg

SEQ ID NO: 215641 - RNA, 22 nt, Human
uggucugguuauuucuuaauga

SEQ ID NO: 215642 - RNA, 22 nt, Human
gcuucccauuauggaaacucuu

SEQ ID NO: 215643 - RNA, 22 nt, Human
gcugucugcugggucgcucagg

SEQ ID NO: 215644 - RNA, 22 nt, Human
ucagcaggguuugacuucuaau

SEQ ID NO: 215645 - RNA, 22 nt, Human
uggcccagagcacugcugggca

SEQ ID NO: 215646 - RNA, 22 nt, Human
auauuauucuaguaacagugau

SEQ ID NO: 215647 - RNA, 22 nt, Human
ugggaaagccagcagugucacc

SEQ ID NO: 215648 - RNA, 21 nt, Human
uggcuuugcccugcuugcccc

SEQ ID NO: 215649 - RNA, 22 nt, Human
ugacagacagcuucucauuuua

SEQ ID NO: 215650 - RNA, 22 nt, Human
uagcuauuguugguaguuaccc

SEQ ID NO: 215651 - RNA, 22 nt, Human
auaaauuuucuugcuguacuua

SEQ ID NO: 215652 - RNA, 22 nt, Human
gagcugaaauaugaagccaauu

SEQ ID NO: 215653 - RNA, 22 nt, Human
ucuuccagcuccccacgguguc

SEQ ID NO: 215654 - RNA, 22 nt, Human
acacauuaggcagugcuuaaau

SEQ ID NO: 215655 - RNA, 22 nt, Human
cuggcugggcagacagaaugcu

SEQ ID NO: 215656 - RNA, 22 nt, Human
ggagaagcaggugcuuuggguc

SEQ ID NO: 215657 - RNA, 22 nt, Human
cuacugaguccuucagcugcca

SEQ ID NO: 215658 - RNA, 22 nt, Human
uguuuucauggagaugguggcg

SEQ ID NO: 215659 - RNA, 22 nt, Human
gccaccccaaccucccuaaguu

SEQ ID NO: 215660 - RNA, 22 nt, Human
uuguagcuuuuuaaugugcugc

SEQ ID NO: 215661 - RNA, 22 nt, Human
uuggccuaccugggaaugcugg

SEQ ID NO: 215662 - RNA, 19 nt, Human
uugcuucaugucuuuugcu

SEQ ID NO: 215663 - RNA, 22 nt, Human
auguuucauuuagauaucaggc

SEQ ID NO: 215664 - RNA, 22 nt, Human
cccaggaaugagcaggcagggg

SEQ ID NO: 215665 - RNA, 22 nt, Human
cuacuucugugaugaaacuaca

SEQ ID NO: 215666 - RNA, 22 nt, Human
cagggacuacagccagcccucc

SEQ ID NO: 215667 - RNA, 22 nt, Human
uuacauucaaggaacucauucu

SEQ ID NO: 215668 - RNA, 22 nt, Human
aggcucuguaugaagguuuggg

SEQ ID NO: 215669 - RNA, 22 nt, Human
gcuggguccaugguccucgggu

SEQ ID NO: 215670 - RNA, 20 nt, Human
cuguuaaaagguaugaauuc

SEQ ID NO: 215671 - RNA, 22 nt, Human
aaggcuagagagguauucaagu

SEQ ID NO: 215672 - RNA, 20 nt, Human
uguguccaucaucugggcac

SEQ ID NO: 215673 - RNA, 17 nt, Human
gagcucuguggcacaag

SEQ ID NO: 215674 - RNA, 22 nt, Human
gagccugggacugggggucaug

SEQ ID NO: 215675 - RNA, 22 nt, Human
gaugauggguugaugugaaggg

SEQ ID NO: 215676 - RNA, 22 nt, Human
cugggccuggagcccacgagcc

SEQ ID NO: 215677 - RNA, 22 nt, Human
uuccugaggcucaucggagucg

SEQ ID NO: 215678 - RNA, 22 nt, Human
ugaugaggcauaugcuacacau

SEQ ID NO: 215679 - RNA, 22 nt, Human
cauuuguaggaugcuucuuguu

SEQ ID NO: 215680 - RNA, 22 nt, Human
gggcuucugggcaccacucccu

SEQ ID NO: 215681 - RNA, 22 nt, Human
guuguacagcauccagugcaga

SEQ ID NO: 215682 - RNA, 19 nt, Human
ugcuguccucagaguaagu

SEQ ID NO: 215683 - RNA, 22 nt, Human
aguuauuuaaaaugauuguccu

SEQ ID NO: 215684 - RNA, 22 nt, Human
cucugucccagacccaccucuc

SEQ ID NO: 215685 - RNA, 22 nt, Human
agaaggaguguacaggucaugc

SEQ ID NO: 215686 - RNA, 22 nt, Human
ucucagagaagugaugagcaau

SEQ ID NO: 215687 - RNA, 22 nt, Human
uacacaugugcacgcguguccu

SEQ ID NO: 215688 - RNA, 22 nt, Human
uuguauuucgaugcacguguag

SEQ ID NO: 215689 - RNA, 22 nt, Human
uuacagugaaguaccauuaaaa

SEQ ID NO: 215690 - RNA, 22 nt, Human
uauacaaugaguacauucuggg

SEQ ID NO: 215691 - RNA, 22 nt, Human
gaaauauucuugucuuguuuuc

SEQ ID NO: 215692 - RNA, 22 nt, Human
ucacucuguuagaggaaagugc

SEQ ID NO: 215693 - RNA, 22 nt, Human
uaguauuuuagaaaaccaugaa

SEQ ID NO: 215694 - RNA, 22 nt, Human
agacacaggauucugcauuucu

SEQ ID NO: 215695 - RNA, 22 nt, Human
acagcaugagaguagcaaaagg

SEQ ID NO: 215696 - RNA, 22 nt, Human
gccuacaugcuuuuaguguuuc

SEQ ID NO: 215697 - RNA, 22 nt, Human
ggcugcugcccaccccugcaug

SEQ ID NO: 215698 - RNA, 22 nt, Human
uggguuaacaguuuauaccaga

SEQ ID NO: 215699 - RNA, 22 nt, Human
accugcagccacuucucuccuu

SEQ ID NO: 215700 - RNA, 22 nt, Human
aagcuguucugaaucaguaagu

SEQ ID NO: 215701 - RNA, 22 nt, Human
uuucuguagggauuucacaguu

SEQ ID NO: 215702 - RNA, 22 nt, Human
gucaggcauuuaggaugaguuc

SEQ ID NO: 215703 - RNA, 20 nt, Human
gcaaggcacagugaggaggg

SEQ ID NO: 215704 - RNA, 22 nt, Human
cugcugaaguuguuggucuuuu

SEQ ID NO: 215705 - RNA, 22 nt, Human
aggcugaggcuggcagcuccag

SEQ ID NO: 215706 - RNA, 22 nt, Human
agucucucuccucgugguaacc

SEQ ID NO: 215707 - RNA, 22 nt, Human
gcccugcccugagccguagacc

SEQ ID NO: 215708 - RNA, 22 nt, Human
gccugguggacacugggcauca

SEQ ID NO: 215709 - RNA, 22 nt, Human
agucugguugauuccuuugcac

SEQ ID NO: 215710 - RNA, 22 nt, Human
uacuuucuguccuucuguuaaa

SEQ ID NO: 215711 - RNA, 22 nt, Human
caauggauauuuuaugugagaa

SEQ ID NO: 215712 - RNA, 22 nt, Human
aguaaaaauugaggugcaaaau

SEQ ID NO: 215713 - RNA, 22 nt, Human
ccagaggugaacaggaggcugu

SEQ ID NO: 215714 - RNA, 22 nt, Human
cacauucagguggcauguuaga

SEQ ID NO: 215715 - RNA, 22 nt, Human
augcaucuauucccaagggcag

SEQ ID NO: 215716 - RNA, 22 nt, Human
ccauccuaucugaccuacuugu

SEQ ID NO: 215717 - RNA, 22 nt, Human
caaggccuugcugucuccuccu

SEQ ID NO: 215718 - RNA, 20 nt, Human
agcaaaaugcaagauuuuca

SEQ ID NO: 215719 - RNA, 22 nt, Human
ucacaggguuuggaagccuccu

SEQ ID NO: 215720 - RNA, 20 nt, Human
uucuacaaaacugauucuga

SEQ ID NO: 215721 - RNA, 22 nt, Human
aaagugguugcugucagccucu

SEQ ID NO: 215722 - RNA, 22 nt, Human
ucaggcuuugggucaggcucug

SEQ ID NO: 215723 - RNA, 20 nt, Human
aauaaaagaagccuucaccc

SEQ ID NO: 215724 - RNA, 22 nt, Human
ggccucucaugcccagagccaa

SEQ ID NO: 215725 - RNA, 22 nt, Human
cuguggaauugaugcuuagugu

SEQ ID NO: 215726 - RNA, 22 nt, Human
gaggcuggagauauuccaaucu

SEQ ID NO: 215727 - RNA, 23 nt, Human
accaugaugggagugcaaauaag

SEQ ID NO: 215728 - RNA, 22 nt, Human
aagucuaaguuuguaacuugga

SEQ ID NO: 215729 - RNA, 22 nt, Human
cacaugcaccagaaaucaacau

SEQ ID NO: 215730 - RNA, 22 nt, Human
uagcaggguuuugaagaggguu

SEQ ID NO: 215731 - RNA, 20 nt, Human
ugcuuuuauaccuauaauga

SEQ ID NO: 215732 - RNA, 22 nt, Human
ugaaggcuuggauuggucauuu

SEQ ID NO: 215733 - RNA, 22 nt, Human
cugggcucugcaguugauguuu

SEQ ID NO: 215734 - RNA, 22 nt, Human
uugagucugcccaaauuaagaa

SEQ ID NO: 215735 - RNA, 23 nt, Human
ggaggcacuuaggcagagcagag

SEQ ID NO: 215736 - RNA, 22 nt, Human
aucccaccucaaucugaagcuc

SEQ ID NO: 215737 - RNA, 22 nt, Human
aguuuauagcccagauucaugg

SEQ ID NO: 215738 - RNA, 22 nt, Human
ucaggaaauggacaucuuugcu

SEQ ID NO: 215739 - RNA, 22 nt, Human
cuggaaagauuucuuuggaguc

SEQ ID NO: 215740 - RNA, 22 nt, Human
gccugcaggcuguaguuuguga

SEQ ID NO: 215741 - RNA, 22 nt, Human
uugaggagaagacuuugcuucc

SEQ ID NO: 215742 - RNA, 22 nt, Human
gggacaucuuucuagucagggu

SEQ ID NO: 215743 - RNA, 22 nt, Human
uuccagagcaguuuucagauca

SEQ ID NO: 215744 - RNA, 22 nt, Human
caaggacacugagcuuuguaaa

SEQ ID NO: 215745 - RNA, 22 nt, Human
gacuuuauuuccuuauuuguga

SEQ ID NO: 215746 - RNA, 22 nt, Human
cugcugagaaaagacugaggga

SEQ ID NO: 215747 - RNA, 22 nt, Human
caaaguauauuggauugaaugg

SEQ ID NO: 215748 - RNA, 22 nt, Human
gaaaugaaacaggcuuuuaagg

SEQ ID NO: 215749 - RNA, 22 nt, Human
uguuccuucacagcaguggaca

SEQ ID NO: 215750 - RNA, 17 nt, Human
uugagucuggggucuac

SEQ ID NO: 215751 - RNA, 22 nt, Human
uucuuuggggucuccagcauag

SEQ ID NO: 215752 - RNA, 22 nt, Human
cagcugaacauguagagcaucu

SEQ ID NO: 215753 - RNA, 22 nt, Human
gauccugugguuuuccugugca

SEQ ID NO: 215754 - RNA, 22 nt, Human
ucacagaaggagggaagcuagu

SEQ ID NO: 215755 - RNA, 22 nt, Human
uauuuguuucuaguggcagcaa

SEQ ID NO: 215756 - RNA, 22 nt, Human
caucauuuuauuaaccaagaaa

SEQ ID NO: 215757 - RNA, 22 nt, Human
ucuggcccagccccugagguca

SEQ ID NO: 215758 - RNA, 22 nt, Human
uaaauguuuagucuuauuuggg

SEQ ID NO: 215759 - RNA, 22 nt, Human
aggagcucucccaugcugcaga

SEQ ID NO: 215760 - RNA, 22 nt, Human
ugcacccucaucagucaaaugg

SEQ ID NO: 215761 - RNA, 21 nt, Human
uauuucuuugacucucucccu

SEQ ID NO: 215762 - RNA, 22 nt, Human
uuguccuggagguuaauagagu

SEQ ID NO: 215763 - RNA, 22 nt, Human
cuggcuggccauguagagauga

SEQ ID NO: 215764 - RNA, 22 nt, Human
aauagcauagaguuaaaaugca

SEQ ID NO: 215765 - RNA, 23 nt, Human
ucuuuccuaaugaaacagugaaa

SEQ ID NO: 215766 - RNA, 22 nt, Human
ggcuccucucuggccgcucccg

SEQ ID NO: 215767 - RNA, 22 nt, Human
uucaggaauaauuaucauauga

SEQ ID NO: 215768 - RNA, 22 nt, Human
acauagaaccuggcacauagua

SEQ ID NO: 215769 - RNA, 22 nt, Human
uagcuugaguguuucauaaaua

SEQ ID NO: 215770 - RNA, 22 nt, Human
aagcuguuggcagauagcucug

SEQ ID NO: 215771 - RNA, 22 nt, Human
caagaacauugugaucacuuca

SEQ ID NO: 215772 - RNA, 22 nt, Human
acaggcacugucaagucaugaa

SEQ ID NO: 215773 - RNA, 22 nt, Human
uguacaguauauuucaaagcca

SEQ ID NO: 215774 - RNA, 22 nt, Human
aggaaaugcaggcaaauacucu

SEQ ID NO: 215775 - RNA, 22 nt, Human
acacaggaagucagcacugaug

SEQ ID NO: 215776 - RNA, 22 nt, Human
gccucagugauaugugggacaa

SEQ ID NO: 215777 - RNA, 22 nt, Human
cagcugagaagugauagcugca

SEQ ID NO: 215778 - RNA, 22 nt, Human
cucaggcacgggucagugagcg

SEQ ID NO: 215779 - RNA, 21 nt, Human
acagcagggcuggcaugacag

SEQ ID NO: 215780 - RNA, 22 nt, Human
ggguacagagagaugagguaac

SEQ ID NO: 215781 - RNA, 22 nt, Human
aagcccuuggcgcacaccgggc

SEQ ID NO: 215782 - RNA, 22 nt, Human
cauguguccacccuugaacaca

SEQ ID NO: 215783 - RNA, 22 nt, Human
aagaugcuugagaacuguuuga

SEQ ID NO: 215784 - RNA, 22 nt, Human
ucuggcuccacucugugcaugc

SEQ ID NO: 215785 - RNA, 22 nt, Human
ucaggaacccuggucuccugcu

SEQ ID NO: 215786 - RNA, 22 nt, Human
aaggagaaaugguagaugugca

SEQ ID NO: 215787 - RNA, 22 nt, Human
uucugggcucucuuucugugug

SEQ ID NO: 215788 - RNA, 21 nt, Human
ucacacacguuuccaagggca

SEQ ID NO: 215789 - RNA, 22 nt, Human
uuucucugccaguuauuuuccu

SEQ ID NO: 215790 - RNA, 20 nt, Human
ugaucaugugaaagucaugu

SEQ ID NO: 215791 - RNA, 22 nt, Human
acuggcagagacccugauggcc

SEQ ID NO: 215792 - RNA, 22 nt, Human
ucaggcuguuccuguccaaaau

SEQ ID NO: 215793 - RNA, 22 nt, Human
ucaggcagaugcagggauggau

SEQ ID NO: 215794 - RNA, 22 nt, Human
ucccugagaaagcccaggaggu

SEQ ID NO: 215795 - RNA, 22 nt, Human
ccuggcaguggugaagaagagg

SEQ ID NO: 215796 - RNA, 22 nt, Human
uuaguuauacuacugaauggag

SEQ ID NO: 215797 - RNA, 16 nt, Human
gaugagucuuaguggu

SEQ ID NO: 215798 - RNA, 22 nt, Human
uucugacacauuacuacaugga

SEQ ID NO: 215799 - RNA, 22 nt, Human
ccuguccuccggagcgggcugu

SEQ ID NO: 215800 - RNA, 22 nt, Human
uagggcaggugaagaaaagcua

SEQ ID NO: 215801 - RNA, 22 nt, Human
agagcaccccgggaagagcaag

SEQ ID NO: 215802 - RNA, 22 nt, Human
gugcucagguucccaugagugc

SEQ ID NO: 215803 - RNA, 22 nt, Human
ggcagugccugaugcugcagga

SEQ ID NO: 215804 - RNA, 22 nt, Human
ugaggccucuugguauggugug

SEQ ID NO: 215805 - RNA, 22 nt, Human
cccuccccacaaagcuucacac

SEQ ID NO: 215806 - RNA, 18 nt, Human
ugcuggcaacuacuauug

SEQ ID NO: 215807 - RNA, 22 nt, Human
cauccaggcaccacaaccagcu

SEQ ID NO: 215808 - RNA, 22 nt, Human
cucugugggccugugcuuuagu

SEQ ID NO: 215809 - RNA, 22 nt, Human
augcacaguauguagggucuau

SEQ ID NO: 215810 - RNA, 20 nt, Human
cugccuggaggccucuaccu

SEQ ID NO: 215811 - RNA, 22 nt, Human
ggcccagcucuauugaauuaca

SEQ ID NO: 215812 - RNA, 22 nt, Human
uucucugagucuugguuucuua

SEQ ID NO: 215813 - RNA, 22 nt, Human
ucaugccugauuauguuacuca

SEQ ID NO: 215814 - RNA, 22 nt, Human
ugaaagaaggguggaaaaugua

SEQ ID NO: 215815 - RNA, 22 nt, Human
ggguuggauuacuuagggagaa

SEQ ID NO: 215816 - RNA, 22 nt, Human
caauacaucaggucaaaaugug

SEQ ID NO: 215817 - RNA, 22 nt, Human
gagguucaggaaaugggcaaag

SEQ ID NO: 215818 - RNA, 22 nt, Human
cacaggccugggguugagcggg

SEQ ID NO: 215819 - RNA, 22 nt, Human
cuuggcugcuuuugugcacauu

SEQ ID NO: 215820 - RNA, 22 nt, Human
auuugcuugugcuaugaaaguu

SEQ ID NO: 215821 - RNA, 22 nt, Human
cagggaugggauggagucaguu

SEQ ID NO: 215822 - RNA, 22 nt, Human
caaaguauaguguaggauggca

SEQ ID NO: 215823 - RNA, 22 nt, Human
acacagaggcaugacaguggcu

SEQ ID NO: 215824 - RNA, 22 nt, Human
gaggccuggcucugcccuccug

SEQ ID NO: 215825 - RNA, 22 nt, Human
uuauuucaaaagagcuuggggu

SEQ ID NO: 215826 - RNA, 21 nt, Human
gccuugccacaugugccacag

SEQ ID NO: 215827 - RNA, 22 nt, Human
ucuccagggugagcuaggccag

SEQ ID NO: 215828 - RNA, 22 nt, Human
uggcuugggagauucucgaacu

SEQ ID NO: 215829 - RNA, 21 nt, Human
agggucaggaaccaggguacc

SEQ ID NO: 215830 - RNA, 20 nt, Human
ucuguccuuucugcuaaggc

SEQ ID NO: 215831 - RNA, 22 nt, Human
cagaaacagacaugacgcagua

SEQ ID NO: 215832 - RNA, 18 nt, Human
uguggcugguccacacug

SEQ ID NO: 215833 - RNA, 22 nt, Human
aucagagauuguaguaugugca

SEQ ID NO: 215834 - RNA, 22 nt, Human
aaggcuccuuuguaguucuuuu

SEQ ID NO: 215835 - RNA, 22 nt, Human
cagccaggggcuggcguguuga

SEQ ID NO: 215836 - RNA, 22 nt, Human
ucaauuuauguggcuauucauu

SEQ ID NO: 215837 - RNA, 22 nt, Human
ccuguggcugccccgcuguugg

SEQ ID NO: 215838 - RNA, 22 nt, Human
gagggcaggggucuugcacggu

SEQ ID NO: 215839 - RNA, 22 nt, Human
cauucaaacauuaauuuauuca

SEQ ID NO: 215840 - RNA, 18 nt, Human
uggcuggcagugggcagc

SEQ ID NO: 215841 - RNA, 22 nt, Human
ugggcucaaucugcuucuguuu

SEQ ID NO: 215842 - RNA, 22 nt, Human
aggagcucagccauucauuuga

SEQ ID NO: 215843 - RNA, 22 nt, Human
caaaaguaauggcgguuuuuac

SEQ ID NO: 215844 - RNA, 22 nt, Human
uuuggaauaaucagauccuagu

SEQ ID NO: 215845 - RNA, 22 nt, Human
uauaugaugccaaauaaccugu

SEQ ID NO: 215846 - RNA, 22 nt, Human
uucuuuucggccugugagaagg

SEQ ID NO: 215847 - RNA, 22 nt, Human
caaugguugaacccugucauga

SEQ ID NO: 215848 - RNA, 22 nt, Human
aucagaaaggugggcaagcaga

SEQ ID NO: 215849 - RNA, 22 nt, Human
cugggucuggcuacugcuuccu

SEQ ID NO: 215850 - RNA, 22 nt, Human
uccacccugcuuucuuaucucc

SEQ ID NO: 215851 - RNA, 22 nt, Human
gcugccugcucacccggccugg

SEQ ID NO: 215852 - RNA, 22 nt, Human
uccaggagguaugaguggcccc

SEQ ID NO: 215853 - RNA, 22 nt, Human
acuucacuuguaaaugcagccu

SEQ ID NO: 215854 - RNA, 22 nt, Human
cccaggcuccuagaggcccaga

SEQ ID NO: 215855 - RNA, 22 nt, Human
ccccuggguccaggcuucucug

SEQ ID NO: 215856 - RNA, 22 nt, Human
gaaagggucuuugauuucccuc

SEQ ID NO: 215857 - RNA, 23 nt, Human
ucucaggacacacaugucuauca

SEQ ID NO: 215858 - RNA, 18 nt, Human
uggagcugagggcaaugc

SEQ ID NO: 215859 - RNA, 22 nt, Human
aggaccaacauagcagcagugg

SEQ ID NO: 215860 - RNA, 22 nt, Human
uagguaguuuccuguuguuggg

SEQ ID NO: 215861 - RNA, 22 nt, Human
uccucagucguuugagccaaaa

SEQ ID NO: 215862 - RNA, 20 nt, Human
ggcuccuucuuucauggccc

SEQ ID NO: 215863 - RNA, 22 nt, Human
aauagcaaaugcucauuugaaa

SEQ ID NO: 215864 - RNA, 22 nt, Human
acuguggcgucaggaagaaauu

SEQ ID NO: 215865 - RNA, 22 nt, Human
cucugccaucucacuggguccu

SEQ ID NO: 215866 - RNA, 19 nt, Human
ccagagagcuagguacaga

SEQ ID NO: 215867 - RNA, 22 nt, Human
aggucacccguuugacuaucca

SEQ ID NO: 215868 - RNA, 22 nt, Human
caggaaagucuguaaaggaacc

SEQ ID NO: 215869 - RNA, 22 nt, Human
ugaggaugguuaaagaacauug

SEQ ID NO: 215870 - RNA, 22 nt, Human
ucucugagcaccuaagauauau

SEQ ID NO: 215871 - RNA, 22 nt, Human
guuuauucuucagcaacaucug

SEQ ID NO: 215872 - RNA, 22 nt, Human
uugguguacaucuccccuucau

SEQ ID NO: 215873 - RNA, 22 nt, Human
ugggaagcauuaaugauagggg

SEQ ID NO: 215874 - RNA, 22 nt, Human
aagaacugugcuccaggcucca

SEQ ID NO: 215875 - RNA, 23 nt, Human
agcccuugauaauaaagcaccag

SEQ ID NO: 215876 - RNA, 22 nt, Human
agaaucaaagagaaauacuuug

SEQ ID NO: 215877 - RNA, 22 nt, Human
uuggaaaagugaaacuagaugc

SEQ ID NO: 215878 - RNA, 22 nt, Human
gcucugggaauucagaaagccu

SEQ ID NO: 215879 - RNA, 19 nt, Human
ucaaugcaugaaaucagcc

SEQ ID NO: 215880 - RNA, 22 nt, Human
uauugcuggugcuguucugaau

SEQ ID NO: 215881 - RNA, 22 nt, Human
uguuuugguuuaaguauaugaa

SEQ ID NO: 215882 - RNA, 22 nt, Human
gcugagaugucguuagauaucu

SEQ ID NO: 215883 - RNA, 22 nt, Human
ggugagagucuuguggucccag

SEQ ID NO: 215884 - RNA, 22 nt, Human
agaguuuguaguggugaaugua

SEQ ID NO: 215885 - RNA, 22 nt, Human
gacagacaugggacuucauacu

SEQ ID NO: 215886 - RNA, 19 nt, Human
uguggucucuguucucagg

SEQ ID NO: 215887 - RNA, 22 nt, Human
uggcuucugagucuccugacau

SEQ ID NO: 215888 - RNA, 22 nt, Human
cugggcagagcuaacaccugag

SEQ ID NO: 215889 - RNA, 22 nt, Human
uaauuccuagaaauuauucuca

SEQ ID NO: 215890 - RNA, 22 nt, Human
ccuggcugaggggccaaggacc

SEQ ID NO: 215891 - RNA, 22 nt, Human
guccccagcugugacgagagcc

SEQ ID NO: 215892 - RNA, 22 nt, Human
aaucuucacagaaaaaugucug

SEQ ID NO: 215893 - RNA, 22 nt, Human
uaguacaguggagagcaaagaa

SEQ ID NO: 215894 - RNA, 22 nt, Human
gagugcuuugucuuguaauucu

SEQ ID NO: 215895 - RNA, 22 nt, Human
ugggccagcacugggugcucau

SEQ ID NO: 215896 - RNA, 22 nt, Human
agcugguccuaauugagccauu

SEQ ID NO: 215897 - RNA, 21 nt, Human
gaguggaacgcucuucacacc

SEQ ID NO: 215898 - RNA, 22 nt, Human
agccuggcuaaauucucccaug

SEQ ID NO: 215899 - RNA, 22 nt, Human
gagacaggauuuaaccaaagcu

SEQ ID NO: 215900 - RNA, 22 nt, Human
gggguguggacggcugugccag

SEQ ID NO: 215901 - RNA, 22 nt, Human
uccugguguaaugguaagcaug

SEQ ID NO: 215902 - RNA, 22 nt, Human
uuggcagagccccagccuugga

SEQ ID NO: 215903 - RNA, 19 nt, Human
uggcaucuguaaaauggug

SEQ ID NO: 215904 - RNA, 22 nt, Human
cugggccuagaggaagcugaca

SEQ ID NO: 215905 - RNA, 20 nt, Human
ugcuggggacauacagggug

SEQ ID NO: 215906 - RNA, 22 nt, Human
ugccuggguucccaccccaaag

SEQ ID NO: 215907 - RNA, 22 nt, Human
aaacaauguuccuauauuagag

SEQ ID NO: 215908 - RNA, 22 nt, Human
gcugguuucacccaaccgaugu

SEQ ID NO: 215909 - RNA, 22 nt, Human
uucaggauucugugucugacaa

SEQ ID NO: 215910 - RNA, 22 nt, Human
agcagagugccccaucacaagg

SEQ ID NO: 215911 - RNA, 22 nt, Human
ucuggguacuugcaagauuuuc

SEQ ID NO: 215912 - RNA, 22 nt, Human
cagguucuuaaguaacagcaca

SEQ ID NO: 215913 - RNA, 22 nt, Human
cugcccaccacaccugcuccug

SEQ ID NO: 215914 - RNA, 22 nt, Human
ccugccugauuccaggauggcu

SEQ ID NO: 215915 - RNA, 22 nt, Human
cucugugggaggaggaguaggc

SEQ ID NO: 215916 - RNA, 17 nt, Human
gaauccuucucuguucu

SEQ ID NO: 215917 - RNA, 22 nt, Human
acacuuuacucuuacaccauug

SEQ ID NO: 215918 - RNA, 22 nt, Human
aauagaauguaaucuaauacau

SEQ ID NO: 215919 - RNA, 18 nt, Human
ggcuucccuacucacuuc

SEQ ID NO: 215920 - RNA, 22 nt, Human
ugggacagauuauaagucugca

SEQ ID NO: 215921 - RNA, 22 nt, Human
uggagagaagaggcagugugcu

SEQ ID NO: 215922 - RNA, 22 nt, Human
aagauacauauuuguucuagug

SEQ ID NO: 215923 - RNA, 22 nt, Human
auggcuucuagcauugucacaa

SEQ ID NO: 215924 - RNA, 22 nt, Human
agguggaaauggcuuuccuagg

SEQ ID NO: 215925 - RNA, 22 nt, Human
uuaguuuucucaucuaucucac

SEQ ID NO: 215926 - RNA, 23 nt, Human
uauacacauguggcaguauagug

SEQ ID NO: 215927 - RNA, 22 nt, Human
acuuugggaagcugcaauugcc

SEQ ID NO: 215928 - RNA, 22 nt, Human
auggacaaugugaaacuacaag

SEQ ID NO: 215929 - RNA, 23 nt, Human
aggcugagcucucccagcuucag

SEQ ID NO: 215930 - RNA, 22 nt, Human
cccugcagacgucuugaugccu

SEQ ID NO: 215931 - RNA, 22 nt, Human
caggcccugggcaggcacagag

SEQ ID NO: 215932 - RNA, 22 nt, Human
guauuuuaagugacuacuaggu

SEQ ID NO: 215933 - RNA, 22 nt, Human
ugcuggcuccucgaggcuucgu

SEQ ID NO: 215934 - RNA, 22 nt, Human
uaacaugauuugcuauuuagau

SEQ ID NO: 215935 - RNA, 22 nt, Human
gaaguggaauuacugggucaua

SEQ ID NO: 215936 - RNA, 22 nt, Human
gaaggagccgagcucuucccca

SEQ ID NO: 215937 - RNA, 22 nt, Human
ggagguggagcuggaaguucca

SEQ ID NO: 215938 - RNA, 22 nt, Human
uguauucagugauuucacaaua

SEQ ID NO: 215939 - RNA, 22 nt, Human
auugcuuaucuaucuuuaaguc

SEQ ID NO: 215940 - RNA, 22 nt, Human
auauauaugcugauggcugcca

SEQ ID NO: 215941 - RNA, 22 nt, Human
uacaaagccugguagauaucug

SEQ ID NO: 215942 - RNA, 22 nt, Human
aacuucauggguucaaagcugg

SEQ ID NO: 215943 - RNA, 18 nt, Human
gacacauccccaggccuc

SEQ ID NO: 215944 - RNA, 22 nt, Human
ucagaauggcccauaaauaguc

SEQ ID NO: 215945 - RNA, 22 nt, Human
agggucuguggaugcaucuggg

SEQ ID NO: 215946 - RNA, 20 nt, Human
aauuagcuuaagucaaucag

SEQ ID NO: 215947 - RNA, 23 nt, Human
gcucagccucagcaggcccagga

SEQ ID NO: 215948 - RNA, 22 nt, Human
uuuucucaagauccaaugcacu

SEQ ID NO: 215949 - RNA, 22 nt, Human
uccagagcagguggucagaagg

SEQ ID NO: 215950 - RNA, 22 nt, Human
auucaaacuguguuaggcagca

SEQ ID NO: 215951 - RNA, 22 nt, Human
gggaccuggcaccuuugcucug

SEQ ID NO: 215952 - RNA, 22 nt, Human
agagaauuaacauuccauggcu

SEQ ID NO: 215953 - RNA, 18 nt, Human
aaaauaacaaaguuggcu

SEQ ID NO: 215954 - RNA, 22 nt, Human
augguguuuauaggcaaagauc

SEQ ID NO: 215955 - RNA, 22 nt, Human
guucucucugcuuccaagaugg

SEQ ID NO: 215956 - RNA, 22 nt, Human
gcuccagcuccggcuccgaagc

SEQ ID NO: 215957 - RNA, 19 nt, Human
cuuccuggaggagagccuc

SEQ ID NO: 215958 - RNA, 22 nt, Human
ugcugucuguuuacuggcuaua

SEQ ID NO: 215959 - RNA, 22 nt, Human
uuuggcaugggcuauuugcuuu

SEQ ID NO: 215960 - RNA, 21 nt, Human
agcagaggcugccuggugacu

SEQ ID NO: 215961 - RNA, 22 nt, Human
gcuggggagggcgucaaggcca

SEQ ID NO: 215962 - RNA, 22 nt, Human
uuagaagucaucuagucuaaaa

SEQ ID NO: 215963 - RNA, 22 nt, Human
uccugaggcccuguuagggucu

SEQ ID NO: 215964 - RNA, 22 nt, Human
ucaggaaagccuagaagagaac

SEQ ID NO: 215965 - RNA, 22 nt, Human
ugcacacauuaaggauacacag

SEQ ID NO: 215966 - RNA, 22 nt, Human
gacccaggguauccagagcugc

SEQ ID NO: 215967 - RNA, 23 nt, Human
ccucccaccuauuucacuuucuu

SEQ ID NO: 215968 - RNA, 20 nt, Human
auggaggaagggcaagagaa

SEQ ID NO: 215969 - RNA, 22 nt, Human
auguuacuuagaauaauucugg

SEQ ID NO: 215970 - RNA, 22 nt, Human
agggaacuccaugaggccagag

SEQ ID NO: 215971 - RNA, 22 nt, Human
gagucagaaaguagugugccua

SEQ ID NO: 215972 - RNA, 22 nt, Human
cucaaaauccauaaaaucaggu

SEQ ID NO: 215973 - RNA, 22 nt, Human
augcuauacauaugacaucaca

SEQ ID NO: 215974 - RNA, 22 nt, Human
gcaggcuugggacgagcuggag

SEQ ID NO: 215975 - RNA, 22 nt, Human
uccaggcaguuuuccagguugu

SEQ ID NO: 215976 - RNA, 21 nt, Human
auauuucagauuuccguaauc

SEQ ID NO: 215977 - RNA, 22 nt, Human
agcucaagugcaagcauucuau

SEQ ID NO: 215978 - RNA, 22 nt, Human
augguacagauaauacaugcug

SEQ ID NO: 215979 - RNA, 22 nt, Human
uggaaagacauguccuucauua

SEQ ID NO: 215980 - RNA, 22 nt, Human
aggcuugggacugcuuaggagc

SEQ ID NO: 215981 - RNA, 22 nt, Human
ggcuuggcuugggcucagaggc

SEQ ID NO: 215982 - RNA, 22 nt, Human
agguaacuguggcuagguaacu

SEQ ID NO: 215983 - RNA, 22 nt, Human
gucagaggggacaagacacaga

SEQ ID NO: 215984 - RNA, 22 nt, Human
guucucuggaaacuaugauuca

SEQ ID NO: 215985 - RNA, 22 nt, Human
gucucagagagcuacucucuua

SEQ ID NO: 215986 - RNA, 22 nt, Human
gagaggccugagaggcugcgga

SEQ ID NO: 215987 - RNA, 22 nt, Human
gcugagguccagcauucgccua

SEQ ID NO: 215988 - RNA, 22 nt, Human
uaaaagacccucuagaguccca

SEQ ID NO: 215989 - RNA, 22 nt, Human
cugucuccgcccucuugguagg

SEQ ID NO: 215990 - RNA, 22 nt, Human
ucucuguggcauccacucaacu

SEQ ID NO: 215991 - RNA, 21 nt, Human
ucuuuaugacuugcccauuug

SEQ ID NO: 215992 - RNA, 22 nt, Human
cgguggucauaaguggcuggcg

SEQ ID NO: 215993 - RNA, 21 nt, Human
auggagucaggggaaugggcc

SEQ ID NO: 215994 - RNA, 22 nt, Human
accuagaauccaucugcuuauu

SEQ ID NO: 215995 - RNA, 22 nt, Human
aaagcagagcagggcacuuaug

SEQ ID NO: 215996 - RNA, 22 nt, Human
ucacugggagaugugggaaggg

SEQ ID NO: 215997 - RNA, 22 nt, Human
uggccacaugcgucugugaggc

SEQ ID NO: 215998 - RNA, 22 nt, Human
acagacagacagagaacuauuc

SEQ ID NO: 215999 - RNA, 22 nt, Human
ucaccauacauaaauuacauug

SEQ ID NO: 216000 - RNA, 21 nt, Human
ugggaccuauuucaacuggau

SEQ ID NO: 216001 - RNA, 22 nt, Human
ugcaggucuccauuggcagacu

SEQ ID NO: 216002 - RNA, 22 nt, Human
aaggaacugcugauguggugac

SEQ ID NO: 216003 - RNA, 20 nt, Human
agcccaggccugugugaguc

SEQ ID NO: 216004 - RNA, 22 nt, Human
agcugcaagauuucuuuuguau

SEQ ID NO: 216005 - RNA, 22 nt, Human
ucccugggagaugaugaugagg

SEQ ID NO: 216006 - RNA, 22 nt, Human
uagaagaaaagcacuuagagau

SEQ ID NO: 216007 - RNA, 22 nt, Human
auucugggaacuuugucucuca

SEQ ID NO: 216008 - RNA, 22 nt, Human
caggcacaaaaggaccccagca

SEQ ID NO: 216009 - RNA, 22 nt, Human
uuguuuauguguugucuauggc

SEQ ID NO: 216010 - RNA, 22 nt, Human
ucugggugugguaucuuagcca

SEQ ID NO: 216011 - RNA, 22 nt, Human
uccaugagggacacuggaugcu

SEQ ID NO: 216012 - RNA, 22 nt, Human
gagaagggauaugccacucucg

SEQ ID NO: 216013 - RNA, 22 nt, Human
ucacaucuuauuagaguaucuc

SEQ ID NO: 216014 - RNA, 19 nt, Human
ucaugcauuucuaagugca

SEQ ID NO: 216015 - RNA, 22 nt, Human
aaagugguucuuacauccgugg

SEQ ID NO: 216016 - RNA, 22 nt, Human
auaaguaggaaaauuugaauau

SEQ ID NO: 216017 - RNA, 22 nt, Human
gcccacauuuuuggcuuagagg

SEQ ID NO: 216018 - RNA, 22 nt, Human
auaaauuaugaauggcccuuuu

SEQ ID NO: 216019 - RNA, 22 nt, Human
gcccucaggcagggagucuuuc

SEQ ID NO: 216020 - RNA, 22 nt, Human
gagcaggucuuucauggugcau

SEQ ID NO: 216021 - RNA, 23 nt, Human
acuuugcauacccaaauuguuuu

SEQ ID NO: 216022 - RNA, 22 nt, Human
uaacaaaguaccauagacugga

SEQ ID NO: 216023 - RNA, 22 nt, Human
aguguucuagcgcugugcuugu

SEQ ID NO: 216024 - RNA, 18 nt, Human
gcucuggcucaccuccag

SEQ ID NO: 216025 - RNA, 22 nt, Human
uggaguucucaggugagggcuu

SEQ ID NO: 216026 - RNA, 22 nt, Human
gaggccaggguaccaucaacau

SEQ ID NO: 216027 - RNA, 22 nt, Human
agcuccugggccaucacaacca

SEQ ID NO: 216028 - RNA, 22 nt, Human
uugcugaaguuaaugcuugcaa

SEQ ID NO: 216029 - RNA, 22 nt, Human
uccaucuggugagugaggagcc

SEQ ID NO: 216030 - RNA, 22 nt, Human
aaacuaaaccuggcuuaguaag

SEQ ID NO: 216031 - RNA, 22 nt, Human
gcuguggccuaguuuguuauau

SEQ ID NO: 216032 - RNA, 16 nt, Human
agcagggcgggaagga

SEQ ID NO: 216033 - RNA, 22 nt, Human
uaguuuuauaauguuaacaucu

SEQ ID NO: 216034 - RNA, 22 nt, Human
uucugucaaacucacaggccga

SEQ ID NO: 216035 - RNA, 22 nt, Human
agcucugcaggcacagcugagg

SEQ ID NO: 216036 - RNA, 22 nt, Human
acuuuacaggcacuucaaguau

SEQ ID NO: 216037 - RNA, 22 nt, Human
ugaggcuuggaggcuccagugg

SEQ ID NO: 216038 - RNA, 22 nt, Human
agcaggugacagggcuguggug

SEQ ID NO: 216039 - RNA, 22 nt, Human
uuuuuccuagugcuuucuggua

SEQ ID NO: 216040 - RNA, 22 nt, Human
uaacuuagaaguuuaauuguau

SEQ ID NO: 216041 - RNA, 22 nt, Human
gcugugugaccugggcaagucu

SEQ ID NO: 216042 - RNA, 22 nt, Human
cccaagagguggagguugcagu

SEQ ID NO: 216043 - RNA, 22 nt, Human
cauggccuugagugacugcacu

SEQ ID NO: 216044 - RNA, 22 nt, Human
ccaggcagggagcuguuuggcc

SEQ ID NO: 216045 - RNA, 22 nt, Human
agggccaggcucccaugucagg

SEQ ID NO: 216046 - RNA, 22 nt, Human
caggcacagugggguccucucu

SEQ ID NO: 216047 - RNA, 22 nt, Human
cuggagugauacucagaaugug

SEQ ID NO: 216048 - RNA, 22 nt, Human
uagaucaggcugcuuagauaga

SEQ ID NO: 216049 - RNA, 22 nt, Human
caggacacauuucuuguucagg

SEQ ID NO: 216050 - RNA, 22 nt, Human
ugccaggccucaggagucucca

SEQ ID NO: 216051 - RNA, 22 nt, Human
uguuugaguucuagcgcauuua

SEQ ID NO: 216052 - RNA, 22 nt, Human
gacuuugguucagggcucagag

SEQ ID NO: 216053 - RNA, 22 nt, Human
gcugccaguguggcaugaugca

SEQ ID NO: 216054 - RNA, 22 nt, Human
aggaaagacuggggccccagaa

SEQ ID NO: 216055 - RNA, 23 nt, Human
agaggccagccuuuggagacacc

SEQ ID NO: 216056 - RNA, 22 nt, Human
gccucagaaagcuuuuauucau

SEQ ID NO: 216057 - RNA, 22 nt, Human
uaacaguagccuuauguggucu

SEQ ID NO: 216058 - RNA, 22 nt, Human
uuuacuuucucaaguauauagg

SEQ ID NO: 216059 - RNA, 22 nt, Human
aagcauuuuucacagcaacagc

SEQ ID NO: 216060 - RNA, 22 nt, Human
uccugggaguggccauguaaug

SEQ ID NO: 216061 - RNA, 22 nt, Human
ucccugagcucacauggcagga

SEQ ID NO: 216062 - RNA, 22 nt, Human
uguggaaggggccccaugacca

SEQ ID NO: 216063 - RNA, 22 nt, Human
cagaggcuggauggacuugccu

SEQ ID NO: 216064 - RNA, 21 nt, Human
aggcucagagagaaacucuug

SEQ ID NO: 216065 - RNA, 22 nt, Human
acauuagagaagcuuggagaug

SEQ ID NO: 216066 - RNA, 21 nt, Human
uuuauuuauauaggacacaug

SEQ ID NO: 216067 - RNA, 22 nt, Human
gcagauggaucaccugaggucg

SEQ ID NO: 216068 - RNA, 22 nt, Human
cacacauuucagaugcuacaau

SEQ ID NO: 216069 - RNA, 22 nt, Human
agugacagggaaggauaggauu

SEQ ID NO: 216070 - RNA, 22 nt, Human
cacucuccagcacaccccauuu

SEQ ID NO: 216071 - RNA, 22 nt, Human
aagcucuuuucaccauuaaagu

SEQ ID NO: 216072 - RNA, 22 nt, Human
aagggcuggagacugggucuuc

SEQ ID NO: 216073 - RNA, 22 nt, Human
gagggggcgugcaaggcuccgc

SEQ ID NO: 216074 - RNA, 22 nt, Human
gagggcuguggggcaugaccag

SEQ ID NO: 216075 - RNA, 22 nt, Human
ccuugguuuccaggaugaggcu

SEQ ID NO: 216076 - RNA, 17 nt, Human
cugagccccgggcagcu

SEQ ID NO: 216077 - RNA, 22 nt, Human
uucaacaacuugguucaaaugg

SEQ ID NO: 216078 - RNA, 22 nt, Human
uagcuauuuugcuuggaaauac

SEQ ID NO: 216079 - RNA, 22 nt, Human
aauacauguuuucuacuauucu

SEQ ID NO: 216080 - RNA, 22 nt, Human
ugcugagaggaaagaaugcaca

SEQ ID NO: 216081 - RNA, 20 nt, Human
uacaaauuuuccauguuucc

SEQ ID NO: 216082 - RNA, 23 nt, Human
aaaugugagggaaaaucuuucug

SEQ ID NO: 216083 - RNA, 22 nt, Human
agcugccucagucacucauggc

SEQ ID NO: 216084 - RNA, 22 nt, Human
gaggcugaauggccagaagcca

SEQ ID NO: 216085 - RNA, 22 nt, Human
cugaggcugaagagggccuacg

SEQ ID NO: 216086 - RNA, 22 nt, Human
aucuacccacugaacacaauau

SEQ ID NO: 216087 - RNA, 22 nt, Human
cagggcaggaauuugacauugc

SEQ ID NO: 216088 - RNA, 21 nt, Human
agaggccaagucaucauuucc

SEQ ID NO: 216089 - RNA, 22 nt, Human
uucucuggccugaggcgaggcc

SEQ ID NO: 216090 - RNA, 22 nt, Human
ugaguggacgugaggcugagua

SEQ ID NO: 216091 - RNA, 22 nt, Human
guuuuugucgaguuccuugacc

SEQ ID NO: 216092 - RNA, 22 nt, Human
cagcuggaucccugcagaacuu

SEQ ID NO: 216093 - RNA, 22 nt, Human
ggacaaaacuucuugcauuucu

SEQ ID NO: 216094 - RNA, 19 nt, Human
ugaggcaagcuuuuucuug

SEQ ID NO: 216095 - RNA, 16 nt, Human
uggcuucccagagaua

SEQ ID NO: 216096 - RNA, 22 nt, Human
cagcuuugccaaguaaggucuu

SEQ ID NO: 216097 - RNA, 22 nt, Human
aucaguuuggaacauucaggcc

SEQ ID NO: 216098 - RNA, 22 nt, Human
aaguuacacagaguuggaggcu

SEQ ID NO: 216099 - RNA, 22 nt, Human
guggcagagaacaaggagaggu

SEQ ID NO: 216100 - RNA, 22 nt, Human
agcagggcuccugaaagccgcg

SEQ ID NO: 216101 - RNA, 22 nt, Human
uguucagaacaaagguaaauga

SEQ ID NO: 216102 - RNA, 22 nt, Human
ugggggugcccuaugaggaagc

SEQ ID NO: 216103 - RNA, 22 nt, Human
uucauguaauuccauaagguaa

SEQ ID NO: 216104 - RNA, 22 nt, Human
ucccugggacggccuuuuggag

SEQ ID NO: 216105 - RNA, 22 nt, Human
uggcuucuauugcuguggcauu

SEQ ID NO: 216106 - RNA, 22 nt, Human
uccagcagacucaucagcaagg

SEQ ID NO: 216107 - RNA, 20 nt, Human
ugcuuuaugcuauacuuugu

SEQ ID NO: 216108 - RNA, 22 nt, Human
ucaucauaauauggaaucuugu

SEQ ID NO: 216109 - RNA, 22 nt, Human
aggaaagccaaucucucuugac

SEQ ID NO: 216110 - RNA, 22 nt, Human
uucugaggcuuucccguccccu

SEQ ID NO: 216111 - RNA, 22 nt, Human
ucuguacaccaggggccauucu

SEQ ID NO: 216112 - RNA, 22 nt, Human
ggucugagcuugagcccaugcu

SEQ ID NO: 216113 - RNA, 22 nt, Human
gcucugagauugagccuuuggu

SEQ ID NO: 216114 - RNA, 22 nt, Human
ucuggaugauaugugaacuuga

SEQ ID NO: 216115 - RNA, 22 nt, Human
gcaggucccagaaaguuaauuc

SEQ ID NO: 216116 - RNA, 22 nt, Human
ugaggccaacuagggagaugga

SEQ ID NO: 216117 - RNA, 22 nt, Human
gggagcaggacauaauagcaau

SEQ ID NO: 216118 - RNA, 22 nt, Human
guaaaauugcaauuacuuuugc

SEQ ID NO: 216119 - RNA, 22 nt, Human
ccacagcaccgcugccaguccc

SEQ ID NO: 216120 - RNA, 22 nt, Human
uguuggaauuaggauacagagg

SEQ ID NO: 216121 - RNA, 22 nt, Human
uggagguguggagucaaaggga

SEQ ID NO: 216122 - RNA, 23 nt, Human
acauucuugauucaggccuuagc

SEQ ID NO: 216123 - RNA, 19 nt, Human
uuugugaagaaaaugaugc

SEQ ID NO: 216124 - RNA, 22 nt, Human
uucaguuuucuuuagaauguag

SEQ ID NO: 216125 - RNA, 22 nt, Human
cucugaaaguuagagaaaauag

SEQ ID NO: 216126 - RNA, 22 nt, Human
auaguguuacccuucuuaaagu

SEQ ID NO: 216127 - RNA, 22 nt, Human
gcucagcuggaccaucguguuu

SEQ ID NO: 216128 - RNA, 22 nt, Human
gggucucucaugcaguugcugu

SEQ ID NO: 216129 - RNA, 22 nt, Human
ucagagcacuuggcucauggca

SEQ ID NO: 216130 - RNA, 22 nt, Human
cugaggagacagaagccaaaua

SEQ ID NO: 216131 - RNA, 22 nt, Human
aggcagcagagguugaggaaag

SEQ ID NO: 216132 - RNA, 22 nt, Human
gcaccagcugcaggguggcuga

SEQ ID NO: 216133 - RNA, 22 nt, Human
gccuguuggguaacagaguuca

SEQ ID NO: 216134 - RNA, 22 nt, Human
gcacugugacccagagcaggug

SEQ ID NO: 216135 - RNA, 22 nt, Human
gaacugaagacuuuuacuguac

SEQ ID NO: 216136 - RNA, 22 nt, Human
agggaaggaaaagcugucgcuu

SEQ ID NO: 216137 - RNA, 22 nt, Human
gccacagacagagagucuagug

SEQ ID NO: 216138 - RNA, 22 nt, Human
gaagucuugaaacacaaacuag

SEQ ID NO: 216139 - RNA, 22 nt, Human
agcuuuggcccuggagguuacu

SEQ ID NO: 216140 - RNA, 22 nt, Human
gccuccugguugcuucuccaac

SEQ ID NO: 216141 - RNA, 22 nt, Human
uaaggccauuauggugggcccg

SEQ ID NO: 216142 - RNA, 22 nt, Human
ugguaagauaagagccaggccu

SEQ ID NO: 216143 - RNA, 22 nt, Human
cagguggugccuccaggcuggu

SEQ ID NO: 216144 - RNA, 22 nt, Human
uuugaaaguguuuacuugggaa

SEQ ID NO: 216145 - RNA, 22 nt, Human
acaacaaagacacuugaaauga

SEQ ID NO: 216146 - RNA, 21 nt, Human
uccucagggccccagagcacu

SEQ ID NO: 216147 - RNA, 22 nt, Human
aaaaccauguaucuauuuccuu

SEQ ID NO: 216148 - RNA, 22 nt, Human
aaggacaggcuaaccugacauu

SEQ ID NO: 216149 - RNA, 22 nt, Human
uuagcagguuucuggcucuugg

SEQ ID NO: 216150 - RNA, 22 nt, Human
ccuggcuuucucauuuacaggc

SEQ ID NO: 216151 - RNA, 22 nt, Human
ccuggagcuuuuccauccugga

SEQ ID NO: 216152 - RNA, 22 nt, Human
uucuucuugaaacuuuagguug

SEQ ID NO: 216153 - RNA, 22 nt, Human
gaaggcuguuucugguagugau

SEQ ID NO: 216154 - RNA, 22 nt, Human
guucaaggaagggaggaaagcc

SEQ ID NO: 216155 - RNA, 22 nt, Human
aaccauucacaguguagccaaa

SEQ ID NO: 216156 - RNA, 22 nt, Human
ugccaggcauguaguagacuug

SEQ ID NO: 216157 - RNA, 22 nt, Human
uugaccuauguuucuucaucug

SEQ ID NO: 216158 - RNA, 22 nt, Human
agccuguccagaggacagggcu

SEQ ID NO: 216159 - RNA, 22 nt, Human
uggaaggagcuaaggaccuggg

SEQ ID NO: 216160 - RNA, 22 nt, Human
uacagaauguguaucauuacca

SEQ ID NO: 216161 - RNA, 22 nt, Human
cugagcagucuagccagguguu

SEQ ID NO: 216162 - RNA, 22 nt, Human
uggcauuucaccuuucauuucc

SEQ ID NO: 216163 - RNA, 22 nt, Human
ucugaaauaggaaagcaaaugg

SEQ ID NO: 216164 - RNA, 22 nt, Human
cagaaaccucccugaauauuuu

SEQ ID NO: 216165 - RNA, 22 nt, Human
acagcacaaucugagucccaga

SEQ ID NO: 216166 - RNA, 22 nt, Human
ccagagccucuuaugaagaucg

SEQ ID NO: 216167 - RNA, 22 nt, Human
uaggacaugcuacauaaauagg

SEQ ID NO: 216168 - RNA, 22 nt, Human
uagaaacaaagaccugggugcu

SEQ ID NO: 216169 - RNA, 17 nt, Human
ugcaggcuguuauagcc

SEQ ID NO: 216170 - RNA, 22 nt, Human
aggucuggaggcggagucagga

SEQ ID NO: 216171 - RNA, 22 nt, Human
ccuugagaugagcuaauuuuuu

SEQ ID NO: 216172 - RNA, 22 nt, Human
uugcacaugauagaugauuucu

SEQ ID NO: 216173 - RNA, 22 nt, Human
acacuuuaugucuagaucuggg

SEQ ID NO: 216174 - RNA, 17 nt, Human
gaaagcaucacaugcuc

SEQ ID NO: 216175 - RNA, 22 nt, Human
uggagucugugaugcucugggu

SEQ ID NO: 216176 - RNA, 22 nt, Human
guugugcagggcgaggaccuga

SEQ ID NO: 216177 - RNA, 21 nt, Human
uagaacugacgauuucagagu

SEQ ID NO: 216178 - RNA, 22 nt, Human
uggcuuccacugugugcccccu

SEQ ID NO: 216179 - RNA, 22 nt, Human
uaaaguuuggcagacaauaaca

SEQ ID NO: 216180 - RNA, 22 nt, Human
gugaagcaguugcguggguucc

SEQ ID NO: 216181 - RNA, 22 nt, Human
ucacagaagaugcuggauguug

SEQ ID NO: 216182 - RNA, 21 nt, Human
ugacauuuaguagcauuguca

SEQ ID NO: 216183 - RNA, 22 nt, Human
gugggacagcggggugggacag

SEQ ID NO: 216184 - RNA, 22 nt, Human
ccagcugagguugaagaaagag

SEQ ID NO: 216185 - RNA, 22 nt, Human
uccaggaaagcacugggcuggg

SEQ ID NO: 216186 - RNA, 22 nt, Human
uacauucauggugacuuguaug

SEQ ID NO: 216187 - RNA, 22 nt, Human
auguuuccagguucuuccuaug

SEQ ID NO: 216188 - RNA, 22 nt, Human
uugggaaauauggauuguuauu

SEQ ID NO: 216189 - RNA, 22 nt, Human
agcuugacagacagaugguagc

SEQ ID NO: 216190 - RNA, 18 nt, Human
uaacauguuuucauuaag

SEQ ID NO: 216191 - RNA, 22 nt, Human
cugggagaggcugcuccgcucu

SEQ ID NO: 216192 - RNA, 22 nt, Human
ucucagggagggcgagucagcg

SEQ ID NO: 216193 - RNA, 22 nt, Human
agacauuuuagacauaaaagau

SEQ ID NO: 216194 - RNA, 22 nt, Human
ucuggaauucucaaguccugga

SEQ ID NO: 216195 - RNA, 22 nt, Human
auguuuccgugagcauccuuga

SEQ ID NO: 216196 - RNA, 22 nt, Human
gcuggagaugcuaugcagaggg

SEQ ID NO: 216197 - RNA, 22 nt, Human
ugcaaauauugggacagucuag

SEQ ID NO: 216198 - RNA, 22 nt, Human
uccaaaguaauuucacuucugu

SEQ ID NO: 216199 - RNA, 19 nt, Human
agaaucuaaauuauuucug

SEQ ID NO: 216200 - RNA, 22 nt, Human
aggcccugagaaaaucccugca

SEQ ID NO: 216201 - RNA, 22 nt, Human
ucccaggcuaccagugagguca

SEQ ID NO: 216202 - RNA, 22 nt, Human
gcugcucacugaaggacccugu

SEQ ID NO: 216203 - RNA, 21 nt, Human
agagcuggccugccaggcccu

SEQ ID NO: 216204 - RNA, 22 nt, Human
uccaucauggcagcagcaguga

SEQ ID NO: 216205 - RNA, 22 nt, Human
caggucucggguucagcaguga

SEQ ID NO: 216206 - RNA, 22 nt, Human
gcuuccugucccucagccauga

SEQ ID NO: 216207 - RNA, 22 nt, Human
uccaugauuggucaucauagaa

SEQ ID NO: 216208 - RNA, 22 nt, Human
aaacugaaacaucaucauguug

SEQ ID NO: 216209 - RNA, 22 nt, Human
cacacaucaaccuagacauugu

SEQ ID NO: 216210 - RNA, 22 nt, Human
cuucuuaaucccuuauauauuu

SEQ ID NO: 216211 - RNA, 22 nt, Human
cugcagagcuaggcugagugaa

SEQ ID NO: 216212 - RNA, 22 nt, Human
acaauucucucauaucuuauua

SEQ ID NO: 216213 - RNA, 22 nt, Human
cucuccuccaacagcccugccg

SEQ ID NO: 216214 - RNA, 22 nt, Human
gcugaggccucagaaggcugag

SEQ ID NO: 216215 - RNA, 22 nt, Human
ugcuggggucauggggcgcccg

SEQ ID NO: 216216 - RNA, 22 nt, Human
gacagguggggaaacuaaggua

SEQ ID NO: 216217 - RNA, 23 nt, Human
aggggcagcaaguuuugguguua

SEQ ID NO: 216218 - RNA, 20 nt, Human
cagagaccaggccagguguc

SEQ ID NO: 216219 - RNA, 21 nt, Human
agcugcaggccucccagggau

SEQ ID NO: 216220 - RNA, 22 nt, Human
cuggaucugucuuuuggauccc

SEQ ID NO: 216221 - RNA, 22 nt, Human
acauaugugcuuauauccauga

SEQ ID NO: 216222 - RNA, 22 nt, Human
caaauuuaagugaggucuuugu

SEQ ID NO: 216223 - RNA, 22 nt, Human
uaacacaaaagaauaugugugu

SEQ ID NO: 216224 - RNA, 22 nt, Human
ucccucagagggcaagcgcaga

SEQ ID NO: 216225 - RNA, 22 nt, Human
aggcugugggaauggcugcuug

SEQ ID NO: 216226 - RNA, 22 nt, Human
ccagaggaucaguacuggcugg

SEQ ID NO: 216227 - RNA, 22 nt, Human
caagcuggagguuggagcuacu

SEQ ID NO: 216228 - RNA, 22 nt, Human
uaaggcuuuuaaagguucacca

SEQ ID NO: 216229 - RNA, 22 nt, Human
aagcaggcuugguguggccgcu

SEQ ID NO: 216230 - RNA, 22 nt, Human
uuuuaacacucagcacuaucuc

SEQ ID NO: 216231 - RNA, 22 nt, Human
agucaguuucccuggaaagcag

SEQ ID NO: 216232 - RNA, 22 nt, Human
uccagcauucuuagaccucuau

SEQ ID NO: 216233 - RNA, 18 nt, Human
acugaagaugcaagaccu

SEQ ID NO: 216234 - RNA, 22 nt, Human
gugagcuguuuuggacccaucu

SEQ ID NO: 216235 - RNA, 22 nt, Human
gcugggaguuugauuugacugg

SEQ ID NO: 216236 - RNA, 22 nt, Human
auuggccauuugcauguauuau

SEQ ID NO: 216237 - RNA, 19 nt, Human
ucucuggcuugucugccug

SEQ ID NO: 216238 - RNA, 22 nt, Human
aaauguuuaaguguaggagcaa

SEQ ID NO: 216239 - RNA, 22 nt, Human
guccugugcucagacauggggg

SEQ ID NO: 216240 - RNA, 19 nt, Human
agccagugagccucugggu

SEQ ID NO: 216241 - RNA, 22 nt, Human
gucugggaguuuggugcugccg

SEQ ID NO: 216242 - RNA, 22 nt, Human
gcaggagccaggccgagcuggu

SEQ ID NO: 216243 - RNA, 22 nt, Human
aauacagcagauggagacaaau

SEQ ID NO: 216244 - RNA, 22 nt, Human
aggaagugcagggggaaguacu

SEQ ID NO: 216245 - RNA, 17 nt, Human
uggcagcugaaagcucu

SEQ ID NO: 216246 - RNA, 22 nt, Human
uaguaguaauuguuaucuuauu

SEQ ID NO: 216247 - RNA, 22 nt, Human
agagcagauuucaaauauuggc

SEQ ID NO: 216248 - RNA, 22 nt, Human
agucaguugcaguuuauggaug

SEQ ID NO: 216249 - RNA, 22 nt, Human
aggaagcacuggaagggguugg

SEQ ID NO: 216250 - RNA, 22 nt, Human
ucuguucagaagaggugaaagu

SEQ ID NO: 216251 - RNA, 22 nt, Human
cugcucugagaggcucuuccua

SEQ ID NO: 216252 - RNA, 22 nt, Human
gcauucuuagggccuggggugu

SEQ ID NO: 216253 - RNA, 22 nt, Human
cugagccaaccacagcaggagc

SEQ ID NO: 216254 - RNA, 22 nt, Human
caggcagcucgaugccuuguug

SEQ ID NO: 216255 - RNA, 22 nt, Human
ucuauuuuauacucaaaucuuc

SEQ ID NO: 216256 - RNA, 19 nt, Human
ugagacagagaccaguucu

SEQ ID NO: 216257 - RNA, 22 nt, Human
aggagcugcauggauaccuggu

SEQ ID NO: 216258 - RNA, 22 nt, Human
uucuagaugauaaaccagcagc

SEQ ID NO: 216259 - RNA, 23 nt, Human
acagugaaacacgcaguaagagu

SEQ ID NO: 216260 - RNA, 22 nt, Human
cugcuuuaaguauucaacaaag

SEQ ID NO: 216261 - RNA, 22 nt, Human
gggagagguuacccgagcaacu

SEQ ID NO: 216262 - RNA, 20 nt, Human
aggaaaaauggaaacuggag

SEQ ID NO: 216263 - RNA, 22 nt, Human
ucugccugagaaguggggugcc

SEQ ID NO: 216264 - RNA, 22 nt, Human
gugagggguggcugagcaguuu

SEQ ID NO: 216265 - RNA, 22 nt, Human
gaaagugcucucucuauacaca

SEQ ID NO: 216266 - RNA, 22 nt, Human
uuuguguuuuagcuggugaggc

SEQ ID NO: 216267 - RNA, 22 nt, Human
ucuuauuugcaacuggcucaga

SEQ ID NO: 216268 - RNA, 22 nt, Human
gggcugagagugacuguucugu

SEQ ID NO: 216269 - RNA, 22 nt, Human
aucagcaagcauuuauugagug

SEQ ID NO: 216270 - RNA, 22 nt, Human
uggcugaggcuggagugcagug

SEQ ID NO: 216271 - RNA, 22 nt, Human
ggcaggcuuucagcaucaaguc

SEQ ID NO: 216272 - RNA, 22 nt, Human
ugagaggaacaggcaguagguu

SEQ ID NO: 216273 - RNA, 22 nt, Human
uggccucuccuggcagcaucca

SEQ ID NO: 216274 - RNA, 22 nt, Human
cuggaggucauguaauauggaa

SEQ ID NO: 216275 - RNA, 22 nt, Human
aauuaugguauguucaacaacu

SEQ ID NO: 216276 - RNA, 22 nt, Human
auuauaaauauuuucuaggggu

SEQ ID NO: 216277 - RNA, 22 nt, Human
ucuguggcgcauaguugucucu

SEQ ID NO: 216278 - RNA, 22 nt, Human
uugaauaguguuuucaguauac

SEQ ID NO: 216279 - RNA, 22 nt, Human
gcaguaggggcuggagggcugu

SEQ ID NO: 216280 - RNA, 22 nt, Human
agagaaacaggucagcugggag

SEQ ID NO: 216281 - RNA, 22 nt, Human
augcuuuuccaggagaaauaua

SEQ ID NO: 216282 - RNA, 18 nt, Human
uggcuucugcuagcugga

SEQ ID NO: 216283 - RNA, 22 nt, Human
uuacauuagacccacuuucaug

SEQ ID NO: 216284 - RNA, 22 nt, Human
agacucuuggucauuggcauua

SEQ ID NO: 216285 - RNA, 22 nt, Human
cuuucucuucagcacccagccc

SEQ ID NO: 216286 - RNA, 22 nt, Human
acuguacugaaaaguaagcaag

SEQ ID NO: 216287 - RNA, 22 nt, Human
ugcuuucauauugccuaugacu

SEQ ID NO: 216288 - RNA, 22 nt, Human
ucagcuuuuuacaugugaaaua

SEQ ID NO: 216289 - RNA, 23 nt, Human
ugugaauugaggacaucaaaagc

SEQ ID NO: 216290 - RNA, 22 nt, Human
ucugguaacucagaagaaagga

SEQ ID NO: 216291 - RNA, 22 nt, Human
cagaagcagauucuaaagcaag

SEQ ID NO: 216292 - RNA, 22 nt, Human
ccagguguguacagaacagcac

SEQ ID NO: 216293 - RNA, 22 nt, Human
gugagcagcucaggguggucuc

SEQ ID NO: 216294 - RNA, 22 nt, Human
cugagccuccauuucaucaggu

SEQ ID NO: 216295 - RNA, 22 nt, Human
gcuagggaucugauuugcuguu

SEQ ID NO: 216296 - RNA, 21 nt, Human
cagcagaguaaugcauucgua

SEQ ID NO: 216297 - RNA, 22 nt, Human
cuacaggaaggaucuugcucaa

SEQ ID NO: 216298 - RNA, 22 nt, Human
cagcaagagacuguucucuaag

SEQ ID NO: 216299 - RNA, 22 nt, Human
ucccaaauauaaugcaagagac

SEQ ID NO: 216300 - RNA, 22 nt, Human
ugauauuugcugacugcauugu

SEQ ID NO: 216301 - RNA, 19 nt, Human
augaguacacuuguacauu

SEQ ID NO: 216302 - RNA, 22 nt, Human
uacaacauaacgggcauucagu

SEQ ID NO: 216303 - RNA, 22 nt, Human
aucuuuuacuacaaaucaggug

SEQ ID NO: 216304 - RNA, 22 nt, Human
ggcucucagggaaaggccuccc

SEQ ID NO: 216305 - RNA, 22 nt, Human
uggcuucuuagaccaguggccu

SEQ ID NO: 216306 - RNA, 22 nt, Human
ccagggcugagcugugaccaug

SEQ ID NO: 216307 - RNA, 22 nt, Human
ucacagccuggacaguugccug

SEQ ID NO: 216308 - RNA, 22 nt, Human
augcuuggaugcugccauggga

SEQ ID NO: 216309 - RNA, 22 nt, Human
uuuccucugagugagcugggag

SEQ ID NO: 216310 - RNA, 22 nt, Human
uggcugagccuuuggggcuuuc

SEQ ID NO: 216311 - RNA, 22 nt, Human
gaaggauuugagauuauccuag

SEQ ID NO: 216312 - RNA, 22 nt, Human
cacaggcaccccugacugcuca

SEQ ID NO: 216313 - RNA, 22 nt, Human
aauucucaggaauuucaucugu

SEQ ID NO: 216314 - RNA, 21 nt, Human
ucccucagacagggugccuau

SEQ ID NO: 216315 - RNA, 22 nt, Human
agaaggcucaucccucacccca

SEQ ID NO: 216316 - RNA, 22 nt, Human
ugcagcucauugguguccuggu

SEQ ID NO: 216317 - RNA, 22 nt, Human
uggagagcagggcuggaguuca

SEQ ID NO: 216318 - RNA, 22 nt, Human
acaaggcuguuggucacaaacc

SEQ ID NO: 216319 - RNA, 22 nt, Human
ucaggcugcuggccagcaggcu

SEQ ID NO: 216320 - RNA, 22 nt, Human
uaagugaugaagaccuguuugg

SEQ ID NO: 216321 - RNA, 22 nt, Human
acagggcagagugaaaugcuau

SEQ ID NO: 216322 - RNA, 22 nt, Human
agaaaguuuggggcugggcacg

SEQ ID NO: 216323 - RNA, 22 nt, Human
guacaugagcauaaacacacau

SEQ ID NO: 216324 - RNA, 22 nt, Human
uuggcccacucucagaaugugg

SEQ ID NO: 216325 - RNA, 22 nt, Human
aagcaagcaguguggaauuuua

SEQ ID NO: 216326 - RNA, 22 nt, Human
ugcaggaauagcuacagagcug

SEQ ID NO: 216327 - RNA, 22 nt, Human
aggucuggagugggaucugaga

SEQ ID NO: 216328 - RNA, 22 nt, Human
cuguggcucucugcaggguccc

SEQ ID NO: 216329 - RNA, 22 nt, Human
cggcugugucuucacaggagcc

SEQ ID NO: 216330 - RNA, 22 nt, Human
uacauacacaaauauacuguuu

SEQ ID NO: 216331 - RNA, 22 nt, Human
uggcaggcagugugggagcugg

SEQ ID NO: 216332 - RNA, 22 nt, Human
ggcugcaggcuucccuccagca

SEQ ID NO: 216333 - RNA, 22 nt, Human
ucuggcucucauacucgccagu

SEQ ID NO: 216334 - RNA, 22 nt, Human
cacagaacugguuaauagcaga

SEQ ID NO: 216335 - RNA, 22 nt, Human
agcuccaggaucugaaaguucg

SEQ ID NO: 216336 - RNA, 22 nt, Human
uacacauucuagggcacaguua

SEQ ID NO: 216337 - RNA, 22 nt, Human
gcuggcucccagaggccccagc

SEQ ID NO: 216338 - RNA, 22 nt, Human
gcgcaccaccuccagguggccg

SEQ ID NO: 216339 - RNA, 22 nt, Human
aguguacacuaaaugaauacaa

SEQ ID NO: 216340 - RNA, 22 nt, Human
ccucacagcuuuucaaagugga

SEQ ID NO: 216341 - RNA, 22 nt, Human
aagaacuuccuaauauauuuuc

SEQ ID NO: 216342 - RNA, 21 nt, Human
uaaggccaagucuauuucugu

SEQ ID NO: 216343 - RNA, 22 nt, Human
ugcucagggacaauggagaggg

SEQ ID NO: 216344 - RNA, 22 nt, Human
accugaauugauuugaccugua

SEQ ID NO: 216345 - RNA, 22 nt, Human
ugguggcaucaauugacuucuc

SEQ ID NO: 216346 - RNA, 22 nt, Human
aggaccuguaccucagcaucua

SEQ ID NO: 216347 - RNA, 22 nt, Human
ccuggcagcaggugggcccgug

SEQ ID NO: 216348 - RNA, 22 nt, Human
guguggucgaaguucucccgga

SEQ ID NO: 216349 - RNA, 23 nt, Human
cuccccaguguccucaugcaucu

SEQ ID NO: 216350 - RNA, 18 nt, Human
acuguggcucagaguugc

SEQ ID NO: 216351 - RNA, 22 nt, Human
aguggacuuuuaguauccuuau

SEQ ID NO: 216352 - RNA, 22 nt, Human
aucuagaacaauuauugucaca

SEQ ID NO: 216353 - RNA, 21 nt, Human
uagaaagucaaagcuaucagc

SEQ ID NO: 216354 - RNA, 22 nt, Human
aacaaugccaacagcaugcugg

SEQ ID NO: 216355 - RNA, 22 nt, Human
gaaauaauucugugucugaaca

SEQ ID NO: 216356 - RNA, 22 nt, Human
acuacauuaugaggaaagagug

SEQ ID NO: 216357 - RNA, 22 nt, Human
agcaagcauugcugguuagguc

SEQ ID NO: 216358 - RNA, 21 nt, Human
aggagccauguggucugaugg

SEQ ID NO: 216359 - RNA, 22 nt, Human
gagagggguuugccauccuaug

SEQ ID NO: 216360 - RNA, 22 nt, Human
gagagggagccagccaggaacc

SEQ ID NO: 216361 - RNA, 22 nt, Human
ucccacagugguacagcccuga

SEQ ID NO: 216362 - RNA, 22 nt, Human
gcacggcaagacggggccuccu

SEQ ID NO: 216363 - RNA, 22 nt, Human
cucuuuggcuuugacucccauu

SEQ ID NO: 216364 - RNA, 22 nt, Human
gcugcugggucccucugugcca

SEQ ID NO: 216365 - RNA, 22 nt, Human
cuguccauggcaaugaugcaga

SEQ ID NO: 216366 - RNA, 23 nt, Human
auguauuuaaauuucagugauga

SEQ ID NO: 216367 - RNA, 22 nt, Human
uccagcccgacugggccugccg

SEQ ID NO: 216368 - RNA, 22 nt, Human
ucccagcagcauagcucagaau

SEQ ID NO: 216369 - RNA, 22 nt, Human
uauugaugcuuggauugggcca

SEQ ID NO: 216370 - RNA, 22 nt, Human
aacuuuagcuauuuaaucugau

SEQ ID NO: 216371 - RNA, 22 nt, Human
gagcucuuugaaccugggcagu

SEQ ID NO: 216372 - RNA, 22 nt, Human
ucagagaacacagaggugaugu

SEQ ID NO: 216373 - RNA, 22 nt, Human
aagcccuggcucagcucaccag

SEQ ID NO: 216374 - RNA, 22 nt, Human
caaagccauagaguagauaaga

SEQ ID NO: 216375 - RNA, 22 nt, Human
ugggagcaguucagguguggcu

SEQ ID NO: 216376 - RNA, 22 nt, Human
agacacagcuaccauaauacca

SEQ ID NO: 216377 - RNA, 20 nt, Human
aggaggcaugaggggauuua

SEQ ID NO: 216378 - RNA, 22 nt, Human
gagggagcuugauggauguuug

SEQ ID NO: 216379 - RNA, 23 nt, Human
cacugggggcugcuacagagagg

SEQ ID NO: 216380 - RNA, 22 nt, Human
gagugagggccaacauccagcu

SEQ ID NO: 216381 - RNA, 22 nt, Human
uugaaucauuacaauagauaag

SEQ ID NO: 216382 - RNA, 22 nt, Human
ccuguggcugguaguaucguuu

SEQ ID NO: 216383 - RNA, 22 nt, Human
uccugagugagagcugggaggu

SEQ ID NO: 216384 - RNA, 22 nt, Human
uuaaauuaggacucuaguucug

SEQ ID NO: 216385 - RNA, 21 nt, Human
uuagaaagcucacuacaguua

SEQ ID NO: 216386 - RNA, 21 nt, Human
agguacuaaugaaaagugauu

SEQ ID NO: 216387 - RNA, 22 nt, Human
agaaagcuuaugaaugggcaag

SEQ ID NO: 216388 - RNA, 22 nt, Human
cucaggauagcugcgcagccug

SEQ ID NO: 216389 - RNA, 22 nt, Human
auuuagaagcuaauuuuucaga

SEQ ID NO: 216390 - RNA, 22 nt, Human
gugugcucuggaggcuagauuu

SEQ ID NO: 216391 - RNA, 22 nt, Human
uugcaagguuucucucugccua

SEQ ID NO: 216392 - RNA, 22 nt, Human
uuaaaagaauccuguuauccuc

SEQ ID NO: 216393 - RNA, 20 nt, Human
ggaaggggcaaaguguguga

SEQ ID NO: 216394 - RNA, 22 nt, Human
uuaaggaacuugucuuucucuu

SEQ ID NO: 216395 - RNA, 22 nt, Human
gcagaaacuuggagaagccagg

SEQ ID NO: 216396 - RNA, 22 nt, Human
cauaaucccccauuugugacau

SEQ ID NO: 216397 - RNA, 22 nt, Human
ccccagcugcauacuugccaag

SEQ ID NO: 216398 - RNA, 22 nt, Human
caauuucaauacaaaauacauu

SEQ ID NO: 216399 - RNA, 22 nt, Human
gagucuuucugggcuuguucuu

SEQ ID NO: 216400 - RNA, 22 nt, Human
ucauucuugcguaugccauggu

SEQ ID NO: 216401 - RNA, 22 nt, Human
auugcugggaauauuuagccca

SEQ ID NO: 216402 - RNA, 22 nt, Human
uggcagaguuggagguggaaga

SEQ ID NO: 216403 - RNA, 18 nt, Human
gugagcagagagcaucac

SEQ ID NO: 216404 - RNA, 22 nt, Human
uauuucagcccuacuacuuggc

SEQ ID NO: 216405 - RNA, 22 nt, Human
uaacacuugaagccauuuuugc

SEQ ID NO: 216406 - RNA, 22 nt, Human
aaggccagcgcagaccauuguc

SEQ ID NO: 216407 - RNA, 22 nt, Human
auuuucauuuugcagggugaga

SEQ ID NO: 216408 - RNA, 22 nt, Human
ggcccugaagugauugugaguu

SEQ ID NO: 216409 - RNA, 20 nt, Human
aggcucagagcaguaguaca

SEQ ID NO: 216410 - RNA, 22 nt, Human
gcaaggauguacugcaauagga

SEQ ID NO: 216411 - RNA, 22 nt, Human
ugaaagcauaugcuaaagacca

SEQ ID NO: 216412 - RNA, 22 nt, Human
caucuuuaguuauugaauauag

SEQ ID NO: 216413 - RNA, 22 nt, Human
ccaggagaugggagcaucuaaa

SEQ ID NO: 216414 - RNA, 22 nt, Human
uggcucagaugcucuuccagug

SEQ ID NO: 216415 - RNA, 18 nt, Human
cugggucuccaggcugcc

SEQ ID NO: 216416 - RNA, 18 nt, Human
cuucucccaucuuggcca

SEQ ID NO: 216417 - RNA, 22 nt, Human
acuuagaaagggauucuagauu

SEQ ID NO: 216418 - RNA, 22 nt, Human
uggcagugggaagcuggaaguc

SEQ ID NO: 216419 - RNA, 22 nt, Human
agugaugguuuccagucacuga

SEQ ID NO: 216420 - RNA, 22 nt, Human
uuacuaguggagaaacugaggc

SEQ ID NO: 216421 - RNA, 22 nt, Human
uuuguauaagaacauucuagca

SEQ ID NO: 216422 - RNA, 22 nt, Human
uauugcugaaaugcugaguuca

SEQ ID NO: 216423 - RNA, 22 nt, Human
aucuuugugcuaauguaguucu

SEQ ID NO: 216424 - RNA, 20 nt, Human
cccaggugucugaagcucug

SEQ ID NO: 216425 - RNA, 22 nt, Human
ugucugucuguccuucucauua

SEQ ID NO: 216426 - RNA, 22 nt, Human
guguguccucauaagauggagg

SEQ ID NO: 216427 - RNA, 22 nt, Human
gaggcugugucuugggguggaa

SEQ ID NO: 216428 - RNA, 21 nt, Human
ccugccaggaaacugaguguc

SEQ ID NO: 216429 - RNA, 22 nt, Human
uuccugugcuuauucuucucug

SEQ ID NO: 216430 - RNA, 22 nt, Human
uccaggauggugacgguggcca

SEQ ID NO: 216431 - RNA, 20 nt, Human
ugcuccaggaacacuggccg

SEQ ID NO: 216432 - RNA, 22 nt, Human
uuuacaacuuucuguucuguau

SEQ ID NO: 216433 - RNA, 22 nt, Human
ggaaguuguaugaucggggaau

SEQ ID NO: 216434 - RNA, 22 nt, Human
uccccagaggugaggcagcuuu

SEQ ID NO: 216435 - RNA, 22 nt, Human
cuuauuuuaagucaguuugggu

SEQ ID NO: 216436 - RNA, 22 nt, Human
gcagaguugaugcaaguacuga

SEQ ID NO: 216437 - RNA, 22 nt, Human
ugucuccaccaucaucuuacca

SEQ ID NO: 216438 - RNA, 22 nt, Human
ggcgcacaaugugcagguuugu

SEQ ID NO: 216439 - RNA, 22 nt, Human
aguccaugguucugacucaucu

SEQ ID NO: 216440 - RNA, 22 nt, Human
uuugucagucaugucugcuuuu

SEQ ID NO: 216441 - RNA, 22 nt, Human
ggcaaagagacaugcaucgggg

SEQ ID NO: 216442 - RNA, 22 nt, Human
cuauuuaucuauuucugaauga

SEQ ID NO: 216443 - RNA, 22 nt, Human
aaaauugguuccuuucugaggc

SEQ ID NO: 216444 - RNA, 22 nt, Human
aucuguggaaagguaaccagua

SEQ ID NO: 216445 - RNA, 22 nt, Human
ucuuaaguaccuccuuuaucac

SEQ ID NO: 216446 - RNA, 22 nt, Human
uagggcagaguccaggaugggc

SEQ ID NO: 216447 - RNA, 22 nt, Human
acuucucugcuaccugcaaaga

SEQ ID NO: 216448 - RNA, 20 nt, Human
uagaaucuguucugauucau

SEQ ID NO: 216449 - RNA, 22 nt, Human
uauuuucaucuuguccuuggau

SEQ ID NO: 216450 - RNA, 22 nt, Human
cagaaccugagagcacaauccu

SEQ ID NO: 216451 - RNA, 22 nt, Human
cuagaaucccaaauggacuggg

SEQ ID NO: 216452 - RNA, 22 nt, Human
ugagcagagacgggggccucca

SEQ ID NO: 216453 - RNA, 22 nt, Human
ugagcuggaggacaggagggua

SEQ ID NO: 216454 - RNA, 22 nt, Human
aguggcaucaacuuuaucugua

SEQ ID NO: 216455 - RNA, 22 nt, Human
uuguccaaggucccacaguuag

SEQ ID NO: 216456 - RNA, 22 nt, Human
caggucuguuuccaucagugcu

SEQ ID NO: 216457 - RNA, 22 nt, Human
gucucagguucgagccuccuua

SEQ ID NO: 216458 - RNA, 22 nt, Human
ucauuguagggcauuuagagag

SEQ ID NO: 216459 - RNA, 21 nt, Human
uaaagaagaugaaugugauca

SEQ ID NO: 216460 - RNA, 22 nt, Human
uuaggaagaaggaggcaguauu

SEQ ID NO: 216461 - RNA, 22 nt, Human
acaccaaaguagaauuaaugua

SEQ ID NO: 216462 - RNA, 22 nt, Human
aagugccugaccuagccuggag

SEQ ID NO: 216463 - RNA, 22 nt, Human
gcaccugggacccagaggcacc

SEQ ID NO: 216464 - RNA, 18 nt, Human
acagggagggcgcugggg

SEQ ID NO: 216465 - RNA, 21 nt, Human
auuuccacauaaucauaagac

SEQ ID NO: 216466 - RNA, 22 nt, Human
ccugggaaggggaagagaauuc

SEQ ID NO: 216467 - RNA, 22 nt, Human
ggagccugggccuccugcccuu

SEQ ID NO: 216468 - RNA, 22 nt, Human
gcuugggaagggcccuguguac

SEQ ID NO: 216469 - RNA, 22 nt, Human
guggccuggauagacuccaucu

SEQ ID NO: 216470 - RNA, 22 nt, Human
cuacuuccagggguggggcuca

SEQ ID NO: 216471 - RNA, 22 nt, Human
gagagcuccuucaggaagcuuc

SEQ ID NO: 216472 - RNA, 18 nt, Human
cggcuucugucaccuugc

SEQ ID NO: 216473 - RNA, 22 nt, Human
uugaggcacagauuuuaguggc

SEQ ID NO: 216474 - RNA, 22 nt, Human
cuguccagucuuuagcaagcug

SEQ ID NO: 216475 - RNA, 23 nt, Human
ucccucaggccuuaucuccaucu

SEQ ID NO: 216476 - RNA, 22 nt, Human
auauuccauugguuucccuucu

SEQ ID NO: 216477 - RNA, 22 nt, Human
cccuggcaugcaugucccuggc

SEQ ID NO: 216478 - RNA, 22 nt, Human
ucuucuucccaucccucaaaug

SEQ ID NO: 216479 - RNA, 22 nt, Human
ucuguggccuguguccaagugc

SEQ ID NO: 216480 - RNA, 22 nt, Human
aaugucugccagaacugaucau

SEQ ID NO: 216481 - RNA, 22 nt, Human
aauggcuuuuaaaaauagcauu

SEQ ID NO: 216482 - RNA, 22 nt, Human
uaauuagaguuugguaaacaau

SEQ ID NO: 216483 - RNA, 22 nt, Human
ucaggacaacauguugcuaauc

SEQ ID NO: 216484 - RNA, 22 nt, Human
cugggucugucacuagauaaau

SEQ ID NO: 216485 - RNA, 22 nt, Human
agggagccagaguugggagcuc

SEQ ID NO: 216486 - RNA, 21 nt, Human
cuuggcugcagugacaggcau

SEQ ID NO: 216487 - RNA, 22 nt, Human
acagguuugcugcuguuuuagg

SEQ ID NO: 216488 - RNA, 22 nt, Human
aggcagccaguucagguuucuu

SEQ ID NO: 216489 - RNA, 22 nt, Human
uucuuacauuacuuuacaugug

SEQ ID NO: 216490 - RNA, 22 nt, Human
uggugggaguccgcugugcugc

SEQ ID NO: 216491 - RNA, 22 nt, Human
gccaggcugcuggcugcugucc

SEQ ID NO: 216492 - RNA, 22 nt, Human
gcugggaagugcaagaucaagg

SEQ ID NO: 216493 - RNA, 22 nt, Human
cuccugggaggaugcggacccg

SEQ ID NO: 216494 - RNA, 22 nt, Human
aagaagaugguuaacuuucagu

SEQ ID NO: 216495 - RNA, 22 nt, Human
gcccagaguggccacuuggcuc

SEQ ID NO: 216496 - RNA, 21 nt, Human
gcauucuucaugugauucaga

SEQ ID NO: 216497 - RNA, 22 nt, Human
augaauacgcggucauacacau

SEQ ID NO: 216498 - RNA, 22 nt, Human
cuccagcucgcgagcucugcuc

SEQ ID NO: 216499 - RNA, 22 nt, Human
uucucagagugaccaagucuuu

SEQ ID NO: 216500 - RNA, 21 nt, Human
caauuacuuuugcaccgacuu

SEQ ID NO: 216501 - RNA, 17 nt, Human
gauuuccugaaguucuu

SEQ ID NO: 216502 - RNA, 22 nt, Human
uccaggaggccucauuuccugu

SEQ ID NO: 216503 - RNA, 20 nt, Human
cagcccuuuauccuccuaug

SEQ ID NO: 216504 - RNA, 22 nt, Human
uugauucagaaaaagauggaga

SEQ ID NO: 216505 - RNA, 22 nt, Human
accuucaaugaaaauaauaguc

SEQ ID NO: 216506 - RNA, 22 nt, Human
ucugccuuguuugagcuuugac

SEQ ID NO: 216507 - RNA, 22 nt, Human
acaauuucuaauauagaucuua

SEQ ID NO: 216508 - RNA, 22 nt, Human
guucugcuuaaauuauugaucc

SEQ ID NO: 216509 - RNA, 22 nt, Human
acagggagucugaggggauagu

SEQ ID NO: 216510 - RNA, 18 nt, Human
uucaccagugugaugggu

SEQ ID NO: 216511 - RNA, 22 nt, Human
gcagaguuggagccagcccagg

SEQ ID NO: 216512 - RNA, 23 nt, Human
aaggccagaauuucaauggugcc

SEQ ID NO: 216513 - RNA, 18 nt, Human
agaauuaccaaagugcuu

SEQ ID NO: 216514 - RNA, 22 nt, Human
aguuacaaccaugacacaagca

SEQ ID NO: 216515 - RNA, 22 nt, Human
agaugcugcuccacaggccagg

SEQ ID NO: 216516 - RNA, 22 nt, Human
gaagaggcuuuccuagggcaag

SEQ ID NO: 216517 - RNA, 22 nt, Human
ggagucuguuuuacaugcagga

SEQ ID NO: 216518 - RNA, 22 nt, Human
aucuuuaggaaccuaaccuauu

SEQ ID NO: 216519 - RNA, 22 nt, Human
uucucuggcgguguguuuuccu

SEQ ID NO: 216520 - RNA, 19 nt, Human
ucaggaaguugaugaggug

SEQ ID NO: 216521 - RNA, 22 nt, Human
aguggcuuuuuaguggcagaug

SEQ ID NO: 216522 - RNA, 22 nt, Human
ugacaagaagaccugguaauga

SEQ ID NO: 216523 - RNA, 22 nt, Human
uuagagcugggauggauuuucc

SEQ ID NO: 216524 - RNA, 22 nt, Human
agucucugcaugaugcagcaca

SEQ ID NO: 216525 - RNA, 22 nt, Human
cccucccaagcacucugacaua

SEQ ID NO: 216526 - RNA, 22 nt, Human
ucuggcagcgaagcguguacuu

SEQ ID NO: 216527 - RNA, 22 nt, Human
caagcugggucccaacaauuac

SEQ ID NO: 216528 - RNA, 18 nt, Human
cuccugggcugcagaugc

SEQ ID NO: 216529 - RNA, 22 nt, Human
cugagaagaggguauguggcgc

SEQ ID NO: 216530 - RNA, 22 nt, Human
aaggugucacuguuucuggccu

SEQ ID NO: 216531 - RNA, 22 nt, Human
acauaagugcacaauaaauauu

SEQ ID NO: 216532 - RNA, 22 nt, Human
ccaggagccacucaggcccaca

SEQ ID NO: 216533 - RNA, 22 nt, Human
gcuuccggagccaaaaggcccc

SEQ ID NO: 216534 - RNA, 22 nt, Human
gcuccccagcuuagcccuggcu

SEQ ID NO: 216535 - RNA, 22 nt, Human
gcaggcugcugagauccuuagg

SEQ ID NO: 216536 - RNA, 22 nt, Human
ugcucaggagcuuagagcacag

SEQ ID NO: 216537 - RNA, 22 nt, Human
aagcuugaaucaauggauaucc

SEQ ID NO: 216538 - RNA, 22 nt, Human
augaaauggugguuuuccauuu

SEQ ID NO: 216539 - RNA, 22 nt, Human
ucagggcacauucugcaguggc

SEQ ID NO: 216540 - RNA, 22 nt, Human
auugacaagaaagauauuuuua

SEQ ID NO: 216541 - RNA, 22 nt, Human
ugagcccagagcccuuguaggg

SEQ ID NO: 216542 - RNA, 22 nt, Human
gcaggcugaguugggaaaccaa

SEQ ID NO: 216543 - RNA, 19 nt, Human
aggccugggguuuugcacu

SEQ ID NO: 216544 - RNA, 22 nt, Human
agugaaaaccuaaucaugcagu

SEQ ID NO: 216545 - RNA, 17 nt, Human
gacaggcucagugacga

SEQ ID NO: 216546 - RNA, 22 nt, Human
cagcccugcugacacugucuga

SEQ ID NO: 216547 - RNA, 17 nt, Human
ugggccaguagaaggga

SEQ ID NO: 216548 - RNA, 22 nt, Human
cccacccucaagggugucuaua

SEQ ID NO: 216549 - RNA, 22 nt, Human
ucuccaaauaguuauauuuaga

SEQ ID NO: 216550 - RNA, 22 nt, Human
ugauggaaaauaaaucuuauuc

SEQ ID NO: 216551 - RNA, 22 nt, Human
cugccaggccuggggugcuguc

SEQ ID NO: 216552 - RNA, 21 nt, Human
agugacagaggaaggugcaua

SEQ ID NO: 216553 - RNA, 22 nt, Human
uccuggcugccgucguccugcg

SEQ ID NO: 216554 - RNA, 22 nt, Human
augcaggggcagcagagccugg

SEQ ID NO: 216555 - RNA, 22 nt, Human
uuauauaucuugauuuguucca

SEQ ID NO: 216556 - RNA, 22 nt, Human
uggacccaggcaggucuguccu

SEQ ID NO: 216557 - RNA, 22 nt, Human
augcacaguaaugagcugguug

SEQ ID NO: 216558 - RNA, 22 nt, Human
agagcccuaaacccugccuugg

SEQ ID NO: 216559 - RNA, 22 nt, Human
ugaaugauuaaaacccggacua

SEQ ID NO: 216560 - RNA, 22 nt, Human
ggcucugcugcacccuuggcuc

SEQ ID NO: 216561 - RNA, 23 nt, Human
ugggccuggccucccaguccagc

SEQ ID NO: 216562 - RNA, 22 nt, Human
uugagcuugaggaguuauuuga

SEQ ID NO: 216563 - RNA, 22 nt, Human
caaaagucuuccuauucucuua

SEQ ID NO: 216564 - RNA, 22 nt, Human
aaaucaugaggacauuaugcca

SEQ ID NO: 216565 - RNA, 22 nt, Human
ggcucugccauuuccuagcugc

SEQ ID NO: 216566 - RNA, 22 nt, Human
ccaaggcuggagugcaguggcg

SEQ ID NO: 216567 - RNA, 22 nt, Human
agucuccacccaugacaguaca

SEQ ID NO: 216568 - RNA, 22 nt, Human
uuaguuaguggggcugucaguc

SEQ ID NO: 216569 - RNA, 22 nt, Human
aacacuuucuuccuugcucagg

SEQ ID NO: 216570 - RNA, 22 nt, Human
aaaggucuucucaaacauccca

SEQ ID NO: 216571 - RNA, 22 nt, Human
gccuguuuaucuaucaugaacu

SEQ ID NO: 216572 - RNA, 22 nt, Human
agacuuagugaguucuaaguuu

SEQ ID NO: 216573 - RNA, 19 nt, Human
aagggcugggcaccucacu

SEQ ID NO: 216574 - RNA, 22 nt, Human
gcucugggcugaaucauuuauc

SEQ ID NO: 216575 - RNA, 19 nt, Human
auuuauuguaugauuccau

SEQ ID NO: 216576 - RNA, 22 nt, Human
caaaugcaggucagcagguguc

SEQ ID NO: 216577 - RNA, 23 nt, Human
augccaggcugccuggccagccu

SEQ ID NO: 216578 - RNA, 22 nt, Human
gaaggccauuagagccugugcc

SEQ ID NO: 216579 - RNA, 22 nt, Human
gcagggcauagaggcacggagg

SEQ ID NO: 216580 - RNA, 22 nt, Human
cguccagggcgggcuccccuca

SEQ ID NO: 216581 - RNA, 22 nt, Human
cugggcaaauugugccagcuau

SEQ ID NO: 216582 - RNA, 22 nt, Human
cucuagaacugauugggaagaa

SEQ ID NO: 216583 - RNA, 22 nt, Human
aagggggcacagucacuguaau

SEQ ID NO: 216584 - RNA, 22 nt, Human
ccaggccuccugugaguggacc

SEQ ID NO: 216585 - RNA, 22 nt, Human
uaagcaagggucucuguaucag

SEQ ID NO: 216586 - RNA, 19 nt, Human
uagggcuggccgggcggug

SEQ ID NO: 216587 - RNA, 21 nt, Human
uugaaaguaaauucagcagcu

SEQ ID NO: 216588 - RNA, 22 nt, Human
cagaggcauauaauugcugggg

SEQ ID NO: 216589 - RNA, 19 nt, Human
cucuccagcuccaguagcu

SEQ ID NO: 216590 - RNA, 22 nt, Human
uggcagcauguuauguaaggaa

SEQ ID NO: 216591 - RNA, 22 nt, Human
uuucccaguucccugcucuaua

SEQ ID NO: 216592 - RNA, 22 nt, Human
ugcuuuaucaaagcuauaguga

SEQ ID NO: 216593 - RNA, 22 nt, Human
uuucacagcuggguggcagagu

SEQ ID NO: 216594 - RNA, 22 nt, Human
gucaggcuggggcugcugccag

SEQ ID NO: 216595 - RNA, 22 nt, Human
ccugccugcaccuucucugggg

SEQ ID NO: 216596 - RNA, 22 nt, Human
acaaaauuaccuaguuauuuuc

SEQ ID NO: 216597 - RNA, 22 nt, Human
cagcccugcugguuuugggcaa

SEQ ID NO: 216598 - RNA, 20 nt, Human
gcuguggcaagugcucacug

SEQ ID NO: 216599 - RNA, 22 nt, Human
uacauguauguguuaauaucug

SEQ ID NO: 216600 - RNA, 19 nt, Human
ucaugucucucaucuguga

SEQ ID NO: 216601 - RNA, 23 nt, Human
uguguccuuaacuguauauacua

SEQ ID NO: 216602 - RNA, 22 nt, Human
gagacaggccaggugguacuua

SEQ ID NO: 216603 - RNA, 22 nt, Human
guagcuauuuaugauacucaug

SEQ ID NO: 216604 - RNA, 22 nt, Human
agcaggugcauggcgagcgcgg

SEQ ID NO: 216605 - RNA, 22 nt, Human
agaggcacaacagucccauugu

SEQ ID NO: 216606 - RNA, 22 nt, Human
ucaaugaggugauugcuguccu

SEQ ID NO: 216607 - RNA, 22 nt, Human
cucacaggcaucucaucaggcu

SEQ ID NO: 216608 - RNA, 22 nt, Human
gcaaaauuuacacuccuucuuc

SEQ ID NO: 216609 - RNA, 22 nt, Human
acacaucugcaagagccagacc

SEQ ID NO: 216610 - RNA, 22 nt, Human
acaggucuccagagugagagga

SEQ ID NO: 216611 - RNA, 22 nt, Human
cauuucauuccuuugaaagugg

SEQ ID NO: 216612 - RNA, 22 nt, Human
acacagagcuucucaacuggga

SEQ ID NO: 216613 - RNA, 22 nt, Human
gggaagagaccguacccuggcc

SEQ ID NO: 216614 - RNA, 22 nt, Human
uggaggcaccacuggcugcccg

SEQ ID NO: 216615 - RNA, 22 nt, Human
cccaguggggaaauagcuagcu

SEQ ID NO: 216616 - RNA, 22 nt, Human
cugaggagaccaucaacuaauu

SEQ ID NO: 216617 - RNA, 22 nt, Human
aaggggaaaaaguguuaggagu

SEQ ID NO: 216618 - RNA, 22 nt, Human
uugcuuuaagguaucuggagaa

SEQ ID NO: 216619 - RNA, 22 nt, Human
gagguccagagcagguucagug

SEQ ID NO: 216620 - RNA, 22 nt, Human
agucucugggcaugguugugac

SEQ ID NO: 216621 - RNA, 22 nt, Human
uacacacaugcauuugccuuau

SEQ ID NO: 216622 - RNA, 22 nt, Human
auuuuccucugguuuccccaga

SEQ ID NO: 216623 - RNA, 22 nt, Human
gcucaaaugucauggggagccu

SEQ ID NO: 216624 - RNA, 22 nt, Human
aggccugucccagcugaggacg

SEQ ID NO: 216625 - RNA, 22 nt, Human
accaggccuagcaaguacauua

SEQ ID NO: 216626 - RNA, 22 nt, Human
uacaaaugaaccaacuuugaug

SEQ ID NO: 216627 - RNA, 19 nt, Human
ucagucuaggaaugagcua

SEQ ID NO: 216628 - RNA, 22 nt, Human
auuguacauaugauguauguaa

SEQ ID NO: 216629 - RNA, 22 nt, Human
gaccagcucucugaagaaagag

SEQ ID NO: 216630 - RNA, 22 nt, Human
ucucugagaaguuccuuuguga

SEQ ID NO: 216631 - RNA, 22 nt, Human
aucucuguuuuaggagauagug

SEQ ID NO: 216632 - RNA, 22 nt, Human
caggagcaguuagaagcccacu

SEQ ID NO: 216633 - RNA, 19 nt, Human
acccaggguugauguccag

SEQ ID NO: 216634 - RNA, 22 nt, Human
ugcugccaagcccgugcuccug

SEQ ID NO: 216635 - RNA, 22 nt, Human
gcugggagugggcaagaugaga

SEQ ID NO: 216636 - RNA, 22 nt, Human
cucagagagugaauuccugccu

SEQ ID NO: 216637 - RNA, 21 nt, Human
ucaggaagagccaguucaugc

SEQ ID NO: 216638 - RNA, 22 nt, Human
aaggcuucuuaugcaauuguuu

SEQ ID NO: 216639 - RNA, 22 nt, Human
agucucuuuugcgaagaguguu

SEQ ID NO: 216640 - RNA, 22 nt, Human
cagggacugagauccagacugu

SEQ ID NO: 216641 - RNA, 22 nt, Human
auccuguggggcggcugcaggg

SEQ ID NO: 216642 - RNA, 22 nt, Human
guccucugagggggcugcacgc

SEQ ID NO: 216643 - RNA, 22 nt, Human
cagaagaaaucauuaucuggac

SEQ ID NO: 216644 - RNA, 22 nt, Human
uuccagaauuuuguucugcuug

SEQ ID NO: 216645 - RNA, 22 nt, Human
ccuggggagaagagcuuccccc

SEQ ID NO: 216646 - RNA, 22 nt, Human
ugcuagggauauaguggcgagu

SEQ ID NO: 216647 - RNA, 22 nt, Human
acagguguugacucacaggccc

SEQ ID NO: 216648 - RNA, 23 nt, Human
ggcuggugcccuuggccagucgg

SEQ ID NO: 216649 - RNA, 22 nt, Human
aaaaucuaaguagcgaguaagg

SEQ ID NO: 216650 - RNA, 22 nt, Human
gccuggcuugccagcccuggcg

SEQ ID NO: 216651 - RNA, 22 nt, Human
aaacaaugaaauauuuuuaugg

SEQ ID NO: 216652 - RNA, 22 nt, Human
auggcuuccaaggcccuccgug

SEQ ID NO: 216653 - RNA, 19 nt, Human
uauuuacuucuugauugca

SEQ ID NO: 216654 - RNA, 22 nt, Human
aaaguugaguuuuauguguuac

SEQ ID NO: 216655 - RNA, 22 nt, Human
uuucaagucauucuauaauauc

SEQ ID NO: 216656 - RNA, 22 nt, Human
caaguuuuagaaauaucuggau

SEQ ID NO: 216657 - RNA, 22 nt, Human
agaggggaguccuaaucugauu

SEQ ID NO: 216658 - RNA, 22 nt, Human
gagcccucucuguaggcaagua

SEQ ID NO: 216659 - RNA, 23 nt, Human
uggggagggaagucauuucugua

SEQ ID NO: 216660 - RNA, 22 nt, Human
agggaaggcuuuugacauuucc

SEQ ID NO: 216661 - RNA, 22 nt, Human
uucaacuauuaugaauaaaauu

SEQ ID NO: 216662 - RNA, 22 nt, Human
aaagugcugggauuacaagugu

SEQ ID NO: 216663 - RNA, 22 nt, Human
ucucagagcuucagaaagcacc

SEQ ID NO: 216664 - RNA, 22 nt, Human
caggguggccagguagauaaua

SEQ ID NO: 216665 - RNA, 19 nt, Human
acuggcaguuucugcaugg

SEQ ID NO: 216666 - RNA, 22 nt, Human
gcugaaauuagacugcagaagu

SEQ ID NO: 216667 - RNA, 22 nt, Human
ugccucccucucugccacugga

SEQ ID NO: 216668 - RNA, 22 nt, Human
agucugucuuuggcuucaccac

SEQ ID NO: 216669 - RNA, 22 nt, Human
ggcccugcucaggcugcgauga

SEQ ID NO: 216670 - RNA, 22 nt, Human
agcugaggcucugagagggaag

SEQ ID NO: 216671 - RNA, 22 nt, Human
cucuuucugauucgcugggacc

SEQ ID NO: 216672 - RNA, 22 nt, Human
cagugaggugcccagccugccc

SEQ ID NO: 216673 - RNA, 22 nt, Human
gggggaugcucaggaggcugcu

SEQ ID NO: 216674 - RNA, 22 nt, Human
acagaacugcagacagugccaa

SEQ ID NO: 216675 - RNA, 22 nt, Human
ucauauuuauauguuggcacag

SEQ ID NO: 216676 - RNA, 22 nt, Human
agagccaggaucuguuuugggg

SEQ ID NO: 216677 - RNA, 20 nt, Human
agguuuauauuuagaggugu

SEQ ID NO: 216678 - RNA, 22 nt, Human
cagguggcagaggucucuggaa

SEQ ID NO: 216679 - RNA, 22 nt, Human
uacauuccugggcuccacccua

SEQ ID NO: 216680 - RNA, 22 nt, Human
uauaaagaaguguaaacaggaa

SEQ ID NO: 216681 - RNA, 22 nt, Human
cgcauacauagaaacacacaga

SEQ ID NO: 216682 - RNA, 22 nt, Human
auggucaguugcagcuaauguu

SEQ ID NO: 216683 - RNA, 22 nt, Human
ggcugagcccccucugcguagg

SEQ ID NO: 216684 - RNA, 22 nt, Human
aaaguaacaauaagguucuauu

SEQ ID NO: 216685 - RNA, 22 nt, Human
gcucaggccucacuccauuugg

SEQ ID NO: 216686 - RNA, 22 nt, Human
ucacaucauggagaauuauggg

SEQ ID NO: 216687 - RNA, 22 nt, Human
gucuggcucuggaaggcaaagg

SEQ ID NO: 216688 - RNA, 22 nt, Human
cccaggaugaucgagaguggga

SEQ ID NO: 216689 - RNA, 22 nt, Human
ucauuauccuaguaucuugaau

SEQ ID NO: 216690 - RNA, 22 nt, Human
agugcuuugguauagaacuauu

SEQ ID NO: 216691 - RNA, 22 nt, Human
ggcaugcucuuuguccacagua

SEQ ID NO: 216692 - RNA, 22 nt, Human
auuugauaguaugacagggcag

SEQ ID NO: 216693 - RNA, 22 nt, Human
aggcaggugggagugauuccuu

SEQ ID NO: 216694 - RNA, 20 nt, Human
augccucuaauuuugcaaac

SEQ ID NO: 216695 - RNA, 22 nt, Human
uggaugagaaacucuggugacu

SEQ ID NO: 216696 - RNA, 22 nt, Human
cuuauucauaagucagacacac

SEQ ID NO: 216697 - RNA, 22 nt, Human
augcugaagaaucacagggacu

SEQ ID NO: 216698 - RNA, 17 nt, Human
cugggccucugcccuuu

SEQ ID NO: 216699 - RNA, 22 nt, Human
caggcuggagugcaguugugca

SEQ ID NO: 216700 - RNA, 22 nt, Human
ugcucaggcccugggccauccu

SEQ ID NO: 216701 - RNA, 20 nt, Human
agcugcaacagacuguaugg

SEQ ID NO: 216702 - RNA, 22 nt, Human
auguuuacugaaaagauuucaa

SEQ ID NO: 216703 - RNA, 22 nt, Human
uaagcaaaggauuuugaucuuu

SEQ ID NO: 216704 - RNA, 22 nt, Human
cccuuggcuucuauggguuuuc

SEQ ID NO: 216705 - RNA, 22 nt, Human
ggcucccuagggagagugggag

SEQ ID NO: 216706 - RNA, 18 nt, Human
ucuagaaacuucucuccu

SEQ ID NO: 216707 - RNA, 22 nt, Human
aacuccaggcagggaggccacu

SEQ ID NO: 216708 - RNA, 22 nt, Human
gcucagagauggggaaugaaaa

SEQ ID NO: 216709 - RNA, 22 nt, Human
gcauucagccuaaagagaaaag

SEQ ID NO: 216710 - RNA, 22 nt, Human
ggcugugcgucauccggcugca

SEQ ID NO: 216711 - RNA, 22 nt, Human
auugcuggaugagcucuuggau

SEQ ID NO: 216712 - RNA, 22 nt, Human
aucuguggcuggugagaggcag

SEQ ID NO: 216713 - RNA, 22 nt, Human
ggccacauguggcugcucguau

SEQ ID NO: 216714 - RNA, 22 nt, Human
aaacagagagauguauguggag

SEQ ID NO: 216715 - RNA, 22 nt, Human
gcuggcaguuuccucaccgagg

SEQ ID NO: 216716 - RNA, 22 nt, Human
agaguuaaggccacugucagua

SEQ ID NO: 216717 - RNA, 22 nt, Human
ccaggucuucacuuuacugaag

SEQ ID NO: 216718 - RNA, 22 nt, Human
uucuggcaucugggggaggccu

SEQ ID NO: 216719 - RNA, 21 nt, Human
ccagcagcucaaggaucucuu

SEQ ID NO: 216720 - RNA, 22 nt, Human
caaguauuuccugauggccugu

SEQ ID NO: 216721 - RNA, 22 nt, Human
acuccuggugcugaugaagaga

SEQ ID NO: 216722 - RNA, 22 nt, Human
ugagcccaggaguuggagaccg

SEQ ID NO: 216723 - RNA, 22 nt, Human
uuucauugcagagucugugugc

SEQ ID NO: 216724 - RNA, 22 nt, Human
uugcaucuaccauaucaaagau

SEQ ID NO: 216725 - RNA, 22 nt, Human
ugaaggcauaaaucuugggaac

SEQ ID NO: 216726 - RNA, 22 nt, Human
gagguucacuuccugaaauagc

SEQ ID NO: 216727 - RNA, 22 nt, Human
uucacaguggcccucucugagu

SEQ ID NO: 216728 - RNA, 20 nt, Human
ggcauggguggggcucccag

SEQ ID NO: 216729 - RNA, 22 nt, Human
cuauuauuauguuaacuggacu

SEQ ID NO: 216730 - RNA, 22 nt, Human
cuuggcuguugggcauugagaa

SEQ ID NO: 216731 - RNA, 22 nt, Human
ccugggcaacauagugagaccu

SEQ ID NO: 216732 - RNA, 22 nt, Human
cagguggcuaacggccucauag

SEQ ID NO: 216733 - RNA, 20 nt, Human
aggcucagcugagcucuugg

SEQ ID NO: 216734 - RNA, 22 nt, Human
agacacagucugucuggaggag

SEQ ID NO: 216735 - RNA, 22 nt, Human
gcaggcagccacgauucccuug

SEQ ID NO: 216736 - RNA, 23 nt, Human
gccuccaaaccucuaggcuggug

SEQ ID NO: 216737 - RNA, 23 nt, Human
ucagaacaaugccuuaggggcau

SEQ ID NO: 216738 - RNA, 22 nt, Human
ucucacaagcucaaggauuagu

SEQ ID NO: 216739 - RNA, 23 nt, Human
cccugagcugguccaggcucaac

SEQ ID NO: 216740 - RNA, 19 nt, Human
gaaggggaagguggguacc

SEQ ID NO: 216741 - RNA, 22 nt, Human
aguuagaguuaauuuccuaaca

SEQ ID NO: 216742 - RNA, 22 nt, Human
ucuggaauuuucuagggcauca

SEQ ID NO: 216743 - RNA, 19 nt, Human
ggugugaagugaggaguua

SEQ ID NO: 216744 - RNA, 22 nt, Human
gaauagcuuagauuccuuagug

SEQ ID NO: 216745 - RNA, 22 nt, Human
aauaguaaaagauacagcuaau

SEQ ID NO: 216746 - RNA, 22 nt, Human
uggcucucaauggcuguacuau

SEQ ID NO: 216747 - RNA, 22 nt, Human
agcugaagcaacaacaggaugg

SEQ ID NO: 216748 - RNA, 22 nt, Human
uuacaguuuaccaagaauauug

SEQ ID NO: 216749 - RNA, 22 nt, Human
ccuggcagcgugccgagcugcg

SEQ ID NO: 216750 - RNA, 22 nt, Human
uccugggaagagaccugagcau

SEQ ID NO: 216751 - RNA, 22 nt, Human
ccugcucuccauacacuuucua

SEQ ID NO: 216752 - RNA, 22 nt, Human
aacaaaugaccugauuucuucc

SEQ ID NO: 216753 - RNA, 22 nt, Human
cugccugugauuuuucucuagu

SEQ ID NO: 216754 - RNA, 22 nt, Human
cgagagccggaaggggcggugc

SEQ ID NO: 216755 - RNA, 22 nt, Human
ggcugugcugagggggaagccc

SEQ ID NO: 216756 - RNA, 22 nt, Human
gggggaggugaaugcaauaagg

SEQ ID NO: 216757 - RNA, 22 nt, Human
caguguuuguauagaauaugca

SEQ ID NO: 216758 - RNA, 22 nt, Human
cauuuguuaagaaggaaaaagg

SEQ ID NO: 216759 - RNA, 22 nt, Human
uccagccaggauggcccaggga

SEQ ID NO: 216760 - RNA, 22 nt, Human
uccagcccaggcuggaguguag

SEQ ID NO: 216761 - RNA, 22 nt, Human
agcucuuacauuuaggucuaug

SEQ ID NO: 216762 - RNA, 22 nt, Human
auuggucuaaaguuaagaagau

SEQ ID NO: 216763 - RNA, 22 nt, Human
agcuuccugucuucugcacaaa

SEQ ID NO: 216764 - RNA, 22 nt, Human
ucugauuuacuggaaaaaagga

SEQ ID NO: 216765 - RNA, 22 nt, Human
cagagguuugaucgaguagguc

SEQ ID NO: 216766 - RNA, 22 nt, Human
uuagagcuagaugaggucauga

SEQ ID NO: 216767 - RNA, 22 nt, Human
ugucacauguguggcauuuuuc

SEQ ID NO: 216768 - RNA, 22 nt, Human
gaggcucagagugguuaaauaa

SEQ ID NO: 216769 - RNA, 22 nt, Human
uccaggcagggcagccaucaag

SEQ ID NO: 216770 - RNA, 22 nt, Human
cuuucauuugauaagaaugcca

SEQ ID NO: 216771 - RNA, 22 nt, Human
gccugcucagaccuagcaggcc

SEQ ID NO: 216772 - RNA, 22 nt, Human
cacaggcuugucagcaugaggc

SEQ ID NO: 216773 - RNA, 22 nt, Human
gcagggcaaauguggaaaggag

SEQ ID NO: 216774 - RNA, 22 nt, Human
ugagaugcugggaacaaggaag

SEQ ID NO: 216775 - RNA, 22 nt, Human
gccaggcucaguagcgauuccu

SEQ ID NO: 216776 - RNA, 22 nt, Human
cccaggagacagaaacagaggu

SEQ ID NO: 216777 - RNA, 22 nt, Human
ugaaggagcugauguaaggggu

SEQ ID NO: 216778 - RNA, 22 nt, Human
gugugcagggggccagcgcagc

SEQ ID NO: 216779 - RNA, 22 nt, Human
uaggugucagguauagaauuua

SEQ ID NO: 216780 - RNA, 22 nt, Human
gaggcucaguuauuuuagccug

SEQ ID NO: 216781 - RNA, 22 nt, Human
ggcugguguugagugccuguag

SEQ ID NO: 216782 - RNA, 22 nt, Human
aacuuuaucggaacagguacuc

SEQ ID NO: 216783 - RNA, 22 nt, Human
ggaccugccagaacucaggcua

SEQ ID NO: 216784 - RNA, 22 nt, Human
aguuagaauagucagauuguag

SEQ ID NO: 216785 - RNA, 22 nt, Human
cccugggauugccuuggccuug

SEQ ID NO: 216786 - RNA, 22 nt, Human
ggcuuggaaaugguaaugagcu

SEQ ID NO: 216787 - RNA, 22 nt, Human
uaggaacaaagagccucacauu

SEQ ID NO: 216788 - RNA, 22 nt, Human
agcaggcugggcaauaugggca

SEQ ID NO: 216789 - RNA, 22 nt, Human
gccuguuuacuuugccgcagga

SEQ ID NO: 216790 - RNA, 22 nt, Human
guugaaaguggagaaccugguu

SEQ ID NO: 216791 - RNA, 22 nt, Human
uugggcuggcccuugucucugg

SEQ ID NO: 216792 - RNA, 22 nt, Human
gagugggcaaaagaaaguaggc

SEQ ID NO: 216793 - RNA, 22 nt, Human
gauacacaaguggaaggagacg

SEQ ID NO: 216794 - RNA, 22 nt, Human
gucccaggcaggccacuggcag

SEQ ID NO: 216795 - RNA, 22 nt, Human
acacauuaugagcaguugucuu

SEQ ID NO: 216796 - RNA, 22 nt, Human
cugugaaaugcuuugcgauggu

SEQ ID NO: 216797 - RNA, 22 nt, Human
ccagagaggggaagggcuugcc

SEQ ID NO: 216798 - RNA, 23 nt, Human
aaggugucauugaugggauucua

SEQ ID NO: 216799 - RNA, 22 nt, Human
aacugucuuaauaacaaaagcu

SEQ ID NO: 216800 - RNA, 22 nt, Human
gagaggcucugaggacuggggu

SEQ ID NO: 216801 - RNA, 22 nt, Human
cuccuugguguaguacugagca

SEQ ID NO: 216802 - RNA, 22 nt, Human
ggacagcccauacacaugucug

SEQ ID NO: 216803 - RNA, 20 nt, Human
ggcaggugcuguccccuccu

SEQ ID NO: 216804 - RNA, 22 nt, Human
ucccagggcagcuguccagaag

SEQ ID NO: 216805 - RNA, 18 nt, Human
ugguuugucaugagaauu

SEQ ID NO: 216806 - RNA, 22 nt, Human
ugaggcucagaaauguaaguuu

SEQ ID NO: 216807 - RNA, 22 nt, Human
cauuugcuguauuuucagauuc

SEQ ID NO: 216808 - RNA, 22 nt, Human
cccugggauggauuggcaggaa

SEQ ID NO: 216809 - RNA, 22 nt, Human
augauacauugcaaaauuuuaa

SEQ ID NO: 216810 - RNA, 22 nt, Human
gagcuuuagcugagaccugcuu

SEQ ID NO: 216811 - RNA, 22 nt, Human
uccauuuggccucuguauugua

SEQ ID NO: 216812 - RNA, 22 nt, Human
gucugggcuccuggcaggcagc

SEQ ID NO: 216813 - RNA, 22 nt, Human
aaacagcagcuguuuaauuugc

SEQ ID NO: 216814 - RNA, 22 nt, Human
acugucacuugcaacugugagg

SEQ ID NO: 216815 - RNA, 22 nt, Human
ggagggagcauccccuugcuga

SEQ ID NO: 216816 - RNA, 22 nt, Human
ugagucuguauguccagauuua

SEQ ID NO: 216817 - RNA, 19 nt, Human
agcaggcuaggcugccucu

SEQ ID NO: 216818 - RNA, 22 nt, Human
uucugugguugaaaggagagau

SEQ ID NO: 216819 - RNA, 22 nt, Human
guacauguaugagauaugugua

SEQ ID NO: 216820 - RNA, 23 nt, Human
cugaaauaccagaaaaucagugu

SEQ ID NO: 216821 - RNA, 22 nt, Human
uuaaaugugauuucauuuaugu

SEQ ID NO: 216822 - RNA, 22 nt, Human
gcagccugaggcccuuucuggc

SEQ ID NO: 216823 - RNA, 22 nt, Human
ucaaugagaaagacacagucuu

SEQ ID NO: 216824 - RNA, 22 nt, Human
gagaaacuaacaucugaaggug

SEQ ID NO: 216825 - RNA, 22 nt, Human
augggcagaguggggacaggaa

SEQ ID NO: 216826 - RNA, 22 nt, Human
caagcagccccaacaugaggau

SEQ ID NO: 216827 - RNA, 21 nt, Human
aacuuguauuucuccuuauuc

SEQ ID NO: 216828 - RNA, 22 nt, Human
gucaaacaaauuaacauaucca

SEQ ID NO: 216829 - RNA, 22 nt, Human
aaacauuguaauuuuagcaugg

SEQ ID NO: 216830 - RNA, 22 nt, Human
uuccagucuaguaccuggaugc

SEQ ID NO: 216831 - RNA, 22 nt, Human
gaggugagaagggggucagaug

SEQ ID NO: 216832 - RNA, 22 nt, Human
aggagauagucaaagcuucuug

SEQ ID NO: 216833 - RNA, 22 nt, Human
aggcucugacccaugggaccca

SEQ ID NO: 216834 - RNA, 22 nt, Human
cccugggaggcuuccaggcaga

SEQ ID NO: 216835 - RNA, 22 nt, Human
ucaaggaauuuaguuuaguaaa

SEQ ID NO: 216836 - RNA, 22 nt, Human
ggaacacagugccuuacaaacu

SEQ ID NO: 216837 - RNA, 19 nt, Human
gaauacagauaauaagcag

SEQ ID NO: 216838 - RNA, 22 nt, Human
gcuuugaagacuuuuccagggu

SEQ ID NO: 216839 - RNA, 22 nt, Human
agcuggccuucggugucacugg

SEQ ID NO: 216840 - RNA, 22 nt, Human
ugaaaaacuuuaauccauaaag

SEQ ID NO: 216841 - RNA, 22 nt, Human
acaguugacagggagaggguua

SEQ ID NO: 216842 - RNA, 22 nt, Human
uucuuuuacauuaagauuucag

SEQ ID NO: 216843 - RNA, 22 nt, Human
acuucccaacacuuuugagaug

SEQ ID NO: 216844 - RNA, 22 nt, Human
ucagagaauuguuuaauggaau

SEQ ID NO: 216845 - RNA, 22 nt, Human
gucugggcuuagggacauggca

SEQ ID NO: 216846 - RNA, 22 nt, Human
ugaaagaguuugacaugauucu

SEQ ID NO: 216847 - RNA, 23 nt, Human
uggcaaagcauucuuauaacagu

SEQ ID NO: 216848 - RNA, 22 nt, Human
aguaauaauagcuguaaagugc

SEQ ID NO: 216849 - RNA, 22 nt, Human
uuucugaacuugguacuggagc

SEQ ID NO: 216850 - RNA, 22 nt, Human
agugugagauuaaaccgaauca

SEQ ID NO: 216851 - RNA, 22 nt, Human
auccacagaaggaacuugaaag

SEQ ID NO: 216852 - RNA, 22 nt, Human
acaagaaagguaggauucaggu

SEQ ID NO: 216853 - RNA, 22 nt, Human
ugcagagagccagcucucucgg

SEQ ID NO: 216854 - RNA, 17 nt, Human
agugaaauuuacauugc

SEQ ID NO: 216855 - RNA, 22 nt, Human
ucaaaauuaaaccaacguccag

SEQ ID NO: 216856 - RNA, 22 nt, Human
cugagaauuacucugaugagua

SEQ ID NO: 216857 - RNA, 22 nt, Human
uaucaauacauguuaucagugu

SEQ ID NO: 216858 - RNA, 22 nt, Human
gccuggaguucagccaaguccc

SEQ ID NO: 216859 - RNA, 22 nt, Human
guggcagaaacuggcagaggag

SEQ ID NO: 216860 - RNA, 22 nt, Human
aaacagcuaauggccaggaaua

SEQ ID NO: 216861 - RNA, 22 nt, Human
aaaggaagauugagcuuuucca

SEQ ID NO: 216862 - RNA, 21 nt, Human
agaagccugaugaggucugcu

SEQ ID NO: 216863 - RNA, 22 nt, Human
gcuuaggaugaaugcuguagaa

SEQ ID NO: 216864 - RNA, 19 nt, Human
auuugaaagcugugcuugc

SEQ ID NO: 216865 - RNA, 22 nt, Human
uuuuucaugagacuagaaguca

SEQ ID NO: 216866 - RNA, 22 nt, Human
gaaggcugucagagaggagggc

SEQ ID NO: 216867 - RNA, 22 nt, Human
ugaaaugcuuaggaccagaagg

SEQ ID NO: 216868 - RNA, 22 nt, Human
auuugccuguaagacaaggccu

SEQ ID NO: 216869 - RNA, 22 nt, Human
ucuucagaggaagucagucuuu

SEQ ID NO: 216870 - RNA, 22 nt, Human
ucauuguugcguuaaugucuuc

SEQ ID NO: 216871 - RNA, 22 nt, Human
uggguaaacaauguuugccuaa

SEQ ID NO: 216872 - RNA, 20 nt, Human
aaaggaauauaugaaguaua

SEQ ID NO: 216873 - RNA, 22 nt, Human
uggcuuccuaaacugauuucca

SEQ ID NO: 216874 - RNA, 22 nt, Human
uuguggcaugugagaacuagaa

SEQ ID NO: 216875 - RNA, 22 nt, Human
aucugggcauggaggaaagaga

SEQ ID NO: 216876 - RNA, 22 nt, Human
augguaaauuuuaccuuaugua

SEQ ID NO: 216877 - RNA, 19 nt, Human
cacaugagggcugagggac

SEQ ID NO: 216878 - RNA, 22 nt, Human
agaagaauacuugauguucaug

SEQ ID NO: 216879 - RNA, 22 nt, Human
ugggccuguuucccuucagggc

SEQ ID NO: 216880 - RNA, 22 nt, Human
ugagcaggcaaacaaugguuau

SEQ ID NO: 216881 - RNA, 22 nt, Human
ccccagggacugguuucaugga

SEQ ID NO: 216882 - RNA, 22 nt, Human
caauuugacaaguugcauguuu

SEQ ID NO: 216883 - RNA, 22 nt, Human
augucuuuuaugauuacgggau

SEQ ID NO: 216884 - RNA, 23 nt, Human
gugagcagcaccaugaggcuaga

SEQ ID NO: 216885 - RNA, 18 nt, Human
auccuagaccauacacag

SEQ ID NO: 216886 - RNA, 22 nt, Human
uggacaggggcugcuguuguca

SEQ ID NO: 216887 - RNA, 22 nt, Human
ugagcaggagauaaacagguag

SEQ ID NO: 216888 - RNA, 22 nt, Human
aggagccaugagcaggaggcaa

SEQ ID NO: 216889 - RNA, 22 nt, Human
gagaaugggaaugaaaguagca

SEQ ID NO: 216890 - RNA, 19 nt, Human
aucuuuagcaacuuucaaa

SEQ ID NO: 216891 - RNA, 17 nt, Human
ucccaggaacagggaau

SEQ ID NO: 216892 - RNA, 22 nt, Human
acagugcagggugggaagaagg

SEQ ID NO: 216893 - RNA, 22 nt, Human
caguccuuggcaaguucucagu

SEQ ID NO: 216894 - RNA, 22 nt, Human
gaggagcucugcuccauccuuc

SEQ ID NO: 216895 - RNA, 22 nt, Human
accaggaagcugugagaccuuu

SEQ ID NO: 216896 - RNA, 22 nt, Human
ucacuacaaaagucucccuuuc

SEQ ID NO: 216897 - RNA, 21 nt, Human
gcccagaguccucccacucca

SEQ ID NO: 216898 - RNA, 22 nt, Human
cauuuacauaacaguaacgcug

SEQ ID NO: 216899 - RNA, 22 nt, Human
cugagacuuucaugugcuuuua

SEQ ID NO: 216900 - RNA, 22 nt, Human
cuguggcuaggaagcuguggga

SEQ ID NO: 216901 - RNA, 22 nt, Human
uccaggugagugcaggugcaga

SEQ ID NO: 216902 - RNA, 21 nt, Human
auuuagaaggaaauuuugcaa

SEQ ID NO: 216903 - RNA, 22 nt, Human
acagcuuuuaugggaccagcca

SEQ ID NO: 216904 - RNA, 22 nt, Human
ugcuguccuguuuuggaguaau

SEQ ID NO: 216905 - RNA, 22 nt, Human
uacacaucccagacucccagga

SEQ ID NO: 216906 - RNA, 22 nt, Human
uuucuauucuggaucuguggca

SEQ ID NO: 216907 - RNA, 22 nt, Human
ccucaggcaagucacuuaacau

SEQ ID NO: 216908 - RNA, 20 nt, Human
agaaccuaaguuaaaacaca

SEQ ID NO: 216909 - RNA, 22 nt, Human
ccugcuggcggggacccaguga

SEQ ID NO: 216910 - RNA, 22 nt, Human
uaauuaguguccagcuucugcu

SEQ ID NO: 216911 - RNA, 22 nt, Human
uuauugcuuuggaaaacacuca

SEQ ID NO: 216912 - RNA, 22 nt, Human
aaacauguaaguucagaucacc

SEQ ID NO: 216913 - RNA, 22 nt, Human
ggcaggaagcucauguggacug

SEQ ID NO: 216914 - RNA, 22 nt, Human
gugcugggugcugcagacaggu

SEQ ID NO: 216915 - RNA, 22 nt, Human
uaucuuuguaucaaucuccauu

SEQ ID NO: 216916 - RNA, 22 nt, Human
aucaccaggcaaaaugucagag

SEQ ID NO: 216917 - RNA, 22 nt, Human
gcugaggcuccucgggaggaca

SEQ ID NO: 216918 - RNA, 22 nt, Human
ccaggugcucuugccagggcug

SEQ ID NO: 216919 - RNA, 22 nt, Human
ucugggcugggagcguguggac

SEQ ID NO: 216920 - RNA, 22 nt, Human
aaaagcagguacucagcuuggg

SEQ ID NO: 216921 - RNA, 22 nt, Human
uggcaggguggcaacuuuuggu

SEQ ID NO: 216922 - RNA, 22 nt, Human
aagccaaggagaauggccucag

SEQ ID NO: 216923 - RNA, 20 nt, Human
cucucacagcucccucagcc

SEQ ID NO: 216924 - RNA, 22 nt, Human
ccagggcucugcuucugccaug

SEQ ID NO: 216925 - RNA, 22 nt, Human
cuggccucuguguucaccauag

SEQ ID NO: 216926 - RNA, 22 nt, Human
acagccugcagccccaggucgc

SEQ ID NO: 216927 - RNA, 22 nt, Human
ccacugucugugacaucagaaa

SEQ ID NO: 216928 - RNA, 22 nt, Human
guccuucuuuucaucccugguu

SEQ ID NO: 216929 - RNA, 22 nt, Human
aacaauguguucagcacugugg

SEQ ID NO: 216930 - RNA, 22 nt, Human
acagggccauuggaggauuaua

SEQ ID NO: 216931 - RNA, 22 nt, Human
gacaggccaggggcugaggugg

SEQ ID NO: 216932 - RNA, 22 nt, Human
ggccaugcuguugccugcuggu

SEQ ID NO: 216933 - RNA, 22 nt, Human
aaaguguugggauuauaggcgu

SEQ ID NO: 216934 - RNA, 22 nt, Human
cuuuauuccuacaagauuuucu

SEQ ID NO: 216935 - RNA, 22 nt, Human
cauuguuauagcauuacacacc

SEQ ID NO: 216936 - RNA, 22 nt, Human
ccaggacacugcuucacagcag

SEQ ID NO: 216937 - RNA, 20 nt, Human
cacucugagggaguccaugu

SEQ ID NO: 216938 - RNA, 22 nt, Human
agcauccaacuuugauuagaga

SEQ ID NO: 216939 - RNA, 22 nt, Human
auuaguguucuuaucuucuagg

SEQ ID NO: 216940 - RNA, 22 nt, Human
ggcugagcuuuucaugaugguu

SEQ ID NO: 216941 - RNA, 22 nt, Human
cuggcugggguaccaguugaac

SEQ ID NO: 216942 - RNA, 22 nt, Human
cucgggcaggagggcccucucc

SEQ ID NO: 216943 - RNA, 20 nt, Human
gaaggaagggggcaagguga

SEQ ID NO: 216944 - RNA, 22 nt, Human
agaaacuucagcuauucuuuug

SEQ ID NO: 216945 - RNA, 20 nt, Human
gccuagggucacuucaguga

SEQ ID NO: 216946 - RNA, 22 nt, Human
uuuuuaguagagguggguuuca

SEQ ID NO: 216947 - RNA, 22 nt, Human
agcagacauggcuuggaugugg

SEQ ID NO: 216948 - RNA, 22 nt, Human
uuagauguggacuuauguuauu

SEQ ID NO: 216949 - RNA, 22 nt, Human
gcaggcuaugucagggccgcuc

SEQ ID NO: 216950 - RNA, 22 nt, Human
gacacuguuauggugagguaag

SEQ ID NO: 216951 - RNA, 22 nt, Human
uuucauaaacaguagaagacua

SEQ ID NO: 216952 - RNA, 22 nt, Human
ugugaagguaaggaggggcaag

SEQ ID NO: 216953 - RNA, 22 nt, Human
gauuguaaaacagaucauuauc

SEQ ID NO: 216954 - RNA, 22 nt, Human
uacugucucugcccuggccagg

SEQ ID NO: 216955 - RNA, 22 nt, Human
uagaaacauucaguugcagucc

SEQ ID NO: 216956 - RNA, 22 nt, Human
gacuucugaauuccuaucaggu

SEQ ID NO: 216957 - RNA, 22 nt, Human
auugcuuuguacaugccuagca

SEQ ID NO: 216958 - RNA, 22 nt, Human
uguauugaauuguguuauaucu

SEQ ID NO: 216959 - RNA, 22 nt, Human
gagccaggcccguacuugcugu

SEQ ID NO: 216960 - RNA, 19 nt, Human
agggagaauuccaagagga

SEQ ID NO: 216961 - RNA, 22 nt, Human
ucagagcugcccaugcaagggg

SEQ ID NO: 216962 - RNA, 22 nt, Human
uagccaggucacacuguguguu

SEQ ID NO: 216963 - RNA, 22 nt, Human
uccauacucagaaaguauugca

SEQ ID NO: 216964 - RNA, 22 nt, Human
gaggagagaacauuccuccaua

SEQ ID NO: 216965 - RNA, 20 nt, Human
gcuucccaauucuugaucug

SEQ ID NO: 216966 - RNA, 22 nt, Human
cuuggggaugcaaagccagugu

SEQ ID NO: 216967 - RNA, 18 nt, Human
ccaggcuacuucuuggcc

SEQ ID NO: 216968 - RNA, 21 nt, Human
caugugucuuguguuacugcu

SEQ ID NO: 216969 - RNA, 22 nt, Human
ccaugagccaggcugaggaagc

SEQ ID NO: 216970 - RNA, 22 nt, Human
cauugaaaccuaacauaggcug

SEQ ID NO: 216971 - RNA, 22 nt, Human
acagugaugagggaauuuugug

SEQ ID NO: 216972 - RNA, 22 nt, Human
ccccagcccacaagcauauuaa

SEQ ID NO: 216973 - RNA, 22 nt, Human
gucaaaacaaaguuaagaauuc

SEQ ID NO: 216974 - RNA, 22 nt, Human
cagaaggcuuuguggaguagac

SEQ ID NO: 216975 - RNA, 22 nt, Human
ugaauuguggcuuuuuccaauu

SEQ ID NO: 216976 - RNA, 22 nt, Human
agaggcggagguugcagugagc

SEQ ID NO: 216977 - RNA, 19 nt, Human
ucucuacacuacauuucua

SEQ ID NO: 216978 - RNA, 22 nt, Human
ucauuuuuugcauaccuguguc

SEQ ID NO: 216979 - RNA, 22 nt, Human
gaggugucccgcaguccccaag

SEQ ID NO: 216980 - RNA, 22 nt, Human
gcagcagugcgggcagcuacag

SEQ ID NO: 216981 - RNA, 22 nt, Human
gcaggacuugaauccaggcagu

SEQ ID NO: 216982 - RNA, 22 nt, Human
cacgggagacgugaucuuggac

SEQ ID NO: 216983 - RNA, 22 nt, Human
aaguauuauuuaacaaauuugu

SEQ ID NO: 216984 - RNA, 18 nt, Human
cuaaacugcaccuaauga

SEQ ID NO: 216985 - RNA, 22 nt, Human
aagcacuggagaugccagagug

SEQ ID NO: 216986 - RNA, 22 nt, Human
uccaggcauuccagccauucca

SEQ ID NO: 216987 - RNA, 22 nt, Human
gcuggcuggaggugaggaagaa

SEQ ID NO: 216988 - RNA, 22 nt, Human
ccuuccuggagcccaugcagau

SEQ ID NO: 216989 - RNA, 22 nt, Human
cacuugaaauauuaggggugau

SEQ ID NO: 216990 - RNA, 22 nt, Human
auccuguggcuccagggagccg

SEQ ID NO: 216991 - RNA, 22 nt, Human
ucuggguccgggacuguggaug

SEQ ID NO: 216992 - RNA, 22 nt, Human
aaacugaaguagauucugaaau

SEQ ID NO: 216993 - RNA, 22 nt, Human
caagacuucaccgcucugugcu

SEQ ID NO: 216994 - RNA, 22 nt, Human
ucuggcaccacugagucugcag

SEQ ID NO: 216995 - RNA, 22 nt, Human
cuuucuuaauuuuuaaggacac

SEQ ID NO: 216996 - RNA, 22 nt, Human
caggucuguauuaacagagggu

SEQ ID NO: 216997 - RNA, 22 nt, Human
acuguggccuuguggguucagg

SEQ ID NO: 216998 - RNA, 22 nt, Human
augagcaaggcuuugugauagu

SEQ ID NO: 216999 - RNA, 22 nt, Human
ugcaaggguagaagugauggca

SEQ ID NO: 217000 - RNA, 22 nt, Human
ucugagagcaggaggagcugcu

SEQ ID NO: 217001 - RNA, 22 nt, Human
uuuacagaaugucaauuucuau

SEQ ID NO: 217002 - RNA, 22 nt, Human
ggggcaggagcccuucuucagc

SEQ ID NO: 217003 - RNA, 22 nt, Human
cagcaugaauguguucguaggg

SEQ ID NO: 217004 - RNA, 22 nt, Human
uggagcaggacugcugcccuca

SEQ ID NO: 217005 - RNA, 22 nt, Human
aggaaugugccuagccucccug

SEQ ID NO: 217006 - RNA, 22 nt, Human
cuggaacuccuggggagcuggu

SEQ ID NO: 217007 - RNA, 22 nt, Human
gugaacaguucauuuuaucaug

SEQ ID NO: 217008 - RNA, 22 nt, Human
cacuugauggaagagcagaaga

SEQ ID NO: 217009 - RNA, 22 nt, Human
agucacaugcauuuucuucaau

SEQ ID NO: 217010 - RNA, 22 nt, Human
uuccauauuggaaggcacaggc

SEQ ID NO: 217011 - RNA, 22 nt, Human
auuuguaauuucuuaucugugu

SEQ ID NO: 217012 - RNA, 22 nt, Human
uugcccagagcugccuguuaca

SEQ ID NO: 217013 - RNA, 23 nt, Human
agaguuuucuguuuucuguaggg

SEQ ID NO: 217014 - RNA, 22 nt, Human
ugaaucauggauaaauagcuua

SEQ ID NO: 217015 - RNA, 22 nt, Human
cccagcagugacccagugauac

SEQ ID NO: 217016 - RNA, 22 nt, Human
gacuggagucaaugagcagcac

SEQ ID NO: 217017 - RNA, 22 nt, Human
ucuuuaucaagucuguucuuug

SEQ ID NO: 217018 - RNA, 22 nt, Human
agucuucucauuucacaugcuu

SEQ ID NO: 217019 - RNA, 22 nt, Human
uucuguaggacuucugccaacu

SEQ ID NO: 217020 - RNA, 20 nt, Human
ugcagcagaagcccaugcuc

SEQ ID NO: 217021 - RNA, 22 nt, Human
cagcuauuggcaagaaguggug

SEQ ID NO: 217022 - RNA, 22 nt, Human
aauuaacuaauuugguacaaga

SEQ ID NO: 217023 - RNA, 22 nt, Human
uuagaaaaaacgucuucuagug

SEQ ID NO: 217024 - RNA, 22 nt, Human
ucccaggguauccuguaguaaa

SEQ ID NO: 217025 - RNA, 22 nt, Human
uuugacauggaauaacucauuu

SEQ ID NO: 217026 - RNA, 23 nt, Human
ucucuggccuuugaucagguuga

SEQ ID NO: 217027 - RNA, 22 nt, Human
ugcccuccacaguggcuccacc

SEQ ID NO: 217028 - RNA, 22 nt, Human
uuuauguuugcauuuucaaaga

SEQ ID NO: 217029 - RNA, 22 nt, Human
augaggcaucugcagucacuag

SEQ ID NO: 217030 - RNA, 22 nt, Human
uuacaacaccaggcaguauccu

SEQ ID NO: 217031 - RNA, 22 nt, Human
cugccuggguucaaguccuguu

SEQ ID NO: 217032 - RNA, 22 nt, Human
auggagacgcaagggaccuagg

SEQ ID NO: 217033 - RNA, 22 nt, Human
gcuggcagagagcuggugagga

SEQ ID NO: 217034 - RNA, 22 nt, Human
uccacacacauuucuaugugca

SEQ ID NO: 217035 - RNA, 22 nt, Human
agaugaagaugccacuaagacc

SEQ ID NO: 217036 - RNA, 22 nt, Human
agcagaagugccuuagcaauca

SEQ ID NO: 217037 - RNA, 20 nt, Human
accaauuucagaggugcaga

SEQ ID NO: 217038 - RNA, 22 nt, Human
uuuacugaauuugguauauucc

SEQ ID NO: 217039 - RNA, 22 nt, Human
uuucuguaaguggcaaauaaug

SEQ ID NO: 217040 - RNA, 22 nt, Human
ucugcuguguccccugugcggg

SEQ ID NO: 217041 - RNA, 22 nt, Human
ccuucugagcuucaauuucagu

SEQ ID NO: 217042 - RNA, 22 nt, Human
ggcugagcacuuuaggcaggag

SEQ ID NO: 217043 - RNA, 22 nt, Human
agauuugcggcuuuacuuugca

SEQ ID NO: 217044 - RNA, 22 nt, Human
aucagagaaauggagggcgcuu

SEQ ID NO: 217045 - RNA, 22 nt, Human
agugcuuuuauaucauuaaucc

SEQ ID NO: 217046 - RNA, 22 nt, Human
auuauaggcuugagccaccgug

SEQ ID NO: 217047 - RNA, 22 nt, Human
ccagggcaugggaagaacugaa

SEQ ID NO: 217048 - RNA, 22 nt, Human
ccuggccaggcauggagucaca

SEQ ID NO: 217049 - RNA, 22 nt, Human
ggucaagacgggcucugcccuu

SEQ ID NO: 217050 - RNA, 22 nt, Human
gauaacauuauaaguucacugu

SEQ ID NO: 217051 - RNA, 22 nt, Human
auguuugucaggauuguaauua

SEQ ID NO: 217052 - RNA, 22 nt, Human
cccucagggaccacugacuuca

SEQ ID NO: 217053 - RNA, 22 nt, Human
uauggcaguuacccuugaugau

SEQ ID NO: 217054 - RNA, 18 nt, Human
ugaccugcgcuucacggu

SEQ ID NO: 217055 - RNA, 22 nt, Human
gccucagaaaguggcagguagg

SEQ ID NO: 217056 - RNA, 20 nt, Human
agauggugaaggccagggag

SEQ ID NO: 217057 - RNA, 22 nt, Human
ccagugcauugccgugucuagg

SEQ ID NO: 217058 - RNA, 22 nt, Human
gaauucuagucacacacauuca

SEQ ID NO: 217059 - RNA, 19 nt, Human
cuccucagucccagagguc

SEQ ID NO: 217060 - RNA, 22 nt, Human
augaacaagagagggaagauuc

SEQ ID NO: 217061 - RNA, 22 nt, Human
gagcuacugaaauauugauuuu

SEQ ID NO: 217062 - RNA, 22 nt, Human
ucugugcagaacucacagaagg

SEQ ID NO: 217063 - RNA, 22 nt, Human
uaaaguuuauuugaacaucucu

SEQ ID NO: 217064 - RNA, 22 nt, Human
cccaggugggcaccucgaggaa

SEQ ID NO: 217065 - RNA, 22 nt, Human
uauucaaaguaccuucauugcc

SEQ ID NO: 217066 - RNA, 16 nt, Human
ccucugggauguuugc

SEQ ID NO: 217067 - RNA, 22 nt, Human
uggcccugccacucacugcuga

SEQ ID NO: 217068 - RNA, 22 nt, Human
uagaauguuaagaauauguaua

SEQ ID NO: 217069 - RNA, 22 nt, Human
ugagccagguuuuccaucauuc

SEQ ID NO: 217070 - RNA, 22 nt, Human
gccacagggcgagcggaggcca

SEQ ID NO: 217071 - RNA, 22 nt, Human
ugacguuuuagguguuaaaucg

SEQ ID NO: 217072 - RNA, 22 nt, Human
uuaacagacuugggauuuucua

SEQ ID NO: 217073 - RNA, 22 nt, Human
aagggcagccugacucacgguc

SEQ ID NO: 217074 - RNA, 22 nt, Human
uugcuuugccaccagaagucua

SEQ ID NO: 217075 - RNA, 22 nt, Human
gcaggccuuggcaaugagccug

SEQ ID NO: 217076 - RNA, 22 nt, Human
gacauaauccuccucaccuacu

SEQ ID NO: 217077 - RNA, 22 nt, Human
uggaagaauaggauagaagaac

SEQ ID NO: 217078 - RNA, 22 nt, Human
caaggcugugcaggguccauau

SEQ ID NO: 217079 - RNA, 22 nt, Human
ucagaaguccaauaccauggga

SEQ ID NO: 217080 - RNA, 22 nt, Human
aaggcugaggcagugaggcaga

SEQ ID NO: 217081 - RNA, 22 nt, Human
gaggaagaagggauuagaacuc

SEQ ID NO: 217082 - RNA, 22 nt, Human
aaccuaugaacucuuggugugc

SEQ ID NO: 217083 - RNA, 20 nt, Human
gcuccaggucagagaggacg

SEQ ID NO: 217084 - RNA, 22 nt, Human
uaguggaguagaaaccaaagaa

SEQ ID NO: 217085 - RNA, 19 nt, Human
ugcauauaucuaugaaaga

SEQ ID NO: 217086 - RNA, 22 nt, Human
aaacuucauggauaauauaaag

SEQ ID NO: 217087 - RNA, 22 nt, Human
ccagggaaggcucugccugcuu

SEQ ID NO: 217088 - RNA, 22 nt, Human
uuccaugaagggcagccucuca

SEQ ID NO: 217089 - RNA, 22 nt, Human
uacauguggagauaacugaagc

SEQ ID NO: 217090 - RNA, 22 nt, Human
gauauuuacaaauuugccaaua

SEQ ID NO: 217091 - RNA, 19 nt, Human
gcuucuguuugggcuuaga

SEQ ID NO: 217092 - RNA, 22 nt, Human
uaauacuuaccuugcagagucu

SEQ ID NO: 217093 - RNA, 21 nt, Human
aggaauguguauauauacaau

SEQ ID NO: 217094 - RNA, 22 nt, Human
ucaggcagguggcuggcuaugg

SEQ ID NO: 217095 - RNA, 22 nt, Human
ugcuccaggcaagcugagaguu

SEQ ID NO: 217096 - RNA, 22 nt, Human
cguuaguggaguuugaagcugu

SEQ ID NO: 217097 - RNA, 22 nt, Human
guauuuuauggccuggggccua

SEQ ID NO: 217098 - RNA, 22 nt, Human
uugaggaguguuuagggugagg

SEQ ID NO: 217099 - RNA, 18 nt, Human
cucucuggucuggauccc

SEQ ID NO: 217100 - RNA, 22 nt, Human
uagagguguucauucucuccau

SEQ ID NO: 217101 - RNA, 22 nt, Human
ucauaaaaauagacucuaaagu

SEQ ID NO: 217102 - RNA, 22 nt, Human
gcugcaggggggucuggacuug

SEQ ID NO: 217103 - RNA, 22 nt, Human
gaauguuacuuugauuuugucc

SEQ ID NO: 217104 - RNA, 18 nt, Human
aaauuagauggaccugug

SEQ ID NO: 217105 - RNA, 22 nt, Human
ggugcugaugaagauguagccu

SEQ ID NO: 217106 - RNA, 22 nt, Human
gucauagaggccuauauaauuu

SEQ ID NO: 217107 - RNA, 22 nt, Human
uuucugagaaauuaaacacuuu

SEQ ID NO: 217108 - RNA, 22 nt, Human
guggcgcagaggguggcagaga

SEQ ID NO: 217109 - RNA, 22 nt, Human
ggcacugcccacccucacaggg

SEQ ID NO: 217110 - RNA, 22 nt, Human
guuuuucucugaaauaguugac

SEQ ID NO: 217111 - RNA, 22 nt, Human
caugacaauaagccagcagaaa

SEQ ID NO: 217112 - RNA, 22 nt, Human
aagucucucauggcugacagca

SEQ ID NO: 217113 - RNA, 19 nt, Human
ugugugcaaauggaagcca

SEQ ID NO: 217114 - RNA, 22 nt, Human
gagagucuagugcaccuaguuu

SEQ ID NO: 217115 - RNA, 22 nt, Human
aggggagcaacauagucacucu

SEQ ID NO: 217116 - RNA, 22 nt, Human
agccagagggaucuuucuaaga

SEQ ID NO: 217117 - RNA, 22 nt, Human
cugaggcaggagaauugcugga

SEQ ID NO: 217118 - RNA, 22 nt, Human
cuggcucaggaaaguugcugcu

SEQ ID NO: 217119 - RNA, 22 nt, Human
gguuuacucguaguggcgguuu

SEQ ID NO: 217120 - RNA, 22 nt, Human
gagcuucccucugcagucccug

SEQ ID NO: 217121 - RNA, 20 nt, Human
ucccucaggucauugggcug

SEQ ID NO: 217122 - RNA, 22 nt, Human
ugcagagauagaacuacuuucu

SEQ ID NO: 217123 - RNA, 22 nt, Human
cugggccagaccuuguggucuu

SEQ ID NO: 217124 - RNA, 22 nt, Human
ucagaggccuugguuaugguau

SEQ ID NO: 217125 - RNA, 22 nt, Human
cuugaaucuucugaguauuugc

SEQ ID NO: 217126 - RNA, 22 nt, Human
agugucagcuaauuauucauga

SEQ ID NO: 217127 - RNA, 22 nt, Human
agcugaggacgugaagggcggc

SEQ ID NO: 217128 - RNA, 22 nt, Human
ggcucugcagugacuugagggg

SEQ ID NO: 217129 - RNA, 22 nt, Human
ugcugugggauauauguucaaa

SEQ ID NO: 217130 - RNA, 20 nt, Human
acuguuggaaguggagaaug

SEQ ID NO: 217131 - RNA, 22 nt, Human
ugcucuggcuggagcaaugacu

SEQ ID NO: 217132 - RNA, 23 nt, Human
uccucccaaauuucagccucauu

SEQ ID NO: 217133 - RNA, 22 nt, Human
ccacaucucuugauguaccuac

SEQ ID NO: 217134 - RNA, 22 nt, Human
uccacauuauguuucuccuuuc

SEQ ID NO: 217135 - RNA, 22 nt, Human
ugaguauugaccagaaaauuua

SEQ ID NO: 217136 - RNA, 22 nt, Human
cauauccagguuucuuugguuu

SEQ ID NO: 217137 - RNA, 22 nt, Human
ucuuauaaaaggacucccauuu

SEQ ID NO: 217138 - RNA, 22 nt, Human
uucugucugauggugccagaac

SEQ ID NO: 217139 - RNA, 22 nt, Human
agcagcugcagggagggucugc

SEQ ID NO: 217140 - RNA, 22 nt, Human
uugacacagaucaauauucaac

SEQ ID NO: 217141 - RNA, 22 nt, Human
caggguuucaccauguuagcag

SEQ ID NO: 217142 - RNA, 22 nt, Human
ugcauuaaauauaaucuguuga

SEQ ID NO: 217143 - RNA, 20 nt, Human
gaaggcuuggacagugacag

SEQ ID NO: 217144 - RNA, 22 nt, Human
ugcacaggaggcuguggagaag

SEQ ID NO: 217145 - RNA, 21 nt, Human
cuuggaguugguugaggaugc

SEQ ID NO: 217146 - RNA, 22 nt, Human
aagccagguguugugguaagag

SEQ ID NO: 217147 - RNA, 22 nt, Human
uaggagggggaacaaggcauac

SEQ ID NO: 217148 - RNA, 22 nt, Human
auuaaagacagcagauggaugg

SEQ ID NO: 217149 - RNA, 22 nt, Human
accaggccaacagcuaaguuaa

SEQ ID NO: 217150 - RNA, 22 nt, Human
ucuucccuaaucaccaucuuca

SEQ ID NO: 217151 - RNA, 22 nt, Human
agugccaggagcaaggagcucc

SEQ ID NO: 217152 - RNA, 22 nt, Human
agcuuacaguucaaugacaaag

SEQ ID NO: 217153 - RNA, 22 nt, Human
cagauucugaagucuagcugcu

SEQ ID NO: 217154 - RNA, 22 nt, Human
uguaaacuguagaaaauacuuu

SEQ ID NO: 217155 - RNA, 22 nt, Human
agccuccuggaguuucugggau

SEQ ID NO: 217156 - RNA, 22 nt, Human
cagaguggugcaagggcagugu

SEQ ID NO: 217157 - RNA, 22 nt, Human
cuggagugaggucugggagccu

SEQ ID NO: 217158 - RNA, 22 nt, Human
ccaggaucuguacaccucugag

SEQ ID NO: 217159 - RNA, 22 nt, Human
guggcccucugauagggucagg

SEQ ID NO: 217160 - RNA, 22 nt, Human
ucuaagaucuacuauacaugug

SEQ ID NO: 217161 - RNA, 19 nt, Human
aggcuggaugcccaucuua

SEQ ID NO: 217162 - RNA, 22 nt, Human
caguggaagcuggcugugaaga

SEQ ID NO: 217163 - RNA, 22 nt, Human
uagggcucugagaguucagccu

SEQ ID NO: 217164 - RNA, 20 nt, Human
uuuggagagaaagaaguagu

SEQ ID NO: 217165 - RNA, 22 nt, Human
gcauggcagccaguacauggug

SEQ ID NO: 217166 - RNA, 22 nt, Human
ggaggaagggcccaggcuuuau

SEQ ID NO: 217167 - RNA, 21 nt, Human
uuggcugccugagauuagaau

SEQ ID NO: 217168 - RNA, 22 nt, Human
ucagcacaggucuugcaaaaca

SEQ ID NO: 217169 - RNA, 22 nt, Human
accuuagaccagcaagauauuu

SEQ ID NO: 217170 - RNA, 22 nt, Human
gugcccaguaaaugaaagcuuu

SEQ ID NO: 217171 - RNA, 22 nt, Human
uuggaaaacuuacacagagcug

SEQ ID NO: 217172 - RNA, 22 nt, Human
uaggaaacagugcauauauagu

SEQ ID NO: 217173 - RNA, 22 nt, Human
guacaggaaggagggaguuuca

SEQ ID NO: 217174 - RNA, 22 nt, Human
cagcccucagguccucagcagc

SEQ ID NO: 217175 - RNA, 22 nt, Human
gaggccucaugaggugagcauu

SEQ ID NO: 217176 - RNA, 22 nt, Human
aagagcccugguugaaaauaac

SEQ ID NO: 217177 - RNA, 22 nt, Human
uggcucuguggucuuagcaugc

SEQ ID NO: 217178 - RNA, 22 nt, Human
cuagugaaauuugcaaguaauu

SEQ ID NO: 217179 - RNA, 22 nt, Human
auuagaacuaggcuaaguaaaa

SEQ ID NO: 217180 - RNA, 22 nt, Human
auggucuugugagaguaacagu

SEQ ID NO: 217181 - RNA, 22 nt, Human
ucuccauaggcaguucauaaca

SEQ ID NO: 217182 - RNA, 22 nt, Human
gcagaauauauuacugagccuc

SEQ ID NO: 217183 - RNA, 22 nt, Human
caguaccagucaccacauugau

SEQ ID NO: 217184 - RNA, 21 nt, Human
agcuguuugaagcuauauugg

SEQ ID NO: 217185 - RNA, 22 nt, Human
gaauguuauguauccagucaca

SEQ ID NO: 217186 - RNA, 22 nt, Human
cagcugaggaauacuagaugua

SEQ ID NO: 217187 - RNA, 22 nt, Human
auacaaucaucauuauauuccc

SEQ ID NO: 217188 - RNA, 17 nt, Human
ccucuuccucucagcug

SEQ ID NO: 217189 - RNA, 22 nt, Human
ggucagccuuggauuugguagc

SEQ ID NO: 217190 - RNA, 22 nt, Human
cccaggugcugaaggaggccgc

SEQ ID NO: 217191 - RNA, 22 nt, Human
uccaggaacgagaggcugggca

SEQ ID NO: 217192 - RNA, 22 nt, Human
aaugucugaggcucaucugagg

SEQ ID NO: 217193 - RNA, 22 nt, Human
gaauguaagugggcagaagaca

SEQ ID NO: 217194 - RNA, 22 nt, Human
ugagcuggucacuccuucugaa

SEQ ID NO: 217195 - RNA, 22 nt, Human
gacuaaauuccuguucgcgaug

SEQ ID NO: 217196 - RNA, 22 nt, Human
ugaaggugaaugucuaugggga

SEQ ID NO: 217197 - RNA, 22 nt, Human
aguggcugugaaauacauggga

SEQ ID NO: 217198 - RNA, 22 nt, Human
aguaccaugcuuccugacuggu

SEQ ID NO: 217199 - RNA, 22 nt, Human
aagagcaucgguggagccccca

SEQ ID NO: 217200 - RNA, 22 nt, Human
gacaggaagucugaaggaggga

SEQ ID NO: 217201 - RNA, 22 nt, Human
uguggcaggcaagauguacaga

SEQ ID NO: 217202 - RNA, 22 nt, Human
cuaaaugacagguaccauagug

SEQ ID NO: 217203 - RNA, 22 nt, Human
ccacugucagaggggcugugcc

SEQ ID NO: 217204 - RNA, 22 nt, Human
ggaaaggagauauuggagagug

SEQ ID NO: 217205 - RNA, 22 nt, Human
aacaagucauuccauuugacag

SEQ ID NO: 217206 - RNA, 22 nt, Human
gucaguuauuuugagcaauugg

SEQ ID NO: 217207 - RNA, 22 nt, Human
uuaguucucaugaauuuuaagu

SEQ ID NO: 217208 - RNA, 23 nt, Human
cugaggucugcaauucuaguagu

SEQ ID NO: 217209 - RNA, 23 nt, Human
agauuguuauucccaguucaugu

SEQ ID NO: 217210 - RNA, 22 nt, Human
uuagugcaaaccucagagacac

SEQ ID NO: 217211 - RNA, 18 nt, Human
ugcuuuaugcuuauauaa

SEQ ID NO: 217212 - RNA, 22 nt, Human
uaagacauuugaaaugugaucc

SEQ ID NO: 217213 - RNA, 22 nt, Human
aaaaggcuaauuaaguuuugga

SEQ ID NO: 217214 - RNA, 22 nt, Human
ugccaccaggagaaccagugca

SEQ ID NO: 217215 - RNA, 22 nt, Human
gaggugucauuuaguuaaucag

SEQ ID NO: 217216 - RNA, 22 nt, Human
aaaaggcuaauccagagcaacu

SEQ ID NO: 217217 - RNA, 22 nt, Human
cuuucucaaugccggaaggcac

SEQ ID NO: 217218 - RNA, 22 nt, Human
ucacagcauugaguguacuaga

SEQ ID NO: 217219 - RNA, 22 nt, Human
gagucagaagaaacuauuuaca

SEQ ID NO: 217220 - RNA, 18 nt, Human
ggcucaggcuauccuaac

SEQ ID NO: 217221 - RNA, 22 nt, Human
uuccagcuaacucacaucccuu

SEQ ID NO: 217222 - RNA, 19 nt, Human
aguucuuguccugucuguu

SEQ ID NO: 217223 - RNA, 22 nt, Human
gcagugggcaacaagagcugga

SEQ ID NO: 217224 - RNA, 22 nt, Human
agugauugaguguuagcagucu

SEQ ID NO: 217225 - RNA, 22 nt, Human
acaggcagauguuuuaguugua

SEQ ID NO: 217226 - RNA, 22 nt, Human
ccaggagggaggaguuccugag

SEQ ID NO: 217227 - RNA, 22 nt, Human
ugacagggcuagaggcaaugca

SEQ ID NO: 217228 - RNA, 22 nt, Human
cccauauacuuuuucuggucca

SEQ ID NO: 217229 - RNA, 19 nt, Human
uuagggacaugaauucuag

SEQ ID NO: 217230 - RNA, 22 nt, Human
uccacagggccuuucuggugug

SEQ ID NO: 217231 - RNA, 22 nt, Human
uggacagguugaguaggaggag

SEQ ID NO: 217232 - RNA, 22 nt, Human
uaauuuacuugcaaauaacaau

SEQ ID NO: 217233 - RNA, 22 nt, Human
aggcaugacuuuggcugaagaa

SEQ ID NO: 217234 - RNA, 22 nt, Human
gaaaaaugagcugaugucaggg

SEQ ID NO: 217235 - RNA, 22 nt, Human
uagaggcauaagagggaagcag

SEQ ID NO: 217236 - RNA, 22 nt, Human
ugaccaguuaagucauccuguc

SEQ ID NO: 217237 - RNA, 22 nt, Human
uaacucuagucccaggcaugaa

SEQ ID NO: 217238 - RNA, 22 nt, Human
guggauggagcagugacccagg

SEQ ID NO: 217239 - RNA, 22 nt, Human
uuccuucuagagcuuguuuagg

SEQ ID NO: 217240 - RNA, 22 nt, Human
ggcuggacugccucccagaguc

SEQ ID NO: 217241 - RNA, 22 nt, Human
cgcagagggcaggcagugcugg

SEQ ID NO: 217242 - RNA, 22 nt, Human
aggaaacuaaggcucagugaag

SEQ ID NO: 217243 - RNA, 22 nt, Human
uaucuagaacuccagaauguag

SEQ ID NO: 217244 - RNA, 22 nt, Human
uucaugugauaaaugugugacu

SEQ ID NO: 217245 - RNA, 22 nt, Human
caguguggcugagacagaggcu

SEQ ID NO: 217246 - RNA, 22 nt, Human
aucuuucagggccauuuguauu

SEQ ID NO: 217247 - RNA, 22 nt, Human
gaaagugcaugugcccaccauu

SEQ ID NO: 217248 - RNA, 22 nt, Human
ucuccuggauggaccuucucuu

SEQ ID NO: 217249 - RNA, 22 nt, Human
gauaaauuaucagggguuuaaa

SEQ ID NO: 217250 - RNA, 22 nt, Human
uccaaacgggagccaaaugagc

SEQ ID NO: 217251 - RNA, 22 nt, Human
uugccaggagacaucuggagcc

SEQ ID NO: 217252 - RNA, 22 nt, Human
gagaggcuaugagguucugugu

SEQ ID NO: 217253 - RNA, 22 nt, Human
aaguuuaagguggaaguggugg

SEQ ID NO: 217254 - RNA, 22 nt, Human
uggccucugugggagcugagca

SEQ ID NO: 217255 - RNA, 22 nt, Human
ggcccaguguaccccaggcagu

SEQ ID NO: 217256 - RNA, 22 nt, Human
gaaaccuuugccgauggggucc

SEQ ID NO: 217257 - RNA, 22 nt, Human
aggacaagcuaaaggacuuccu

SEQ ID NO: 217258 - RNA, 22 nt, Human
uaaaagagaauggauaacagag

SEQ ID NO: 217259 - RNA, 22 nt, Human
cugggggcagcaagaagccaug

SEQ ID NO: 217260 - RNA, 22 nt, Human
agaaggccaauagggugcacug

SEQ ID NO: 217261 - RNA, 22 nt, Human
cggcugagcagugcugauggaa

SEQ ID NO: 217262 - RNA, 22 nt, Human
cuuccugggcaauguucugcuu

SEQ ID NO: 217263 - RNA, 22 nt, Human
cucuggcuuuaaggaugccaca

SEQ ID NO: 217264 - RNA, 22 nt, Human
gggcacuggaaggcucucaggc

SEQ ID NO: 217265 - RNA, 22 nt, Human
uuggaggaugcaaugagggagu

SEQ ID NO: 217266 - RNA, 20 nt, Human
aggccccagguggacacuag

SEQ ID NO: 217267 - RNA, 22 nt, Human
guuaucaugcuucaucaucacu

SEQ ID NO: 217268 - RNA, 22 nt, Human
acaauucauuaaugugagguag

SEQ ID NO: 217269 - RNA, 22 nt, Human
uuuuagacuuguauguaaagcc

SEQ ID NO: 217270 - RNA, 22 nt, Human
cagcccagcagacuguuaccac

SEQ ID NO: 217271 - RNA, 22 nt, Human
cuuguauucagaguggacauga

SEQ ID NO: 217272 - RNA, 22 nt, Human
aucuuuggugcaugauacuuug

SEQ ID NO: 217273 - RNA, 22 nt, Human
uuuuauugcaauaaagugugua

SEQ ID NO: 217274 - RNA, 22 nt, Human
gugccagcucuccccacaucug

SEQ ID NO: 217275 - RNA, 22 nt, Human
cuucuuccugcugcagccucca

SEQ ID NO: 217276 - RNA, 22 nt, Human
gugggucccuaaacacauccca

SEQ ID NO: 217277 - RNA, 22 nt, Human
caauucuuuguagaagcucucc

SEQ ID NO: 217278 - RNA, 22 nt, Human
gugugcaggccacaggccaggg

SEQ ID NO: 217279 - RNA, 22 nt, Human
gcaagcuguccuuuugcauggc

SEQ ID NO: 217280 - RNA, 23 nt, Human
ccauggccaaugucaagcuacua

SEQ ID NO: 217281 - RNA, 22 nt, Human
cuuuggaaucauugcuuauuca

SEQ ID NO: 217282 - RNA, 22 nt, Human
ggaggugggcuaaggacucucu

SEQ ID NO: 217283 - RNA, 22 nt, Human
gaaugauuugguuguuuagauu

SEQ ID NO: 217284 - RNA, 22 nt, Human
aauguugagcuugaaaguaggu

SEQ ID NO: 217285 - RNA, 22 nt, Human
acccacgaagaugagcggcaug

SEQ ID NO: 217286 - RNA, 22 nt, Human
ucuuccagccaauagcguccuu

SEQ ID NO: 217287 - RNA, 22 nt, Human
ugcuguuaguaaggaacaugac

SEQ ID NO: 217288 - RNA, 22 nt, Human
ugcuggagaagcuccugggacu

SEQ ID NO: 217289 - RNA, 22 nt, Human
ugcaaauaaauuucuguucauu

SEQ ID NO: 217290 - RNA, 22 nt, Human
uuauuucauugauuucuaagac

SEQ ID NO: 217291 - RNA, 22 nt, Human
uggacaugucuucuccaagaaa

SEQ ID NO: 217292 - RNA, 17 nt, Human
cacuugcuggucuaccu

SEQ ID NO: 217293 - RNA, 22 nt, Human
auucuacacaacaugaugaugg

SEQ ID NO: 217294 - RNA, 22 nt, Human
aauguaaagcucaggucaggag

SEQ ID NO: 217295 - RNA, 19 nt, Human
uccugaaaacuucuggaau

SEQ ID NO: 217296 - RNA, 22 nt, Human
uggagacagagauagccaauug

SEQ ID NO: 217297 - RNA, 22 nt, Human
guggcugcugguacucugggaa

SEQ ID NO: 217298 - RNA, 22 nt, Human
ucagaacagguuguacuauguc

SEQ ID NO: 217299 - RNA, 22 nt, Human
gcugaagacaauggaauugacu

SEQ ID NO: 217300 - RNA, 22 nt, Human
uguuuucugauucucguguggu

SEQ ID NO: 217301 - RNA, 22 nt, Human
ggugcucaaggugacaggacau

SEQ ID NO: 217302 - RNA, 22 nt, Human
ugggaacaccugcugcccagug

SEQ ID NO: 217303 - RNA, 20 nt, Human
aggcagagcgcacuuuuaga

SEQ ID NO: 217304 - RNA, 22 nt, Human
ucuguaaaucuacuaagagcuc

SEQ ID NO: 217305 - RNA, 22 nt, Human
uggaagugcucuucugaccaac

SEQ ID NO: 217306 - RNA, 19 nt, Human
gccucugcuggggacaggc

SEQ ID NO: 217307 - RNA, 22 nt, Human
ccaggugugguggcauacaccu

SEQ ID NO: 217308 - RNA, 22 nt, Human
ggcuuccuggggccuccugcaa

SEQ ID NO: 217309 - RNA, 22 nt, Human
uacuguuuucuauaauggcugu

SEQ ID NO: 217310 - RNA, 22 nt, Human
cugcaggcaucuaacugugggc

SEQ ID NO: 217311 - RNA, 22 nt, Human
gggugggaacaggaugccagga

SEQ ID NO: 217312 - RNA, 19 nt, Human
ggcaggugugcuuaugcuu

SEQ ID NO: 217313 - RNA, 22 nt, Human
aggcagcuuaagcccuggccca

SEQ ID NO: 217314 - RNA, 22 nt, Human
ggcucaggcuggagugcagugg

SEQ ID NO: 217315 - RNA, 22 nt, Human
uggcuccugcauuugugcuaac

SEQ ID NO: 217316 - RNA, 22 nt, Human
cugcagagaauuguggggcuuc

SEQ ID NO: 217317 - RNA, 22 nt, Human
uuucucuggcauuagguauaaa

SEQ ID NO: 217318 - RNA, 22 nt, Human
aacaguuuaugauaaauucuua

SEQ ID NO: 217319 - RNA, 22 nt, Human
aaggcugguuccaucccuggug

SEQ ID NO: 217320 - RNA, 19 nt, Human
cuuauuagagugagagcuu

SEQ ID NO: 217321 - RNA, 22 nt, Human
gagcgggaggaacggcucgggc

SEQ ID NO: 217322 - RNA, 22 nt, Human
ccuccuggguucaagcgauucu

SEQ ID NO: 217323 - RNA, 22 nt, Human
cuuuucuggccaggaacuugcc

SEQ ID NO: 217324 - RNA, 22 nt, Human
aaagugcaaucaguuagaccau

SEQ ID NO: 217325 - RNA, 22 nt, Human
uugguuuagagagugugguuac

SEQ ID NO: 217326 - RNA, 22 nt, Human
ccaggcugagcaugauuggagc

SEQ ID NO: 217327 - RNA, 22 nt, Human
uuugucuuggccucaguuuucu

SEQ ID NO: 217328 - RNA, 22 nt, Human
aaguccagugauacuggcagga

SEQ ID NO: 217329 - RNA, 22 nt, Human
caggcaagcaaggggucuugaa

SEQ ID NO: 217330 - RNA, 19 nt, Human
auucauuggccaggguggu

SEQ ID NO: 217331 - RNA, 22 nt, Human
gguggcugugagcauuauguga

SEQ ID NO: 217332 - RNA, 22 nt, Human
ccuggcaccuucacagacuacu

SEQ ID NO: 217333 - RNA, 22 nt, Human
cuugaguuacagcucuccaaga

SEQ ID NO: 217334 - RNA, 22 nt, Human
cugggagaucuccugagggcag

SEQ ID NO: 217335 - RNA, 19 nt, Human
ucaggagcagcuucugaac

SEQ ID NO: 217336 - RNA, 22 nt, Human
aggaggccugcagcugccauuc

SEQ ID NO: 217337 - RNA, 22 nt, Human
aggaguuauggcagaaucaaau

SEQ ID NO: 217338 - RNA, 22 nt, Human
uauaaagagucucaaagaaguu

SEQ ID NO: 217339 - RNA, 22 nt, Human
gaugggguuuugccaggcuggu

SEQ ID NO: 217340 - RNA, 22 nt, Human
uuucucgcguuugagcucucag

SEQ ID NO: 217341 - RNA, 19 nt, Human
gugucaggaugugcagggg

SEQ ID NO: 217342 - RNA, 22 nt, Human
agcugccaaguuggaguagcaa

SEQ ID NO: 217343 - RNA, 22 nt, Human
ggcugugaacccuggcagugug

SEQ ID NO: 217344 - RNA, 20 nt, Human
agguguccuguagcuugagu

SEQ ID NO: 217345 - RNA, 20 nt, Human
uccugaauuuccuuucugcu

SEQ ID NO: 217346 - RNA, 22 nt, Human
gcuggcaggagccuuucccuuu

SEQ ID NO: 217347 - RNA, 22 nt, Human
uagccauguguggaacacagcc

SEQ ID NO: 217348 - RNA, 22 nt, Human
gagcugaagaugucagaaccgu

SEQ ID NO: 217349 - RNA, 22 nt, Human
agcaguguucuaaucuggcuag

SEQ ID NO: 217350 - RNA, 21 nt, Human
ucagugacaggugcugaccuc

SEQ ID NO: 217351 - RNA, 22 nt, Human
uuuaaauuuagaagaaacacug

SEQ ID NO: 217352 - RNA, 22 nt, Human
cuaaaugauauuuugguuuccu

SEQ ID NO: 217353 - RNA, 22 nt, Human
acauuugagcaucuacuaagug

SEQ ID NO: 217354 - RNA, 21 nt, Human
aggaggaacccguggcugggc

SEQ ID NO: 217355 - RNA, 22 nt, Human
gaguuacauucauuguuacgcu

SEQ ID NO: 217356 - RNA, 22 nt, Human
aggagcucaaagaugccaggag

SEQ ID NO: 217357 - RNA, 22 nt, Human
ccucugugccucguguccucug

SEQ ID NO: 217358 - RNA, 22 nt, Human
agaccccauaccucagcaggua

SEQ ID NO: 217359 - RNA, 22 nt, Human
uacaugugcuggguucuuggcc

SEQ ID NO: 217360 - RNA, 17 nt, Human
uacaaugugauucaauc

SEQ ID NO: 217361 - RNA, 22 nt, Human
aucagagcccugaugacagacu

SEQ ID NO: 217362 - RNA, 22 nt, Human
caucuggguucucagauggaua

SEQ ID NO: 217363 - RNA, 20 nt, Human
uaggcagcuugacccuuggu

SEQ ID NO: 217364 - RNA, 22 nt, Human
ccugcugugaccggggagcagg

SEQ ID NO: 217365 - RNA, 22 nt, Human
ccaggcucugccaggcccuuga

SEQ ID NO: 217366 - RNA, 22 nt, Human
ccuggcaguuuugcccaggauu

SEQ ID NO: 217367 - RNA, 22 nt, Human
aagcuacaguuuacccaugguu

SEQ ID NO: 217368 - RNA, 22 nt, Human
uccauucauucauugaugaaca

SEQ ID NO: 217369 - RNA, 22 nt, Human
agucacaguuccuacccaguaa

SEQ ID NO: 217370 - RNA, 22 nt, Human
augcaaaugcagccauugcaga

SEQ ID NO: 217371 - RNA, 22 nt, Human
ucuggcugggugagagcuucuc

SEQ ID NO: 217372 - RNA, 22 nt, Human
uauguauucucagauuuacuaa

SEQ ID NO: 217373 - RNA, 18 nt, Human
agagaaagaccaaagcau

SEQ ID NO: 217374 - RNA, 22 nt, Human
ggccuuccugcugcuccgggcc

SEQ ID NO: 217375 - RNA, 22 nt, Human
uuucuagcuguaggaagcugag

SEQ ID NO: 217376 - RNA, 19 nt, Human
agcugugcagacacuucgc

SEQ ID NO: 217377 - RNA, 22 nt, Human
cccuuccucaaggagcuguguu

SEQ ID NO: 217378 - RNA, 22 nt, Human
uauguauagagucuuuuaaauu

SEQ ID NO: 217379 - RNA, 22 nt, Human
augucugucuuuguacuccaca

SEQ ID NO: 217380 - RNA, 22 nt, Human
agaugugacugggcaaguuacu

SEQ ID NO: 217381 - RNA, 22 nt, Human
gguggcucucuuaagggcagcg

SEQ ID NO: 217382 - RNA, 22 nt, Human
uccagcccagcuccucucagaa

SEQ ID NO: 217383 - RNA, 22 nt, Human
agcagcagagcucuggucugca

SEQ ID NO: 217384 - RNA, 22 nt, Human
cagagaaagaagcccauucauu

SEQ ID NO: 217385 - RNA, 22 nt, Human
caucucauuuauuccaacucag

SEQ ID NO: 217386 - RNA, 22 nt, Human
caaagggcucuagacucagcag

SEQ ID NO: 217387 - RNA, 22 nt, Human
cuggcagguuuggugucuggug

SEQ ID NO: 217388 - RNA, 22 nt, Human
uagcaaccagaacagcacucua

SEQ ID NO: 217389 - RNA, 22 nt, Human
agcauuagguguguuucagagg

SEQ ID NO: 217390 - RNA, 22 nt, Human
uuucucagaggagccagacggu

SEQ ID NO: 217391 - RNA, 22 nt, Human
uccaggcuggcucuucaaaauu

SEQ ID NO: 217392 - RNA, 21 nt, Human
ugaaagaaggugcagucugaa

SEQ ID NO: 217393 - RNA, 22 nt, Human
aguaugcaaaugucauaagcau

SEQ ID NO: 217394 - RNA, 22 nt, Human
ucugaaauuguuaguaaaaaug

SEQ ID NO: 217395 - RNA, 22 nt, Human
agcauuuaguuaguaaauguuu

SEQ ID NO: 217396 - RNA, 22 nt, Human
aaauuagaucaguggauuuucu

SEQ ID NO: 217397 - RNA, 22 nt, Human
ucagugaucuaaggguauggcc

SEQ ID NO: 217398 - RNA, 22 nt, Human
agcaaaguagcugcuguucuua

SEQ ID NO: 217399 - RNA, 22 nt, Human
gaaggccacaaaaaaugucaua

SEQ ID NO: 217400 - RNA, 22 nt, Human
gcugcugugugggagacaggcg

SEQ ID NO: 217401 - RNA, 22 nt, Human
uuggccagcagcucuggcuuag

SEQ ID NO: 217402 - RNA, 22 nt, Human
ugagucuuuagaauucuaacuu

SEQ ID NO: 217403 - RNA, 22 nt, Human
caggcauuguucuagguucuca

SEQ ID NO: 217404 - RNA, 22 nt, Human
gcugagauuacgggcaugagcc

SEQ ID NO: 217405 - RNA, 22 nt, Human
uucaggaugcucagaguagucu

SEQ ID NO: 217406 - RNA, 22 nt, Human
aacuguagggaucugucuuagu

SEQ ID NO: 217407 - RNA, 22 nt, Human
uacauguucaaauuugucuuuc

SEQ ID NO: 217408 - RNA, 22 nt, Human
ucuagaaaaccaauauuacaug

SEQ ID NO: 217409 - RNA, 22 nt, Human
uacaucaaaucaauguuccagu

SEQ ID NO: 217410 - RNA, 22 nt, Human
cauagagugauguaagguaugu

SEQ ID NO: 217411 - RNA, 22 nt, Human
cccagcucaucaggagccgccc

SEQ ID NO: 217412 - RNA, 22 nt, Human
cccaguggggagcuucugccuu

SEQ ID NO: 217413 - RNA, 22 nt, Human
cucagcaacccuagaacauuug

SEQ ID NO: 217414 - RNA, 22 nt, Human
gcucacagucugcugagugcag

SEQ ID NO: 217415 - RNA, 22 nt, Human
gggcagugggaccaggcaccag

SEQ ID NO: 217416 - RNA, 21 nt, Human
augcaggcugcucagaagcaa

SEQ ID NO: 217417 - RNA, 22 nt, Human
ggugcugagagccuaggagggc

SEQ ID NO: 217418 - RNA, 22 nt, Human
cuggagccccagacagggagag

SEQ ID NO: 217419 - RNA, 22 nt, Human
cagguggggagaguguggagca

SEQ ID NO: 217420 - RNA, 22 nt, Human
aggcuggcucggcuuuucuguc

SEQ ID NO: 217421 - RNA, 19 nt, Human
aggcagucauuggaauaua

SEQ ID NO: 217422 - RNA, 18 nt, Human
ucauggcuuuagucccuc

SEQ ID NO: 217423 - RNA, 19 nt, Human
ggggagaacuagagacagc

SEQ ID NO: 217424 - RNA, 22 nt, Human
cuuguucugugcuucuuacauu

SEQ ID NO: 217425 - RNA, 22 nt, Human
guauucagaaggaugaucuagu

SEQ ID NO: 217426 - RNA, 22 nt, Human
agauuucucuuucccuggcuga

SEQ ID NO: 217427 - RNA, 22 nt, Human
cccaggcuggauuucgguggca

SEQ ID NO: 217428 - RNA, 22 nt, Human
gggucuggcaugcugagaugga

SEQ ID NO: 217429 - RNA, 23 nt, Human
aucugaaaagcauuugcaguuug

SEQ ID NO: 217430 - RNA, 22 nt, Human
uaaagacacugguuuuaaucau

SEQ ID NO: 217431 - RNA, 22 nt, Human
cagugcugagagccuggccagg

SEQ ID NO: 217432 - RNA, 22 nt, Human
acguuuuauucccaugcagcau

SEQ ID NO: 217433 - RNA, 22 nt, Human
cagaugcuuguuggcuggucuc

SEQ ID NO: 217434 - RNA, 22 nt, Human
uuauucuuuucuccagaauccc

SEQ ID NO: 217435 - RNA, 22 nt, Human
augaggcagcccuucccuucuc

SEQ ID NO: 217436 - RNA, 22 nt, Human
caggauggucucgaucuccuga

SEQ ID NO: 217437 - RNA, 22 nt, Human
uuucuucucacccaggacagag

SEQ ID NO: 217438 - RNA, 22 nt, Human
acaguaauauugaugcucguca

SEQ ID NO: 217439 - RNA, 22 nt, Human
ccaggcucacugacuaccacau

SEQ ID NO: 217440 - RNA, 22 nt, Human
ggcugaaauuggauccuugggc

SEQ ID NO: 217441 - RNA, 18 nt, Human
ugcugggguagaauccac

SEQ ID NO: 217442 - RNA, 23 nt, Human
cccagaccuugugcugcccuugg

SEQ ID NO: 217443 - RNA, 22 nt, Human
agagccccugguggagugagaa

SEQ ID NO: 217444 - RNA, 22 nt, Human
cuucaguguccucucuaguaga

SEQ ID NO: 217445 - RNA, 22 nt, Human
cacucaggguacaauggagggc

SEQ ID NO: 217446 - RNA, 22 nt, Human
uagagaaaagcagggaucagga

SEQ ID NO: 217447 - RNA, 22 nt, Human
uuauuuauguuaacagucgaga

SEQ ID NO: 217448 - RNA, 22 nt, Human
agacagacaugcuaguuuucuu

SEQ ID NO: 217449 - RNA, 22 nt, Human
ugggcccugacuucaagcaucc

SEQ ID NO: 217450 - RNA, 22 nt, Human
cugcaauaguuuagaauaauug

SEQ ID NO: 217451 - RNA, 22 nt, Human
acagagaaaguuccucucaggc

SEQ ID NO: 217452 - RNA, 22 nt, Human
uuugcuuuugugcucuaguggu

SEQ ID NO: 217453 - RNA, 22 nt, Human
gcauguguugguuuaugcaugu

SEQ ID NO: 217454 - RNA, 22 nt, Human
ucaacuuugaaaccauagugaa

SEQ ID NO: 217455 - RNA, 22 nt, Human
caugcagucaauaaacaugugu

SEQ ID NO: 217456 - RNA, 22 nt, Human
uccugcagcauccgucgucugu

SEQ ID NO: 217457 - RNA, 22 nt, Human
aaggccagacucuggaaugaca

SEQ ID NO: 217458 - RNA, 22 nt, Human
uguacaugaauaaaagaucuug

SEQ ID NO: 217459 - RNA, 18 nt, Human
gcugcaggcgccugcggu

SEQ ID NO: 217460 - RNA, 22 nt, Human
ucauuguauuaaaauauugguu

SEQ ID NO: 217461 - RNA, 22 nt, Human
auguuguuuuuucauaaaguau

SEQ ID NO: 217462 - RNA, 22 nt, Human
ggaaggcuccauacacaaagca

SEQ ID NO: 217463 - RNA, 22 nt, Human
uaugacuuuggaaaaauuacuu

SEQ ID NO: 217464 - RNA, 22 nt, Human
uaugacaagguggaguaugagu

SEQ ID NO: 217465 - RNA, 18 nt, Human
agaagccugccucaaugc

SEQ ID NO: 217466 - RNA, 22 nt, Human
augcaacaggguugggaggcgg

SEQ ID NO: 217467 - RNA, 21 nt, Human
ugcaaagcugcugaaguggua

SEQ ID NO: 217468 - RNA, 22 nt, Human
ggaugcccacuaucugcuggcu

SEQ ID NO: 217469 - RNA, 22 nt, Human
aguccaguguguucuggcagca

SEQ ID NO: 217470 - RNA, 22 nt, Human
uacaaacuaacaugucucaucc

SEQ ID NO: 217471 - RNA, 22 nt, Human
ccuggccaggcucucagcacug

SEQ ID NO: 217472 - RNA, 22 nt, Human
gucaacaaagaaaauuguuaau

SEQ ID NO: 217473 - RNA, 22 nt, Human
uaucaaaguuguccugugaagu

SEQ ID NO: 217474 - RNA, 22 nt, Human
agcagcagaucaaacaggcuug

SEQ ID NO: 217475 - RNA, 22 nt, Human
ucucuucauagugacacccauc

SEQ ID NO: 217476 - RNA, 22 nt, Human
ugacaaaacugcaauuacuuuu

SEQ ID NO: 217477 - RNA, 22 nt, Human
gcucagagagaggauauguuau

SEQ ID NO: 217478 - RNA, 22 nt, Human
gaggcuguguuucagugaggcc

SEQ ID NO: 217479 - RNA, 22 nt, Human
agcugcaggccucuccugggga

SEQ ID NO: 217480 - RNA, 22 nt, Human
cuugccucccucagcucacagc

SEQ ID NO: 217481 - RNA, 22 nt, Human
cuugccuguggcuaguuggcuc

SEQ ID NO: 217482 - RNA, 22 nt, Human
ugaaugaugcaguauaaugaua

SEQ ID NO: 217483 - RNA, 22 nt, Human
agacuucuugagcuggcacuuc

SEQ ID NO: 217484 - RNA, 22 nt, Human
agcauuccacacugaagucugc

SEQ ID NO: 217485 - RNA, 22 nt, Human
aacaaauguguuuuguaauuaa

SEQ ID NO: 217486 - RNA, 22 nt, Human
aaugauugcaaacauugagaac

SEQ ID NO: 217487 - RNA, 22 nt, Human
cuggcugggaaguagaguaggu

SEQ ID NO: 217488 - RNA, 22 nt, Human
auaugacauaaaaucauuuuug

SEQ ID NO: 217489 - RNA, 19 nt, Human
cagaggcaccagguauaga

SEQ ID NO: 217490 - RNA, 22 nt, Human
auugcuggcagcuggaucugca

SEQ ID NO: 217491 - RNA, 22 nt, Human
acucuggggugaugucucugag

SEQ ID NO: 217492 - RNA, 22 nt, Human
ggagcagagcugggcuuggcug

SEQ ID NO: 217493 - RNA, 22 nt, Human
uuacaauugagucuauuguaug

SEQ ID NO: 217494 - RNA, 22 nt, Human
aaauuucuaagcagccacuucc

SEQ ID NO: 217495 - RNA, 22 nt, Human
cccugagcucaggcccuugggg

SEQ ID NO: 217496 - RNA, 22 nt, Human
uuuuuugucuugaagaaauggu

SEQ ID NO: 217497 - RNA, 22 nt, Human
gacaagugcugauuuaucuccc

SEQ ID NO: 217498 - RNA, 22 nt, Human
aggcugcuucuuguccuuggca

SEQ ID NO: 217499 - RNA, 22 nt, Human
ucauggcucuaaagacauagau

SEQ ID NO: 217500 - RNA, 22 nt, Human
cagucucucuuguagugcagcu

SEQ ID NO: 217501 - RNA, 22 nt, Human
gcagggacaacugugcaccuga

SEQ ID NO: 217502 - RNA, 22 nt, Human
auuccaaacagugcugcagacu

SEQ ID NO: 217503 - RNA, 22 nt, Human
uagauggaggcuagaugcaggg

SEQ ID NO: 217504 - RNA, 22 nt, Human
ugaaggccagcagagugaaggc

SEQ ID NO: 217505 - RNA, 22 nt, Human
ugcugaggcuagaccuggaagu

SEQ ID NO: 217506 - RNA, 22 nt, Human
ccucuggggcaucagacaaagg

SEQ ID NO: 217507 - RNA, 22 nt, Human
aggcugcagaacagucaggugc

SEQ ID NO: 217508 - RNA, 22 nt, Human
ccugggcugcaugauggcauuu

SEQ ID NO: 217509 - RNA, 22 nt, Human
cuucccagaccuuagagugcag

SEQ ID NO: 217510 - RNA, 22 nt, Human
cuguccagcuuggcuccugggg

SEQ ID NO: 217511 - RNA, 22 nt, Human
ggacaggcgcagggccaaggaa

SEQ ID NO: 217512 - RNA, 22 nt, Human
gugcaggcuagauccuuccuac

SEQ ID NO: 217513 - RNA, 22 nt, Human
cacuguucaucaaaacugcucu

SEQ ID NO: 217514 - RNA, 22 nt, Human
ccagggccucguguucugagug

SEQ ID NO: 217515 - RNA, 22 nt, Human
guuauuagaagugaaggauugu

SEQ ID NO: 217516 - RNA, 22 nt, Human
aagagucauagagacauugauu

SEQ ID NO: 217517 - RNA, 22 nt, Human
ggcagaguugguggagucaguu

SEQ ID NO: 217518 - RNA, 22 nt, Human
ggggccacuggcaggaccuugg

SEQ ID NO: 217519 - RNA, 22 nt, Human
gaggcggcggccgagccuggcu

SEQ ID NO: 217520 - RNA, 22 nt, Human
auucaaguucuucugucuuugc

SEQ ID NO: 217521 - RNA, 22 nt, Human
cuccuucccuucaaguguuccu

SEQ ID NO: 217522 - RNA, 22 nt, Human
aacugcaaucacuuuugcacca

SEQ ID NO: 217523 - RNA, 22 nt, Human
agaguuaagacguacaugagug

SEQ ID NO: 217524 - RNA, 22 nt, Human
agggccagaguacaucagggcu

SEQ ID NO: 217525 - RNA, 23 nt, Human
uaacaauggacuccucuuagcua

SEQ ID NO: 217526 - RNA, 22 nt, Human
cagggcucccuugcaaggaggg

SEQ ID NO: 217527 - RNA, 22 nt, Human
uggcacacagagaagacacuug

SEQ ID NO: 217528 - RNA, 22 nt, Human
ugacagggaaagguccucuuuu

SEQ ID NO: 217529 - RNA, 22 nt, Human
aggggcuggaguucgagguuac

SEQ ID NO: 217530 - RNA, 22 nt, Human
ccaggcuagagagcaguggcac

SEQ ID NO: 217531 - RNA, 22 nt, Human
gggucaggcucagcagggcagc

SEQ ID NO: 217532 - RNA, 22 nt, Human
aaagugcauagaguagugccua

SEQ ID NO: 217533 - RNA, 22 nt, Human
ggugcagagcagugucagagca

SEQ ID NO: 217534 - RNA, 22 nt, Human
ucugucauuagccuugacugua

SEQ ID NO: 217535 - RNA, 20 nt, Human
uuuuagcacuuguuauggug

SEQ ID NO: 217536 - RNA, 22 nt, Human
gggagcugaugauguaaguccc

SEQ ID NO: 217537 - RNA, 22 nt, Human
acaacacauguguauaugugug

SEQ ID NO: 217538 - RNA, 22 nt, Human
aguccaagauuagggugacagc

SEQ ID NO: 217539 - RNA, 22 nt, Human
agcagguguaucggucaccuac

SEQ ID NO: 217540 - RNA, 22 nt, Human
cccagcuugcccaggacugagg

SEQ ID NO: 217541 - RNA, 22 nt, Human
aguuaucagguguuuucaugga

SEQ ID NO: 217542 - RNA, 22 nt, Human
guuucauacagauuauucaugg

SEQ ID NO: 217543 - RNA, 22 nt, Human
ugaaauagucuaaaaaaccaga

SEQ ID NO: 217544 - RNA, 22 nt, Human
gaugagcauuguuucauguguu

SEQ ID NO: 217545 - RNA, 22 nt, Human
ugcccaggcuccucgcagccuu

SEQ ID NO: 217546 - RNA, 22 nt, Human
agaagccagaauauucauggau

SEQ ID NO: 217547 - RNA, 22 nt, Human
uagaugaagcaacauguguaau

SEQ ID NO: 217548 - RNA, 22 nt, Human
acggcuucuugacuguggguug

SEQ ID NO: 217549 - RNA, 22 nt, Human
ucuucucccaucggccgcaggg

SEQ ID NO: 217550 - RNA, 22 nt, Human
cuggaaucuuuggagaaugugg

SEQ ID NO: 217551 - RNA, 22 nt, Human
cuggccugagcacagcggcugc

SEQ ID NO: 217552 - RNA, 22 nt, Human
uuaaauaguaggucuauuuugg

SEQ ID NO: 217553 - RNA, 22 nt, Human
gaguuauaaccuaguuuaacug

SEQ ID NO: 217554 - RNA, 19 nt, Human
ucaaagcaagcauguucug

SEQ ID NO: 217555 - RNA, 22 nt, Human
gaggagguggagucaugcagag

SEQ ID NO: 217556 - RNA, 22 nt, Human
uugagcccaggaggccugggug

SEQ ID NO: 217557 - RNA, 22 nt, Human
uggcagagucaucacaucugga

SEQ ID NO: 217558 - RNA, 20 nt, Human
acugcuguagaccaucugca

SEQ ID NO: 217559 - RNA, 22 nt, Human
cugccuggcuaaacucaagucg

SEQ ID NO: 217560 - RNA, 22 nt, Human
gcagcccaauggacugagacag

SEQ ID NO: 217561 - RNA, 22 nt, Human
gggcuuggaguaggcugaugaa

SEQ ID NO: 217562 - RNA, 23 nt, Human
cuuauucauucauguagcccauu

SEQ ID NO: 217563 - RNA, 22 nt, Human
uccuccagaaacugaggcagaa

SEQ ID NO: 217564 - RNA, 22 nt, Human
uucacugccaacuaacauggaa

SEQ ID NO: 217565 - RNA, 19 nt, Human
agguuacaggugucacaga

SEQ ID NO: 217566 - RNA, 22 nt, Human
gaagcuucguggcucuucaaau

SEQ ID NO: 217567 - RNA, 22 nt, Human
cagagucagcuagucuugggau

SEQ ID NO: 217568 - RNA, 22 nt, Human
agccuucaguaaauccacugug

SEQ ID NO: 217569 - RNA, 20 nt, Human
uguaaauaggcauuguaguu

SEQ ID NO: 217570 - RNA, 22 nt, Human
ucagacagaaagaugaguaugg

SEQ ID NO: 217571 - RNA, 20 nt, Human
uguuucugacgguaggagag

SEQ ID NO: 217572 - RNA, 22 nt, Human
gggccagguaucgucuuuagua

SEQ ID NO: 217573 - RNA, 22 nt, Human
gugaggggccaagaguagggca

SEQ ID NO: 217574 - RNA, 22 nt, Human
gcaggccugucuugcucgcccu

SEQ ID NO: 217575 - RNA, 22 nt, Human
ccugggcugggcgucucauggg

SEQ ID NO: 217576 - RNA, 22 nt, Human
gagcuuggugcacagugguuaa

SEQ ID NO: 217577 - RNA, 22 nt, Human
cucagagguggaugccuugugg

SEQ ID NO: 217578 - RNA, 22 nt, Human
aguagcaccagggaagcagggc

SEQ ID NO: 217579 - RNA, 22 nt, Human
ugacaugcuaagauuauguuau

SEQ ID NO: 217580 - RNA, 22 nt, Human
ggcucugcuccuggugccagug

SEQ ID NO: 217581 - RNA, 20 nt, Human
ugucuucauuauggugcccu

SEQ ID NO: 217582 - RNA, 22 nt, Human
ugggaggaagugcuaaugggag

SEQ ID NO: 217583 - RNA, 22 nt, Human
acacauucuuuaaaugucuguu

SEQ ID NO: 217584 - RNA, 22 nt, Human
gccugagcccaggugugcagag

SEQ ID NO: 217585 - RNA, 21 nt, Human
ucagcaggcaccagaaggcug

SEQ ID NO: 217586 - RNA, 22 nt, Human
gccucagcucccagcccaggcu

SEQ ID NO: 217587 - RNA, 22 nt, Human
gagggcaaaacagagaagaugu

SEQ ID NO: 217588 - RNA, 19 nt, Human
gcagagugggguggagggu

SEQ ID NO: 217589 - RNA, 18 nt, Human
cagcugccagcucaugga

SEQ ID NO: 217590 - RNA, 22 nt, Human
uagcugaagaggguauuguagg

SEQ ID NO: 217591 - RNA, 22 nt, Human
uuguuuaauaucgugaaguacu

SEQ ID NO: 217592 - RNA, 22 nt, Human
cccuuccugggugucccggagu

SEQ ID NO: 217593 - RNA, 22 nt, Human
ucugccuuucacacagacggcc

SEQ ID NO: 217594 - RNA, 22 nt, Human
gagccagggcugugagcugagc

SEQ ID NO: 217595 - RNA, 22 nt, Human
cucugggcuuguugaccugcac

SEQ ID NO: 217596 - RNA, 21 nt, Human
cuacacagcuuucuauaggaa

SEQ ID NO: 217597 - RNA, 22 nt, Human
ggcagugagucccggagaggcc

SEQ ID NO: 217598 - RNA, 22 nt, Human
cuugacacugucacucaggcca

SEQ ID NO: 217599 - RNA, 22 nt, Human
aguucucagcuuaguaugcugu

SEQ ID NO: 217600 - RNA, 22 nt, Human
aacaggcuaguuuuaaagcaua

SEQ ID NO: 217601 - RNA, 22 nt, Human
aauuaguaaccuaauuccaucu

SEQ ID NO: 217602 - RNA, 22 nt, Human
agggggugcccagaugaaggau

SEQ ID NO: 217603 - RNA, 22 nt, Human
ucucacugcaaauauuauguau

SEQ ID NO: 217604 - RNA, 22 nt, Human
agagcaucuaacacauaagccu

SEQ ID NO: 217605 - RNA, 22 nt, Human
uggcuucugcucccagaaugau

SEQ ID NO: 217606 - RNA, 22 nt, Human
aguguuagugaaagguguuuau

SEQ ID NO: 217607 - RNA, 22 nt, Human
caaaucuauauguugauauucu

SEQ ID NO: 217608 - RNA, 19 nt, Human
cuggcagccugucuguguc

SEQ ID NO: 217609 - RNA, 22 nt, Human
uuugugaucuccucccucuaga

SEQ ID NO: 217610 - RNA, 22 nt, Human
gacugaggagguaagguuugaa

SEQ ID NO: 217611 - RNA, 20 nt, Human
uuguuucugcuauuuucuaa

SEQ ID NO: 217612 - RNA, 22 nt, Human
aaagcugcugugaaugguuugg

SEQ ID NO: 217613 - RNA, 22 nt, Human
cuccauugaacauccucucaga

SEQ ID NO: 217614 - RNA, 22 nt, Human
uccuagaauaaucuuugacugc

SEQ ID NO: 217615 - RNA, 22 nt, Human
ucaguuagggccucagaagaca

SEQ ID NO: 217616 - RNA, 21 nt, Human
ccaggggcaaauugucguuuc

SEQ ID NO: 217617 - RNA, 22 nt, Human
uucuguguggguagcuccuguu

SEQ ID NO: 217618 - RNA, 20 nt, Human
agacaggagcccccauucag

SEQ ID NO: 217619 - RNA, 22 nt, Human
ucuagauuuggggcaugaaguu

SEQ ID NO: 217620 - RNA, 22 nt, Human
agcuucuugggcuuuacacaaa

SEQ ID NO: 217621 - RNA, 22 nt, Human
auguauuugcuuguuauggauu

SEQ ID NO: 217622 - RNA, 22 nt, Human
ucagucuuuuucucuuaaguac

SEQ ID NO: 217623 - RNA, 22 nt, Human
aaacaacuucugcacuaugggu

SEQ ID NO: 217624 - RNA, 22 nt, Human
gguggcagugcuugcgggucua

SEQ ID NO: 217625 - RNA, 22 nt, Human
aggaagccugggagguuuggga

SEQ ID NO: 217626 - RNA, 18 nt, Human
uaggcugggggcuguagu

SEQ ID NO: 217627 - RNA, 22 nt, Human
augcagaauugcuaaguaucug

SEQ ID NO: 217628 - RNA, 22 nt, Human
uucccugcaaccuuucccuggg

SEQ ID NO: 217629 - RNA, 22 nt, Human
cuggaggugggggcaagagugu

SEQ ID NO: 217630 - RNA, 22 nt, Human
gggggcuggaauauccaucaac

SEQ ID NO: 217631 - RNA, 22 nt, Human
uauuuaauuagugauuguagag

SEQ ID NO: 217632 - RNA, 21 nt, Human
acuccaaacaaguuaagcugu

SEQ ID NO: 217633 - RNA, 22 nt, Human
cuucuggagcucaccaacuucc

SEQ ID NO: 217634 - RNA, 22 nt, Human
aggaaggacuccaugguccguc

SEQ ID NO: 217635 - RNA, 22 nt, Human
cagucaccaccagguggcagua

SEQ ID NO: 217636 - RNA, 22 nt, Human
aaauacaauuucaggcuguaau

SEQ ID NO: 217637 - RNA, 22 nt, Human
uggguccuugcuaacuucuaug

SEQ ID NO: 217638 - RNA, 22 nt, Human
augcaaacaugaagagaaagag

SEQ ID NO: 217639 - RNA, 22 nt, Human
ucaaaugcugccuuugugugcc

SEQ ID NO: 217640 - RNA, 22 nt, Human
uuagagaauuccaaaugacuac

SEQ ID NO: 217641 - RNA, 22 nt, Human
aagcugcaugaaguugaguaga

SEQ ID NO: 217642 - RNA, 22 nt, Human
caauucaaaugcauaguucaca

SEQ ID NO: 217643 - RNA, 22 nt, Human
ccaggcuagcccagaccacagg

SEQ ID NO: 217644 - RNA, 22 nt, Human
uugauacauuuuuaggauaaac

SEQ ID NO: 217645 - RNA, 22 nt, Human
ccacagcaugcaggccugacac

SEQ ID NO: 217646 - RNA, 22 nt, Human
ggacaguugguugggcucuugu

SEQ ID NO: 217647 - RNA, 22 nt, Human
accugguuccuccucacugcug

SEQ ID NO: 217648 - RNA, 22 nt, Human
ucuccccaaaggacucacucuc

SEQ ID NO: 217649 - RNA, 19 nt, Human
ggcauccagaacuaccagu

SEQ ID NO: 217650 - RNA, 22 nt, Human
uccuccagcuguauccugccug

SEQ ID NO: 217651 - RNA, 22 nt, Human
ccacagaaucgcuaguggagca

SEQ ID NO: 217652 - RNA, 22 nt, Human
uguaauucauucaacugaagaa

SEQ ID NO: 217653 - RNA, 22 nt, Human
auaacuuaaugggucaugcucu

SEQ ID NO: 217654 - RNA, 22 nt, Human
ggucaguguauguauugauaag

SEQ ID NO: 217655 - RNA, 22 nt, Human
ccugggucuguauugguaggua

SEQ ID NO: 217656 - RNA, 22 nt, Human
aggcaguuuaggcagcgauuua

SEQ ID NO: 217657 - RNA, 22 nt, Human
uuugcaaugugaaauuaaagaa

SEQ ID NO: 217658 - RNA, 22 nt, Human
cacaaaaucuuucucgauuauu

SEQ ID NO: 217659 - RNA, 22 nt, Human
cucuuuggagaagcacguauua

SEQ ID NO: 217660 - RNA, 22 nt, Human
acagaaugcguagugcauguug

SEQ ID NO: 217661 - RNA, 22 nt, Human
ccacuguuggcccgaagggguc

SEQ ID NO: 217662 - RNA, 22 nt, Human
gaaagacauaguugcaagaugg

SEQ ID NO: 217663 - RNA, 22 nt, Human
caaggccaguucaccaagggca

SEQ ID NO: 217664 - RNA, 22 nt, Human
uuuuuagaauuggcugagaauu

SEQ ID NO: 217665 - RNA, 22 nt, Human
aaaucucaggccucuauuuacu

SEQ ID NO: 217666 - RNA, 22 nt, Human
gucucugucacaacuacucauc

SEQ ID NO: 217667 - RNA, 22 nt, Human
cugguggcaucuugagaugguu

SEQ ID NO: 217668 - RNA, 22 nt, Human
aagccacuauggugauucucaa

SEQ ID NO: 217669 - RNA, 22 nt, Human
uggggcaguggcuuuucacccu

SEQ ID NO: 217670 - RNA, 22 nt, Human
guggguccgcuugguuccggug

SEQ ID NO: 217671 - RNA, 22 nt, Human
uucccaguauuaccuucaggaa

SEQ ID NO: 217672 - RNA, 22 nt, Human
uauuucauucuuuaucaggagc

SEQ ID NO: 217673 - RNA, 18 nt, Human
ucaagacaucaugaaaua

SEQ ID NO: 217674 - RNA, 22 nt, Human
ggucuggaagcgcaguaggcug

SEQ ID NO: 217675 - RNA, 22 nt, Human
cuauacuacuauacagauguaa

SEQ ID NO: 217676 - RNA, 22 nt, Human
gcagggcagcuuagucccuguc

SEQ ID NO: 217677 - RNA, 22 nt, Human
gccugaggaauugaggggguaa

SEQ ID NO: 217678 - RNA, 22 nt, Human
uuagucuccagcuuaggguuug

SEQ ID NO: 217679 - RNA, 22 nt, Human
gcacacagacuaaccauauuuc

SEQ ID NO: 217680 - RNA, 22 nt, Human
gcagagcuaucuucuggauuug

SEQ ID NO: 217681 - RNA, 22 nt, Human
uagugucaucguugcagcugag

SEQ ID NO: 217682 - RNA, 23 nt, Human
uuaaguggucaguuuuagacaac

SEQ ID NO: 217683 - RNA, 22 nt, Human
uagcuggcuuauauaaaagggc

SEQ ID NO: 217684 - RNA, 22 nt, Human
gguccuuugccaucucuccacc

SEQ ID NO: 217685 - RNA, 22 nt, Human
caggcaccccaggugagcacug

SEQ ID NO: 217686 - RNA, 22 nt, Human
gcugcccugacaagcuacuccc

SEQ ID NO: 217687 - RNA, 22 nt, Human
agggaggaccaaugugugguua

SEQ ID NO: 217688 - RNA, 22 nt, Human
uggcaaaguaucugucccagcu

SEQ ID NO: 217689 - RNA, 19 nt, Human
auguucugaauuacuguaa

SEQ ID NO: 217690 - RNA, 23 nt, Human
gccugcugucacagcgggcccag

SEQ ID NO: 217691 - RNA, 22 nt, Human
uauaauaugaggcaggagugau

SEQ ID NO: 217692 - RNA, 22 nt, Human
uuccuuucccuugcuucugugc

SEQ ID NO: 217693 - RNA, 20 nt, Human
gaaaauaggccagccaggua

SEQ ID NO: 217694 - RNA, 22 nt, Human
uucagagaguccaguaugcagu

SEQ ID NO: 217695 - RNA, 22 nt, Human
uuacugauggaacagagauaga

SEQ ID NO: 217696 - RNA, 22 nt, Human
caaaguaucaacucccacacug

SEQ ID NO: 217697 - RNA, 22 nt, Human
agaggcaggagguugacuugag

SEQ ID NO: 217698 - RNA, 23 nt, Human
uuguaaaacagugugacgguucc

SEQ ID NO: 217699 - RNA, 22 nt, Human
uucuuucuuuguaguccugaac

SEQ ID NO: 217700 - RNA, 22 nt, Human
uauacugaguguguuaaugaug

SEQ ID NO: 217701 - RNA, 22 nt, Human
augcaggaguucgaggcuguau

SEQ ID NO: 217702 - RNA, 22 nt, Human
ugcucaggacaguggaaccuaa

SEQ ID NO: 217703 - RNA, 22 nt, Human
gggccacuggguccugcuggcc

SEQ ID NO: 217704 - RNA, 22 nt, Human
uccucaguuauaaauaggaaac

SEQ ID NO: 217705 - RNA, 22 nt, Human
gcgucuuuuagauuuuacaucu

SEQ ID NO: 217706 - RNA, 22 nt, Human
uaaucguauguguaucaaauca

SEQ ID NO: 217707 - RNA, 19 nt, Human
agggucaggacaaggacuu

SEQ ID NO: 217708 - RNA, 22 nt, Human
gcugugcuugcaugagugucug

SEQ ID NO: 217709 - RNA, 22 nt, Human
ccagcccuacaguaucaccugu

SEQ ID NO: 217710 - RNA, 22 nt, Human
auggcccuggaaagagcuugag

SEQ ID NO: 217711 - RNA, 22 nt, Human
agauauuaggaggauucauaau

SEQ ID NO: 217712 - RNA, 22 nt, Human
gcaaagcacacccucagaguuu

SEQ ID NO: 217713 - RNA, 22 nt, Human
auggcagaauuaggauuucaag

SEQ ID NO: 217714 - RNA, 22 nt, Human
aaguguuauguaggauuucaga

SEQ ID NO: 217715 - RNA, 22 nt, Human
agggacagaugaaugacugagu

SEQ ID NO: 217716 - RNA, 22 nt, Human
uucuacacuuuucauuagcuag

SEQ ID NO: 217717 - RNA, 22 nt, Human
aguguucuaacaacugcuuuca

SEQ ID NO: 217718 - RNA, 22 nt, Human
gaaguacaaaggacauggaaac

SEQ ID NO: 217719 - RNA, 22 nt, Human
aggcuggcccaccucuugucuu

SEQ ID NO: 217720 - RNA, 22 nt, Human
guauuuuacugcucaaagcucu

SEQ ID NO: 217721 - RNA, 22 nt, Human
uaugaucucugggucuggagcu

SEQ ID NO: 217722 - RNA, 22 nt, Human
aggaccuguguuuuccuugaau

SEQ ID NO: 217723 - RNA, 22 nt, Human
uggugcagguguugaugcagga

SEQ ID NO: 217724 - RNA, 22 nt, Human
cugcaggcuuccagggcugugg

SEQ ID NO: 217725 - RNA, 22 nt, Human
ugaggacauuuaucuuggcgca

SEQ ID NO: 217726 - RNA, 22 nt, Human
cccugacccuaucagagggcca

SEQ ID NO: 217727 - RNA, 22 nt, Human
aacaccagucccaagagaggcu

SEQ ID NO: 217728 - RNA, 22 nt, Human
cuauuagguuggugcaaaagua

SEQ ID NO: 217729 - RNA, 22 nt, Human
gcaagcugaugugauagugaaa

SEQ ID NO: 217730 - RNA, 23 nt, Human
uggcauagugaggggcacagaga

SEQ ID NO: 217731 - RNA, 22 nt, Human
gacagcagaugaagccugcaga

SEQ ID NO: 217732 - RNA, 22 nt, Human
agcuggugcucaggggcaugga

SEQ ID NO: 217733 - RNA, 22 nt, Human
uuuguuacaaagaaagaagagc

SEQ ID NO: 217734 - RNA, 19 nt, Human
uacaggcaguuucuacaau

SEQ ID NO: 217735 - RNA, 21 nt, Human
ucccacagcgccagcuccugu

SEQ ID NO: 217736 - RNA, 22 nt, Human
ggcugcugaaguguggcaaucu

SEQ ID NO: 217737 - RNA, 22 nt, Human
caggccuuaguaggugcucccu

SEQ ID NO: 217738 - RNA, 22 nt, Human
agcuccagauuaauuguaggag

SEQ ID NO: 217739 - RNA, 22 nt, Human
agcgccugcggugugagccugc

SEQ ID NO: 217740 - RNA, 20 nt, Human
ugcucccuugcgagucgcug

SEQ ID NO: 217741 - RNA, 22 nt, Human
ccagagggagccaccagggugu

SEQ ID NO: 217742 - RNA, 22 nt, Human
uccaaggaagucauuuaaacug

SEQ ID NO: 217743 - RNA, 22 nt, Human
uguggcugucuguucuccuagg

SEQ ID NO: 217744 - RNA, 22 nt, Human
auuacaugagagaauguaaaua

SEQ ID NO: 217745 - RNA, 22 nt, Human
uaaugaaugagaauauaacaga

SEQ ID NO: 217746 - RNA, 22 nt, Human
caccuucagaaugcuccaggca

SEQ ID NO: 217747 - RNA, 22 nt, Human
ucuuugaucagccuuucacuga

SEQ ID NO: 217748 - RNA, 22 nt, Human
augcuaaauccagaagcaguca

SEQ ID NO: 217749 - RNA, 17 nt, Human
cagaggagcuuuggggg

SEQ ID NO: 217750 - RNA, 22 nt, Human
uuaguguguccaguucugaaaa

SEQ ID NO: 217751 - RNA, 22 nt, Human
cagucccaugagcccagaacau

SEQ ID NO: 217752 - RNA, 22 nt, Human
cugaagagcaaaccaacuggac

SEQ ID NO: 217753 - RNA, 22 nt, Human
caugcaaagcguuuugaccagc

SEQ ID NO: 217754 - RNA, 22 nt, Human
aagucucuggugaugcaggaaa

SEQ ID NO: 217755 - RNA, 22 nt, Human
cugcugugugcuuacuuggguu

SEQ ID NO: 217756 - RNA, 22 nt, Human
uuuguuuauuaggggagaguug

SEQ ID NO: 217757 - RNA, 22 nt, Human
aaauuaagggugagaagaguug

SEQ ID NO: 217758 - RNA, 19 nt, Human
acagugcuucugagugagg

SEQ ID NO: 217759 - RNA, 22 nt, Human
ccugugcccucagccuggcucu

SEQ ID NO: 217760 - RNA, 22 nt, Human
cuggcucauuuuagcaucaggu

SEQ ID NO: 217761 - RNA, 22 nt, Human
aaggccaggacaccaggggacu

SEQ ID NO: 217762 - RNA, 22 nt, Human
aguguucauuuauucauucacu

SEQ ID NO: 217763 - RNA, 22 nt, Human
acagauggccauauuacuauau

SEQ ID NO: 217764 - RNA, 22 nt, Human
aaucaagaaaaugaggauucuu

SEQ ID NO: 217765 - RNA, 22 nt, Human
ucccugggcacaaucugcuggc

SEQ ID NO: 217766 - RNA, 22 nt, Human
cacuugaagugaauugcucacc

SEQ ID NO: 217767 - RNA, 21 nt, Human
ugcaggaaguauggugccuau

SEQ ID NO: 217768 - RNA, 22 nt, Human
ucagcucuacacacaccugugu

SEQ ID NO: 217769 - RNA, 22 nt, Human
cucugugauuuugugagccaga

SEQ ID NO: 217770 - RNA, 22 nt, Human
auccaauuacguuuuuugucau

SEQ ID NO: 217771 - RNA, 22 nt, Human
uggccucagauuauugcacagu

SEQ ID NO: 217772 - RNA, 22 nt, Human
ucucuggaagcgcagaucuguu

SEQ ID NO: 217773 - RNA, 22 nt, Human
ccugggcucugaggagggaguc

SEQ ID NO: 217774 - RNA, 22 nt, Human
gcagguggagcaguagucuggu

SEQ ID NO: 217775 - RNA, 22 nt, Human
ggcccagcuuucauuccuugcu

SEQ ID NO: 217776 - RNA, 22 nt, Human
cccuaggcugggcucuuggcuu

SEQ ID NO: 217777 - RNA, 22 nt, Human
uugcuuuagaaucugcuucugg

SEQ ID NO: 217778 - RNA, 22 nt, Human
ucccagccggugccuggguccc

SEQ ID NO: 217779 - RNA, 22 nt, Human
cuauuuggccaagcugcccaca

SEQ ID NO: 217780 - RNA, 22 nt, Human
agccugguuuaagcauuuuaua

SEQ ID NO: 217781 - RNA, 22 nt, Human
ccugagcauuagacauccauca

SEQ ID NO: 217782 - RNA, 22 nt, Human
guaaacaucagccacucuauuu

SEQ ID NO: 217783 - RNA, 22 nt, Human
uucuauaaugcaagccacugca

SEQ ID NO: 217784 - RNA, 22 nt, Human
cauuuauucauuugcuagggcu

SEQ ID NO: 217785 - RNA, 22 nt, Human
agcuggucuuaaauguguccag

SEQ ID NO: 217786 - RNA, 22 nt, Human
ugcucccugacccaggucuucu

SEQ ID NO: 217787 - RNA, 19 nt, Human
guguacagcucagugaauu

SEQ ID NO: 217788 - RNA, 21 nt, Human
gccugcuguucacccugccac

SEQ ID NO: 217789 - RNA, 22 nt, Human
gaagguccagcguggccaaguc

SEQ ID NO: 217790 - RNA, 22 nt, Human
gcucuagguuccuagccaaguc

SEQ ID NO: 217791 - RNA, 22 nt, Human
aggcauggggcugcagucaggu

SEQ ID NO: 217792 - RNA, 22 nt, Human
cagguggugccuccucccuucc

SEQ ID NO: 217793 - RNA, 18 nt, Human
gacaaaaguacagacaga

SEQ ID NO: 217794 - RNA, 22 nt, Human
agcaaagcacuuugcauacaua

SEQ ID NO: 217795 - RNA, 22 nt, Human
cugucauuuaagacauucugga

SEQ ID NO: 217796 - RNA, 22 nt, Human
gggcuucuugccauggggacgg

SEQ ID NO: 217797 - RNA, 22 nt, Human
ggagaugcaauguagaaucugg

SEQ ID NO: 217798 - RNA, 22 nt, Human
cagguuuagguggacgugcagg

SEQ ID NO: 217799 - RNA, 22 nt, Human
gcugggaaguggcagagcugga

SEQ ID NO: 217800 - RNA, 22 nt, Human
gccuguccacuaaacagccaag

SEQ ID NO: 217801 - RNA, 22 nt, Human
gaugcaaaccuuacauggaccu

SEQ ID NO: 217802 - RNA, 22 nt, Human
gcucaaagaggccuccaaaucc

SEQ ID NO: 217803 - RNA, 22 nt, Human
agcccccucccuagugacugga

SEQ ID NO: 217804 - RNA, 22 nt, Human
auaguacacauccuacaauguu

SEQ ID NO: 217805 - RNA, 22 nt, Human
aacaugaaaaccuccacagcaa

SEQ ID NO: 217806 - RNA, 22 nt, Human
aauuuucuaaggugaugaucug

SEQ ID NO: 217807 - RNA, 22 nt, Human
auggcuucaucuuuuaguccuu

SEQ ID NO: 217808 - RNA, 22 nt, Human
ugccaggcucaggaugucccug

SEQ ID NO: 217809 - RNA, 19 nt, Human
ucacaggcaucuccccaga

SEQ ID NO: 217810 - RNA, 22 nt, Human
caccauuuaguagcaagagcuc

SEQ ID NO: 217811 - RNA, 22 nt, Human
cccuggcagagggggcaggugc

SEQ ID NO: 217812 - RNA, 22 nt, Human
gaacaguagaugagaugcuaga

SEQ ID NO: 217813 - RNA, 17 nt, Human
gaggacagggaaguagg

SEQ ID NO: 217814 - RNA, 22 nt, Human
agguauuucaaagcccacuucc

SEQ ID NO: 217815 - RNA, 22 nt, Human
ccuuuuucccuggagggacagc

SEQ ID NO: 217816 - RNA, 22 nt, Human
cucuccuggggagcacacacac

SEQ ID NO: 217817 - RNA, 22 nt, Human
ccuuggauuuugugcccacgcc

SEQ ID NO: 217818 - RNA, 22 nt, Human
guguccugcauuggcucugccc

SEQ ID NO: 217819 - RNA, 22 nt, Human
ugggucuguagggcuguccaau

SEQ ID NO: 217820 - RNA, 22 nt, Human
caggccaggguugagaagagaa

SEQ ID NO: 217821 - RNA, 22 nt, Human
cagggaaaguucuuguccacuc

SEQ ID NO: 217822 - RNA, 22 nt, Human
ggugccaggcuguagucagggu

SEQ ID NO: 217823 - RNA, 22 nt, Human
agcuuuguauuugagcauacga

SEQ ID NO: 217824 - RNA, 22 nt, Human
cagcuuggcuucacauucugua

SEQ ID NO: 217825 - RNA, 22 nt, Human
auugcugguagucagugucccu

SEQ ID NO: 217826 - RNA, 22 nt, Human
ccagaggagaugccuccucugu

SEQ ID NO: 217827 - RNA, 22 nt, Human
gauggucuguauuaaacagaug

SEQ ID NO: 217828 - RNA, 22 nt, Human
ccagggcaauaggaacacuuuu

SEQ ID NO: 217829 - RNA, 22 nt, Human
ucaaaggcccauugucccguug

SEQ ID NO: 217830 - RNA, 22 nt, Human
ugggccugaguuugggaacugg

SEQ ID NO: 217831 - RNA, 22 nt, Human
agaagggagagaaaguugguua

SEQ ID NO: 217832 - RNA, 22 nt, Human
acuuuggaauaagcuauauaac

SEQ ID NO: 217833 - RNA, 22 nt, Human
acagguguugaaugaugucaca

SEQ ID NO: 217834 - RNA, 22 nt, Human
uccucuccauauuuucugauuu

SEQ ID NO: 217835 - RNA, 22 nt, Human
ggaauguuugcucccuucaggg

SEQ ID NO: 217836 - RNA, 22 nt, Human
ucacagaaacagaauggcacag

SEQ ID NO: 217837 - RNA, 22 nt, Human
ucucugaauaaugcuauucuuu

SEQ ID NO: 217838 - RNA, 16 nt, Human
ggcuccagaauagcga

SEQ ID NO: 217839 - RNA, 22 nt, Human
cagaguucaaagccugcuggga

SEQ ID NO: 217840 - RNA, 22 nt, Human
accauucugguccauacuguuc

SEQ ID NO: 217841 - RNA, 22 nt, Human
uaguuuuacaucagccauuguu

SEQ ID NO: 217842 - RNA, 22 nt, Human
acugcugauuauugaaguagag

SEQ ID NO: 217843 - RNA, 22 nt, Human
ggccuugggauguggcugcagc

SEQ ID NO: 217844 - RNA, 22 nt, Human
ugauuuucaugggugaucuuug

SEQ ID NO: 217845 - RNA, 22 nt, Human
caggaugggugucggccagcac

SEQ ID NO: 217846 - RNA, 22 nt, Human
guauuaggaaauaugaagaaag

SEQ ID NO: 217847 - RNA, 22 nt, Human
uucacauuuacugguuuguccg

SEQ ID NO: 217848 - RNA, 22 nt, Human
ucauaugauuguaaugagaaua

SEQ ID NO: 217849 - RNA, 22 nt, Human
aggcccuggguuagggcccacu

SEQ ID NO: 217850 - RNA, 23 nt, Human
gagcuuagucuacucagacaucc

SEQ ID NO: 217851 - RNA, 23 nt, Human
gcugccuccuacaaaagcccagc

SEQ ID NO: 217852 - RNA, 22 nt, Human
ucugaggaaagagagugggaug

SEQ ID NO: 217853 - RNA, 22 nt, Human
gauuuucauuauagcuaguuuc

SEQ ID NO: 217854 - RNA, 22 nt, Human
agcauccaacaggagggaaggg

SEQ ID NO: 217855 - RNA, 22 nt, Human
ugauucuauggaaggcauaagg

SEQ ID NO: 217856 - RNA, 22 nt, Human
cacagguucaccucagguaggu

SEQ ID NO: 217857 - RNA, 22 nt, Human
aggaccuuuggcaaggcugcuc

SEQ ID NO: 217858 - RNA, 22 nt, Human
uuuaucugcauucugaccaucu

SEQ ID NO: 217859 - RNA, 22 nt, Human
ugguuucucugaacucuacgac

SEQ ID NO: 217860 - RNA, 22 nt, Human
auccuacaaagcagggcuaugg

SEQ ID NO: 217861 - RNA, 22 nt, Human
ucacaggcaaagaagauuggug

SEQ ID NO: 217862 - RNA, 22 nt, Human
uuauuauagauuaugcaagauu

SEQ ID NO: 217863 - RNA, 20 nt, Human
uccagccacuuccgcugguc

SEQ ID NO: 217864 - RNA, 22 nt, Human
ugcuuuauucgacaucugguag

SEQ ID NO: 217865 - RNA, 22 nt, Human
uuuaauuuuccugguaggccug

SEQ ID NO: 217866 - RNA, 22 nt, Human
cugaggcugggcauggggucca

SEQ ID NO: 217867 - RNA, 22 nt, Human
uuucucagggaggagucaagcc

SEQ ID NO: 217868 - RNA, 22 nt, Human
acacacaugccuuuccuaagua

SEQ ID NO: 217869 - RNA, 22 nt, Human
uacaguuacccuggaaagaaau

SEQ ID NO: 217870 - RNA, 23 nt, Human
uuucaacuccugccauuauuucu

SEQ ID NO: 217871 - RNA, 22 nt, Human
ucagagaaguaggcuaauggug

SEQ ID NO: 217872 - RNA, 22 nt, Human
guguuacauauucuaaaaugcu

SEQ ID NO: 217873 - RNA, 22 nt, Human
cugaggaggggccugagugaga

SEQ ID NO: 217874 - RNA, 22 nt, Human
acaguguuuucuuaaggagaaa

SEQ ID NO: 217875 - RNA, 22 nt, Human
ugcauuuuugagguuaacucaa

SEQ ID NO: 217876 - RNA, 22 nt, Human
caaguguccaugauagucuuag

SEQ ID NO: 217877 - RNA, 22 nt, Human
gcagcaggaauaggauaagcaa

SEQ ID NO: 217878 - RNA, 22 nt, Human
ugcagaagaccuuccagggcug

SEQ ID NO: 217879 - RNA, 22 nt, Human
aggucugaguagagaaaaggca

SEQ ID NO: 217880 - RNA, 22 nt, Human
aaacugcaaugacagguaggag

SEQ ID NO: 217881 - RNA, 21 nt, Human
uacaagaccggauucgggccc

SEQ ID NO: 217882 - RNA, 22 nt, Human
aaagcaucagaucugacacuuc

SEQ ID NO: 217883 - RNA, 22 nt, Human
gcuggcaggauaacuucuaagc

SEQ ID NO: 217884 - RNA, 22 nt, Human
cagcagaaacccagcaaagcca

SEQ ID NO: 217885 - RNA, 22 nt, Human
ggccugagucccaccuggcugu

SEQ ID NO: 217886 - RNA, 22 nt, Human
ccagaagugucuaucaagaugu

SEQ ID NO: 217887 - RNA, 22 nt, Human
ucuccugucuucucagcacccc

SEQ ID NO: 217888 - RNA, 19 nt, Human
acugggcuuguccucgugg

SEQ ID NO: 217889 - RNA, 22 nt, Human
agaggaguuugcuggugugugc

SEQ ID NO: 217890 - RNA, 20 nt, Human
ucagaacaguagaggagcua

SEQ ID NO: 217891 - RNA, 22 nt, Human
uuucagaaagcaucaucaaagu

SEQ ID NO: 217892 - RNA, 22 nt, Human
uguuuuaagggucaacugucac

SEQ ID NO: 217893 - RNA, 22 nt, Human
ggcucugcugguaagaugccuc

SEQ ID NO: 217894 - RNA, 22 nt, Human
agcagggcagugaucagaaagg

SEQ ID NO: 217895 - RNA, 22 nt, Human
uuucacacuagucagaauacca

SEQ ID NO: 217896 - RNA, 22 nt, Human
agaccaagaaaggaugaggauc

SEQ ID NO: 217897 - RNA, 22 nt, Human
agcaaacaguuucuggggaucu

SEQ ID NO: 217898 - RNA, 22 nt, Human
cagcuggcugcggugaggggac

SEQ ID NO: 217899 - RNA, 22 nt, Human
cucugugugguccucuguauug

SEQ ID NO: 217900 - RNA, 22 nt, Human
acuccagggcuccaccccagau

SEQ ID NO: 217901 - RNA, 20 nt, Human
ccagcuuucccugcagcauc

SEQ ID NO: 217902 - RNA, 22 nt, Human
caguacauuucauaugauucua

SEQ ID NO: 217903 - RNA, 22 nt, Human
ggccagagguguccucaguucu

SEQ ID NO: 217904 - RNA, 22 nt, Human
ucccacuggacgucugugcugg

SEQ ID NO: 217905 - RNA, 22 nt, Human
agaagcacaccugaccucuagc

SEQ ID NO: 217906 - RNA, 22 nt, Human
gccaucuggcauugcagcaccu

SEQ ID NO: 217907 - RNA, 22 nt, Human
cucugaggucuaggaccauggc

SEQ ID NO: 217908 - RNA, 22 nt, Human
gagaacuugaacuuuuccucug

SEQ ID NO: 217909 - RNA, 22 nt, Human
ugcugcaguucacccugccguc

SEQ ID NO: 217910 - RNA, 22 nt, Human
ucacaugucaaaaacuacauaa

SEQ ID NO: 217911 - RNA, 22 nt, Human
ugaggcucaagaaagauuuguu

SEQ ID NO: 217912 - RNA, 22 nt, Human
uccugggaugacuuuugaaaug

SEQ ID NO: 217913 - RNA, 22 nt, Human
ugcacaggccuugaagggagag

SEQ ID NO: 217914 - RNA, 22 nt, Human
uccagggagauacuggcugcca

SEQ ID NO: 217915 - RNA, 22 nt, Human
uuccagcaggcagacaggagau

SEQ ID NO: 217916 - RNA, 22 nt, Human
uccucaggaucuaggagugcuu

SEQ ID NO: 217917 - RNA, 22 nt, Human
gagcucagccugaggccuggcu

SEQ ID NO: 217918 - RNA, 22 nt, Human
guguauguucuacuuaauauua

SEQ ID NO: 217919 - RNA, 22 nt, Human
cuauuucauguuccuauggccg

SEQ ID NO: 217920 - RNA, 22 nt, Human
ggcugggaggccgugcugaccu

SEQ ID NO: 217921 - RNA, 22 nt, Human
ucuguggccuccuuccacuuac

SEQ ID NO: 217922 - RNA, 22 nt, Human
uuuaaucuauucccuaaacacc

SEQ ID NO: 217923 - RNA, 22 nt, Human
uuccuuuagugucauauacuuu

SEQ ID NO: 217924 - RNA, 19 nt, Human
aagagggaaagugcuaugc

SEQ ID NO: 217925 - RNA, 22 nt, Human
guaucacuuuugagagugagaa

SEQ ID NO: 217926 - RNA, 22 nt, Human
ucuccuggguaaaaggguugau

SEQ ID NO: 217927 - RNA, 22 nt, Human
acugcacuucacccugggugac

SEQ ID NO: 217928 - RNA, 22 nt, Human
caguuuugguccuuucuaggua

SEQ ID NO: 217929 - RNA, 22 nt, Human
cuucagcuuucagcuucccuga

SEQ ID NO: 217930 - RNA, 22 nt, Human
acaguguguucugggaccucca

SEQ ID NO: 217931 - RNA, 22 nt, Human
aggcuucugggauucccuuggu

SEQ ID NO: 217932 - RNA, 22 nt, Human
uucucuuugacauuauucaggu

SEQ ID NO: 217933 - RNA, 22 nt, Human
gcauggcugcucccuggcugca

SEQ ID NO: 217934 - RNA, 22 nt, Human
agcccagcaguaagauuagaga

SEQ ID NO: 217935 - RNA, 22 nt, Human
uucugggcuugaaaguuuaaua

SEQ ID NO: 217936 - RNA, 22 nt, Human
gaaauaauuuagaagguauucc

SEQ ID NO: 217937 - RNA, 22 nt, Human
uguuucauguggacauaguugu

SEQ ID NO: 217938 - RNA, 22 nt, Human
ccaccauucaaggucuucacag

SEQ ID NO: 217939 - RNA, 22 nt, Human
gcauccagagguagccacugug

SEQ ID NO: 217940 - RNA, 22 nt, Human
agggaccugcucacugccuggc

SEQ ID NO: 217941 - RNA, 22 nt, Human
aggaaaugcugaugcuccugga

SEQ ID NO: 217942 - RNA, 19 nt, Human
gggcaaagugaucguccug

SEQ ID NO: 217943 - RNA, 22 nt, Human
cagggcuggguuaaaagcaggg

SEQ ID NO: 217944 - RNA, 22 nt, Human
acaggcucucuauugagugcag

SEQ ID NO: 217945 - RNA, 22 nt, Human
cuccaggacucaggccccuggg

SEQ ID NO: 217946 - RNA, 22 nt, Human
augacucaaaauuauuguuuug

SEQ ID NO: 217947 - RNA, 22 nt, Human
ccagcacugcucucagacugag

SEQ ID NO: 217948 - RNA, 22 nt, Human
gucaccagcaccaaugccacau

SEQ ID NO: 217949 - RNA, 22 nt, Human
agaccuguuggguucauuggcu

SEQ ID NO: 217950 - RNA, 22 nt, Human
augugugguuuguaaaugauuu

SEQ ID NO: 217951 - RNA, 22 nt, Human
gcugaguugaaagcagaggaua

SEQ ID NO: 217952 - RNA, 22 nt, Human
gcagugucuuugaccuccaccc

SEQ ID NO: 217953 - RNA, 22 nt, Human
cagaugaaguaggugacgagca

SEQ ID NO: 217954 - RNA, 22 nt, Human
uggcccagcccugcucuagggc

SEQ ID NO: 217955 - RNA, 22 nt, Human
uuagaaucuaacauucuuaucu

SEQ ID NO: 217956 - RNA, 22 nt, Human
ucugcugcacaaauucaucucu

SEQ ID NO: 217957 - RNA, 22 nt, Human
gaggaggaaguucucuguaggc

SEQ ID NO: 217958 - RNA, 22 nt, Human
aagucagugaaaaggcaucauc

SEQ ID NO: 217959 - RNA, 22 nt, Human
uaaggcuaucugaguuuaugug

SEQ ID NO: 217960 - RNA, 22 nt, Human
gcccaggaucugcucagaucau

SEQ ID NO: 217961 - RNA, 22 nt, Human
gagcccuccauggagccaggca

SEQ ID NO: 217962 - RNA, 22 nt, Human
ugcaguggugguaaagaugcuc

SEQ ID NO: 217963 - RNA, 22 nt, Human
ggucuagaguggggccuggaaa

SEQ ID NO: 217964 - RNA, 22 nt, Human
ugcuggcauuucaggacucacc

SEQ ID NO: 217965 - RNA, 22 nt, Human
ggugggucuugcggggcagcuu

SEQ ID NO: 217966 - RNA, 22 nt, Human
aggcucagaggugagcaucugc

SEQ ID NO: 217967 - RNA, 22 nt, Human
aaaaaagauugaugguggaugc

SEQ ID NO: 217968 - RNA, 22 nt, Human
cagcugagaguagaaauggagg

SEQ ID NO: 217969 - RNA, 22 nt, Human
gagaggggcccaagccacauag

SEQ ID NO: 217970 - RNA, 22 nt, Human
uggcugcagaucaagggcaggc

SEQ ID NO: 217971 - RNA, 21 nt, Human
ugcagcagauuugggggaaga

SEQ ID NO: 217972 - RNA, 19 nt, Human
agacuuuuguaaguugaga

SEQ ID NO: 217973 - RNA, 22 nt, Human
aacaugaugacauuguaagcuu

SEQ ID NO: 217974 - RNA, 22 nt, Human
accaucugaguagagagaagua

SEQ ID NO: 217975 - RNA, 22 nt, Human
agucaguuguggagauuuaacu

SEQ ID NO: 217976 - RNA, 22 nt, Human
cagaaaauagaguuucucugag

SEQ ID NO: 217977 - RNA, 23 nt, Human
gccucagagaaacagcugcacac

SEQ ID NO: 217978 - RNA, 22 nt, Human
cugcagggagcagauggcgugu

SEQ ID NO: 217979 - RNA, 20 nt, Human
gucugcaguaagagggaaua

SEQ ID NO: 217980 - RNA, 22 nt, Human
aguuggugggugugagcuggac

SEQ ID NO: 217981 - RNA, 22 nt, Human
gcacaguguaccacagucccua

SEQ ID NO: 217982 - RNA, 22 nt, Human
uagaaucugaauauucuuauuu

SEQ ID NO: 217983 - RNA, 22 nt, Human
acagcuggaggggcugcagagg

SEQ ID NO: 217984 - RNA, 22 nt, Human
aaaguagcuuaguugauauuuc

SEQ ID NO: 217985 - RNA, 22 nt, Human
cuucagaaccagccagaagagg

SEQ ID NO: 217986 - RNA, 22 nt, Human
uagcaggcauggagaugacugu

SEQ ID NO: 217987 - RNA, 22 nt, Human
aaggucuggaugaugggugugc

SEQ ID NO: 217988 - RNA, 22 nt, Human
acuauaaaaggauaaaccagaa

SEQ ID NO: 217989 - RNA, 22 nt, Human
ccucaggcuuaacuugucuuga

SEQ ID NO: 217990 - RNA, 22 nt, Human
aagugcugggauuacaagcgug

SEQ ID NO: 217991 - RNA, 22 nt, Human
aguuuccaaauauuguuuuagc

SEQ ID NO: 217992 - RNA, 22 nt, Human
gaucauuuugaugcccuuuuag

SEQ ID NO: 217993 - RNA, 22 nt, Human
cauguacauucuguagauggag

SEQ ID NO: 217994 - RNA, 22 nt, Human
cacacaugacccacuuuuaccg

SEQ ID NO: 217995 - RNA, 22 nt, Human
cagugucaccaggcgagucucc

SEQ ID NO: 217996 - RNA, 22 nt, Human
ucagaacagcaggguguggcug

SEQ ID NO: 217997 - RNA, 22 nt, Human
gucccuggagcugagcagugcu

SEQ ID NO: 217998 - RNA, 22 nt, Human
gcuguggccaacaaaccacuuu

SEQ ID NO: 217999 - RNA, 20 nt, Human
aggcugggguguuuugccca

SEQ ID NO: 218000 - RNA, 22 nt, Human
aucuuuagauuagaaacucuaa

SEQ ID NO: 218001 - RNA, 22 nt, Human
auuugcauaucugauagacuaa

SEQ ID NO: 218002 - RNA, 19 nt, Human
agcauuuggaauucuacac

SEQ ID NO: 218003 - RNA, 22 nt, Human
cagcccugcagccauggccugu

SEQ ID NO: 218004 - RNA, 22 nt, Human
ucucugugugugugacagcauu

SEQ ID NO: 218005 - RNA, 22 nt, Human
guaaacaggaauguggucaugg

SEQ ID NO: 218006 - RNA, 22 nt, Human
cugcaggacgaccgccucaucu

SEQ ID NO: 218007 - RNA, 23 nt, Human
ugugggcgcauuguaaggguagc

SEQ ID NO: 218008 - RNA, 22 nt, Human
cuuccagaggaacucugcagug

SEQ ID NO: 218009 - RNA, 22 nt, Human
gagcuuggaagcagauccucac

SEQ ID NO: 218010 - RNA, 22 nt, Human
cuggcuccaccccaggaggaug

SEQ ID NO: 218011 - RNA, 22 nt, Human
uggcuccugcagaccaucugga

SEQ ID NO: 218012 - RNA, 22 nt, Human
ucuguggcccaagugauggcug

SEQ ID NO: 218013 - RNA, 22 nt, Human
uuccaugacaccgagggaaguc

SEQ ID NO: 218014 - RNA, 22 nt, Human
cauccagggcagccauggccug

SEQ ID NO: 218015 - RNA, 22 nt, Human
cacagcugcccccucucuaacu

SEQ ID NO: 218016 - RNA, 22 nt, Human
uuucuacaguacugauuucaua

SEQ ID NO: 218017 - RNA, 22 nt, Human
acuuuguuuggcuauuagaguc

SEQ ID NO: 218018 - RNA, 22 nt, Human
uccugggacaagccguggaagu

SEQ ID NO: 218019 - RNA, 20 nt, Human
aaaugcuguaauguuuggga

SEQ ID NO: 218020 - RNA, 22 nt, Human
uguauaugugauguacauguac

SEQ ID NO: 218021 - RNA, 22 nt, Human
ucaaaggcauugccaauaagua

SEQ ID NO: 218022 - RNA, 22 nt, Human
gaauuaguguugaaaucagggc

SEQ ID NO: 218023 - RNA, 22 nt, Human
uuacauguuuaugugguacaug

SEQ ID NO: 218024 - RNA, 22 nt, Human
aggggagaggugagcaacuucu

SEQ ID NO: 218025 - RNA, 22 nt, Human
ugucagcagaaguggugcacuc

SEQ ID NO: 218026 - RNA, 22 nt, Human
uuggccaacauggugaaacccc

SEQ ID NO: 218027 - RNA, 22 nt, Human
gaggccagccccucuugaaggc

SEQ ID NO: 218028 - RNA, 23 nt, Human
uagugucaagagggaguguaauu

SEQ ID NO: 218029 - RNA, 22 nt, Human
aagcagcuggaagaguaagaug

SEQ ID NO: 218030 - RNA, 22 nt, Human
aaauuauaggugccaccuugga

SEQ ID NO: 218031 - RNA, 22 nt, Human
cuuuuacauuuguugaagagua

SEQ ID NO: 218032 - RNA, 22 nt, Human
ggagcacuauaauagagauuuu

SEQ ID NO: 218033 - RNA, 22 nt, Human
uuggaaaguuuuuacugaagac

SEQ ID NO: 218034 - RNA, 22 nt, Human
aagaggagggcagauucaaggc

SEQ ID NO: 218035 - RNA, 20 nt, Human
aaugucuugagacauuucag

SEQ ID NO: 218036 - RNA, 22 nt, Human
uccugccuugccugggacauca

SEQ ID NO: 218037 - RNA, 22 nt, Human
aggcacaguuucauccccgggc

SEQ ID NO: 218038 - RNA, 22 nt, Human
auccccagacuuuagauuucuc

SEQ ID NO: 218039 - RNA, 22 nt, Human
uuuacaggguucaagaaugaaa

SEQ ID NO: 218040 - RNA, 22 nt, Human
ucccaguggcuucauaaggcag

SEQ ID NO: 218041 - RNA, 20 nt, Human
ucagugucaguagccacuac

SEQ ID NO: 218042 - RNA, 22 nt, Human
auaaaacuuauuagaauugugu

SEQ ID NO: 218043 - RNA, 22 nt, Human
agcugagcugcagaugacugua

SEQ ID NO: 218044 - RNA, 22 nt, Human
ccugaaauuugaagaccugaau

SEQ ID NO: 218045 - RNA, 22 nt, Human
ucagggcugcagaagaggcagg

SEQ ID NO: 218046 - RNA, 22 nt, Human
gcugucugcugugcacugagca

SEQ ID NO: 218047 - RNA, 22 nt, Human
acauuucucccugcaugccugc

SEQ ID NO: 218048 - RNA, 22 nt, Human
gaccugggguaagcuuggcaac

SEQ ID NO: 218049 - RNA, 22 nt, Human
ccccugaagacaauggagaggu

SEQ ID NO: 218050 - RNA, 22 nt, Human
ggagcccuuggcaccuaguagg

SEQ ID NO: 218051 - RNA, 22 nt, Human
uccugggaagcgccggccugcg

SEQ ID NO: 218052 - RNA, 22 nt, Human
ucuccagucccuucucuguuag

SEQ ID NO: 218053 - RNA, 22 nt, Human
agcuccuugaauuaaugcugcu

SEQ ID NO: 218054 - RNA, 22 nt, Human
caugauguuaucuaaaucuggu

SEQ ID NO: 218055 - RNA, 22 nt, Human
cugguaaaugaugagaagcacc

SEQ ID NO: 218056 - RNA, 20 nt, Human
aucagcaacugccacucagu

SEQ ID NO: 218057 - RNA, 22 nt, Human
augcaaaucuuaaguaugugug

SEQ ID NO: 218058 - RNA, 22 nt, Human
uuucaaagaccauuaacuauca

SEQ ID NO: 218059 - RNA, 19 nt, Human
ucuugcagccccagcaggc

SEQ ID NO: 218060 - RNA, 22 nt, Human
aauaagaucuuaaagguuauau

SEQ ID NO: 218061 - RNA, 22 nt, Human
uccagggacagcgcuggagcua

SEQ ID NO: 218062 - RNA, 22 nt, Human
uaagccacuagucuguuaugaa

SEQ ID NO: 218063 - RNA, 22 nt, Human
caauuagacauuuauuggccag

SEQ ID NO: 218064 - RNA, 22 nt, Human
cgcaacagcguggcgcccagcu

SEQ ID NO: 218065 - RNA, 22 nt, Human
agcugagagccccugcccugug

SEQ ID NO: 218066 - RNA, 22 nt, Human
gccagagagagucccugggccu

SEQ ID NO: 218067 - RNA, 22 nt, Human
agcuagaauguuccuuuucauu

SEQ ID NO: 218068 - RNA, 22 nt, Human
uucuuagagaugguuaaaaaua

SEQ ID NO: 218069 - RNA, 22 nt, Human
acagcauucaauaaauaauaac

SEQ ID NO: 218070 - RNA, 22 nt, Human
cagaccagcucuaugaacccaa

SEQ ID NO: 218071 - RNA, 22 nt, Human
aaaauguaaagcuugaguguag

SEQ ID NO: 218072 - RNA, 22 nt, Human
ggccuuagcggucauagcaaag

SEQ ID NO: 218073 - RNA, 22 nt, Human
uuccuggcacccuuguuagccu

SEQ ID NO: 218074 - RNA, 22 nt, Human
caugcugugugguuagaacugu

SEQ ID NO: 218075 - RNA, 22 nt, Human
ucuucucuacaccagcagcccc

SEQ ID NO: 218076 - RNA, 19 nt, Human
ggaugagggucaggcauag

SEQ ID NO: 218077 - RNA, 22 nt, Human
agggccagaggcaccuugcagc

SEQ ID NO: 218078 - RNA, 22 nt, Human
ugggaccugcccuggccccauc

SEQ ID NO: 218079 - RNA, 22 nt, Human
aagucuuucauaagucucuuau

SEQ ID NO: 218080 - RNA, 18 nt, Human
aggagccuuugcacugga

SEQ ID NO: 218081 - RNA, 22 nt, Human
agcucaggccggagcuacaggc

SEQ ID NO: 218082 - RNA, 22 nt, Human
aagggcaggagaagacggauau

SEQ ID NO: 218083 - RNA, 22 nt, Human
gaauuugggguguguuauuuca

SEQ ID NO: 218084 - RNA, 22 nt, Human
ucccagaggcuccagucucuau

SEQ ID NO: 218085 - RNA, 20 nt, Human
ccugggcucaaagcauccuc

SEQ ID NO: 218086 - RNA, 22 nt, Human
ugggcacagaauagauggccca

SEQ ID NO: 218087 - RNA, 22 nt, Human
aaauacuguuuuauuccaugau

SEQ ID NO: 218088 - RNA, 22 nt, Human
aagguauuggucuggucuuccu

SEQ ID NO: 218089 - RNA, 22 nt, Human
gagaggcauggaacagauucuu

SEQ ID NO: 218090 - RNA, 22 nt, Human
ggacacaaaagugaauaaaaua

SEQ ID NO: 218091 - RNA, 21 nt, Human
cacuccacuuagaacaggguu

SEQ ID NO: 218092 - RNA, 21 nt, Human
ucaggaggcucagacuccugc

SEQ ID NO: 218093 - RNA, 22 nt, Human
gcugucugucuucacaucucgc

SEQ ID NO: 218094 - RNA, 22 nt, Human
gaauuacauuguuagccuuccu

SEQ ID NO: 218095 - RNA, 22 nt, Human
ucuucagaggagcugaauauau

SEQ ID NO: 218096 - RNA, 22 nt, Human
uuuucaguuccaucucugcucu

SEQ ID NO: 218097 - RNA, 22 nt, Human
cugcagagaguaacugaaauau

SEQ ID NO: 218098 - RNA, 22 nt, Human
uucacacuuguuaggauggcuu

SEQ ID NO: 218099 - RNA, 22 nt, Human
cggacccacucggaucccagcc

SEQ ID NO: 218100 - RNA, 22 nt, Human
ugagaacauugggaaagcuaug

SEQ ID NO: 218101 - RNA, 22 nt, Human
aaagugguuuaugauauuccaa

SEQ ID NO: 218102 - RNA, 22 nt, Human
uucugucaugcucauguaauug

SEQ ID NO: 218103 - RNA, 22 nt, Human
cuauguuuaucuguauuucugu

SEQ ID NO: 218104 - RNA, 22 nt, Human
gacuggaaagccuguccucaga

SEQ ID NO: 218105 - RNA, 20 nt, Human
gaggaaaagcugccaggccu

SEQ ID NO: 218106 - RNA, 22 nt, Human
acacugagauuuuccugacacc

SEQ ID NO: 218107 - RNA, 22 nt, Human
ucagggcaggcgagcagcugcu

SEQ ID NO: 218108 - RNA, 22 nt, Human
ugcagccccccagauggccgua

SEQ ID NO: 218109 - RNA, 20 nt, Human
aggaagccaaaggcugucuu

SEQ ID NO: 218110 - RNA, 22 nt, Human
cagcucuuggagccuccaguaa

SEQ ID NO: 218111 - RNA, 22 nt, Human
ugaaagguuaaaaguaguauug

SEQ ID NO: 218112 - RNA, 22 nt, Human
cugggcaggagaggugguugga

SEQ ID NO: 218113 - RNA, 22 nt, Human
cacagugcucaaacacaagugc

SEQ ID NO: 218114 - RNA, 22 nt, Human
uuaaacugcagacucaguguuc

SEQ ID NO: 218115 - RNA, 22 nt, Human
guagcugauauuagcaaugagu

SEQ ID NO: 218116 - RNA, 22 nt, Human
uccuuaaaggacuagaagucaa

SEQ ID NO: 218117 - RNA, 22 nt, Human
acaguggcucaugccugucauc

SEQ ID NO: 218118 - RNA, 22 nt, Human
uuacaggguugcagcauugacg

SEQ ID NO: 218119 - RNA, 22 nt, Human
augcugaagagagaacuacuca

SEQ ID NO: 218120 - RNA, 22 nt, Human
ggcaggcacaguaauacauguu

SEQ ID NO: 218121 - RNA, 22 nt, Human
uauuuagaacagacaauagaaa

SEQ ID NO: 218122 - RNA, 22 nt, Human
agguggggcccaccaauuugca

SEQ ID NO: 218123 - RNA, 22 nt, Human
aaucucagagauaucugugucc

SEQ ID NO: 218124 - RNA, 22 nt, Human
ccagacugagggucccugagcu

SEQ ID NO: 218125 - RNA, 22 nt, Human
uggcacucacucucagagucug

SEQ ID NO: 218126 - RNA, 22 nt, Human
gggaggcauguguuauccacuu

SEQ ID NO: 218127 - RNA, 22 nt, Human
cagcugaaagaaggaaguguca

SEQ ID NO: 218128 - RNA, 22 nt, Human
ucugggucuaugaucucacuuc

SEQ ID NO: 218129 - RNA, 22 nt, Human
gccaugaguaaacuggaaagcc

SEQ ID NO: 218130 - RNA, 22 nt, Human
uucuagaaauccguaagugaau

SEQ ID NO: 218131 - RNA, 22 nt, Human
aaacccagagacuagaaagacc

SEQ ID NO: 218132 - RNA, 22 nt, Human
aaugcacagcuaaagugguucc

SEQ ID NO: 218133 - RNA, 22 nt, Human
agaaugcuccagagcugaaaga

SEQ ID NO: 218134 - RNA, 22 nt, Human
cuuuggcagccucugcuauuga

SEQ ID NO: 218135 - RNA, 22 nt, Human
gaggcugcuuuccuccuauccu

SEQ ID NO: 218136 - RNA, 19 nt, Human
augcaaauagauuuggaau

SEQ ID NO: 218137 - RNA, 22 nt, Human
aguccaggcggguauagaggcu

SEQ ID NO: 218138 - RNA, 22 nt, Human
cugagggagagaauggggcaaa

SEQ ID NO: 218139 - RNA, 22 nt, Human
aaaaguuaacuguguucaugca

SEQ ID NO: 218140 - RNA, 22 nt, Human
aaaugaguuuccucaauguccu

SEQ ID NO: 218141 - RNA, 22 nt, Human
uauuugaugguucuaaaacagc

SEQ ID NO: 218142 - RNA, 22 nt, Human
gcuuggcuguguucaagggcgg

SEQ ID NO: 218143 - RNA, 22 nt, Human
cuaucuuucgauucuagcuuaa

SEQ ID NO: 218144 - RNA, 22 nt, Human
ugcagggccgcuggaggucaug

SEQ ID NO: 218145 - RNA, 22 nt, Human
ccuguauuugcaacuuuucuua

SEQ ID NO: 218146 - RNA, 22 nt, Human
acacauaucuaagauagaugac

SEQ ID NO: 218147 - RNA, 22 nt, Human
ggcuccuguggcaagacagcuu

SEQ ID NO: 218148 - RNA, 22 nt, Human
ggucuuguuuauauaagguggu

SEQ ID NO: 218149 - RNA, 22 nt, Human
accugaggcuguuagucuaggu

SEQ ID NO: 218150 - RNA, 22 nt, Human
cagucuccgccagcuccucaca

SEQ ID NO: 218151 - RNA, 22 nt, Human
cucugcaggcacccaggguggg

SEQ ID NO: 218152 - RNA, 22 nt, Human
ucugccaggccacacagggcac

SEQ ID NO: 218153 - RNA, 22 nt, Human
caugccaguuuugagaugcacc

SEQ ID NO: 218154 - RNA, 22 nt, Human
ugaguccugcucugggcagggu

SEQ ID NO: 218155 - RNA, 22 nt, Human
uaguuaaagcccuaaauugaua

SEQ ID NO: 218156 - RNA, 22 nt, Human
cuacaguagagguugucaggga

SEQ ID NO: 218157 - RNA, 22 nt, Human
cacagagaacugugggagugug

SEQ ID NO: 218158 - RNA, 22 nt, Human
caggagacucagcauccaggau

SEQ ID NO: 218159 - RNA, 22 nt, Human
cuguggcucuccaauggaggga

SEQ ID NO: 218160 - RNA, 22 nt, Human
ugccucuggccuuuggugccca

SEQ ID NO: 218161 - RNA, 19 nt, Human
agccaguccaaguucuguc

SEQ ID NO: 218162 - RNA, 22 nt, Human
cagcugagaccagaaugcaggu

SEQ ID NO: 218163 - RNA, 22 nt, Human
uuuacucuugcuacacaacugu

SEQ ID NO: 218164 - RNA, 22 nt, Human
acagugucugacacguaggaag

SEQ ID NO: 218165 - RNA, 21 nt, Human
aggcauuauaaauuucaccug

SEQ ID NO: 218166 - RNA, 22 nt, Human
cuguccugggggugguccuugc

SEQ ID NO: 218167 - RNA, 22 nt, Human
gggcccuggcuuuccuguucuu

SEQ ID NO: 218168 - RNA, 20 nt, Human
uagauccuggggauuuauug

SEQ ID NO: 218169 - RNA, 22 nt, Human
agcucagggccaucggcccuuu

SEQ ID NO: 218170 - RNA, 22 nt, Human
uuauucacucugaagccauccu

SEQ ID NO: 218171 - RNA, 21 nt, Human
uuagaacaauauuugguauag

SEQ ID NO: 218172 - RNA, 16 nt, Human
uaggaaacugcaugug

SEQ ID NO: 218173 - RNA, 22 nt, Human
cagcagcugauggggaagugau

SEQ ID NO: 218174 - RNA, 22 nt, Human
uuugaugaguuuaauaacagcc

SEQ ID NO: 218175 - RNA, 22 nt, Human
aggucauuaaaguuaaaugagg

SEQ ID NO: 218176 - RNA, 22 nt, Human
aaaguuacuaucacaaugaaau

SEQ ID NO: 218177 - RNA, 22 nt, Human
gccagcagcugugggguggcca

SEQ ID NO: 218178 - RNA, 22 nt, Human
gcagugggagcuuaggcagugc

SEQ ID NO: 218179 - RNA, 20 nt, Human
uguccccuagaucccagcuc

SEQ ID NO: 218180 - RNA, 22 nt, Human
auuagcuuaucacacaagcugc

SEQ ID NO: 218181 - RNA, 22 nt, Human
uguggcugaucaaagcgcucag

SEQ ID NO: 218182 - RNA, 19 nt, Human
ugucugcugaugacucuau

SEQ ID NO: 218183 - RNA, 22 nt, Human
agugagggacuagugcugggga

SEQ ID NO: 218184 - RNA, 22 nt, Human
uguuuauugagugccuacuaua

SEQ ID NO: 218185 - RNA, 19 nt, Human
gcuggcagaauuuugaacc

SEQ ID NO: 218186 - RNA, 22 nt, Human
ccugccuuucucaguaaucuuu

SEQ ID NO: 218187 - RNA, 22 nt, Human
aaagaucaauagauaaagcuac

SEQ ID NO: 218188 - RNA, 22 nt, Human
uuguguacuacaguaugccaca

SEQ ID NO: 218189 - RNA, 22 nt, Human
gcccaggauggcuggaggugcu

SEQ ID NO: 218190 - RNA, 22 nt, Human
agagucugaaugcucagaguug

SEQ ID NO: 218191 - RNA, 22 nt, Human
uguagaggaggaaacugaggcu

SEQ ID NO: 218192 - RNA, 22 nt, Human
ugguaaaaaccgcaauuacauu

SEQ ID NO: 218193 - RNA, 21 nt, Human
aacauuaguaauuugacuuuu

SEQ ID NO: 218194 - RNA, 22 nt, Human
acucaaauagcaacggugagaa

SEQ ID NO: 218195 - RNA, 22 nt, Human
uugguacaaaaccaugaaagaa

SEQ ID NO: 218196 - RNA, 22 nt, Human
ggcacagcaccuuuucacauug

SEQ ID NO: 218197 - RNA, 22 nt, Human
agagcaauuagcuuagguaaaa

SEQ ID NO: 218198 - RNA, 22 nt, Human
auaaacugugcuggaugaugag

SEQ ID NO: 218199 - RNA, 19 nt, Human
caggcccuggacccaucug

SEQ ID NO: 218200 - RNA, 22 nt, Human
auguuuccauuuucuuguauca

SEQ ID NO: 218201 - RNA, 22 nt, Human
gcugcccuaauaucacauguua

SEQ ID NO: 218202 - RNA, 22 nt, Human
gccuggcugcuagccagaggca

SEQ ID NO: 218203 - RNA, 22 nt, Human
ccuguggcuggucaggccagca

SEQ ID NO: 218204 - RNA, 22 nt, Human
guugaaagcuuuucauuuaguu

SEQ ID NO: 218205 - RNA, 20 nt, Human
aguggccacugcagagaugc

SEQ ID NO: 218206 - RNA, 22 nt, Human
auuaagugugacaugcugcucu

SEQ ID NO: 218207 - RNA, 20 nt, Human
aggagaccaagccaagugga

SEQ ID NO: 218208 - RNA, 22 nt, Human
aaaaguuagcuauuaguaggug

SEQ ID NO: 218209 - RNA, 22 nt, Human
guaacucuggguagaacucaug

SEQ ID NO: 218210 - RNA, 22 nt, Human
aggacuggcagugugagggguc

SEQ ID NO: 218211 - RNA, 22 nt, Human
uugcugagcuuuggcaaggaag

SEQ ID NO: 218212 - RNA, 22 nt, Human
aauucuucaagugcuuuggaga

SEQ ID NO: 218213 - RNA, 22 nt, Human
aagcccagaugagaucccugga

SEQ ID NO: 218214 - RNA, 21 nt, Human
cauuaaguaccagggcacugu

SEQ ID NO: 218215 - RNA, 22 nt, Human
gcaugagggggguuaggaaguu

SEQ ID NO: 218216 - RNA, 18 nt, Human
agugcaugcuaggggaag

SEQ ID NO: 218217 - RNA, 22 nt, Human
uucuagaauguuuugaaaggga

SEQ ID NO: 218218 - RNA, 20 nt, Human
aggcugucauuucuggcagg

SEQ ID NO: 218219 - RNA, 22 nt, Human
auugagcuguuuuguaggauaa

SEQ ID NO: 218220 - RNA, 22 nt, Human
uuccuucuuccaaacccaucau

SEQ ID NO: 218221 - RNA, 23 nt, Human
ucuuugguaaauaaaguggggau

SEQ ID NO: 218222 - RNA, 22 nt, Human
aggaaacaugaaucugccuuga

SEQ ID NO: 218223 - RNA, 22 nt, Human
cugcuuuaucugagacaaguca

SEQ ID NO: 218224 - RNA, 20 nt, Human
gcaaaauaggcucuguuggu

SEQ ID NO: 218225 - RNA, 22 nt, Human
ccagcccuccuccaucagagga

SEQ ID NO: 218226 - RNA, 22 nt, Human
cugaggagcaaccccgugcccu

SEQ ID NO: 218227 - RNA, 22 nt, Human
ugggguggauagaaagugaugu

SEQ ID NO: 218228 - RNA, 22 nt, Human
ugcccaggauugugaggucagg

SEQ ID NO: 218229 - RNA, 22 nt, Human
ggcuuuagggcaggcaguguua

SEQ ID NO: 218230 - RNA, 22 nt, Human
ggcccagaagccagaagccucc

SEQ ID NO: 218231 - RNA, 20 nt, Human
ugcagcacgggcccuuucca

SEQ ID NO: 218232 - RNA, 21 nt, Human
acagagaaagagcagccuccu

SEQ ID NO: 218233 - RNA, 22 nt, Human
cagcuccucuggccagcccugc

SEQ ID NO: 218234 - RNA, 22 nt, Human
caguuuaaccuauccauuaugu

SEQ ID NO: 218235 - RNA, 22 nt, Human
agccaggccuuagggagaggca

SEQ ID NO: 218236 - RNA, 22 nt, Human
ccagucccagcucugccaugcu

SEQ ID NO: 218237 - RNA, 22 nt, Human
uugagucucugccaaaacacaa

SEQ ID NO: 218238 - RNA, 22 nt, Human
uauuccuauggccacugcuacu

SEQ ID NO: 218239 - RNA, 22 nt, Human
agcccuggaagccacaguccua

SEQ ID NO: 218240 - RNA, 22 nt, Human
ccugaggucagccauucuugcc

SEQ ID NO: 218241 - RNA, 21 nt, Human
aaaaggaaggucuguuugggg

SEQ ID NO: 218242 - RNA, 23 nt, Human
cuccuggaggguccggcccugcc

SEQ ID NO: 218243 - RNA, 23 nt, Human
agacagaggcugaggcuggccgc

SEQ ID NO: 218244 - RNA, 22 nt, Human
cuuuccucuggcacugucuggu

SEQ ID NO: 218245 - RNA, 22 nt, Human
uucuuuggggaauauucugguu

SEQ ID NO: 218246 - RNA, 22 nt, Human
uggagaguggauaugggagcaa

SEQ ID NO: 218247 - RNA, 22 nt, Human
cagagccagcuguccuuggcau

SEQ ID NO: 218248 - RNA, 22 nt, Human
ucugaggaucugaagggaacag

SEQ ID NO: 218249 - RNA, 22 nt, Human
ccugguggccuucagcccacaa

SEQ ID NO: 218250 - RNA, 21 nt, Human
cacaggcuucuauacacaaug

SEQ ID NO: 218251 - RNA, 22 nt, Human
gcagcaggcuuuucauaccuug

SEQ ID NO: 218252 - RNA, 22 nt, Human
aucucccagccacagcauucuu

SEQ ID NO: 218253 - RNA, 22 nt, Human
ggaagagaaaugagucaagacu

SEQ ID NO: 218254 - RNA, 22 nt, Human
guccuuaguuacuuuucauguc

SEQ ID NO: 218255 - RNA, 22 nt, Human
ugucaauaguuuugaguucucu

SEQ ID NO: 218256 - RNA, 22 nt, Human
ccaggguuuaaauucugacuau

SEQ ID NO: 218257 - RNA, 22 nt, Human
uuuggaauagcauagaagcuca

SEQ ID NO: 218258 - RNA, 22 nt, Human
cuggagggcugcagcgaggcug

SEQ ID NO: 218259 - RNA, 22 nt, Human
gacaggcuuccuaagugccaga

SEQ ID NO: 218260 - RNA, 22 nt, Human
gugcaggagcaggagccauguc

SEQ ID NO: 218261 - RNA, 22 nt, Human
agcuucucuggucuucugccaa

SEQ ID NO: 218262 - RNA, 20 nt, Human
ggcuuccccgccaucuuccg

SEQ ID NO: 218263 - RNA, 22 nt, Human
uaaggccaccguuauagaacca

SEQ ID NO: 218264 - RNA, 22 nt, Human
gaaggagggugcggaucugagc

SEQ ID NO: 218265 - RNA, 22 nt, Human
cacuuuauaugcauuaccucau

SEQ ID NO: 218266 - RNA, 16 nt, Human
agcccugccguguacu

SEQ ID NO: 218267 - RNA, 22 nt, Human
aagaguuuccaugcucugugcu

SEQ ID NO: 218268 - RNA, 22 nt, Human
aucuggcucgcuaggcucuggg

SEQ ID NO: 218269 - RNA, 22 nt, Human
ccacccagaccagggaucuggg

SEQ ID NO: 218270 - RNA, 22 nt, Human
uaugagcaagaguuugugaagg

SEQ ID NO: 218271 - RNA, 22 nt, Human
agguauuaugcugcugaaugcu

SEQ ID NO: 218272 - RNA, 22 nt, Human
cuggcuccauuacucagcaucu

SEQ ID NO: 218273 - RNA, 22 nt, Human
gccaggcacugcucuaagcccu

SEQ ID NO: 218274 - RNA, 22 nt, Human
uuauugaguaucugcuuggugu

SEQ ID NO: 218275 - RNA, 22 nt, Human
uggcuucucagaauacucugga

SEQ ID NO: 218276 - RNA, 22 nt, Human
acugcccuggagacagcagagu

SEQ ID NO: 218277 - RNA, 22 nt, Human
guauauaucggcacuauuuuaa

SEQ ID NO: 218278 - RNA, 22 nt, Human
aagcugugaaauagauuacaca

SEQ ID NO: 218279 - RNA, 22 nt, Human
uugugcagaguugccuuuauuu

SEQ ID NO: 218280 - RNA, 22 nt, Human
caggcccuccugugaucugccu

SEQ ID NO: 218281 - RNA, 22 nt, Human
gggagcugagggaccucugugg

SEQ ID NO: 218282 - RNA, 22 nt, Human
ucagaaucugaaaagcgcuugg

SEQ ID NO: 218283 - RNA, 22 nt, Human
uggcucugagacacaggcucuc

SEQ ID NO: 218284 - RNA, 22 nt, Human
aaggaacugaugcucaaagaau

SEQ ID NO: 218285 - RNA, 22 nt, Human
ugcccuggaggggcuuacaguc

SEQ ID NO: 218286 - RNA, 22 nt, Human
auaaaauuugcuacuguuaaau

SEQ ID NO: 218287 - RNA, 22 nt, Human
ucuggggugcagccuggacaua

SEQ ID NO: 218288 - RNA, 22 nt, Human
caauacacuaaacuucucugaa

SEQ ID NO: 218289 - RNA, 18 nt, Human
acagugcugucacugcuu

SEQ ID NO: 218290 - RNA, 23 nt, Human
ugaaugauggugcuccucaucuu

SEQ ID NO: 218291 - RNA, 22 nt, Human
caggcugcagaggccuuucaug

SEQ ID NO: 218292 - RNA, 22 nt, Human
aaucugaauauuuauguguauu

SEQ ID NO: 218293 - RNA, 22 nt, Human
gaggcagcaggcugaggaggau

SEQ ID NO: 218294 - RNA, 22 nt, Human
ugccuuagagcacucaagagug

SEQ ID NO: 218295 - RNA, 22 nt, Human
aggcugcagaggugcugccaga

SEQ ID NO: 218296 - RNA, 22 nt, Human
gaugaggggucauuggcuggga

SEQ ID NO: 218297 - RNA, 22 nt, Human
gccuguuuuccugcugugguug

SEQ ID NO: 218298 - RNA, 22 nt, Human
ucugagaagcaccuucuggaca

SEQ ID NO: 218299 - RNA, 22 nt, Human
ugaggggagaagcagcagccug

SEQ ID NO: 218300 - RNA, 22 nt, Human
ggguguccugugccaagcuggg

SEQ ID NO: 218301 - RNA, 22 nt, Human
cuggcugccuggagugagggag

SEQ ID NO: 218302 - RNA, 22 nt, Human
accaggcagcugggggugaugu

SEQ ID NO: 218303 - RNA, 22 nt, Human
guacaggaccgcggcccccugg

SEQ ID NO: 218304 - RNA, 22 nt, Human
uaggccaguggcagguugugug

SEQ ID NO: 218305 - RNA, 22 nt, Human
agugaagguuuacagggccccu

SEQ ID NO: 218306 - RNA, 22 nt, Human
guccauaugucaggugugaauu

SEQ ID NO: 218307 - RNA, 22 nt, Human
cccacaggugugagcuugcugg

SEQ ID NO: 218308 - RNA, 22 nt, Human
ggaauguuuuucauugcucucu

SEQ ID NO: 218309 - RNA, 22 nt, Human
aaggugguuguaggcuggucug

SEQ ID NO: 218310 - RNA, 22 nt, Human
gaacuauaugucuuaaagcuuu

SEQ ID NO: 218311 - RNA, 22 nt, Human
ccugggcuugguuguugagaac

SEQ ID NO: 218312 - RNA, 22 nt, Human
ugugcagggaagggcaugcuau

SEQ ID NO: 218313 - RNA, 22 nt, Human
gugagucuuaagcaccaccuuu

SEQ ID NO: 218314 - RNA, 21 nt, Human
gcagaauagucucugucuuca

SEQ ID NO: 218315 - RNA, 22 nt, Human
uccuguguuacugccuggagcg

SEQ ID NO: 218316 - RNA, 22 nt, Human
ugcauaaaauaugagaaaugua

SEQ ID NO: 218317 - RNA, 22 nt, Human
aaauuuuagaccaggcaaaacu

SEQ ID NO: 218318 - RNA, 22 nt, Human
gcacaggaugauggguugaggg

SEQ ID NO: 218319 - RNA, 17 nt, Human
acaugggcugagacucc

SEQ ID NO: 218320 - RNA, 22 nt, Human
cagucuggaggucagcuggcuu

SEQ ID NO: 218321 - RNA, 23 nt, Human
uuuggacuugugacucuucuccu

SEQ ID NO: 218322 - RNA, 22 nt, Human
ucuccacagucccaccucgcuu

SEQ ID NO: 218323 - RNA, 22 nt, Human
gcacugaaugcuuuuacuguaa

SEQ ID NO: 218324 - RNA, 22 nt, Human
uuggcuucucuuaacccuaaag

SEQ ID NO: 218325 - RNA, 22 nt, Human
gcccagagagaugcuguagacc

SEQ ID NO: 218326 - RNA, 22 nt, Human
agcagcagcucaguucucagcu

SEQ ID NO: 218327 - RNA, 22 nt, Human
cuuuaugaaccuguucagcuug

SEQ ID NO: 218328 - RNA, 22 nt, Human
ucccagucuguguccuuuacag

SEQ ID NO: 218329 - RNA, 21 nt, Human
gcaaauguucaggaaaaaaga

SEQ ID NO: 218330 - RNA, 22 nt, Human
auuucagacuguguuggaaaau

SEQ ID NO: 218331 - RNA, 22 nt, Human
auucucuggguuccaguaaaug

SEQ ID NO: 218332 - RNA, 18 nt, Human
caaagcaggugacagugu

SEQ ID NO: 218333 - RNA, 22 nt, Human
gugcucuguguauuaggauguc

SEQ ID NO: 218334 - RNA, 22 nt, Human
cccaggcuggagggcaguguca

SEQ ID NO: 218335 - RNA, 22 nt, Human
ugcccugcagugagugcgucug

SEQ ID NO: 218336 - RNA, 22 nt, Human
uaucuagauuucuuucucugug

SEQ ID NO: 218337 - RNA, 22 nt, Human
aagggggcgaagacgugauuga

SEQ ID NO: 218338 - RNA, 22 nt, Human
aggcagugcagaguccucuucu

SEQ ID NO: 218339 - RNA, 22 nt, Human
uaacugaacaucucaaaucaag

SEQ ID NO: 218340 - RNA, 22 nt, Human
cauuacaaacauguuaagauuu

SEQ ID NO: 218341 - RNA, 22 nt, Human
ucuuuaaucauaaccaagaugg

SEQ ID NO: 218342 - RNA, 22 nt, Human
gcaggugggggagaaguuguga

SEQ ID NO: 218343 - RNA, 22 nt, Human
cagcugagcugccagacuacug

SEQ ID NO: 218344 - RNA, 22 nt, Human
aucaguuuggugcuuucaguga

SEQ ID NO: 218345 - RNA, 22 nt, Human
uauuucagucacuucuucucug

SEQ ID NO: 218346 - RNA, 22 nt, Human
ccugggccugaaaacauuucuc

SEQ ID NO: 218347 - RNA, 22 nt, Human
gaaagcugugaaauagugcucu

SEQ ID NO: 218348 - RNA, 20 nt, Human
cacaggcuuacaguuuagau

SEQ ID NO: 218349 - RNA, 22 nt, Human
ccagggcucuaugaggguggag

SEQ ID NO: 218350 - RNA, 22 nt, Human
aggucugagcuccuuccucuga

SEQ ID NO: 218351 - RNA, 22 nt, Human
cuuugggauuucaugagagcua

SEQ ID NO: 218352 - RNA, 22 nt, Human
gcaggcuugagagaucagaugg

SEQ ID NO: 218353 - RNA, 22 nt, Human
ucuuuacuuguguauuguauau

SEQ ID NO: 218354 - RNA, 22 nt, Human
aucaggauccaccuugagccug

SEQ ID NO: 218355 - RNA, 22 nt, Human
ucccuggcugggggcugccuug

SEQ ID NO: 218356 - RNA, 22 nt, Human
caaauacugagcacgcaaucaa

SEQ ID NO: 218357 - RNA, 20 nt, Human
agagagaccuaggccuaguc

SEQ ID NO: 218358 - RNA, 22 nt, Human
agugugagugcucauguccauc

SEQ ID NO: 218359 - RNA, 22 nt, Human
ggcucuggcaaggggaggcuac

SEQ ID NO: 218360 - RNA, 22 nt, Human
uuucagaaacgauuaugaacac

SEQ ID NO: 218361 - RNA, 23 nt, Human
aggauguaggauguauggcagag

SEQ ID NO: 218362 - RNA, 22 nt, Human
caccuagggcaucccugcccca

SEQ ID NO: 218363 - RNA, 22 nt, Human
gacuguguccaugugcuggauu

SEQ ID NO: 218364 - RNA, 22 nt, Human
uuguuaaaauuggagccgagag

SEQ ID NO: 218365 - RNA, 22 nt, Human
ugaggcaguucuuacuuguauu

SEQ ID NO: 218366 - RNA, 22 nt, Human
aagcacaggggaaauaaguugu

SEQ ID NO: 218367 - RNA, 22 nt, Human
gcugggcugagcuagacuuggc

SEQ ID NO: 218368 - RNA, 22 nt, Human
ucugcagggcccuuggcuccug

SEQ ID NO: 218369 - RNA, 22 nt, Human
gaggccugguuuccagcauccu

SEQ ID NO: 218370 - RNA, 22 nt, Human
agcugcaaguccaaaggaauua

SEQ ID NO: 218371 - RNA, 22 nt, Human
uacuucaugaguuaauaugcag

SEQ ID NO: 218372 - RNA, 19 nt, Human
caggacagacuucaaagcc

SEQ ID NO: 218373 - RNA, 22 nt, Human
uaaguguuucuccagugucuuu

SEQ ID NO: 218374 - RNA, 22 nt, Human
aaaauugucgaacaguaguaac

SEQ ID NO: 218375 - RNA, 22 nt, Human
agcguaugaauauuugaagaga

SEQ ID NO: 218376 - RNA, 21 nt, Human
ccugggagaucagcugccuuc

SEQ ID NO: 218377 - RNA, 22 nt, Human
uagggauggaugaugccuggca

SEQ ID NO: 218378 - RNA, 22 nt, Human
augcacaggaccacacauaaug

SEQ ID NO: 218379 - RNA, 22 nt, Human
cccaugagauucugaauuuggc

SEQ ID NO: 218380 - RNA, 22 nt, Human
guauuagggccaaaggcaggaa

SEQ ID NO: 218381 - RNA, 22 nt, Human
uauuucuuucagguauguguug

SEQ ID NO: 218382 - RNA, 22 nt, Human
ccugccacuucuugcuauggag

SEQ ID NO: 218383 - RNA, 22 nt, Human
gucacuuuacacuccuacuaaa

SEQ ID NO: 218384 - RNA, 22 nt, Human
ugauguccucaugucaagcucc

SEQ ID NO: 218385 - RNA, 22 nt, Human
auccccuuaucccaggcugagc

SEQ ID NO: 218386 - RNA, 22 nt, Human
acuguauuuuguacuuucgugu

SEQ ID NO: 218387 - RNA, 22 nt, Human
uucuacaucacuuaacaugcua

SEQ ID NO: 218388 - RNA, 22 nt, Human
aaccagcuaaacuuugcucgaa

SEQ ID NO: 218389 - RNA, 22 nt, Human
aaauguguauaugaaacaugau

SEQ ID NO: 218390 - RNA, 22 nt, Human
aagauucacagagugaaugaaa

SEQ ID NO: 218391 - RNA, 22 nt, Human
ucugucuucuucauugccuaua

SEQ ID NO: 218392 - RNA, 22 nt, Human
gaaggccaagaggcuccaagau

SEQ ID NO: 218393 - RNA, 22 nt, Human
auuaaauuggaucugcauaguu

SEQ ID NO: 218394 - RNA, 22 nt, Human
gaaugcagauggcugguguaug

SEQ ID NO: 218395 - RNA, 22 nt, Human
uagggcaguuauaacauuagug

SEQ ID NO: 218396 - RNA, 22 nt, Human
cauuuuaaaugauuuaagccaa

SEQ ID NO: 218397 - RNA, 23 nt, Human
aggagaagagauuuccacaugca

SEQ ID NO: 218398 - RNA, 22 nt, Human
aucagugcugggagaugucaga

SEQ ID NO: 218399 - RNA, 19 nt, Human
guugaaaguaggugagggu

SEQ ID NO: 218400 - RNA, 22 nt, Human
acaaugcaauaggagcuagaaa

SEQ ID NO: 218401 - RNA, 22 nt, Human
cagggugggcacccagccucca

SEQ ID NO: 218402 - RNA, 19 nt, Human
uggaggaaguauauuucau

SEQ ID NO: 218403 - RNA, 22 nt, Human
uacagaggcacaugcaauuuuc

SEQ ID NO: 218404 - RNA, 22 nt, Human
cuuaauuucaaacugcuaguga

SEQ ID NO: 218405 - RNA, 22 nt, Human
cagguucccuugcagcuaagug

SEQ ID NO: 218406 - RNA, 22 nt, Human
uccugggagcccuugcuccacc

SEQ ID NO: 218407 - RNA, 22 nt, Human
uggcugagggggcaguucagga

SEQ ID NO: 218408 - RNA, 22 nt, Human
uuccaggagaggaaaccugauu

SEQ ID NO: 218409 - RNA, 23 nt, Human
acauguggagagaacagauaucu

SEQ ID NO: 218410 - RNA, 22 nt, Human
cagcaaaguaagcugacaugua

SEQ ID NO: 218411 - RNA, 22 nt, Human
ucccucaggacccaacuuguaa

SEQ ID NO: 218412 - RNA, 23 nt, Human
aaacaagcccuaaugaagagucc

SEQ ID NO: 218413 - RNA, 22 nt, Human
cauaauccugguguagcccucu

SEQ ID NO: 218414 - RNA, 23 nt, Human
acuuccaguuauaggaacucuuc

SEQ ID NO: 218415 - RNA, 22 nt, Human
ucuguuuucucuguauuuugac

SEQ ID NO: 218416 - RNA, 22 nt, Human
uagaaagucaaaacacuguguu

SEQ ID NO: 218417 - RNA, 22 nt, Human
aggccagcuguuacuagagcca

SEQ ID NO: 218418 - RNA, 22 nt, Human
ucuggaugaagacccagaggcu

SEQ ID NO: 218419 - RNA, 22 nt, Human
ucaggaugagcucauaacuaug

SEQ ID NO: 218420 - RNA, 22 nt, Human
agggcugcaucugccuggugaa

SEQ ID NO: 218421 - RNA, 22 nt, Human
ucagggcacguuucugcaaugc

SEQ ID NO: 218422 - RNA, 21 nt, Human
ucuggagcccuaagcugagaa

SEQ ID NO: 218423 - RNA, 22 nt, Human
gagagacagcacacaguguggg

SEQ ID NO: 218424 - RNA, 22 nt, Human
agagauauauauuuguuuacca

SEQ ID NO: 218425 - RNA, 22 nt, Human
uuuuuauaacucuuuugugaca

SEQ ID NO: 218426 - RNA, 22 nt, Human
uaucagcaacucagagcagucu

SEQ ID NO: 218427 - RNA, 22 nt, Human
guggccagugggaaugggcuca

SEQ ID NO: 218428 - RNA, 20 nt, Human
uaugaguauuacuuucagga

SEQ ID NO: 218429 - RNA, 22 nt, Human
gcugggcuggccgccgagaucg

SEQ ID NO: 218430 - RNA, 22 nt, Human
aagauauauuuuggugauuuca

SEQ ID NO: 218431 - RNA, 22 nt, Human
gcuggaagaaugagugccucgu

SEQ ID NO: 218432 - RNA, 22 nt, Human
uuuaaaaucagaugggaguugg

SEQ ID NO: 218433 - RNA, 22 nt, Human
gggcaugccugcgcagugcaug

SEQ ID NO: 218434 - RNA, 22 nt, Human
ggcucuggggaagcucucuuca

SEQ ID NO: 218435 - RNA, 22 nt, Human
aaagcugcaagcuccugaggaa

SEQ ID NO: 218436 - RNA, 22 nt, Human
cuacauaaucuggauuugucug

SEQ ID NO: 218437 - RNA, 23 nt, Human
cacaggcugcgcauaagcuucuc

SEQ ID NO: 218438 - RNA, 22 nt, Human
aauauguuuauaagauaucuuc

SEQ ID NO: 218439 - RNA, 22 nt, Human
cuguguccauguucuaauuugg

SEQ ID NO: 218440 - RNA, 22 nt, Human
uuacuucuugucucaugccuau

SEQ ID NO: 218441 - RNA, 18 nt, Human
caggugggucuccugccc

SEQ ID NO: 218442 - RNA, 22 nt, Human
ugcccuggcauuggguuggaua

SEQ ID NO: 218443 - RNA, 22 nt, Human
cugccagccaggccagguaggc

SEQ ID NO: 218444 - RNA, 22 nt, Human
aucuuagaaguuugauaaaauc

SEQ ID NO: 218445 - RNA, 22 nt, Human
gggcugcuugcuggagacagac

SEQ ID NO: 218446 - RNA, 21 nt, Human
gggaaacucugcuuaacagag

SEQ ID NO: 218447 - RNA, 22 nt, Human
caaauucucacccuguuugauu

SEQ ID NO: 218448 - RNA, 22 nt, Human
cacaugugggaaauggugcuua

SEQ ID NO: 218449 - RNA, 22 nt, Human
gggcugggauugcuugcuguga

SEQ ID NO: 218450 - RNA, 22 nt, Human
acugggaaucucaggaacaugg

SEQ ID NO: 218451 - RNA, 22 nt, Human
acccuggagcaauaaucccugg

SEQ ID NO: 218452 - RNA, 22 nt, Human
accaaggaagagauucucaguu

SEQ ID NO: 218453 - RNA, 22 nt, Human
uaaaguauauuuuuucucaaua

SEQ ID NO: 218454 - RNA, 22 nt, Human
guccaugauucuguguaguaga

SEQ ID NO: 218455 - RNA, 22 nt, Human
caagcaggguuuaugcauggag

SEQ ID NO: 218456 - RNA, 22 nt, Human
uucuuaagucaguaagaugcaa

SEQ ID NO: 218457 - RNA, 22 nt, Human
cuuagggagaaugccucugcag

SEQ ID NO: 218458 - RNA, 22 nt, Human
guggcaguuuugacaucacaaa

SEQ ID NO: 218459 - RNA, 22 nt, Human
gaugaagaggcacugacauauu

SEQ ID NO: 218460 - RNA, 22 nt, Human
agcaugaaaggcgugccaacuu

SEQ ID NO: 218461 - RNA, 22 nt, Human
gcuccaaaguacagugacuuac

SEQ ID NO: 218462 - RNA, 22 nt, Human
ucuggugguauacaucuaggag

SEQ ID NO: 218463 - RNA, 22 nt, Human
ugguauguaaauuguaacucaa

SEQ ID NO: 218464 - RNA, 22 nt, Human
cacaugagacaauuaaagacuu

SEQ ID NO: 218465 - RNA, 22 nt, Human
aaacaugagcacuugcuucaua

SEQ ID NO: 218466 - RNA, 22 nt, Human
cagauuaacacggagcuuaaca

SEQ ID NO: 218467 - RNA, 22 nt, Human
uagacacaucuucauccacaau

SEQ ID NO: 218468 - RNA, 22 nt, Human
aguguuuuuacaagcacucugg

SEQ ID NO: 218469 - RNA, 22 nt, Human
uccugccucaggcucuggagua

SEQ ID NO: 218470 - RNA, 20 nt, Human
ucagaaguuuccuggagcau

SEQ ID NO: 218471 - RNA, 22 nt, Human
agcuuuacaucgaaguucaguc

SEQ ID NO: 218472 - RNA, 22 nt, Human
gaguucucaagcaaucaaagag

SEQ ID NO: 218473 - RNA, 22 nt, Human
aggcacugggaauaugcugagg

SEQ ID NO: 218474 - RNA, 22 nt, Human
ugggcucuuccuauaguuuaua

SEQ ID NO: 218475 - RNA, 23 nt, Human
gacacaggagcacccagcugagc

SEQ ID NO: 218476 - RNA, 21 nt, Human
acuuggcagaacgcagaaggc

SEQ ID NO: 218477 - RNA, 22 nt, Human
agcugugugugcuugggauuau

SEQ ID NO: 218478 - RNA, 22 nt, Human
cuccuggcacucaguguggaag

SEQ ID NO: 218479 - RNA, 22 nt, Human
agagaguuguaccacacucaua

SEQ ID NO: 218480 - RNA, 22 nt, Human
ucagggcccuggacaacccucc

SEQ ID NO: 218481 - RNA, 22 nt, Human
uguggggaagaguaugacuugg

SEQ ID NO: 218482 - RNA, 22 nt, Human
ccccaggccuguuggauggcgc

SEQ ID NO: 218483 - RNA, 22 nt, Human
cugggccucauccccagaguuu

SEQ ID NO: 218484 - RNA, 22 nt, Human
augccuuuuuaucauggaugau

SEQ ID NO: 218485 - RNA, 22 nt, Human
uucuaaauguaaauaguaugau

SEQ ID NO: 218486 - RNA, 22 nt, Human
acugaaaaugaauuagaaacag

SEQ ID NO: 218487 - RNA, 22 nt, Human
agacuccucggaccaaucagcg

SEQ ID NO: 218488 - RNA, 22 nt, Human
uugugcuccuaugagaaucuaa

SEQ ID NO: 218489 - RNA, 22 nt, Human
guucuucagucacaucacagaa

SEQ ID NO: 218490 - RNA, 18 nt, Human
acagggaugggguaagug

SEQ ID NO: 218491 - RNA, 22 nt, Human
auccugggaaguggccuccucc

SEQ ID NO: 218492 - RNA, 22 nt, Human
uaacuagaagaaugcaccaaga

SEQ ID NO: 218493 - RNA, 22 nt, Human
uucccagugauugaacaucccu

SEQ ID NO: 218494 - RNA, 22 nt, Human
uguaucagaucaaauacuggcu

SEQ ID NO: 218495 - RNA, 22 nt, Human
aaauguacaacauccauauaua

SEQ ID NO: 218496 - RNA, 22 nt, Human
gacacaguucuguucuaguagg

SEQ ID NO: 218497 - RNA, 22 nt, Human
aauagcuuuuguaugaugaaau

SEQ ID NO: 218498 - RNA, 22 nt, Human
uuggcugaaugaggucaccuuu

SEQ ID NO: 218499 - RNA, 23 nt, Human
uagaucuucaucuaauucuguag

SEQ ID NO: 218500 - RNA, 22 nt, Human
cucugggcuuaccugcuuccug

SEQ ID NO: 218501 - RNA, 23 nt, Human
aacuuugccaggagacagcacag

SEQ ID NO: 218502 - RNA, 22 nt, Human
gucauuuaggucugucagaaau

SEQ ID NO: 218503 - RNA, 22 nt, Human
cuguccucaucugccccaaggg

SEQ ID NO: 218504 - RNA, 22 nt, Human
agccccaguucccuggaagucu

SEQ ID NO: 218505 - RNA, 22 nt, Human
acagcagcauccuauuucacuc

SEQ ID NO: 218506 - RNA, 22 nt, Human
ugaaagguagcuggccucauag

SEQ ID NO: 218507 - RNA, 22 nt, Human
gggcugcugccaccagguggau

SEQ ID NO: 218508 - RNA, 22 nt, Human
cugagggaugggcugggccgcc

SEQ ID NO: 218509 - RNA, 22 nt, Human
cugaggagggaaguccccaaag

SEQ ID NO: 218510 - RNA, 22 nt, Human
ccucugggugggaggccgggcg

SEQ ID NO: 218511 - RNA, 19 nt, Human
acacuguagauauagcuau

SEQ ID NO: 218512 - RNA, 18 nt, Human
ccuggaggucuucggggu

SEQ ID NO: 218513 - RNA, 22 nt, Human
acugcagagcuuuucaguugag

SEQ ID NO: 218514 - RNA, 22 nt, Human
ugggacuugccucgagggcugc

SEQ ID NO: 218515 - RNA, 22 nt, Human
acugccucuuggugcugagaga

SEQ ID NO: 218516 - RNA, 22 nt, Human
acuuccaggguagaggggaaga

SEQ ID NO: 218517 - RNA, 22 nt, Human
aaacugggauucuucacaaggu

SEQ ID NO: 218518 - RNA, 22 nt, Human
ggaguggcacucugaggcgggg

SEQ ID NO: 218519 - RNA, 22 nt, Human
uguggcagagagagcuuccuug

SEQ ID NO: 218520 - RNA, 22 nt, Human
cacuuagaaaacuugagcaagu

SEQ ID NO: 218521 - RNA, 21 nt, Human
ucuuucugaaaucucagucug

SEQ ID NO: 218522 - RNA, 22 nt, Human
cagaggggauaacagguguaga

SEQ ID NO: 218523 - RNA, 22 nt, Human
ucuucuccagugcuucugcaca

SEQ ID NO: 218524 - RNA, 22 nt, Human
cuacauuaaauuggcuuacuua

SEQ ID NO: 218525 - RNA, 22 nt, Human
ggaggcauuauggggaagacuu

SEQ ID NO: 218526 - RNA, 22 nt, Human
caugcuaagucauaaaagagua

SEQ ID NO: 218527 - RNA, 22 nt, Human
cagggcaaagagagcacaugcu

SEQ ID NO: 218528 - RNA, 22 nt, Human
aggccacaaccacccugugccc

SEQ ID NO: 218529 - RNA, 22 nt, Human
agcccaggcagagggaugcuug

SEQ ID NO: 218530 - RNA, 22 nt, Human
cagcccuggugagguuggcuau

SEQ ID NO: 218531 - RNA, 22 nt, Human
uccccaggaaauucugauucuu

SEQ ID NO: 218532 - RNA, 22 nt, Human
gagaaacaacacuugaugccuu

SEQ ID NO: 218533 - RNA, 22 nt, Human
gaagucuugaagagcacuguaa

SEQ ID NO: 218534 - RNA, 19 nt, Human
ugguggcaaugucagcuaa

SEQ ID NO: 218535 - RNA, 22 nt, Human
gaagggaaggaaagaaccagca

SEQ ID NO: 218536 - RNA, 18 nt, Human
gcagagcagaagcucaag

SEQ ID NO: 218537 - RNA, 22 nt, Human
uuggcagaugaacacaacugga

SEQ ID NO: 218538 - RNA, 22 nt, Human
uucucugagauagacuaagugg

SEQ ID NO: 218539 - RNA, 22 nt, Human
auuuacauuccauggugguuac

SEQ ID NO: 218540 - RNA, 22 nt, Human
gaagucagaaaagaauuaggga

SEQ ID NO: 218541 - RNA, 17 nt, Human
cccaggccgccgggagc

SEQ ID NO: 218542 - RNA, 21 nt, Human
uuagaguagagaacaugaucc

SEQ ID NO: 218543 - RNA, 22 nt, Human
gcugccuuugugagccaagggg

SEQ ID NO: 218544 - RNA, 22 nt, Human
gaacaucaugaagaaaacauau

SEQ ID NO: 218545 - RNA, 22 nt, Human
agccuggccacucagggccuga

SEQ ID NO: 218546 - RNA, 22 nt, Human
uggaggaguagauuuucagagg

SEQ ID NO: 218547 - RNA, 22 nt, Human
agaugguguuuccccaggugga

SEQ ID NO: 218548 - RNA, 22 nt, Human
guguggggccaggaucagggcu

SEQ ID NO: 218549 - RNA, 22 nt, Human
uggcaaagaugaagcauuucgu

SEQ ID NO: 218550 - RNA, 22 nt, Human
caauucuuggagaagaagcaua

SEQ ID NO: 218551 - RNA, 22 nt, Human
uuuucuguuacaaaguacagcg

SEQ ID NO: 218552 - RNA, 18 nt, Human
uugagucuagccauggaa

SEQ ID NO: 218553 - RNA, 22 nt, Human
ucaaagcaugguuuugaaagac

SEQ ID NO: 218554 - RNA, 22 nt, Human
ccagcccucacugaggccucuc

SEQ ID NO: 218555 - RNA, 22 nt, Human
aggugcaguggcucaugccugu

SEQ ID NO: 218556 - RNA, 22 nt, Human
acauuucuauagugcaucuguu

SEQ ID NO: 218557 - RNA, 22 nt, Human
guaaacaugcuguguacucagc

SEQ ID NO: 218558 - RNA, 22 nt, Human
aguguggguuuuauggagcccu

SEQ ID NO: 218559 - RNA, 22 nt, Human
cugggacagagcagcagugggg

SEQ ID NO: 218560 - RNA, 22 nt, Human
gacagggacacagccagugagg

SEQ ID NO: 218561 - RNA, 22 nt, Human
uauguaaaggauugagaugaau

SEQ ID NO: 218562 - RNA, 22 nt, Human
cugcuguuccaccucugaaugc

SEQ ID NO: 218563 - RNA, 22 nt, Human
ucuucaguagguccucagaauc

SEQ ID NO: 218564 - RNA, 22 nt, Human
agggcacccucucugcaguacc

SEQ ID NO: 218565 - RNA, 19 nt, Human
agcagcagcaccagggauu

SEQ ID NO: 218566 - RNA, 22 nt, Human
cuccuggaccaccuuguggcca

SEQ ID NO: 218567 - RNA, 22 nt, Human
aagguuuauuaaaaguugaugg

SEQ ID NO: 218568 - RNA, 22 nt, Human
acagcugauaguuaccucuguc

SEQ ID NO: 218569 - RNA, 22 nt, Human
agcacuuugugcauuucugaag

SEQ ID NO: 218570 - RNA, 22 nt, Human
ucuauguaaagccauauugaua

SEQ ID NO: 218571 - RNA, 22 nt, Human
auugauaaauugcaauggggcu

SEQ ID NO: 218572 - RNA, 20 nt, Human
cugggucuccuucugcuuaa

SEQ ID NO: 218573 - RNA, 22 nt, Human
aggugcaggagcugugcaggga

SEQ ID NO: 218574 - RNA, 22 nt, Human
guagaaccuucuuuacuagagu

SEQ ID NO: 218575 - RNA, 22 nt, Human
uacaacaugugguccuuuauga

SEQ ID NO: 218576 - RNA, 22 nt, Human
uaguuauauccagucuuuaaaa

SEQ ID NO: 218577 - RNA, 22 nt, Human
ggcagccucagguuuucuuuga

SEQ ID NO: 218578 - RNA, 22 nt, Human
ccauggcuuacagauggagcau

SEQ ID NO: 218579 - RNA, 22 nt, Human
gacuuucuuguagugucugaug

SEQ ID NO: 218580 - RNA, 21 nt, Human
uuucauugaaugagauaaggu

SEQ ID NO: 218581 - RNA, 22 nt, Human
cccuccagccauggacccaggu

SEQ ID NO: 218582 - RNA, 22 nt, Human
uuaccaaaugaaauagagauuu

SEQ ID NO: 218583 - RNA, 22 nt, Human
ucauuguaauuaucugugguau

SEQ ID NO: 218584 - RNA, 22 nt, Human
ucucugggccuguuuucucauc

SEQ ID NO: 218585 - RNA, 17 nt, Human
ucucaggggcuagcccu

SEQ ID NO: 218586 - RNA, 22 nt, Human
uucucuuagcuguaaagucaau

SEQ ID NO: 218587 - RNA, 22 nt, Human
uucuuuggcauuuccuguaugu

SEQ ID NO: 218588 - RNA, 22 nt, Human
cuuagaagaaugccuaggacag

SEQ ID NO: 218589 - RNA, 22 nt, Human
uggagaaggacagccugagaaa

SEQ ID NO: 218590 - RNA, 22 nt, Human
uaacugauauugaaaaacauca

SEQ ID NO: 218591 - RNA, 22 nt, Human
auaaacuggguaucaagaggcc

SEQ ID NO: 218592 - RNA, 22 nt, Human
agcugcugcggaaagaugccac

SEQ ID NO: 218593 - RNA, 22 nt, Human
ucuuuagacauccaguuucucu

SEQ ID NO: 218594 - RNA, 22 nt, Human
gaaguauuacucugaauguauu

SEQ ID NO: 218595 - RNA, 22 nt, Human
uauguuuuaggaauuaauuguu

SEQ ID NO: 218596 - RNA, 22 nt, Human
ggaagccaggccaaugagaaca

SEQ ID NO: 218597 - RNA, 22 nt, Human
aggguggcugaguagauggaag

SEQ ID NO: 218598 - RNA, 22 nt, Human
uuucaaaguugggaauuguaau

SEQ ID NO: 218599 - RNA, 22 nt, Human
agccuaaugcuuuucccaaagu

SEQ ID NO: 218600 - RNA, 22 nt, Human
guccuggggauacagaagugaa

SEQ ID NO: 218601 - RNA, 22 nt, Human
acaggcugggcgcuuccugcgg

SEQ ID NO: 218602 - RNA, 22 nt, Human
uuccaggaauucagcucucagu

SEQ ID NO: 218603 - RNA, 22 nt, Human
cucggaauggaacaacagcggu

SEQ ID NO: 218604 - RNA, 22 nt, Human
accugaggccuccccagcagac

SEQ ID NO: 218605 - RNA, 22 nt, Human
ccagagaggccuuggcaagaca

SEQ ID NO: 218606 - RNA, 22 nt, Human
guuauaaauaccuaauaggauu

SEQ ID NO: 218607 - RNA, 22 nt, Human
accauagacuggaggaucuccu

SEQ ID NO: 218608 - RNA, 22 nt, Human
uggggccugagguggagcugca

SEQ ID NO: 218609 - RNA, 22 nt, Human
uucaucuggucuaguuuuuagu

SEQ ID NO: 218610 - RNA, 22 nt, Human
cucuuugaaauccaucacugcu

SEQ ID NO: 218611 - RNA, 22 nt, Human
auuacaguaaaugcuacaggca

SEQ ID NO: 218612 - RNA, 22 nt, Human
acaguggaagaagcacugaacu

SEQ ID NO: 218613 - RNA, 22 nt, Human
caggaucccuggccuccgccca

SEQ ID NO: 218614 - RNA, 22 nt, Human
auuccaaagguuaaugcccauu

SEQ ID NO: 218615 - RNA, 22 nt, Human
agcacauuaagugaguucaugu

SEQ ID NO: 218616 - RNA, 18 nt, Human
aaggucugucugguaggu

SEQ ID NO: 218617 - RNA, 22 nt, Human
uuaagagguggucgugucugug

SEQ ID NO: 218618 - RNA, 18 nt, Human
cagaggagagacauucag

SEQ ID NO: 218619 - RNA, 22 nt, Human
aaguggugguaugaaccgaggg

SEQ ID NO: 218620 - RNA, 21 nt, Human
aggcaauucgaaguugcagac

SEQ ID NO: 218621 - RNA, 22 nt, Human
gcugugcuuuugguagauccca

SEQ ID NO: 218622 - RNA, 22 nt, Human
caggcccugccuugagggaccu

SEQ ID NO: 218623 - RNA, 22 nt, Human
gaccacagcuacaagggcaagg

SEQ ID NO: 218624 - RNA, 22 nt, Human
auucuucauacagacaaguccu

SEQ ID NO: 218625 - RNA, 22 nt, Human
ugagccagugugguaaagcuga

SEQ ID NO: 218626 - RNA, 22 nt, Human
uaaccuacuaugauucugggaa

SEQ ID NO: 218627 - RNA, 22 nt, Human
agaggcaacauggggaacagau

SEQ ID NO: 218628 - RNA, 20 nt, Human
uaagaugagcuauaagaagu

SEQ ID NO: 218629 - RNA, 22 nt, Human
gccuugguuggccagcaggucc

SEQ ID NO: 218630 - RNA, 20 nt, Human
ggagcugcccugggcuggag

SEQ ID NO: 218631 - RNA, 22 nt, Human
gcaaacauucaggaguacagga

SEQ ID NO: 218632 - RNA, 22 nt, Human
ccugagcaaaggaaggaugacu

SEQ ID NO: 218633 - RNA, 22 nt, Human
uucaucuggaaguucccaaggc

SEQ ID NO: 218634 - RNA, 22 nt, Human
gcagcuuucuacuuccuacagc

SEQ ID NO: 218635 - RNA, 22 nt, Human
gacuugccugcacugagccuau

SEQ ID NO: 218636 - RNA, 22 nt, Human
uuuauucaagaugagguucaug

SEQ ID NO: 218637 - RNA, 22 nt, Human
ugggacuuguguggcaguauuu

SEQ ID NO: 218638 - RNA, 22 nt, Human
aucugggcagggcagcaaggcg

SEQ ID NO: 218639 - RNA, 22 nt, Human
cuacauuuguucaaauaagcug

SEQ ID NO: 218640 - RNA, 22 nt, Human
accuguuuaccugcaccuguuu

SEQ ID NO: 218641 - RNA, 22 nt, Human
ugucaugguauuugugagcugc

SEQ ID NO: 218642 - RNA, 20 nt, Human
uguauuacuuggucuuacaa

SEQ ID NO: 218643 - RNA, 22 nt, Human
uuuaaauguuuauagagaguac

SEQ ID NO: 218644 - RNA, 22 nt, Human
uuagcaaauaucuugaaacagg

SEQ ID NO: 218645 - RNA, 19 nt, Human
ucugggcagggccagcacc

SEQ ID NO: 218646 - RNA, 22 nt, Human
caugcuguccugccagggaugg

SEQ ID NO: 218647 - RNA, 23 nt, Human
aguucucauucaucacggccuau

SEQ ID NO: 218648 - RNA, 22 nt, Human
acaaaagugagugugucucaga

SEQ ID NO: 218649 - RNA, 18 nt, Human
auguacauuugcuaaagc

SEQ ID NO: 218650 - RNA, 22 nt, Human
uucuuggccaccagaucucacu

SEQ ID NO: 218651 - RNA, 22 nt, Human
aaauugcagaugcuaaaugacu

SEQ ID NO: 218652 - RNA, 22 nt, Human
cugggaggcacuauucaggagg

SEQ ID NO: 218653 - RNA, 22 nt, Human
ccugcaccugagcagccugacu

SEQ ID NO: 218654 - RNA, 22 nt, Human
gaggauggaggugugagcuaug

SEQ ID NO: 218655 - RNA, 22 nt, Human
gucccagggaugcagacaugag

SEQ ID NO: 218656 - RNA, 22 nt, Human
gcggggcacagugauggagcac

SEQ ID NO: 218657 - RNA, 22 nt, Human
uuccuucuggagcccggggagc

SEQ ID NO: 218658 - RNA, 22 nt, Human
ccagcugguuaaaauagagaaa

SEQ ID NO: 218659 - RNA, 22 nt, Human
agcuggggguagugagaaauaa

SEQ ID NO: 218660 - RNA, 22 nt, Human
ggcaggggugaggccacucuga

SEQ ID NO: 218661 - RNA, 22 nt, Human
uggccaguuugcucaggcaguc

SEQ ID NO: 218662 - RNA, 22 nt, Human
aggaaugugaggcaaguuguga

SEQ ID NO: 218663 - RNA, 22 nt, Human
ccucaagaacaauccaccauua

SEQ ID NO: 218664 - RNA, 22 nt, Human
uucauucccaagaguaaacaua

SEQ ID NO: 218665 - RNA, 20 nt, Human
aucuuuggcucagaagccuu

SEQ ID NO: 218666 - RNA, 22 nt, Human
uagaaauucaaugcucugagua

SEQ ID NO: 218667 - RNA, 22 nt, Human
ugagcagaguuguuucuccuga

SEQ ID NO: 218668 - RNA, 22 nt, Human
aaagacuaaacaaccaauaucu

SEQ ID NO: 218669 - RNA, 22 nt, Human
ggccuguguccuccuugcccug

SEQ ID NO: 218670 - RNA, 22 nt, Human
acagaauauuuggcaugcgucu

SEQ ID NO: 218671 - RNA, 22 nt, Human
gcacagccacguaaugugguca

SEQ ID NO: 218672 - RNA, 22 nt, Human
cauuuguuaauuacuauuaucu

SEQ ID NO: 218673 - RNA, 22 nt, Human
auuugcaagcaugcacaaaagc

SEQ ID NO: 218674 - RNA, 22 nt, Human
accuguuuagaaagcuuaugag

SEQ ID NO: 218675 - RNA, 22 nt, Human
cugaauuauuuaaggugaaggg

SEQ ID NO: 218676 - RNA, 22 nt, Human
agcccugcgugccaggggacug

SEQ ID NO: 218677 - RNA, 22 nt, Human
uaagcuggagcuucccccgucc

SEQ ID NO: 218678 - RNA, 22 nt, Human
cagagugaacagugggaugugc

SEQ ID NO: 218679 - RNA, 22 nt, Human
uaugacaaaugauauauuuggc

SEQ ID NO: 218680 - RNA, 22 nt, Human
cuggccugaggccgccuucaga

SEQ ID NO: 218681 - RNA, 22 nt, Human
uccagcccucuggcccgcggug

SEQ ID NO: 218682 - RNA, 21 nt, Human
uacacaaagcgugguccagag

SEQ ID NO: 218683 - RNA, 22 nt, Human
acuggcagcagcagcccuuggg

SEQ ID NO: 218684 - RNA, 22 nt, Human
uuuacuuguucugcugaauucu

SEQ ID NO: 218685 - RNA, 22 nt, Human
uuuccuacugcccuauacacac

SEQ ID NO: 218686 - RNA, 22 nt, Human
ucacuuuacuuuguuaaucugg

SEQ ID NO: 218687 - RNA, 22 nt, Human
acaggcacucucauuaaaauag

SEQ ID NO: 218688 - RNA, 22 nt, Human
ugggccaggcaugugaucagca

SEQ ID NO: 218689 - RNA, 22 nt, Human
ugggaggacuugugggcuucau

SEQ ID NO: 218690 - RNA, 22 nt, Human
gccagcuggagacuggcagggg

SEQ ID NO: 218691 - RNA, 22 nt, Human
cuggaggcuggcuuccccuggc

SEQ ID NO: 218692 - RNA, 21 nt, Human
gcugcagggcccagggcaccc

SEQ ID NO: 218693 - RNA, 22 nt, Human
uaaaguauaagcauuggaguau

SEQ ID NO: 218694 - RNA, 22 nt, Human
uagggcugcagaacaauggccu

SEQ ID NO: 218695 - RNA, 22 nt, Human
gcaccaggagaaucacguuaga

SEQ ID NO: 218696 - RNA, 22 nt, Human
gugcagcugagggccucuucua

SEQ ID NO: 218697 - RNA, 20 nt, Human
auucucugcucaaguggcac

SEQ ID NO: 218698 - RNA, 22 nt, Human
agguucucacacgucuacaccc

SEQ ID NO: 218699 - RNA, 22 nt, Human
gcuugggagaggcuuccucuuu

SEQ ID NO: 218700 - RNA, 22 nt, Human
agcugcuguccuaggcacugua

SEQ ID NO: 218701 - RNA, 22 nt, Human
agacacagaaguugcuguuggg

SEQ ID NO: 218702 - RNA, 20 nt, Human
uugggccugucagcacuccc

SEQ ID NO: 218703 - RNA, 22 nt, Human
aaaugagguuaauacagugcuu

SEQ ID NO: 218704 - RNA, 22 nt, Human
augucugcuuuccuuuuaauca

SEQ ID NO: 218705 - RNA, 22 nt, Human
cucaggcucuggccauccaagg

SEQ ID NO: 218706 - RNA, 22 nt, Human
ucacccuucccagcuguccgcc

SEQ ID NO: 218707 - RNA, 22 nt, Human
agggcacuggcuugcaaacuca

SEQ ID NO: 218708 - RNA, 22 nt, Human
acccugagucagacagccugac

SEQ ID NO: 218709 - RNA, 22 nt, Human
ucuuccuucgcccuugcuguuu

SEQ ID NO: 218710 - RNA, 22 nt, Human
ggagaagccaggugauaagcaa

SEQ ID NO: 218711 - RNA, 22 nt, Human
ccugggagccaagccucugugu

SEQ ID NO: 218712 - RNA, 22 nt, Human
uuaccacacuuauuuacauugg

SEQ ID NO: 218713 - RNA, 22 nt, Human
gcagcucaagagaggugcuaug

SEQ ID NO: 218714 - RNA, 22 nt, Human
auccaggguguggagagagcuc

SEQ ID NO: 218715 - RNA, 22 nt, Human
uugaaugaggaagagcacuggc

SEQ ID NO: 218716 - RNA, 22 nt, Human
uuucuucagccuucacaaccug

SEQ ID NO: 218717 - RNA, 22 nt, Human
uuugaaaauuuaagugcuacac

SEQ ID NO: 218718 - RNA, 22 nt, Human
cacagccuuuaggguacacaca

SEQ ID NO: 218719 - RNA, 22 nt, Human
auuucucacucacaguccaugu

SEQ ID NO: 218720 - RNA, 19 nt, Human
cuugaaacuacuguugaga

SEQ ID NO: 218721 - RNA, 22 nt, Human
agcaaagcaguggcuaagcuga

SEQ ID NO: 218722 - RNA, 22 nt, Human
cccaggguugccugccucugcu

SEQ ID NO: 218723 - RNA, 22 nt, Human
guucuggguucuggguuauugg

SEQ ID NO: 218724 - RNA, 22 nt, Human
aguaacaucuuugacauuuguu

SEQ ID NO: 218725 - RNA, 22 nt, Human
aaauauaauuucugccucaaua

SEQ ID NO: 218726 - RNA, 22 nt, Human
acucaggcuacaacgcguggcu

SEQ ID NO: 218727 - RNA, 22 nt, Human
ugccugccaaugaugcuugugu

SEQ ID NO: 218728 - RNA, 22 nt, Human
cugggcaguaugaauauucaaa

SEQ ID NO: 218729 - RNA, 22 nt, Human
guccugaaugccuuuaggcaga

SEQ ID NO: 218730 - RNA, 22 nt, Human
auacaugugugugcauacaugu

SEQ ID NO: 218731 - RNA, 22 nt, Human
gguaacaaggccgauagaaaca

SEQ ID NO: 218732 - RNA, 22 nt, Human
caaguggggcagauucucuucc

SEQ ID NO: 218733 - RNA, 22 nt, Human
gaacagagaagcuuuacuaaag

SEQ ID NO: 218734 - RNA, 18 nt, Human
gacagcuguccugagccc

SEQ ID NO: 218735 - RNA, 22 nt, Human
gagggcaguagccucguacccu

SEQ ID NO: 218736 - RNA, 22 nt, Human
ucuccuggccgggcuguccccu

SEQ ID NO: 218737 - RNA, 22 nt, Human
ccugguggacagcagccagcag

SEQ ID NO: 218738 - RNA, 22 nt, Human
ccagacaggaacacacaucucc

SEQ ID NO: 218739 - RNA, 22 nt, Human
acaacaguccaguauagacugu

SEQ ID NO: 218740 - RNA, 22 nt, Human
ucugugcagggaccccaagagu

SEQ ID NO: 218741 - RNA, 22 nt, Human
ccucuccuugcacccgucccgc

SEQ ID NO: 218742 - RNA, 22 nt, Human
cuuuggaaggaacaggauucuc

SEQ ID NO: 218743 - RNA, 22 nt, Human
auauaauuuuugguuagcucaa

SEQ ID NO: 218744 - RNA, 22 nt, Human
ccugggucccaucccagaguga

SEQ ID NO: 218745 - RNA, 22 nt, Human
aguccugaugcucuggcaggag

SEQ ID NO: 218746 - RNA, 22 nt, Human
aaggggauuuaagguaagaaga

SEQ ID NO: 218747 - RNA, 22 nt, Human
gcucccagggcagcgcagaaga

SEQ ID NO: 218748 - RNA, 22 nt, Human
cacauacaaugguguuauuugg

SEQ ID NO: 218749 - RNA, 22 nt, Human
caguuaaaggcccaauaucugg

SEQ ID NO: 218750 - RNA, 22 nt, Human
uuccuccagccuggagcacuuc

SEQ ID NO: 218751 - RNA, 22 nt, Human
uuacaaacaagaucuuauucuu

SEQ ID NO: 218752 - RNA, 22 nt, Human
cugcccugcagcuccacggacu

SEQ ID NO: 218753 - RNA, 22 nt, Human
uauuaaagagagaaucaucauc

SEQ ID NO: 218754 - RNA, 22 nt, Human
auuuacagaagcauguaauagc

SEQ ID NO: 218755 - RNA, 22 nt, Human
uauuucugauugcucaugaggc

SEQ ID NO: 218756 - RNA, 22 nt, Human
agggaagccccgaggaggcacc

SEQ ID NO: 218757 - RNA, 22 nt, Human
accgaaggaaacuggaaccguu

SEQ ID NO: 218758 - RNA, 22 nt, Human
ucaguuaagcacuauacccuaa

SEQ ID NO: 218759 - RNA, 22 nt, Human
uucuaauugaccuuaggcugug

SEQ ID NO: 218760 - RNA, 22 nt, Human
ugcacacauguuuacaagcauc

SEQ ID NO: 218761 - RNA, 22 nt, Human
cagacagagcucacaagucuuu

SEQ ID NO: 218762 - RNA, 22 nt, Human
auauuaggcaaggagauuauuu

SEQ ID NO: 218763 - RNA, 22 nt, Human
guguggccguguauccauggcu

SEQ ID NO: 218764 - RNA, 21 nt, Human
acugugcagccugaggaugug

SEQ ID NO: 218765 - RNA, 22 nt, Human
gaggccuggcugucagucccca

SEQ ID NO: 218766 - RNA, 22 nt, Human
acauuuguuucucuagaguagg

SEQ ID NO: 218767 - RNA, 22 nt, Human
gcagugaacauaacacagaagg

SEQ ID NO: 218768 - RNA, 22 nt, Human
uucaaacaaaacuguucccaua

SEQ ID NO: 218769 - RNA, 22 nt, Human
cuguccugaggcagguggccug

SEQ ID NO: 218770 - RNA, 22 nt, Human
ucagaaucugcauuuaacaaaa

SEQ ID NO: 218771 - RNA, 22 nt, Human
uagaaucuggaucugggcgcau

SEQ ID NO: 218772 - RNA, 22 nt, Human
gagcaagauuaaaaggcugggu

SEQ ID NO: 218773 - RNA, 22 nt, Human
ucagagucuaugcaacagaauu

SEQ ID NO: 218774 - RNA, 22 nt, Human
auucagcaaugagcuuggauuu

SEQ ID NO: 218775 - RNA, 22 nt, Human
agguauauugaaugcuuacuua

SEQ ID NO: 218776 - RNA, 22 nt, Human
ccuuuauucaauuaguccuaau

SEQ ID NO: 218777 - RNA, 22 nt, Human
ggccucucugagagcagacguu

SEQ ID NO: 218778 - RNA, 22 nt, Human
aaggugugaagagaugggaaga

SEQ ID NO: 218779 - RNA, 22 nt, Human
uguguucauguauguauacaua

SEQ ID NO: 218780 - RNA, 21 nt, Human
uuguuacaaugcaagaguaug

SEQ ID NO: 218781 - RNA, 22 nt, Human
uuccaggcuauccggugaaggg

SEQ ID NO: 218782 - RNA, 22 nt, Human
uuggaaagaccgaauuccuguu

SEQ ID NO: 218783 - RNA, 22 nt, Human
ucuggcuuucucagcauggcau

SEQ ID NO: 218784 - RNA, 22 nt, Human
ccaggaucugauauugggcucc

SEQ ID NO: 218785 - RNA, 22 nt, Human
accagaggcaguuucggcuggu

SEQ ID NO: 218786 - RNA, 22 nt, Human
ucagcagaguuucaucuuggga

SEQ ID NO: 218787 - RNA, 22 nt, Human
gagaagggauauggcuucuuga

SEQ ID NO: 218788 - RNA, 17 nt, Human
uuuacauugcucgcagu

SEQ ID NO: 218789 - RNA, 22 nt, Human
uuuacagaagagaaggaugcuu

SEQ ID NO: 218790 - RNA, 22 nt, Human
cauggccaggcacgcgcauagc

SEQ ID NO: 218791 - RNA, 22 nt, Human
aagagagggguugcauggaaau

SEQ ID NO: 218792 - RNA, 23 nt, Human
uggcucugagagguucagaugcu

SEQ ID NO: 218793 - RNA, 20 nt, Human
accagguggcugaugacacc

SEQ ID NO: 218794 - RNA, 22 nt, Human
ccucacaguuuggcuaacugug

SEQ ID NO: 218795 - RNA, 22 nt, Human
auuauucagucuuguaaggagu

SEQ ID NO: 218796 - RNA, 22 nt, Human
gaucuucucuuuaguagaaaca

SEQ ID NO: 218797 - RNA, 21 nt, Human
ucuguacaucauugagucccc

SEQ ID NO: 218798 - RNA, 22 nt, Human
ugacaagauagauugaguuuua

SEQ ID NO: 218799 - RNA, 22 nt, Human
agcccuugcagacugucagcau

SEQ ID NO: 218800 - RNA, 22 nt, Human
cagaagagaugaaauaguauua

SEQ ID NO: 218801 - RNA, 22 nt, Human
aauacaguaauuuugaugaguu

SEQ ID NO: 218802 - RNA, 22 nt, Human
auagaaacagggaagcaaagca

SEQ ID NO: 218803 - RNA, 22 nt, Human
aauggcaguaguugcaugagag

SEQ ID NO: 218804 - RNA, 22 nt, Human
uugccaucccuuaccucaguca

SEQ ID NO: 218805 - RNA, 22 nt, Human
uccauccauguaggaagauggu

SEQ ID NO: 218806 - RNA, 22 nt, Human
gccuguuuggcugcugacauug

SEQ ID NO: 218807 - RNA, 22 nt, Human
agcuuuauuugucauucacggc

SEQ ID NO: 218808 - RNA, 22 nt, Human
gguggggcugcaagcaguucgg

SEQ ID NO: 218809 - RNA, 22 nt, Human
cugagagaaacaugacucagga

SEQ ID NO: 218810 - RNA, 22 nt, Human
gaugaauucuggcuuggacaga

SEQ ID NO: 218811 - RNA, 22 nt, Human
ccaggaggggucucugucuccc

SEQ ID NO: 218812 - RNA, 22 nt, Human
acuguguugccuucccccagcc

SEQ ID NO: 218813 - RNA, 20 nt, Human
ccagagaguagguuagugau

SEQ ID NO: 218814 - RNA, 23 nt, Human
agagugcagagauaugcuugugu

SEQ ID NO: 218815 - RNA, 22 nt, Human
agucaguuuucuccagggggcu

SEQ ID NO: 218816 - RNA, 22 nt, Human
agauauacacccauaucacaua

SEQ ID NO: 218817 - RNA, 22 nt, Human
guaauagaugaaacaaugugga

SEQ ID NO: 218818 - RNA, 22 nt, Human
ccucgugugcuaggauccaggu

SEQ ID NO: 218819 - RNA, 22 nt, Human
ggcucuguggcuggccaugaug

SEQ ID NO: 218820 - RNA, 22 nt, Human
ucaaauacagaagauccuuucc

SEQ ID NO: 218821 - RNA, 22 nt, Human
caacuucuuggcuuccuaaugg

SEQ ID NO: 218822 - RNA, 22 nt, Human
aggcugagauagguggaucauu

SEQ ID NO: 218823 - RNA, 22 nt, Human
ccuucaggucauauaugucaga

SEQ ID NO: 218824 - RNA, 22 nt, Human
auggcccagacucagacuggug

SEQ ID NO: 218825 - RNA, 21 nt, Human
gggguuggcaagagcagagac

SEQ ID NO: 218826 - RNA, 22 nt, Human
agggcucagcaucucauucugu

SEQ ID NO: 218827 - RNA, 22 nt, Human
ggccaccaaaguccuguggcuu

SEQ ID NO: 218828 - RNA, 22 nt, Human
ccccagggaagcuuugcuuacu

SEQ ID NO: 218829 - RNA, 22 nt, Human
ucaggcucaaagggccggauga

SEQ ID NO: 218830 - RNA, 21 nt, Human
agacaggucagggagagguga

SEQ ID NO: 218831 - RNA, 22 nt, Human
ccuguucauuuguauuugucuu

SEQ ID NO: 218832 - RNA, 22 nt, Human
ggcuccugggcagcugcucccu

SEQ ID NO: 218833 - RNA, 22 nt, Human
uccuggccucgcuguccaccuu

SEQ ID NO: 218834 - RNA, 22 nt, Human
cucugggaaagauugugcaggc

SEQ ID NO: 218835 - RNA, 22 nt, Human
uugauucuacuuaaaacauaug

SEQ ID NO: 218836 - RNA, 22 nt, Human
cugucccauccuuacucuaccc

SEQ ID NO: 218837 - RNA, 22 nt, Human
cuccucccucuuugccacacau

SEQ ID NO: 218838 - RNA, 22 nt, Human
agauauuuguaucuugcuauug

SEQ ID NO: 218839 - RNA, 19 nt, Human
agggauauuuaaaaagcuc

SEQ ID NO: 218840 - RNA, 19 nt, Human
gcuuccagcacugcaggag

SEQ ID NO: 218841 - RNA, 21 nt, Human
auauuuuuguuuggacuguca

SEQ ID NO: 218842 - RNA, 22 nt, Human
guuccguuuauaugcuggauua

SEQ ID NO: 218843 - RNA, 22 nt, Human
uucuuguuuauuaagauauaaa

SEQ ID NO: 218844 - RNA, 20 nt, Human
ucaaccuacugugcucaagu

SEQ ID NO: 218845 - RNA, 22 nt, Human
auccauuucaguguuccacuug

SEQ ID NO: 218846 - RNA, 22 nt, Human
caccaggcugagccucucaucu

SEQ ID NO: 218847 - RNA, 22 nt, Human
ugucaaauuuuuauugcaguau

SEQ ID NO: 218848 - RNA, 23 nt, Human
gcagccaagagaccagggcaggc

SEQ ID NO: 218849 - RNA, 22 nt, Human
acacacuucacccuugagcuaa

SEQ ID NO: 218850 - RNA, 22 nt, Human
agggaugauuucagugucugcc

SEQ ID NO: 218851 - RNA, 20 nt, Human
gggagucuggaugaaagaug

SEQ ID NO: 218852 - RNA, 22 nt, Human
uggaagggguuacgcagcagga

SEQ ID NO: 218853 - RNA, 22 nt, Human
agaauaauacugaaaugcugaa

SEQ ID NO: 218854 - RNA, 22 nt, Human
cugcaucugcauaaucaacuuc

SEQ ID NO: 218855 - RNA, 22 nt, Human
uggagaugaacauggugauguu

SEQ ID NO: 218856 - RNA, 23 nt, Human
gccaggcacaugguggacacgca

SEQ ID NO: 218857 - RNA, 22 nt, Human
aggcucagagagcuguguccau

SEQ ID NO: 218858 - RNA, 22 nt, Human
cucuagaagcugaggggcccaa

SEQ ID NO: 218859 - RNA, 22 nt, Human
agcaccugugcccugauggaga

SEQ ID NO: 218860 - RNA, 22 nt, Human
ggucugagauauuuguucagcu

SEQ ID NO: 218861 - RNA, 22 nt, Human
ucucuggcugauauuccucugc

SEQ ID NO: 218862 - RNA, 22 nt, Human
cgggguccgggcaguaggcugc

SEQ ID NO: 218863 - RNA, 22 nt, Human
acaugcuuuucccacaauuaua

SEQ ID NO: 218864 - RNA, 22 nt, Human
uuacagaggcuuccagggccca

SEQ ID NO: 218865 - RNA, 22 nt, Human
ucuucagagugaaagucuguga

SEQ ID NO: 218866 - RNA, 22 nt, Human
uagguacauuauuagaugcaug

SEQ ID NO: 218867 - RNA, 22 nt, Human
agaauccuggccaggucagagc

SEQ ID NO: 218868 - RNA, 22 nt, Human
guugggccccagagguccaggc

SEQ ID NO: 218869 - RNA, 22 nt, Human
acuuuagaaguaaggaugaguu

SEQ ID NO: 218870 - RNA, 22 nt, Human
ucuaggguguauaaggaagccu

SEQ ID NO: 218871 - RNA, 22 nt, Human
uacacaucaaccuggcuuuggc

SEQ ID NO: 218872 - RNA, 22 nt, Human
ucucagagauucagggagaagu

SEQ ID NO: 218873 - RNA, 22 nt, Human
aaggaaacacugaacuuuguag

SEQ ID NO: 218874 - RNA, 22 nt, Human
uagcccagagucccaauuccag

SEQ ID NO: 218875 - RNA, 22 nt, Human
aucuaggauuugaaugcacagu

SEQ ID NO: 218876 - RNA, 22 nt, Human
uuugcagagugcagaagcaucu

SEQ ID NO: 218877 - RNA, 22 nt, Human
aaacagaaauuuccucaugcuc

SEQ ID NO: 218878 - RNA, 22 nt, Human
guccaggagcucagggcuuauu

SEQ ID NO: 218879 - RNA, 22 nt, Human
ccuggcaggcuggggacagugc

SEQ ID NO: 218880 - RNA, 20 nt, Human
agcaccuguguagaagcauc

SEQ ID NO: 218881 - RNA, 22 nt, Human
acaguucacuuuuuauaucaaa

SEQ ID NO: 218882 - RNA, 22 nt, Human
gaagaacgucuuauaaauucac

SEQ ID NO: 218883 - RNA, 21 nt, Human
ggcaggauggcaguggacccc

SEQ ID NO: 218884 - RNA, 22 nt, Human
aaggaagacuugagaagguucc

SEQ ID NO: 218885 - RNA, 22 nt, Human
caaagcagagaacugucucauu

SEQ ID NO: 218886 - RNA, 23 nt, Human
ggagaggggugugggcaucuuua

SEQ ID NO: 218887 - RNA, 22 nt, Human
aauuucaaagcucacuggcaua

SEQ ID NO: 218888 - RNA, 22 nt, Human
agagaugcuguggguagaggca

SEQ ID NO: 218889 - RNA, 22 nt, Human
augaaagaugauuuaaaguacu

SEQ ID NO: 218890 - RNA, 22 nt, Human
ugaagccagucaauguuaaguu

SEQ ID NO: 218891 - RNA, 22 nt, Human
caucuuuaauuugugacaacua

SEQ ID NO: 218892 - RNA, 22 nt, Human
ucacagaauugacaugggaauc

SEQ ID NO: 218893 - RNA, 22 nt, Human
uccaggccacgaccuccuggau

SEQ ID NO: 218894 - RNA, 22 nt, Human
gggcuuggcuggggccaccaga

SEQ ID NO: 218895 - RNA, 22 nt, Human
cagagggcacaugguuuccuca

SEQ ID NO: 218896 - RNA, 22 nt, Human
cucaggauguacuacagaaggc

SEQ ID NO: 218897 - RNA, 22 nt, Human
agaggugacauaggagaggcuc

SEQ ID NO: 218898 - RNA, 21 nt, Human
agggcagauuagcuguaagag

SEQ ID NO: 218899 - RNA, 17 nt, Human
ggaaggucaaggggagg

SEQ ID NO: 218900 - RNA, 22 nt, Human
agguccaggccucaugauggcc

SEQ ID NO: 218901 - RNA, 22 nt, Human
ggaggggucucuagcgaggaga

SEQ ID NO: 218902 - RNA, 22 nt, Human
agccagaggaagccuggcccuc

SEQ ID NO: 218903 - RNA, 22 nt, Human
agucuuuccuuuuggaagaaaa

SEQ ID NO: 218904 - RNA, 22 nt, Human
uuaaauugucauuugagcaaug

SEQ ID NO: 218905 - RNA, 22 nt, Human
ccagaagcagagccugaggcag

SEQ ID NO: 218906 - RNA, 20 nt, Human
ugcagguguguccaagcacu

SEQ ID NO: 218907 - RNA, 22 nt, Human
ugccugucuuggaguccuggcc

SEQ ID NO: 218908 - RNA, 22 nt, Human
caggaagcaccagcccggcccc

SEQ ID NO: 218909 - RNA, 22 nt, Human
ugccagagaagacccagucacu

SEQ ID NO: 218910 - RNA, 22 nt, Human
gggcuucucagagaggcuuuag

SEQ ID NO: 218911 - RNA, 22 nt, Human
ucagugcaggaauuuccuuaga

SEQ ID NO: 218912 - RNA, 22 nt, Human
uggcucuguucgccaucaggag

SEQ ID NO: 218913 - RNA, 21 nt, Human
uuugaaagugggugauucuuu

SEQ ID NO: 218914 - RNA, 22 nt, Human
aggaauguuaagaaggucuacc

SEQ ID NO: 218915 - RNA, 22 nt, Human
gacaaggaaauuacuagcugga

SEQ ID NO: 218916 - RNA, 22 nt, Human
gccugcugccacccuggcuccg

SEQ ID NO: 218917 - RNA, 22 nt, Human
acugccuucaugcagaccccug

SEQ ID NO: 218918 - RNA, 22 nt, Human
ugagcuuacgugggaacagacu

SEQ ID NO: 218919 - RNA, 21 nt, Human
ugcagaaaugguuuuucuaag

SEQ ID NO: 218920 - RNA, 22 nt, Human
uuggcaaaauuuaaagaaguga

SEQ ID NO: 218921 - RNA, 22 nt, Human
cagguggucaggcaaggacacg

SEQ ID NO: 218922 - RNA, 22 nt, Human
uggaccagcagccccagugccu

SEQ ID NO: 218923 - RNA, 22 nt, Human
ucucaggcaucuguguggcaca

SEQ ID NO: 218924 - RNA, 22 nt, Human
gcaugcaguaaaauucagcaac

SEQ ID NO: 218925 - RNA, 22 nt, Human
ucugggugucacuccugccugc

SEQ ID NO: 218926 - RNA, 20 nt, Human
ugcuuccuggccacugcggg

SEQ ID NO: 218927 - RNA, 22 nt, Human
aauguucagaggacaauauaaa

SEQ ID NO: 218928 - RNA, 22 nt, Human
cugcccaggggagugcugucgg

SEQ ID NO: 218929 - RNA, 22 nt, Human
acuucuauuggucaugauaaaa

SEQ ID NO: 218930 - RNA, 23 nt, Human
agggaaaguaguaauggccuuug

SEQ ID NO: 218931 - RNA, 22 nt, Human
agguaggauggguggagaugau

SEQ ID NO: 218932 - RNA, 22 nt, Human
cugccuggccacaacccagggu

SEQ ID NO: 218933 - RNA, 22 nt, Human
auuagggaaacugacuugucuc

SEQ ID NO: 218934 - RNA, 22 nt, Human
cacagacagugucccuuuguug

SEQ ID NO: 218935 - RNA, 22 nt, Human
acacugaaugcuguuuagaaau

SEQ ID NO: 218936 - RNA, 22 nt, Human
aguacaauuuaaugaagauagc

SEQ ID NO: 218937 - RNA, 21 nt, Human
ccuaggaggcuuaauuaggcu

SEQ ID NO: 218938 - RNA, 22 nt, Human
uuuauauauggcuggucuggau

SEQ ID NO: 218939 - RNA, 22 nt, Human
ugacacauaccgaaaauauuug

SEQ ID NO: 218940 - RNA, 22 nt, Human
gugcuuuaaaccacugugcugu

SEQ ID NO: 218941 - RNA, 22 nt, Human
gaguccuugacacauaguaggu

SEQ ID NO: 218942 - RNA, 22 nt, Human
uggcagaggaggcucagauuga

SEQ ID NO: 218943 - RNA, 22 nt, Human
gccagguugcugacgacgaucu

SEQ ID NO: 218944 - RNA, 22 nt, Human
agaccacuaaaacuuucucuau

SEQ ID NO: 218945 - RNA, 22 nt, Human
aggcaccuugagagcaggagcu

SEQ ID NO: 218946 - RNA, 22 nt, Human
ggcuuugggcccucaagucucc

SEQ ID NO: 218947 - RNA, 22 nt, Human
gcuucauuuugcccucuggugg

SEQ ID NO: 218948 - RNA, 22 nt, Human
uggguucuagagggaccagaac

SEQ ID NO: 218949 - RNA, 22 nt, Human
cucaggcugugaugugauggca

SEQ ID NO: 218950 - RNA, 22 nt, Human
ucccuucaagauuuggggaaau

SEQ ID NO: 218951 - RNA, 22 nt, Human
ccccagcacaggcuccucagau

SEQ ID NO: 218952 - RNA, 22 nt, Human
ugagguggaaggauccuuugaa

SEQ ID NO: 218953 - RNA, 22 nt, Human
ucuuauugguaaugauggcauu

SEQ ID NO: 218954 - RNA, 20 nt, Human
ggcagccaaucagcgugccg

SEQ ID NO: 218955 - RNA, 22 nt, Human
gcaaagcagucuucugugccua

SEQ ID NO: 218956 - RNA, 22 nt, Human
ccucuuugagauucaguuuucc

SEQ ID NO: 218957 - RNA, 22 nt, Human
gggaaacuuucacaauguccag

SEQ ID NO: 218958 - RNA, 22 nt, Human
cauuuaaucuggcucaugagca

SEQ ID NO: 218959 - RNA, 22 nt, Human
gccugagaaggacacagcaggu

SEQ ID NO: 218960 - RNA, 18 nt, Human
ugaacuggcaucagaauc

SEQ ID NO: 218961 - RNA, 22 nt, Human
ccucuucucaacuccagccaga

SEQ ID NO: 218962 - RNA, 22 nt, Human
uaaugaugcaguuacugucuca

SEQ ID NO: 218963 - RNA, 22 nt, Human
agggccuguccgcucccgcccg

SEQ ID NO: 218964 - RNA, 22 nt, Human
ugcccucagcagcagcuccugc

SEQ ID NO: 218965 - RNA, 22 nt, Human
gggcucagaggaguggccuggg

SEQ ID NO: 218966 - RNA, 22 nt, Human
aacugucugaaacugggguuuc

SEQ ID NO: 218967 - RNA, 22 nt, Human
uguuugaacugaauaacauagu

SEQ ID NO: 218968 - RNA, 22 nt, Human
aagacaagcaucaaaucaggca

SEQ ID NO: 218969 - RNA, 22 nt, Human
aggcuucccagcugagcucagc

SEQ ID NO: 218970 - RNA, 22 nt, Human
uggguccagugcagcugcgcgu

SEQ ID NO: 218971 - RNA, 22 nt, Human
ucagaggugguaaaggacagca

SEQ ID NO: 218972 - RNA, 22 nt, Human
aaggcagcacagcaacugcuca

SEQ ID NO: 218973 - RNA, 21 nt, Human
ggaagcaguggcggcaacucc

SEQ ID NO: 218974 - RNA, 22 nt, Human
gagaggccugggcccgugagcu

SEQ ID NO: 218975 - RNA, 22 nt, Human
guuuacaacaugccaacugggc

SEQ ID NO: 218976 - RNA, 22 nt, Human
cuguuguauuauucaauauuau

SEQ ID NO: 218977 - RNA, 22 nt, Human
gaggcuccgguaguagccuuga

SEQ ID NO: 218978 - RNA, 22 nt, Human
cagauggauuuuguaggcugau

SEQ ID NO: 218979 - RNA, 22 nt, Human
aucuguggauaugcacagagca

SEQ ID NO: 218980 - RNA, 22 nt, Human
ucucauuggaaaagaguuuaau

SEQ ID NO: 218981 - RNA, 22 nt, Human
aagucuaguauccuucuugacu

SEQ ID NO: 218982 - RNA, 22 nt, Human
aguggcagagaccccagccagc

SEQ ID NO: 218983 - RNA, 22 nt, Human
ucuaaacacuaagucuugaugc

SEQ ID NO: 218984 - RNA, 23 nt, Human
cugggcugcuugagucccuggcu

SEQ ID NO: 218985 - RNA, 22 nt, Human
ugcagcccaggcgucagguggu

SEQ ID NO: 218986 - RNA, 22 nt, Human
gagcuggggcggauacucagcu

SEQ ID NO: 218987 - RNA, 22 nt, Human
ccuggcugacagcuuaauucca

SEQ ID NO: 218988 - RNA, 22 nt, Human
agaggauguucuaggcacucau

SEQ ID NO: 218989 - RNA, 22 nt, Human
gcaggugaugugaugugagcau

SEQ ID NO: 218990 - RNA, 22 nt, Human
guucuucagcccucagguccua

SEQ ID NO: 218991 - RNA, 22 nt, Human
guccugugcccuggguggcgcu

SEQ ID NO: 218992 - RNA, 22 nt, Human
uggaggaaaauuacuggggucu

SEQ ID NO: 218993 - RNA, 22 nt, Human
caucuugaagguuucuuuagcu

SEQ ID NO: 218994 - RNA, 22 nt, Human
ucaggugucaagcagggagcug

SEQ ID NO: 218995 - RNA, 22 nt, Human
agugcauguaucuacagucaca

SEQ ID NO: 218996 - RNA, 22 nt, Human
guggcuucuucugccagaagga

SEQ ID NO: 218997 - RNA, 22 nt, Human
ggcuuccagcugggccuuggag

SEQ ID NO: 218998 - RNA, 22 nt, Human
cuccagugcccuccuugggggc

SEQ ID NO: 218999 - RNA, 22 nt, Human
auaagcugaauagucaacacaa

SEQ ID NO: 219000 - RNA, 22 nt, Human
gagucaggcaugaagguaauua

SEQ ID NO: 219001 - RNA, 22 nt, Human
uggcacagcccagagcucuuga

SEQ ID NO: 219002 - RNA, 22 nt, Human
uggaugagucugagauugggca

SEQ ID NO: 219003 - RNA, 22 nt, Human
uaggacauguguuuuauauaug

SEQ ID NO: 219004 - RNA, 22 nt, Human
ugggggacugcacuggcgucag

SEQ ID NO: 219005 - RNA, 22 nt, Human
uucugggcaggacuggggaccc

SEQ ID NO: 219006 - RNA, 22 nt, Human
gcacagacauauccauauuuac

SEQ ID NO: 219007 - RNA, 22 nt, Human
agccaggccagacucacacccu

SEQ ID NO: 219008 - RNA, 22 nt, Human
ugauggcuuauggagagagcaa

SEQ ID NO: 219009 - RNA, 23 nt, Human
agcagcagcaauuaaguggauau

SEQ ID NO: 219010 - RNA, 22 nt, Human
gacauuuacugaauacugauua

SEQ ID NO: 219011 - RNA, 22 nt, Human
gcugccuccaaucugugccccg

SEQ ID NO: 219012 - RNA, 22 nt, Human
uugcuuuaccugugguauauuu

SEQ ID NO: 219013 - RNA, 22 nt, Human
caacacauugaagcuaugauga

SEQ ID NO: 219014 - RNA, 22 nt, Human
aggugacaucccggcagcagag

SEQ ID NO: 219015 - RNA, 22 nt, Human
aagacagugugucaggcaggug

SEQ ID NO: 219016 - RNA, 22 nt, Human
cugcuccagacaccugcagggg

SEQ ID NO: 219017 - RNA, 22 nt, Human
ugcugggcacugucuagguacu

SEQ ID NO: 219018 - RNA, 22 nt, Human
ugaggccugcccuggggaaguu

SEQ ID NO: 219019 - RNA, 22 nt, Human
aggcacaagaaacugcucccca

SEQ ID NO: 219020 - RNA, 22 nt, Human
agcaugcaguaaguacccugug

SEQ ID NO: 219021 - RNA, 22 nt, Human
aucagugcugagagacuaucaa

SEQ ID NO: 219022 - RNA, 22 nt, Human
aguguuuaccccaaucaguuua

SEQ ID NO: 219023 - RNA, 22 nt, Human
aagaggcagcccgcugaggcug

SEQ ID NO: 219024 - RNA, 22 nt, Human
caaggccaguccauuuuggaag

SEQ ID NO: 219025 - RNA, 22 nt, Human
aaaugucaaagacguguuuuug

SEQ ID NO: 219026 - RNA, 22 nt, Human
cugaagggucuggggcugugcc

SEQ ID NO: 219027 - RNA, 22 nt, Human
aggacagcccccaacagcaaca

SEQ ID NO: 219028 - RNA, 22 nt, Human
aaaagcaguuuauagucaguug

SEQ ID NO: 219029 - RNA, 22 nt, Human
ucuuccugaaacccuguuccag

SEQ ID NO: 219030 - RNA, 22 nt, Human
uucuacaugagaaaauguauuu

SEQ ID NO: 219031 - RNA, 22 nt, Human
agagaggucucaggagaaacca

SEQ ID NO: 219032 - RNA, 22 nt, Human
uauuccuauuucuaaacauaug

SEQ ID NO: 219033 - RNA, 19 nt, Human
uccauaaugaagauagagg

SEQ ID NO: 219034 - RNA, 22 nt, Human
aggcagguguuaacccucugag

SEQ ID NO: 219035 - RNA, 22 nt, Human
agggcacaucugcugggaaugg

SEQ ID NO: 219036 - RNA, 21 nt, Human
ucccagggccaggugccauca

SEQ ID NO: 219037 - RNA, 22 nt, Human
cacugagaggucucauuuccaa

SEQ ID NO: 219038 - RNA, 22 nt, Human
uaacacagacagccacuaguaa

SEQ ID NO: 219039 - RNA, 22 nt, Human
acaguauauauagucuaaaagc

SEQ ID NO: 219040 - RNA, 22 nt, Human
cugugaccuuagcaagggaaau

SEQ ID NO: 219041 - RNA, 22 nt, Human
gccaaaguaccuagcccucugc

SEQ ID NO: 219042 - RNA, 22 nt, Human
caaaugcaggucauaaccugag

SEQ ID NO: 219043 - RNA, 22 nt, Human
gagcccugaacaacagcaggaa

SEQ ID NO: 219044 - RNA, 22 nt, Human
agagggaaugugauugcaccau

SEQ ID NO: 219045 - RNA, 22 nt, Human
ugcuggggcucugaccacucca

SEQ ID NO: 219046 - RNA, 22 nt, Human
gcacuauagcugcagcacagag

SEQ ID NO: 219047 - RNA, 18 nt, Human
uccugggaaaggcauaca

SEQ ID NO: 219048 - RNA, 19 nt, Human
gcccucaggcagcuccauc

SEQ ID NO: 219049 - RNA, 20 nt, Human
uuggucagugguucaguuug

SEQ ID NO: 219050 - RNA, 22 nt, Human
aaauaaguaguuuaguguugug

SEQ ID NO: 219051 - RNA, 22 nt, Human
gagcccugagaguugugaggcc

SEQ ID NO: 219052 - RNA, 22 nt, Human
cugggagauaugaggaucugga

SEQ ID NO: 219053 - RNA, 22 nt, Human
uaaggaaugcuugaauguuccu

SEQ ID NO: 219054 - RNA, 22 nt, Human
uaaaauguguuucuguaugguu

SEQ ID NO: 219055 - RNA, 22 nt, Human
uugacaggagccaaaauaggau

SEQ ID NO: 219056 - RNA, 22 nt, Human
agagcagccucagcucccugug

SEQ ID NO: 219057 - RNA, 23 nt, Human
cucuggguccgauguccugacag

SEQ ID NO: 219058 - RNA, 22 nt, Human
cagggcugagaauuuagagaca

SEQ ID NO: 219059 - RNA, 22 nt, Human
gcacuuuaaauguucacggaaa

SEQ ID NO: 219060 - RNA, 22 nt, Human
gauggcagucaaccaggugagg

SEQ ID NO: 219061 - RNA, 22 nt, Human
gucaggccaauacucuccagca

SEQ ID NO: 219062 - RNA, 22 nt, Human
cauguacaaggaugcucagagu

SEQ ID NO: 219063 - RNA, 22 nt, Human
cugccugcuuaccaugcaucag

SEQ ID NO: 219064 - RNA, 22 nt, Human
uucugagaugcguuagaaauuu

SEQ ID NO: 219065 - RNA, 22 nt, Human
ugggagcaagcuacuuagggaa

SEQ ID NO: 219066 - RNA, 22 nt, Human
cagcuuuuuagaaucuagggca

SEQ ID NO: 219067 - RNA, 22 nt, Human
ucucagggcagcaaggaagcau

SEQ ID NO: 219068 - RNA, 22 nt, Human
cccagugucugggccugcaggg

SEQ ID NO: 219069 - RNA, 22 nt, Human
gcacaguugugacaaccaucgc

SEQ ID NO: 219070 - RNA, 22 nt, Human
acacugugacaaaggcuguucu

SEQ ID NO: 219071 - RNA, 22 nt, Human
agcuggucugcugcauggagug

SEQ ID NO: 219072 - RNA, 22 nt, Human
acuccugguuuguguccuggcu

SEQ ID NO: 219073 - RNA, 22 nt, Human
gcaagcaguuguggcuucugag

SEQ ID NO: 219074 - RNA, 20 nt, Human
ucuguuauugcauguacaua

SEQ ID NO: 219075 - RNA, 22 nt, Human
gaggcucacuuucauccucuuc

SEQ ID NO: 219076 - RNA, 22 nt, Human
ggccuuccaucugccucuguuu

SEQ ID NO: 219077 - RNA, 19 nt, Human
ugggaaaguaacauacaaa

SEQ ID NO: 219078 - RNA, 22 nt, Human
ccaggugucauggauaaugggu

SEQ ID NO: 219079 - RNA, 22 nt, Human
uagaacugcucucauacuugcu

SEQ ID NO: 219080 - RNA, 22 nt, Human
ggcagcugagaucaugcuguug

SEQ ID NO: 219081 - RNA, 22 nt, Human
uugccuggauucuaccacagaa

SEQ ID NO: 219082 - RNA, 22 nt, Human
ugaguauuuucccuaucaaugu

SEQ ID NO: 219083 - RNA, 23 nt, Human
agcugaaagcuugcaacgaggca

SEQ ID NO: 219084 - RNA, 22 nt, Human
agcaugcacaugacuggcuuaa

SEQ ID NO: 219085 - RNA, 22 nt, Human
cagagggagcccuccaggagca

SEQ ID NO: 219086 - RNA, 22 nt, Human
acagaauaacucuugcuugagu

SEQ ID NO: 219087 - RNA, 22 nt, Human
agaagaauuucucucaugauuu

SEQ ID NO: 219088 - RNA, 19 nt, Human
uuucuuuuccccucagcac

SEQ ID NO: 219089 - RNA, 21 nt, Human
cccaccccauaaggcagaacc

SEQ ID NO: 219090 - RNA, 22 nt, Human
agcuggcccacuguguggucca

SEQ ID NO: 219091 - RNA, 22 nt, Human
acuggcagggggagccccgaga

SEQ ID NO: 219092 - RNA, 22 nt, Human
auuuugcacacuaugcagcuuu

SEQ ID NO: 219093 - RNA, 22 nt, Human
aguggcugguaguuacugagca

SEQ ID NO: 219094 - RNA, 22 nt, Human
gcucagggagagagggcagccg

SEQ ID NO: 219095 - RNA, 22 nt, Human
ucuuagaaaugaaguucuuucu

SEQ ID NO: 219096 - RNA, 22 nt, Human
ggcuggguuugacuccuggcuu

SEQ ID NO: 219097 - RNA, 22 nt, Human
gaugagugauguugaagaaggu

SEQ ID NO: 219098 - RNA, 22 nt, Human
ugcauaacuagaguaauuacag

SEQ ID NO: 219099 - RNA, 22 nt, Human
ucagagcaugugggcugcaguu

SEQ ID NO: 219100 - RNA, 22 nt, Human
uuugcugugggauauccaugug

SEQ ID NO: 219101 - RNA, 22 nt, Human
ucccaggcaggugacaggggga

SEQ ID NO: 219102 - RNA, 22 nt, Human
auuucuuaugaauauugacugu

SEQ ID NO: 219103 - RNA, 22 nt, Human
auuuaugauuagccuauuguug

SEQ ID NO: 219104 - RNA, 22 nt, Human
cuggaaguauaggggagaugau

SEQ ID NO: 219105 - RNA, 22 nt, Human
gcaggggaguggcaggcccgga

SEQ ID NO: 219106 - RNA, 22 nt, Human
caguuuuaaauuuugaaugucu

SEQ ID NO: 219107 - RNA, 22 nt, Human
aggcagagaaaaaccagauaug

SEQ ID NO: 219108 - RNA, 22 nt, Human
gccuggagcucuccacuugggg

SEQ ID NO: 219109 - RNA, 22 nt, Human
ccagcugugccggggaccuggg

SEQ ID NO: 219110 - RNA, 22 nt, Human
gaaaagaacugcaugggauuaa

SEQ ID NO: 219111 - RNA, 22 nt, Human
aaauaguuagcccugcauauau

SEQ ID NO: 219112 - RNA, 22 nt, Human
aaacaggcuuauauuuugcucu

SEQ ID NO: 219113 - RNA, 22 nt, Human
cugcuggcccccauuucagggu

SEQ ID NO: 219114 - RNA, 22 nt, Human
uaaggcagugagaagaaacagg

SEQ ID NO: 219115 - RNA, 22 nt, Human
uugaaagaacucuucagagaua

SEQ ID NO: 219116 - RNA, 22 nt, Human
cccagagcugagggggcacguu

SEQ ID NO: 219117 - RNA, 22 nt, Human
gggaucuuucugaugcuguggc

SEQ ID NO: 219118 - RNA, 22 nt, Human
augaggcagagggcugugccag

SEQ ID NO: 219119 - RNA, 22 nt, Human
caucaucucuggcccuugaagu

SEQ ID NO: 219120 - RNA, 22 nt, Human
uuuauauccaucuuugaaguaa

SEQ ID NO: 219121 - RNA, 22 nt, Human
cuuuucaugccagcccaucaca

SEQ ID NO: 219122 - RNA, 22 nt, Human
cuuuggaaugcacagaggugua

SEQ ID NO: 219123 - RNA, 22 nt, Human
cacuugaaguuugggggacucu

SEQ ID NO: 219124 - RNA, 23 nt, Human
aguacauucgaaaaauucuguga

SEQ ID NO: 219125 - RNA, 22 nt, Human
uggcuucugggguggccugcau

SEQ ID NO: 219126 - RNA, 18 nt, Human
agcaacagaaacauaugg

SEQ ID NO: 219127 - RNA, 22 nt, Human
acagucuacuaaacaucaucag

SEQ ID NO: 219128 - RNA, 22 nt, Human
uucauguucauauguguauauc

SEQ ID NO: 219129 - RNA, 22 nt, Human
ggagagucugccgagccagccc

SEQ ID NO: 219130 - RNA, 22 nt, Human
ccuggcucugcgugcagcuccg

SEQ ID NO: 219131 - RNA, 22 nt, Human
cuggugcacguggcugcagucg

SEQ ID NO: 219132 - RNA, 22 nt, Human
aauucaacagucaguuaucuca

SEQ ID NO: 219133 - RNA, 22 nt, Human
cuuuggcuugcacuauuacacu

SEQ ID NO: 219134 - RNA, 22 nt, Human
cacacaggaaaauuggaauuaa

SEQ ID NO: 219135 - RNA, 22 nt, Human
augugcauaaacauauuguugg

SEQ ID NO: 219136 - RNA, 22 nt, Human
cacugucuugauuacuaugggu

SEQ ID NO: 219137 - RNA, 22 nt, Human
agggccaguauuaagguaauua

SEQ ID NO: 219138 - RNA, 22 nt, Human
uacaggugcucuacagacagga

SEQ ID NO: 219139 - RNA, 22 nt, Human
ccagcuccacugucagaugaga

SEQ ID NO: 219140 - RNA, 22 nt, Human
augcacaucuuacagaugcaga

SEQ ID NO: 219141 - RNA, 19 nt, Human
auuucaagagguuuauugg

SEQ ID NO: 219142 - RNA, 19 nt, Human
cucaccuggaggugcugau

SEQ ID NO: 219143 - RNA, 20 nt, Human
acuuuacagagaagacugac

SEQ ID NO: 219144 - RNA, 21 nt, Human
ucugucuuccucagccuaagg

SEQ ID NO: 219145 - RNA, 22 nt, Human
cuguuuaucuaggaguugcagg

SEQ ID NO: 219146 - RNA, 22 nt, Human
ucuuugauuuuguuacuaagac

SEQ ID NO: 219147 - RNA, 22 nt, Human
guccaggaaucaaaagauggaa

SEQ ID NO: 219148 - RNA, 22 nt, Human
uggcuggaggguuagugagaua

SEQ ID NO: 219149 - RNA, 19 nt, Human
agccagaguggcccagggg

SEQ ID NO: 219150 - RNA, 22 nt, Human
guuauacauauguguuaacaaa

SEQ ID NO: 219151 - RNA, 22 nt, Human
auacaaagacaaaucucaaucu

SEQ ID NO: 219152 - RNA, 22 nt, Human
accagccuccuagcugcuccug

SEQ ID NO: 219153 - RNA, 22 nt, Human
gccugccuagaauugcagcuuu

SEQ ID NO: 219154 - RNA, 22 nt, Human
aggaugaggcuggcaggucuug

SEQ ID NO: 219155 - RNA, 22 nt, Human
uggcucagaacuacuucuaguu

SEQ ID NO: 219156 - RNA, 22 nt, Human
cuuccuuccacaccuucagaau

SEQ ID NO: 219157 - RNA, 22 nt, Human
uuguacaguuuaagugggugaa

SEQ ID NO: 219158 - RNA, 22 nt, Human
uaccugcacagccagccaugug

SEQ ID NO: 219159 - RNA, 22 nt, Human
guucauucugaaaagcagcuug

SEQ ID NO: 219160 - RNA, 22 nt, Human
ucuaaacauugguauggagcag

SEQ ID NO: 219161 - RNA, 22 nt, Human
uuucaacaucaccuagcaguuc

SEQ ID NO: 219162 - RNA, 22 nt, Human
ucaaaugcaccucucauuuguu

SEQ ID NO: 219163 - RNA, 22 nt, Human
guuaauuugcagcuuucgagcu

SEQ ID NO: 219164 - RNA, 19 nt, Human
auugcagcuauagacugcc

SEQ ID NO: 219165 - RNA, 23 nt, Human
agugcucccaggaccuggggcag

SEQ ID NO: 219166 - RNA, 23 nt, Human
uggcuucugccccauucucucca

SEQ ID NO: 219167 - RNA, 22 nt, Human
gcuguacauucuguggguuugg

SEQ ID NO: 219168 - RNA, 20 nt, Human
augaguuuaaacauucagag

SEQ ID NO: 219169 - RNA, 22 nt, Human
uccuucaacuuuuuacuugccc

SEQ ID NO: 219170 - RNA, 22 nt, Human
gaggagagccugcacuuugacc

SEQ ID NO: 219171 - RNA, 22 nt, Human
gacaaugcagaaguacuuguuc

SEQ ID NO: 219172 - RNA, 21 nt, Human
ucugggcugcugcugcccauc

SEQ ID NO: 219173 - RNA, 22 nt, Human
guacccuguggccagccagcca

SEQ ID NO: 219174 - RNA, 22 nt, Human
augcacauaggccaaaucauuu

SEQ ID NO: 219175 - RNA, 22 nt, Human
auggcuucugucuuggaaacuu

SEQ ID NO: 219176 - RNA, 22 nt, Human
guucuauuccccuuaucuguga

SEQ ID NO: 219177 - RNA, 22 nt, Human
auuacaaguagacuaacuuuca

SEQ ID NO: 219178 - RNA, 22 nt, Human
gcacuggagauacagagaugaa

SEQ ID NO: 219179 - RNA, 22 nt, Human
agagugcuagccugagggaggu

SEQ ID NO: 219180 - RNA, 22 nt, Human
acccuggagcuuuucuggcccu

SEQ ID NO: 219181 - RNA, 22 nt, Human
cucaggaugcaggucacaggac

SEQ ID NO: 219182 - RNA, 22 nt, Human
uaucaucuuguugucaugcagc

SEQ ID NO: 219183 - RNA, 22 nt, Human
ggccugaggcgucccagcugug

SEQ ID NO: 219184 - RNA, 22 nt, Human
augcacccauguacauacacau

SEQ ID NO: 219185 - RNA, 22 nt, Human
aaauaguuuagcucucauuuca

SEQ ID NO: 219186 - RNA, 20 nt, Human
aaacucuaccucaaucguca

SEQ ID NO: 219187 - RNA, 22 nt, Human
uucagaaagugaaucuuguuau

SEQ ID NO: 219188 - RNA, 22 nt, Human
gcuucugugguugucacgacua

SEQ ID NO: 219189 - RNA, 17 nt, Human
augaggucauuaagaua

SEQ ID NO: 219190 - RNA, 22 nt, Human
uuuuucaagacaaccugcaugu

SEQ ID NO: 219191 - RNA, 22 nt, Human
gcaguggggcgcugggaguugg

SEQ ID NO: 219192 - RNA, 21 nt, Human
caguuacacaaguguuaccag

SEQ ID NO: 219193 - RNA, 23 nt, Human
ggcagagagcauggcuggggccc

SEQ ID NO: 219194 - RNA, 22 nt, Human
cagguucuuguuucaaacagac

SEQ ID NO: 219195 - RNA, 22 nt, Human
agguuuaugauucugcacgugg

SEQ ID NO: 219196 - RNA, 22 nt, Human
augcaucuuuucaagguauuuc

SEQ ID NO: 219197 - RNA, 22 nt, Human
gagcaguaggagaacccugagc

SEQ ID NO: 219198 - RNA, 22 nt, Human
uuagucuucuuccuuauauguu

SEQ ID NO: 219199 - RNA, 22 nt, Human
acaugccaugaagguauuuuug

SEQ ID NO: 219200 - RNA, 21 nt, Human
agaauccauucagaccuucuc

SEQ ID NO: 219201 - RNA, 22 nt, Human
uucucacaggcuggaaugauga

SEQ ID NO: 219202 - RNA, 22 nt, Human
uagaucugauacaauucaucug

SEQ ID NO: 219203 - RNA, 22 nt, Human
acaauuuauccauuguauaguu

SEQ ID NO: 219204 - RNA, 22 nt, Human
aguggaggcacuaauuggauuu

SEQ ID NO: 219205 - RNA, 22 nt, Human
ugagcccuggcucuuucacuua

SEQ ID NO: 219206 - RNA, 22 nt, Human
ugugacuggaguccagcccacu

SEQ ID NO: 219207 - RNA, 22 nt, Human
auauuauuuucccuggaguugu

SEQ ID NO: 219208 - RNA, 22 nt, Human
cugcucagcggaaggaagagcg

SEQ ID NO: 219209 - RNA, 22 nt, Human
cagugcaggaagugagaugccu

SEQ ID NO: 219210 - RNA, 21 nt, Human
ggcagccugacccccagagag

SEQ ID NO: 219211 - RNA, 22 nt, Human
acugggcuguggacacccagcg

SEQ ID NO: 219212 - RNA, 22 nt, Human
cuccaccacacaucuguccacc

SEQ ID NO: 219213 - RNA, 22 nt, Human
uggaggaaaaaaccaggcagag

SEQ ID NO: 219214 - RNA, 22 nt, Human
ggccuuagagaccaccuagucu

SEQ ID NO: 219215 - RNA, 22 nt, Human
caauuucaucuugugcuucaau

SEQ ID NO: 219216 - RNA, 22 nt, Human
cuuacagagaagaaaauguagu

SEQ ID NO: 219217 - RNA, 22 nt, Human
cugugccuaagaugcaugucuc

SEQ ID NO: 219218 - RNA, 22 nt, Human
ugauaucuaccauaaccauucg

SEQ ID NO: 219219 - RNA, 22 nt, Human
uccaaauucuauguucuuucca

SEQ ID NO: 219220 - RNA, 22 nt, Human
ccugccaggcuuugggcuucug

SEQ ID NO: 219221 - RNA, 22 nt, Human
uaggccauucuuggagcuuacu

SEQ ID NO: 219222 - RNA, 22 nt, Human
cugggucccacagccugcuggg

SEQ ID NO: 219223 - RNA, 22 nt, Human
ugucauggcacugguaggagug

SEQ ID NO: 219224 - RNA, 22 nt, Human
aagucuuaaccaaauaaauguu

SEQ ID NO: 219225 - RNA, 22 nt, Human
auucagucaaaaaugauggaga

SEQ ID NO: 219226 - RNA, 22 nt, Human
cuguacagcaaguucaccuugg

SEQ ID NO: 219227 - RNA, 22 nt, Human
caaagucagggaagaguggcug

SEQ ID NO: 219228 - RNA, 22 nt, Human
ugccugggacaugcuguggacu

SEQ ID NO: 219229 - RNA, 22 nt, Human
caauuucuaacauuccauggau

SEQ ID NO: 219230 - RNA, 22 nt, Human
caaaaaacaccugugugaguau

SEQ ID NO: 219231 - RNA, 22 nt, Human
gccugcagggcccuuguggguc

SEQ ID NO: 219232 - RNA, 20 nt, Human
ucaugcagguguucuagguu

SEQ ID NO: 219233 - RNA, 22 nt, Human
acaaugaaagguauucugaacu

SEQ ID NO: 219234 - RNA, 22 nt, Human
acccaggguuccugggucccag

SEQ ID NO: 219235 - RNA, 22 nt, Human
ugagaaaagguugagaugauaa

SEQ ID NO: 219236 - RNA, 22 nt, Human
cuugaaguugcaaaacauuaau

SEQ ID NO: 219237 - RNA, 22 nt, Human
aauuaacaaauguagcugugau

SEQ ID NO: 219238 - RNA, 22 nt, Human
gggauggggucaacauguaccu

SEQ ID NO: 219239 - RNA, 22 nt, Human
ggauaguucuggauauuuuaag

SEQ ID NO: 219240 - RNA, 22 nt, Human
gcuccuggccagcacagggccc

SEQ ID NO: 219241 - RNA, 22 nt, Human
cagagccauccaggugccuguu

SEQ ID NO: 219242 - RNA, 22 nt, Human
uucuuguacuggagauacauga

SEQ ID NO: 219243 - RNA, 22 nt, Human
uacaucauggugagcaggaggc

SEQ ID NO: 219244 - RNA, 22 nt, Human
acaggagcucuagggacagcac

SEQ ID NO: 219245 - RNA, 22 nt, Human
ccuggcaguucaucaaauggca

SEQ ID NO: 219246 - RNA, 22 nt, Human
augcacuacuuggcuuuacuga

SEQ ID NO: 219247 - RNA, 22 nt, Human
caaauacaaauacgggcagcuu

SEQ ID NO: 219248 - RNA, 22 nt, Human
agccaggcagggcucucgcucu

SEQ ID NO: 219249 - RNA, 22 nt, Human
aggaccugaaauucuugcuuuu

SEQ ID NO: 219250 - RNA, 22 nt, Human
gggcugugcugaguaggaggug

SEQ ID NO: 219251 - RNA, 22 nt, Human
gaggugucacuauuuugcuuau

SEQ ID NO: 219252 - RNA, 22 nt, Human
auauguauguacgcacauauuc

SEQ ID NO: 219253 - RNA, 22 nt, Human
cugauucuuugaagaugcaccc

SEQ ID NO: 219254 - RNA, 22 nt, Human
aggcugaguuucucauucucgc

SEQ ID NO: 219255 - RNA, 22 nt, Human
aggacagcagugcuggcacuug

SEQ ID NO: 219256 - RNA, 22 nt, Human
aagaacugaguacguuaauaaa

SEQ ID NO: 219257 - RNA, 22 nt, Human
gcuuuugccuacaucuuggucu

SEQ ID NO: 219258 - RNA, 22 nt, Human
agcugccauccgaggugucaga

SEQ ID NO: 219259 - RNA, 22 nt, Human
ccaggcagaugggccggcuuca

SEQ ID NO: 219260 - RNA, 22 nt, Human
aggcuggcuuugguagcauggu

SEQ ID NO: 219261 - RNA, 21 nt, Human
accaggccaggaggcuggcac

SEQ ID NO: 219262 - RNA, 22 nt, Human
ccuugcucaucccccagugccu

SEQ ID NO: 219263 - RNA, 22 nt, Human
agagaaaagaguucaggcuuug

SEQ ID NO: 219264 - RNA, 22 nt, Human
aucuuucuuauuugaagaaaga

SEQ ID NO: 219265 - RNA, 22 nt, Human
uuugucauauagacuauuguga

SEQ ID NO: 219266 - RNA, 22 nt, Human
cagcagagcuuauuaacuaaaa

SEQ ID NO: 219267 - RNA, 22 nt, Human
guggaaugaauagauuugcauu

SEQ ID NO: 219268 - RNA, 19 nt, Human
uccuucuccggccaccccg

SEQ ID NO: 219269 - RNA, 22 nt, Human
uucacagaauggcaaguuaugg

SEQ ID NO: 219270 - RNA, 22 nt, Human
cacaggaggaggccagagcgua

SEQ ID NO: 219271 - RNA, 21 nt, Human
acaguucaugauaacuccauc

SEQ ID NO: 219272 - RNA, 22 nt, Human
gauguaaauggucuuuggcaga

SEQ ID NO: 219273 - RNA, 22 nt, Human
aagacagagacucugcaacagg

SEQ ID NO: 219274 - RNA, 22 nt, Human
ucauacaggcucaagcuauacg

SEQ ID NO: 219275 - RNA, 22 nt, Human
gagcagguuucaaugcugaugc

SEQ ID NO: 219276 - RNA, 17 nt, Human
ugaacuuuagguggagc

SEQ ID NO: 219277 - RNA, 22 nt, Human
ucccugccucucagacuuccuu

SEQ ID NO: 219278 - RNA, 22 nt, Human
cuuauucagcaaguuuggguac

SEQ ID NO: 219279 - RNA, 22 nt, Human
cucugaauggacacuccagugu

SEQ ID NO: 219280 - RNA, 22 nt, Human
guacauuucaguuuccuuaaga

SEQ ID NO: 219281 - RNA, 22 nt, Human
ggcucugcggcgugugcgcagg

SEQ ID NO: 219282 - RNA, 22 nt, Human
gaggccagaagugccucgggcu

SEQ ID NO: 219283 - RNA, 20 nt, Human
ugucaauagcacugaggcug

SEQ ID NO: 219284 - RNA, 22 nt, Human
ccuagacuagaggcagggagcc

SEQ ID NO: 219285 - RNA, 22 nt, Human
cuauuaggcuuccauuucaugc

SEQ ID NO: 219286 - RNA, 22 nt, Human
uaacaggguaggagggcaugaa

SEQ ID NO: 219287 - RNA, 21 nt, Human
acuggcugccaugauccaggg

SEQ ID NO: 219288 - RNA, 22 nt, Human
auauguauugagugccaacugu

SEQ ID NO: 219289 - RNA, 22 nt, Human
ugguccuugcuauagagugaua

SEQ ID NO: 219290 - RNA, 22 nt, Human
gcaguaguccauaaguacucug

SEQ ID NO: 219291 - RNA, 22 nt, Human
uucugggcccacuguagcaucc

SEQ ID NO: 219292 - RNA, 22 nt, Human
ucuuagaauugaagucagaggg

SEQ ID NO: 219293 - RNA, 22 nt, Human
guuuaucacaauaaauaauucu

SEQ ID NO: 219294 - RNA, 22 nt, Human
gagccagcuauguagcaagagg

SEQ ID NO: 219295 - RNA, 22 nt, Human
gcacagccuugcccugugcccu

SEQ ID NO: 219296 - RNA, 22 nt, Human
gucaccugaggggaggugacag

SEQ ID NO: 219297 - RNA, 22 nt, Human
uuaugauuuagaaagauucacu

SEQ ID NO: 219298 - RNA, 22 nt, Human
uuaaagcuggcguuacaguuug

SEQ ID NO: 219299 - RNA, 22 nt, Human
ccugccagaaaagagggaguuc

SEQ ID NO: 219300 - RNA, 22 nt, Human
caggcucagcucuggccagugc

SEQ ID NO: 219301 - RNA, 22 nt, Human
ucauuugucuggcacagggaau

SEQ ID NO: 219302 - RNA, 22 nt, Human
ucaggcuugggaggcccagggc

SEQ ID NO: 219303 - RNA, 22 nt, Human
acaggccuuggcaggcauguga

SEQ ID NO: 219304 - RNA, 22 nt, Human
ccuguauucaauuuugugugau

SEQ ID NO: 219305 - RNA, 22 nt, Human
gaugcaaagauaaaacagacgc

SEQ ID NO: 219306 - RNA, 22 nt, Human
cuggguguucacccgaggcgcu

SEQ ID NO: 219307 - RNA, 22 nt, Human
caggagcuggauaggaccacaa

SEQ ID NO: 219308 - RNA, 22 nt, Human
acagaauugaagcugaguaaau

SEQ ID NO: 219309 - RNA, 22 nt, Human
aaugaguucugguucauuuuau

SEQ ID NO: 219310 - RNA, 23 nt, Human
aaaggcaggccuaggacauauug

SEQ ID NO: 219311 - RNA, 22 nt, Human
gccagguguccucacagugagg

SEQ ID NO: 219312 - RNA, 22 nt, Human
uuuucuauucauugucuauggu

SEQ ID NO: 219313 - RNA, 22 nt, Human
uuguuauaaagacuaaauaugu

SEQ ID NO: 219314 - RNA, 22 nt, Human
cugggaagcuucgagcaggaaa

SEQ ID NO: 219315 - RNA, 22 nt, Human
acuauuuacucaaaugagguug

SEQ ID NO: 219316 - RNA, 22 nt, Human
auuguuccuggaaaagaacagg

SEQ ID NO: 219317 - RNA, 22 nt, Human
ucuuauuauuguuguaaaagca

SEQ ID NO: 219318 - RNA, 22 nt, Human
uuaggaaaggaacauugaaacg

SEQ ID NO: 219319 - RNA, 21 nt, Human
gaacauuuggguuguuucuac

SEQ ID NO: 219320 - RNA, 22 nt, Human
ccauucuuucagugucucaugu

SEQ ID NO: 219321 - RNA, 22 nt, Human
cccagccaaaagcaaguuuacc

SEQ ID NO: 219322 - RNA, 16 nt, Human
uccaguuuucagcacu

SEQ ID NO: 219323 - RNA, 22 nt, Human
guggggaaaggaguggggcuca

SEQ ID NO: 219324 - RNA, 22 nt, Human
cacacauugguuuuacuccuuu

SEQ ID NO: 219325 - RNA, 22 nt, Human
ggcaggugcugggagcaucuca

SEQ ID NO: 219326 - RNA, 22 nt, Human
cauggcucggggacaggaggua

SEQ ID NO: 219327 - RNA, 22 nt, Human
uccaugcaaacaguggcuagcu

SEQ ID NO: 219328 - RNA, 22 nt, Human
cggcuuccaacaagcuuugcug

SEQ ID NO: 219329 - RNA, 22 nt, Human
auauaauucucagguuugacua

SEQ ID NO: 219330 - RNA, 22 nt, Human
gaaaacacuuugaucugaaagu

SEQ ID NO: 219331 - RNA, 18 nt, Human
aggcaggcuggagugacu

SEQ ID NO: 219332 - RNA, 22 nt, Human
uauaagcacauccuugacugau

SEQ ID NO: 219333 - RNA, 22 nt, Human
ugcccuggggagcccagccagg

SEQ ID NO: 219334 - RNA, 22 nt, Human
gcugugcauugagccugagagu

SEQ ID NO: 219335 - RNA, 22 nt, Human
acuuauuucauggaucauaaug

SEQ ID NO: 219336 - RNA, 22 nt, Human
ggcagccaguagggccagccug

SEQ ID NO: 219337 - RNA, 22 nt, Human
gagaaaugcuagcuuaggaauc

SEQ ID NO: 219338 - RNA, 22 nt, Human
cuggccuuuuguuucuggagaa

SEQ ID NO: 219339 - RNA, 22 nt, Human
gggcagguguugucaaucuaau

SEQ ID NO: 219340 - RNA, 22 nt, Human
uggaaucuguauguauguauaa

SEQ ID NO: 219341 - RNA, 22 nt, Human
uccugaagaacgaagucaugua

SEQ ID NO: 219342 - RNA, 22 nt, Human
caguggggaggccaggauagaa

SEQ ID NO: 219343 - RNA, 20 nt, Human
uauaugcagccaacacuccc

SEQ ID NO: 219344 - RNA, 22 nt, Human
uuugcacuagcauuuguccaug

SEQ ID NO: 219345 - RNA, 22 nt, Human
cugcccugucuuuuucugauga

SEQ ID NO: 219346 - RNA, 21 nt, Human
ggcaggugggucucuguugcu

SEQ ID NO: 219347 - RNA, 22 nt, Human
cugguuugucuugggaggaugu

SEQ ID NO: 219348 - RNA, 23 nt, Human
uuaaggagcuugcacucugggug

SEQ ID NO: 219349 - RNA, 22 nt, Human
ugugaaggagcaugcagagggg

SEQ ID NO: 219350 - RNA, 23 nt, Human
cauguacacacagcuguacagug

SEQ ID NO: 219351 - RNA, 22 nt, Human
cugcccugugaggguccuuggg

SEQ ID NO: 219352 - RNA, 22 nt, Human
guuuacaaauauuuuaaauggu

SEQ ID NO: 219353 - RNA, 22 nt, Human
ccaccuccucggccaugugacg

SEQ ID NO: 219354 - RNA, 22 nt, Human
aacagacauauuuuuaauaugc

SEQ ID NO: 219355 - RNA, 22 nt, Human
auagaaaacagauguccuuaaa

SEQ ID NO: 219356 - RNA, 22 nt, Human
gacagcagcauaauacaugaac

SEQ ID NO: 219357 - RNA, 18 nt, Human
cccccagccaaauucucu

SEQ ID NO: 219358 - RNA, 22 nt, Human
uaagagcuuagcuaaggaugug

SEQ ID NO: 219359 - RNA, 22 nt, Human
ggcuuucuagaucuagcucugu

SEQ ID NO: 219360 - RNA, 22 nt, Human
cagagggugugaaggggaugaa

SEQ ID NO: 219361 - RNA, 22 nt, Human
cugagacacggagaggcugugu

SEQ ID NO: 219362 - RNA, 22 nt, Human
cagguucuggagaugcagagau

SEQ ID NO: 219363 - RNA, 22 nt, Human
auguaaaguaaucugucgauca

SEQ ID NO: 219364 - RNA, 22 nt, Human
cuuaggauuuaauuucagacuc

SEQ ID NO: 219365 - RNA, 22 nt, Human
ggaaggcuacaggaauccagcg

SEQ ID NO: 219366 - RNA, 22 nt, Human
guauauauuggauaaaccagag

SEQ ID NO: 219367 - RNA, 18 nt, Human
uucuccagaaaacauagc

SEQ ID NO: 219368 - RNA, 23 nt, Human
ggcucagaaaaaguccuggccuc

SEQ ID NO: 219369 - RNA, 22 nt, Human
ugcuauuuaacuuuuaugugua

SEQ ID NO: 219370 - RNA, 19 nt, Human
cuacuuuauaauaugccuc

SEQ ID NO: 219371 - RNA, 22 nt, Human
agcagaguuucucaacaucagc

SEQ ID NO: 219372 - RNA, 22 nt, Human
uuucacaucaugggauggaagc

SEQ ID NO: 219373 - RNA, 22 nt, Human
acaguuugcccugacauucucc

SEQ ID NO: 219374 - RNA, 22 nt, Human
cagauauguggauucuauuagc

SEQ ID NO: 219375 - RNA, 22 nt, Human
cucagagcucgugggaccuugg

SEQ ID NO: 219376 - RNA, 23 nt, Human
aguggcuggacagacuuuccugg

SEQ ID NO: 219377 - RNA, 22 nt, Human
acaguucuuuggauggaagaau

SEQ ID NO: 219378 - RNA, 22 nt, Human
aucugagacugaguuuggauuu

SEQ ID NO: 219379 - RNA, 22 nt, Human
caaggcugcugcgggucgcacc

SEQ ID NO: 219380 - RNA, 22 nt, Human
acucuuauaguauugguuauua

SEQ ID NO: 219381 - RNA, 22 nt, Human
aauugacaaaucauacuuguau

SEQ ID NO: 219382 - RNA, 22 nt, Human
gguaaaaaucacaaauacuuua

SEQ ID NO: 219383 - RNA, 22 nt, Human
gcaaaggcuucuuuuauucucc

SEQ ID NO: 219384 - RNA, 22 nt, Human
gagucugagucuaauggcccca

SEQ ID NO: 219385 - RNA, 21 nt, Human
agcagcugggcaacauggagg

SEQ ID NO: 219386 - RNA, 22 nt, Human
cucacuguccaacaggcuuuac

SEQ ID NO: 219387 - RNA, 22 nt, Human
aggucagcccucucugggcagg

SEQ ID NO: 219388 - RNA, 22 nt, Human
gagcccagcugcggcccucagc

SEQ ID NO: 219389 - RNA, 22 nt, Human
aguggccaccaugccagcucuc

SEQ ID NO: 219390 - RNA, 22 nt, Human
cugcugccccugagcucagccu

SEQ ID NO: 219391 - RNA, 22 nt, Human
ccaguccauauuuauacugccg

SEQ ID NO: 219392 - RNA, 22 nt, Human
ccugaguuaguugcugugucuc

SEQ ID NO: 219393 - RNA, 22 nt, Human
cugccuguggucugugaucuaa

SEQ ID NO: 219394 - RNA, 22 nt, Human
augcaggagaccaauuggaugg

SEQ ID NO: 219395 - RNA, 22 nt, Human
gcaggugugcugaauuacguga

SEQ ID NO: 219396 - RNA, 22 nt, Human
ugacugccgauuguccuucucu

SEQ ID NO: 219397 - RNA, 22 nt, Human
acauguguacauauauaugugc

SEQ ID NO: 219398 - RNA, 22 nt, Human
gcuuccuggagggagagagcug

SEQ ID NO: 219399 - RNA, 22 nt, Human
uuuauuggauauuuacaagaua

SEQ ID NO: 219400 - RNA, 22 nt, Human
uuuguguuguuuuaagccacua

SEQ ID NO: 219401 - RNA, 22 nt, Human
guauuagguuggugcaaaagua

SEQ ID NO: 219402 - RNA, 22 nt, Human
uugcuuuaucuaagcauggcca

SEQ ID NO: 219403 - RNA, 22 nt, Human
gcagcucugacaaugccuggaa

SEQ ID NO: 219404 - RNA, 22 nt, Human
gaucacauaauuuggaaacagc

SEQ ID NO: 219405 - RNA, 22 nt, Human
ugaaguuuuacuaggugaauuu

SEQ ID NO: 219406 - RNA, 22 nt, Human
cagcagcuccaaagaauagcca

SEQ ID NO: 219407 - RNA, 22 nt, Human
aaagcagguugcaauuacagug

SEQ ID NO: 219408 - RNA, 22 nt, Human
gcuucucucucagacugcaagc

SEQ ID NO: 219409 - RNA, 22 nt, Human
acuccccagacugccaugcugg

SEQ ID NO: 219410 - RNA, 22 nt, Human
uacacuguguaaaaugcacuuu

SEQ ID NO: 219411 - RNA, 22 nt, Human
aggugccauugcuugccaguuu

SEQ ID NO: 219412 - RNA, 22 nt, Human
gggaccuggacaugugugugcu

SEQ ID NO: 219413 - RNA, 22 nt, Human
ucuggcagcaagucuguuucuc

SEQ ID NO: 219414 - RNA, 22 nt, Human
ugagccagaguggagugugccu

SEQ ID NO: 219415 - RNA, 23 nt, Human
uggaaugagcugggaagcugagc

SEQ ID NO: 219416 - RNA, 22 nt, Human
gagggagaaggacuaucaggcu

SEQ ID NO: 219417 - RNA, 19 nt, Human
uuucagacauuucaaauuu

SEQ ID NO: 219418 - RNA, 22 nt, Human
ccaggcagagugcuccagaaag

SEQ ID NO: 219419 - RNA, 22 nt, Human
uguggucuuggaagaaguugcu

SEQ ID NO: 219420 - RNA, 23 nt, Human
cugcagagaacugagggacagcc

SEQ ID NO: 219421 - RNA, 18 nt, Human
uuccaugauuccuuucac

SEQ ID NO: 219422 - RNA, 22 nt, Human
aaagcaguauaaguaacggaag

SEQ ID NO: 219423 - RNA, 18 nt, Human
ucuuuggacaacuacugg

SEQ ID NO: 219424 - RNA, 22 nt, Human
ucucccagaaguccucaguaca

SEQ ID NO: 219425 - RNA, 20 nt, Human
aucuuugucucuguaguugu

SEQ ID NO: 219426 - RNA, 22 nt, Human
agcagcaauaauaaaguaauac

SEQ ID NO: 219427 - RNA, 22 nt, Human
acagcuggcaggggggcaugaa

SEQ ID NO: 219428 - RNA, 22 nt, Human
ccauagcaagaggagcagaaau

SEQ ID NO: 219429 - RNA, 20 nt, Human
uauuccaaggguagagaaaa

SEQ ID NO: 219430 - RNA, 22 nt, Human
guacaauaacuagucuuauagu

SEQ ID NO: 219431 - RNA, 22 nt, Human
ucagauggauucauuacaugac

SEQ ID NO: 219432 - RNA, 22 nt, Human
acuccuggggcugccaucacag

SEQ ID NO: 219433 - RNA, 22 nt, Human
agaucaaaucugggauuucuaa

SEQ ID NO: 219434 - RNA, 22 nt, Human
agaguggcuugcucagcuagca

SEQ ID NO: 219435 - RNA, 22 nt, Human
ucaguuaaugguaagggugaaa

SEQ ID NO: 219436 - RNA, 22 nt, Human
aaagcugcuuuaaacaucuaug

SEQ ID NO: 219437 - RNA, 22 nt, Human
ugucugugugagcaaaugacuu

SEQ ID NO: 219438 - RNA, 22 nt, Human
aguuuuauuccaaugugcagca

SEQ ID NO: 219439 - RNA, 22 nt, Human
aggguaggguaaaugaugcauc

SEQ ID NO: 219440 - RNA, 22 nt, Human
cagguuggucggcaaguacaca

SEQ ID NO: 219441 - RNA, 22 nt, Human
ccugccuggggacaaaggaggg

SEQ ID NO: 219442 - RNA, 22 nt, Human
gggggugguucuaaguccuaua

SEQ ID NO: 219443 - RNA, 23 nt, Human
aggaagcccauuuuagucuaccu

SEQ ID NO: 219444 - RNA, 22 nt, Human
ugguccuggccuugaccccagg

SEQ ID NO: 219445 - RNA, 22 nt, Human
ggcugccucuauuuaggaucaa

SEQ ID NO: 219446 - RNA, 22 nt, Human
aggucugguauuuuucuauacu

SEQ ID NO: 219447 - RNA, 22 nt, Human
aggagaccuucaccacuuccac

SEQ ID NO: 219448 - RNA, 22 nt, Human
ugccgugucccauugugcucug

SEQ ID NO: 219449 - RNA, 22 nt, Human
caggagcuacucagguuggguu

SEQ ID NO: 219450 - RNA, 22 nt, Human
aagaaguuggaaaugauugaga

SEQ ID NO: 219451 - RNA, 22 nt, Human
agcaguuauguucuauaaaguc

SEQ ID NO: 219452 - RNA, 22 nt, Human
aggagucagauuguuugaaugu

SEQ ID NO: 219453 - RNA, 22 nt, Human
guacauuucauuuaaaugaugu

SEQ ID NO: 219454 - RNA, 22 nt, Human
agcaacaggaauauuauggcaa

SEQ ID NO: 219455 - RNA, 22 nt, Human
caggaugguggcaugaucagaa

SEQ ID NO: 219456 - RNA, 22 nt, Human
ugaggcuuagauuugguaacuc

SEQ ID NO: 219457 - RNA, 22 nt, Human
ggcagcucugcuccuuggcucc

SEQ ID NO: 219458 - RNA, 22 nt, Human
acccagcaaagauaaacuuaug

SEQ ID NO: 219459 - RNA, 22 nt, Human
uacagaaaaacaucuggagccg

SEQ ID NO: 219460 - RNA, 22 nt, Human
ucucagagccuaacuaaccuaa

SEQ ID NO: 219461 - RNA, 22 nt, Human
ggccucugggguccugagccca

SEQ ID NO: 219462 - RNA, 22 nt, Human
uuuaacuugaucaguagagcau

SEQ ID NO: 219463 - RNA, 22 nt, Human
uccuggcccacuaugccagcau

SEQ ID NO: 219464 - RNA, 22 nt, Human
ucccaaggccaggcaucuagaa

SEQ ID NO: 219465 - RNA, 19 nt, Human
gagggcucauuugaacaau

SEQ ID NO: 219466 - RNA, 22 nt, Human
ugagaggcuagaucagcucugu

SEQ ID NO: 219467 - RNA, 22 nt, Human
acaaacaucuugaccucagauu

SEQ ID NO: 219468 - RNA, 22 nt, Human
auguguuuauaauuacucaauc

SEQ ID NO: 219469 - RNA, 22 nt, Human
ggcagcucacgggcauggggug

SEQ ID NO: 219470 - RNA, 22 nt, Human
ucagugucuauagauaagguuu

SEQ ID NO: 219471 - RNA, 22 nt, Human
agugacuucuccuaaugucaua

SEQ ID NO: 219472 - RNA, 22 nt, Human
agcaggaacucagggaguucuc

SEQ ID NO: 219473 - RNA, 19 nt, Human
ucuuuguacaagucucugc

SEQ ID NO: 219474 - RNA, 22 nt, Human
cucaggaguaguucagcagcug

SEQ ID NO: 219475 - RNA, 22 nt, Human
cacucaggcugugucaggagga

SEQ ID NO: 219476 - RNA, 22 nt, Human
caggcuugauuauucagacaau

SEQ ID NO: 219477 - RNA, 22 nt, Human
caggaggcagagguugcagcga

SEQ ID NO: 219478 - RNA, 22 nt, Human
ggcugaaauucagaguaaauuc

SEQ ID NO: 219479 - RNA, 22 nt, Human
agccagucggggccaugcuggg

SEQ ID NO: 219480 - RNA, 22 nt, Human
auccagagagguuaggugacau

SEQ ID NO: 219481 - RNA, 22 nt, Human
gagccuucaucgcagccuuguu

SEQ ID NO: 219482 - RNA, 22 nt, Human
uauaaauuauuaggcugcuaaa

SEQ ID NO: 219483 - RNA, 22 nt, Human
cccagaggaggcaaagcucugu

SEQ ID NO: 219484 - RNA, 22 nt, Human
uccagagagaaaaacaagcuuu

SEQ ID NO: 219485 - RNA, 22 nt, Human
ugcugaaagucccaaaucucau

SEQ ID NO: 219486 - RNA, 22 nt, Human
gggcugaccaaugccuugcuuu

SEQ ID NO: 219487 - RNA, 22 nt, Human
aaggagagagcuuugcuggaac

SEQ ID NO: 219488 - RNA, 22 nt, Human
aauagaacaauaauuguaaacu

SEQ ID NO: 219489 - RNA, 22 nt, Human
gaucuuuauacuguaauaauga

SEQ ID NO: 219490 - RNA, 22 nt, Human
gcagaugccagaucaugcaggg

SEQ ID NO: 219491 - RNA, 22 nt, Human
ccugcagagccacgugccagcg

SEQ ID NO: 219492 - RNA, 22 nt, Human
acaugcaaagggaugcaauuau

SEQ ID NO: 219493 - RNA, 21 nt, Human
uccugcagggcagcagagugg

SEQ ID NO: 219494 - RNA, 22 nt, Human
cucaugucggcaggacucgccc

SEQ ID NO: 219495 - RNA, 22 nt, Human
uggcugagaaaaugguuuuagg

SEQ ID NO: 219496 - RNA, 22 nt, Human
ggagccugaaaagucugcauuu

SEQ ID NO: 219497 - RNA, 22 nt, Human
ggccucugguucacagggagga

SEQ ID NO: 219498 - RNA, 22 nt, Human
gcucaggccuccagaggggcaa

SEQ ID NO: 219499 - RNA, 22 nt, Human
auagaagaggaaacugagguug

SEQ ID NO: 219500 - RNA, 22 nt, Human
ugccagggugucaggagagcua

SEQ ID NO: 219501 - RNA, 22 nt, Human
gcugccauguugugaggacacu

SEQ ID NO: 219502 - RNA, 22 nt, Human
agcccugcacaggucuguggcu

SEQ ID NO: 219503 - RNA, 22 nt, Human
cuuucaaaacgcucuguaugca

SEQ ID NO: 219504 - RNA, 22 nt, Human
uucacuguacugacugucuuau

SEQ ID NO: 219505 - RNA, 22 nt, Human
gaaccauuucugaauaguuugu

SEQ ID NO: 219506 - RNA, 22 nt, Human
cgcaggcacagaguggacagcg

SEQ ID NO: 219507 - RNA, 22 nt, Human
cuccaggccccuggccuucugc

SEQ ID NO: 219508 - RNA, 22 nt, Human
aaggcugguuuccuugauguuu

SEQ ID NO: 219509 - RNA, 22 nt, Human
acuuucugugguuaccagggag

SEQ ID NO: 219510 - RNA, 22 nt, Human
cgcaggcuggcgcggaguggca

SEQ ID NO: 219511 - RNA, 22 nt, Human
uuuaauagggcccaaugagacu

SEQ ID NO: 219512 - RNA, 22 nt, Human
ggguaagcugcuuuaucucucu

SEQ ID NO: 219513 - RNA, 22 nt, Human
aaaugcaugagaaaguauucug

SEQ ID NO: 219514 - RNA, 22 nt, Human
caguuucuauggcugggcucug

SEQ ID NO: 219515 - RNA, 22 nt, Human
uucaaugccuagaacuuagcau

SEQ ID NO: 219516 - RNA, 22 nt, Human
ucugccuggguguggagcagag

SEQ ID NO: 219517 - RNA, 22 nt, Human
ugugugugcaggagagcaggug

SEQ ID NO: 219518 - RNA, 22 nt, Human
gcagagcucaugccugcaccuc

SEQ ID NO: 219519 - RNA, 22 nt, Human
auucuucaguauguguggauug

SEQ ID NO: 219520 - RNA, 22 nt, Human
aggcaggcaaccaccugggaag

SEQ ID NO: 219521 - RNA, 22 nt, Human
uuccuuucacguuuuaaugcac

SEQ ID NO: 219522 - RNA, 22 nt, Human
auuuauuaugggauuuggcaca

SEQ ID NO: 219523 - RNA, 22 nt, Human
agguccuggugaccauggaguu

SEQ ID NO: 219524 - RNA, 21 nt, Human
gcacuucugcagggcugcugg

SEQ ID NO: 219525 - RNA, 22 nt, Human
gagagaaaggcuugcaggcugu

SEQ ID NO: 219526 - RNA, 22 nt, Human
gcuccugggcucuaccuugcua

SEQ ID NO: 219527 - RNA, 22 nt, Human
ucugugaaaggaaagaacugac

SEQ ID NO: 219528 - RNA, 22 nt, Human
cauauaucuaccugcaauugca

SEQ ID NO: 219529 - RNA, 22 nt, Human
acagcucuucuucaagccuggc

SEQ ID NO: 219530 - RNA, 22 nt, Human
uacuuuuuaugauaagaacuga

SEQ ID NO: 219531 - RNA, 22 nt, Human
uuagaaaauggaggugggaggg

SEQ ID NO: 219532 - RNA, 22 nt, Human
acugcaauuauuuguucaccaa

SEQ ID NO: 219533 - RNA, 22 nt, Human
uggaaacuaagacuagagagac

SEQ ID NO: 219534 - RNA, 22 nt, Human
ggguuucaugguucucacaaug

SEQ ID NO: 219535 - RNA, 22 nt, Human
uauuguauuaaggauucaagua

SEQ ID NO: 219536 - RNA, 22 nt, Human
caggcacacauccgugagagau

SEQ ID NO: 219537 - RNA, 22 nt, Human
cacacuuuuggcauguuugguu

SEQ ID NO: 219538 - RNA, 22 nt, Human
cacagcagagggagccauugaa

SEQ ID NO: 219539 - RNA, 20 nt, Human
cucugcagcaaggccugggu

SEQ ID NO: 219540 - RNA, 22 nt, Human
aagcaauauacugauaugauua

SEQ ID NO: 219541 - RNA, 22 nt, Human
aaggaacucacagucuguuggg

SEQ ID NO: 219542 - RNA, 22 nt, Human
gcagggcagggcaagaacuggg

SEQ ID NO: 219543 - RNA, 22 nt, Human
gggugaagcuccugcaggggcc

SEQ ID NO: 219544 - RNA, 22 nt, Human
uuguacuaucaccaugucaugu

SEQ ID NO: 219545 - RNA, 22 nt, Human
acaaugaugcagaugaguaaga

SEQ ID NO: 219546 - RNA, 22 nt, Human
guguccuuaugcauaccagagu

SEQ ID NO: 219547 - RNA, 19 nt, Human
caugugucaauacuguacc

SEQ ID NO: 219548 - RNA, 22 nt, Human
cagcugguuggaagggagcuga

SEQ ID NO: 219549 - RNA, 22 nt, Human
agucauuuugcuaaaugagggu

SEQ ID NO: 219550 - RNA, 22 nt, Human
uacagccugauuuggagccacu

SEQ ID NO: 219551 - RNA, 22 nt, Human
cagaagcuuugucuagucuuga

SEQ ID NO: 219552 - RNA, 22 nt, Human
ugugcccuguuaaaugcacagu

SEQ ID NO: 219553 - RNA, 17 nt, Human
ggaggcaacagacaggg

SEQ ID NO: 219554 - RNA, 22 nt, Human
uaguggagaaguggagucugug

SEQ ID NO: 219555 - RNA, 22 nt, Human
cgcaacagagcagguuugauga

SEQ ID NO: 219556 - RNA, 22 nt, Human
ccacucagcacaguggaugcag

SEQ ID NO: 219557 - RNA, 23 nt, Human
uggcccugugcaugcugcuuccc

SEQ ID NO: 219558 - RNA, 22 nt, Human
ucugccuucuuuuagucaucuu

SEQ ID NO: 219559 - RNA, 21 nt, Human
ccugugccagucuauguguuc

SEQ ID NO: 219560 - RNA, 22 nt, Human
ucuccaggaagcccucccugac

SEQ ID NO: 219561 - RNA, 22 nt, Human
acccugggcuuggccugcucag

SEQ ID NO: 219562 - RNA, 22 nt, Human
caauaacuuugauauuuugcgg

SEQ ID NO: 219563 - RNA, 22 nt, Human
gaccauuucuaggaaucagacu

SEQ ID NO: 219564 - RNA, 22 nt, Human
gagugaguuggaaaacagacac

SEQ ID NO: 219565 - RNA, 22 nt, Human
aggcuggcugaaaaacacccuu

SEQ ID NO: 219566 - RNA, 22 nt, Human
ucacagacuggucagucaacuu

SEQ ID NO: 219567 - RNA, 22 nt, Human
gcacuuaggguauguacugggc

SEQ ID NO: 219568 - RNA, 22 nt, Human
ucacagacacagggagaagcau

SEQ ID NO: 219569 - RNA, 22 nt, Human
aaggcugugucagaagcucccu

SEQ ID NO: 219570 - RNA, 22 nt, Human
uuuauaguuauauacagauguu

SEQ ID NO: 219571 - RNA, 22 nt, Human
aauucuuguuguuaguauauuu

SEQ ID NO: 219572 - RNA, 22 nt, Human
gucagacacauuucuuucagug

SEQ ID NO: 219573 - RNA, 22 nt, Human
aucucaaaugauuacaccaagc

SEQ ID NO: 219574 - RNA, 22 nt, Human
uaguucuucaugaauucagcuu

SEQ ID NO: 219575 - RNA, 22 nt, Human
cuccucuggguccugguggcca

SEQ ID NO: 219576 - RNA, 22 nt, Human
acugggaagacaagaaagauag

SEQ ID NO: 219577 - RNA, 22 nt, Human
ucauggcuaaugcaguauauuc

SEQ ID NO: 219578 - RNA, 22 nt, Human
aucuaaaaugugguuaguuggu

SEQ ID NO: 219579 - RNA, 22 nt, Human
ccagaagggcuauugcagugac

SEQ ID NO: 219580 - RNA, 22 nt, Human
gcugguccacucccuggaggcu

SEQ ID NO: 219581 - RNA, 22 nt, Human
auggcuggucucccauggaaaa

SEQ ID NO: 219582 - RNA, 22 nt, Human
gaggcccaggguacaggccgcu

SEQ ID NO: 219583 - RNA, 22 nt, Human
ugaggcagauauuuauuggguu

SEQ ID NO: 219584 - RNA, 22 nt, Human
aaaaccacaauuacuuuugcac

SEQ ID NO: 219585 - RNA, 22 nt, Human
uuccugugugacucaagugguu

SEQ ID NO: 219586 - RNA, 19 nt, Human
aagcuccagcagauccuuu

SEQ ID NO: 219587 - RNA, 22 nt, Human
ccugcucuagacucugggaagg

SEQ ID NO: 219588 - RNA, 22 nt, Human
agcccugguagccugcugccau

SEQ ID NO: 219589 - RNA, 19 nt, Human
gggcccagcauggaggguu

SEQ ID NO: 219590 - RNA, 22 nt, Human
uacaguuacuguuauaugugcu

SEQ ID NO: 219591 - RNA, 22 nt, Human
uaauuucaauagcuugcauaau

SEQ ID NO: 219592 - RNA, 22 nt, Human
cggggcugaggcaacgcggaga

SEQ ID NO: 219593 - RNA, 22 nt, Human
uccaggcuggccucgcgugaca

SEQ ID NO: 219594 - RNA, 22 nt, Human
caaacuuucaguuauaacauga

SEQ ID NO: 219595 - RNA, 19 nt, Human
ccucccacggauuccuucc

SEQ ID NO: 219596 - RNA, 22 nt, Human
ugcuggagagccuuggccaagg

SEQ ID NO: 219597 - RNA, 22 nt, Human
agaagccaauucugugugaguc

SEQ ID NO: 219598 - RNA, 22 nt, Human
uucuuacagaguuuacagagcc

SEQ ID NO: 219599 - RNA, 22 nt, Human
cugagguguuuaguaggggcgg

SEQ ID NO: 219600 - RNA, 22 nt, Human
aaucauucuuauuucacagcaa

SEQ ID NO: 219601 - RNA, 22 nt, Human
caguauuuguucccuaucaaug

SEQ ID NO: 219602 - RNA, 17 nt, Human
aagaacacucaauagca

SEQ ID NO: 219603 - RNA, 22 nt, Human
cucagggcuugaguguccagga

SEQ ID NO: 219604 - RNA, 22 nt, Human
aaagcuaugaggcaugcauuuc

SEQ ID NO: 219605 - RNA, 22 nt, Human
ggccaugccaggcugccuggga

SEQ ID NO: 219606 - RNA, 22 nt, Human
aguacaugcagaacuaacagau

SEQ ID NO: 219607 - RNA, 22 nt, Human
uuacaagugucagguacuggca

SEQ ID NO: 219608 - RNA, 22 nt, Human
uagaaacuacuagaauaagaga

SEQ ID NO: 219609 - RNA, 17 nt, Human
ugagcuucaaucaggug

SEQ ID NO: 219610 - RNA, 23 nt, Human
caggacaugggaggaaguauggc

SEQ ID NO: 219611 - RNA, 22 nt, Human
aguguauugucucacaguucuu

SEQ ID NO: 219612 - RNA, 22 nt, Human
aucacaaaggguuuucucugag

SEQ ID NO: 219613 - RNA, 22 nt, Human
accacagcuuugcaccaggugu

SEQ ID NO: 219614 - RNA, 22 nt, Human
gcucuggcuacuccacccuguu

SEQ ID NO: 219615 - RNA, 22 nt, Human
gauggcagcagcagccagggau

SEQ ID NO: 219616 - RNA, 22 nt, Human
uaucuaaauggaauauuccaga

SEQ ID NO: 219617 - RNA, 21 nt, Human
uuuaaagaauaggaagggagg

SEQ ID NO: 219618 - RNA, 22 nt, Human
ggagcugaguucuucagccggg

SEQ ID NO: 219619 - RNA, 22 nt, Human
acuuucuuggucccauguuuga

SEQ ID NO: 219620 - RNA, 22 nt, Human
auguaguugaagugcuauaaag

SEQ ID NO: 219621 - RNA, 23 nt, Human
acacauuuuucccguucugaggu

SEQ ID NO: 219622 - RNA, 22 nt, Human
acagaaaaguuuacuuuugcuc

SEQ ID NO: 219623 - RNA, 22 nt, Human
ucucagagcuucaguuauuuuc

SEQ ID NO: 219624 - RNA, 22 nt, Human
agcacugugagcaccagcacgc

SEQ ID NO: 219625 - RNA, 22 nt, Human
uacagagaggugacccuugggc

SEQ ID NO: 219626 - RNA, 23 nt, Human
uaaucucuucaagagaaggggaa

SEQ ID NO: 219627 - RNA, 22 nt, Human
aggaugagauuccagggucaau

SEQ ID NO: 219628 - RNA, 22 nt, Human
uggcuucugguuuauccuuaua

SEQ ID NO: 219629 - RNA, 22 nt, Human
agcaggcugaugggcaugcuug

SEQ ID NO: 219630 - RNA, 22 nt, Human
uggcagagaacacacaugauuc

SEQ ID NO: 219631 - RNA, 22 nt, Human
caggccuugucaagaaaaugcc

SEQ ID NO: 219632 - RNA, 20 nt, Human
acauccuggugacuagaacu

SEQ ID NO: 219633 - RNA, 22 nt, Human
aagaacauaacagaagcugugu

SEQ ID NO: 219634 - RNA, 22 nt, Human
ugccaggcauuugacagacacu

SEQ ID NO: 219635 - RNA, 22 nt, Human
ccccuccuggccacacugucag

SEQ ID NO: 219636 - RNA, 22 nt, Human
accuccuggcugcucauggaac

SEQ ID NO: 219637 - RNA, 22 nt, Human
ccuuagaaauguaccaaaggaa

SEQ ID NO: 219638 - RNA, 22 nt, Human
cacaagacuuauuuguguagaa

SEQ ID NO: 219639 - RNA, 19 nt, Human
uguguucauucaucagagg

SEQ ID NO: 219640 - RNA, 22 nt, Human
cuggccugccugccgguugucg

SEQ ID NO: 219641 - RNA, 22 nt, Human
uucccuuuguuaaauuggaaga

SEQ ID NO: 219642 - RNA, 22 nt, Human
auuccacagcuacaucaaucua

SEQ ID NO: 219643 - RNA, 22 nt, Human
cuaaagcaacugagacacauag

SEQ ID NO: 219644 - RNA, 22 nt, Human
cucucuggguccucuuuuauag

SEQ ID NO: 219645 - RNA, 22 nt, Human
ucaagcaaucucugugucccug

SEQ ID NO: 219646 - RNA, 22 nt, Human
gauccacaggaaccaaaacgca

SEQ ID NO: 219647 - RNA, 22 nt, Human
gcacacauauauaugagcaugu

SEQ ID NO: 219648 - RNA, 22 nt, Human
acuggcagaacuggugauuguc

SEQ ID NO: 219649 - RNA, 22 nt, Human
uaacaauaguguuugcuaguca

SEQ ID NO: 219650 - RNA, 22 nt, Human
cacaaauguaguagcuuaaaac

SEQ ID NO: 219651 - RNA, 22 nt, Human
gccaggacuagagggaggugag

SEQ ID NO: 219652 - RNA, 22 nt, Human
cucucaugagcauuccuaaggg

SEQ ID NO: 219653 - RNA, 22 nt, Human
cuuacaaaggagaggagauagg

SEQ ID NO: 219654 - RNA, 22 nt, Human
aggcuuagacuaccuggucugu

SEQ ID NO: 219655 - RNA, 20 nt, Human
aaugaggucccacugaggag

SEQ ID NO: 219656 - RNA, 20 nt, Human
aaacuaaagguguuugguuu

SEQ ID NO: 219657 - RNA, 22 nt, Human
ucaaucacguguuccauguucu

SEQ ID NO: 219658 - RNA, 22 nt, Human
aggcuucccaagcagcugcaaa

SEQ ID NO: 219659 - RNA, 18 nt, Human
uacaggaagggguucucg

SEQ ID NO: 219660 - RNA, 22 nt, Human
cagcggaggacagaugggagcu

SEQ ID NO: 219661 - RNA, 22 nt, Human
aaaaucuugugacuuaggaagg

SEQ ID NO: 219662 - RNA, 21 nt, Human
cuggagcuuggugagaagugu

SEQ ID NO: 219663 - RNA, 22 nt, Human
cacacaugaaucccuaguaccu

SEQ ID NO: 219664 - RNA, 22 nt, Human
cuuuguuaggggcucagggugg

SEQ ID NO: 219665 - RNA, 22 nt, Human
gcagaauagggcauaacuuugc

SEQ ID NO: 219666 - RNA, 22 nt, Human
guccuucaagguccuuggugug

SEQ ID NO: 219667 - RNA, 22 nt, Human
cuaagaaauguugugaaugcca

SEQ ID NO: 219668 - RNA, 22 nt, Human
uagaacaugugaaaauauagcc

SEQ ID NO: 219669 - RNA, 22 nt, Human
gcccaggggcagcgcauagugg

SEQ ID NO: 219670 - RNA, 22 nt, Human
accuguuuguuaagaaagcuuc

SEQ ID NO: 219671 - RNA, 22 nt, Human
uuccaagugcccauauuucauc

SEQ ID NO: 219672 - RNA, 22 nt, Human
cuguauaugugcauacacacac

SEQ ID NO: 219673 - RNA, 22 nt, Human
uuuaaauguuuaaaacucguga

SEQ ID NO: 219674 - RNA, 21 nt, Human
ggcccugguuacgccuccucu

SEQ ID NO: 219675 - RNA, 22 nt, Human
ucagcaggugccucagauucuu

SEQ ID NO: 219676 - RNA, 22 nt, Human
agccuguguugcucuggcgaua

SEQ ID NO: 219677 - RNA, 22 nt, Human
aggcugcuggaggauuuaugcc

SEQ ID NO: 219678 - RNA, 22 nt, Human
gugcugcucaagggacaggaca

SEQ ID NO: 219679 - RNA, 22 nt, Human
cugccuccugccgugcagcuuc

SEQ ID NO: 219680 - RNA, 22 nt, Human
caagcauacugugagaguuuua

SEQ ID NO: 219681 - RNA, 22 nt, Human
cucauuuauccaaaagccaguu

SEQ ID NO: 219682 - RNA, 22 nt, Human
ucuuuucuggacucugcaugga

SEQ ID NO: 219683 - RNA, 22 nt, Human
uagaaguucaugcgaauuauuu

SEQ ID NO: 219684 - RNA, 22 nt, Human
uucauacauuuuuacuaacagc

SEQ ID NO: 219685 - RNA, 22 nt, Human
uggccugggcaugaagcaucgu

SEQ ID NO: 219686 - RNA, 21 nt, Human
ugacauuuccaauauaaagcc

SEQ ID NO: 219687 - RNA, 22 nt, Human
aguuuuucugggaggcacugcu

SEQ ID NO: 219688 - RNA, 19 nt, Human
gaggaggaaaacuagugua

SEQ ID NO: 219689 - RNA, 23 nt, Human
ucagggcucacacguuuucuggc

SEQ ID NO: 219690 - RNA, 22 nt, Human
ccagugccugugggcauggugc

SEQ ID NO: 219691 - RNA, 22 nt, Human
caggccucuccuuagucuggca

SEQ ID NO: 219692 - RNA, 22 nt, Human
gcgguccaggagcgcagguccu

SEQ ID NO: 219693 - RNA, 22 nt, Human
ucagagaauucgauuaaaugca

SEQ ID NO: 219694 - RNA, 22 nt, Human
uugcaaaaucauuucucaggau

SEQ ID NO: 219695 - RNA, 22 nt, Human
gaggcuggugguuaguuccauu

SEQ ID NO: 219696 - RNA, 22 nt, Human
aggccugggucucgugccuacc

SEQ ID NO: 219697 - RNA, 22 nt, Human
uguucauuuggcccuuuuguau

SEQ ID NO: 219698 - RNA, 22 nt, Human
ucccucucuugggcguggcuca

SEQ ID NO: 219699 - RNA, 22 nt, Human
gauggaggaaaaguuggaaugc

SEQ ID NO: 219700 - RNA, 22 nt, Human
augugcuggcuaacuggauggg

SEQ ID NO: 219701 - RNA, 22 nt, Human
uacaguaaaugugguagaaacu

SEQ ID NO: 219702 - RNA, 22 nt, Human
uauuaagauacguaguuguaaa

SEQ ID NO: 219703 - RNA, 22 nt, Human
cccagagagcauuuggacaaag

SEQ ID NO: 219704 - RNA, 22 nt, Human
ucugagcuauguaagacuugga

SEQ ID NO: 219705 - RNA, 22 nt, Human
auuaaauuuucacuaggcuccc

SEQ ID NO: 219706 - RNA, 22 nt, Human
ucuuccagcaaugugaaaucac

SEQ ID NO: 219707 - RNA, 22 nt, Human
gcugugcauggagggccguuca

SEQ ID NO: 219708 - RNA, 22 nt, Human
caaagcagagccagagcuuguc

SEQ ID NO: 219709 - RNA, 22 nt, Human
ccuucccuaaagcgucgcuuag
